United States Patent 12,644,137 (MATERIALS AND METHODS FOR TREATMENT OF HEMOGLOBINOPATHIES) - sequence listing, part 10

SEQ ID NO: 201490 - DNA, 22 bp, Artificial Sequence
  Synthetic oligonucleotide; TTC chr2 60501819 60501840 60501836 60501841 +
ttaattacagcagtgtgctcat

SEQ ID NO: 201491 - DNA, 22 bp, Artificial Sequence
  Synthetic oligonucleotide; CTT chr2 60501821 60501842 60501838 60501843 +
aattacagcagtgtgctcatct

SEQ ID NO: 201492 - DNA, 22 bp, Artificial Sequence
  Synthetic oligonucleotide; TTA chr2 60501822 60501843 60501839 60501844 +
attacagcagtgtgctcatctc

SEQ ID NO: 201493 - DNA, 22 bp, Artificial Sequence
  Synthetic oligonucleotide; TTA chr2 60501826 60501847 60501843 60501848 +
cagcagtgtgctcatctcacat

SEQ ID NO: 201494 - DNA, 22 bp, Artificial Sequence
  Synthetic oligonucleotide; CTC chr2 60501839 60501860 60501856 60501861 +
atctcacataaaaatttaagac

SEQ ID NO: 201495 - DNA, 22 bp, Artificial Sequence
  Synthetic oligonucleotide; CTC chr2 60501844 60501865 60501861 60501866 +
acataaaaatttaagacgggaa

SEQ ID NO: 201496 - DNA, 22 bp, Artificial Sequence
  Synthetic oligonucleotide; TTT chr2 60501856 60501877 60501873 60501878 +
aagacgggaaaacaggaagatg

SEQ ID NO: 201497 - DNA, 22 bp, Artificial Sequence
  Synthetic oligonucleotide; TTA chr2 60501857 60501878 60501874 60501879 +
agacgggaaaacaggaagatgc

SEQ ID NO: 201498 - DNA, 22 bp, Artificial Sequence
  Synthetic oligonucleotide; TTC chr2 60501883 60501904 60501900 60501905 +
tgagaagttatatcagcccctc

SEQ ID NO: 201499 - DNA, 22 bp, Artificial Sequence
  Synthetic oligonucleotide; CTG chr2 60501885 60501906 60501902 60501907 +
agaagttatatcagcccctctg

SEQ ID NO: 201500 - DNA, 22 bp, Artificial Sequence
  Synthetic oligonucleotide; TTA chr2 60501893 60501914 60501910 60501915 +
tatcagcccctctgcctctcta

SEQ ID NO: 201501 - DNA, 22 bp, Artificial Sequence
  Synthetic oligonucleotide; CTC chr2 60501905 60501926 60501922 60501927 +
tgcctctctacattccaaaaca

SEQ ID NO: 201502 - DNA, 22 bp, Artificial Sequence
  Synthetic oligonucleotide; CTG chr2 60501907 60501928 60501924 60501929 +
cctctctacattccaaaacagc

SEQ ID NO: 201503 - DNA, 22 bp, Artificial Sequence
  Synthetic oligonucleotide; CTC chr2 60501911 60501932 60501928 60501933 +
tctacattccaaaacagccttt

SEQ ID NO: 201504 - DNA, 22 bp, Artificial Sequence
  Synthetic oligonucleotide; CTC chr2 60501913 60501934 60501930 60501935 +
tacattccaaaacagcctttta

SEQ ID NO: 201505 - DNA, 22 bp, Artificial Sequence
  Synthetic oligonucleotide; CTA chr2 60501915 60501936 60501932 60501937 +
cattccaaaacagccttttatt

SEQ ID NO: 201506 - DNA, 22 bp, Artificial Sequence
  Synthetic oligonucleotide; TTC chr2 60501920 60501941 60501937 60501942 +
caaaacagccttttattctaat

SEQ ID NO: 201507 - DNA, 22 bp, Artificial Sequence
  Synthetic oligonucleotide; CTT chr2 60501932 60501953 60501949 60501954 +
ttattctaattattttactagt

SEQ ID NO: 201508 - DNA, 22 bp, Artificial Sequence
  Synthetic oligonucleotide; TTT chr2 60501933 60501954 60501950 60501955 +
tattctaattattttactagtg

SEQ ID NO: 201509 - DNA, 22 bp, Artificial Sequence
  Synthetic oligonucleotide; TTT chr2 60501934 60501955 60501951 60501956 +
attctaattattttactagtga

SEQ ID NO: 201510 - DNA, 22 bp, Artificial Sequence
  Synthetic oligonucleotide; TTA chr2 60501935 60501956 60501952 60501957 +
ttctaattattttactagtgaa

SEQ ID NO: 201511 - DNA, 22 bp, Artificial Sequence
  Synthetic oligonucleotide; TTC chr2 60501938 60501959 60501955 60501960 +
taattattttactagtgaatta

SEQ ID NO: 201512 - DNA, 22 bp, Artificial Sequence
  Synthetic oligonucleotide; CTA chr2 60501940 60501961 60501957 60501962 +
attattttactagtgaattatg

SEQ ID NO: 201513 - DNA, 22 bp, Artificial Sequence
  Synthetic oligonucleotide; TTA chr2 60501944 60501965 60501961 60501966 +
ttttactagtgaattatggaat

SEQ ID NO: 201514 - DNA, 22 bp, Artificial Sequence
  Synthetic oligonucleotide; TTT chr2 60501947 60501968 60501964 60501969 +
tactagtgaattatggaataaa

SEQ ID NO: 201515 - DNA, 22 bp, Artificial Sequence
  Synthetic oligonucleotide; TTT chr2 60501948 60501969 60501965 60501970 +
actagtgaattatggaataaag

SEQ ID NO: 201516 - DNA, 22 bp, Artificial Sequence
  Synthetic oligonucleotide; TTA chr2 60501949 60501970 60501966 60501971 +
ctagtgaattatggaataaagt

SEQ ID NO: 201517 - DNA, 22 bp, Artificial Sequence
  Synthetic oligonucleotide; CTA chr2 60501952 60501973 60501969 60501974 +
gtgaattatggaataaagtagt

SEQ ID NO: 201518 - DNA, 22 bp, Artificial Sequence
  Synthetic oligonucleotide; TTA chr2 60501960 60501981 60501977 60501982 +
tggaataaagtagtattatgtt

SEQ ID NO: 201519 - DNA, 22 bp, Artificial Sequence
  Synthetic oligonucleotide; TTA chr2 60501978 60501999 60501995 60502000 +
tgtttctttctacacaacttgt

SEQ ID NO: 201520 - DNA, 22 bp, Artificial Sequence
  Synthetic oligonucleotide; TTT chr2 60501983 60502004 60502000 60502005 +
ctttctacacaacttgtgttgc

SEQ ID NO: 201521 - DNA, 22 bp, Artificial Sequence
  Synthetic oligonucleotide; TTC chr2 60501984 60502005 60502001 60502006 +
tttctacacaacttgtgttgca

SEQ ID NO: 201522 - DNA, 22 bp, Artificial Sequence
  Synthetic oligonucleotide; CTT chr2 60501986 60502007 60502003 60502008 +
tctacacaacttgtgttgcact

SEQ ID NO: 201523 - DNA, 22 bp, Artificial Sequence
  Synthetic oligonucleotide; TTT chr2 60501987 60502008 60502004 60502009 +
ctacacaacttgtgttgcacta

SEQ ID NO: 201524 - DNA, 22 bp, Artificial Sequence
  Synthetic oligonucleotide; TTC chr2 60501988 60502009 60502005 60502010 +
tacacaacttgtgttgcactag

SEQ ID NO: 201525 - DNA, 22 bp, Artificial Sequence
  Synthetic oligonucleotide; CTA chr2 60501990 60502011 60502007 60502012 +
cacaacttgtgttgcactaggt

SEQ ID NO: 201526 - DNA, 22 bp, Artificial Sequence
  Synthetic oligonucleotide; CTT chr2 60501998 60502019 60502015 60502020 +
gtgttgcactaggtgaaatctc

SEQ ID NO: 201527 - DNA, 22 bp, Artificial Sequence
  Synthetic oligonucleotide; TTG chr2 60501999 60502020 60502016 60502021 +
tgttgcactaggtgaaatctca

SEQ ID NO: 201528 - DNA, 22 bp, Artificial Sequence
  Synthetic oligonucleotide; TTG chr2 60502004 60502025 60502021 60502026 +
cactaggtgaaatctcaggcta

SEQ ID NO: 201529 - DNA, 22 bp, Artificial Sequence
  Synthetic oligonucleotide; CTA chr2 60502009 60502030 60502026 60502031 +
ggtgaaatctcaggctaacaga

SEQ ID NO: 201530 - DNA, 22 bp, Artificial Sequence
  Synthetic oligonucleotide; CTC chr2 60502020 60502041 60502037 60502042 +
aggctaacagagcttcagggag

SEQ ID NO: 201531 - DNA, 22 bp, Artificial Sequence
  Synthetic oligonucleotide; CTA chr2 60502026 60502047 60502043 60502048 +
acagagcttcagggaggaaagg

SEQ ID NO: 201532 - DNA, 22 bp, Artificial Sequence
  Synthetic oligonucleotide; CTT chr2 60502035 60502056 60502052 60502057 +
cagggaggaaaggccagaccaa

SEQ ID NO: 201533 - DNA, 22 bp, Artificial Sequence
  Synthetic oligonucleotide; TTC chr2 60502036 60502057 60502053 60502058 +
agggaggaaaggccagaccaaa

SEQ ID NO: 201534 - DNA, 22 bp, Artificial Sequence
  Synthetic oligonucleotide; CTC chr2 60502068 60502089 60502085 60502090 +
actccacagagaagctgtacca

SEQ ID NO: 201535 - DNA, 22 bp, Artificial Sequence
  Synthetic oligonucleotide; CTC chr2 60502072 60502093 60502089 60502094 +
cacagagaagctgtaccaccag

SEQ ID NO: 201536 - DNA, 22 bp, Artificial Sequence
  Synthetic oligonucleotide; CTG chr2 60502085 60502106 60502102 60502107 +
taccaccagaagtcctggaaaa

SEQ ID NO: 201537 - DNA, 22 bp, Artificial Sequence
  Synthetic oligonucleotide; CTG chr2 60502102 60502123 60502119 60502124 +
gaaaactgagaggtttgcatgt

SEQ ID NO: 201538 - DNA, 22 bp, Artificial Sequence
  Synthetic oligonucleotide; CTG chr2 60502110 60502131 60502127 60502132 +
agaggtttgcatgttgtaacaa

SEQ ID NO: 201539 - DNA, 22 bp, Artificial Sequence
  Synthetic oligonucleotide; TTT chr2 60502118 60502139 60502135 60502140 +
gcatgttgtaacaatgcaactc

SEQ ID NO: 201540 - DNA, 22 bp, Artificial Sequence
  Synthetic oligonucleotide; TTG chr2 60502119 60502140 60502136 60502141 +
catgttgtaacaatgcaactca

SEQ ID NO: 201541 - DNA, 22 bp, Artificial Sequence
  Synthetic oligonucleotide; TTG chr2 60502126 60502147 60502143 60502148 +
taacaatgcaactcaagactat

SEQ ID NO: 201542 - DNA, 22 bp, Artificial Sequence
  Synthetic oligonucleotide; CTC chr2 60502140 60502161 60502157 60502162 +
aagactatcagaatgatatgaa

SEQ ID NO: 201543 - DNA, 22 bp, Artificial Sequence
  Synthetic oligonucleotide; CTA chr2 60502147 60502168 60502164 60502169 +
tcagaatgatatgaatatttgt

SEQ ID NO: 201544 - DNA, 22 bp, Artificial Sequence
  Synthetic oligonucleotide; TTT chr2 60502167 60502188 60502184 60502189 +
gtatagatacttatcaaagcaa

SEQ ID NO: 201545 - DNA, 22 bp, Artificial Sequence
  Synthetic oligonucleotide; TTG chr2 60502168 60502189 60502185 60502190 +
tatagatacttatcaaagcaac

SEQ ID NO: 201546 - DNA, 22 bp, Artificial Sequence
  Synthetic oligonucleotide; CTT chr2 60502179 60502200 60502196 60502201 +
atcaaagcaacaatcagagatc

SEQ ID NO: 201547 - DNA, 22 bp, Artificial Sequence
  Synthetic oligonucleotide; TTA chr2 60502180 60502201 60502197 60502202 +
tcaaagcaacaatcagagatca

SEQ ID NO: 201548 - DNA, 22 bp, Artificial Sequence
  Synthetic oligonucleotide; CTC chr2 60502210 60502231 60502227 60502232 +
caaatgagcttacagtttatga

SEQ ID NO: 201549 - DNA, 22 bp, Artificial Sequence
  Synthetic oligonucleotide; CTT chr2 60502221 60502242 60502238 60502243 +
acagtttatgatcctgctttgt

SEQ ID NO: 201550 - DNA, 22 bp, Artificial Sequence
  Synthetic oligonucleotide; TTA chr2 60502222 60502243 60502239 60502244 +
cagtttatgatcctgctttgta

SEQ ID NO: 201551 - DNA, 22 bp, Artificial Sequence
  Synthetic oligonucleotide; TTT chr2 60502228 60502249 60502245 60502250 +
atgatcctgctttgtaaaagct

SEQ ID NO: 201552 - DNA, 22 bp, Artificial Sequence
  Synthetic oligonucleotide; TTA chr2 60502229 60502250 60502246 60502251 +
tgatcctgctttgtaaaagctg

SEQ ID NO: 201553 - DNA, 22 bp, Artificial Sequence
  Synthetic oligonucleotide; CTG chr2 60502237 60502258 60502254 60502259 +
ctttgtaaaagctggtgaaaca

SEQ ID NO: 201554 - DNA, 22 bp, Artificial Sequence
  Synthetic oligonucleotide; CTT chr2 60502240 60502261 60502257 60502262 +
tgtaaaagctggtgaaacaaaa

SEQ ID NO: 201555 - DNA, 22 bp, Artificial Sequence
  Synthetic oligonucleotide; TTT chr2 60502241 60502262 60502258 60502263 +
gtaaaagctggtgaaacaaaat

SEQ ID NO: 201556 - DNA, 22 bp, Artificial Sequence
  Synthetic oligonucleotide; TTG chr2 60502242 60502263 60502259 60502264 +
taaaagctggtgaaacaaaatg

SEQ ID NO: 201557 - DNA, 22 bp, Artificial Sequence
  Synthetic oligonucleotide; CTG chr2 60502251 60502272 60502268 60502273 +
gtgaaacaaaatgatggatagc

SEQ ID NO: 201558 - DNA, 22 bp, Artificial Sequence
  Synthetic oligonucleotide; TTT chr2 60502279 60502300 60502296 60502301 +
gctgagctccaaagtcagggag

SEQ ID NO: 201559 - DNA, 22 bp, Artificial Sequence
  Synthetic oligonucleotide; TTG chr2 60502280 60502301 60502297 60502302 +
ctgagctccaaagtcagggagt

SEQ ID NO: 201560 - DNA, 22 bp, Artificial Sequence
  Synthetic oligonucleotide; CTG chr2 60502283 60502304 60502300 60502305 +
agctccaaagtcagggagtagg

SEQ ID NO: 201561 - DNA, 22 bp, Artificial Sequence
  Synthetic oligonucleotide; CTC chr2 60502288 60502309 60502305 60502310 +
caaagtcagggagtaggtaaac

SEQ ID NO: 201562 - DNA, 22 bp, Artificial Sequence
  Synthetic oligonucleotide; CTC chr2 60502329 60502350 60502346 60502351 +
cctcctggctctcctctacatt

SEQ ID NO: 201563 - DNA, 22 bp, Artificial Sequence
  Synthetic oligonucleotide; CTC chr2 60502333 60502354 60502350 60502355 +
ctggctctcctctacattctgt

SEQ ID NO: 201564 - DNA, 22 bp, Artificial Sequence
  Synthetic oligonucleotide; CTG chr2 60502336 60502357 60502353 60502358 +
gctctcctctacattctgtgag

SEQ ID NO: 201565 - DNA, 22 bp, Artificial Sequence
  Synthetic oligonucleotide; CTC chr2 60502340 60502361 60502357 60502362 +
tcctctacattctgtgagcaaa

SEQ ID NO: 201566 - DNA, 22 bp, Artificial Sequence
  Synthetic oligonucleotide; CTC chr2 60502342 60502363 60502359 60502364 +
ctctacattctgtgagcaaacg

SEQ ID NO: 201567 - DNA, 22 bp, Artificial Sequence
  Synthetic oligonucleotide; CTC chr2 60502345 60502366 60502362 60502367 +
tacattctgtgagcaaacggaa

SEQ ID NO: 201568 - DNA, 22 bp, Artificial Sequence
  Synthetic oligonucleotide; CTA chr2 60502347 60502368 60502364 60502369 +
cattctgtgagcaaacggaaaa

SEQ ID NO: 201569 - DNA, 22 bp, Artificial Sequence
  Synthetic oligonucleotide; TTC chr2 60502352 60502373 60502369 60502374 +
tgtgagcaaacggaaaaataaa

SEQ ID NO: 201570 - DNA, 22 bp, Artificial Sequence
  Synthetic oligonucleotide; CTG chr2 60502354 60502375 60502371 60502376 +
tgagcaaacggaaaaataaacc

SEQ ID NO: 201571 - DNA, 22 bp, Artificial Sequence
  Synthetic oligonucleotide; CTC chr2 60502391 60502412 60502408 60502413 +
agcctaataaaactgcacagac

SEQ ID NO: 201572 - DNA, 22 bp, Artificial Sequence
  Synthetic oligonucleotide; CTA chr2 60502397 60502418 60502414 60502419 +
ataaaactgcacagacagaata

SEQ ID NO: 201573 - DNA, 22 bp, Artificial Sequence
  Synthetic oligonucleotide; CTG chr2 60502406 60502427 60502423 60502428 +
cacagacagaataacttcttca

SEQ ID NO: 201574 - DNA, 22 bp, Artificial Sequence
  Synthetic oligonucleotide; CTT chr2 60502423 60502444 60502440 60502445 +
cttcatcagattcagaagagta

SEQ ID NO: 201575 - DNA, 22 bp, Artificial Sequence
  Synthetic oligonucleotide; TTC chr2 60502424 60502445 60502441 60502446 +
ttcatcagattcagaagagtag

SEQ ID NO: 201576 - DNA, 22 bp, Artificial Sequence
  Synthetic oligonucleotide; CTT chr2 60502426 60502447 60502443 60502448 +
catcagattcagaagagtagca

SEQ ID NO: 201577 - DNA, 22 bp, Artificial Sequence
  Synthetic oligonucleotide; TTC chr2 60502427 60502448 60502444 60502449 +
atcagattcagaagagtagcag

SEQ ID NO: 201578 - DNA, 22 bp, Artificial Sequence
  Synthetic oligonucleotide; TTC chr2 60502436 60502457 60502453 60502458 +
agaagagtagcagggggtttct

SEQ ID NO: 201579 - DNA, 22 bp, Artificial Sequence
  Synthetic oligonucleotide; TTT chr2 60502456 60502477 60502473 60502478 +
ctcgctagcacagatttgagct

SEQ ID NO: 201580 - DNA, 22 bp, Artificial Sequence
  Synthetic oligonucleotide; TTC chr2 60502457 60502478 60502474 60502479 +
tcgctagcacagatttgagctc

SEQ ID NO: 201581 - DNA, 22 bp, Artificial Sequence
  Synthetic oligonucleotide; CTC chr2 60502459 60502480 60502476 60502481 +
gctagcacagatttgagctctg

SEQ ID NO: 201582 - DNA, 22 bp, Artificial Sequence
  Synthetic oligonucleotide; CTA chr2 60502463 60502484 60502480 60502485 +
gcacagatttgagctctgccat

SEQ ID NO: 201583 - DNA, 22 bp, Artificial Sequence
  Synthetic oligonucleotide; TTT chr2 60502473 60502494 60502490 60502495 +
gagctctgccatcacacacttt

SEQ ID NO: 201584 - DNA, 22 bp, Artificial Sequence
  Synthetic oligonucleotide; TTG chr2 60502474 60502495 60502491 60502496 +
agctctgccatcacacactttg

SEQ ID NO: 201585 - DNA, 22 bp, Artificial Sequence
  Synthetic oligonucleotide; CTC chr2 60502479 60502500 60502496 60502501 +
tgccatcacacactttgtacat

SEQ ID NO: 201586 - DNA, 22 bp, Artificial Sequence
  Synthetic oligonucleotide; CTG chr2 60502481 60502502 60502498 60502503 +
ccatcacacactttgtacatac

SEQ ID NO: 201587 - DNA, 22 bp, Artificial Sequence
  Synthetic oligonucleotide; CTT chr2 60502494 60502515 60502511 60502516 +
tgtacatacaattctgggatct

SEQ ID NO: 201588 - DNA, 22 bp, Artificial Sequence
  Synthetic oligonucleotide; TTT chr2 60502495 60502516 60502512 60502517 +
gtacatacaattctgggatctc

SEQ ID NO: 201589 - DNA, 22 bp, Artificial Sequence
  Synthetic oligonucleotide; TTG chr2 60502496 60502517 60502513 60502518 +
tacatacaattctgggatctca

SEQ ID NO: 201590 - DNA, 22 bp, Artificial Sequence
  Synthetic oligonucleotide; TTC chr2 60502508 60502529 60502525 60502530 +
tgggatctcaggtattgctcct

SEQ ID NO: 201591 - DNA, 22 bp, Artificial Sequence
  Synthetic oligonucleotide; CTG chr2 60502510 60502531 60502527 60502532 +
ggatctcaggtattgctcctaa

SEQ ID NO: 201592 - DNA, 22 bp, Artificial Sequence
  Synthetic oligonucleotide; CTC chr2 60502517 60502538 60502534 60502539 +
aggtattgctcctaaagaaaga

SEQ ID NO: 201593 - DNA, 22 bp, Artificial Sequence
  Synthetic oligonucleotide; TTG chr2 60502525 60502546 60502542 60502547 +
ctcctaaagaaagagccagctt

SEQ ID NO: 201594 - DNA, 22 bp, Artificial Sequence
  Synthetic oligonucleotide; CTC chr2 60502528 60502549 60502545 60502550 +
ctaaagaaagagccagcttcct

SEQ ID NO: 201595 - DNA, 22 bp, Artificial Sequence
  Synthetic oligonucleotide; CTA chr2 60502531 60502552 60502548 60502553 +
aagaaagagccagcttccttct

SEQ ID NO: 201596 - DNA, 22 bp, Artificial Sequence
  Synthetic oligonucleotide; CTT chr2 60502547 60502568 60502564 60502569 +
ccttctcttatcttcctccaac

SEQ ID NO: 201597 - DNA, 22 bp, Artificial Sequence
  Synthetic oligonucleotide; TTC chr2 60502548 60502569 60502565 60502570 +
cttctcttatcttcctccaaca

SEQ ID NO: 201598 - DNA, 22 bp, Artificial Sequence
  Synthetic oligonucleotide; CTT chr2 60502551 60502572 60502568 60502573 +
ctcttatcttcctccaacatcc

SEQ ID NO: 201599 - DNA, 22 bp, Artificial Sequence
  Synthetic oligonucleotide; TTC chr2 60502552 60502573 60502569 60502574 +
tcttatcttcctccaacatcca

SEQ ID NO: 201600 - DNA, 22 bp, Artificial Sequence
  Synthetic oligonucleotide; CTC chr2 60502554 60502575 60502571 60502576 +
ttatcttcctccaacatccaaa

SEQ ID NO: 201601 - DNA, 22 bp, Artificial Sequence
  Synthetic oligonucleotide; CTT chr2 60502556 60502577 60502573 60502578 +
atcttcctccaacatccaaaag

SEQ ID NO: 201602 - DNA, 22 bp, Artificial Sequence
  Synthetic oligonucleotide; TTA chr2 60502557 60502578 60502574 60502579 +
tcttcctccaacatccaaaagc

SEQ ID NO: 201603 - DNA, 22 bp, Artificial Sequence
  Synthetic oligonucleotide; CTT chr2 60502561 60502582 60502578 60502583 +
cctccaacatccaaaagcagtg

SEQ ID NO: 201604 - DNA, 22 bp, Artificial Sequence
  Synthetic oligonucleotide; TTC chr2 60502562 60502583 60502579 60502584 +
ctccaacatccaaaagcagtgt

SEQ ID NO: 201605 - DNA, 22 bp, Artificial Sequence
  Synthetic oligonucleotide; CTC chr2 60502565 60502586 60502582 60502587 +
caacatccaaaagcagtgttca

SEQ ID NO: 201606 - DNA, 22 bp, Artificial Sequence
  Synthetic oligonucleotide; TTC chr2 60502586 60502607 60502603 60502608 +
acacccaatcccatgctttcta

SEQ ID NO: 201607 - DNA, 22 bp, Artificial Sequence
  Synthetic oligonucleotide; CTT chr2 60502604 60502625 60502621 60502626 +
tctaatattaaaatatgaattt

SEQ ID NO: 201608 - DNA, 22 bp, Artificial Sequence
  Synthetic oligonucleotide; TTT chr2 60502605 60502626 60502622 60502627 +
ctaatattaaaatatgaattta

SEQ ID NO: 201609 - DNA, 22 bp, Artificial Sequence
  Synthetic oligonucleotide; TTC chr2 60502606 60502627 60502623 60502628 +
taatattaaaatatgaatttaa

SEQ ID NO: 201610 - DNA, 22 bp, Artificial Sequence
  Synthetic oligonucleotide; CTA chr2 60502608 60502629 60502625 60502630 +
atattaaaatatgaatttaaga

SEQ ID NO: 201611 - DNA, 22 bp, Artificial Sequence
  Synthetic oligonucleotide; TTA chr2 60502614 60502635 60502631 60502636 +
aaatatgaatttaagaaatacc

SEQ ID NO: 201612 - DNA, 22 bp, Artificial Sequence
  Synthetic oligonucleotide; TTT chr2 60502626 60502647 60502643 60502648 +
aagaaataccagtgaaaagaga

SEQ ID NO: 201613 - DNA, 22 bp, Artificial Sequence
  Synthetic oligonucleotide; TTA chr2 60502627 60502648 60502644 60502649 +
agaaataccagtgaaaagagat

SEQ ID NO: 201614 - DNA, 22 bp, Artificial Sequence
  Synthetic oligonucleotide; TTT chr2 60502651 60502672 60502668 60502673 +
tttaaaccagaaactctttgtg

SEQ ID NO: 201615 - DNA, 22 bp, Artificial Sequence
  Synthetic oligonucleotide; TTT chr2 60502652 60502673 60502669 60502674 +
ttaaaccagaaactctttgtgt

SEQ ID NO: 201616 - DNA, 22 bp, Artificial Sequence
  Synthetic oligonucleotide; TTT chr2 60502653 60502674 60502670 60502675 +
taaaccagaaactctttgtgtt

SEQ ID NO: 201617 - DNA, 22 bp, Artificial Sequence
  Synthetic oligonucleotide; TTT chr2 60502654 60502675 60502671 60502676 +
aaaccagaaactctttgtgttg

SEQ ID NO: 201618 - DNA, 22 bp, Artificial Sequence
  Synthetic oligonucleotide; TTA chr2 60502655 60502676 60502672 60502677 +
aaccagaaactctttgtgttgt

SEQ ID NO: 201619 - DNA, 22 bp, Artificial Sequence
  Synthetic oligonucleotide; CTC chr2 60502667 60502688 60502684 60502689 +
tttgtgttgtaatgttcttgat

SEQ ID NO: 201620 - DNA, 22 bp, Artificial Sequence
  Synthetic oligonucleotide; CTT chr2 60502669 60502690 60502686 60502691 +
tgtgttgtaatgttcttgatat

SEQ ID NO: 201621 - DNA, 22 bp, Artificial Sequence
  Synthetic oligonucleotide; TTT chr2 60502670 60502691 60502687 60502692 +
gtgttgtaatgttcttgatatg

SEQ ID NO: 201622 - DNA, 22 bp, Artificial Sequence
  Synthetic oligonucleotide; TTG chr2 60502671 60502692 60502688 60502693 +
tgttgtaatgttcttgatatgt

SEQ ID NO: 201623 - DNA, 22 bp, Artificial Sequence
  Synthetic oligonucleotide; TTG chr2 60502676 60502697 60502693 60502698 +
taatgttcttgatatgttaata

SEQ ID NO: 201624 - DNA, 22 bp, Artificial Sequence
  Synthetic oligonucleotide; TTC chr2 60502684 60502705 60502701 60502706 +
ttgatatgttaataaaactgtt

SEQ ID NO: 201625 - DNA, 22 bp, Artificial Sequence
  Synthetic oligonucleotide; CTT chr2 60502686 60502707 60502703 60502708 +
gatatgttaataaaactgtttt

SEQ ID NO: 201626 - DNA, 22 bp, Artificial Sequence
  Synthetic oligonucleotide; TTG chr2 60502687 60502708 60502704 60502709 +
atatgttaataaaactgttttc

SEQ ID NO: 201627 - DNA, 22 bp, Artificial Sequence
  Synthetic oligonucleotide; TTA chr2 60502695 60502716 60502712 60502717 +
ataaaactgttttcaatcatca

SEQ ID NO: 201628 - DNA, 22 bp, Artificial Sequence
  Synthetic oligonucleotide; CTG chr2 60502704 60502725 60502721 60502726 +
ttttcaatcatcatcagagaaa

SEQ ID NO: 201629 - DNA, 22 bp, Artificial Sequence
  Synthetic oligonucleotide; TTT chr2 60502707 60502728 60502724 60502729 +
tcaatcatcatcagagaaaaac

SEQ ID NO: 201630 - DNA, 22 bp, Artificial Sequence
  Synthetic oligonucleotide; TTT chr2 60502708 60502729 60502725 60502730 +
caatcatcatcagagaaaaaca

SEQ ID NO: 201631 - DNA, 22 bp, Artificial Sequence
  Synthetic oligonucleotide; TTC chr2 60502709 60502730 60502726 60502731 +
aatcatcatcagagaaaaacaa

SEQ ID NO: 201632 - DNA, 22 bp, Artificial Sequence
  Synthetic oligonucleotide; TTT chr2 60502735 60502756 60502752 60502757 +
acctctgatcatggtagcacag

SEQ ID NO: 201633 - DNA, 22 bp, Artificial Sequence
  Synthetic oligonucleotide; TTA chr2 60502736 60502757 60502753 60502758 +
cctctgatcatggtagcacagt

SEQ ID NO: 201634 - DNA, 22 bp, Artificial Sequence
  Synthetic oligonucleotide; CTC chr2 60502740 60502761 60502757 60502762 +
tgatcatggtagcacagtagag

SEQ ID NO: 201635 - DNA, 22 bp, Artificial Sequence
  Synthetic oligonucleotide; CTG chr2 60502742 60502763 60502759 60502764 +
atcatggtagcacagtagagca

SEQ ID NO: 201636 - DNA, 22 bp, Artificial Sequence
  Synthetic oligonucleotide; CTC chr2 60502776 60502797 60502793 60502798 +
aattggtgatcaaaagaaataa

SEQ ID NO: 201637 - DNA, 22 bp, Artificial Sequence
  Synthetic oligonucleotide; TTG chr2 60502781 60502802 60502798 60502803 +
gtgatcaaaagaaataaattct

SEQ ID NO: 201638 - DNA, 22 bp, Artificial Sequence
  Synthetic oligonucleotide; TTC chr2 60502802 60502823 60502819 60502824 +
tagtcctgtcacccagaaacta

SEQ ID NO: 201639 - DNA, 22 bp, Artificial Sequence
  Synthetic oligonucleotide; CTA chr2 60502804 60502825 60502821 60502826 +
gtcctgtcacccagaaactatg

SEQ ID NO: 201640 - DNA, 22 bp, Artificial Sequence
  Synthetic oligonucleotide; CTG chr2 60502810 60502831 60502827 60502832 +
tcacccagaaactatgtgacca

SEQ ID NO: 201641 - DNA, 22 bp, Artificial Sequence
  Synthetic oligonucleotide; CTA chr2 60502824 60502845 60502841 60502846 +
tgtgaccaggggaggtacttaa

SEQ ID NO: 201642 - DNA, 22 bp, Artificial Sequence
  Synthetic oligonucleotide; CTT chr2 60502844 60502865 60502861 60502866 +
aatctctaagagaatcaagtct

SEQ ID NO: 201643 - DNA, 22 bp, Artificial Sequence
  Synthetic oligonucleotide; TTA chr2 60502845 60502866 60502862 60502867 +
atctctaagagaatcaagtctc

SEQ ID NO: 201644 - DNA, 22 bp, Artificial Sequence
  Synthetic oligonucleotide; CTC chr2 60502850 60502871 60502867 60502872 +
taagagaatcaagtctcgagtg

SEQ ID NO: 201645 - DNA, 22 bp, Artificial Sequence
  Synthetic oligonucleotide; CTA chr2 60502852 60502873 60502869 60502874 +
agagaatcaagtctcgagtggg

SEQ ID NO: 201646 - DNA, 22 bp, Artificial Sequence
  Synthetic oligonucleotide; CTC chr2 60502867 60502888 60502884 60502889 +
gagtgggtaaaatgagctgggg

SEQ ID NO: 201647 - DNA, 22 bp, Artificial Sequence
  Synthetic oligonucleotide; CTG chr2 60502886 60502907 60502903 60502908 +
gggaaggagtgaaccagtgaga

SEQ ID NO: 201648 - DNA, 22 bp, Artificial Sequence
  Synthetic oligonucleotide; CTG chr2 60502918 60502939 60502935 60502940 +
gtctgtctggggctcccagaag

SEQ ID NO: 201649 - DNA, 22 bp, Artificial Sequence
  Synthetic oligonucleotide; CTG chr2 60502923 60502944 60502940 60502945 +
tctggggctcccagaagacaca

SEQ ID NO: 201650 - DNA, 22 bp, Artificial Sequence
  Synthetic oligonucleotide; CTG chr2 60502927 60502948 60502944 60502949 +
gggctcccagaagacacagcca

SEQ ID NO: 201651 - DNA, 22 bp, Artificial Sequence
  Synthetic oligonucleotide; CTC chr2 60502933 60502954 60502950 60502955 +
ccagaagacacagccagacttc

SEQ ID NO: 201652 - DNA, 22 bp, Artificial Sequence
  Synthetic oligonucleotide; CTT chr2 60502954 60502975 60502971 60502976 +
ctttcttgctcttgtccaaaca

SEQ ID NO: 201653 - DNA, 22 bp, Artificial Sequence
  Synthetic oligonucleotide; TTC chr2 60502955 60502976 60502972 60502977 +
tttcttgctcttgtccaaacac

SEQ ID NO: 201654 - DNA, 22 bp, Artificial Sequence
  Synthetic oligonucleotide; CTT chr2 60502957 60502978 60502974 60502979 +
tcttgctcttgtccaaacacct

SEQ ID NO: 201655 - DNA, 22 bp, Artificial Sequence
  Synthetic oligonucleotide; TTT chr2 60502958 60502979 60502975 60502980 +
cttgctcttgtccaaacacctc

SEQ ID NO: 201656 - DNA, 22 bp, Artificial Sequence
  Synthetic oligonucleotide; TTC chr2 60502959 60502980 60502976 60502981 +
ttgctcttgtccaaacacctcc

SEQ ID NO: 201657 - DNA, 22 bp, Artificial Sequence
  Synthetic oligonucleotide; CTT chr2 60502961 60502982 60502978 60502983 +
gctcttgtccaaacacctcctt

SEQ ID NO: 201658 - DNA, 22 bp, Artificial Sequence
  Synthetic oligonucleotide; TTG chr2 60502962 60502983 60502979 60502984 +
ctcttgtccaaacacctccttg

SEQ ID NO: 201659 - DNA, 22 bp, Artificial Sequence
  Synthetic oligonucleotide; CTC chr2 60502965 60502986 60502982 60502987 +
ttgtccaaacacctccttgtct

SEQ ID NO: 201660 - DNA, 22 bp, Artificial Sequence
  Synthetic oligonucleotide; CTT chr2 60502967 60502988 60502984 60502989 +
gtccaaacacctccttgtcttt

SEQ ID NO: 201661 - DNA, 22 bp, Artificial Sequence
  Synthetic oligonucleotide; TTG chr2 60502968 60502989 60502985 60502990 +
tccaaacacctccttgtctttt

SEQ ID NO: 201662 - DNA, 22 bp, Artificial Sequence
  Synthetic oligonucleotide; CTC chr2 60502980 60503001 60502997 60503002 +
cttgtcttttaaggcctgggct

SEQ ID NO: 201663 - DNA, 22 bp, Artificial Sequence
  Synthetic oligonucleotide; CTT chr2 60502983 60503004 60503000 60503005 +
gtcttttaaggcctgggctgtc

SEQ ID NO: 201664 - DNA, 22 bp, Artificial Sequence
  Synthetic oligonucleotide; TTG chr2 60502984 60503005 60503001 60503006 +
tcttttaaggcctgggctgtct

SEQ ID NO: 201665 - DNA, 22 bp, Artificial Sequence
  Synthetic oligonucleotide; CTT chr2 60502988 60503009 60503005 60503010 +
ttaaggcctgggctgtctaggg

SEQ ID NO: 201666 - DNA, 22 bp, Artificial Sequence
  Synthetic oligonucleotide; TTT chr2 60502989 60503010 60503006 60503011 +
taaggcctgggctgtctagggg

SEQ ID NO: 201667 - DNA, 22 bp, Artificial Sequence
  Synthetic oligonucleotide; TTT chr2 60502990 60503011 60503007 60503012 +
aaggcctgggctgtctaggggg

SEQ ID NO: 201668 - DNA, 22 bp, Artificial Sequence
  Synthetic oligonucleotide; TTA chr2 60502991 60503012 60503008 60503013 +
aggcctgggctgtctaggggga

SEQ ID NO: 201669 - DNA, 22 bp, Artificial Sequence
  Synthetic oligonucleotide; CTG chr2 60502998 60503019 60503015 60503020 +
ggctgtctagggggatggctac

SEQ ID NO: 201670 - DNA, 22 bp, Artificial Sequence
  Synthetic oligonucleotide; CTG chr2 60503003 60503024 60503020 60503025 +
tctagggggatggctactggct

SEQ ID NO: 201671 - DNA, 22 bp, Artificial Sequence
  Synthetic oligonucleotide; CTA chr2 60503007 60503028 60503024 60503029 +
gggggatggctactggcttgga

SEQ ID NO: 201672 - DNA, 22 bp, Artificial Sequence
  Synthetic oligonucleotide; CTA chr2 60503019 60503040 60503036 60503041 +
ctggcttggagcaaaaccaacg

SEQ ID NO: 201673 - DNA, 22 bp, Artificial Sequence
  Synthetic oligonucleotide; CTG chr2 60503022 60503043 60503039 60503044 +
gcttggagcaaaaccaacgtgt

SEQ ID NO: 201674 - DNA, 22 bp, Artificial Sequence
  Synthetic oligonucleotide; CTT chr2 60503026 60503047 60503043 60503048 +
ggagcaaaaccaacgtgtctgt

SEQ ID NO: 201675 - DNA, 22 bp, Artificial Sequence
  Synthetic oligonucleotide; TTG chr2 60503027 60503048 60503044 60503049 +
gagcaaaaccaacgtgtctgtc

SEQ ID NO: 201676 - DNA, 22 bp, Artificial Sequence
  Synthetic oligonucleotide; CTG chr2 60503047 60503068 60503064 60503069 +
tcatcttaatacacacggaatg

SEQ ID NO: 201677 - DNA, 22 bp, Artificial Sequence
  Synthetic oligonucleotide; CTT chr2 60503054 60503075 60503071 60503076 +
aatacacacggaatgtgttgaa

SEQ ID NO: 201678 - DNA, 22 bp, Artificial Sequence
  Synthetic oligonucleotide; TTA chr2 60503055 60503076 60503072 60503077 +
atacacacggaatgtgttgaaa

SEQ ID NO: 201679 - DNA, 22 bp, Artificial Sequence
  Synthetic oligonucleotide; TTG chr2 60503074 60503095 60503091 60503096 +
aaatgaaggtgtctgtgtggaa

SEQ ID NO: 201680 - DNA, 22 bp, Artificial Sequence
  Synthetic oligonucleotide; CTG chr2 60503089 60503110 60503106 60503111 +
tgtggaagggacagacccagat

SEQ ID NO: 201681 - DNA, 22 bp, Artificial Sequence
  Synthetic oligonucleotide; CTC chr2 60503117 60503138 60503134 60503139 +
tgcatttgtcctggcaatggga

SEQ ID NO: 201682 - DNA, 22 bp, Artificial Sequence
  Synthetic oligonucleotide; CTG chr2 60503119 60503140 60503136 60503141 +
catttgtcctggcaatgggagc

SEQ ID NO: 201683 - DNA, 22 bp, Artificial Sequence
  Synthetic oligonucleotide; TTT chr2 60503124 60503145 60503141 60503146 +
gtcctggcaatgggagcaggaa

SEQ ID NO: 201684 - DNA, 22 bp, Artificial Sequence
  Synthetic oligonucleotide; TTG chr2 60503125 60503146 60503142 60503147 +
tcctggcaatgggagcaggaat

SEQ ID NO: 201685 - DNA, 22 bp, Artificial Sequence
  Synthetic oligonucleotide; CTG chr2 60503130 60503151 60503147 60503152 +
gcaatgggagcaggaatgagtc

SEQ ID NO: 201686 - DNA, 22 bp, Artificial Sequence
  Synthetic oligonucleotide; CTT chr2 60503158 60503179 60503175 60503180 +
ctctaaacctggtcactcctag

SEQ ID NO: 201687 - DNA, 22 bp, Artificial Sequence
  Synthetic oligonucleotide; TTC chr2 60503159 60503180 60503176 60503181 +
tctaaacctggtcactcctagt

SEQ ID NO: 201688 - DNA, 22 bp, Artificial Sequence
  Synthetic oligonucleotide; CTC chr2 60503161 60503182 60503178 60503183 +
taaacctggtcactcctagtcc

SEQ ID NO: 201689 - DNA, 22 bp, Artificial Sequence
  Synthetic oligonucleotide; CTA chr2 60503163 60503184 60503180 60503185 +
aacctggtcactcctagtccca

SEQ ID NO: 201690 - DNA, 22 bp, Artificial Sequence
  Synthetic oligonucleotide; CTG chr2 60503169 60503190 60503186 60503191 +
gtcactcctagtcccaagatgg

SEQ ID NO: 201691 - DNA, 22 bp, Artificial Sequence
  Synthetic oligonucleotide; CTC chr2 60503176 60503197 60503193 60503198 +
ctagtcccaagatggagaagcc

SEQ ID NO: 201692 - DNA, 22 bp, Artificial Sequence
  Synthetic oligonucleotide; CTA chr2 60503179 60503200 60503196 60503201 +
gtcccaagatggagaagccaca

SEQ ID NO: 201693 - DNA, 22 bp, Artificial Sequence
  Synthetic oligonucleotide; CTT chr2 60503209 60503230 60503226 60503231 +
gatcatgttagccccattctgc

SEQ ID NO: 201694 - DNA, 22 bp, Artificial Sequence
  Synthetic oligonucleotide; TTG chr2 60503210 60503231 60503227 60503232 +
atcatgttagccccattctgca

SEQ ID NO: 201695 - DNA, 22 bp, Artificial Sequence
  Synthetic oligonucleotide; TTA chr2 60503219 60503240 60503236 60503241 +
gccccattctgcagcctcagga

SEQ ID NO: 201696 - DNA, 22 bp, Artificial Sequence
  Synthetic oligonucleotide; TTC chr2 60503228 60503249 60503245 60503250 +
tgcagcctcaggaggctctgac

SEQ ID NO: 201697 - DNA, 22 bp, Artificial Sequence
  Synthetic oligonucleotide; CTG chr2 60503230 60503251 60503247 60503252 +
cagcctcaggaggctctgacca

SEQ ID NO: 201698 - DNA, 22 bp, Artificial Sequence
  Synthetic oligonucleotide; CTC chr2 60503237 60503258 60503254 60503259 +
aggaggctctgaccaggtggaa

SEQ ID NO: 201699 - DNA, 22 bp, Artificial Sequence
  Synthetic oligonucleotide; CTC chr2 60503246 60503267 60503263 60503268 +
tgaccaggtggaaagccagaat

SEQ ID NO: 201700 - DNA, 22 bp, Artificial Sequence
  Synthetic oligonucleotide; CTG chr2 60503248 60503269 60503265 60503270 +
accaggtggaaagccagaatgg

SEQ ID NO: 201701 - DNA, 22 bp, Artificial Sequence
  Synthetic oligonucleotide; CTG chr2 60503311 60503332 60503328 60503333 +
caaggagcctcacttctccagg

SEQ ID NO: 201702 - DNA, 22 bp, Artificial Sequence
  Synthetic oligonucleotide; CTC chr2 60503322 60503343 60503339 60503344 +
acttctccaggcattgtgactt

SEQ ID NO: 201703 - DNA, 22 bp, Artificial Sequence
  Synthetic oligonucleotide; CTT chr2 60503326 60503347 60503343 60503348 +
ctccaggcattgtgacttttta

SEQ ID NO: 201704 - DNA, 22 bp, Artificial Sequence
  Synthetic oligonucleotide; TTC chr2 60503327 60503348 60503344 60503349 +
tccaggcattgtgactttttat

SEQ ID NO: 201705 - DNA, 22 bp, Artificial Sequence
  Synthetic oligonucleotide; CTC chr2 60503329 60503350 60503346 60503351 +
caggcattgtgactttttatta

SEQ ID NO: 201706 - DNA, 22 bp, Artificial Sequence
  Synthetic oligonucleotide; TTG chr2 60503338 60503359 60503355 60503360 +
tgactttttattaaaaaccctt

SEQ ID NO: 201707 - DNA, 22 bp, Artificial Sequence
  Synthetic oligonucleotide; CTT chr2 60503344 60503365 60503361 60503366 +
tttattaaaaacccttacccat

SEQ ID NO: 201708 - DNA, 22 bp, Artificial Sequence
  Synthetic oligonucleotide; TTT chr2 60503345 60503366 60503362 60503367 +
ttattaaaaacccttacccatg

SEQ ID NO: 201709 - DNA, 22 bp, Artificial Sequence
  Synthetic oligonucleotide; TTT chr2 60503346 60503367 60503363 60503368 +
tattaaaaacccttacccatgc

SEQ ID NO: 201710 - DNA, 22 bp, Artificial Sequence
  Synthetic oligonucleotide; TTT chr2 60503347 60503368 60503364 60503369 +
attaaaaacccttacccatgcc

SEQ ID NO: 201711 - DNA, 22 bp, Artificial Sequence
  Synthetic oligonucleotide; TTA chr2 60503348 60503369 60503365 60503370 +
ttaaaaacccttacccatgcca

SEQ ID NO: 201712 - DNA, 22 bp, Artificial Sequence
  Synthetic oligonucleotide; TTA chr2 60503351 60503372 60503368 60503373 +
aaaacccttacccatgccaccc

SEQ ID NO: 201713 - DNA, 22 bp, Artificial Sequence
  Synthetic oligonucleotide; CTT chr2 60503360 60503381 60503377 60503382 +
acccatgccacccaccgcagcc

SEQ ID NO: 201714 - DNA, 22 bp, Artificial Sequence
  Synthetic oligonucleotide; TTA chr2 60503361 60503382 60503378 60503383 +
cccatgccacccaccgcagcct

SEQ ID NO: 201715 - DNA, 22 bp, Artificial Sequence
  Synthetic oligonucleotide; CTG chr2 60503384 60503405 60503401 60503406 +
gacaggcattccaggagccaga

SEQ ID NO: 201716 - DNA, 22 bp, Artificial Sequence
  Synthetic oligonucleotide; TTC chr2 60503395 60503416 60503412 60503417 +
caggagccagacatgtccctgg

SEQ ID NO: 201717 - DNA, 22 bp, Artificial Sequence
  Synthetic oligonucleotide; CTG chr2 60503416 60503437 60503433 60503438 +
gaagacagtaggctattgcttc

SEQ ID NO: 201718 - DNA, 22 bp, Artificial Sequence
  Synthetic oligonucleotide; CTA chr2 60503431 60503452 60503448 60503453 +
ttgcttcctctgagcactgcaa

SEQ ID NO: 201719 - DNA, 22 bp, Artificial Sequence
  Synthetic oligonucleotide; TTG chr2 60503434 60503455 60503451 60503456 +
cttcctctgagcactgcaacaa

SEQ ID NO: 201720 - DNA, 22 bp, Artificial Sequence
  Synthetic oligonucleotide; CTT chr2 60503437 60503458 60503454 60503459 +
cctctgagcactgcaacaattt

SEQ ID NO: 201721 - DNA, 22 bp, Artificial Sequence
  Synthetic oligonucleotide; TTC chr2 60503438 60503459 60503455 60503460 +
ctctgagcactgcaacaatttt

SEQ ID NO: 201722 - DNA, 22 bp, Artificial Sequence
  Synthetic oligonucleotide; CTC chr2 60503441 60503462 60503458 60503463 +
tgagcactgcaacaattttctc

SEQ ID NO: 201723 - DNA, 22 bp, Artificial Sequence
  Synthetic oligonucleotide; CTG chr2 60503443 60503464 60503460 60503465 +
agcactgcaacaattttctctg

SEQ ID NO: 201724 - DNA, 22 bp, Artificial Sequence
  Synthetic oligonucleotide; CTG chr2 60503450 60503471 60503467 60503472 +
caacaattttctctggaccctc

SEQ ID NO: 201725 - DNA, 22 bp, Artificial Sequence
  Synthetic oligonucleotide; TTT chr2 60503459 60503480 60503476 60503481 +
tctctggaccctctcctccacc

SEQ ID NO: 201726 - DNA, 22 bp, Artificial Sequence
  Synthetic oligonucleotide; TTT chr2 60503460 60503481 60503477 60503482 +
ctctggaccctctcctccacct

SEQ ID NO: 201727 - DNA, 22 bp, Artificial Sequence
  Synthetic oligonucleotide; TTC chr2 60503461 60503482 60503478 60503483 +
tctggaccctctcctccaccta

SEQ ID NO: 201728 - DNA, 22 bp, Artificial Sequence
  Synthetic oligonucleotide; CTC chr2 60503463 60503484 60503480 60503485 +
tggaccctctcctccacctatt

SEQ ID NO: 201729 - DNA, 22 bp, Artificial Sequence
  Synthetic oligonucleotide; CTG chr2 60503465 60503486 60503482 60503487 +
gaccctctcctccacctattca

SEQ ID NO: 201730 - DNA, 22 bp, Artificial Sequence
  Synthetic oligonucleotide; CTC chr2 60503472 60503493 60503489 60503494 +
tcctccacctattcacagatgg

SEQ ID NO: 201731 - DNA, 22 bp, Artificial Sequence
  Synthetic oligonucleotide; CTC chr2 60503474 60503495 60503491 60503496 +
ctccacctattcacagatgggg

SEQ ID NO: 201732 - DNA, 22 bp, Artificial Sequence
  Synthetic oligonucleotide; CTC chr2 60503477 60503498 60503494 60503499 +
cacctattcacagatggggcat

SEQ ID NO: 201733 - DNA, 22 bp, Artificial Sequence
  Synthetic oligonucleotide; CTA chr2 60503483 60503504 60503500 60503505 +
ttcacagatggggcataaccct

SEQ ID NO: 201734 - DNA, 22 bp, Artificial Sequence
  Synthetic oligonucleotide; TTC chr2 60503486 60503507 60503503 60503508 +
acagatggggcataaccctccc

SEQ ID NO: 201735 - DNA, 22 bp, Artificial Sequence
  Synthetic oligonucleotide; CTC chr2 60503506 60503527 60503523 60503528 +
cctcctatccattagattgccc

SEQ ID NO: 201736 - DNA, 22 bp, Artificial Sequence
  Synthetic oligonucleotide; CTC chr2 60503510 60503531 60503527 60503532 +
ctatccattagattgcccaaat

SEQ ID NO: 201737 - DNA, 22 bp, Artificial Sequence
  Synthetic oligonucleotide; CTA chr2 60503513 60503534 60503530 60503535 +
tccattagattgcccaaatctg

SEQ ID NO: 201738 - DNA, 22 bp, Artificial Sequence
  Synthetic oligonucleotide; TTA chr2 60503520 60503541 60503537 60503542 +
gattgcccaaatctgggaaaat

SEQ ID NO: 201739 - DNA, 22 bp, Artificial Sequence
  Synthetic oligonucleotide; TTG chr2 60503525 60503546 60503542 60503547 +
cccaaatctgggaaaataatgt

SEQ ID NO: 201740 - DNA, 22 bp, Artificial Sequence
  Synthetic oligonucleotide; CTG chr2 60503535 60503556 60503552 60503557 +
ggaaaataatgtgtggcgctca

SEQ ID NO: 201741 - DNA, 22 bp, Artificial Sequence
  Synthetic oligonucleotide; CTC chr2 60503556 60503577 60503573 60503578 +
aggtctgagtgcagaccaagct

SEQ ID NO: 201742 - DNA, 22 bp, Artificial Sequence
  Synthetic oligonucleotide; CTG chr2 60503563 60503584 60503580 60503585 +
agtgcagaccaagctcccaata

SEQ ID NO: 201743 - DNA, 22 bp, Artificial Sequence
  Synthetic oligonucleotide; CTC chr2 60503579 60503600 60503596 60503601 +
ccaataccagtggctctttcag

SEQ ID NO: 201744 - DNA, 22 bp, Artificial Sequence
  Synthetic oligonucleotide; CTC chr2 60503595 60503616 60503612 60503617 +
tttcaggcttacaaagccttgg

SEQ ID NO: 201745 - DNA, 22 bp, Artificial Sequence
  Synthetic oligonucleotide; CTT chr2 60503597 60503618 60503614 60503619 +
tcaggcttacaaagccttggtg

SEQ ID NO: 201746 - DNA, 22 bp, Artificial Sequence
  Synthetic oligonucleotide; TTT chr2 60503598 60503619 60503615 60503620 +
caggcttacaaagccttggtgg

SEQ ID NO: 201747 - DNA, 22 bp, Artificial Sequence
  Synthetic oligonucleotide; TTC chr2 60503599 60503620 60503616 60503621 +
aggcttacaaagccttggtggt

SEQ ID NO: 201748 - DNA, 22 bp, Artificial Sequence
  Synthetic oligonucleotide; CTT chr2 60503605 60503626 60503622 60503627 +
acaaagccttggtggtttccac

SEQ ID NO: 201749 - DNA, 22 bp, Artificial Sequence
  Synthetic oligonucleotide; TTA chr2 60503606 60503627 60503623 60503628 +
caaagccttggtggtttccaca

SEQ ID NO: 201750 - DNA, 22 bp, Artificial Sequence
  Synthetic oligonucleotide; CTT chr2 60503615 60503636 60503632 60503637 +
ggtggtttccacacccagcagt

SEQ ID NO: 201751 - DNA, 22 bp, Artificial Sequence
  Synthetic oligonucleotide; TTG chr2 60503616 60503637 60503633 60503638 +
gtggtttccacacccagcagtt

SEQ ID NO: 201752 - DNA, 22 bp, Artificial Sequence
  Synthetic oligonucleotide; TTT chr2 60503623 60503644 60503640 60503645 +
ccacacccagcagttcctaccc

SEQ ID NO: 201753 - DNA, 22 bp, Artificial Sequence
  Synthetic oligonucleotide; TTC chr2 60503624 60503645 60503641 60503646 +
cacacccagcagttcctaccca

SEQ ID NO: 201754 - DNA, 22 bp, Artificial Sequence
  Synthetic oligonucleotide; TTC chr2 60503639 60503660 60503656 60503661 +
ctacccaggactgagaagccct

SEQ ID NO: 201755 - DNA, 22 bp, Artificial Sequence
  Synthetic oligonucleotide; CTA chr2 60503642 60503663 60503659 60503664 +
cccaggactgagaagccctcag

SEQ ID NO: 201756 - DNA, 22 bp, Artificial Sequence
  Synthetic oligonucleotide; CTG chr2 60503652 60503673 60503669 60503674 +
agaagccctcagcaaacaccca

SEQ ID NO: 201757 - DNA, 22 bp, Artificial Sequence
  Synthetic oligonucleotide; CTC chr2 60503662 60503683 60503679 60503684 +
agcaaacacccagatggccctt

SEQ ID NO: 201758 - DNA, 22 bp, Artificial Sequence
  Synthetic oligonucleotide; CTT chr2 60503684 60503705 60503701 60503706 +
gttcaccctcctggaaacctat

SEQ ID NO: 201759 - DNA, 22 bp, Artificial Sequence
  Synthetic oligonucleotide; TTG chr2 60503685 60503706 60503702 60503707 +
ttcaccctcctggaaacctata

SEQ ID NO: 201760 - DNA, 22 bp, Artificial Sequence
  Synthetic oligonucleotide; TTC chr2 60503688 60503709 60503705 60503710 +
accctcctggaaacctatagct

SEQ ID NO: 201761 - DNA, 22 bp, Artificial Sequence
  Synthetic oligonucleotide; CTC chr2 60503694 60503715 60503711 60503716 +
ctggaaacctatagctgccagg

SEQ ID NO: 201762 - DNA, 22 bp, Artificial Sequence
  Synthetic oligonucleotide; CTG chr2 60503697 60503718 60503714 60503719 +
gaaacctatagctgccagggaa

SEQ ID NO: 201763 - DNA, 22 bp, Artificial Sequence
  Synthetic oligonucleotide; CTA chr2 60503705 60503726 60503722 60503727 +
tagctgccagggaaatgtgaca

SEQ ID NO: 201764 - DNA, 22 bp, Artificial Sequence
  Synthetic oligonucleotide; CTG chr2 60503711 60503732 60503728 60503733 +
ccagggaaatgtgacattttgt

SEQ ID NO: 201765 - DNA, 22 bp, Artificial Sequence
  Synthetic oligonucleotide; TTT chr2 60503730 60503751 60503747 60503752 +
tgtgaggactaatttaacccgc

SEQ ID NO: 201766 - DNA, 22 bp, Artificial Sequence
  Synthetic oligonucleotide; TTT chr2 60503731 60503752 60503748 60503753 +
gtgaggactaatttaacccgcc

SEQ ID NO: 201767 - DNA, 22 bp, Artificial Sequence
  Synthetic oligonucleotide; TTG chr2 60503732 60503753 60503749 60503754 +
tgaggactaatttaacccgcct

SEQ ID NO: 201768 - DNA, 22 bp, Artificial Sequence
  Synthetic oligonucleotide; CTA chr2 60503741 60503762 60503758 60503763 +
atttaacccgcctagaagattt

SEQ ID NO: 201769 - DNA, 22 bp, Artificial Sequence
  Synthetic oligonucleotide; TTT chr2 60503745 60503766 60503762 60503767 +
aacccgcctagaagatttagga

SEQ ID NO: 201770 - DNA, 22 bp, Artificial Sequence
  Synthetic oligonucleotide; TTA chr2 60503746 60503767 60503763 60503768 +
acccgcctagaagatttaggag

SEQ ID NO: 201771 - DNA, 22 bp, Artificial Sequence
  Synthetic oligonucleotide; CTA chr2 60503755 60503776 60503772 60503777 +
gaagatttaggagccaagatgc

SEQ ID NO: 201772 - DNA, 22 bp, Artificial Sequence
  Synthetic oligonucleotide; TTT chr2 60503763 60503784 60503780 60503785 +
aggagccaagatgcaaccctaa

SEQ ID NO: 201773 - DNA, 22 bp, Artificial Sequence
  Synthetic oligonucleotide; TTA chr2 60503764 60503785 60503781 60503786 +
ggagccaagatgcaaccctaaa

SEQ ID NO: 201774 - DNA, 22 bp, Artificial Sequence
  Synthetic oligonucleotide; CTA chr2 60503784 60503805 60503801 60503806 +
aagcccactgcaagggacaata

SEQ ID NO: 201775 - DNA, 22 bp, Artificial Sequence
  Synthetic oligonucleotide; CTG chr2 60503794 60503815 60503811 60503816 +
caagggacaatattctggatct

SEQ ID NO: 201776 - DNA, 22 bp, Artificial Sequence
  Synthetic oligonucleotide; TTC chr2 60503809 60503830 60503826 60503831 +
tggatcttttgtcagagcttta

SEQ ID NO: 201777 - DNA, 22 bp, Artificial Sequence
  Synthetic oligonucleotide; CTG chr2 60503811 60503832 60503828 60503833 +
gatcttttgtcagagctttatt

SEQ ID NO: 201778 - DNA, 22 bp, Artificial Sequence
  Synthetic oligonucleotide; CTT chr2 60503817 60503838 60503834 60503839 +
ttgtcagagctttattatttta

SEQ ID NO: 201779 - DNA, 22 bp, Artificial Sequence
  Synthetic oligonucleotide; TTT chr2 60503818 60503839 60503835 60503840 +
tgtcagagctttattattttaa

SEQ ID NO: 201780 - DNA, 22 bp, Artificial Sequence
  Synthetic oligonucleotide; TTT chr2 60503819 60503840 60503836 60503841 +
gtcagagctttattattttaat

SEQ ID NO: 201781 - DNA, 22 bp, Artificial Sequence
  Synthetic oligonucleotide; TTG chr2 60503820 60503841 60503837 60503842 +
tcagagctttattattttaata

SEQ ID NO: 201782 - DNA, 22 bp, Artificial Sequence
  Synthetic oligonucleotide; CTT chr2 60503829 60503850 60503846 60503851 +
tattattttaataaaattttta

SEQ ID NO: 201783 - DNA, 22 bp, Artificial Sequence
  Synthetic oligonucleotide; TTT chr2 60503830 60503851 60503847 60503852 +
attattttaataaaatttttat

SEQ ID NO: 201784 - DNA, 22 bp, Artificial Sequence
  Synthetic oligonucleotide; TTA chr2 60503831 60503852 60503848 60503853 +
ttattttaataaaatttttata

SEQ ID NO: 201785 - DNA, 22 bp, Artificial Sequence
  Synthetic oligonucleotide; TTA chr2 60503834 60503855 60503851 60503856 +
ttttaataaaatttttatatta

SEQ ID NO: 201786 - DNA, 22 bp, Artificial Sequence
  Synthetic oligonucleotide; TTT chr2 60503837 60503858 60503854 60503859 +
taataaaatttttatattaaac

SEQ ID NO: 201787 - DNA, 22 bp, Artificial Sequence
  Synthetic oligonucleotide; TTT chr2 60503838 60503859 60503855 60503860 +
aataaaatttttatattaaaca

SEQ ID NO: 201788 - DNA, 22 bp, Artificial Sequence
  Synthetic oligonucleotide; TTA chr2 60503839 60503860 60503856 60503861 +
ataaaatttttatattaaacag

SEQ ID NO: 201789 - DNA, 22 bp, Artificial Sequence
  Synthetic oligonucleotide; TTT chr2 60503848 60503869 60503865 60503870 +
ttatattaaacagcaattcaca

SEQ ID NO: 201790 - DNA, 22 bp, Artificial Sequence
  Synthetic oligonucleotide; TTT chr2 60503849 60503870 60503866 60503871 +
tatattaaacagcaattcacat

SEQ ID NO: 201791 - DNA, 22 bp, Artificial Sequence
  Synthetic oligonucleotide; TTT chr2 60503850 60503871 60503867 60503872 +
atattaaacagcaattcacatt

SEQ ID NO: 201792 - DNA, 22 bp, Artificial Sequence
  Synthetic oligonucleotide; TTA chr2 60503851 60503872 60503868 60503873 +
tattaaacagcaattcacattc

SEQ ID NO: 201793 - DNA, 22 bp, Artificial Sequence
  Synthetic oligonucleotide; TTA chr2 60503856 60503877 60503873 60503878 +
aacagcaattcacattcatcta

SEQ ID NO: 201794 - DNA, 22 bp, Artificial Sequence
  Synthetic oligonucleotide; TTC chr2 60503867 60503888 60503884 60503889 +
acattcatctaaacctcctgaa

SEQ ID NO: 201795 - DNA, 22 bp, Artificial Sequence
  Synthetic oligonucleotide; TTC chr2 60503873 60503894 60503890 60503895 +
atctaaacctcctgaaaattgg

SEQ ID NO: 201796 - DNA, 22 bp, Artificial Sequence
  Synthetic oligonucleotide; CTA chr2 60503878 60503899 60503895 60503900 +
aacctcctgaaaattggttatt

SEQ ID NO: 201797 - DNA, 22 bp, Artificial Sequence
  Synthetic oligonucleotide; CTC chr2 60503884 60503905 60503901 60503906 +
ctgaaaattggttattggctgc

SEQ ID NO: 201798 - DNA, 22 bp, Artificial Sequence
  Synthetic oligonucleotide; CTG chr2 60503887 60503908 60503904 60503909 +
aaaattggttattggctgcttc

SEQ ID NO: 201799 - DNA, 22 bp, Artificial Sequence
  Synthetic oligonucleotide; TTG chr2 60503894 60503915 60503911 60503916 +
gttattggctgcttcgttgatt

SEQ ID NO: 201800 - DNA, 22 bp, Artificial Sequence
  Synthetic oligonucleotide; TTA chr2 60503898 60503919 60503915 60503920 +
ttggctgcttcgttgattctag

SEQ ID NO: 201801 - DNA, 22 bp, Artificial Sequence
  Synthetic oligonucleotide; TTG chr2 60503901 60503922 60503918 60503923 +
gctgcttcgttgattctagaaa

SEQ ID NO: 201802 - DNA, 22 bp, Artificial Sequence
  Synthetic oligonucleotide; CTG chr2 60503905 60503926 60503922 60503927 +
cttcgttgattctagaaaaaaa

SEQ ID NO: 201803 - DNA, 22 bp, Artificial Sequence
  Synthetic oligonucleotide; CTT chr2 60503908 60503929 60503925 60503930 +
cgttgattctagaaaaaaaaga

SEQ ID NO: 201804 - DNA, 22 bp, Artificial Sequence
  Synthetic oligonucleotide; TTC chr2 60503909 60503930 60503926 60503931 +
gttgattctagaaaaaaaagaa

SEQ ID NO: 201805 - DNA, 22 bp, Artificial Sequence
  Synthetic oligonucleotide; TTG chr2 60503913 60503934 60503930 60503935 +
attctagaaaaaaaagaaagca

SEQ ID NO: 201806 - DNA, 22 bp, Artificial Sequence
  Synthetic oligonucleotide; TTC chr2 60503917 60503938 60503934 60503939 +
tagaaaaaaaagaaagcaagaa

SEQ ID NO: 201807 - DNA, 22 bp, Artificial Sequence
  Synthetic oligonucleotide; CTA chr2 60503919 60503940 60503936 60503941 +
gaaaaaaaagaaagcaagaaat

SEQ ID NO: 201808 - DNA, 22 bp, Artificial Sequence
  Synthetic oligonucleotide; CTG chr2 60503984 60504005 60504001 60504006 +
agtattaaggcccaacccagcc

SEQ ID NO: 201809 - DNA, 22 bp, Artificial Sequence
  Synthetic oligonucleotide; TTA chr2 60503991 60504012 60504008 60504013 +
aggcccaacccagccaaaaccc

SEQ ID NO: 201810 - DNA, 22 bp, Artificial Sequence
  Synthetic oligonucleotide; CTG chr2 60504019 60504040 60504036 60504041 +
ctagaagcctgctggaagccta

SEQ ID NO: 201811 - DNA, 22 bp, Artificial Sequence
  Synthetic oligonucleotide; CTA chr2 60504022 60504043 60504039 60504044 +
gaagcctgctggaagcctacat

SEQ ID NO: 201812 - DNA, 22 bp, Artificial Sequence
  Synthetic oligonucleotide; CTG chr2 60504030 60504051 60504047 60504052 +
ctggaagcctacatggcttcga

SEQ ID NO: 201813 - DNA, 22 bp, Artificial Sequence
  Synthetic oligonucleotide; CTG chr2 60504033 60504054 60504050 60504055 +
gaagcctacatggcttcgagcg

SEQ ID NO: 201814 - DNA, 22 bp, Artificial Sequence
  Synthetic oligonucleotide; CTA chr2 60504041 60504062 60504058 60504063 +
catggcttcgagcggcacattc

SEQ ID NO: 201815 - DNA, 22 bp, Artificial Sequence
  Synthetic oligonucleotide; CTT chr2 60504049 60504070 60504066 60504071 +
cgagcggcacattctgagaact

SEQ ID NO: 201816 - DNA, 22 bp, Artificial Sequence
  Synthetic oligonucleotide; TTC chr2 60504050 60504071 60504067 60504072 +
gagcggcacattctgagaactc

SEQ ID NO: 201817 - DNA, 22 bp, Artificial Sequence
  Synthetic oligonucleotide; TTC chr2 60504063 60504084 60504080 60504085 +
tgagaactctgaagagtaccac

SEQ ID NO: 201818 - DNA, 22 bp, Artificial Sequence
  Synthetic oligonucleotide; CTG chr2 60504065 60504086 60504082 60504087 +
agaactctgaagagtaccactc

SEQ ID NO: 201819 - DNA, 22 bp, Artificial Sequence
  Synthetic oligonucleotide; CTC chr2 60504072 60504093 60504089 60504094 +
tgaagagtaccactcagccgac

SEQ ID NO: 201820 - DNA, 22 bp, Artificial Sequence
  Synthetic oligonucleotide; CTG chr2 60504074 60504095 60504091 60504096 +
aagagtaccactcagccgacac

SEQ ID NO: 201821 - DNA, 22 bp, Artificial Sequence
  Synthetic oligonucleotide; CTC chr2 60504087 60504108 60504104 60504109 +
agccgacactgcccccatgaca

SEQ ID NO: 201822 - DNA, 22 bp, Artificial Sequence
  Synthetic oligonucleotide; CTG chr2 60504098 60504119 60504115 60504120 +
cccccatgacatagggccctgg

SEQ ID NO: 201823 - DNA, 22 bp, Artificial Sequence
  Synthetic oligonucleotide; CTG chr2 60504119 60504140 60504136 60504141 +
gtctcctctttgactcacactt

SEQ ID NO: 201824 - DNA, 22 bp, Artificial Sequence
  Synthetic oligonucleotide; CTC chr2 60504124 60504145 60504141 60504146 +
ctctttgactcacacttgcctg

SEQ ID NO: 201825 - DNA, 22 bp, Artificial Sequence
  Synthetic oligonucleotide; CTC chr2 60504127 60504148 60504144 60504149 +
tttgactcacacttgcctggca

SEQ ID NO: 201826 - DNA, 22 bp, Artificial Sequence
  Synthetic oligonucleotide; CTT chr2 60504129 60504150 60504146 60504151 +
tgactcacacttgcctggcagg

SEQ ID NO: 201827 - DNA, 22 bp, Artificial Sequence
  Synthetic oligonucleotide; TTT chr2 60504130 60504151 60504147 60504152 +
gactcacacttgcctggcagga

SEQ ID NO: 201828 - DNA, 22 bp, Artificial Sequence
  Synthetic oligonucleotide; TTG chr2 60504131 60504152 60504148 60504153 +
actcacacttgcctggcaggac

SEQ ID NO: 201829 - DNA, 22 bp, Artificial Sequence
  Synthetic oligonucleotide; CTC chr2 60504135 60504156 60504152 60504157 +
acacttgcctggcaggactccc

SEQ ID NO: 201830 - DNA, 22 bp, Artificial Sequence
  Synthetic oligonucleotide; CTT chr2 60504141 60504162 60504158 60504163 +
gcctggcaggactccccaaaca

SEQ ID NO: 201831 - DNA, 22 bp, Artificial Sequence
  Synthetic oligonucleotide; TTG chr2 60504142 60504163 60504159 60504164 +
cctggcaggactccccaaacag

SEQ ID NO: 201832 - DNA, 22 bp, Artificial Sequence
  Synthetic oligonucleotide; CTG chr2 60504146 60504167 60504163 60504168 +
gcaggactccccaaacagaaca

SEQ ID NO: 201833 - DNA, 22 bp, Artificial Sequence
  Synthetic oligonucleotide; CTC chr2 60504155 60504176 60504172 60504177 +
cccaaacagaacagagatgctc

SEQ ID NO: 201834 - DNA, 22 bp, Artificial Sequence
  Synthetic oligonucleotide; CTC chr2 60504177 60504198 60504194 60504199 +
agccgggcacaagagagcaggc

SEQ ID NO: 201835 - DNA, 22 bp, Artificial Sequence
  Synthetic oligonucleotide; CTC chr2 60504209 60504230 60504226 60504231 +
atgctgcactgtggtttcccca

SEQ ID NO: 201836 - DNA, 22 bp, Artificial Sequence
  Synthetic oligonucleotide; CTG chr2 60504215 60504236 60504232 60504237 +
cactgtggtttccccagcaatt

SEQ ID NO: 201837 - DNA, 22 bp, Artificial Sequence
  Synthetic oligonucleotide; CTG chr2 60504220 60504241 60504237 60504242 +
tggtttccccagcaattccaga

SEQ ID NO: 201838 - DNA, 22 bp, Artificial Sequence
  Synthetic oligonucleotide; TTT chr2 60504226 60504247 60504243 60504248 +
ccccagcaattccagaactgct

SEQ ID NO: 201839 - DNA, 22 bp, Artificial Sequence
  Synthetic oligonucleotide; TTC chr2 60504227 60504248 60504244 60504249 +
cccagcaattccagaactgctg

SEQ ID NO: 201840 - DNA, 22 bp, Artificial Sequence
  Synthetic oligonucleotide; TTC chr2 60504238 60504259 60504255 60504260 +
cagaactgctgcctaccggcac

SEQ ID NO: 201841 - DNA, 22 bp, Artificial Sequence
  Synthetic oligonucleotide; CTG chr2 60504246 60504267 60504263 60504268 +
ctgcctaccggcacgcatgcag

SEQ ID NO: 201842 - DNA, 22 bp, Artificial Sequence
  Synthetic oligonucleotide; CTG chr2 60504249 60504270 60504266 60504271 +
cctaccggcacgcatgcaggat

SEQ ID NO: 201843 - DNA, 22 bp, Artificial Sequence
  Synthetic oligonucleotide; CTA chr2 60504253 60504274 60504270 60504275 +
ccggcacgcatgcaggatcaat

SEQ ID NO: 201844 - DNA, 22 bp, Artificial Sequence
  Synthetic oligonucleotide; CTT chr2 60504294 60504315 60504311 60504316 +
ctgggtctgcctgggtccaccc

SEQ ID NO: 201845 - DNA, 22 bp, Artificial Sequence
  Synthetic oligonucleotide; TTC chr2 60504295 60504316 60504312 60504317 +
tgggtctgcctgggtccaccct

SEQ ID NO: 201846 - DNA, 22 bp, Artificial Sequence
  Synthetic oligonucleotide; CTG chr2 60504297 60504318 60504314 60504319 +
ggtctgcctgggtccacccttc

SEQ ID NO: 201847 - DNA, 22 bp, Artificial Sequence
  Synthetic oligonucleotide; CTG chr2 60504303 60504324 60504320 60504325 +
cctgggtccacccttcctttct

SEQ ID NO: 201848 - DNA, 22 bp, Artificial Sequence
  Synthetic oligonucleotide; CTG chr2 60504307 60504328 60504324 60504329 +
ggtccacccttcctttcttagt

SEQ ID NO: 201849 - DNA, 22 bp, Artificial Sequence
  Synthetic oligonucleotide; CTT chr2 60504318 60504339 60504335 60504340 +
cctttcttagtcactgcaagat

SEQ ID NO: 201850 - DNA, 22 bp, Artificial Sequence
  Synthetic oligonucleotide; TTC chr2 60504319 60504340 60504336 60504341 +
ctttcttagtcactgcaagatt

SEQ ID NO: 201851 - DNA, 22 bp, Artificial Sequence
  Synthetic oligonucleotide; CTT chr2 60504322 60504343 60504339 60504344 +
tcttagtcactgcaagatttca

SEQ ID NO: 201852 - DNA, 22 bp, Artificial Sequence
  Synthetic oligonucleotide; TTT chr2 60504323 60504344 60504340 60504345 +
cttagtcactgcaagatttcac

SEQ ID NO: 201853 - DNA, 22 bp, Artificial Sequence
  Synthetic oligonucleotide; TTC chr2 60504324 60504345 60504341 60504346 +
ttagtcactgcaagatttcacc

SEQ ID NO: 201854 - DNA, 22 bp, Artificial Sequence
  Synthetic oligonucleotide; CTT chr2 60504326 60504347 60504343 60504348 +
agtcactgcaagatttcaccca

SEQ ID NO: 201855 - DNA, 22 bp, Artificial Sequence
  Synthetic oligonucleotide; TTA chr2 60504327 60504348 60504344 60504349 +
gtcactgcaagatttcacccag

SEQ ID NO: 201856 - DNA, 22 bp, Artificial Sequence
  Synthetic oligonucleotide; CTG chr2 60504334 60504355 60504351 60504356 +
caagatttcacccagcccagcc

SEQ ID NO: 201857 - DNA, 22 bp, Artificial Sequence
  Synthetic oligonucleotide; TTT chr2 60504342 60504363 60504359 60504364 +
cacccagcccagccacccactg

SEQ ID NO: 201858 - DNA, 22 bp, Artificial Sequence
  Synthetic oligonucleotide; TTC chr2 60504343 60504364 60504360 60504365 +
acccagcccagccacccactga

SEQ ID NO: 201859 - DNA, 22 bp, Artificial Sequence
  Synthetic oligonucleotide; CTG chr2 60504364 60504385 60504381 60504386 +
aaaaggcagaggaggccaccta

SEQ ID NO: 201860 - DNA, 22 bp, Artificial Sequence
  Synthetic oligonucleotide; CTA chr2 60504386 60504407 60504403 60504408 +
tctgaatgctaggatatgacac

SEQ ID NO: 201861 - DNA, 22 bp, Artificial Sequence
  Synthetic oligonucleotide; CTG chr2 60504390 60504411 60504407 60504412 +
aatgctaggatatgacacactt

SEQ ID NO: 201862 - DNA, 22 bp, Artificial Sequence
  Synthetic oligonucleotide; CTA chr2 60504397 60504418 60504414 60504419 +
ggatatgacacacttgaacctt

SEQ ID NO: 201863 - DNA, 22 bp, Artificial Sequence
  Synthetic oligonucleotide; CTT chr2 60504412 60504433 60504429 60504434 +
gaaccttcctcctggccagcct

SEQ ID NO: 201864 - DNA, 22 bp, Artificial Sequence
  Synthetic oligonucleotide; TTG chr2 60504413 60504434 60504430 60504435 +
aaccttcctcctggccagcctg

SEQ ID NO: 201865 - DNA, 22 bp, Artificial Sequence
  Synthetic oligonucleotide; CTT chr2 60504419 60504440 60504436 60504441 +
cctcctggccagcctgctctcc

SEQ ID NO: 201866 - DNA, 22 bp, Artificial Sequence
  Synthetic oligonucleotide; TTC chr2 60504420 60504441 60504437 60504442 +
ctcctggccagcctgctctccc

SEQ ID NO: 201867 - DNA, 22 bp, Artificial Sequence
  Synthetic oligonucleotide; CTC chr2 60504423 60504444 60504440 60504445 +
ctggccagcctgctctcccaaa

SEQ ID NO: 201868 - DNA, 22 bp, Artificial Sequence
  Synthetic oligonucleotide; CTG chr2 60504426 60504447 60504443 60504448 +
gccagcctgctctcccaaagaa

SEQ ID NO: 201869 - DNA, 22 bp, Artificial Sequence
  Synthetic oligonucleotide; CTG chr2 60504435 60504456 60504452 60504457 +
ctctcccaaagaaggaataaca

SEQ ID NO: 201870 - DNA, 22 bp, Artificial Sequence
  Synthetic oligonucleotide; CTC chr2 60504438 60504459 60504455 60504460 +
tcccaaagaaggaataacagaa

SEQ ID NO: 201871 - DNA, 22 bp, Artificial Sequence
  Synthetic oligonucleotide; CTC chr2 60504440 60504461 60504457 60504462 +
ccaaagaaggaataacagaaca

SEQ ID NO: 201872 - DNA, 22 bp, Artificial Sequence
  Synthetic oligonucleotide; CTC chr2 60504476 60504497 60504493 60504498 +
tgactacttctggtttgtaaat

SEQ ID NO: 201873 - DNA, 22 bp, Artificial Sequence
  Synthetic oligonucleotide; CTG chr2 60504478 60504499 60504495 60504500 +
actacttctggtttgtaaattt

SEQ ID NO: 201874 - DNA, 22 bp, Artificial Sequence
  Synthetic oligonucleotide; CTA chr2 60504482 60504503 60504499 60504504 +
cttctggtttgtaaatttatac

SEQ ID NO: 201875 - DNA, 22 bp, Artificial Sequence
  Synthetic oligonucleotide; CTT chr2 60504485 60504506 60504502 60504507 +
ctggtttgtaaatttataccaa

SEQ ID NO: 201876 - DNA, 22 bp, Artificial Sequence
  Synthetic oligonucleotide; TTC chr2 60504486 60504507 60504503 60504508 +
tggtttgtaaatttataccaat

SEQ ID NO: 201877 - DNA, 22 bp, Artificial Sequence
  Synthetic oligonucleotide; CTG chr2 60504488 60504509 60504505 60504510 +
gtttgtaaatttataccaatgt

SEQ ID NO: 201878 - DNA, 22 bp, Artificial Sequence
  Synthetic oligonucleotide; TTT chr2 60504492 60504513 60504509 60504514 +
gtaaatttataccaatgttctt

SEQ ID NO: 201879 - DNA, 22 bp, Artificial Sequence
  Synthetic oligonucleotide; TTG chr2 60504493 60504514 60504510 60504515 +
taaatttataccaatgttcttc

SEQ ID NO: 201880 - DNA, 22 bp, Artificial Sequence
  Synthetic oligonucleotide; TTT chr2 60504500 60504521 60504517 60504522 +
ataccaatgttcttcttgaagt

SEQ ID NO: 201881 - DNA, 22 bp, Artificial Sequence
  Synthetic oligonucleotide; TTA chr2 60504501 60504522 60504518 60504523 +
taccaatgttcttcttgaagtg

SEQ ID NO: 201882 - DNA, 22 bp, Artificial Sequence
  Synthetic oligonucleotide; TTC chr2 60504512 60504533 60504529 60504534 +
ttcttgaagtgggagctcagca

SEQ ID NO: 201883 - DNA, 22 bp, Artificial Sequence
  Synthetic oligonucleotide; CTT chr2 60504514 60504535 60504531 60504536 +
cttgaagtgggagctcagcatc

SEQ ID NO: 201884 - DNA, 22 bp, Artificial Sequence
  Synthetic oligonucleotide; TTC chr2 60504515 60504536 60504532 60504537 +
ttgaagtgggagctcagcatcg

SEQ ID NO: 201885 - DNA, 22 bp, Artificial Sequence
  Synthetic oligonucleotide; CTT chr2 60504517 60504538 60504534 60504539 +
gaagtgggagctcagcatcggg

SEQ ID NO: 201886 - DNA, 22 bp, Artificial Sequence
  Synthetic oligonucleotide; TTG chr2 60504518 60504539 60504535 60504540 +
aagtgggagctcagcatcggga

SEQ ID NO: 201887 - DNA, 22 bp, Artificial Sequence
  Synthetic oligonucleotide; CTC chr2 60504530 60504551 60504547 60504552 +
agcatcgggacacccagaaaaa

SEQ ID NO: 201888 - DNA, 22 bp, Artificial Sequence
  Synthetic oligonucleotide; CTC chr2 60504560 60504581 60504577 60504582 +
caaggcaaaaagcaaatagcag

SEQ ID NO: 201889 - DNA, 22 bp, Artificial Sequence
  Synthetic oligonucleotide; CTG chr2 60504592 60504613 60504609 60504614 +
ctgaaacagccaactctgtctc

SEQ ID NO: 201890 - DNA, 22 bp, Artificial Sequence
  Synthetic oligonucleotide; CTG chr2 60504595 60504616 60504612 60504617 +
aaacagccaactctgtctctgt

SEQ ID NO: 201891 - DNA, 22 bp, Artificial Sequence
  Synthetic oligonucleotide; CTC chr2 60504608 60504629 60504625 60504630 +
tgtctctgtctcccccaagccc

SEQ ID NO: 201892 - DNA, 22 bp, Artificial Sequence
  Synthetic oligonucleotide; CTG chr2 60504610 60504631 60504627 60504632 +
tctctgtctcccccaagccctc

SEQ ID NO: 201893 - DNA, 22 bp, Artificial Sequence
  Synthetic oligonucleotide; CTC chr2 60504614 60504635 60504631 60504636 +
tgtctcccccaagccctcctag

SEQ ID NO: 201894 - DNA, 22 bp, Artificial Sequence
  Synthetic oligonucleotide; CTG chr2 60504616 60504637 60504633 60504638 +
tctcccccaagccctcctagtc

SEQ ID NO: 201895 - DNA, 22 bp, Artificial Sequence
  Synthetic oligonucleotide; CTC chr2 60504620 60504641 60504637 60504642 +
ccccaagccctcctagtcagaa

SEQ ID NO: 201896 - DNA, 22 bp, Artificial Sequence
  Synthetic oligonucleotide; CTC chr2 60504632 60504653 60504649 60504654 +
ctagtcagaacgttctctcagc

SEQ ID NO: 201897 - DNA, 22 bp, Artificial Sequence
  Synthetic oligonucleotide; CTA chr2 60504635 60504656 60504652 60504657 +
gtcagaacgttctctcagcatt

SEQ ID NO: 201898 - DNA, 22 bp, Artificial Sequence
  Synthetic oligonucleotide; TTC chr2 60504647 60504668 60504664 60504669 +
tctcagcatttcagcaggtact

SEQ ID NO: 201899 - DNA, 22 bp, Artificial Sequence
  Synthetic oligonucleotide; CTC chr2 60504649 60504670 60504666 60504671 +
tcagcatttcagcaggtactgc

SEQ ID NO: 201900 - DNA, 22 bp, Artificial Sequence
  Synthetic oligonucleotide; CTC chr2 60504651 60504672 60504668 60504673 +
agcatttcagcaggtactgctc

SEQ ID NO: 201901 - DNA, 22 bp, Artificial Sequence
  Synthetic oligonucleotide; TTT chr2 60504658 60504679 60504675 60504680 +
cagcaggtactgctcacctgga

SEQ ID NO: 201902 - DNA, 22 bp, Artificial Sequence
  Synthetic oligonucleotide; TTC chr2 60504659 60504680 60504676 60504681 +
agcaggtactgctcacctggaa

SEQ ID NO: 201903 - DNA, 22 bp, Artificial Sequence
  Synthetic oligonucleotide; CTG chr2 60504670 60504691 60504687 60504692 +
ctcacctggaaatacagctgat

SEQ ID NO: 201904 - DNA, 22 bp, Artificial Sequence
  Synthetic oligonucleotide; CTC chr2 60504673 60504694 60504690 60504695 +
acctggaaatacagctgatgta

SEQ ID NO: 201905 - DNA, 22 bp, Artificial Sequence
  Synthetic oligonucleotide; CTG chr2 60504678 60504699 60504695 60504700 +
gaaatacagctgatgtatttac

SEQ ID NO: 201906 - DNA, 22 bp, Artificial Sequence
  Synthetic oligonucleotide; CTG chr2 60504690 60504711 60504707 60504712 +
atgtatttactgagaagcttct

SEQ ID NO: 201907 - DNA, 22 bp, Artificial Sequence
  Synthetic oligonucleotide; TTT chr2 60504698 60504719 60504715 60504720 +
actgagaagcttcttcaagctt

SEQ ID NO: 201908 - DNA, 22 bp, Artificial Sequence
  Synthetic oligonucleotide; TTA chr2 60504699 60504720 60504716 60504721 +
ctgagaagcttcttcaagcttt

SEQ ID NO: 201909 - DNA, 22 bp, Artificial Sequence
  Synthetic oligonucleotide; CTG chr2 60504702 60504723 60504719 60504724 +
agaagcttcttcaagctttcta

SEQ ID NO: 201910 - DNA, 22 bp, Artificial Sequence
  Synthetic oligonucleotide; CTT chr2 60504710 60504731 60504727 60504732 +
cttcaagctttctactggtgct

SEQ ID NO: 201911 - DNA, 22 bp, Artificial Sequence
  Synthetic oligonucleotide; TTC chr2 60504711 60504732 60504728 60504733 +
ttcaagctttctactggtgctt

SEQ ID NO: 201912 - DNA, 22 bp, Artificial Sequence
  Synthetic oligonucleotide; CTT chr2 60504713 60504734 60504730 60504735 +
caagctttctactggtgcttag

SEQ ID NO: 201913 - DNA, 22 bp, Artificial Sequence
  Synthetic oligonucleotide; TTC chr2 60504714 60504735 60504731 60504736 +
aagctttctactggtgcttagg

SEQ ID NO: 201914 - DNA, 22 bp, Artificial Sequence
  Synthetic oligonucleotide; CTT chr2 60504720 60504741 60504737 60504742 +
tctactggtgcttagggacaat

SEQ ID NO: 201915 - DNA, 22 bp, Artificial Sequence
  Synthetic oligonucleotide; TTT chr2 60504721 60504742 60504738 60504743 +
ctactggtgcttagggacaatg

SEQ ID NO: 201916 - DNA, 22 bp, Artificial Sequence
  Synthetic oligonucleotide; TTC chr2 60504722 60504743 60504739 60504744 +
tactggtgcttagggacaatgc

SEQ ID NO: 201917 - DNA, 22 bp, Artificial Sequence
  Synthetic oligonucleotide; CTA chr2 60504724 60504745 60504741 60504746 +
ctggtgcttagggacaatgcca

SEQ ID NO: 201918 - DNA, 22 bp, Artificial Sequence
  Synthetic oligonucleotide; CTG chr2 60504727 60504748 60504744 60504749 +
gtgcttagggacaatgccaatc

SEQ ID NO: 201919 - DNA, 22 bp, Artificial Sequence
  Synthetic oligonucleotide; CTT chr2 60504733 60504754 60504750 60504755 +
agggacaatgccaatcaagtct

SEQ ID NO: 201920 - DNA, 22 bp, Artificial Sequence
  Synthetic oligonucleotide; TTA chr2 60504734 60504755 60504751 60504756 +
gggacaatgccaatcaagtctt

SEQ ID NO: 201921 - DNA, 22 bp, Artificial Sequence
  Synthetic oligonucleotide; CTT chr2 60504756 60504777 60504773 60504778 +
gaaattatatagagaggtggaa

SEQ ID NO: 201922 - DNA, 22 bp, Artificial Sequence
  Synthetic oligonucleotide; TTG chr2 60504757 60504778 60504774 60504779 +
aaattatatagagaggtggaat

SEQ ID NO: 201923 - DNA, 22 bp, Artificial Sequence
  Synthetic oligonucleotide; TTA chr2 60504763 60504784 60504780 60504785 +
tatagagaggtggaatatcagg

SEQ ID NO: 201924 - DNA, 22 bp, Artificial Sequence
  Synthetic oligonucleotide; CTG chr2 60504795 60504816 60504812 60504817 +
tccctgaaaatgcttaaaagat

SEQ ID NO: 201925 - DNA, 22 bp, Artificial Sequence
  Synthetic oligonucleotide; CTG chr2 60504801 60504822 60504818 60504823 +
aaaatgcttaaaagatcaaact

SEQ ID NO: 201926 - DNA, 22 bp, Artificial Sequence
  Synthetic oligonucleotide; CTT chr2 60504810 60504831 60504827 60504832 +
aaaagatcaaactgattcctat

SEQ ID NO: 201927 - DNA, 22 bp, Artificial Sequence
  Synthetic oligonucleotide; TTA chr2 60504811 60504832 60504828 60504833 +
aaagatcaaactgattcctatc

SEQ ID NO: 201928 - DNA, 22 bp, Artificial Sequence
  Synthetic oligonucleotide; CTG chr2 60504824 60504845 60504841 60504846 +
attcctatcacatgcctcccct

SEQ ID NO: 201929 - DNA, 22 bp, Artificial Sequence
  Synthetic oligonucleotide; TTC chr2 60504828 60504849 60504845 60504850 +
ctatcacatgcctcccctacca

SEQ ID NO: 201930 - DNA, 22 bp, Artificial Sequence
  Synthetic oligonucleotide; CTA chr2 60504831 60504852 60504848 60504853 +
tcacatgcctcccctaccagtg

SEQ ID NO: 201931 - DNA, 22 bp, Artificial Sequence
  Synthetic oligonucleotide; CTC chr2 60504842 60504863 60504859 60504864 +
ccctaccagtgagcgcccacca

SEQ ID NO: 201932 - DNA, 22 bp, Artificial Sequence
  Synthetic oligonucleotide; CTA chr2 60504847 60504868 60504864 60504869 +
ccagtgagcgcccaccactagc

SEQ ID NO: 201933 - DNA, 22 bp, Artificial Sequence
  Synthetic oligonucleotide; CTA chr2 60504867 60504888 60504884 60504889 +
gcttccttgctccaaactatta

SEQ ID NO: 201934 - DNA, 22 bp, Artificial Sequence
  Synthetic oligonucleotide; CTT chr2 60504871 60504892 60504888 60504893 +
ccttgctccaaactattaaaac

SEQ ID NO: 201935 - DNA, 22 bp, Artificial Sequence
  Synthetic oligonucleotide; TTC chr2 60504872 60504893 60504889 60504894 +
cttgctccaaactattaaaaca

SEQ ID NO: 201936 - DNA, 22 bp, Artificial Sequence
  Synthetic oligonucleotide; CTT chr2 60504875 60504896 60504892 60504897 +
gctccaaactattaaaacagag

SEQ ID NO: 201937 - DNA, 22 bp, Artificial Sequence
  Synthetic oligonucleotide; TTG chr2 60504876 60504897 60504893 60504898 +
ctccaaactattaaaacagagc

SEQ ID NO: 201938 - DNA, 22 bp, Artificial Sequence
  Synthetic oligonucleotide; CTC chr2 60504879 60504900 60504896 60504901 +
caaactattaaaacagagcgtc

SEQ ID NO: 201939 - DNA, 22 bp, Artificial Sequence
  Synthetic oligonucleotide; CTA chr2 60504886 60504907 60504903 60504908 +
ttaaaacagagcgtccccccaa

SEQ ID NO: 201940 - DNA, 22 bp, Artificial Sequence
  Synthetic oligonucleotide; TTA chr2 60504889 60504910 60504906 60504911 +
aaacagagcgtccccccaaaaa

SEQ ID NO: 201941 - DNA, 22 bp, Artificial Sequence
  Synthetic oligonucleotide; CTT chr2 60504920 60504941 60504937 60504942 +
ctgcaagccacaacttccctac

SEQ ID NO: 201942 - DNA, 22 bp, Artificial Sequence
  Synthetic oligonucleotide; TTC chr2 60504921 60504942 60504938 60504943 +
tgcaagccacaacttccctacc

SEQ ID NO: 201943 - DNA, 22 bp, Artificial Sequence
  Synthetic oligonucleotide; CTG chr2 60504923 60504944 60504940 60504945 +
caagccacaacttccctaccct

SEQ ID NO: 201944 - DNA, 22 bp, Artificial Sequence
  Synthetic oligonucleotide; CTT chr2 60504936 60504957 60504953 60504958 +
ccctaccctgtgtgcaggctgt

SEQ ID NO: 201945 - DNA, 22 bp, Artificial Sequence
  Synthetic oligonucleotide; TTC chr2 60504937 60504958 60504954 60504959 +
cctaccctgtgtgcaggctgtg

SEQ ID NO: 201946 - DNA, 22 bp, Artificial Sequence
  Synthetic oligonucleotide; CTA chr2 60504941 60504962 60504958 60504963 +
ccctgtgtgcaggctgtggaag

SEQ ID NO: 201947 - DNA, 22 bp, Artificial Sequence
  Synthetic oligonucleotide; CTG chr2 60504946 60504967 60504963 60504968 +
tgtgcaggctgtggaagcgtgg

SEQ ID NO: 201948 - DNA, 22 bp, Artificial Sequence
  Synthetic oligonucleotide; CTG chr2 60504957 60504978 60504974 60504979 +
tggaagcgtggggtggacccag

SEQ ID NO: 201949 - DNA, 22 bp, Artificial Sequence
  Synthetic oligonucleotide; TTC chr2 60504994 60505015 60505011 60505016 +
tggatcagaatccctagtctac

SEQ ID NO: 201950 - DNA, 22 bp, Artificial Sequence
  Synthetic oligonucleotide; CTG chr2 60504996 60505017 60505013 60505018 +
gatcagaatccctagtctaccc

SEQ ID NO: 201951 - DNA, 22 bp, Artificial Sequence
  Synthetic oligonucleotide; CTA chr2 60505010 60505031 60505027 60505032 +
gtctacccctgcggctgcatga

SEQ ID NO: 201952 - DNA, 22 bp, Artificial Sequence
  Synthetic oligonucleotide; CTA chr2 60505015 60505036 60505032 60505037 +
cccctgcggctgcatgagacca

SEQ ID NO: 201953 - DNA, 22 bp, Artificial Sequence
  Synthetic oligonucleotide; CTG chr2 60505021 60505042 60505038 60505043 +
cggctgcatgagaccagacctg

SEQ ID NO: 201954 - DNA, 22 bp, Artificial Sequence
  Synthetic oligonucleotide; CTG chr2 60505027 60505048 60505044 60505049 +
catgagaccagacctgccattt

SEQ ID NO: 201955 - DNA, 22 bp, Artificial Sequence
  Synthetic oligonucleotide; CTG chr2 60505043 60505064 60505060 60505065 +
ccatttaacctctctaagcttc

SEQ ID NO: 201956 - DNA, 22 bp, Artificial Sequence
  Synthetic oligonucleotide; TTT chr2 60505049 60505070 60505066 60505071 +
aacctctctaagcttcaactac

SEQ ID NO: 201957 - DNA, 22 bp, Artificial Sequence
  Synthetic oligonucleotide; TTA chr2 60505050 60505071 60505067 60505072 +
acctctctaagcttcaactacc

SEQ ID NO: 201958 - DNA, 22 bp, Artificial Sequence
  Synthetic oligonucleotide; CTC chr2 60505055 60505076 60505072 60505077 +
tctaagcttcaactaccctttc

SEQ ID NO: 201959 - DNA, 22 bp, Artificial Sequence
  Synthetic oligonucleotide; CTC chr2 60505057 60505078 60505074 60505079 +
taagcttcaactaccctttctc

SEQ ID NO: 201960 - DNA, 22 bp, Artificial Sequence
  Synthetic oligonucleotide; CTA chr2 60505059 60505080 60505076 60505081 +
agcttcaactaccctttctcct

SEQ ID NO: 201961 - DNA, 22 bp, Artificial Sequence
  Synthetic oligonucleotide; CTT chr2 60505064 60505085 60505081 60505086 +
caactaccctttctcctgcctc

SEQ ID NO: 201962 - DNA, 22 bp, Artificial Sequence
  Synthetic oligonucleotide; TTC chr2 60505065 60505086 60505082 60505087 +
aactaccctttctcctgcctct

SEQ ID NO: 201963 - DNA, 22 bp, Artificial Sequence
  Synthetic oligonucleotide; CTA chr2 60505070 60505091 60505087 60505092 +
ccctttctcctgcctcttcaca

SEQ ID NO: 201964 - DNA, 22 bp, Artificial Sequence
  Synthetic oligonucleotide; CTT chr2 60505075 60505096 60505092 60505097 +
tctcctgcctcttcacagggtt

SEQ ID NO: 201965 - DNA, 22 bp, Artificial Sequence
  Synthetic oligonucleotide; TTT chr2 60505076 60505097 60505093 60505098 +
ctcctgcctcttcacagggtta

SEQ ID NO: 201966 - DNA, 22 bp, Artificial Sequence
  Synthetic oligonucleotide; TTC chr2 60505077 60505098 60505094 60505099 +
tcctgcctcttcacagggttac

SEQ ID NO: 201967 - DNA, 22 bp, Artificial Sequence
  Synthetic oligonucleotide; CTC chr2 60505079 60505100 60505096 60505101 +
ctgcctcttcacagggttactc

SEQ ID NO: 201968 - DNA, 22 bp, Artificial Sequence
  Synthetic oligonucleotide; CTG chr2 60505082 60505103 60505099 60505104 +
cctcttcacagggttactcatg

SEQ ID NO: 201969 - DNA, 22 bp, Artificial Sequence
  Synthetic oligonucleotide; CTC chr2 60505086 60505107 60505103 60505108 +
ttcacagggttactcatgaggt

SEQ ID NO: 201970 - DNA, 22 bp, Artificial Sequence
  Synthetic oligonucleotide; CTT chr2 60505088 60505109 60505105 60505110 +
cacagggttactcatgaggtga

SEQ ID NO: 201971 - DNA, 22 bp, Artificial Sequence
  Synthetic oligonucleotide; TTC chr2 60505089 60505110 60505106 60505111 +
acagggttactcatgaggtgag

SEQ ID NO: 201972 - DNA, 22 bp, Artificial Sequence
  Synthetic oligonucleotide; TTA chr2 60505098 60505119 60505115 60505120 +
ctcatgaggtgagtctcaattt

SEQ ID NO: 201973 - DNA, 22 bp, Artificial Sequence
  Synthetic oligonucleotide; CTC chr2 60505101 60505122 60505118 60505123 +
atgaggtgagtctcaatttgac

SEQ ID NO: 201974 - DNA, 22 bp, Artificial Sequence
  Synthetic oligonucleotide; CTC chr2 60505115 60505136 60505132 60505137 +
aatttgacaatactcctcaaag

SEQ ID NO: 201975 - DNA, 22 bp, Artificial Sequence
  Synthetic oligonucleotide; TTT chr2 60505120 60505141 60505137 60505142 +
gacaatactcctcaaagggctt

SEQ ID NO: 201976 - DNA, 22 bp, Artificial Sequence
  Synthetic oligonucleotide; TTG chr2 60505121 60505142 60505138 60505143 +
acaatactcctcaaagggctta

SEQ ID NO: 201977 - DNA, 22 bp, Artificial Sequence
  Synthetic oligonucleotide; CTC chr2 60505130 60505151 60505147 60505152 +
ctcaaagggcttactcaaaaaa

SEQ ID NO: 201978 - DNA, 22 bp, Artificial Sequence
  Synthetic oligonucleotide; CTC chr2 60505133 60505154 60505150 60505155 +
aaagggcttactcaaaaaaaaa

SEQ ID NO: 201979 - DNA, 22 bp, Artificial Sequence
  Synthetic oligonucleotide; CTT chr2 60505142 60505163 60505159 60505164 +
actcaaaaaaaaaatgtgattt

SEQ ID NO: 201980 - DNA, 22 bp, Artificial Sequence
  Synthetic oligonucleotide; TTA chr2 60505143 60505164 60505160 60505165 +
ctcaaaaaaaaaatgtgatttt

SEQ ID NO: 201981 - DNA, 22 bp, Artificial Sequence
  Synthetic oligonucleotide; CTC chr2 60505146 60505167 60505163 60505168 +
aaaaaaaaaatgtgattttatc

SEQ ID NO: 201982 - DNA, 22 bp, Artificial Sequence
  Synthetic oligonucleotide; TTT chr2 60505164 60505185 60505181 60505186 +
tatccgtatcctcattactaac

SEQ ID NO: 201983 - DNA, 22 bp, Artificial Sequence
  Synthetic oligonucleotide; TTT chr2 60505165 60505186 60505182 60505187 +
atccgtatcctcattactaaca

SEQ ID NO: 201984 - DNA, 22 bp, Artificial Sequence
  Synthetic oligonucleotide; TTA chr2 60505166 60505187 60505183 60505188 +
tccgtatcctcattactaacag

SEQ ID NO: 201985 - DNA, 22 bp, Artificial Sequence
  Synthetic oligonucleotide; CTC chr2 60505177 60505198 60505194 60505199 +
attactaacagcacaatggaca

SEQ ID NO: 201986 - DNA, 22 bp, Artificial Sequence
  Synthetic oligonucleotide; TTA chr2 60505181 60505202 60505198 60505203 +
ctaacagcacaatggacattcg

SEQ ID NO: 201987 - DNA, 22 bp, Artificial Sequence
  Synthetic oligonucleotide; CTA chr2 60505184 60505205 60505201 60505206 +
acagcacaatggacattcgaaa

SEQ ID NO: 201988 - DNA, 22 bp, Artificial Sequence
  Synthetic oligonucleotide; TTC chr2 60505202 60505223 60505219 60505224 +
gaaagggatgggcccaattttt

SEQ ID NO: 201989 - DNA, 22 bp, Artificial Sequence
  Synthetic oligonucleotide; TTT chr2 60505222 60505243 60505239 60505244 +
ttcataagccaaaaaagctaga

SEQ ID NO: 201990 - DNA, 22 bp, Artificial Sequence
  Synthetic oligonucleotide; TTT chr2 60505223 60505244 60505240 60505245 +
tcataagccaaaaaagctagag

SEQ ID NO: 201991 - DNA, 22 bp, Artificial Sequence
  Synthetic oligonucleotide; TTT chr2 60505224 60505245 60505241 60505246 +
cataagccaaaaaagctagagg

SEQ ID NO: 201992 - DNA, 22 bp, Artificial Sequence
  Synthetic oligonucleotide; TTC chr2 60505225 60505246 60505242 60505247 +
ataagccaaaaaagctagagga

SEQ ID NO: 201993 - DNA, 22 bp, Artificial Sequence
  Synthetic oligonucleotide; CTA chr2 60505242 60505263 60505259 60505264 +
gaggatcggagagaaaagaagg

SEQ ID NO: 201994 - DNA, 22 bp, Artificial Sequence
  Synthetic oligonucleotide; CTC chr2 60505275 60505296 60505292 60505297 +
agaaacggcttcaagggtgtcc

SEQ ID NO: 201995 - DNA, 22 bp, Artificial Sequence
  Synthetic oligonucleotide; CTT chr2 60505286 60505307 60505303 60505308 +
caagggtgtcctttggcacccc

SEQ ID NO: 201996 - DNA, 22 bp, Artificial Sequence
  Synthetic oligonucleotide; TTC chr2 60505287 60505308 60505304 60505309 +
aagggtgtcctttggcacccca

SEQ ID NO: 201997 - DNA, 22 bp, Artificial Sequence
  Synthetic oligonucleotide; CTT chr2 60505299 60505320 60505316 60505321 +
tggcaccccattcttccagatt

SEQ ID NO: 201998 - DNA, 22 bp, Artificial Sequence
  Synthetic oligonucleotide; TTT chr2 60505300 60505321 60505317 60505322 +
ggcaccccattcttccagattg

SEQ ID NO: 201999 - DNA, 22 bp, Artificial Sequence
  Synthetic oligonucleotide; TTG chr2 60505301 60505322 60505318 60505323 +
gcaccccattcttccagattgt

SEQ ID NO: 202000 - DNA, 22 bp, Artificial Sequence
  Synthetic oligonucleotide; TTC chr2 60505312 60505333 60505329 60505334 +
ttccagattgttccaaatgcct

SEQ ID NO: 202001 - DNA, 22 bp, Artificial Sequence
  Synthetic oligonucleotide; CTT chr2 60505314 60505335 60505331 60505336 +
ccagattgttccaaatgcctgc

SEQ ID NO: 202002 - DNA, 22 bp, Artificial Sequence
  Synthetic oligonucleotide; TTC chr2 60505315 60505336 60505332 60505337 +
cagattgttccaaatgcctgct

SEQ ID NO: 202003 - DNA, 22 bp, Artificial Sequence
  Synthetic oligonucleotide; TTG chr2 60505322 60505343 60505339 60505344 +
ttccaaatgcctgctgcagtaa

SEQ ID NO: 202004 - DNA, 22 bp, Artificial Sequence
  Synthetic oligonucleotide; TTC chr2 60505325 60505346 60505342 60505347 +
caaatgcctgctgcagtaataa

SEQ ID NO: 202005 - DNA, 22 bp, Artificial Sequence
  Synthetic oligonucleotide; CTG chr2 60505335 60505356 60505352 60505357 +
ctgcagtaataacagccccaaa

SEQ ID NO: 202006 - DNA, 22 bp, Artificial Sequence
  Synthetic oligonucleotide; CTG chr2 60505338 60505359 60505355 60505360 +
cagtaataacagccccaaaaga

SEQ ID NO: 202007 - DNA, 22 bp, Artificial Sequence
  Synthetic oligonucleotide; CTT chr2 60505371 60505392 60505388 60505393 +
tgtcaggacttgtaggtgaaat

SEQ ID NO: 202008 - DNA, 22 bp, Artificial Sequence
  Synthetic oligonucleotide; TTT chr2 60505372 60505393 60505389 60505394 +
gtcaggacttgtaggtgaaatg

SEQ ID NO: 202009 - DNA, 22 bp, Artificial Sequence
  Synthetic oligonucleotide; TTG chr2 60505373 60505394 60505390 60505395 +
tcaggacttgtaggtgaaatgt

SEQ ID NO: 202010 - DNA, 22 bp, Artificial Sequence
  Synthetic oligonucleotide; CTT chr2 60505382 60505403 60505399 60505404 +
gtaggtgaaatgtgttggagca

SEQ ID NO: 202011 - DNA, 22 bp, Artificial Sequence
  Synthetic oligonucleotide; TTG chr2 60505383 60505404 60505400 60505405 +
taggtgaaatgtgttggagcag

SEQ ID NO: 202012 - DNA, 22 bp, Artificial Sequence
  Synthetic oligonucleotide; TTG chr2 60505399 60505420 60505416 60505421 +
gagcagctgtcagcttggggaa

SEQ ID NO: 202013 - DNA, 22 bp, Artificial Sequence
  Synthetic oligonucleotide; CTG chr2 60505408 60505429 60505425 60505430 +
tcagcttggggaaaatcactca

SEQ ID NO: 202014 - DNA, 22 bp, Artificial Sequence
  Synthetic oligonucleotide; CTT chr2 60505415 60505436 60505432 60505437 +
ggggaaaatcactcatcaggta

SEQ ID NO: 202015 - DNA, 22 bp, Artificial Sequence
  Synthetic oligonucleotide; TTG chr2 60505416 60505437 60505433 60505438 +
gggaaaatcactcatcaggtag

SEQ ID NO: 202016 - DNA, 22 bp, Artificial Sequence
  Synthetic oligonucleotide; CTC chr2 60505429 60505450 60505446 60505451 +
atcaggtagtcagccgagtgag

SEQ ID NO: 202017 - DNA, 22 bp, Artificial Sequence
  Synthetic oligonucleotide; CTG chr2 60505455 60505476 60505472 60505477 +
ccttcagctggacaaacactgc

SEQ ID NO: 202018 - DNA, 22 bp, Artificial Sequence
  Synthetic oligonucleotide; CTT chr2 60505459 60505480 60505476 60505481 +
cagctggacaaacactgcatcc

SEQ ID NO: 202019 - DNA, 22 bp, Artificial Sequence
  Synthetic oligonucleotide; TTC chr2 60505460 60505481 60505477 60505482 +
agctggacaaacactgcatcca

SEQ ID NO: 202020 - DNA, 22 bp, Artificial Sequence
  Synthetic oligonucleotide; CTG chr2 60505465 60505486 60505482 60505487 +
gacaaacactgcatccacacag

SEQ ID NO: 202021 - DNA, 22 bp, Artificial Sequence
  Synthetic oligonucleotide; CTG chr2 60505476 60505497 60505493 60505498 +
catccacacagggaacaagcgg

SEQ ID NO: 202022 - DNA, 22 bp, Artificial Sequence
  Synthetic oligonucleotide; CTT chr2 60505504 60505525 60505521 60505526 +
tcctgtccttcccttaggggcc

SEQ ID NO: 202023 - DNA, 22 bp, Artificial Sequence
  Synthetic oligonucleotide; TTT chr2 60505505 60505526 60505522 60505527 +
cctgtccttcccttaggggcca

SEQ ID NO: 202024 - DNA, 22 bp, Artificial Sequence
  Synthetic oligonucleotide; TTC chr2 60505506 60505527 60505523 60505528 +
ctgtccttcccttaggggccaa

SEQ ID NO: 202025 - DNA, 22 bp, Artificial Sequence
  Synthetic oligonucleotide; CTG chr2 60505509 60505530 60505526 60505531 +
tccttcccttaggggccaaacc

SEQ ID NO: 202026 - DNA, 22 bp, Artificial Sequence
  Synthetic oligonucleotide; CTT chr2 60505514 60505535 60505531 60505536 +
cccttaggggccaaaccagccc

SEQ ID NO: 202027 - DNA, 22 bp, Artificial Sequence
  Synthetic oligonucleotide; TTC chr2 60505515 60505536 60505532 60505537 +
ccttaggggccaaaccagccct

SEQ ID NO: 202028 - DNA, 22 bp, Artificial Sequence
  Synthetic oligonucleotide; CTT chr2 60505519 60505540 60505536 60505541 +
aggggccaaaccagccctcttt

SEQ ID NO: 202029 - DNA, 22 bp, Artificial Sequence
  Synthetic oligonucleotide; TTA chr2 60505520 60505541 60505537 60505542 +
ggggccaaaccagccctctttt

SEQ ID NO: 202030 - DNA, 22 bp, Artificial Sequence
  Synthetic oligonucleotide; CTC chr2 60505538 60505559 60505555 60505560 +
ttttaccttcttgtccaaccca

SEQ ID NO: 202031 - DNA, 22 bp, Artificial Sequence
  Synthetic oligonucleotide; CTT chr2 60505540 60505561 60505557 60505562 +
ttaccttcttgtccaacccagt

SEQ ID NO: 202032 - DNA, 22 bp, Artificial Sequence
  Synthetic oligonucleotide; TTT chr2 60505541 60505562 60505558 60505563 +
taccttcttgtccaacccagtg

SEQ ID NO: 202033 - DNA, 22 bp, Artificial Sequence
  Synthetic oligonucleotide; TTT chr2 60505542 60505563 60505559 60505564 +
accttcttgtccaacccagtgg

SEQ ID NO: 202034 - DNA, 22 bp, Artificial Sequence
  Synthetic oligonucleotide; TTA chr2 60505543 60505564 60505560 60505565 +
ccttcttgtccaacccagtggg

SEQ ID NO: 202035 - DNA, 22 bp, Artificial Sequence
  Synthetic oligonucleotide; CTT chr2 60505547 60505568 60505564 60505569 +
cttgtccaacccagtgggcctc

SEQ ID NO: 202036 - DNA, 22 bp, Artificial Sequence
  Synthetic oligonucleotide; TTC chr2 60505548 60505569 60505565 60505570 +
ttgtccaacccagtgggcctct

SEQ ID NO: 202037 - DNA, 22 bp, Artificial Sequence
  Synthetic oligonucleotide; CTT chr2 60505550 60505571 60505567 60505572 +
gtccaacccagtgggcctctct

SEQ ID NO: 202038 - DNA, 22 bp, Artificial Sequence
  Synthetic oligonucleotide; TTG chr2 60505551 60505572 60505568 60505573 +
tccaacccagtgggcctctctc

SEQ ID NO: 202039 - DNA, 22 bp, Artificial Sequence
  Synthetic oligonucleotide; CTC chr2 60505569 60505590 60505586 60505591 +
tctccctcaaatgcatacctcc

SEQ ID NO: 202040 - DNA, 22 bp, Artificial Sequence
  Synthetic oligonucleotide; CTC chr2 60505571 60505592 60505588 60505593 +
tccctcaaatgcatacctcctt

SEQ ID NO: 202041 - DNA, 22 bp, Artificial Sequence
  Synthetic oligonucleotide; CTC chr2 60505573 60505594 60505590 60505595 +
cctcaaatgcatacctccttct

SEQ ID NO: 202042 - DNA, 22 bp, Artificial Sequence
  Synthetic oligonucleotide; CTC chr2 60505577 60505598 60505594 60505599 +
aaatgcatacctccttctcttt

SEQ ID NO: 202043 - DNA, 22 bp, Artificial Sequence
  Synthetic oligonucleotide; CTC chr2 60505590 60505611 60505607 60505612 +
cttctctttcctccagctccct

SEQ ID NO: 202044 - DNA, 22 bp, Artificial Sequence
  Synthetic oligonucleotide; CTT chr2 60505593 60505614 60505610 60505615 +
ctctttcctccagctccctaag

SEQ ID NO: 202045 - DNA, 22 bp, Artificial Sequence
  Synthetic oligonucleotide; TTC chr2 60505594 60505615 60505611 60505616 +
tctttcctccagctccctaagc

SEQ ID NO: 202046 - DNA, 22 bp, Artificial Sequence
  Synthetic oligonucleotide; CTC chr2 60505596 60505617 60505613 60505618 +
tttcctccagctccctaagctg

SEQ ID NO: 202047 - DNA, 22 bp, Artificial Sequence
  Synthetic oligonucleotide; CTT chr2 60505598 60505619 60505615 60505620 +
tcctccagctccctaagctgtt

SEQ ID NO: 202048 - DNA, 22 bp, Artificial Sequence
  Synthetic oligonucleotide; TTT chr2 60505599 60505620 60505616 60505621 +
cctccagctccctaagctgttg

SEQ ID NO: 202049 - DNA, 22 bp, Artificial Sequence
  Synthetic oligonucleotide; TTC chr2 60505600 60505621 60505617 60505622 +
ctccagctccctaagctgttgt

SEQ ID NO: 202050 - DNA, 22 bp, Artificial Sequence
  Synthetic oligonucleotide; CTC chr2 60505603 60505624 60505620 60505625 +
cagctccctaagctgttgttca

SEQ ID NO: 202051 - DNA, 22 bp, Artificial Sequence
  Synthetic oligonucleotide; CTC chr2 60505609 60505630 60505626 60505631 +
cctaagctgttgttcagggcac

SEQ ID NO: 202052 - DNA, 22 bp, Artificial Sequence
  Synthetic oligonucleotide; CTA chr2 60505613 60505634 60505630 60505635 +
agctgttgttcagggcacagac

SEQ ID NO: 202053 - DNA, 22 bp, Artificial Sequence
  Synthetic oligonucleotide; CTG chr2 60505618 60505639 60505635 60505640 +
ttgttcagggcacagacagctc

SEQ ID NO: 202054 - DNA, 22 bp, Artificial Sequence
  Synthetic oligonucleotide; TTG chr2 60505621 60505642 60505638 60505643 +
ttcagggcacagacagctcttc

SEQ ID NO: 202055 - DNA, 22 bp, Artificial Sequence
  Synthetic oligonucleotide; TTC chr2 60505624 60505645 60505641 60505646 +
agggcacagacagctcttcagg

SEQ ID NO: 202056 - DNA, 22 bp, Artificial Sequence
  Synthetic oligonucleotide; CTC chr2 60505640 60505661 60505657 60505662 +
ttcaggctgccagagcaagaga

SEQ ID NO: 202057 - DNA, 22 bp, Artificial Sequence
  Synthetic oligonucleotide; CTT chr2 60505642 60505663 60505659 60505664 +
caggctgccagagcaagagagt

SEQ ID NO: 202058 - DNA, 22 bp, Artificial Sequence
  Synthetic oligonucleotide; TTC chr2 60505643 60505664 60505660 60505665 +
aggctgccagagcaagagagtt

SEQ ID NO: 202059 - DNA, 22 bp, Artificial Sequence
  Synthetic oligonucleotide; CTG chr2 60505649 60505670 60505666 60505671 +
ccagagcaagagagttaggaaa

SEQ ID NO: 202060 - DNA, 22 bp, Artificial Sequence
  Synthetic oligonucleotide; TTA chr2 60505666 60505687 60505683 60505688 +
ggaaataacgacccctccacat

SEQ ID NO: 202061 - DNA, 22 bp, Artificial Sequence
  Synthetic oligonucleotide; CTC chr2 60505683 60505704 60505700 60505705 +
cacatgcattcccacctcccgg

SEQ ID NO: 202062 - DNA, 22 bp, Artificial Sequence
  Synthetic oligonucleotide; TTC chr2 60505694 60505715 60505711 60505716 +
ccacctcccggaagcaggggac

SEQ ID NO: 202063 - DNA, 22 bp, Artificial Sequence
  Synthetic oligonucleotide; CTC chr2 60505701 60505722 60505718 60505723 +
ccggaagcaggggacacagctg

SEQ ID NO: 202064 - DNA, 22 bp, Artificial Sequence
  Synthetic oligonucleotide; CTG chr2 60505723 60505744 60505740 60505745 +
gccactctgtgacggagggtgg

SEQ ID NO: 202065 - DNA, 22 bp, Artificial Sequence
  Synthetic oligonucleotide; CTC chr2 60505730 60505751 60505747 60505752 +
tgtgacggagggtgggtaacct

SEQ ID NO: 202066 - DNA, 22 bp, Artificial Sequence
  Synthetic oligonucleotide; CTG chr2 60505732 60505753 60505749 60505754 +
tgacggagggtgggtaacctct

SEQ ID NO: 202067 - DNA, 22 bp, Artificial Sequence
  Synthetic oligonucleotide; CTC chr2 60505753 60505774 60505770 60505775 +
tctacctgggtctatcatttta

SEQ ID NO: 202068 - DNA, 22 bp, Artificial Sequence
  Synthetic oligonucleotide; CTC chr2 60505755 60505776 60505772 60505777 +
tacctgggtctatcattttaga

SEQ ID NO: 202069 - DNA, 22 bp, Artificial Sequence
  Synthetic oligonucleotide; CTA chr2 60505757 60505778 60505774 60505779 +
cctgggtctatcattttagaat

SEQ ID NO: 202070 - DNA, 22 bp, Artificial Sequence
  Synthetic oligonucleotide; CTG chr2 60505761 60505782 60505778 60505783 +
ggtctatcattttagaataaat

SEQ ID NO: 202071 - DNA, 22 bp, Artificial Sequence
  Synthetic oligonucleotide; CTA chr2 60505767 60505788 60505784 60505789 +
tcattttagaataaatcattcg

SEQ ID NO: 202072 - DNA, 22 bp, Artificial Sequence
  Synthetic oligonucleotide; TTT chr2 60505773 60505794 60505790 60505795 +
tagaataaatcattcgtggctg

SEQ ID NO: 202073 - DNA, 22 bp, Artificial Sequence
  Synthetic oligonucleotide; TTT chr2 60505774 60505795 60505791 60505796 +
agaataaatcattcgtggctga

SEQ ID NO: 202074 - DNA, 22 bp, Artificial Sequence
  Synthetic oligonucleotide; TTA chr2 60505775 60505796 60505792 60505797 +
gaataaatcattcgtggctgac

SEQ ID NO: 202075 - DNA, 22 bp, Artificial Sequence
  Synthetic oligonucleotide; TTC chr2 60505788 60505809 60505805 60505810 +
gtggctgactcttaaatgggaa

SEQ ID NO: 202076 - DNA, 22 bp, Artificial Sequence
  Synthetic oligonucleotide; CTG chr2 60505795 60505816 60505812 60505817 +
actcttaaatgggaagggccaa

SEQ ID NO: 202077 - DNA, 22 bp, Artificial Sequence
  Synthetic oligonucleotide; CTC chr2 60505799 60505820 60505816 60505821 +
ttaaatgggaagggccaattac

SEQ ID NO: 202078 - DNA, 22 bp, Artificial Sequence
  Synthetic oligonucleotide; CTT chr2 60505801 60505822 60505818 60505823 +
aaatgggaagggccaattacag

SEQ ID NO: 202079 - DNA, 22 bp, Artificial Sequence
  Synthetic oligonucleotide; TTA chr2 60505802 60505823 60505819 60505824 +
aatgggaagggccaattacaga

SEQ ID NO: 202080 - DNA, 22 bp, Artificial Sequence
  Synthetic oligonucleotide; TTA chr2 60505820 60505841 60505837 60505842 +
cagatatctctgagaacaactc

SEQ ID NO: 202081 - DNA, 22 bp, Artificial Sequence
  Synthetic oligonucleotide; CTC chr2 60505830 60505851 60505847 60505852 +
tgagaacaactctacctgaggg

SEQ ID NO: 202082 - DNA, 22 bp, Artificial Sequence
  Synthetic oligonucleotide; CTG chr2 60505832 60505853 60505849 60505854 +
agaacaactctacctgagggag

SEQ ID NO: 202083 - DNA, 22 bp, Artificial Sequence
  Synthetic oligonucleotide; CTC chr2 60505842 60505863 60505859 60505864 +
tacctgagggagggggaaatcc

SEQ ID NO: 202084 - DNA, 22 bp, Artificial Sequence
  Synthetic oligonucleotide; CTA chr2 60505844 60505865 60505861 60505866 +
cctgagggagggggaaatccct

SEQ ID NO: 202085 - DNA, 22 bp, Artificial Sequence
  Synthetic oligonucleotide; CTG chr2 60505848 60505869 60505865 60505870 +
agggagggggaaatccctccca

SEQ ID NO: 202086 - DNA, 22 bp, Artificial Sequence
  Synthetic oligonucleotide; CTC chr2 60505867 60505888 60505884 60505889 +
ccaaaacaacggtgggcagaaa

SEQ ID NO: 202087 - DNA, 22 bp, Artificial Sequence
  Synthetic oligonucleotide; CTG chr2 60505895 60505916 60505912 60505917 +
catcccgtaaatacccagaagc

SEQ ID NO: 202088 - DNA, 22 bp, Artificial Sequence
  Synthetic oligonucleotide; CTG chr2 60505934 60505955 60505951 60505956 +
gttcgtctgccagatgctgtgg

SEQ ID NO: 202089 - DNA, 22 bp, Artificial Sequence
  Synthetic oligonucleotide; TTC chr2 60505938 60505959 60505955 60505960 +
gtctgccagatgctgtggagat

SEQ ID NO: 202090 - DNA, 22 bp, Artificial Sequence
  Synthetic oligonucleotide; CTG chr2 60505943 60505964 60505960 60505965 +
ccagatgctgtggagatggcat

SEQ ID NO: 202091 - DNA, 22 bp, Artificial Sequence
  Synthetic oligonucleotide; CTG chr2 60505953 60505974 60505970 60505975 +
tggagatggcatggtggcattt

SEQ ID NO: 202092 - DNA, 22 bp, Artificial Sequence
  Synthetic oligonucleotide; TTT chr2 60505975 60505996 60505992 60505997 +
ggtaaataacccaaatagggct

SEQ ID NO: 202093 - DNA, 22 bp, Artificial Sequence
  Synthetic oligonucleotide; TTG chr2 60505976 60505997 60505993 60505998 +
gtaaataacccaaatagggctt

SEQ ID NO: 202094 - DNA, 22 bp, Artificial Sequence
  Synthetic oligonucleotide; CTT chr2 60505998 60506019 60506015 60506020 +
tgcagggtatgggacaccacac

SEQ ID NO: 202095 - DNA, 22 bp, Artificial Sequence
  Synthetic oligonucleotide; TTT chr2 60505999 60506020 60506016 60506021 +
gcagggtatgggacaccacact

SEQ ID NO: 202096 - DNA, 22 bp, Artificial Sequence
  Synthetic oligonucleotide; TTG chr2 60506000 60506021 60506017 60506022 +
cagggtatgggacaccacacta

SEQ ID NO: 202097 - DNA, 22 bp, Artificial Sequence
  Synthetic oligonucleotide; CTA chr2 60506022 60506043 60506039 60506044 +
ggctttgcagcccgggtgaaac

SEQ ID NO: 202098 - DNA, 22 bp, Artificial Sequence
  Synthetic oligonucleotide; CTT chr2 60506027 60506048 60506044 60506049 +
tgcagcccgggtgaaaccagat

SEQ ID NO: 202099 - DNA, 22 bp, Artificial Sequence
  Synthetic oligonucleotide; TTT chr2 60506028 60506049 60506045 60506050 +
gcagcccgggtgaaaccagatg

SEQ ID NO: 202100 - DNA, 22 bp, Artificial Sequence
  Synthetic oligonucleotide; TTG chr2 60506029 60506050 60506046 60506051 +
cagcccgggtgaaaccagatgg

SEQ ID NO: 202101 - DNA, 22 bp, Artificial Sequence
  Synthetic oligonucleotide; CTC chr2 60506074 60506095 60506091 60506096 +
ataggcaagggatgttagcaca

SEQ ID NO: 202102 - DNA, 22 bp, Artificial Sequence
  Synthetic oligonucleotide; TTA chr2 60506091 60506112 60506108 60506113 +
gcacacctaaaaatcccctttc

SEQ ID NO: 202103 - DNA, 22 bp, Artificial Sequence
  Synthetic oligonucleotide; CTA chr2 60506100 60506121 60506117 60506122 +
aaaatcccctttcccagccatc

SEQ ID NO: 202104 - DNA, 22 bp, Artificial Sequence
  Synthetic oligonucleotide; CTT chr2 60506111 60506132 60506128 60506133 +
tcccagccatcctttgacaccc

SEQ ID NO: 202105 - DNA, 22 bp, Artificial Sequence
  Synthetic oligonucleotide; TTT chr2 60506112 60506133 60506129 60506134 +
cccagccatcctttgacaccca

SEQ ID NO: 202106 - DNA, 22 bp, Artificial Sequence
  Synthetic oligonucleotide; TTC chr2 60506113 60506134 60506130 60506135 +
ccagccatcctttgacacccac

SEQ ID NO: 202107 - DNA, 22 bp, Artificial Sequence
  Synthetic oligonucleotide; CTT chr2 60506125 60506146 60506142 60506147 +
tgacacccaccatagaaatcac

SEQ ID NO: 202108 - DNA, 22 bp, Artificial Sequence
  Synthetic oligonucleotide; TTT chr2 60506126 60506147 60506143 60506148 +
gacacccaccatagaaatcaca

SEQ ID NO: 202109 - DNA, 22 bp, Artificial Sequence
  Synthetic oligonucleotide; TTG chr2 60506127 60506148 60506144 60506149 +
acacccaccatagaaatcacag

SEQ ID NO: 202110 - DNA, 22 bp, Artificial Sequence
  Synthetic oligonucleotide; CTG chr2 60506170 60506191 60506187 60506192 +
ggcccaaaatagcctgtcctgt

SEQ ID NO: 202111 - DNA, 22 bp, Artificial Sequence
  Synthetic oligonucleotide; CTG chr2 60506186 60506207 60506203 60506208 +
tcctgttagccaaatgccagca

SEQ ID NO: 202112 - DNA, 22 bp, Artificial Sequence
  Synthetic oligonucleotide; CTG chr2 60506191 60506212 60506208 60506213 +
ttagccaaatgccagcactccc

SEQ ID NO: 202113 - DNA, 22 bp, Artificial Sequence
  Synthetic oligonucleotide; TTA chr2 60506194 60506215 60506211 60506216 +
gccaaatgccagcactcccact

SEQ ID NO: 202114 - DNA, 22 bp, Artificial Sequence
  Synthetic oligonucleotide; CTC chr2 60506211 60506232 60506228 60506233 +
ccactttctctgagggcatgga

SEQ ID NO: 202115 - DNA, 22 bp, Artificial Sequence
  Synthetic oligonucleotide; CTT chr2 60506217 60506238 60506234 60506239 +
tctctgagggcatggaggggag

SEQ ID NO: 202116 - DNA, 22 bp, Artificial Sequence
  Synthetic oligonucleotide; TTT chr2 60506218 60506239 60506235 60506240 +
ctctgagggcatggaggggagg

SEQ ID NO: 202117 - DNA, 22 bp, Artificial Sequence
  Synthetic oligonucleotide; TTC chr2 60506219 60506240 60506236 60506241 +
tctgagggcatggaggggaggc

SEQ ID NO: 202118 - DNA, 22 bp, Artificial Sequence
  Synthetic oligonucleotide; CTC chr2 60506221 60506242 60506238 60506243 +
tgagggcatggaggggaggcag

SEQ ID NO: 202119 - DNA, 22 bp, Artificial Sequence
  Synthetic oligonucleotide; CTG chr2 60506223 60506244 60506240 60506245 +
agggcatggaggggaggcagca

SEQ ID NO: 202120 - DNA, 22 bp, Artificial Sequence
  Synthetic oligonucleotide; CTA chr2 60506249 60506270 60506266 60506271 +
gggctctggcctcctcatttaa

SEQ ID NO: 202121 - DNA, 22 bp, Artificial Sequence
  Synthetic oligonucleotide; CTC chr2 60506255 60506276 60506272 60506277 +
tggcctcctcatttaattctct

SEQ ID NO: 202122 - DNA, 22 bp, Artificial Sequence
  Synthetic oligonucleotide; CTG chr2 60506257 60506278 60506274 60506279 +
gcctcctcatttaattctctct

SEQ ID NO: 202123 - DNA, 22 bp, Artificial Sequence
  Synthetic oligonucleotide; CTC chr2 60506262 60506283 60506279 60506284 +
ctcatttaattctctctgcatc

SEQ ID NO: 202124 - DNA, 22 bp, Artificial Sequence
  Synthetic oligonucleotide; CTC chr2 60506265 60506286 60506282 60506287 +
atttaattctctctgcatcaga

SEQ ID NO: 202125 - DNA, 22 bp, Artificial Sequence
  Synthetic oligonucleotide; TTT chr2 60506269 60506290 60506286 60506291 +
aattctctctgcatcagaggaa

SEQ ID NO: 202126 - DNA, 22 bp, Artificial Sequence
  Synthetic oligonucleotide; TTA chr2 60506270 60506291 60506287 60506292 +
attctctctgcatcagaggaag

SEQ ID NO: 202127 - DNA, 22 bp, Artificial Sequence
  Synthetic oligonucleotide; TTC chr2 60506274 60506295 60506291 60506296 +
tctctgcatcagaggaagagtc

SEQ ID NO: 202128 - DNA, 22 bp, Artificial Sequence
  Synthetic oligonucleotide; CTC chr2 60506276 60506297 60506293 60506298 +
tctgcatcagaggaagagtcac

SEQ ID NO: 202129 - DNA, 22 bp, Artificial Sequence
  Synthetic oligonucleotide; CTC chr2 60506278 60506299 60506295 60506300 +
tgcatcagaggaagagtcacct

SEQ ID NO: 202130 - DNA, 22 bp, Artificial Sequence
  Synthetic oligonucleotide; CTG chr2 60506280 60506301 60506297 60506302 +
catcagaggaagagtcaccttc

SEQ ID NO: 202131 - DNA, 22 bp, Artificial Sequence
  Synthetic oligonucleotide; CTT chr2 60506301 60506322 60506318 60506323 +
cacaggccagctgtggtctgac

SEQ ID NO: 202132 - DNA, 22 bp, Artificial Sequence
  Synthetic oligonucleotide; TTC chr2 60506302 60506323 60506319 60506324 +
acaggccagctgtggtctgact

SEQ ID NO: 202133 - DNA, 22 bp, Artificial Sequence
  Synthetic oligonucleotide; CTG chr2 60506314 60506335 60506331 60506336 +
tggtctgacttgccacatctaa

SEQ ID NO: 202134 - DNA, 22 bp, Artificial Sequence
  Synthetic oligonucleotide; CTG chr2 60506321 60506342 60506338 60506343 +
acttgccacatctaatgccacc

SEQ ID NO: 202135 - DNA, 22 bp, Artificial Sequence
  Synthetic oligonucleotide; CTT chr2 60506325 60506346 60506342 60506347 +
gccacatctaatgccaccaggc

SEQ ID NO: 202136 - DNA, 22 bp, Artificial Sequence
  Synthetic oligonucleotide; TTG chr2 60506326 60506347 60506343 60506348 +
ccacatctaatgccaccaggcc

SEQ ID NO: 202137 - DNA, 22 bp, Artificial Sequence
  Synthetic oligonucleotide; CTA chr2 60506335 60506356 60506352 60506357 +
atgccaccaggccctgccagcg

SEQ ID NO: 202138 - DNA, 22 bp, Artificial Sequence
  Synthetic oligonucleotide; CTG chr2 60506351 60506372 60506368 60506373 +
ccagcggcccccattctggtct

SEQ ID NO: 202139 - DNA, 22 bp, Artificial Sequence
  Synthetic oligonucleotide; TTC chr2 60506367 60506388 60506384 60506389 +
tggtctgtcaaacccctggaaa

SEQ ID NO: 202140 - DNA, 22 bp, Artificial Sequence
  Synthetic oligonucleotide; CTG chr2 60506369 60506390 60506386 60506391 +
gtctgtcaaacccctggaaaac

SEQ ID NO: 202141 - DNA, 22 bp, Artificial Sequence
  Synthetic oligonucleotide; CTG chr2 60506374 60506395 60506391 60506396 +
tcaaacccctggaaaacttcag

SEQ ID NO: 202142 - DNA, 22 bp, Artificial Sequence
  Synthetic oligonucleotide; CTG chr2 60506385 60506406 60506402 60506407 +
gaaaacttcagacagtgttcct

SEQ ID NO: 202143 - DNA, 22 bp, Artificial Sequence
  Synthetic oligonucleotide; CTT chr2 60506393 60506414 60506410 60506415 +
cagacagtgttcctcagatcca

SEQ ID NO: 202144 - DNA, 22 bp, Artificial Sequence
  Synthetic oligonucleotide; TTC chr2 60506394 60506415 60506411 60506416 +
agacagtgttcctcagatccag

SEQ ID NO: 202145 - DNA, 22 bp, Artificial Sequence
  Synthetic oligonucleotide; TTC chr2 60506405 60506426 60506422 60506427 +
ctcagatccaggacagagctgg

SEQ ID NO: 202146 - DNA, 22 bp, Artificial Sequence
  Synthetic oligonucleotide; CTC chr2 60506408 60506429 60506425 60506430 +
agatccaggacagagctggctc

SEQ ID NO: 202147 - DNA, 22 bp, Artificial Sequence
  Synthetic oligonucleotide; CTG chr2 60506426 60506447 60506443 60506448 +
gctcaggacgccacatgggtca

SEQ ID NO: 202148 - DNA, 22 bp, Artificial Sequence
  Synthetic oligonucleotide; CTC chr2 60506430 60506451 60506447 60506452 +
aggacgccacatgggtcaaccc

SEQ ID NO: 202149 - DNA, 22 bp, Artificial Sequence
  Synthetic oligonucleotide; CTC chr2 60506468 60506489 60506485 60506490 +
agaccctccaaggtgacaaaga

SEQ ID NO: 202150 - DNA, 22 bp, Artificial Sequence
  Synthetic oligonucleotide; CTC chr2 60506476 60506497 60506493 60506498 +
caaggtgacaaagacctcacta

SEQ ID NO: 202151 - DNA, 22 bp, Artificial Sequence
  Synthetic oligonucleotide; CTC chr2 60506494 60506515 60506511 60506516 +
actagactgtatctcatttttc

SEQ ID NO: 202152 - DNA, 22 bp, Artificial Sequence
  Synthetic oligonucleotide; CTA chr2 60506498 60506519 60506515 60506520 +
gactgtatctcatttttccagc

SEQ ID NO: 202153 - DNA, 22 bp, Artificial Sequence
  Synthetic oligonucleotide; CTG chr2 60506503 60506524 60506520 60506525 +
tatctcatttttccagcctcag

SEQ ID NO: 202154 - DNA, 22 bp, Artificial Sequence
  Synthetic oligonucleotide; CTC chr2 60506509 60506530 60506526 60506531 +
atttttccagcctcagtgagcc

SEQ ID NO: 202155 - DNA, 22 bp, Artificial Sequence
  Synthetic oligonucleotide; TTT chr2 60506513 60506534 60506530 60506535 +
ttccagcctcagtgagccggcc

SEQ ID NO: 202156 - DNA, 22 bp, Artificial Sequence
  Synthetic oligonucleotide; TTT chr2 60506514 60506535 60506531 60506536 +
tccagcctcagtgagccggccc

SEQ ID NO: 202157 - DNA, 22 bp, Artificial Sequence
  Synthetic oligonucleotide; TTT chr2 60506515 60506536 60506532 60506537 +
ccagcctcagtgagccggcccc

SEQ ID NO: 202158 - DNA, 22 bp, Artificial Sequence
  Synthetic oligonucleotide; TTC chr2 60506516 60506537 60506533 60506538 +
cagcctcagtgagccggcccca

SEQ ID NO: 202159 - DNA, 22 bp, Artificial Sequence
  Synthetic oligonucleotide; CTC chr2 60506523 60506544 60506540 60506545 +
agtgagccggccccagctggca

SEQ ID NO: 202160 - DNA, 22 bp, Artificial Sequence
  Synthetic oligonucleotide; CTG chr2 60506542 60506563 60506559 60506564 +
gcatgctgagtccaggaaagcc

SEQ ID NO: 202161 - DNA, 22 bp, Artificial Sequence
  Synthetic oligonucleotide; CTG chr2 60506550 60506571 60506567 60506572 +
agtccaggaaagccctggctat

SEQ ID NO: 202162 - DNA, 22 bp, Artificial Sequence
  Synthetic oligonucleotide; CTG chr2 60506567 60506588 60506584 60506589 +
gctatacaaaacacagcaccca

SEQ ID NO: 202163 - DNA, 22 bp, Artificial Sequence
  Synthetic oligonucleotide; CTA chr2 60506571 60506592 60506588 60506593 +
tacaaaacacagcacccacgtg

SEQ ID NO: 202164 - DNA, 22 bp, Artificial Sequence
  Synthetic oligonucleotide; CTT chr2 60506597 60506618 60506614 60506619 +
tgtgcatggctgcttagagggc

SEQ ID NO: 202165 - DNA, 22 bp, Artificial Sequence
  Synthetic oligonucleotide; TTT chr2 60506598 60506619 60506615 60506620 +
gtgcatggctgcttagagggct

SEQ ID NO: 202166 - DNA, 22 bp, Artificial Sequence
  Synthetic oligonucleotide; TTG chr2 60506599 60506620 60506616 60506621 +
tgcatggctgcttagagggcta

SEQ ID NO: 202167 - DNA, 22 bp, Artificial Sequence
  Synthetic oligonucleotide; CTG chr2 60506609 60506630 60506626 60506631 +
cttagagggctaatgataaagg

SEQ ID NO: 202168 - DNA, 22 bp, Artificial Sequence
  Synthetic oligonucleotide; CTT chr2 60506612 60506633 60506629 60506634 +
agagggctaatgataaaggcag

SEQ ID NO: 202169 - DNA, 22 bp, Artificial Sequence
  Synthetic oligonucleotide; TTA chr2 60506613 60506634 60506630 60506635 +
gagggctaatgataaaggcagc

SEQ ID NO: 202170 - DNA, 22 bp, Artificial Sequence
  Synthetic oligonucleotide; CTA chr2 60506621 60506642 60506638 60506643 +
atgataaaggcagctcactaag

SEQ ID NO: 202171 - DNA, 22 bp, Artificial Sequence
  Synthetic oligonucleotide; CTC chr2 60506637 60506658 60506654 60506659 +
actaagaaaacgaccgtgccca

SEQ ID NO: 202172 - DNA, 22 bp, Artificial Sequence
  Synthetic oligonucleotide; CTA chr2 60506641 60506662 60506658 60506663 +
agaaaacgaccgtgcccagcag

SEQ ID NO: 202173 - DNA, 22 bp, Artificial Sequence
  Synthetic oligonucleotide; CTC chr2 60506667 60506688 60506684 60506689 +
ctaaatggcgaaggcagcattt

SEQ ID NO: 202174 - DNA, 22 bp, Artificial Sequence
  Synthetic oligonucleotide; CTA chr2 60506670 60506691 60506687 60506692 +
aatggcgaaggcagcatttacc

SEQ ID NO: 202175 - DNA, 22 bp, Artificial Sequence
  Synthetic oligonucleotide; TTT chr2 60506689 60506710 60506706 60506711 +
accactgatgacagccccccgc

SEQ ID NO: 202176 - DNA, 22 bp, Artificial Sequence
  Synthetic oligonucleotide; TTA chr2 60506690 60506711 60506707 60506712 +
ccactgatgacagccccccgca

SEQ ID NO: 202177 - DNA, 22 bp, Artificial Sequence
  Synthetic oligonucleotide; CTG chr2 60506696 60506717 60506713 60506718 +
atgacagccccccgcatgtttc

SEQ ID NO: 202178 - DNA, 22 bp, Artificial Sequence
  Synthetic oligonucleotide; TTT chr2 60506717 60506738 60506734 60506739 +
cctcctaaacgcctgatatata

SEQ ID NO: 202179 - DNA, 22 bp, Artificial Sequence
  Synthetic oligonucleotide; TTC chr2 60506718 60506739 60506735 60506740 +
ctcctaaacgcctgatatatat

SEQ ID NO: 202180 - DNA, 22 bp, Artificial Sequence
  Synthetic oligonucleotide; CTC chr2 60506721 60506742 60506738 60506743 +
ctaaacgcctgatatatatcca

SEQ ID NO: 202181 - DNA, 22 bp, Artificial Sequence
  Synthetic oligonucleotide; CTA chr2 60506724 60506745 60506741 60506746 +
aacgcctgatatatatccattt

SEQ ID NO: 202182 - DNA, 22 bp, Artificial Sequence
  Synthetic oligonucleotide; CTG chr2 60506732 60506753 60506749 60506754 +
atatatatccatttttctgtca

SEQ ID NO: 202183 - DNA, 22 bp, Artificial Sequence
  Synthetic oligonucleotide; TTT chr2 60506746 60506767 60506763 60506768 +
ttctgtcagcaacctcaaataa

SEQ ID NO: 202184 - DNA, 22 bp, Artificial Sequence
  Synthetic oligonucleotide; TTT chr2 60506747 60506768 60506764 60506769 +
tctgtcagcaacctcaaataat

SEQ ID NO: 202185 - DNA, 22 bp, Artificial Sequence
  Synthetic oligonucleotide; TTT chr2 60506748 60506769 60506765 60506770 +
ctgtcagcaacctcaaataatg

SEQ ID NO: 202186 - DNA, 22 bp, Artificial Sequence
  Synthetic oligonucleotide; TTC chr2 60506749 60506770 60506766 60506771 +
tgtcagcaacctcaaataatgt

SEQ ID NO: 202187 - DNA, 22 bp, Artificial Sequence
  Synthetic oligonucleotide; CTG chr2 60506751 60506772 60506768 60506773 +
tcagcaacctcaaataatgtct

SEQ ID NO: 202188 - DNA, 22 bp, Artificial Sequence
  Synthetic oligonucleotide; CTC chr2 60506762 60506783 60506779 60506784 +
aaataatgtctataatgctgag

SEQ ID NO: 202189 - DNA, 22 bp, Artificial Sequence
  Synthetic oligonucleotide; CTA chr2 60506774 60506795 60506791 60506796 +
taatgctgagatttatacatgg

SEQ ID NO: 202190 - DNA, 22 bp, Artificial Sequence
  Synthetic oligonucleotide; CTG chr2 60506782 60506803 60506799 60506804 +
agatttatacatgggtacttat

SEQ ID NO: 202191 - DNA, 22 bp, Artificial Sequence
  Synthetic oligonucleotide; TTT chr2 60506788 60506809 60506805 60506810 +
atacatgggtacttataaatgt

SEQ ID NO: 202192 - DNA, 22 bp, Artificial Sequence
  Synthetic oligonucleotide; TTA chr2 60506789 60506810 60506806 60506811 +
tacatgggtacttataaatgtg

SEQ ID NO: 202193 - DNA, 22 bp, Artificial Sequence
  Synthetic oligonucleotide; CTT chr2 60506802 60506823 60506819 60506824 +
ataaatgtgatttcattatagc

SEQ ID NO: 202194 - DNA, 22 bp, Artificial Sequence
  Synthetic oligonucleotide; TTA chr2 60506803 60506824 60506820 60506825 +
taaatgtgatttcattatagcc

SEQ ID NO: 202195 - DNA, 22 bp, Artificial Sequence
  Synthetic oligonucleotide; TTT chr2 60506815 60506836 60506832 60506837 +
cattatagcctctgcaaaacta

SEQ ID NO: 202196 - DNA, 22 bp, Artificial Sequence
  Synthetic oligonucleotide; TTC chr2 60506816 60506837 60506833 60506838 +
attatagcctctgcaaaactac

SEQ ID NO: 202197 - DNA, 22 bp, Artificial Sequence
  Synthetic oligonucleotide; TTA chr2 60506820 60506841 60506837 60506842 +
tagcctctgcaaaactaccttt

SEQ ID NO: 202198 - DNA, 22 bp, Artificial Sequence
  Synthetic oligonucleotide; CTC chr2 60506827 60506848 60506844 60506849 +
tgcaaaactacctttccgccta

SEQ ID NO: 202199 - DNA, 22 bp, Artificial Sequence
  Synthetic oligonucleotide; CTG chr2 60506829 60506850 60506846 60506851 +
caaaactacctttccgcctaaa

SEQ ID NO: 202200 - DNA, 22 bp, Artificial Sequence
  Synthetic oligonucleotide; CTA chr2 60506837 60506858 60506854 60506859 +
cctttccgcctaaacattcaat

SEQ ID NO: 202201 - DNA, 22 bp, Artificial Sequence
  Synthetic oligonucleotide; CTT chr2 60506841 60506862 60506858 60506863 +
tccgcctaaacattcaattaat

SEQ ID NO: 202202 - DNA, 22 bp, Artificial Sequence
  Synthetic oligonucleotide; TTT chr2 60506842 60506863 60506859 60506864 +
ccgcctaaacattcaattaatg

SEQ ID NO: 202203 - DNA, 22 bp, Artificial Sequence
  Synthetic oligonucleotide; TTC chr2 60506843 60506864 60506860 60506865 +
cgcctaaacattcaattaatgt

SEQ ID NO: 202204 - DNA, 22 bp, Artificial Sequence
  Synthetic oligonucleotide; CTA chr2 60506849 60506870 60506866 60506871 +
aacattcaattaatgtaattaa

SEQ ID NO: 202205 - DNA, 22 bp, Artificial Sequence
  Synthetic oligonucleotide; TTC chr2 60506856 60506877 60506873 60506878 +
aattaatgtaattaaattgcta

SEQ ID NO: 202206 - DNA, 22 bp, Artificial Sequence
  Synthetic oligonucleotide; TTA chr2 60506861 60506882 60506878 60506883 +
atgtaattaaattgctacctga

SEQ ID NO: 202207 - DNA, 22 bp, Artificial Sequence
  Synthetic oligonucleotide; TTA chr2 60506870 60506891 60506887 60506892 +
aattgctacctgatggcattat

SEQ ID NO: 202208 - DNA, 22 bp, Artificial Sequence
  Synthetic oligonucleotide; TTG chr2 60506875 60506896 60506892 60506897 +
ctacctgatggcattatctaat

SEQ ID NO: 202209 - DNA, 22 bp, Artificial Sequence
  Synthetic oligonucleotide; CTA chr2 60506878 60506899 60506895 60506900 +
cctgatggcattatctaattta

SEQ ID NO: 202210 - DNA, 22 bp, Artificial Sequence
  Synthetic oligonucleotide; CTG chr2 60506882 60506903 60506899 60506904 +
atggcattatctaatttaactt

SEQ ID NO: 202211 - DNA, 22 bp, Artificial Sequence
  Synthetic oligonucleotide; TTA chr2 60506891 60506912 60506908 60506913 +
tctaatttaacttgggatccaa

SEQ ID NO: 202212 - DNA, 22 bp, Artificial Sequence
  Synthetic oligonucleotide; CTA chr2 60506895 60506916 60506912 60506917 +
atttaacttgggatccaaacta

SEQ ID NO: 202213 - DNA, 22 bp, Artificial Sequence
  Synthetic oligonucleotide; TTT chr2 60506899 60506920 60506916 60506921 +
aacttgggatccaaactattga

SEQ ID NO: 202214 - DNA, 22 bp, Artificial Sequence
  Synthetic oligonucleotide; TTA chr2 60506900 60506921 60506917 60506922 +
acttgggatccaaactattgaa

SEQ ID NO: 202215 - DNA, 22 bp, Artificial Sequence
  Synthetic oligonucleotide; CTT chr2 60506904 60506925 60506921 60506926 +
gggatccaaactattgaaaagc

SEQ ID NO: 202216 - DNA, 22 bp, Artificial Sequence
  Synthetic oligonucleotide; TTG chr2 60506905 60506926 60506922 60506927 +
ggatccaaactattgaaaagca

SEQ ID NO: 202217 - DNA, 22 bp, Artificial Sequence
  Synthetic oligonucleotide; CTA chr2 60506917 60506938 60506934 60506939 +
ttgaaaagcatgtgccttttaa

SEQ ID NO: 202218 - DNA, 22 bp, Artificial Sequence
  Synthetic oligonucleotide; TTG chr2 60506920 60506941 60506937 60506942 +
aaaagcatgtgccttttaacac

SEQ ID NO: 202219 - DNA, 22 bp, Artificial Sequence
  Synthetic oligonucleotide; CTT chr2 60506935 60506956 60506952 60506957 +
ttaacaccctgactggtaaggc

SEQ ID NO: 202220 - DNA, 22 bp, Artificial Sequence
  Synthetic oligonucleotide; TTT chr2 60506936 60506957 60506953 60506958 +
taacaccctgactggtaaggca

SEQ ID NO: 202221 - DNA, 22 bp, Artificial Sequence
  Synthetic oligonucleotide; TTT chr2 60506937 60506958 60506954 60506959 +
aacaccctgactggtaaggcat

SEQ ID NO: 202222 - DNA, 22 bp, Artificial Sequence
  Synthetic oligonucleotide; TTA chr2 60506938 60506959 60506955 60506960 +
acaccctgactggtaaggcatg

SEQ ID NO: 202223 - DNA, 22 bp, Artificial Sequence
  Synthetic oligonucleotide; CTG chr2 60506946 60506967 60506963 60506968 +
actggtaaggcatgtgatgaac

SEQ ID NO: 202224 - DNA, 22 bp, Artificial Sequence
  Synthetic oligonucleotide; CTG chr2 60506950 60506971 60506967 60506972 +
gtaaggcatgtgatgaacagag

SEQ ID NO: 202225 - DNA, 22 bp, Artificial Sequence
  Synthetic oligonucleotide; CTA chr2 60506975 60506996 60506992 60506997 +
taaacatgttggcgtaactgag

SEQ ID NO: 202226 - DNA, 22 bp, Artificial Sequence
  Synthetic oligonucleotide; TTG chr2 60506986 60507007 60507003 60507008 +
gcgtaactgagctgtttaaaaa

SEQ ID NO: 202227 - DNA, 22 bp, Artificial Sequence
  Synthetic oligonucleotide; CTG chr2 60506995 60507016 60507012 60507017 +
agctgtttaaaaataaattagc

SEQ ID NO: 202228 - DNA, 22 bp, Artificial Sequence
  Synthetic oligonucleotide; CTG chr2 60507000 60507021 60507017 60507022 +
tttaaaaataaattagcaaact

SEQ ID NO: 202229 - DNA, 22 bp, Artificial Sequence
  Synthetic oligonucleotide; TTT chr2 60507003 60507024 60507020 60507025 +
aaaaataaattagcaaactata

SEQ ID NO: 202230 - DNA, 22 bp, Artificial Sequence
  Synthetic oligonucleotide; TTA chr2 60507004 60507025 60507021 60507026 +
aaaataaattagcaaactataa

SEQ ID NO: 202231 - DNA, 22 bp, Artificial Sequence
  Synthetic oligonucleotide; TTA chr2 60507015 60507036 60507032 60507037 +
gcaaactataaaaataaacagt

SEQ ID NO: 202232 - DNA, 22 bp, Artificial Sequence
  Synthetic oligonucleotide; CTA chr2 60507023 60507044 60507040 60507045 +
taaaaataaacagtaacgtaca

SEQ ID NO: 202233 - DNA, 22 bp, Artificial Sequence
  Synthetic oligonucleotide; CTC chr2 60507054 60507075 60507071 60507076 +
aattatgaactaactctaattt

SEQ ID NO: 202234 - DNA, 22 bp, Artificial Sequence
  Synthetic oligonucleotide; TTA chr2 60507059 60507080 60507076 60507081 +
tgaactaactctaatttttgtt

SEQ ID NO: 202235 - DNA, 22 bp, Artificial Sequence
  Synthetic oligonucleotide; CTA chr2 60507066 60507087 60507083 60507088 +
actctaatttttgttctgaaat

SEQ ID NO: 202236 - DNA, 22 bp, Artificial Sequence
  Synthetic oligonucleotide; CTC chr2 60507070 60507091 60507087 60507092 +
taatttttgttctgaaatactg

SEQ ID NO: 202237 - DNA, 22 bp, Artificial Sequence
  Synthetic oligonucleotide; CTA chr2 60507072 60507093 60507089 60507094 +
atttttgttctgaaatactgtc

SEQ ID NO: 202238 - DNA, 22 bp, Artificial Sequence
  Synthetic oligonucleotide; TTT chr2 60507076 60507097 60507093 60507098 +
ttgttctgaaatactgtctttg

SEQ ID NO: 202239 - DNA, 22 bp, Artificial Sequence
  Synthetic oligonucleotide; TTT chr2 60507077 60507098 60507094 60507099 +
tgttctgaaatactgtctttga

SEQ ID NO: 202240 - DNA, 22 bp, Artificial Sequence
  Synthetic oligonucleotide; TTT chr2 60507078 60507099 60507095 60507100 +
gttctgaaatactgtctttgac

SEQ ID NO: 202241 - DNA, 22 bp, Artificial Sequence
  Synthetic oligonucleotide; TTG chr2 60507079 60507100 60507096 60507101 +
ttctgaaatactgtctttgacc

SEQ ID NO: 202242 - DNA, 22 bp, Artificial Sequence
  Synthetic oligonucleotide; TTC chr2 60507082 60507103 60507099 60507104 +
tgaaatactgtctttgacctta

SEQ ID NO: 202243 - DNA, 22 bp, Artificial Sequence
  Synthetic oligonucleotide; CTG chr2 60507084 60507105 60507101 60507106 +
aaatactgtctttgaccttagt

SEQ ID NO: 202244 - DNA, 22 bp, Artificial Sequence
  Synthetic oligonucleotide; CTG chr2 60507092 60507113 60507109 60507114 +
tctttgaccttagtcataaaca

SEQ ID NO: 202245 - DNA, 22 bp, Artificial Sequence
  Synthetic oligonucleotide; CTT chr2 60507096 60507117 60507113 60507118 +
tgaccttagtcataaacaagca

SEQ ID NO: 202246 - DNA, 22 bp, Artificial Sequence
  Synthetic oligonucleotide; TTT chr2 60507097 60507118 60507114 60507119 +
gaccttagtcataaacaagcac

SEQ ID NO: 202247 - DNA, 22 bp, Artificial Sequence
  Synthetic oligonucleotide; TTG chr2 60507098 60507119 60507115 60507120 +
accttagtcataaacaagcact

SEQ ID NO: 202248 - DNA, 22 bp, Artificial Sequence
  Synthetic oligonucleotide; CTT chr2 60507103 60507124 60507120 60507125 +
agtcataaacaagcactattaa

SEQ ID NO: 202249 - DNA, 22 bp, Artificial Sequence
  Synthetic oligonucleotide; TTA chr2 60507104 60507125 60507121 60507126 +
gtcataaacaagcactattaaa

SEQ ID NO: 202250 - DNA, 22 bp, Artificial Sequence
  Synthetic oligonucleotide; CTA chr2 60507121 60507142 60507138 60507143 +
ttaaaaaaacataatatcccaa

SEQ ID NO: 202251 - DNA, 22 bp, Artificial Sequence
  Synthetic oligonucleotide; TTA chr2 60507124 60507145 60507141 60507146 +
aaaaaacataatatcccaacag

SEQ ID NO: 202252 - DNA, 22 bp, Artificial Sequence
  Synthetic oligonucleotide; TTA chr2 60507164 60507185 60507181 60507186 +
aatgctcttctagctctgcaga

SEQ ID NO: 202253 - DNA, 22 bp, Artificial Sequence
  Synthetic oligonucleotide; CTC chr2 60507171 60507192 60507188 60507193 +
ttctagctctgcagaatgcaaa

SEQ ID NO: 202254 - DNA, 22 bp, Artificial Sequence
  Synthetic oligonucleotide; CTT chr2 60507173 60507194 60507190 60507195 +
ctagctctgcagaatgcaaagc

SEQ ID NO: 202255 - DNA, 22 bp, Artificial Sequence
  Synthetic oligonucleotide; TTC chr2 60507174 60507195 60507191 60507196 +
tagctctgcagaatgcaaagca

SEQ ID NO: 202256 - DNA, 22 bp, Artificial Sequence
  Synthetic oligonucleotide; CTA chr2 60507176 60507197 60507193 60507198 +
gctctgcagaatgcaaagcaag

SEQ ID NO: 202257 - DNA, 22 bp, Artificial Sequence
  Synthetic oligonucleotide; CTC chr2 60507180 60507201 60507197 60507202 +
tgcagaatgcaaagcaagacaa

SEQ ID NO: 202258 - DNA, 22 bp, Artificial Sequence
  Synthetic oligonucleotide; CTG chr2 60507182 60507203 60507199 60507204 +
cagaatgcaaagcaagacaagg

SEQ ID NO: 202259 - DNA, 22 bp, Artificial Sequence
  Synthetic oligonucleotide; CTT chr2 60507401 60507422 60507418 60507423 +
gcctttcttgaaaagctagaaa

SEQ ID NO: 202260 - DNA, 22 bp, Artificial Sequence
  Synthetic oligonucleotide; TTG chr2 60507402 60507423 60507419 60507424 +
cctttcttgaaaagctagaaaa

SEQ ID NO: 202261 - DNA, 22 bp, Artificial Sequence
  Synthetic oligonucleotide; CTT chr2 60507406 60507427 60507423 60507428 +
tcttgaaaagctagaaaactgt

SEQ ID NO: 202262 - DNA, 22 bp, Artificial Sequence
  Synthetic oligonucleotide; TTT chr2 60507407 60507428 60507424 60507429 +
cttgaaaagctagaaaactgtg

SEQ ID NO: 202263 - DNA, 22 bp, Artificial Sequence
  Synthetic oligonucleotide; TTC chr2 60507408 60507429 60507425 60507430 +
ttgaaaagctagaaaactgtgt

SEQ ID NO: 202264 - DNA, 22 bp, Artificial Sequence
  Synthetic oligonucleotide; CTT chr2 60507410 60507431 60507427 60507432 +
gaaaagctagaaaactgtgtcc

SEQ ID NO: 202265 - DNA, 22 bp, Artificial Sequence
  Synthetic oligonucleotide; TTG chr2 60507411 60507432 60507428 60507433 +
aaaagctagaaaactgtgtcca

SEQ ID NO: 202266 - DNA, 22 bp, Artificial Sequence
  Synthetic oligonucleotide; CTA chr2 60507419 60507440 60507436 60507441 +
gaaaactgtgtccaaaacctac

SEQ ID NO: 202267 - DNA, 22 bp, Artificial Sequence
  Synthetic oligonucleotide; CTG chr2 60507427 60507448 60507444 60507449 +
tgtccaaaacctacaaagacta

SEQ ID NO: 202268 - DNA, 22 bp, Artificial Sequence
  Synthetic oligonucleotide; CTA chr2 60507440 60507461 60507457 60507462 +
caaagactattgtgctcttgtt

SEQ ID NO: 202269 - DNA, 22 bp, Artificial Sequence
  Synthetic oligonucleotide; CTA chr2 60507449 60507470 60507466 60507471 +
ttgtgctcttgttgacttgaag

SEQ ID NO: 202270 - DNA, 22 bp, Artificial Sequence
  Synthetic oligonucleotide; TTG chr2 60507452 60507473 60507469 60507474 +
tgctcttgttgacttgaagctg

SEQ ID NO: 202271 - DNA, 22 bp, Artificial Sequence
  Synthetic oligonucleotide; CTC chr2 60507457 60507478 60507474 60507479 +
ttgttgacttgaagctgcttcc

SEQ ID NO: 202272 - DNA, 22 bp, Artificial Sequence
  Synthetic oligonucleotide; CTT chr2 60507459 60507480 60507476 60507481 +
gttgacttgaagctgcttccgt

SEQ ID NO: 202273 - DNA, 22 bp, Artificial Sequence
  Synthetic oligonucleotide; TTG chr2 60507460 60507481 60507477 60507482 +
ttgacttgaagctgcttccgtt

SEQ ID NO: 202274 - DNA, 22 bp, Artificial Sequence
  Synthetic oligonucleotide; TTG chr2 60507463 60507484 60507480 60507485 +
acttgaagctgcttccgttcaa

SEQ ID NO: 202275 - DNA, 22 bp, Artificial Sequence
  Synthetic oligonucleotide; CTT chr2 60507467 60507488 60507484 60507489 +
gaagctgcttccgttcaagcca

SEQ ID NO: 202276 - DNA, 22 bp, Artificial Sequence
  Synthetic oligonucleotide; TTG chr2 60507468 60507489 60507485 60507490 +
aagctgcttccgttcaagccag

SEQ ID NO: 202277 - DNA, 22 bp, Artificial Sequence
  Synthetic oligonucleotide; CTG chr2 60507474 60507495 60507491 60507496 +
cttccgttcaagccagaaaagt

SEQ ID NO: 202278 - DNA, 22 bp, Artificial Sequence
  Synthetic oligonucleotide; CTT chr2 60507477 60507498 60507494 60507499 +
ccgttcaagccagaaaagttaa

SEQ ID NO: 202279 - DNA, 22 bp, Artificial Sequence
  Synthetic oligonucleotide; TTC chr2 60507478 60507499 60507495 60507500 +
cgttcaagccagaaaagttaaa

SEQ ID NO: 202280 - DNA, 22 bp, Artificial Sequence
  Synthetic oligonucleotide; TTC chr2 60507483 60507504 60507500 60507505 +
aagccagaaaagttaaaacctt

SEQ ID NO: 202281 - DNA, 22 bp, Artificial Sequence
  Synthetic oligonucleotide; TTA chr2 60507498 60507519 60507515 60507520 +
aaaccttgtgaagtgcttttac

SEQ ID NO: 202282 - DNA, 22 bp, Artificial Sequence
  Synthetic oligonucleotide; CTT chr2 60507505 60507526 60507522 60507527 +
gtgaagtgcttttacattttca

SEQ ID NO: 202283 - DNA, 22 bp, Artificial Sequence
  Synthetic oligonucleotide; TTG chr2 60507506 60507527 60507523 60507528 +
tgaagtgcttttacattttcag

SEQ ID NO: 202284 - DNA, 22 bp, Artificial Sequence
  Synthetic oligonucleotide; CTT chr2 60507516 60507537 60507533 60507538 +
ttacattttcagatgttttgga

SEQ ID NO: 202285 - DNA, 22 bp, Artificial Sequence
  Synthetic oligonucleotide; TTT chr2 60507517 60507538 60507534 60507539 +
tacattttcagatgttttggag

SEQ ID NO: 202286 - DNA, 22 bp, Artificial Sequence
  Synthetic oligonucleotide; TTT chr2 60507518 60507539 60507535 60507540 +
acattttcagatgttttggagt

SEQ ID NO: 202287 - DNA, 22 bp, Artificial Sequence
  Synthetic oligonucleotide; TTA chr2 60507519 60507540 60507536 60507541 +
cattttcagatgttttggagtc

SEQ ID NO: 202288 - DNA, 22 bp, Artificial Sequence
  Synthetic oligonucleotide; TTT chr2 60507524 60507545 60507541 60507546 +
tcagatgttttggagtctctca

SEQ ID NO: 202289 - DNA, 22 bp, Artificial Sequence
  Synthetic oligonucleotide; TTT chr2 60507525 60507546 60507542 60507547 +
cagatgttttggagtctctcaa

SEQ ID NO: 202290 - DNA, 22 bp, Artificial Sequence
  Synthetic oligonucleotide; TTC chr2 60507526 60507547 60507543 60507548 +
agatgttttggagtctctcaag

SEQ ID NO: 202291 - DNA, 22 bp, Artificial Sequence
  Synthetic oligonucleotide; TTT chr2 60507534 60507555 60507551 60507556 +
tggagtctctcaagaaatgagg

SEQ ID NO: 202292 - DNA, 22 bp, Artificial Sequence
  Synthetic oligonucleotide; TTT chr2 60507535 60507556 60507552 60507557 +
ggagtctctcaagaaatgagga

SEQ ID NO: 202293 - DNA, 22 bp, Artificial Sequence
  Synthetic oligonucleotide; TTG chr2 60507536 60507557 60507553 60507558 +
gagtctctcaagaaatgaggac

SEQ ID NO: 202294 - DNA, 22 bp, Artificial Sequence
  Synthetic oligonucleotide; CTC chr2 60507543 60507564 60507560 60507565 +
tcaagaaatgaggacaggcaag

SEQ ID NO: 202295 - DNA, 22 bp, Artificial Sequence
  Synthetic oligonucleotide; CTC chr2 60507545 60507566 60507562 60507567 +
aagaaatgaggacaggcaaggg

SEQ ID NO: 202296 - DNA, 22 bp, Artificial Sequence
  Synthetic oligonucleotide; CTG chr2 60507576 60507597 60507593 60507598 +
tttccacatgcagctgtttcaa

SEQ ID NO: 202297 - DNA, 22 bp, Artificial Sequence
  Synthetic oligonucleotide; TTT chr2 60507579 60507600 60507596 60507601 +
ccacatgcagctgtttcaacag

SEQ ID NO: 202298 - DNA, 22 bp, Artificial Sequence
  Synthetic oligonucleotide; TTC chr2 60507580 60507601 60507597 60507602 +
cacatgcagctgtttcaacagc

SEQ ID NO: 202299 - DNA, 22 bp, Artificial Sequence
  Synthetic oligonucleotide; CTG chr2 60507592 60507613 60507609 60507614 +
tttcaacagctcactgcataac

SEQ ID NO: 202300 - DNA, 22 bp, Artificial Sequence
  Synthetic oligonucleotide; TTT chr2 60507595 60507616 60507612 60507617 +
caacagctcactgcataacaga

SEQ ID NO: 202301 - DNA, 22 bp, Artificial Sequence
  Synthetic oligonucleotide; TTC chr2 60507596 60507617 60507613 60507618 +
aacagctcactgcataacagag

SEQ ID NO: 202302 - DNA, 22 bp, Artificial Sequence
  Synthetic oligonucleotide; CTC chr2 60507604 60507625 60507621 60507626 +
actgcataacagagtctcttac

SEQ ID NO: 202303 - DNA, 22 bp, Artificial Sequence
  Synthetic oligonucleotide; CTG chr2 60507608 60507629 60507625 60507630 +
cataacagagtctcttacacag

SEQ ID NO: 202304 - DNA, 22 bp, Artificial Sequence
  Synthetic oligonucleotide; CTC chr2 60507622 60507643 60507639 60507644 +
ttacacagggctgcctccgcac

SEQ ID NO: 202305 - DNA, 22 bp, Artificial Sequence
  Synthetic oligonucleotide; CTT chr2 60507624 60507645 60507641 60507646 +
acacagggctgcctccgcacct

SEQ ID NO: 202306 - DNA, 22 bp, Artificial Sequence
  Synthetic oligonucleotide; TTA chr2 60507625 60507646 60507642 60507647 +
cacagggctgcctccgcacctg

SEQ ID NO: 202307 - DNA, 22 bp, Artificial Sequence
  Synthetic oligonucleotide; CTG chr2 60507635 60507656 60507652 60507657 +
cctccgcacctgagctgagctt

SEQ ID NO: 202308 - DNA, 22 bp, Artificial Sequence
  Synthetic oligonucleotide; CTC chr2 60507639 60507660 60507656 60507661 +
cgcacctgagctgagcttgctg

SEQ ID NO: 202309 - DNA, 22 bp, Artificial Sequence
  Synthetic oligonucleotide; CTG chr2 60507647 60507668 60507664 60507669 +
agctgagcttgctgtcctaagt

SEQ ID NO: 202310 - DNA, 22 bp, Artificial Sequence
  Synthetic oligonucleotide; CTG chr2 60507652 60507673 60507669 60507674 +
agcttgctgtcctaagtcggct

SEQ ID NO: 202311 - DNA, 22 bp, Artificial Sequence
  Synthetic oligonucleotide; CTT chr2 60507657 60507678 60507674 60507679 +
gctgtcctaagtcggctactgc

SEQ ID NO: 202312 - DNA, 22 bp, Artificial Sequence
  Synthetic oligonucleotide; TTG chr2 60507658 60507679 60507675 60507680 +
ctgtcctaagtcggctactgct

SEQ ID NO: 202313 - DNA, 22 bp, Artificial Sequence
  Synthetic oligonucleotide; CTG chr2 60507661 60507682 60507678 60507683 +
tcctaagtcggctactgcttct

SEQ ID NO: 202314 - DNA, 22 bp, Artificial Sequence
  Synthetic oligonucleotide; CTA chr2 60507666 60507687 60507683 60507688 +
agtcggctactgcttctaagtc

SEQ ID NO: 202315 - DNA, 22 bp, Artificial Sequence
  Synthetic oligonucleotide; CTA chr2 60507675 60507696 60507692 60507697 +
ctgcttctaagtccccagcttt

SEQ ID NO: 202316 - DNA, 22 bp, Artificial Sequence
  Synthetic oligonucleotide; CTG chr2 60507678 60507699 60507695 60507700 +
cttctaagtccccagcttttct

SEQ ID NO: 202317 - DNA, 22 bp, Artificial Sequence
  Synthetic oligonucleotide; CTT chr2 60507681 60507702 60507698 60507703 +
ctaagtccccagcttttctaag

SEQ ID NO: 202318 - DNA, 22 bp, Artificial Sequence
  Synthetic oligonucleotide; TTC chr2 60507682 60507703 60507699 60507704 +
taagtccccagcttttctaaga

SEQ ID NO: 202319 - DNA, 22 bp, Artificial Sequence
  Synthetic oligonucleotide; CTA chr2 60507684 60507705 60507701 60507706 +
agtccccagcttttctaagaca

SEQ ID NO: 202320 - DNA, 22 bp, Artificial Sequence
  Synthetic oligonucleotide; CTT chr2 60507696 60507717 60507713 60507718 +
ttctaagacatatggcagaaat

SEQ ID NO: 202321 - DNA, 22 bp, Artificial Sequence
  Synthetic oligonucleotide; TTT chr2 60507697 60507718 60507714 60507719 +
tctaagacatatggcagaaatg

SEQ ID NO: 202322 - DNA, 22 bp, Artificial Sequence
  Synthetic oligonucleotide; TTT chr2 60507698 60507719 60507715 60507720 +
ctaagacatatggcagaaatgt

SEQ ID NO: 202323 - DNA, 22 bp, Artificial Sequence
  Synthetic oligonucleotide; TTC chr2 60507699 60507720 60507716 60507721 +
taagacatatggcagaaatgtg

SEQ ID NO: 202324 - DNA, 22 bp, Artificial Sequence
  Synthetic oligonucleotide; CTA chr2 60507701 60507722 60507718 60507723 +
agacatatggcagaaatgtgga

SEQ ID NO: 202325 - DNA, 22 bp, Artificial Sequence
  Synthetic oligonucleotide; TTG chr2 60507728 60507749 60507745 60507750 +
tcttccaaacagcacaagacag

SEQ ID NO: 202326 - DNA, 22 bp, Artificial Sequence
  Synthetic oligonucleotide; CTT chr2 60507732 60507753 60507749 60507754 +
ccaaacagcacaagacagaaag

SEQ ID NO: 202327 - DNA, 22 bp, Artificial Sequence
  Synthetic oligonucleotide; TTC chr2 60507733 60507754 60507750 60507755 +
caaacagcacaagacagaaagc

SEQ ID NO: 202328 - DNA, 22 bp, Artificial Sequence
  Synthetic oligonucleotide; CTG chr2 60507810 60507831 60507827 60507832 +
ttgaaactgtatacaggacacg

SEQ ID NO: 202329 - DNA, 22 bp, Artificial Sequence
  Synthetic oligonucleotide; TTG chr2 60507813 60507834 60507830 60507835 +
aaactgtatacaggacacgtct

SEQ ID NO: 202330 - DNA, 22 bp, Artificial Sequence
  Synthetic oligonucleotide; CTG chr2 60507819 60507840 60507836 60507841 +
tatacaggacacgtcttcacag

SEQ ID NO: 202331 - DNA, 22 bp, Artificial Sequence
  Synthetic oligonucleotide; CTT chr2 60507836 60507857 60507853 60507858 +
cacagtaatccaatgctcctgt

SEQ ID NO: 202332 - DNA, 22 bp, Artificial Sequence
  Synthetic oligonucleotide; TTC chr2 60507837 60507858 60507854 60507859 +
acagtaatccaatgctcctgta

SEQ ID NO: 202333 - DNA, 22 bp, Artificial Sequence
  Synthetic oligonucleotide; CTC chr2 60507854 60507875 60507871 60507876 +
ctgtaacaaaggacagcatact

SEQ ID NO: 202334 - DNA, 22 bp, Artificial Sequence
  Synthetic oligonucleotide; CTG chr2 60507857 60507878 60507874 60507879 +
taacaaaggacagcatactatg

SEQ ID NO: 202335 - DNA, 22 bp, Artificial Sequence
  Synthetic oligonucleotide; CTA chr2 60507877 60507898 60507894 60507899 +
tgggataattactatggattat

SEQ ID NO: 202336 - DNA, 22 bp, Artificial Sequence
  Synthetic oligonucleotide; TTA chr2 60507888 60507909 60507905 60507910 +
ctatggattattattacagttt

SEQ ID NO: 202337 - DNA, 22 bp, Artificial Sequence
  Synthetic oligonucleotide; CTA chr2 60507891 60507912 60507908 60507913 +
tggattattattacagtttcta

SEQ ID NO: 202338 - DNA, 22 bp, Artificial Sequence
  Synthetic oligonucleotide; TTA chr2 60507898 60507919 60507915 60507920 +
ttattacagtttctaaagcaaa

SEQ ID NO: 202339 - DNA, 22 bp, Artificial Sequence
  Synthetic oligonucleotide; TTA chr2 60507901 60507922 60507918 60507923 +
ttacagtttctaaagcaaaaga

SEQ ID NO: 202340 - DNA, 22 bp, Artificial Sequence
  Synthetic oligonucleotide; TTA chr2 60507904 60507925 60507921 60507926 +
cagtttctaaagcaaaagaaca

SEQ ID NO: 202341 - DNA, 22 bp, Artificial Sequence
  Synthetic oligonucleotide; TTT chr2 60507910 60507931 60507927 60507932 +
ctaaagcaaaagaacaaaaaaa

SEQ ID NO: 202342 - DNA, 22 bp, Artificial Sequence
  Synthetic oligonucleotide; TTC chr2 60507911 60507932 60507928 60507933 +
taaagcaaaagaacaaaaaaaa

SEQ ID NO: 202343 - DNA, 22 bp, Artificial Sequence
  Synthetic oligonucleotide; CTA chr2 60507913 60507934 60507930 60507935 +
aagcaaaagaacaaaaaaaaat

SEQ ID NO: 202344 - DNA, 22 bp, Artificial Sequence
  Synthetic oligonucleotide; TTC chr2 60507937 60507958 60507954 60507959 +
acaaaagacatattacacacgc

SEQ ID NO: 202345 - DNA, 22 bp, Artificial Sequence
  Synthetic oligonucleotide; TTA chr2 60507952 60507973 60507969 60507974 +
cacacgcagatttctaaagctt

SEQ ID NO: 202346 - DNA, 22 bp, Artificial Sequence
  Synthetic oligonucleotide; TTT chr2 60507965 60507986 60507982 60507987 +
ctaaagctttaaaatcatatgg

SEQ ID NO: 202347 - DNA, 22 bp, Artificial Sequence
  Synthetic oligonucleotide; TTC chr2 60507966 60507987 60507983 60507988 +
taaagctttaaaatcatatggt

SEQ ID NO: 202348 - DNA, 22 bp, Artificial Sequence
  Synthetic oligonucleotide; CTA chr2 60507968 60507989 60507985 60507990 +
aagctttaaaatcatatggtct

SEQ ID NO: 202349 - DNA, 22 bp, Artificial Sequence
  Synthetic oligonucleotide; CTT chr2 60507974 60507995 60507991 60507996 +
taaaatcatatggtcttcggtg

SEQ ID NO: 202350 - DNA, 22 bp, Artificial Sequence
  Synthetic oligonucleotide; TTT chr2 60507975 60507996 60507992 60507997 +
aaaatcatatggtcttcggtgt

SEQ ID NO: 202351 - DNA, 22 bp, Artificial Sequence
  Synthetic oligonucleotide; TTA chr2 60507976 60507997 60507993 60507998 +
aaatcatatggtcttcggtgtt

SEQ ID NO: 202352 - DNA, 22 bp, Artificial Sequence
  Synthetic oligonucleotide; CTT chr2 60507991 60508012 60508008 60508013 +
cggtgttggttcctatggggtt

SEQ ID NO: 202353 - DNA, 22 bp, Artificial Sequence
  Synthetic oligonucleotide; TTC chr2 60507992 60508013 60508009 60508014 +
ggtgttggttcctatggggtta

SEQ ID NO: 202354 - DNA, 22 bp, Artificial Sequence
  Synthetic oligonucleotide; TTG chr2 60507999 60508020 60508016 60508021 +
gttcctatggggttacggataa

SEQ ID NO: 202355 - DNA, 22 bp, Artificial Sequence
  Synthetic oligonucleotide; TTC chr2 60508003 60508024 60508020 60508025 +
ctatggggttacggataatgcc

SEQ ID NO: 202356 - DNA, 22 bp, Artificial Sequence
  Synthetic oligonucleotide; CTA chr2 60508006 60508027 60508023 60508028 +
tggggttacggataatgcccta

SEQ ID NO: 202357 - DNA, 22 bp, Artificial Sequence
  Synthetic oligonucleotide; TTA chr2 60508014 60508035 60508031 60508036 +
cggataatgccctaactgagca

SEQ ID NO: 202358 - DNA, 22 bp, Artificial Sequence
  Synthetic oligonucleotide; CTA chr2 60508028 60508049 60508045 60508050 +
actgagcacgacagatgcaaac

SEQ ID NO: 202359 - DNA, 22 bp, Artificial Sequence
  Synthetic oligonucleotide; CTG chr2 60508032 60508053 60508049 60508054 +
agcacgacagatgcaaacacaa

SEQ ID NO: 202360 - DNA, 22 bp, Artificial Sequence
  Synthetic oligonucleotide; CTG chr2 60508076 60508097 60508093 60508098 +
aaattctctcatgtcatggtgc

SEQ ID NO: 202361 - DNA, 22 bp, Artificial Sequence
  Synthetic oligonucleotide; TTC chr2 60508082 60508103 60508099 60508104 +
tctcatgtcatggtgcttactg

SEQ ID NO: 202362 - DNA, 22 bp, Artificial Sequence
  Synthetic oligonucleotide; CTC chr2 60508084 60508105 60508101 60508106 +
tcatgtcatggtgcttactgcc

SEQ ID NO: 202363 - DNA, 22 bp, Artificial Sequence
  Synthetic oligonucleotide; CTC chr2 60508086 60508107 60508103 60508108 +
atgtcatggtgcttactgccct

SEQ ID NO: 202364 - DNA, 22 bp, Artificial Sequence
  Synthetic oligonucleotide; CTT chr2 60508100 60508121 60508117 60508122 +
actgccctttctttcacaaaca

SEQ ID NO: 202365 - DNA, 22 bp, Artificial Sequence
  Synthetic oligonucleotide; TTA chr2 60508101 60508122 60508118 60508123 +
ctgccctttctttcacaaacaa

SEQ ID NO: 202366 - DNA, 22 bp, Artificial Sequence
  Synthetic oligonucleotide; CTG chr2 60508104 60508125 60508121 60508126 +
ccctttctttcacaaacaaaag

SEQ ID NO: 202367 - DNA, 22 bp, Artificial Sequence
  Synthetic oligonucleotide; CTT chr2 60508109 60508130 60508126 60508131 +
tctttcacaaacaaaagtagtt

SEQ ID NO: 202368 - DNA, 22 bp, Artificial Sequence
  Synthetic oligonucleotide; TTT chr2 60508110 60508131 60508127 60508132 +
ctttcacaaacaaaagtagttg

SEQ ID NO: 202369 - DNA, 22 bp, Artificial Sequence
  Synthetic oligonucleotide; TTC chr2 60508111 60508132 60508128 60508133 +
tttcacaaacaaaagtagttga

SEQ ID NO: 202370 - DNA, 22 bp, Artificial Sequence
  Synthetic oligonucleotide; CTT chr2 60508113 60508134 60508130 60508135 +
tcacaaacaaaagtagttgagc

SEQ ID NO: 202371 - DNA, 22 bp, Artificial Sequence
  Synthetic oligonucleotide; TTT chr2 60508114 60508135 60508131 60508136 +
cacaaacaaaagtagttgagca

SEQ ID NO: 202372 - DNA, 22 bp, Artificial Sequence
  Synthetic oligonucleotide; TTC chr2 60508115 60508136 60508132 60508137 +
acaaacaaaagtagttgagcaa

SEQ ID NO: 202373 - DNA, 22 bp, Artificial Sequence
  Synthetic oligonucleotide; TTG chr2 60508132 60508153 60508149 60508154 +
agcaacagctaagtagttattc

SEQ ID NO: 202374 - DNA, 22 bp, Artificial Sequence
  Synthetic oligonucleotide; CTA chr2 60508143 60508164 60508160 60508165 +
agtagttattcatctcaaagaa

SEQ ID NO: 202375 - DNA, 22 bp, Artificial Sequence
  Synthetic oligonucleotide; TTA chr2 60508151 60508172 60508168 60508173 +
ttcatctcaaagaaccaaccta

SEQ ID NO: 202376 - DNA, 22 bp, Artificial Sequence
  Synthetic oligonucleotide; TTC chr2 60508154 60508175 60508171 60508176 +
atctcaaagaaccaacctaaaa

SEQ ID NO: 202377 - DNA, 22 bp, Artificial Sequence
  Synthetic oligonucleotide; CTC chr2 60508159 60508180 60508176 60508181 +
aaagaaccaacctaaaattctg

SEQ ID NO: 202378 - DNA, 22 bp, Artificial Sequence
  Synthetic oligonucleotide; CTA chr2 60508173 60508194 60508190 60508195 +
aaattctgacaggcccagcact

SEQ ID NO: 202379 - DNA, 22 bp, Artificial Sequence
  Synthetic oligonucleotide; TTC chr2 60508179 60508200 60508196 60508201 +
tgacaggcccagcactgtctac

SEQ ID NO: 202380 - DNA, 22 bp, Artificial Sequence
  Synthetic oligonucleotide; CTG chr2 60508181 60508202 60508198 60508203 +
acaggcccagcactgtctaccc

SEQ ID NO: 202381 - DNA, 22 bp, Artificial Sequence
  Synthetic oligonucleotide; CTG chr2 60508196 60508217 60508213 60508218 +
tctacccccacccccaaacaac

SEQ ID NO: 202382 - DNA, 22 bp, Artificial Sequence
  Synthetic oligonucleotide; CTA chr2 60508200 60508221 60508217 60508222 +
cccccacccccaaacaacaaca

SEQ ID NO: 202383 - DNA, 22 bp, Artificial Sequence
  Synthetic oligonucleotide; TTA chr2 60508236 60508257 60508253 60508258 +
cacaaataaaaactaggaggaa

SEQ ID NO: 202384 - DNA, 22 bp, Artificial Sequence
  Synthetic oligonucleotide; CTA chr2 60508251 60508272 60508268 60508273 +
ggaggaagctcaaactcatcca

SEQ ID NO: 202385 - DNA, 22 bp, Artificial Sequence
  Synthetic oligonucleotide; CTC chr2 60508262 60508283 60508279 60508284 +
aaactcatccacacttggttca

SEQ ID NO: 202386 - DNA, 22 bp, Artificial Sequence
  Synthetic oligonucleotide; CTC chr2 60508268 60508289 60508285 60508290 +
atccacacttggttcaggacac

SEQ ID NO: 202387 - DNA, 22 bp, Artificial Sequence
  Synthetic oligonucleotide; CTT chr2 60508278 60508299 60508295 60508300 +
ggttcaggacacagggaaggcc

SEQ ID NO: 202388 - DNA, 22 bp, Artificial Sequence
  Synthetic oligonucleotide; TTG chr2 60508279 60508300 60508296 60508301 +
gttcaggacacagggaaggcct

SEQ ID NO: 202389 - DNA, 22 bp, Artificial Sequence
  Synthetic oligonucleotide; TTC chr2 60508283 60508304 60508300 60508305 +
aggacacagggaaggcctgatg

SEQ ID NO: 202390 - DNA, 22 bp, Artificial Sequence
  Synthetic oligonucleotide; CTG chr2 60508302 60508323 60508319 60508324 +
atgtgaaagaggagacagagaa

SEQ ID NO: 202391 - DNA, 22 bp, Artificial Sequence
  Synthetic oligonucleotide; CTT chr2 60508328 60508349 60508345 60508350 +
cctgggtgtgcagaattacacc

SEQ ID NO: 202392 - DNA, 22 bp, Artificial Sequence
  Synthetic oligonucleotide; TTC chr2 60508329 60508350 60508346 60508351 +
ctgggtgtgcagaattacaccc

SEQ ID NO: 202393 - DNA, 22 bp, Artificial Sequence
  Synthetic oligonucleotide; CTG chr2 60508332 60508353 60508349 60508354 +
ggtgtgcagaattacaccccag

SEQ ID NO: 202394 - DNA, 22 bp, Artificial Sequence
  Synthetic oligonucleotide; TTA chr2 60508346 60508367 60508363 60508368 +
caccccaggccacactccctgc

SEQ ID NO: 202395 - DNA, 22 bp, Artificial Sequence
  Synthetic oligonucleotide; CTC chr2 60508363 60508384 60508380 60508385 +
cctgcaggggccacaggagcaa

SEQ ID NO: 202396 - DNA, 22 bp, Artificial Sequence
  Synthetic oligonucleotide; CTG chr2 60508367 60508388 60508384 60508389 +
caggggccacaggagcaagcac

SEQ ID NO: 202397 - DNA, 22 bp, Artificial Sequence
  Synthetic oligonucleotide; CTG chr2 60508391 60508412 60508408 60508413 +
cagccgggtccctgagtctgac

SEQ ID NO: 202398 - DNA, 22 bp, Artificial Sequence
  Synthetic oligonucleotide; CTG chr2 60508405 60508426 60508422 60508427 +
agtctgacttttacccaaacag

SEQ ID NO: 202399 - DNA, 22 bp, Artificial Sequence
  Synthetic oligonucleotide; CTG chr2 60508411 60508432 60508428 60508433 +
acttttacccaaacagggggtt

SEQ ID NO: 202400 - DNA, 22 bp, Artificial Sequence
  Synthetic oligonucleotide; CTT chr2 60508415 60508436 60508432 60508437 +
ttacccaaacagggggttgcca

SEQ ID NO: 202401 - DNA, 22 bp, Artificial Sequence
  Synthetic oligonucleotide; TTT chr2 60508416 60508437 60508433 60508438 +
tacccaaacagggggttgccag

SEQ ID NO: 202402 - DNA, 22 bp, Artificial Sequence
  Synthetic oligonucleotide; TTT chr2 60508417 60508438 60508434 60508439 +
acccaaacagggggttgccagt

SEQ ID NO: 202403 - DNA, 22 bp, Artificial Sequence
  Synthetic oligonucleotide; TTA chr2 60508418 60508439 60508435 60508440 +
cccaaacagggggttgccagtt

SEQ ID NO: 202404 - DNA, 22 bp, Artificial Sequence
  Synthetic oligonucleotide; TTG chr2 60508434 60508455 60508451 60508456 +
ccagttgctgcgagacaaatat

SEQ ID NO: 202405 - DNA, 22 bp, Artificial Sequence
  Synthetic oligonucleotide; TTG chr2 60508441 60508462 60508458 60508463 +
ctgcgagacaaatatccctagc

SEQ ID NO: 202406 - DNA, 22 bp, Artificial Sequence
  Synthetic oligonucleotide; CTG chr2 60508444 60508465 60508461 60508466 +
cgagacaaatatccctagcaca

SEQ ID NO: 202407 - DNA, 22 bp, Artificial Sequence
  Synthetic oligonucleotide; CTA chr2 60508461 60508482 60508478 60508483 +
gcacattacctagttggcaaag

SEQ ID NO: 202408 - DNA, 22 bp, Artificial Sequence
  Synthetic oligonucleotide; TTA chr2 60508469 60508490 60508486 60508491 +
cctagttggcaaaggaatgcaa

SEQ ID NO: 202409 - DNA, 22 bp, Artificial Sequence
  Synthetic oligonucleotide; CTA chr2 60508473 60508494 60508490 60508495 +
gttggcaaaggaatgcaactgg

SEQ ID NO: 202410 - DNA, 22 bp, Artificial Sequence
  Synthetic oligonucleotide; TTG chr2 60508477 60508498 60508494 60508499 +
gcaaaggaatgcaactgggagg

SEQ ID NO: 202411 - DNA, 22 bp, Artificial Sequence
  Synthetic oligonucleotide; CTG chr2 60508494 60508515 60508511 60508516 +
ggaggttctggaatagcacagt

SEQ ID NO: 202412 - DNA, 22 bp, Artificial Sequence
  Synthetic oligonucleotide; TTC chr2 60508502 60508523 60508519 60508524 +
tggaatagcacagtgtggaact

SEQ ID NO: 202413 - DNA, 22 bp, Artificial Sequence
  Synthetic oligonucleotide; CTG chr2 60508504 60508525 60508521 60508526 +
gaatagcacagtgtggaactgc

SEQ ID NO: 202414 - DNA, 22 bp, Artificial Sequence
  Synthetic oligonucleotide; CTG chr2 60508525 60508546 60508542 60508547 +
cactggacttttcctgttctga

SEQ ID NO: 202415 - DNA, 22 bp, Artificial Sequence
  Synthetic oligonucleotide; CTG chr2 60508530 60508551 60508547 60508552 +
gacttttcctgttctgaagagg

SEQ ID NO: 202416 - DNA, 22 bp, Artificial Sequence
  Synthetic oligonucleotide; CTT chr2 60508535 60508556 60508552 60508557 +
ttcctgttctgaagaggacttt

SEQ ID NO: 202417 - DNA, 22 bp, Artificial Sequence
  Synthetic oligonucleotide; TTT chr2 60508536 60508557 60508553 60508558 +
tcctgttctgaagaggactttg

SEQ ID NO: 202418 - DNA, 22 bp, Artificial Sequence
  Synthetic oligonucleotide; TTT chr2 60508537 60508558 60508554 60508559 +
cctgttctgaagaggactttgc

SEQ ID NO: 202419 - DNA, 22 bp, Artificial Sequence
  Synthetic oligonucleotide; TTC chr2 60508538 60508559 60508555 60508560 +
ctgttctgaagaggactttgct

SEQ ID NO: 202420 - DNA, 22 bp, Artificial Sequence
  Synthetic oligonucleotide; CTG chr2 60508541 60508562 60508558 60508563 +
ttctgaagaggactttgctttc

SEQ ID NO: 202421 - DNA, 22 bp, Artificial Sequence
  Synthetic oligonucleotide; TTC chr2 60508544 60508565 60508561 60508566 +
tgaagaggactttgctttcctc

SEQ ID NO: 202422 - DNA, 22 bp, Artificial Sequence
  Synthetic oligonucleotide; CTG chr2 60508546 60508567 60508563 60508568 +
aagaggactttgctttcctccg

SEQ ID NO: 202423 - DNA, 22 bp, Artificial Sequence
  Synthetic oligonucleotide; CTT chr2 60508556 60508577 60508573 60508578 +
tgctttcctccgggatgtaaag

SEQ ID NO: 202424 - DNA, 22 bp, Artificial Sequence
  Synthetic oligonucleotide; TTT chr2 60508557 60508578 60508574 60508579 +
gctttcctccgggatgtaaagc

SEQ ID NO: 202425 - DNA, 22 bp, Artificial Sequence
  Synthetic oligonucleotide; TTG chr2 60508558 60508579 60508575 60508580 +
ctttcctccgggatgtaaagca

SEQ ID NO: 202426 - DNA, 22 bp, Artificial Sequence
  Synthetic oligonucleotide; CTT chr2 60508561 60508582 60508578 60508583 +
tcctccgggatgtaaagcattt

SEQ ID NO: 202427 - DNA, 22 bp, Artificial Sequence
  Synthetic oligonucleotide; TTT chr2 60508562 60508583 60508579 60508584 +
cctccgggatgtaaagcatttg

SEQ ID NO: 202428 - DNA, 22 bp, Artificial Sequence
  Synthetic oligonucleotide; TTC chr2 60508563 60508584 60508580 60508585 +
ctccgggatgtaaagcatttgg

SEQ ID NO: 202429 - DNA, 22 bp, Artificial Sequence
  Synthetic oligonucleotide; CTC chr2 60508566 60508587 60508583 60508588 +
cgggatgtaaagcatttggcag

SEQ ID NO: 202430 - DNA, 22 bp, Artificial Sequence
  Synthetic oligonucleotide; TTT chr2 60508583 60508604 60508600 60508605 +
ggcaggcaaaggacaaaactta

SEQ ID NO: 202431 - DNA, 22 bp, Artificial Sequence
  Synthetic oligonucleotide; TTG chr2 60508584 60508605 60508601 60508606 +
gcaggcaaaggacaaaacttac

SEQ ID NO: 202432 - DNA, 22 bp, Artificial Sequence
  Synthetic oligonucleotide; CTT chr2 60508604 60508625 60508621 60508626 +
acctcaggtactatggcaaact

SEQ ID NO: 202433 - DNA, 22 bp, Artificial Sequence
  Synthetic oligonucleotide; TTA chr2 60508605 60508626 60508622 60508627 +
cctcaggtactatggcaaactg

SEQ ID NO: 202434 - DNA, 22 bp, Artificial Sequence
  Synthetic oligonucleotide; CTC chr2 60508609 60508630 60508626 60508631 +
aggtactatggcaaactggcca

SEQ ID NO: 202435 - DNA, 22 bp, Artificial Sequence
  Synthetic oligonucleotide; CTA chr2 60508617 60508638 60508634 60508639 +
tggcaaactggccaaagagaag

SEQ ID NO: 202436 - DNA, 22 bp, Artificial Sequence
  Synthetic oligonucleotide; CTG chr2 60508627 60508648 60508644 60508649 +
gccaaagagaagcgttgctagg

SEQ ID NO: 202437 - DNA, 22 bp, Artificial Sequence
  Synthetic oligonucleotide; TTG chr2 60508644 60508665 60508661 60508666 +
ctaggagaatggacacggcagg

SEQ ID NO: 202438 - DNA, 22 bp, Artificial Sequence
  Synthetic oligonucleotide; CTA chr2 60508647 60508668 60508664 60508669 +
ggagaatggacacggcaggaaa

SEQ ID NO: 202439 - DNA, 22 bp, Artificial Sequence
  Synthetic oligonucleotide; CTC chr2 60508676 60508697 60508693 60508698 +
agcttggcccaggaagaagctg

SEQ ID NO: 202440 - DNA, 22 bp, Artificial Sequence
  Synthetic oligonucleotide; CTT chr2 60508681 60508702 60508698 60508703 +
ggcccaggaagaagctggcgct

SEQ ID NO: 202441 - DNA, 22 bp, Artificial Sequence
  Synthetic oligonucleotide; TTG chr2 60508682 60508703 60508699 60508704 +
gcccaggaagaagctggcgctc

SEQ ID NO: 202442 - DNA, 22 bp, Artificial Sequence
  Synthetic oligonucleotide; CTG chr2 60508698 60508719 60508715 60508720 +
gcgctcagctacaggggccgtg

SEQ ID NO: 202443 - DNA, 22 bp, Artificial Sequence
  Synthetic oligonucleotide; CTC chr2 60508704 60508725 60508721 60508726 +
agctacaggggccgtgggaata

SEQ ID NO: 202444 - DNA, 22 bp, Artificial Sequence
  Synthetic oligonucleotide; CTA chr2 60508709 60508730 60508726 60508731 +
caggggccgtgggaatagctgg

SEQ ID NO: 202445 - DNA, 22 bp, Artificial Sequence
  Synthetic oligonucleotide; CTG chr2 60508730 60508751 60508747 60508752 +
gaggcctgtgcatttccctgag

SEQ ID NO: 202446 - DNA, 22 bp, Artificial Sequence
  Synthetic oligonucleotide; CTG chr2 60508738 60508759 60508755 60508760 +
tgcatttccctgagggtctcct

SEQ ID NO: 202447 - DNA, 22 bp, Artificial Sequence
  Synthetic oligonucleotide; TTT chr2 60508745 60508766 60508762 60508767 +
ccctgagggtctccttggcgac

SEQ ID NO: 202448 - DNA, 22 bp, Artificial Sequence
  Synthetic oligonucleotide; TTC chr2 60508746 60508767 60508763 60508768 +
cctgagggtctccttggcgaca

SEQ ID NO: 202449 - DNA, 22 bp, Artificial Sequence
  Synthetic oligonucleotide; CTG chr2 60508750 60508771 60508767 60508772 +
agggtctccttggcgacagggc

SEQ ID NO: 202450 - DNA, 22 bp, Artificial Sequence
  Synthetic oligonucleotide; CTC chr2 60508758 60508779 60508775 60508780 +
cttggcgacagggctggacctt

SEQ ID NO: 202451 - DNA, 22 bp, Artificial Sequence
  Synthetic oligonucleotide; CTT chr2 60508761 60508782 60508778 60508783 +
ggcgacagggctggacctttgc

SEQ ID NO: 202452 - DNA, 22 bp, Artificial Sequence
  Synthetic oligonucleotide; TTG chr2 60508762 60508783 60508779 60508784 +
gcgacagggctggacctttgca

SEQ ID NO: 202453 - DNA, 22 bp, Artificial Sequence
  Synthetic oligonucleotide; CTG chr2 60508774 60508795 60508791 60508796 +
gacctttgcactggcagcctgg

SEQ ID NO: 202454 - DNA, 22 bp, Artificial Sequence
  Synthetic oligonucleotide; CTT chr2 60508780 60508801 60508797 60508802 +
tgcactggcagcctggactctt

SEQ ID NO: 202455 - DNA, 22 bp, Artificial Sequence
  Synthetic oligonucleotide; TTT chr2 60508781 60508802 60508798 60508803 +
gcactggcagcctggactcttc

SEQ ID NO: 202456 - DNA, 22 bp, Artificial Sequence
  Synthetic oligonucleotide; TTG chr2 60508782 60508803 60508799 60508804 +
cactggcagcctggactcttct

SEQ ID NO: 202457 - DNA, 22 bp, Artificial Sequence
  Synthetic oligonucleotide; CTG chr2 60508787 60508808 60508804 60508809 +
gcagcctggactcttctctgag

SEQ ID NO: 202458 - DNA, 22 bp, Artificial Sequence
  Synthetic oligonucleotide; CTG chr2 60508795 60508816 60508812 60508817 +
gactcttctctgagctccccct

SEQ ID NO: 202459 - DNA, 22 bp, Artificial Sequence
  Synthetic oligonucleotide; CTC chr2 60508800 60508821 60508817 60508822 +
ttctctgagctcccccttgggt

SEQ ID NO: 202460 - DNA, 22 bp, Artificial Sequence
  Synthetic oligonucleotide; CTT chr2 60508802 60508823 60508819 60508824 +
ctctgagctcccccttgggtta

SEQ ID NO: 202461 - DNA, 22 bp, Artificial Sequence
  Synthetic oligonucleotide; TTC chr2 60508803 60508824 60508820 60508825 +
tctgagctcccccttgggttac

SEQ ID NO: 202462 - DNA, 22 bp, Artificial Sequence
  Synthetic oligonucleotide; CTC chr2 60508805 60508826 60508822 60508827 +
tgagctcccccttgggttacct

SEQ ID NO: 202463 - DNA, 22 bp, Artificial Sequence
  Synthetic oligonucleotide; CTG chr2 60508807 60508828 60508824 60508829 +
agctcccccttgggttacctat

SEQ ID NO: 202464 - DNA, 22 bp, Artificial Sequence
  Synthetic oligonucleotide; CTC chr2 60508812 60508833 60508829 60508834 +
ccccttgggttacctatgattc

SEQ ID NO: 202465 - DNA, 22 bp, Artificial Sequence
  Synthetic oligonucleotide; CTT chr2 60508818 60508839 60508835 60508840 +
gggttacctatgattccagaag

SEQ ID NO: 202466 - DNA, 22 bp, Artificial Sequence
  Synthetic oligonucleotide; TTG chr2 60508819 60508840 60508836 60508841 +
ggttacctatgattccagaaga

SEQ ID NO: 202467 - DNA, 22 bp, Artificial Sequence
  Synthetic oligonucleotide; TTA chr2 60508824 60508845 60508841 60508846 +
cctatgattccagaagagtttg

SEQ ID NO: 202468 - DNA, 22 bp, Artificial Sequence
  Synthetic oligonucleotide; CTA chr2 60508828 60508849 60508845 60508850 +
tgattccagaagagtttgttct

SEQ ID NO: 202469 - DNA, 22 bp, Artificial Sequence
  Synthetic oligonucleotide; TTC chr2 60508834 60508855 60508851 60508856 +
cagaagagtttgttctacatgt

SEQ ID NO: 202470 - DNA, 22 bp, Artificial Sequence
  Synthetic oligonucleotide; TTT chr2 60508845 60508866 60508862 60508867 +
gttctacatgtggcaaagccag

SEQ ID NO: 202471 - DNA, 22 bp, Artificial Sequence
  Synthetic oligonucleotide; TTG chr2 60508846 60508867 60508863 60508868 +
ttctacatgtggcaaagccagc

SEQ ID NO: 202472 - DNA, 22 bp, Artificial Sequence
  Synthetic oligonucleotide; TTC chr2 60508849 60508870 60508866 60508871 +
tacatgtggcaaagccagcacc

SEQ ID NO: 202473 - DNA, 22 bp, Artificial Sequence
  Synthetic oligonucleotide; CTA chr2 60508851 60508872 60508868 60508873 +
catgtggcaaagccagcaccat

SEQ ID NO: 202474 - DNA, 22 bp, Artificial Sequence
  Synthetic oligonucleotide; CTA chr2 60508895 60508916 60508912 60508917 +
aggcctaccttgagggatgtta

SEQ ID NO: 202475 - DNA, 22 bp, Artificial Sequence
  Synthetic oligonucleotide; CTA chr2 60508902 60508923 60508919 60508924 +
ccttgagggatgttaaacttac

SEQ ID NO: 202476 - DNA, 22 bp, Artificial Sequence
  Synthetic oligonucleotide; CTT chr2 60508906 60508927 60508923 60508928 +
gagggatgttaaacttacgccc

SEQ ID NO: 202477 - DNA, 22 bp, Artificial Sequence
  Synthetic oligonucleotide; TTG chr2 60508907 60508928 60508924 60508929 +
agggatgttaaacttacgccct

SEQ ID NO: 202478 - DNA, 22 bp, Artificial Sequence
  Synthetic oligonucleotide; TTA chr2 60508917 60508938 60508934 60508939 +
aacttacgccctacccactgct

SEQ ID NO: 202479 - DNA, 22 bp, Artificial Sequence
  Synthetic oligonucleotide; CTT chr2 60508922 60508943 60508939 60508944 +
acgccctacccactgctactta

SEQ ID NO: 202480 - DNA, 22 bp, Artificial Sequence
  Synthetic oligonucleotide; TTA chr2 60508923 60508944 60508940 60508945 +
cgccctacccactgctacttaa

SEQ ID NO: 202481 - DNA, 22 bp, Artificial Sequence
  Synthetic oligonucleotide; CTA chr2 60508930 60508951 60508947 60508952 +
cccactgctacttaaggtgtct

SEQ ID NO: 202482 - DNA, 22 bp, Artificial Sequence
  Synthetic oligonucleotide; CTG chr2 60508937 60508958 60508954 60508959 +
ctacttaaggtgtcttttgaat

SEQ ID NO: 202483 - DNA, 22 bp, Artificial Sequence
  Synthetic oligonucleotide; CTA chr2 60508940 60508961 60508957 60508962 +
cttaaggtgtcttttgaatcct

SEQ ID NO: 202484 - DNA, 22 bp, Artificial Sequence
  Synthetic oligonucleotide; CTT chr2 60508943 60508964 60508960 60508965 +
aaggtgtcttttgaatcctgag

SEQ ID NO: 202485 - DNA, 22 bp, Artificial Sequence
  Synthetic oligonucleotide; TTA chr2 60508944 60508965 60508961 60508966 +
aggtgtcttttgaatcctgagg

SEQ ID NO: 202486 - DNA, 22 bp, Artificial Sequence
  Synthetic oligonucleotide; CTT chr2 60508953 60508974 60508970 60508975 +
ttgaatcctgaggaccaaggag

SEQ ID NO: 202487 - DNA, 22 bp, Artificial Sequence
  Synthetic oligonucleotide; TTT chr2 60508954 60508975 60508971 60508976 +
tgaatcctgaggaccaaggagc

SEQ ID NO: 202488 - DNA, 22 bp, Artificial Sequence
  Synthetic oligonucleotide; TTT chr2 60508955 60508976 60508972 60508977 +
gaatcctgaggaccaaggagct

SEQ ID NO: 202489 - DNA, 22 bp, Artificial Sequence
  Synthetic oligonucleotide; TTG chr2 60508956 60508977 60508973 60508978 +
aatcctgaggaccaaggagctc

SEQ ID NO: 202490 - DNA, 22 bp, Artificial Sequence
  Synthetic oligonucleotide; CTG chr2 60508963 60508984 60508980 60508985 +
aggaccaaggagctctcctatg

SEQ ID NO: 202491 - DNA, 22 bp, Artificial Sequence
  Synthetic oligonucleotide; CTC chr2 60508978 60508999 60508995 60509000 +
tcctatgacaaggaacctgtca

SEQ ID NO: 202492 - DNA, 22 bp, Artificial Sequence
  Synthetic oligonucleotide; CTC chr2 60508980 60509001 60508997 60509002 +
ctatgacaaggaacctgtcact

SEQ ID NO: 202493 - DNA, 22 bp, Artificial Sequence
  Synthetic oligonucleotide; CTA chr2 60508983 60509004 60509000 60509005 +
tgacaaggaacctgtcactggt

SEQ ID NO: 202494 - DNA, 22 bp, Artificial Sequence
  Synthetic oligonucleotide; CTG chr2 60508997 60509018 60509014 60509019 +
tcactggttcttctgtgattgc

SEQ ID NO: 202495 - DNA, 22 bp, Artificial Sequence
  Synthetic oligonucleotide; CTG chr2 60509003 60509024 60509020 60509025 +
gttcttctgtgattgctaaagc

SEQ ID NO: 202496 - DNA, 22 bp, Artificial Sequence
  Synthetic oligonucleotide; TTC chr2 60509007 60509028 60509024 60509029 +
ttctgtgattgctaaagcctag

SEQ ID NO: 202497 - DNA, 22 bp, Artificial Sequence
  Synthetic oligonucleotide; CTT chr2 60509009 60509030 60509026 60509031 +
ctgtgattgctaaagcctagag

SEQ ID NO: 202498 - DNA, 22 bp, Artificial Sequence
  Synthetic oligonucleotide; TTC chr2 60509010 60509031 60509027 60509032 +
tgtgattgctaaagcctagagg

SEQ ID NO: 202499 - DNA, 22 bp, Artificial Sequence
  Synthetic oligonucleotide; CTG chr2 60509012 60509033 60509029 60509034 +
tgattgctaaagcctagaggac

SEQ ID NO: 202500 - DNA, 22 bp, Artificial Sequence
  Synthetic oligonucleotide; TTG chr2 60509018 60509039 60509035 60509040 +
ctaaagcctagaggacctcctc

SEQ ID NO: 202501 - DNA, 22 bp, Artificial Sequence
  Synthetic oligonucleotide; CTA chr2 60509021 60509042 60509038 60509043 +
aagcctagaggacctcctccaa

SEQ ID NO: 202502 - DNA, 22 bp, Artificial Sequence
  Synthetic oligonucleotide; CTA chr2 60509028 60509049 60509045 60509050 +
gaggacctcctccaaagaaaag

SEQ ID NO: 202503 - DNA, 22 bp, Artificial Sequence
  Synthetic oligonucleotide; CTC chr2 60509037 60509058 60509054 60509059 +
ctccaaagaaaagtggctcaga

SEQ ID NO: 202504 - DNA, 22 bp, Artificial Sequence
  Synthetic oligonucleotide; CTC chr2 60509040 60509061 60509057 60509062 +
caaagaaaagtggctcagacag

SEQ ID NO: 202505 - DNA, 22 bp, Artificial Sequence
  Synthetic oligonucleotide; CTC chr2 60509056 60509077 60509073 60509078 +
agacagaaacactgactcttat

SEQ ID NO: 202506 - DNA, 22 bp, Artificial Sequence
  Synthetic oligonucleotide; CTG chr2 60509070 60509091 60509087 60509092 +
actcttatttctcatcagactc

SEQ ID NO: 202507 - DNA, 22 bp, Artificial Sequence
  Synthetic oligonucleotide; CTC chr2 60509074 60509095 60509091 60509096 +
ttatttctcatcagactccgaa

SEQ ID NO: 202508 - DNA, 22 bp, Artificial Sequence
  Synthetic oligonucleotide; CTT chr2 60509076 60509097 60509093 60509098 +
atttctcatcagactccgaaat

SEQ ID NO: 202509 - DNA, 22 bp, Artificial Sequence
  Synthetic oligonucleotide; TTA chr2 60509077 60509098 60509094 60509099 +
tttctcatcagactccgaaatc

SEQ ID NO: 202510 - DNA, 22 bp, Artificial Sequence
  Synthetic oligonucleotide; TTT chr2 60509080 60509101 60509097 60509102 +
ctcatcagactccgaaatcaca

SEQ ID NO: 202511 - DNA, 22 bp, Artificial Sequence
  Synthetic oligonucleotide; TTC chr2 60509081 60509102 60509098 60509103 +
tcatcagactccgaaatcacag

SEQ ID NO: 202512 - DNA, 22 bp, Artificial Sequence
  Synthetic oligonucleotide; CTC chr2 60509083 60509104 60509100 60509105 +
atcagactccgaaatcacaggc

SEQ ID NO: 202513 - DNA, 22 bp, Artificial Sequence
  Synthetic oligonucleotide; CTC chr2 60509092 60509113 60509109 60509114 +
cgaaatcacaggcttctggtct

SEQ ID NO: 202514 - DNA, 22 bp, Artificial Sequence
  Synthetic oligonucleotide; CTT chr2 60509107 60509128 60509124 60509129 +
ctggtctaaagattcaagctga

SEQ ID NO: 202515 - DNA, 22 bp, Artificial Sequence
  Synthetic oligonucleotide; TTC chr2 60509108 60509129 60509125 60509130 +
tggtctaaagattcaagctgag

SEQ ID NO: 202516 - DNA, 22 bp, Artificial Sequence
  Synthetic oligonucleotide; CTG chr2 60509110 60509131 60509127 60509132 +
gtctaaagattcaagctgagaa

SEQ ID NO: 202517 - DNA, 22 bp, Artificial Sequence
  Synthetic oligonucleotide; CTA chr2 60509115 60509136 60509132 60509137 +
aagattcaagctgagaaacaag

SEQ ID NO: 202518 - DNA, 22 bp, Artificial Sequence
  Synthetic oligonucleotide; TTC chr2 60509122 60509143 60509139 60509144 +
aagctgagaaacaagaaagcaa

SEQ ID NO: 202519 - DNA, 22 bp, Artificial Sequence
  Synthetic oligonucleotide; CTG chr2 60509128 60509149 60509145 60509150 +
agaaacaagaaagcaatttgtt

SEQ ID NO: 202520 - DNA, 22 bp, Artificial Sequence
  Synthetic oligonucleotide; TTT chr2 60509147 60509168 60509164 60509169 +
gtttgattcaggcccttgcaaa

SEQ ID NO: 202521 - DNA, 22 bp, Artificial Sequence
  Synthetic oligonucleotide; TTG chr2 60509148 60509169 60509165 60509170 +
tttgattcaggcccttgcaaat

SEQ ID NO: 202522 - DNA, 22 bp, Artificial Sequence
  Synthetic oligonucleotide; TTT chr2 60509151 60509172 60509168 60509173 +
gattcaggcccttgcaaattac

SEQ ID NO: 202523 - DNA, 22 bp, Artificial Sequence
  Synthetic oligonucleotide; TTG chr2 60509152 60509173 60509169 60509174 +
attcaggcccttgcaaattacc

SEQ ID NO: 202524 - DNA, 22 bp, Artificial Sequence
  Synthetic oligonucleotide; TTC chr2 60509156 60509177 60509173 60509178 +
aggcccttgcaaattacccccc

SEQ ID NO: 202525 - DNA, 22 bp, Artificial Sequence
  Synthetic oligonucleotide; CTT chr2 60509164 60509185 60509181 60509186 +
gcaaattaccccccaataattt

SEQ ID NO: 202526 - DNA, 22 bp, Artificial Sequence
  Synthetic oligonucleotide; TTG chr2 60509165 60509186 60509182 60509187 +
caaattaccccccaataattta

SEQ ID NO: 202527 - DNA, 22 bp, Artificial Sequence
  Synthetic oligonucleotide; TTA chr2 60509172 60509193 60509189 60509194 +
ccccccaataatttacttggtc

SEQ ID NO: 202528 - DNA, 22 bp, Artificial Sequence
  Synthetic oligonucleotide; TTT chr2 60509186 60509207 60509203 60509208 +
acttggtctcagctttggctgg

SEQ ID NO: 202529 - DNA, 22 bp, Artificial Sequence
  Synthetic oligonucleotide; TTA chr2 60509187 60509208 60509204 60509209 +
cttggtctcagctttggctggc

SEQ ID NO: 202530 - DNA, 22 bp, Artificial Sequence
  Synthetic oligonucleotide; CTT chr2 60509190 60509211 60509207 60509212 +
ggtctcagctttggctggcttg

SEQ ID NO: 202531 - DNA, 22 bp, Artificial Sequence
  Synthetic oligonucleotide; TTG chr2 60509191 60509212 60509208 60509213 +
gtctcagctttggctggcttgg

SEQ ID NO: 202532 - DNA, 22 bp, Artificial Sequence
  Synthetic oligonucleotide; CTC chr2 60509196 60509217 60509213 60509218 +
agctttggctggcttggatgtt

SEQ ID NO: 202533 - DNA, 22 bp, Artificial Sequence
  Synthetic oligonucleotide; CTT chr2 60509201 60509222 60509218 60509223 +
tggctggcttggatgttatgag

SEQ ID NO: 202534 - DNA, 22 bp, Artificial Sequence
  Synthetic oligonucleotide; TTT chr2 60509202 60509223 60509219 60509224 +
ggctggcttggatgttatgagg

SEQ ID NO: 202535 - DNA, 22 bp, Artificial Sequence
  Synthetic oligonucleotide; TTG chr2 60509203 60509224 60509220 60509225 +
gctggcttggatgttatgagga

SEQ ID NO: 202536 - DNA, 22 bp, Artificial Sequence
  Synthetic oligonucleotide; CTG chr2 60509207 60509228 60509224 60509229 +
gcttggatgttatgaggattcc

SEQ ID NO: 202537 - DNA, 22 bp, Artificial Sequence
  Synthetic oligonucleotide; CTT chr2 60509211 60509232 60509228 60509233 +
ggatgttatgaggattccaaga

SEQ ID NO: 202538 - DNA, 22 bp, Artificial Sequence
  Synthetic oligonucleotide; TTG chr2 60509212 60509233 60509229 60509234 +
gatgttatgaggattccaagaa

SEQ ID NO: 202539 - DNA, 22 bp, Artificial Sequence
  Synthetic oligonucleotide; TTA chr2 60509219 60509240 60509236 60509241 +
tgaggattccaagaattttttt

SEQ ID NO: 202540 - DNA, 22 bp, Artificial Sequence
  Synthetic oligonucleotide; TTC chr2 60509228 60509249 60509245 60509250 +
caagaatttttttacttttcca

SEQ ID NO: 202541 - DNA, 22 bp, Artificial Sequence
  Synthetic oligonucleotide; TTT chr2 60509237 60509258 60509254 60509259 +
ttttacttttccattagagggc

SEQ ID NO: 202542 - DNA, 22 bp, Artificial Sequence
  Synthetic oligonucleotide; TTT chr2 60509238 60509259 60509255 60509260 +
tttacttttccattagagggct

SEQ ID NO: 202543 - DNA, 22 bp, Artificial Sequence
  Synthetic oligonucleotide; TTT chr2 60509239 60509260 60509256 60509261 +
ttacttttccattagagggctc

SEQ ID NO: 202544 - DNA, 22 bp, Artificial Sequence
  Synthetic oligonucleotide; TTT chr2 60509240 60509261 60509257 60509262 +
tacttttccattagagggctct

SEQ ID NO: 202545 - DNA, 22 bp, Artificial Sequence
  Synthetic oligonucleotide; TTT chr2 60509241 60509262 60509258 60509263 +
acttttccattagagggctctg

SEQ ID NO: 202546 - DNA, 22 bp, Artificial Sequence
  Synthetic oligonucleotide; TTA chr2 60509242 60509263 60509259 60509264 +
cttttccattagagggctctgc

SEQ ID NO: 202547 - DNA, 22 bp, Artificial Sequence
  Synthetic oligonucleotide; CTT chr2 60509245 60509266 60509262 60509267 +
ttccattagagggctctgcact

SEQ ID NO: 202548 - DNA, 22 bp, Artificial Sequence
  Synthetic oligonucleotide; TTT chr2 60509246 60509267 60509263 60509268 +
tccattagagggctctgcactc

SEQ ID NO: 202549 - DNA, 22 bp, Artificial Sequence
  Synthetic oligonucleotide; TTT chr2 60509247 60509268 60509264 60509269 +
ccattagagggctctgcactct

SEQ ID NO: 202550 - DNA, 22 bp, Artificial Sequence
  Synthetic oligonucleotide; TTC chr2 60509248 60509269 60509265 60509270 +
cattagagggctctgcactctc

SEQ ID NO: 202551 - DNA, 22 bp, Artificial Sequence
  Synthetic oligonucleotide; TTA chr2 60509253 60509274 60509270 60509275 +
gagggctctgcactctcctttc

SEQ ID NO: 202552 - DNA, 22 bp, Artificial Sequence
  Synthetic oligonucleotide; CTC chr2 60509261 60509282 60509278 60509283 +
tgcactctcctttcaaggaaaa

SEQ ID NO: 202553 - DNA, 22 bp, Artificial Sequence
  Synthetic oligonucleotide; CTG chr2 60509263 60509284 60509280 60509285 +
cactctcctttcaaggaaaaag

SEQ ID NO: 202554 - DNA, 22 bp, Artificial Sequence
  Synthetic oligonucleotide; CTC chr2 60509268 60509289 60509285 60509290 +
tcctttcaaggaaaaaggctct

SEQ ID NO: 202555 - DNA, 22 bp, Artificial Sequence
  Synthetic oligonucleotide; CTC chr2 60509270 60509291 60509287 60509292 +
ctttcaaggaaaaaggctctat

SEQ ID NO: 202556 - DNA, 22 bp, Artificial Sequence
  Synthetic oligonucleotide; CTT chr2 60509273 60509294 60509290 60509295 +
tcaaggaaaaaggctctatgtg

SEQ ID NO: 202557 - DNA, 22 bp, Artificial Sequence
  Synthetic oligonucleotide; TTT chr2 60509274 60509295 60509291 60509296 +
caaggaaaaaggctctatgtgc

SEQ ID NO: 202558 - DNA, 22 bp, Artificial Sequence
  Synthetic oligonucleotide; TTC chr2 60509275 60509296 60509292 60509297 +
aaggaaaaaggctctatgtgcc

SEQ ID NO: 202559 - DNA, 22 bp, Artificial Sequence
  Synthetic oligonucleotide; CTC chr2 60509289 60509310 60509306 60509311 +
tatgtgccagcccacttctttc

SEQ ID NO: 202560 - DNA, 22 bp, Artificial Sequence
  Synthetic oligonucleotide; CTA chr2 60509291 60509312 60509308 60509313 +
tgtgccagcccacttctttcca

SEQ ID NO: 202561 - DNA, 22 bp, Artificial Sequence
  Synthetic oligonucleotide; CTT chr2 60509306 60509327 60509323 60509328 +
ctttccagaaatggggaaaggg

SEQ ID NO: 202562 - DNA, 22 bp, Artificial Sequence
  Synthetic oligonucleotide; TTC chr2 60509307 60509328 60509324 60509329 +
tttccagaaatggggaaaggga

SEQ ID NO: 202563 - DNA, 22 bp, Artificial Sequence
  Synthetic oligonucleotide; CTT chr2 60509309 60509330 60509326 60509331 +
tccagaaatggggaaagggagg

SEQ ID NO: 202564 - DNA, 22 bp, Artificial Sequence
  Synthetic oligonucleotide; TTT chr2 60509310 60509331 60509327 60509332 +
ccagaaatggggaaagggagga

SEQ ID NO: 202565 - DNA, 22 bp, Artificial Sequence
  Synthetic oligonucleotide; TTC chr2 60509311 60509332 60509328 60509333 +
cagaaatggggaaagggaggag

SEQ ID NO: 202566 - DNA, 22 bp, Artificial Sequence
  Synthetic oligonucleotide; CTG chr2 60509342 60509363 60509359 60509364 +
tggaaaagaggacaacggattt

SEQ ID NO: 202567 - DNA, 22 bp, Artificial Sequence
  Synthetic oligonucleotide; TTT chr2 60509364 60509385 60509381 60509386 +
ccggaagaaattccaagccagg

SEQ ID NO: 202568 - DNA, 22 bp, Artificial Sequence
  Synthetic oligonucleotide; TTC chr2 60509365 60509386 60509382 60509387 +
cggaagaaattccaagccaggg

SEQ ID NO: 202569 - DNA, 22 bp, Artificial Sequence
  Synthetic oligonucleotide; TTC chr2 60509377 60509398 60509394 60509399 +
caagccaggggctaaccgtgga

SEQ ID NO: 202570 - DNA, 22 bp, Artificial Sequence
  Synthetic oligonucleotide; CTA chr2 60509391 60509412 60509408 60509413 +
accgtggacctgagcacagcag

SEQ ID NO: 202571 - DNA, 22 bp, Artificial Sequence
  Synthetic oligonucleotide; CTG chr2 60509403 60509424 60509420 60509425 +
agcacagcagagccacacggac

SEQ ID NO: 202572 - DNA, 22 bp, Artificial Sequence
  Synthetic oligonucleotide; CTC chr2 60509430 60509451 60509447 60509452 +
agaaaacggttctgtggaagca

SEQ ID NO: 202573 - DNA, 22 bp, Artificial Sequence
  Synthetic oligonucleotide; TTC chr2 60509442 60509463 60509459 60509464 +
tgtggaagcacaagacacgtgg

SEQ ID NO: 202574 - DNA, 22 bp, Artificial Sequence
  Synthetic oligonucleotide; CTG chr2 60509444 60509465 60509461 60509466 +
tggaagcacaagacacgtggca

SEQ ID NO: 202575 - DNA, 22 bp, Artificial Sequence
  Synthetic oligonucleotide; CTG chr2 60509478 60509499 60509495 60509500 +
agaagtccaggaaaagatgcag

SEQ ID NO: 202576 - DNA, 22 bp, Artificial Sequence
  Synthetic oligonucleotide; CTT chr2 60509503 60509524 60509520 60509525 +
ccaacccattcctaaatatcac

SEQ ID NO: 202577 - DNA, 22 bp, Artificial Sequence
  Synthetic oligonucleotide; TTC chr2 60509504 60509525 60509521 60509526 +
caacccattcctaaatatcacc

SEQ ID NO: 202578 - DNA, 22 bp, Artificial Sequence
  Synthetic oligonucleotide; TTC chr2 60509514 60509535 60509531 60509536 +
ctaaatatcaccaattaacagc

SEQ ID NO: 202579 - DNA, 22 bp, Artificial Sequence
  Synthetic oligonucleotide; CTA chr2 60509517 60509538 60509534 60509539 +
aatatcaccaattaacagcagc

SEQ ID NO: 202580 - DNA, 22 bp, Artificial Sequence
  Synthetic oligonucleotide; TTA chr2 60509531 60509552 60509548 60509553 +
acagcagctcgatggtctacct

SEQ ID NO: 202581 - DNA, 22 bp, Artificial Sequence
  Synthetic oligonucleotide; CTC chr2 60509541 60509562 60509558 60509563 +
gatggtctacctgagacctgag

SEQ ID NO: 202582 - DNA, 22 bp, Artificial Sequence
  Synthetic oligonucleotide; CTA chr2 60509550 60509571 60509567 60509572 +
cctgagacctgagaaaacaaac

SEQ ID NO: 202583 - DNA, 22 bp, Artificial Sequence
  Synthetic oligonucleotide; CTG chr2 60509554 60509575 60509571 60509576 +
agacctgagaaaacaaacgaag

SEQ ID NO: 202584 - DNA, 22 bp, Artificial Sequence
  Synthetic oligonucleotide; CTG chr2 60509561 60509582 60509578 60509583 +
agaaaacaaacgaagggaaaga

SEQ ID NO: 202585 - DNA, 22 bp, Artificial Sequence
  Synthetic oligonucleotide; CTT chr2 60509607 60509628 60509624 60509629 +
tctggatcaaaagatcaagttg

SEQ ID NO: 202586 - DNA, 22 bp, Artificial Sequence
  Synthetic oligonucleotide; TTT chr2 60509608 60509629 60509625 60509630 +
ctggatcaaaagatcaagttgt

SEQ ID NO: 202587 - DNA, 22 bp, Artificial Sequence
  Synthetic oligonucleotide; TTC chr2 60509609 60509630 60509626 60509631 +
tggatcaaaagatcaagttgtc

SEQ ID NO: 202588 - DNA, 22 bp, Artificial Sequence
  Synthetic oligonucleotide; CTG chr2 60509611 60509632 60509628 60509633 +
gatcaaaagatcaagttgtctt

SEQ ID NO: 202589 - DNA, 22 bp, Artificial Sequence
  Synthetic oligonucleotide; TTG chr2 60509629 60509650 60509646 60509651 +
tctttggtagctaaagaacaac

SEQ ID NO: 202590 - DNA, 22 bp, Artificial Sequence
  Synthetic oligonucleotide; CTT chr2 60509633 60509654 60509650 60509655 +
tggtagctaaagaacaacagag

SEQ ID NO: 202591 - DNA, 22 bp, Artificial Sequence
  Synthetic oligonucleotide; TTT chr2 60509634 60509655 60509651 60509656 +
ggtagctaaagaacaacagaga

SEQ ID NO: 202592 - DNA, 22 bp, Artificial Sequence
  Synthetic oligonucleotide; TTG chr2 60509635 60509656 60509652 60509657 +
gtagctaaagaacaacagagaa

SEQ ID NO: 202593 - DNA, 22 bp, Artificial Sequence
  Synthetic oligonucleotide; CTA chr2 60509642 60509663 60509659 60509664 +
aagaacaacagagaaggaaaaa

SEQ ID NO: 202594 - DNA, 22 bp, Artificial Sequence
  Synthetic oligonucleotide; TTA chr2 60509678 60509699 60509695 60509700 +
ggaggaggagaaaaacacctgg

SEQ ID NO: 202595 - DNA, 22 bp, Artificial Sequence
  Synthetic oligonucleotide; CTG chr2 60509699 60509720 60509716 60509721 +
gccctccccaaagaactcgact

SEQ ID NO: 202596 - DNA, 22 bp, Artificial Sequence
  Synthetic oligonucleotide; CTC chr2 60509705 60509726 60509722 60509727 +
cccaaagaactcgacttaaatc

SEQ ID NO: 202597 - DNA, 22 bp, Artificial Sequence
  Synthetic oligonucleotide; CTC chr2 60509717 60509738 60509734 60509739 +
gacttaaatcatctcagctata

SEQ ID NO: 202598 - DNA, 22 bp, Artificial Sequence
  Synthetic oligonucleotide; CTT chr2 60509722 60509743 60509739 60509744 +
aaatcatctcagctataggcag

SEQ ID NO: 202599 - DNA, 22 bp, Artificial Sequence
  Synthetic oligonucleotide; TTA chr2 60509723 60509744 60509740 60509745 +
aatcatctcagctataggcagt

SEQ ID NO: 202600 - DNA, 22 bp, Artificial Sequence
  Synthetic oligonucleotide; CTC chr2 60509732 60509753 60509749 60509754 +
agctataggcagtcaactgggg

SEQ ID NO: 202601 - DNA, 22 bp, Artificial Sequence
  Synthetic oligonucleotide; CTA chr2 60509737 60509758 60509754 60509759 +
taggcagtcaactggggctctc

SEQ ID NO: 202602 - DNA, 22 bp, Artificial Sequence
  Synthetic oligonucleotide; CTG chr2 60509751 60509772 60509768 60509773 +
gggctctccgaacagccacaat

SEQ ID NO: 202603 - DNA, 22 bp, Artificial Sequence
  Synthetic oligonucleotide; CTC chr2 60509757 60509778 60509774 60509779 +
tccgaacagccacaatcggggg

SEQ ID NO: 202604 - DNA, 22 bp, Artificial Sequence
  Synthetic oligonucleotide; CTC chr2 60509759 60509780 60509776 60509781 +
cgaacagccacaatcggggggc

SEQ ID NO: 202605 - DNA, 22 bp, Artificial Sequence
  Synthetic oligonucleotide; CTA chr2 60509783 60509804 60509800 60509805 +
ctctctttcccctcacgatctt

SEQ ID NO: 202606 - DNA, 22 bp, Artificial Sequence
  Synthetic oligonucleotide; CTC chr2 60509786 60509807 60509803 60509808 +
tctttcccctcacgatcttcct

SEQ ID NO: 202607 - DNA, 22 bp, Artificial Sequence
  Synthetic oligonucleotide; CTC chr2 60509788 60509809 60509805 60509810 +
tttcccctcacgatcttcctga

SEQ ID NO: 202608 - DNA, 22 bp, Artificial Sequence
  Synthetic oligonucleotide; CTT chr2 60509790 60509811 60509807 60509812 +
tcccctcacgatcttcctgaac

SEQ ID NO: 202609 - DNA, 22 bp, Artificial Sequence
  Synthetic oligonucleotide; TTT chr2 60509791 60509812 60509808 60509813 +
cccctcacgatcttcctgaaca

SEQ ID NO: 202610 - DNA, 22 bp, Artificial Sequence
  Synthetic oligonucleotide; TTC chr2 60509792 60509813 60509809 60509814 +
ccctcacgatcttcctgaacag

SEQ ID NO: 202611 - DNA, 22 bp, Artificial Sequence
  Synthetic oligonucleotide; CTC chr2 60509797 60509818 60509814 60509819 +
acgatcttcctgaacagggcag

SEQ ID NO: 202612 - DNA, 22 bp, Artificial Sequence
  Synthetic oligonucleotide; CTT chr2 60509805 60509826 60509822 60509827 +
cctgaacagggcagtagtctag

SEQ ID NO: 202613 - DNA, 22 bp, Artificial Sequence
  Synthetic oligonucleotide; TTC chr2 60509806 60509827 60509823 60509828 +
ctgaacagggcagtagtctagc

SEQ ID NO: 202614 - DNA, 22 bp, Artificial Sequence
  Synthetic oligonucleotide; CTG chr2 60509809 60509830 60509826 60509831 +
aacagggcagtagtctagcatc

SEQ ID NO: 202615 - DNA, 22 bp, Artificial Sequence
  Synthetic oligonucleotide; CTA chr2 60509826 60509847 60509843 60509848 +
gcatccactgaagtcctgaagt

SEQ ID NO: 202616 - DNA, 22 bp, Artificial Sequence
  Synthetic oligonucleotide; CTG chr2 60509836 60509857 60509853 60509858 +
aagtcctgaagtggtgaaggag

SEQ ID NO: 202617 - DNA, 22 bp, Artificial Sequence
  Synthetic oligonucleotide; CTG chr2 60509844 60509865 60509861 60509866 +
aagtggtgaaggagccccagac

SEQ ID NO: 202618 - DNA, 22 bp, Artificial Sequence
  Synthetic oligonucleotide; CTC chr2 60509878 60509899 60509895 60509900 +
tgagcacctccacagcctttct

SEQ ID NO: 202619 - DNA, 22 bp, Artificial Sequence
  Synthetic oligonucleotide; CTG chr2 60509880 60509901 60509897 60509902 +
agcacctccacagcctttctgg

SEQ ID NO: 202620 - DNA, 22 bp, Artificial Sequence
  Synthetic oligonucleotide; CTC chr2 60509888 60509909 60509905 60509910 +
cacagcctttctggcccatccc

SEQ ID NO: 202621 - DNA, 22 bp, Artificial Sequence
  Synthetic oligonucleotide; CTT chr2 60509897 60509918 60509914 60509919 +
tctggcccatcccaataaacag

SEQ ID NO: 202622 - DNA, 22 bp, Artificial Sequence
  Synthetic oligonucleotide; TTT chr2 60509898 60509919 60509915 60509920 +
ctggcccatcccaataaacagc

SEQ ID NO: 202623 - DNA, 22 bp, Artificial Sequence
  Synthetic oligonucleotide; TTC chr2 60509899 60509920 60509916 60509921 +
tggcccatcccaataaacagca

SEQ ID NO: 202624 - DNA, 22 bp, Artificial Sequence
  Synthetic oligonucleotide; CTG chr2 60509901 60509922 60509918 60509923 +
gcccatcccaataaacagcaat

SEQ ID NO: 202625 - DNA, 22 bp, Artificial Sequence
  Synthetic oligonucleotide; TTC chr2 60509925 60509946 60509942 60509947 +
tattctcccagtcaccgagcca

SEQ ID NO: 202626 - DNA, 22 bp, Artificial Sequence
  Synthetic oligonucleotide; CTA chr2 60509927 60509948 60509944 60509949 +
ttctcccagtcaccgagccaca

SEQ ID NO: 202627 - DNA, 22 bp, Artificial Sequence
  Synthetic oligonucleotide; TTC chr2 60509930 60509951 60509947 60509952 +
tcccagtcaccgagccacacat

SEQ ID NO: 202628 - DNA, 22 bp, Artificial Sequence
  Synthetic oligonucleotide; CTC chr2 60509932 60509953 60509949 60509954 +
ccagtcaccgagccacacattt

SEQ ID NO: 202629 - DNA, 22 bp, Artificial Sequence
  Synthetic oligonucleotide; TTT chr2 60509954 60509975 60509971 60509976 +
tggggtccatcttgactcctcc

SEQ ID NO: 202630 - DNA, 22 bp, Artificial Sequence
  Synthetic oligonucleotide; TTT chr2 60509955 60509976 60509972 60509977 +
ggggtccatcttgactcctccc

SEQ ID NO: 202631 - DNA, 22 bp, Artificial Sequence
  Synthetic oligonucleotide; TTG chr2 60509956 60509977 60509973 60509978 +
gggtccatcttgactcctccct

SEQ ID NO: 202632 - DNA, 22 bp, Artificial Sequence
  Synthetic oligonucleotide; CTT chr2 60509967 60509988 60509984 60509989 +
gactcctcccttcctttcatac

SEQ ID NO: 202633 - DNA, 22 bp, Artificial Sequence
  Synthetic oligonucleotide; TTG chr2 60509968 60509989 60509985 60509990 +
actcctcccttcctttcataca

SEQ ID NO: 202634 - DNA, 22 bp, Artificial Sequence
  Synthetic oligonucleotide; CTC chr2 60509972 60509993 60509989 60509994 +
ctcccttcctttcatacaaccc

SEQ ID NO: 202635 - DNA, 22 bp, Artificial Sequence
  Synthetic oligonucleotide; CTC chr2 60509975 60509996 60509992 60509997 +
ccttcctttcatacaacccatc

SEQ ID NO: 202636 - DNA, 22 bp, Artificial Sequence
  Synthetic oligonucleotide; CTT chr2 60509979 60510000 60509996 60510001 +
cctttcatacaacccatcccac

SEQ ID NO: 202637 - DNA, 22 bp, Artificial Sequence
  Synthetic oligonucleotide; TTC chr2 60509980 60510001 60509997 60510002 +
ctttcatacaacccatcccacc

SEQ ID NO: 202638 - DNA, 22 bp, Artificial Sequence
  Synthetic oligonucleotide; CTT chr2 60509983 60510004 60510000 60510005 +
tcatacaacccatcccaccagt

SEQ ID NO: 202639 - DNA, 22 bp, Artificial Sequence
  Synthetic oligonucleotide; TTT chr2 60509984 60510005 60510001 60510006 +
catacaacccatcccaccagtc

SEQ ID NO: 202640 - DNA, 22 bp, Artificial Sequence
  Synthetic oligonucleotide; TTC chr2 60509985 60510006 60510002 60510007 +
atacaacccatcccaccagtca

SEQ ID NO: 202641 - DNA, 22 bp, Artificial Sequence
  Synthetic oligonucleotide; CTG chr2 60510017 60510038 60510034 60510039 +
ccggttttcccttcgaagtatg

SEQ ID NO: 202642 - DNA, 22 bp, Artificial Sequence
  Synthetic oligonucleotide; TTT chr2 60510024 60510045 60510041 60510046 +
tcccttcgaagtatgtccagaa

SEQ ID NO: 202643 - DNA, 22 bp, Artificial Sequence
  Synthetic oligonucleotide; TTT chr2 60510025 60510046 60510042 60510047 +
cccttcgaagtatgtccagaat

SEQ ID NO: 202644 - DNA, 22 bp, Artificial Sequence
  Synthetic oligonucleotide; TTC chr2 60510026 60510047 60510043 60510048 +
ccttcgaagtatgtccagaatc

SEQ ID NO: 202645 - DNA, 22 bp, Artificial Sequence
  Synthetic oligonucleotide; CTT chr2 60510030 60510051 60510047 60510052 +
cgaagtatgtccagaatccagc

SEQ ID NO: 202646 - DNA, 22 bp, Artificial Sequence
  Synthetic oligonucleotide; TTC chr2 60510031 60510052 60510048 60510053 +
gaagtatgtccagaatccagcc

SEQ ID NO: 202647 - DNA, 22 bp, Artificial Sequence
  Synthetic oligonucleotide; CTT chr2 60510057 60510078 60510074 60510079 +
ctcacgtccccaccaccctggt

SEQ ID NO: 202648 - DNA, 22 bp, Artificial Sequence
  Synthetic oligonucleotide; TTC chr2 60510058 60510079 60510075 60510080 +
tcacgtccccaccaccctggtc

SEQ ID NO: 202649 - DNA, 22 bp, Artificial Sequence
  Synthetic oligonucleotide; CTC chr2 60510060 60510081 60510077 60510082 +
acgtccccaccaccctggtcca

SEQ ID NO: 202650 - DNA, 22 bp, Artificial Sequence
  Synthetic oligonucleotide; CTG chr2 60510077 60510098 60510094 60510099 +
gtccacgccaccatcacttgcc

SEQ ID NO: 202651 - DNA, 22 bp, Artificial Sequence
  Synthetic oligonucleotide; CTT chr2 60510096 60510117 60510113 60510118 +
gcctaaaatttgccttctgact

SEQ ID NO: 202652 - DNA, 22 bp, Artificial Sequence
  Synthetic oligonucleotide; TTG chr2 60510097 60510118 60510114 60510119 +
cctaaaatttgccttctgactg

SEQ ID NO: 202653 - DNA, 22 bp, Artificial Sequence
  Synthetic oligonucleotide; CTA chr2 60510101 60510122 60510118 60510123 +
aaatttgccttctgactgcttc

SEQ ID NO: 202654 - DNA, 22 bp, Artificial Sequence
  Synthetic oligonucleotide; TTT chr2 60510107 60510128 60510124 60510129 +
gccttctgactgcttctgcctc

SEQ ID NO: 202655 - DNA, 22 bp, Artificial Sequence
  Synthetic oligonucleotide; TTG chr2 60510108 60510129 60510125 60510130 +
ccttctgactgcttctgcctca

SEQ ID NO: 202656 - DNA, 22 bp, Artificial Sequence
  Synthetic oligonucleotide; CTT chr2 60510112 60510133 60510129 60510134 +
ctgactgcttctgcctcacttt

SEQ ID NO: 202657 - DNA, 22 bp, Artificial Sequence
  Synthetic oligonucleotide; TTC chr2 60510113 60510134 60510130 60510135 +
tgactgcttctgcctcactttc

SEQ ID NO: 202658 - DNA, 22 bp, Artificial Sequence
  Synthetic oligonucleotide; CTG chr2 60510115 60510136 60510132 60510137 +
actgcttctgcctcactttccc

SEQ ID NO: 202659 - DNA, 22 bp, Artificial Sequence
  Synthetic oligonucleotide; CTG chr2 60510119 60510140 60510136 60510141 +
cttctgcctcactttcccatgc

SEQ ID NO: 202660 - DNA, 22 bp, Artificial Sequence
  Synthetic oligonucleotide; CTT chr2 60510122 60510143 60510139 60510144 +
ctgcctcactttcccatgcttg

SEQ ID NO: 202661 - DNA, 22 bp, Artificial Sequence
  Synthetic oligonucleotide; TTC chr2 60510123 60510144 60510140 60510145 +
tgcctcactttcccatgcttga

SEQ ID NO: 202662 - DNA, 22 bp, Artificial Sequence
  Synthetic oligonucleotide; CTG chr2 60510125 60510146 60510142 60510147 +
cctcactttcccatgcttgagt

SEQ ID NO: 202663 - DNA, 22 bp, Artificial Sequence
  Synthetic oligonucleotide; CTC chr2 60510129 60510150 60510146 60510151 +
actttcccatgcttgagtctca

SEQ ID NO: 202664 - DNA, 22 bp, Artificial Sequence
  Synthetic oligonucleotide; CTT chr2 60510133 60510154 60510150 60510155 +
tcccatgcttgagtctcaaaat

SEQ ID NO: 202665 - DNA, 22 bp, Artificial Sequence
  Synthetic oligonucleotide; TTT chr2 60510134 60510155 60510151 60510156 +
cccatgcttgagtctcaaaatg

SEQ ID NO: 202666 - DNA, 22 bp, Artificial Sequence
  Synthetic oligonucleotide; TTC chr2 60510135 60510156 60510152 60510157 +
ccatgcttgagtctcaaaatgc

SEQ ID NO: 202667 - DNA, 22 bp, Artificial Sequence
  Synthetic oligonucleotide; CTT chr2 60510143 60510164 60510160 60510165 +
gagtctcaaaatgcggcccaag

SEQ ID NO: 202668 - DNA, 22 bp, Artificial Sequence
  Synthetic oligonucleotide; TTG chr2 60510144 60510165 60510161 60510166 +
agtctcaaaatgcggcccaaga

SEQ ID NO: 202669 - DNA, 22 bp, Artificial Sequence
  Synthetic oligonucleotide; CTC chr2 60510150 60510171 60510167 60510172 +
aaaatgcggcccaagagactct

SEQ ID NO: 202670 - DNA, 22 bp, Artificial Sequence
  Synthetic oligonucleotide; CTC chr2 60510171 60510192 60510188 60510193 +
tctggaagcgcaagtcatatga

SEQ ID NO: 202671 - DNA, 22 bp, Artificial Sequence
  Synthetic oligonucleotide; CTC chr2 60510173 60510194 60510190 60510195 +
tggaagcgcaagtcatatgaca

SEQ ID NO: 202672 - DNA, 22 bp, Artificial Sequence
  Synthetic oligonucleotide; CTG chr2 60510175 60510196 60510192 60510197 +
gaagcgcaagtcatatgacatc

SEQ ID NO: 202673 - DNA, 22 bp, Artificial Sequence
  Synthetic oligonucleotide; CTC chr2 60510201 60510222 60510218 60510223 +
ctccagtggcttccatctccct

SEQ ID NO: 202674 - DNA, 22 bp, Artificial Sequence
  Synthetic oligonucleotide; CTC chr2 60510204 60510225 60510221 60510226 +
cagtggcttccatctcccttgg

SEQ ID NO: 202675 - DNA, 22 bp, Artificial Sequence
  Synthetic oligonucleotide; CTT chr2 60510213 60510234 60510230 60510235 +
ccatctcccttggagtcagagc

SEQ ID NO: 202676 - DNA, 22 bp, Artificial Sequence
  Synthetic oligonucleotide; TTC chr2 60510214 60510235 60510231 60510236 +
catctcccttggagtcagagcc

SEQ ID NO: 202677 - DNA, 22 bp, Artificial Sequence
  Synthetic oligonucleotide; CTC chr2 60510220 60510241 60510237 60510242 +
ccttggagtcagagccaaaaat

SEQ ID NO: 202678 - DNA, 22 bp, Artificial Sequence
  Synthetic oligonucleotide; CTT chr2 60510224 60510245 60510241 60510246 +
ggagtcagagccaaaaatccct

SEQ ID NO: 202679 - DNA, 22 bp, Artificial Sequence
  Synthetic oligonucleotide; TTG chr2 60510225 60510246 60510242 60510247 +
gagtcagagccaaaaatccctg

SEQ ID NO: 202680 - DNA, 22 bp, Artificial Sequence
  Synthetic oligonucleotide; CTG chr2 60510247 60510268 60510264 60510269 +
ctctacgtccttcaaggagcca

SEQ ID NO: 202681 - DNA, 22 bp, Artificial Sequence
  Synthetic oligonucleotide; CTC chr2 60510250 60510271 60510267 60510272 +
tacgtccttcaaggagccagct

SEQ ID NO: 202682 - DNA, 22 bp, Artificial Sequence
  Synthetic oligonucleotide; CTA chr2 60510252 60510273 60510269 60510274 +
cgtccttcaaggagccagctgg

SEQ ID NO: 202683 - DNA, 22 bp, Artificial Sequence
  Synthetic oligonucleotide; CTT chr2 60510259 60510280 60510276 60510281 +
caaggagccagctggtctcctc

SEQ ID NO: 202684 - DNA, 22 bp, Artificial Sequence
  Synthetic oligonucleotide; TTC chr2 60510260 60510281 60510277 60510282 +
aaggagccagctggtctcctct

SEQ ID NO: 202685 - DNA, 22 bp, Artificial Sequence
  Synthetic oligonucleotide; CTG chr2 60510273 60510294 60510290 60510295 +
gtctcctctcctcctcctcctg

SEQ ID NO: 202686 - DNA, 22 bp, Artificial Sequence
  Synthetic oligonucleotide; CTC chr2 60510278 60510299 60510295 60510300 +
ctctcctcctcctcctgcactc

SEQ ID NO: 202687 - DNA, 22 bp, Artificial Sequence
  Synthetic oligonucleotide; CTC chr2 60510281 60510302 60510298 60510303 +
tcctcctcctcctgcactcttt

SEQ ID NO: 202688 - DNA, 22 bp, Artificial Sequence
  Synthetic oligonucleotide; CTC chr2 60510283 60510304 60510300 60510305 +
ctcctcctcctgcactctttcc

SEQ ID NO: 202689 - DNA, 22 bp, Artificial Sequence
  Synthetic oligonucleotide; CTC chr2 60510286 60510307 60510303 60510308 +
ctcctcctgcactctttccact

SEQ ID NO: 202690 - DNA, 22 bp, Artificial Sequence
  Synthetic oligonucleotide; CTC chr2 60510289 60510310 60510306 60510311 +
ctcctgcactctttccactctg

SEQ ID NO: 202691 - DNA, 22 bp, Artificial Sequence
  Synthetic oligonucleotide; CTC chr2 60510292 60510313 60510309 60510314 +
ctgcactctttccactctgacc

SEQ ID NO: 202692 - DNA, 22 bp, Artificial Sequence
  Synthetic oligonucleotide; CTG chr2 60510295 60510316 60510312 60510317 +
cactctttccactctgacctca

SEQ ID NO: 202693 - DNA, 22 bp, Artificial Sequence
  Synthetic oligonucleotide; CTC chr2 60510300 60510321 60510317 60510322 +
tttccactctgacctcagggcc

SEQ ID NO: 202694 - DNA, 22 bp, Artificial Sequence
  Synthetic oligonucleotide; CTT chr2 60510302 60510323 60510319 60510324 +
tccactctgacctcagggcccc

SEQ ID NO: 202695 - DNA, 22 bp, Artificial Sequence
  Synthetic oligonucleotide; TTT chr2 60510303 60510324 60510320 60510325 +
ccactctgacctcagggcccct

SEQ ID NO: 202696 - DNA, 22 bp, Artificial Sequence
  Synthetic oligonucleotide; TTC chr2 60510304 60510325 60510321 60510326 +
cactctgacctcagggcccctt

SEQ ID NO: 202697 - DNA, 22 bp, Artificial Sequence
  Synthetic oligonucleotide; CTC chr2 60510309 60510330 60510326 60510331 +
tgacctcagggccccttgctcc

SEQ ID NO: 202698 - DNA, 22 bp, Artificial Sequence
  Synthetic oligonucleotide; CTG chr2 60510311 60510332 60510328 60510333 +
acctcagggccccttgctcctc

SEQ ID NO: 202699 - DNA, 22 bp, Artificial Sequence
  Synthetic oligonucleotide; CTC chr2 60510316 60510337 60510333 60510338 +
agggccccttgctcctcctcca

SEQ ID NO: 202700 - DNA, 22 bp, Artificial Sequence
  Synthetic oligonucleotide; CTT chr2 60510326 60510347 60510343 60510348 +
gctcctcctccagtagccaggc

SEQ ID NO: 202701 - DNA, 22 bp, Artificial Sequence
  Synthetic oligonucleotide; TTG chr2 60510327 60510348 60510344 60510349 +
ctcctcctccagtagccaggcg

SEQ ID NO: 202702 - DNA, 22 bp, Artificial Sequence
  Synthetic oligonucleotide; CTC chr2 60510330 60510351 60510347 60510352 +
ctcctccagtagccaggcgtat

SEQ ID NO: 202703 - DNA, 22 bp, Artificial Sequence
  Synthetic oligonucleotide; CTC chr2 60510333 60510354 60510350 60510355 +
ctccagtagccaggcgtattac

SEQ ID NO: 202704 - DNA, 22 bp, Artificial Sequence
  Synthetic oligonucleotide; CTC chr2 60510336 60510357 60510353 60510358 +
cagtagccaggcgtattacaca

SEQ ID NO: 202705 - DNA, 22 bp, Artificial Sequence
  Synthetic oligonucleotide; TTA chr2 60510354 60510375 60510371 60510376 +
cacacaaggtctctgctctcta

SEQ ID NO: 202706 - DNA, 22 bp, Artificial Sequence
  Synthetic oligonucleotide; CTC chr2 60510367 60510388 60510384 60510389 +
tgctctctacacactcttcctg

SEQ ID NO: 202707 - DNA, 22 bp, Artificial Sequence
  Synthetic oligonucleotide; CTG chr2 60510369 60510390 60510386 60510391 +
ctctctacacactcttcctgga

SEQ ID NO: 202708 - DNA, 22 bp, Artificial Sequence
  Synthetic oligonucleotide; CTC chr2 60510372 60510393 60510389 60510394 +
tctacacactcttcctggaacc

SEQ ID NO: 202709 - DNA, 22 bp, Artificial Sequence
  Synthetic oligonucleotide; CTC chr2 60510374 60510395 60510391 60510396 +
tacacactcttcctggaaccat

SEQ ID NO: 202710 - DNA, 22 bp, Artificial Sequence
  Synthetic oligonucleotide; CTA chr2 60510376 60510397 60510393 60510398 +
cacactcttcctggaaccatct

SEQ ID NO: 202711 - DNA, 22 bp, Artificial Sequence
  Synthetic oligonucleotide; CTC chr2 60510383 60510404 60510400 60510405 +
ttcctggaaccatcttctcaaa

SEQ ID NO: 202712 - DNA, 22 bp, Artificial Sequence
  Synthetic oligonucleotide; CTT chr2 60510385 60510406 60510402 60510407 +
cctggaaccatcttctcaaaat

SEQ ID NO: 202713 - DNA, 22 bp, Artificial Sequence
  Synthetic oligonucleotide; TTC chr2 60510386 60510407 60510403 60510408 +
ctggaaccatcttctcaaaatt

SEQ ID NO: 202714 - DNA, 22 bp, Artificial Sequence
  Synthetic oligonucleotide; CTG chr2 60510389 60510410 60510406 60510411 +
gaaccatcttctcaaaattctc

SEQ ID NO: 202715 - DNA, 22 bp, Artificial Sequence
  Synthetic oligonucleotide; CTT chr2 60510399 60510420 60510416 60510421 +
ctcaaaattctcatggccaact

SEQ ID NO: 202716 - DNA, 22 bp, Artificial Sequence
  Synthetic oligonucleotide; TTC chr2 60510400 60510421 60510417 60510422 +
tcaaaattctcatggccaactt

SEQ ID NO: 202717 - DNA, 22 bp, Artificial Sequence
  Synthetic oligonucleotide; CTC chr2 60510402 60510423 60510419 60510424 +
aaaattctcatggccaacttcc

SEQ ID NO: 202718 - DNA, 22 bp, Artificial Sequence
  Synthetic oligonucleotide; TTC chr2 60510409 60510430 60510426 60510431 +
tcatggccaacttcctcacctc

SEQ ID NO: 202719 - DNA, 22 bp, Artificial Sequence
  Synthetic oligonucleotide; CTC chr2 60510411 60510432 60510428 60510433 +
atggccaacttcctcacctctt

SEQ ID NO: 202720 - DNA, 22 bp, Artificial Sequence
  Synthetic oligonucleotide; CTT chr2 60510422 60510443 60510439 60510444 +
cctcacctctttggagcctttg

SEQ ID NO: 202721 - DNA, 22 bp, Artificial Sequence
  Synthetic oligonucleotide; TTC chr2 60510423 60510444 60510440 60510445 +
ctcacctctttggagcctttgc

SEQ ID NO: 202722 - DNA, 22 bp, Artificial Sequence
  Synthetic oligonucleotide; CTC chr2 60510426 60510447 60510443 60510448 +
acctctttggagcctttgcttc

SEQ ID NO: 202723 - DNA, 22 bp, Artificial Sequence
  Synthetic oligonucleotide; CTC chr2 60510431 60510452 60510448 60510453 +
tttggagcctttgcttctcatt

SEQ ID NO: 202724 - DNA, 22 bp, Artificial Sequence
  Synthetic oligonucleotide; CTT chr2 60510433 60510454 60510450 60510455 +
tggagcctttgcttctcattgg

SEQ ID NO: 202725 - DNA, 22 bp, Artificial Sequence
  Synthetic oligonucleotide; TTT chr2 60510434 60510455 60510451 60510456 +
ggagcctttgcttctcattggg

SEQ ID NO: 202726 - DNA, 22 bp, Artificial Sequence
  Synthetic oligonucleotide; TTG chr2 60510435 60510456 60510452 60510457 +
gagcctttgcttctcattgggc

SEQ ID NO: 202727 - DNA, 22 bp, Artificial Sequence
  Synthetic oligonucleotide; CTT chr2 60510442 60510463 60510459 60510464 +
tgcttctcattgggccttccct

SEQ ID NO: 202728 - DNA, 22 bp, Artificial Sequence
  Synthetic oligonucleotide; TTT chr2 60510443 60510464 60510460 60510465 +
gcttctcattgggccttcccta

SEQ ID NO: 202729 - DNA, 22 bp, Artificial Sequence
  Synthetic oligonucleotide; TTG chr2 60510444 60510465 60510461 60510466 +
cttctcattgggccttccctaa

SEQ ID NO: 202730 - DNA, 22 bp, Artificial Sequence
  Synthetic oligonucleotide; CTT chr2 60510447 60510468 60510464 60510469 +
ctcattgggccttccctaatta

SEQ ID NO: 202731 - DNA, 22 bp, Artificial Sequence
  Synthetic oligonucleotide; TTC chr2 60510448 60510469 60510465 60510470 +
tcattgggccttccctaattat

SEQ ID NO: 202732 - DNA, 22 bp, Artificial Sequence
  Synthetic oligonucleotide; CTC chr2 60510450 60510471 60510467 60510472 +
attgggccttccctaattatcc

SEQ ID NO: 202733 - DNA, 22 bp, Artificial Sequence
  Synthetic oligonucleotide; TTG chr2 60510454 60510475 60510471 60510476 +
ggccttccctaattatcctatt

SEQ ID NO: 202734 - DNA, 22 bp, Artificial Sequence
  Synthetic oligonucleotide; CTT chr2 60510460 60510481 60510477 60510482 +
ccctaattatcctatttaaaag

SEQ ID NO: 202735 - DNA, 22 bp, Artificial Sequence
  Synthetic oligonucleotide; TTC chr2 60510461 60510482 60510478 60510483 +
cctaattatcctatttaaaagc

SEQ ID NO: 202736 - DNA, 22 bp, Artificial Sequence
  Synthetic oligonucleotide; CTA chr2 60510465 60510486 60510482 60510487 +
attatcctatttaaaagcctgg

SEQ ID NO: 202737 - DNA, 22 bp, Artificial Sequence
  Synthetic oligonucleotide; TTA chr2 60510469 60510490 60510486 60510491 +
tcctatttaaaagcctggtcac

SEQ ID NO: 202738 - DNA, 22 bp, Artificial Sequence
  Synthetic oligonucleotide; CTA chr2 60510474 60510495 60510491 60510496 +
tttaaaagcctggtcaccatgc

SEQ ID NO: 202739 - DNA, 22 bp, Artificial Sequence
  Synthetic oligonucleotide; TTT chr2 60510477 60510498 60510494 60510499 +
aaaagcctggtcaccatgcacc

SEQ ID NO: 202740 - DNA, 22 bp, Artificial Sequence
  Synthetic oligonucleotide; TTA chr2 60510478 60510499 60510495 60510500 +
aaagcctggtcaccatgcaccc

SEQ ID NO: 202741 - DNA, 22 bp, Artificial Sequence
  Synthetic oligonucleotide; CTG chr2 60510486 60510507 60510503 60510508 +
gtcaccatgcaccccttacccc

SEQ ID NO: 202742 - DNA, 22 bp, Artificial Sequence
  Synthetic oligonucleotide; CTT chr2 60510503 60510524 60510520 60510525 +
acccctcttccccaccttattt

SEQ ID NO: 202743 - DNA, 22 bp, Artificial Sequence
  Synthetic oligonucleotide; TTA chr2 60510504 60510525 60510521 60510526 +
cccctcttccccaccttatttt

SEQ ID NO: 202744 - DNA, 22 bp, Artificial Sequence
  Synthetic oligonucleotide; CTC chr2 60510510 60510531 60510527 60510532 +
ttccccaccttattttcgtgca

SEQ ID NO: 202745 - DNA, 22 bp, Artificial Sequence
  Synthetic oligonucleotide; CTT chr2 60510512 60510533 60510529 60510534 +
ccccaccttattttcgtgcagg

SEQ ID NO: 202746 - DNA, 22 bp, Artificial Sequence
  Synthetic oligonucleotide; TTC chr2 60510513 60510534 60510530 60510535 +
cccaccttattttcgtgcaggc

SEQ ID NO: 202747 - DNA, 22 bp, Artificial Sequence
  Synthetic oligonucleotide; CTT chr2 60510521 60510542 60510538 60510543 +
attttcgtgcaggcagtttgat

SEQ ID NO: 202748 - DNA, 22 bp, Artificial Sequence
  Synthetic oligonucleotide; TTA chr2 60510522 60510543 60510539 60510544 +
ttttcgtgcaggcagtttgatc

SEQ ID NO: 202749 - DNA, 22 bp, Artificial Sequence
  Synthetic oligonucleotide; TTT chr2 60510525 60510546 60510542 60510547 +
tcgtgcaggcagtttgatcttc

SEQ ID NO: 202750 - DNA, 22 bp, Artificial Sequence
  Synthetic oligonucleotide; TTT chr2 60510526 60510547 60510543 60510548 +
cgtgcaggcagtttgatcttct

SEQ ID NO: 202751 - DNA, 22 bp, Artificial Sequence
  Synthetic oligonucleotide; TTC chr2 60510527 60510548 60510544 60510549 +
gtgcaggcagtttgatcttctc

SEQ ID NO: 202752 - DNA, 22 bp, Artificial Sequence
  Synthetic oligonucleotide; TTT chr2 60510540 60510561 60510557 60510562 +
gatcttctcttgccatactata

SEQ ID NO: 202753 - DNA, 22 bp, Artificial Sequence
  Synthetic oligonucleotide; TTG chr2 60510541 60510562 60510558 60510563 +
atcttctcttgccatactatat

SEQ ID NO: 202754 - DNA, 22 bp, Artificial Sequence
  Synthetic oligonucleotide; CTT chr2 60510546 60510567 60510563 60510568 +
ctcttgccatactatataattc

SEQ ID NO: 202755 - DNA, 22 bp, Artificial Sequence
  Synthetic oligonucleotide; TTC chr2 60510547 60510568 60510564 60510569 +
tcttgccatactatataattca

SEQ ID NO: 202756 - DNA, 22 bp, Artificial Sequence
  Synthetic oligonucleotide; CTC chr2 60510549 60510570 60510566 60510571 +
ttgccatactatataattcaca

SEQ ID NO: 202757 - DNA, 22 bp, Artificial Sequence
  Synthetic oligonucleotide; CTT chr2 60510551 60510572 60510568 60510573 +
gccatactatataattcacata

SEQ ID NO: 202758 - DNA, 22 bp, Artificial Sequence
  Synthetic oligonucleotide; TTG chr2 60510552 60510573 60510569 60510574 +
ccatactatataattcacatat

SEQ ID NO: 202759 - DNA, 22 bp, Artificial Sequence
  Synthetic oligonucleotide; CTA chr2 60510560 60510581 60510577 60510582 +
tataattcacatatttattggt

SEQ ID NO: 202760 - DNA, 22 bp, Artificial Sequence
  Synthetic oligonucleotide; TTC chr2 60510568 60510589 60510585 60510590 +
acatatttattggtgcatcttc

SEQ ID NO: 202761 - DNA, 22 bp, Artificial Sequence
  Synthetic oligonucleotide; TTT chr2 60510576 60510597 60510593 60510598 +
attggtgcatcttctgtctctc

SEQ ID NO: 202762 - DNA, 22 bp, Artificial Sequence
  Synthetic oligonucleotide; TTA chr2 60510577 60510598 60510594 60510599 +
ttggtgcatcttctgtctctcc

SEQ ID NO: 202763 - DNA, 22 bp, Artificial Sequence
  Synthetic oligonucleotide; TTG chr2 60510580 60510601 60510597 60510602 +
gtgcatcttctgtctctcccca

SEQ ID NO: 202764 - DNA, 22 bp, Artificial Sequence
  Synthetic oligonucleotide; CTT chr2 60510589 60510610 60510606 60510611 +
ctgtctctccccagctagaaag

SEQ ID NO: 202765 - DNA, 22 bp, Artificial Sequence
  Synthetic oligonucleotide; TTC chr2 60510590 60510611 60510607 60510612 +
tgtctctccccagctagaaagg

SEQ ID NO: 202766 - DNA, 22 bp, Artificial Sequence
  Synthetic oligonucleotide; CTG chr2 60510592 60510613 60510609 60510614 +
tctctccccagctagaaagggg

SEQ ID NO: 202767 - DNA, 22 bp, Artificial Sequence
  Synthetic oligonucleotide; CTC chr2 60510596 60510617 60510613 60510618 +
tccccagctagaaagggggtgc

SEQ ID NO: 202768 - DNA, 22 bp, Artificial Sequence
  Synthetic oligonucleotide; CTC chr2 60510598 60510619 60510615 60510620 +
cccagctagaaagggggtgcca

SEQ ID NO: 202769 - DNA, 22 bp, Artificial Sequence
  Synthetic oligonucleotide; CTA chr2 60510606 60510627 60510623 60510628 +
gaaagggggtgccacaagagca

SEQ ID NO: 202770 - DNA, 22 bp, Artificial Sequence
  Synthetic oligonucleotide; TTT chr2 60510636 60510657 60510653 60510658 +
ttaaggctttctatgcccaaca

SEQ ID NO: 202771 - DNA, 22 bp, Artificial Sequence
  Synthetic oligonucleotide; TTT chr2 60510637 60510658 60510654 60510659 +
taaggctttctatgcccaacac

SEQ ID NO: 202772 - DNA, 22 bp, Artificial Sequence
  Synthetic oligonucleotide; TTT chr2 60510638 60510659 60510655 60510660 +
aaggctttctatgcccaacacc

SEQ ID NO: 202773 - DNA, 22 bp, Artificial Sequence
  Synthetic oligonucleotide; TTA chr2 60510639 60510660 60510656 60510661 +
aggctttctatgcccaacacca

SEQ ID NO: 202774 - DNA, 22 bp, Artificial Sequence
  Synthetic oligonucleotide; CTT chr2 60510645 60510666 60510662 60510667 +
tctatgcccaacaccaagaacc

SEQ ID NO: 202775 - DNA, 22 bp, Artificial Sequence
  Synthetic oligonucleotide; TTT chr2 60510646 60510667 60510663 60510668 +
ctatgcccaacaccaagaaccg

SEQ ID NO: 202776 - DNA, 22 bp, Artificial Sequence
  Synthetic oligonucleotide; TTC chr2 60510647 60510668 60510664 60510669 +
tatgcccaacaccaagaaccgt

SEQ ID NO: 202777 - DNA, 22 bp, Artificial Sequence
  Synthetic oligonucleotide; CTA chr2 60510649 60510670 60510666 60510671 +
tgcccaacaccaagaaccgttc

SEQ ID NO: 202778 - DNA, 22 bp, Artificial Sequence
  Synthetic oligonucleotide; TTC chr2 60510671 60510692 60510688 60510693 +
ccagcatgtggcaggtgttcaa

SEQ ID NO: 202779 - DNA, 22 bp, Artificial Sequence
  Synthetic oligonucleotide; TTC chr2 60510691 60510712 60510708 60510713 +
aaaatatttgttgaaaaatgaa

SEQ ID NO: 202780 - DNA, 22 bp, Artificial Sequence
  Synthetic oligonucleotide; TTT chr2 60510700 60510721 60510717 60510722 +
gttgaaaaatgaatgagtgaac

SEQ ID NO: 202781 - DNA, 22 bp, Artificial Sequence
  Synthetic oligonucleotide; TTG chr2 60510701 60510722 60510718 60510723 +
ttgaaaaatgaatgagtgaacc

SEQ ID NO: 202782 - DNA, 22 bp, Artificial Sequence
  Synthetic oligonucleotide; TTG chr2 60510704 60510725 60510721 60510726 +
aaaaatgaatgagtgaaccttc

SEQ ID NO: 202783 - DNA, 22 bp, Artificial Sequence
  Synthetic oligonucleotide; CTT chr2 60510725 60510746 60510742 60510747 +
cacaattccaaactgccaggag

SEQ ID NO: 202784 - DNA, 22 bp, Artificial Sequence
  Synthetic oligonucleotide; TTC chr2 60510726 60510747 60510743 60510748 +
acaattccaaactgccaggagg

SEQ ID NO: 202785 - DNA, 22 bp, Artificial Sequence
  Synthetic oligonucleotide; TTC chr2 60510733 60510754 60510750 60510755 +
caaactgccaggaggccactca

SEQ ID NO: 202786 - DNA, 22 bp, Artificial Sequence
  Synthetic oligonucleotide; CTG chr2 60510740 60510761 60510757 60510762 +
ccaggaggccactcaatgccat

SEQ ID NO: 202787 - DNA, 22 bp, Artificial Sequence
  Synthetic oligonucleotide; CTC chr2 60510754 60510775 60510771 60510776 +
aatgccatatctataaaactgt

SEQ ID NO: 202788 - DNA, 22 bp, Artificial Sequence
  Synthetic oligonucleotide; CTA chr2 60510767 60510788 60510784 60510789 +
taaaactgtcaggcagcccaac

SEQ ID NO: 202789 - DNA, 22 bp, Artificial Sequence
  Synthetic oligonucleotide; CTG chr2 60510775 60510796 60510792 60510797 +
tcaggcagcccaacctgggggc

SEQ ID NO: 202790 - DNA, 22 bp, Artificial Sequence
  Synthetic oligonucleotide; CTG chr2 60510792 60510813 60510809 60510814 +
ggggcactttagctttggatct

SEQ ID NO: 202791 - DNA, 22 bp, Artificial Sequence
  Synthetic oligonucleotide; CTT chr2 60510801 60510822 60510818 60510823 +
tagctttggatcttgggtttga

SEQ ID NO: 202792 - DNA, 22 bp, Artificial Sequence
  Synthetic oligonucleotide; TTT chr2 60510802 60510823 60510819 60510824 +
agctttggatcttgggtttgag

SEQ ID NO: 202793 - DNA, 22 bp, Artificial Sequence
  Synthetic oligonucleotide; TTA chr2 60510803 60510824 60510820 60510825 +
gctttggatcttgggtttgagc

SEQ ID NO: 202794 - DNA, 22 bp, Artificial Sequence
  Synthetic oligonucleotide; CTT chr2 60510807 60510828 60510824 60510829 +
tggatcttgggtttgagccaga

SEQ ID NO: 202795 - DNA, 22 bp, Artificial Sequence
  Synthetic oligonucleotide; TTT chr2 60510808 60510829 60510825 60510830 +
ggatcttgggtttgagccagat

SEQ ID NO: 202796 - DNA, 22 bp, Artificial Sequence
  Synthetic oligonucleotide; TTG chr2 60510809 60510830 60510826 60510831 +
gatcttgggtttgagccagatt

SEQ ID NO: 202797 - DNA, 22 bp, Artificial Sequence
  Synthetic oligonucleotide; CTT chr2 60510815 60510836 60510832 60510837 +
gggtttgagccagattccattt

SEQ ID NO: 202798 - DNA, 22 bp, Artificial Sequence
  Synthetic oligonucleotide; TTG chr2 60510816 60510837 60510833 60510838 +
ggtttgagccagattccatttt

SEQ ID NO: 202799 - DNA, 22 bp, Artificial Sequence
  Synthetic oligonucleotide; TTT chr2 60510821 60510842 60510838 60510843 +
gagccagattccattttcccca

SEQ ID NO: 202800 - DNA, 22 bp, Artificial Sequence
  Synthetic oligonucleotide; TTG chr2 60510822 60510843 60510839 60510844 +
agccagattccattttccccac

SEQ ID NO: 202801 - DNA, 22 bp, Artificial Sequence
  Synthetic oligonucleotide; TTC chr2 60510832 60510853 60510849 60510854 +
cattttccccacaggccctgag

SEQ ID NO: 202802 - DNA, 22 bp, Artificial Sequence
  Synthetic oligonucleotide; TTT chr2 60510837 60510858 60510854 60510859 +
tccccacaggccctgagaccca

SEQ ID NO: 202803 - DNA, 22 bp, Artificial Sequence
  Synthetic oligonucleotide; TTT chr2 60510838 60510859 60510855 60510860 +
ccccacaggccctgagacccac

SEQ ID NO: 202804 - DNA, 22 bp, Artificial Sequence
  Synthetic oligonucleotide; TTC chr2 60510839 60510860 60510856 60510861 +
cccacaggccctgagacccaca

SEQ ID NO: 202805 - DNA, 22 bp, Artificial Sequence
  Synthetic oligonucleotide; CTG chr2 60510852 60510873 60510869 60510874 +
agacccacagggaagagctttt

SEQ ID NO: 202806 - DNA, 22 bp, Artificial Sequence
  Synthetic oligonucleotide; CTT chr2 60510872 60510893 60510889 60510894 +
ttgcattataatgtaaatggag

SEQ ID NO: 202807 - DNA, 22 bp, Artificial Sequence
  Synthetic oligonucleotide; TTT chr2 60510873 60510894 60510890 60510895 +
tgcattataatgtaaatggagg

SEQ ID NO: 202808 - DNA, 22 bp, Artificial Sequence
  Synthetic oligonucleotide; TTT chr2 60510874 60510895 60510891 60510896 +
gcattataatgtaaatggaggg

SEQ ID NO: 202809 - DNA, 22 bp, Artificial Sequence
  Synthetic oligonucleotide; TTG chr2 60510875 60510896 60510892 60510897 +
cattataatgtaaatggagggg

SEQ ID NO: 202810 - DNA, 22 bp, Artificial Sequence
  Synthetic oligonucleotide; TTA chr2 60510880 60510901 60510897 60510902 +
taatgtaaatggaggggttgag

SEQ ID NO: 202811 - DNA, 22 bp, Artificial Sequence
  Synthetic oligonucleotide; TTG chr2 60510900 60510921 60510917 60510922 +
agctggtttgggggaacccttg

SEQ ID NO: 202812 - DNA, 22 bp, Artificial Sequence
  Synthetic oligonucleotide; CTG chr2 60510905 60510926 60510922 60510927 +
gtttgggggaacccttgacagg

SEQ ID NO: 202813 - DNA, 22 bp, Artificial Sequence
  Synthetic oligonucleotide; TTT chr2 60510909 60510930 60510926 60510931 +
gggggaacccttgacaggagcc

SEQ ID NO: 202814 - DNA, 22 bp, Artificial Sequence
  Synthetic oligonucleotide; TTG chr2 60510910 60510931 60510927 60510932 +
ggggaacccttgacaggagcca

SEQ ID NO: 202815 - DNA, 22 bp, Artificial Sequence
  Synthetic oligonucleotide; CTT chr2 60510921 60510942 60510938 60510943 +
gacaggagccagttaaaaccaa

SEQ ID NO: 202816 - DNA, 22 bp, Artificial Sequence
  Synthetic oligonucleotide; TTG chr2 60510922 60510943 60510939 60510944 +
acaggagccagttaaaaccaaa

SEQ ID NO: 202817 - DNA, 22 bp, Artificial Sequence
  Synthetic oligonucleotide; TTA chr2 60510936 60510957 60510953 60510958 +
aaaccaaacgaaagtctttcct

SEQ ID NO: 202818 - DNA, 22 bp, Artificial Sequence
  Synthetic oligonucleotide; CTT chr2 60510954 60510975 60510971 60510976 +
tcctaaggcttaggtggagcct

SEQ ID NO: 202819 - DNA, 22 bp, Artificial Sequence
  Synthetic oligonucleotide; TTT chr2 60510955 60510976 60510972 60510977 +
cctaaggcttaggtggagcctc

SEQ ID NO: 202820 - DNA, 22 bp, Artificial Sequence
  Synthetic oligonucleotide; TTC chr2 60510956 60510977 60510973 60510978 +
ctaaggcttaggtggagcctct

SEQ ID NO: 202821 - DNA, 22 bp, Artificial Sequence
  Synthetic oligonucleotide; CTA chr2 60510959 60510980 60510976 60510981 +
aggcttaggtggagcctctaga

SEQ ID NO: 202822 - DNA, 22 bp, Artificial Sequence
  Synthetic oligonucleotide; CTT chr2 60510965 60510986 60510982 60510987 +
aggtggagcctctagaaagagg

SEQ ID NO: 202823 - DNA, 22 bp, Artificial Sequence
  Synthetic oligonucleotide; TTA chr2 60510966 60510987 60510983 60510988 +
ggtggagcctctagaaagaggg

SEQ ID NO: 202824 - DNA, 22 bp, Artificial Sequence
  Synthetic oligonucleotide; CTC chr2 60510977 60510998 60510994 60510999 +
tagaaagaggggctgagagcct

SEQ ID NO: 202825 - DNA, 22 bp, Artificial Sequence
  Synthetic oligonucleotide; CTA chr2 60510979 60511000 60510996 60511001 +
gaaagaggggctgagagcctgg

SEQ ID NO: 202826 - DNA, 22 bp, Artificial Sequence
  Synthetic oligonucleotide; CTG chr2 60510992 60511013 60511009 60511014 +
agagcctggggaagagccaacc

SEQ ID NO: 202827 - DNA, 22 bp, Artificial Sequence
  Synthetic oligonucleotide; CTG chr2 60511000 60511021 60511017 60511022 +
gggaagagccaaccaccagcag

SEQ ID NO: 202828 - DNA, 22 bp, Artificial Sequence
  Synthetic oligonucleotide; TTC chr2 60511025 60511046 60511042 60511047 +
ctcagagttcttcccactgggg

SEQ ID NO: 202829 - DNA, 22 bp, Artificial Sequence
  Synthetic oligonucleotide; CTC chr2 60511028 60511049 60511045 60511050 +
agagttcttcccactggggctg

SEQ ID NO: 202830 - DNA, 22 bp, Artificial Sequence
  Synthetic oligonucleotide; TTC chr2 60511035 60511056 60511052 60511057 +
ttcccactggggctgtgcagcc

SEQ ID NO: 202831 - DNA, 22 bp, Artificial Sequence
  Synthetic oligonucleotide; CTT chr2 60511037 60511058 60511054 60511059 +
cccactggggctgtgcagccaa

SEQ ID NO: 202832 - DNA, 22 bp, Artificial Sequence
  Synthetic oligonucleotide; TTC chr2 60511038 60511059 60511055 60511060 +
ccactggggctgtgcagccaac

SEQ ID NO: 202833 - DNA, 22 bp, Artificial Sequence
  Synthetic oligonucleotide; CTG chr2 60511044 60511065 60511061 60511066 +
gggctgtgcagccaactgcgtt

SEQ ID NO: 202834 - DNA, 22 bp, Artificial Sequence
  Synthetic oligonucleotide; CTG chr2 60511050 60511071 60511067 60511072 +
tgcagccaactgcgtttccagg

SEQ ID NO: 202835 - DNA, 22 bp, Artificial Sequence
  Synthetic oligonucleotide; CTG chr2 60511062 60511083 60511079 60511084 +
cgtttccaggcacactgagatg

SEQ ID NO: 202836 - DNA, 22 bp, Artificial Sequence
  Synthetic oligonucleotide; TTT chr2 60511067 60511088 60511084 60511089 +
ccaggcacactgagatgcccat

SEQ ID NO: 202837 - DNA, 22 bp, Artificial Sequence
  Synthetic oligonucleotide; TTC chr2 60511068 60511089 60511085 60511090 +
caggcacactgagatgcccata

SEQ ID NO: 202838 - DNA, 22 bp, Artificial Sequence
  Synthetic oligonucleotide; CTG chr2 60511079 60511100 60511096 60511101 +
agatgcccatactcatatccaa

SEQ ID NO: 202839 - DNA, 22 bp, Artificial Sequence
  Synthetic oligonucleotide; CTC chr2 60511093 60511114 60511110 60511115 +
atatccaatactgtgcaggggc

SEQ ID NO: 202840 - DNA, 22 bp, Artificial Sequence
  Synthetic oligonucleotide; CTG chr2 60511106 60511127 60511123 60511128 +
tgcaggggcactggccaggcac

SEQ ID NO: 202841 - DNA, 22 bp, Artificial Sequence
  Synthetic oligonucleotide; CTG chr2 60511119 60511140 60511136 60511141 +
gccaggcacaaatcccagctgc

SEQ ID NO: 202842 - DNA, 22 bp, Artificial Sequence
  Synthetic oligonucleotide; CTG chr2 60511140 60511161 60511157 60511162 +
cctccacggcattactctccct

SEQ ID NO: 202843 - DNA, 22 bp, Artificial Sequence
  Synthetic oligonucleotide; CTC chr2 60511144 60511165 60511161 60511166 +
cacggcattactctccctccat

SEQ ID NO: 202844 - DNA, 22 bp, Artificial Sequence
  Synthetic oligonucleotide; TTA chr2 60511154 60511175 60511171 60511176 +
ctctccctccattcttgctttc

SEQ ID NO: 202845 - DNA, 22 bp, Artificial Sequence
  Synthetic oligonucleotide; CTC chr2 60511157 60511178 60511174 60511179 +
tccctccattcttgctttcaga

SEQ ID NO: 202846 - DNA, 22 bp, Artificial Sequence
  Synthetic oligonucleotide; CTC chr2 60511159 60511180 60511176 60511181 +
cctccattcttgctttcagatt

SEQ ID NO: 202847 - DNA, 22 bp, Artificial Sequence
  Synthetic oligonucleotide; CTC chr2 60511163 60511184 60511180 60511185 +
cattcttgctttcagattctcc

SEQ ID NO: 202848 - DNA, 22 bp, Artificial Sequence
  Synthetic oligonucleotide; TTC chr2 60511168 60511189 60511185 60511190 +
ttgctttcagattctccctcct

SEQ ID NO: 202849 - DNA, 22 bp, Artificial Sequence
  Synthetic oligonucleotide; CTT chr2 60511170 60511191 60511187 60511192 +
gctttcagattctccctcctcc

SEQ ID NO: 202850 - DNA, 22 bp, Artificial Sequence
  Synthetic oligonucleotide; TTG chr2 60511171 60511192 60511188 60511193 +
ctttcagattctccctcctcct

SEQ ID NO: 202851 - DNA, 22 bp, Artificial Sequence
  Synthetic oligonucleotide; CTT chr2 60511174 60511195 60511191 60511196 +
tcagattctccctcctcctggc

SEQ ID NO: 202852 - DNA, 22 bp, Artificial Sequence
  Synthetic oligonucleotide; TTT chr2 60511175 60511196 60511192 60511197 +
cagattctccctcctcctggca

SEQ ID NO: 202853 - DNA, 22 bp, Artificial Sequence
  Synthetic oligonucleotide; TTC chr2 60511176 60511197 60511193 60511198 +
agattctccctcctcctggcag

SEQ ID NO: 202854 - DNA, 22 bp, Artificial Sequence
  Synthetic oligonucleotide; TTC chr2 60511182 60511203 60511199 60511204 +
tccctcctcctggcaggggcac

SEQ ID NO: 202855 - DNA, 22 bp, Artificial Sequence
  Synthetic oligonucleotide; CTC chr2 60511184 60511205 60511201 60511206 +
cctcctcctggcaggggcactg

SEQ ID NO: 202856 - DNA, 22 bp, Artificial Sequence
  Synthetic oligonucleotide; CTC chr2 60511188 60511209 60511205 60511210 +
ctcctggcaggggcactgggga

SEQ ID NO: 202857 - DNA, 22 bp, Artificial Sequence
  Synthetic oligonucleotide; CTC chr2 60511191 60511212 60511208 60511213 +
ctggcaggggcactggggaggg

SEQ ID NO: 202858 - DNA, 22 bp, Artificial Sequence
  Synthetic oligonucleotide; CTG chr2 60511194 60511215 60511211 60511216 +
gcaggggcactggggagggcag

SEQ ID NO: 202859 - DNA, 22 bp, Artificial Sequence
  Synthetic oligonucleotide; CTG chr2 60511206 60511227 60511223 60511228 +
gggagggcaggagagaaggagg

SEQ ID NO: 202860 - DNA, 22 bp, Artificial Sequence
  Synthetic oligonucleotide; CTT chr2 60511252 60511273 60511269 60511274 +
ctacctgagagcccgggatgca

SEQ ID NO: 202861 - DNA, 22 bp, Artificial Sequence
  Synthetic oligonucleotide; TTC chr2 60511253 60511274 60511270 60511275 +
tacctgagagcccgggatgcag

SEQ ID NO: 202862 - DNA, 22 bp, Artificial Sequence
  Synthetic oligonucleotide; CTA chr2 60511255 60511276 60511272 60511277 +
cctgagagcccgggatgcagcc

SEQ ID NO: 202863 - DNA, 22 bp, Artificial Sequence
  Synthetic oligonucleotide; CTG chr2 60511259 60511280 60511276 60511281 +
agagcccgggatgcagccagaa

SEQ ID NO: 202864 - DNA, 22 bp, Artificial Sequence
  Synthetic oligonucleotide; CTA chr2 60511287 60511308 60511304 60511309 +
aaataccctttcccaccctagc

SEQ ID NO: 202865 - DNA, 22 bp, Artificial Sequence
  Synthetic oligonucleotide; CTT chr2 60511297 60511318 60511314 60511319 +
tcccaccctagcatacaatttg

SEQ ID NO: 202866 - DNA, 22 bp, Artificial Sequence
  Synthetic oligonucleotide; TTT chr2 60511298 60511319 60511315 60511320 +
cccaccctagcatacaatttga

SEQ ID NO: 202867 - DNA, 22 bp, Artificial Sequence
  Synthetic oligonucleotide; TTC chr2 60511299 60511320 60511316 60511321 +
ccaccctagcatacaatttgac

SEQ ID NO: 202868 - DNA, 22 bp, Artificial Sequence
  Synthetic oligonucleotide; CTA chr2 60511307 60511328 60511324 60511329 +
gcatacaatttgacaggtgaat

SEQ ID NO: 202869 - DNA, 22 bp, Artificial Sequence
  Synthetic oligonucleotide; TTT chr2 60511318 60511339 60511335 60511340 +
gacaggtgaataagtgctcccc

SEQ ID NO: 202870 - DNA, 22 bp, Artificial Sequence
  Synthetic oligonucleotide; TTG chr2 60511319 60511340 60511336 60511341 +
acaggtgaataagtgctcccca

SEQ ID NO: 202871 - DNA, 22 bp, Artificial Sequence
  Synthetic oligonucleotide; CTC chr2 60511337 60511358 60511354 60511359 +
cccagtaggcaataacaaggag

SEQ ID NO: 202872 - DNA, 22 bp, Artificial Sequence
  Synthetic oligonucleotide; CTG chr2 60511366 60511387 60511383 60511388 +
aattaaaagaactcgccaattt

SEQ ID NO: 202873 - DNA, 22 bp, Artificial Sequence
  Synthetic oligonucleotide; TTA chr2 60511371 60511392 60511388 60511393 +
aaagaactcgccaatttgggaa

SEQ ID NO: 202874 - DNA, 22 bp, Artificial Sequence
  Synthetic oligonucleotide; CTC chr2 60511380 60511401 60511397 60511402 +
gccaatttgggaagtaatgtca

SEQ ID NO: 202875 - DNA, 22 bp, Artificial Sequence
  Synthetic oligonucleotide; TTT chr2 60511388 60511409 60511405 60511410 +
gggaagtaatgtcattctatgt

SEQ ID NO: 202876 - DNA, 22 bp, Artificial Sequence
  Synthetic oligonucleotide; TTG chr2 60511389 60511410 60511406 60511411 +
ggaagtaatgtcattctatgtg

SEQ ID NO: 202877 - DNA, 22 bp, Artificial Sequence
  Synthetic oligonucleotide; TTC chr2 60511405 60511426 60511422 60511427 +
tatgtgactccactcttttccg

SEQ ID NO: 202878 - DNA, 22 bp, Artificial Sequence
  Synthetic oligonucleotide; CTA chr2 60511407 60511428 60511424 60511429 +
tgtgactccactcttttccgtt

SEQ ID NO: 202879 - DNA, 22 bp, Artificial Sequence
  Synthetic oligonucleotide; CTC chr2 60511415 60511436 60511432 60511437 +
cactcttttccgttaccaataa

SEQ ID NO: 202880 - DNA, 22 bp, Artificial Sequence
  Synthetic oligonucleotide; CTC chr2 60511420 60511441 60511437 60511442 +
ttttccgttaccaataaaacac

SEQ ID NO: 202881 - DNA, 22 bp, Artificial Sequence
  Synthetic oligonucleotide; CTT chr2 60511422 60511443 60511439 60511444 +
ttccgttaccaataaaacactt

SEQ ID NO: 202882 - DNA, 22 bp, Artificial Sequence
  Synthetic oligonucleotide; TTT chr2 60511423 60511444 60511440 60511445 +
tccgttaccaataaaacactta

SEQ ID NO: 202883 - DNA, 22 bp, Artificial Sequence
  Synthetic oligonucleotide; TTT chr2 60511424 60511445 60511441 60511446 +
ccgttaccaataaaacacttaa

SEQ ID NO: 202884 - DNA, 22 bp, Artificial Sequence
  Synthetic oligonucleotide; TTC chr2 60511425 60511446 60511442 60511447 +
cgttaccaataaaacacttaaa

SEQ ID NO: 202885 - DNA, 22 bp, Artificial Sequence
  Synthetic oligonucleotide; TTA chr2 60511430 60511451 60511447 60511452 +
ccaataaaacacttaaagatgc

SEQ ID NO: 202886 - DNA, 22 bp, Artificial Sequence
  Synthetic oligonucleotide; CTT chr2 60511444 60511465 60511461 60511466 +
aaagatgctattcatgcagaca

SEQ ID NO: 202887 - DNA, 22 bp, Artificial Sequence
  Synthetic oligonucleotide; TTA chr2 60511445 60511466 60511462 60511467 +
aagatgctattcatgcagacat

SEQ ID NO: 202888 - DNA, 22 bp, Artificial Sequence
  Synthetic oligonucleotide; CTA chr2 60511454 60511475 60511471 60511476 +
ttcatgcagacataaagtgcta

SEQ ID NO: 202889 - DNA, 22 bp, Artificial Sequence
  Synthetic oligonucleotide; TTC chr2 60511457 60511478 60511474 60511479 +
atgcagacataaagtgctaatg

SEQ ID NO: 202890 - DNA, 22 bp, Artificial Sequence
  Synthetic oligonucleotide; CTA chr2 60511476 60511497 60511493 60511498 +
atggccacttgttaccatgttt

SEQ ID NO: 202891 - DNA, 22 bp, Artificial Sequence
  Synthetic oligonucleotide; CTT chr2 60511486 60511507 60511503 60511508 +
gttaccatgtttcataatgcta

SEQ ID NO: 202892 - DNA, 22 bp, Artificial Sequence
  Synthetic oligonucleotide; TTG chr2 60511487 60511508 60511504 60511509 +
ttaccatgtttcataatgctaa

SEQ ID NO: 202893 - DNA, 22 bp, Artificial Sequence
  Synthetic oligonucleotide; TTA chr2 60511490 60511511 60511507 60511512 +
ccatgtttcataatgctaatat

SEQ ID NO: 202894 - DNA, 22 bp, Artificial Sequence
  Synthetic oligonucleotide; TTT chr2 60511498 60511519 60511515 60511520 +
cataatgctaatatttccctct

SEQ ID NO: 202895 - DNA, 22 bp, Artificial Sequence
  Synthetic oligonucleotide; TTC chr2 60511499 60511520 60511516 60511521 +
ataatgctaatatttccctctg

SEQ ID NO: 202896 - DNA, 22 bp, Artificial Sequence
  Synthetic oligonucleotide; CTA chr2 60511508 60511529 60511525 60511530 +
atatttccctctgatttctgac

SEQ ID NO: 202897 - DNA, 22 bp, Artificial Sequence
  Synthetic oligonucleotide; TTT chr2 60511514 60511535 60511531 60511536 +
ccctctgatttctgacagttct

SEQ ID NO: 202898 - DNA, 22 bp, Artificial Sequence
  Synthetic oligonucleotide; TTC chr2 60511515 60511536 60511532 60511537 +
cctctgatttctgacagttctt

SEQ ID NO: 202899 - DNA, 22 bp, Artificial Sequence
  Synthetic oligonucleotide; CTC chr2 60511519 60511540 60511536 60511541 +
tgatttctgacagttctttttt

SEQ ID NO: 202900 - DNA, 22 bp, Artificial Sequence
  Synthetic oligonucleotide; CTG chr2 60511521 60511542 60511538 60511543 +
atttctgacagttctttttttt

SEQ ID NO: 202901 - DNA, 22 bp, Artificial Sequence
  Synthetic oligonucleotide; TTT chr2 60511525 60511546 60511542 60511547 +
ctgacagttctttttttttcct

SEQ ID NO: 202902 - DNA, 22 bp, Artificial Sequence
  Synthetic oligonucleotide; TTC chr2 60511526 60511547 60511543 60511548 +
tgacagttctttttttttcctt

SEQ ID NO: 202903 - DNA, 22 bp, Artificial Sequence
  Synthetic oligonucleotide; CTG chr2 60511528 60511549 60511545 60511550 +
acagttctttttttttccttct

SEQ ID NO: 202904 - DNA, 22 bp, Artificial Sequence
  Synthetic oligonucleotide; TTC chr2 60511535 60511556 60511552 60511557 +
tttttttttccttcttcttttt

SEQ ID NO: 202905 - DNA, 22 bp, Artificial Sequence
  Synthetic oligonucleotide; CTT chr2 60511537 60511558 60511554 60511559 +
tttttttccttcttcttttttg

SEQ ID NO: 202906 - DNA, 22 bp, Artificial Sequence
  Synthetic oligonucleotide; TTT chr2 60511538 60511559 60511555 60511560 +
ttttttccttcttcttttttgg

SEQ ID NO: 202907 - DNA, 22 bp, Artificial Sequence
  Synthetic oligonucleotide; TTT chr2 60511539 60511560 60511556 60511561 +
tttttccttcttcttttttggg

SEQ ID NO: 202908 - DNA, 22 bp, Artificial Sequence
  Synthetic oligonucleotide; TTT chr2 60511540 60511561 60511557 60511562 +
ttttccttcttcttttttgggg

SEQ ID NO: 202909 - DNA, 22 bp, Artificial Sequence
  Synthetic oligonucleotide; TTT chr2 60511541 60511562 60511558 60511563 +
tttccttcttcttttttggggc

SEQ ID NO: 202910 - DNA, 22 bp, Artificial Sequence
  Synthetic oligonucleotide; TTT chr2 60511542 60511563 60511559 60511564 +
ttccttcttcttttttggggct

SEQ ID NO: 202911 - DNA, 22 bp, Artificial Sequence
  Synthetic oligonucleotide; TTT chr2 60511543 60511564 60511560 60511565 +
tccttcttcttttttggggcta

SEQ ID NO: 202912 - DNA, 22 bp, Artificial Sequence
  Synthetic oligonucleotide; TTT chr2 60511544 60511565 60511561 60511566 +
ccttcttcttttttggggctat

SEQ ID NO: 202913 - DNA, 22 bp, Artificial Sequence
  Synthetic oligonucleotide; TTC chr2 60511545 60511566 60511562 60511567 +
cttcttcttttttggggctatt

SEQ ID NO: 202914 - DNA, 22 bp, Artificial Sequence
  Synthetic oligonucleotide; CTT chr2 60511548 60511569 60511565 60511570 +
cttcttttttggggctatttta

SEQ ID NO: 202915 - DNA, 22 bp, Artificial Sequence
  Synthetic oligonucleotide; TTC chr2 60511549 60511570 60511566 60511571 +
ttcttttttggggctattttaa

SEQ ID NO: 202916 - DNA, 22 bp, Artificial Sequence
  Synthetic oligonucleotide; CTT chr2 60511551 60511572 60511568 60511573 +
cttttttggggctattttaagt

SEQ ID NO: 202917 - DNA, 22 bp, Artificial Sequence
  Synthetic oligonucleotide; TTC chr2 60511552 60511573 60511569 60511574 +
ttttttggggctattttaagtt

SEQ ID NO: 202918 - DNA, 22 bp, Artificial Sequence
  Synthetic oligonucleotide; CTT chr2 60511554 60511575 60511571 60511576 +
ttttggggctattttaagttaa

SEQ ID NO: 202919 - DNA, 22 bp, Artificial Sequence
  Synthetic oligonucleotide; TTT chr2 60511555 60511576 60511572 60511577 +
tttggggctattttaagttaac

SEQ ID NO: 202920 - DNA, 22 bp, Artificial Sequence
  Synthetic oligonucleotide; TTT chr2 60511556 60511577 60511573 60511578 +
ttggggctattttaagttaaca

SEQ ID NO: 202921 - DNA, 22 bp, Artificial Sequence
  Synthetic oligonucleotide; TTT chr2 60511557 60511578 60511574 60511579 +
tggggctattttaagttaacag

SEQ ID NO: 202922 - DNA, 22 bp, Artificial Sequence
  Synthetic oligonucleotide; TTT chr2 60511558 60511579 60511575 60511580 +
ggggctattttaagttaacaga

SEQ ID NO: 202923 - DNA, 22 bp, Artificial Sequence
  Synthetic oligonucleotide; TTG chr2 60511559 60511580 60511576 60511581 +
gggctattttaagttaacagag

SEQ ID NO: 202924 - DNA, 22 bp, Artificial Sequence
  Synthetic oligonucleotide; CTA chr2 60511565 60511586 60511582 60511587 +
ttttaagttaacagagcgctaa

SEQ ID NO: 202925 - DNA, 22 bp, Artificial Sequence
  Synthetic oligonucleotide; TTT chr2 60511568 60511589 60511585 60511590 +
taagttaacagagcgctaatct

SEQ ID NO: 202926 - DNA, 22 bp, Artificial Sequence
  Synthetic oligonucleotide; TTT chr2 60511569 60511590 60511586 60511591 +
aagttaacagagcgctaatctg

SEQ ID NO: 202927 - DNA, 22 bp, Artificial Sequence
  Synthetic oligonucleotide; TTA chr2 60511570 60511591 60511587 60511592 +
agttaacagagcgctaatctga

SEQ ID NO: 202928 - DNA, 22 bp, Artificial Sequence
  Synthetic oligonucleotide; TTA chr2 60511575 60511596 60511592 60511597 +
acagagcgctaatctgattcaa

SEQ ID NO: 202929 - DNA, 22 bp, Artificial Sequence
  Synthetic oligonucleotide; CTA chr2 60511586 60511607 60511603 60511608 +
atctgattcaaaactgaagact

SEQ ID NO: 202930 - DNA, 22 bp, Artificial Sequence
  Synthetic oligonucleotide; CTG chr2 60511591 60511612 60511608 60511613 +
attcaaaactgaagactcaaag

SEQ ID NO: 202931 - DNA, 22 bp, Artificial Sequence
  Synthetic oligonucleotide; TTC chr2 60511595 60511616 60511612 60511617 +
aaaactgaagactcaaagagct

SEQ ID NO: 202932 - DNA, 22 bp, Artificial Sequence
  Synthetic oligonucleotide; CTG chr2 60511602 60511623 60511619 60511624 +
aagactcaaagagctacactct

SEQ ID NO: 202933 - DNA, 22 bp, Artificial Sequence
  Synthetic oligonucleotide; CTC chr2 60511609 60511630 60511626 60511631 +
aaagagctacactctacataac

SEQ ID NO: 202934 - DNA, 22 bp, Artificial Sequence
  Synthetic oligonucleotide; CTA chr2 60511618 60511639 60511635 60511640 +
cactctacataactgcactatt

SEQ ID NO: 202935 - DNA, 22 bp, Artificial Sequence
  Synthetic oligonucleotide; CTC chr2 60511623 60511644 60511640 60511645 +
tacataactgcactattaatga

SEQ ID NO: 202936 - DNA, 22 bp, Artificial Sequence
  Synthetic oligonucleotide; CTA chr2 60511625 60511646 60511642 60511647 +
cataactgcactattaatgaca

SEQ ID NO: 202937 - DNA, 22 bp, Artificial Sequence
  Synthetic oligonucleotide; CTG chr2 60511633 60511654 60511650 60511655 +
cactattaatgacaaccattgc

SEQ ID NO: 202938 - DNA, 22 bp, Artificial Sequence
  Synthetic oligonucleotide; CTA chr2 60511638 60511659 60511655 60511660 +
ttaatgacaaccattgctttac

SEQ ID NO: 202939 - DNA, 22 bp, Artificial Sequence
  Synthetic oligonucleotide; TTA chr2 60511641 60511662 60511658 60511663 +
atgacaaccattgctttacatg

SEQ ID NO: 202940 - DNA, 22 bp, Artificial Sequence
  Synthetic oligonucleotide; TTG chr2 60511654 60511675 60511671 60511676 +
ctttacatgttgcaccatttca

SEQ ID NO: 202941 - DNA, 22 bp, Artificial Sequence
  Synthetic oligonucleotide; CTT chr2 60511657 60511678 60511674 60511679 +
tacatgttgcaccatttcatga

SEQ ID NO: 202942 - DNA, 22 bp, Artificial Sequence
  Synthetic oligonucleotide; TTT chr2 60511658 60511679 60511675 60511680 +
acatgttgcaccatttcatgaa

SEQ ID NO: 202943 - DNA, 22 bp, Artificial Sequence
  Synthetic oligonucleotide; TTA chr2 60511659 60511680 60511676 60511681 +
catgttgcaccatttcatgaaa

SEQ ID NO: 202944 - DNA, 22 bp, Artificial Sequence
  Synthetic oligonucleotide; TTG chr2 60511666 60511687 60511683 60511688 +
caccatttcatgaaaacaatca

SEQ ID NO: 202945 - DNA, 22 bp, Artificial Sequence
  Synthetic oligonucleotide; TTT chr2 60511674 60511695 60511691 60511696 +
catgaaaacaatcatcactcag

SEQ ID NO: 202946 - DNA, 22 bp, Artificial Sequence
  Synthetic oligonucleotide; TTC chr2 60511675 60511696 60511692 60511697 +
atgaaaacaatcatcactcagt

SEQ ID NO: 202947 - DNA, 22 bp, Artificial Sequence
  Synthetic oligonucleotide; CTC chr2 60511694 60511715 60511711 60511716 +
agtcaacgtattttccaagcca

SEQ ID NO: 202948 - DNA, 22 bp, Artificial Sequence
  Synthetic oligonucleotide; TTT chr2 60511707 60511728 60511724 60511729 +
tccaagccacagaaaataagtt

SEQ ID NO: 202949 - DNA, 22 bp, Artificial Sequence
  Synthetic oligonucleotide; TTT chr2 60511708 60511729 60511725 60511730 +
ccaagccacagaaaataagttg

SEQ ID NO: 202950 - DNA, 22 bp, Artificial Sequence
  Synthetic oligonucleotide; TTC chr2 60511709 60511730 60511726 60511731 +
caagccacagaaaataagttga

SEQ ID NO: 202951 - DNA, 22 bp, Artificial Sequence
  Synthetic oligonucleotide; TTG chr2 60511730 60511751 60511747 60511752 +
aaataagttgaaaatgcagtag

SEQ ID NO: 202952 - DNA, 22 bp, Artificial Sequence
  Synthetic oligonucleotide; TTG chr2 60511740 60511761 60511757 60511762 +
aaaatgcagtaggcaaagaagc

SEQ ID NO: 202953 - DNA, 22 bp, Artificial Sequence
  Synthetic oligonucleotide; CTA chr2 60511767 60511788 60511784 60511789 +
gtcatgtaagacactaaggggc

SEQ ID NO: 202954 - DNA, 22 bp, Artificial Sequence
  Synthetic oligonucleotide; CTA chr2 60511783 60511804 60511800 60511805 +
aggggcaggggagtcattaatt

SEQ ID NO: 202955 - DNA, 22 bp, Artificial Sequence
  Synthetic oligonucleotide; TTA chr2 60511802 60511823 60511819 60511824 +
attcttctccaagctttcaaca

SEQ ID NO: 202956 - DNA, 22 bp, Artificial Sequence
  Synthetic oligonucleotide; TTC chr2 60511806 60511827 60511823 60511828 +
ttctccaagctttcaacactct

SEQ ID NO: 202957 - DNA, 22 bp, Artificial Sequence
  Synthetic oligonucleotide; CTT chr2 60511808 60511829 60511825 60511830 +
ctccaagctttcaacactctgt

SEQ ID NO: 202958 - DNA, 22 bp, Artificial Sequence
  Synthetic oligonucleotide; TTC chr2 60511809 60511830 60511826 60511831 +
tccaagctttcaacactctgtt

SEQ ID NO: 202959 - DNA, 22 bp, Artificial Sequence
  Synthetic oligonucleotide; CTC chr2 60511811 60511832 60511828 60511833 +
caagctttcaacactctgtttc

SEQ ID NO: 202960 - DNA, 22 bp, Artificial Sequence
  Synthetic oligonucleotide; CTT chr2 60511818 60511839 60511835 60511840 +
tcaacactctgtttctatgaag

SEQ ID NO: 202961 - DNA, 22 bp, Artificial Sequence
  Synthetic oligonucleotide; TTT chr2 60511819 60511840 60511836 60511841 +
caacactctgtttctatgaagg

SEQ ID NO: 202962 - DNA, 22 bp, Artificial Sequence
  Synthetic oligonucleotide; TTC chr2 60511820 60511841 60511837 60511842 +
aacactctgtttctatgaaggc

SEQ ID NO: 202963 - DNA, 22 bp, Artificial Sequence
  Synthetic oligonucleotide; CTC chr2 60511827 60511848 60511844 60511849 +
tgtttctatgaaggcaagggtt

SEQ ID NO: 202964 - DNA, 22 bp, Artificial Sequence
  Synthetic oligonucleotide; CTG chr2 60511829 60511850 60511846 60511851 +
tttctatgaaggcaagggttgg

SEQ ID NO: 202965 - DNA, 22 bp, Artificial Sequence
  Synthetic oligonucleotide; TTT chr2 60511832 60511853 60511849 60511854 +
ctatgaaggcaagggttggagg

SEQ ID NO: 202966 - DNA, 22 bp, Artificial Sequence
  Synthetic oligonucleotide; TTC chr2 60511833 60511854 60511850 60511855 +
tatgaaggcaagggttggaggg

SEQ ID NO: 202967 - DNA, 22 bp, Artificial Sequence
  Synthetic oligonucleotide; CTA chr2 60511835 60511856 60511852 60511857 +
tgaaggcaagggttggagggag

SEQ ID NO: 202968 - DNA, 22 bp, Artificial Sequence
  Synthetic oligonucleotide; TTG chr2 60511850 60511871 60511867 60511872 +
gagggagcttttttctttcaaa

SEQ ID NO: 202969 - DNA, 22 bp, Artificial Sequence
  Synthetic oligonucleotide; CTT chr2 60511860 60511881 60511877 60511882 +
ttttctttcaaataaatcagta

SEQ ID NO: 202970 - DNA, 22 bp, Artificial Sequence
  Synthetic oligonucleotide; TTT chr2 60511861 60511882 60511878 60511883 +
tttctttcaaataaatcagtaa

SEQ ID NO: 202971 - DNA, 22 bp, Artificial Sequence
  Synthetic oligonucleotide; TTT chr2 60511862 60511883 60511879 60511884 +
ttctttcaaataaatcagtaaa

SEQ ID NO: 202972 - DNA, 22 bp, Artificial Sequence
  Synthetic oligonucleotide; TTT chr2 60511863 60511884 60511880 60511885 +
tctttcaaataaatcagtaaaa

SEQ ID NO: 202973 - DNA, 22 bp, Artificial Sequence
  Synthetic oligonucleotide; TTT chr2 60511864 60511885 60511881 60511886 +
ctttcaaataaatcagtaaaat

SEQ ID NO: 202974 - DNA, 22 bp, Artificial Sequence
  Synthetic oligonucleotide; TTC chr2 60511865 60511886 60511882 60511887 +
tttcaaataaatcagtaaaatg

SEQ ID NO: 202975 - DNA, 22 bp, Artificial Sequence
  Synthetic oligonucleotide; CTT chr2 60511867 60511888 60511884 60511889 +
tcaaataaatcagtaaaatgat

SEQ ID NO: 202976 - DNA, 22 bp, Artificial Sequence
  Synthetic oligonucleotide; TTT chr2 60511868 60511889 60511885 60511890 +
caaataaatcagtaaaatgatg

SEQ ID NO: 202977 - DNA, 22 bp, Artificial Sequence
  Synthetic oligonucleotide; TTC chr2 60511869 60511890 60511886 60511891 +
aaataaatcagtaaaatgatga

SEQ ID NO: 202978 - DNA, 22 bp, Artificial Sequence
  Synthetic oligonucleotide; CTT chr2 60511898 60511919 60511915 60511920 +
cctctgctacgcccagtggccc

SEQ ID NO: 202979 - DNA, 22 bp, Artificial Sequence
  Synthetic oligonucleotide; TTC chr2 60511899 60511920 60511916 60511921 +
ctctgctacgcccagtggccca

SEQ ID NO: 202980 - DNA, 22 bp, Artificial Sequence
  Synthetic oligonucleotide; CTC chr2 60511902 60511923 60511919 60511924 +
tgctacgcccagtggcccaggc

SEQ ID NO: 202981 - DNA, 22 bp, Artificial Sequence
  Synthetic oligonucleotide; CTG chr2 60511904 60511925 60511921 60511926 +
ctacgcccagtggcccaggcac

SEQ ID NO: 202982 - DNA, 22 bp, Artificial Sequence
  Synthetic oligonucleotide; CTA chr2 60511907 60511928 60511924 60511929 +
cgcccagtggcccaggcactct

SEQ ID NO: 202983 - DNA, 22 bp, Artificial Sequence
  Synthetic oligonucleotide; CTC chr2 60511928 60511949 60511945 60511950 +
tcactaaggtatcctcccagca

SEQ ID NO: 202984 - DNA, 22 bp, Artificial Sequence
  Synthetic oligonucleotide; CTC chr2 60511930 60511951 60511947 60511952 +
actaaggtatcctcccagcaat

SEQ ID NO: 202985 - DNA, 22 bp, Artificial Sequence
  Synthetic oligonucleotide; CTA chr2 60511934 60511955 60511951 60511956 +
aggtatcctcccagcaatgtag

SEQ ID NO: 202986 - DNA, 22 bp, Artificial Sequence
  Synthetic oligonucleotide; CTC chr2 60511944 60511965 60511961 60511966 +
ccagcaatgtaggtgttcaaag

SEQ ID NO: 202987 - DNA, 22 bp, Artificial Sequence
  Synthetic oligonucleotide; TTC chr2 60511962 60511983 60511979 60511984 +
aaaggcaaaagaaagggaacca

SEQ ID NO: 202988 - DNA, 22 bp, Artificial Sequence
  Synthetic oligonucleotide; CTC chr2 60511988 60512009 60512005 60512010 +
atggcgtaatacttgctcggcc

SEQ ID NO: 202989 - DNA, 22 bp, Artificial Sequence
  Synthetic oligonucleotide; CTT chr2 60512002 60512023 60512019 60512024 +
gctcggccaaagacatagtaac

SEQ ID NO: 202990 - DNA, 22 bp, Artificial Sequence
  Synthetic oligonucleotide; TTG chr2 60512003 60512024 60512020 60512025 +
ctcggccaaagacatagtaacg

SEQ ID NO: 202991 - DNA, 22 bp, Artificial Sequence
  Synthetic oligonucleotide; CTC chr2 60512006 60512027 60512023 60512028 +
ggccaaagacatagtaacgctt

SEQ ID NO: 202992 - DNA, 22 bp, Artificial Sequence
  Synthetic oligonucleotide; CTT chr2 60512028 60512049 60512045 60512050 +
cccaggaaatacaagtgtcaca

SEQ ID NO: 202993 - DNA, 22 bp, Artificial Sequence
  Synthetic oligonucleotide; TTC chr2 60512029 60512050 60512046 60512051 +
ccaggaaatacaagtgtcacag

SEQ ID NO: 202994 - DNA, 22 bp, Artificial Sequence
  Synthetic oligonucleotide; CTC chr2 60512057 60512078 60512074 60512079 +
caaaatgaatatgtgtgcagcc

SEQ ID NO: 202995 - DNA, 22 bp, Artificial Sequence
  Synthetic oligonucleotide; CTG chr2 60512084 60512105 60512101 60512106 +
ggcttgcaacttaattcaaaca

SEQ ID NO: 202996 - DNA, 22 bp, Artificial Sequence
  Synthetic oligonucleotide; CTT chr2 60512089 60512110 60512106 60512111 +
gcaacttaattcaaacaacttg

SEQ ID NO: 202997 - DNA, 22 bp, Artificial Sequence
  Synthetic oligonucleotide; TTG chr2 60512090 60512111 60512107 60512112 +
caacttaattcaaacaacttgg

SEQ ID NO: 202998 - DNA, 22 bp, Artificial Sequence
  Synthetic oligonucleotide; CTT chr2 60512096 60512117 60512113 60512118 +
aattcaaacaacttggaaggct

SEQ ID NO: 202999 - DNA, 22 bp, Artificial Sequence
  Synthetic oligonucleotide; TTA chr2 60512097 60512118 60512114 60512119 +
attcaaacaacttggaaggcta

SEQ ID NO: 203000 - DNA, 22 bp, Artificial Sequence
  Synthetic oligonucleotide; TTC chr2 60512101 60512122 60512118 60512123 +
aaacaacttggaaggctaagga

SEQ ID NO: 203001 - DNA, 22 bp, Artificial Sequence
  Synthetic oligonucleotide; CTT chr2 60512110 60512131 60512127 60512132 +
ggaaggctaaggagcactggag

SEQ ID NO: 203002 - DNA, 22 bp, Artificial Sequence
  Synthetic oligonucleotide; TTG chr2 60512111 60512132 60512128 60512133 +
gaaggctaaggagcactggagc

SEQ ID NO: 203003 - DNA, 22 bp, Artificial Sequence
  Synthetic oligonucleotide; CTA chr2 60512119 60512140 60512136 60512141 +
aggagcactggagctggggagc

SEQ ID NO: 203004 - DNA, 22 bp, Artificial Sequence
  Synthetic oligonucleotide; CTG chr2 60512129 60512150 60512146 60512151 +
gagctggggagctgcagatgaa

SEQ ID NO: 203005 - DNA, 22 bp, Artificial Sequence
  Synthetic oligonucleotide; CTG chr2 60512135 60512156 60512152 60512157 +
gggagctgcagatgaacccctg

SEQ ID NO: 203006 - DNA, 22 bp, Artificial Sequence
  Synthetic oligonucleotide; CTG chr2 60512143 60512164 60512160 60512165 +
cagatgaacccctgtgctcacc

SEQ ID NO: 203007 - DNA, 22 bp, Artificial Sequence
  Synthetic oligonucleotide; CTG chr2 60512157 60512178 60512174 60512179 +
tgctcaccacccctggagagca

SEQ ID NO: 203008 - DNA, 22 bp, Artificial Sequence
  Synthetic oligonucleotide; CTC chr2 60512162 60512183 60512179 60512184 +
accacccctggagagcagtcag

SEQ ID NO: 203009 - DNA, 22 bp, Artificial Sequence
  Synthetic oligonucleotide; CTG chr2 60512172 60512193 60512189 60512194 +
gagagcagtcagagaggaagcc

SEQ ID NO: 203010 - DNA, 22 bp, Artificial Sequence
  Synthetic oligonucleotide; CTG chr2 60512196 60512217 60512213 60512218 +
ctttcctcagatgttttaaagg

SEQ ID NO: 203011 - DNA, 22 bp, Artificial Sequence
  Synthetic oligonucleotide; CTT chr2 60512199 60512220 60512216 60512221 +
tcctcagatgttttaaaggaag

SEQ ID NO: 203012 - DNA, 22 bp, Artificial Sequence
  Synthetic oligonucleotide; TTT chr2 60512200 60512221 60512217 60512222 +
cctcagatgttttaaaggaagc

SEQ ID NO: 203013 - DNA, 22 bp, Artificial Sequence
  Synthetic oligonucleotide; TTC chr2 60512201 60512222 60512218 60512223 +
ctcagatgttttaaaggaagcc

SEQ ID NO: 203014 - DNA, 22 bp, Artificial Sequence
  Synthetic oligonucleotide; CTC chr2 60512204 60512225 60512221 60512226 +
agatgttttaaaggaagccacc

SEQ ID NO: 203015 - DNA, 22 bp, Artificial Sequence
  Synthetic oligonucleotide; TTT chr2 60512212 60512233 60512229 60512234 +
taaaggaagccacctagagccc

SEQ ID NO: 203016 - DNA, 22 bp, Artificial Sequence
  Synthetic oligonucleotide; TTT chr2 60512213 60512234 60512230 60512235 +
aaaggaagccacctagagcccc

SEQ ID NO: 203017 - DNA, 22 bp, Artificial Sequence
  Synthetic oligonucleotide; TTA chr2 60512214 60512235 60512231 60512236 +
aaggaagccacctagagcccca

SEQ ID NO: 203018 - DNA, 22 bp, Artificial Sequence
  Synthetic oligonucleotide; CTA chr2 60512228 60512249 60512245 60512250 +
gagccccacctgtcactgtgga

SEQ ID NO: 203019 - DNA, 22 bp, Artificial Sequence
  Synthetic oligonucleotide; CTG chr2 60512240 60512261 60512257 60512262 +
tcactgtggaactgctcatggt

SEQ ID NO: 203020 - DNA, 22 bp, Artificial Sequence
  Synthetic oligonucleotide; CTG chr2 60512246 60512267 60512263 60512268 +
tggaactgctcatggtggctgc

SEQ ID NO: 203021 - DNA, 22 bp, Artificial Sequence
  Synthetic oligonucleotide; CTG chr2 60512254 60512275 60512271 60512276 +
ctcatggtggctgcccgatgcg

SEQ ID NO: 203022 - DNA, 22 bp, Artificial Sequence
  Synthetic oligonucleotide; CTC chr2 60512257 60512278 60512274 60512279 +
atggtggctgcccgatgcgctg

SEQ ID NO: 203023 - DNA, 22 bp, Artificial Sequence
  Synthetic oligonucleotide; CTG chr2 60512267 60512288 60512284 60512289 +
cccgatgcgctgatgtggaact

SEQ ID NO: 203024 - DNA, 22 bp, Artificial Sequence
  Synthetic oligonucleotide; CTG chr2 60512279 60512300 60512296 60512301 +
atgtggaactcagaatcattca

SEQ ID NO: 203025 - DNA, 22 bp, Artificial Sequence
  Synthetic oligonucleotide; CTC chr2 60512290 60512311 60512307 60512312 +
agaatcattcatttgggcttgt

SEQ ID NO: 203026 - DNA, 22 bp, Artificial Sequence
  Synthetic oligonucleotide; TTC chr2 60512300 60512321 60512317 60512322 +
atttgggcttgtggctgagctg

SEQ ID NO: 203027 - DNA, 22 bp, Artificial Sequence
  Synthetic oligonucleotide; TTT chr2 60512304 60512325 60512321 60512326 +
gggcttgtggctgagctgtgct

SEQ ID NO: 203028 - DNA, 22 bp, Artificial Sequence
  Synthetic oligonucleotide; TTG chr2 60512305 60512326 60512322 60512327 +
ggcttgtggctgagctgtgcta

SEQ ID NO: 203029 - DNA, 22 bp, Artificial Sequence
  Synthetic oligonucleotide; CTT chr2 60512310 60512331 60512327 60512332 +
gtggctgagctgtgctaggtaa

SEQ ID NO: 203030 - DNA, 22 bp, Artificial Sequence
  Synthetic oligonucleotide; TTG chr2 60512311 60512332 60512328 60512333 +
tggctgagctgtgctaggtaac

SEQ ID NO: 203031 - DNA, 22 bp, Artificial Sequence
  Synthetic oligonucleotide; CTG chr2 60512317 60512338 60512334 60512339 +
agctgtgctaggtaactgggtg

SEQ ID NO: 203032 - DNA, 22 bp, Artificial Sequence
  Synthetic oligonucleotide; CTG chr2 60512322 60512343 60512339 60512344 +
tgctaggtaactgggtggcctg

SEQ ID NO: 203033 - DNA, 22 bp, Artificial Sequence
  Synthetic oligonucleotide; CTA chr2 60512327 60512348 60512344 60512349 +
ggtaactgggtggcctgggcaa

SEQ ID NO: 203034 - DNA, 22 bp, Artificial Sequence
  Synthetic oligonucleotide; CTG chr2 60512335 60512356 60512352 60512357 +
ggtggcctgggcaagtcacttc

SEQ ID NO: 203035 - DNA, 22 bp, Artificial Sequence
  Synthetic oligonucleotide; CTG chr2 60512344 60512365 60512361 60512366 +
ggcaagtcacttcacctccctt

SEQ ID NO: 203036 - DNA, 22 bp, Artificial Sequence
  Synthetic oligonucleotide; CTT chr2 60512356 60512377 60512373 60512378 +
cacctcccttggcctgtgtcct

SEQ ID NO: 203037 - DNA, 22 bp, Artificial Sequence
  Synthetic oligonucleotide; TTC chr2 60512357 60512378 60512374 60512379 +
acctcccttggcctgtgtcctt

SEQ ID NO: 203038 - DNA, 22 bp, Artificial Sequence
  Synthetic oligonucleotide; CTC chr2 60512362 60512383 60512379 60512384 +
ccttggcctgtgtccttgagct

SEQ ID NO: 203039 - DNA, 22 bp, Artificial Sequence
  Synthetic oligonucleotide; CTT chr2 60512366 60512387 60512383 60512388 +
ggcctgtgtccttgagctttcc

SEQ ID NO: 203040 - DNA, 22 bp, Artificial Sequence
  Synthetic oligonucleotide; TTG chr2 60512367 60512388 60512384 60512389 +
gcctgtgtccttgagctttcct

SEQ ID NO: 203041 - DNA, 22 bp, Artificial Sequence
  Synthetic oligonucleotide; CTG chr2 60512372 60512393 60512389 60512394 +
tgtccttgagctttcctggctg

SEQ ID NO: 203042 - DNA, 22 bp, Artificial Sequence
  Synthetic oligonucleotide; CTT chr2 60512379 60512400 60512396 60512401 +
gagctttcctggctgcacatct

SEQ ID NO: 203043 - DNA, 22 bp, Artificial Sequence
  Synthetic oligonucleotide; TTG chr2 60512380 60512401 60512397 60512402 +
agctttcctggctgcacatctt

SEQ ID NO: 203044 - DNA, 22 bp, Artificial Sequence
  Synthetic oligonucleotide; CTT chr2 60512385 60512406 60512402 60512407 +
tcctggctgcacatcttgctct

SEQ ID NO: 203045 - DNA, 22 bp, Artificial Sequence
  Synthetic oligonucleotide; TTT chr2 60512386 60512407 60512403 60512408 +
cctggctgcacatcttgctctc

SEQ ID NO: 203046 - DNA, 22 bp, Artificial Sequence
  Synthetic oligonucleotide; TTC chr2 60512387 60512408 60512404 60512409 +
ctggctgcacatcttgctctca

SEQ ID NO: 203047 - DNA, 22 bp, Artificial Sequence
  Synthetic oligonucleotide; CTG chr2 60512390 60512411 60512407 60512412 +
gctgcacatcttgctctcaggt

SEQ ID NO: 203048 - DNA, 22 bp, Artificial Sequence
  Synthetic oligonucleotide; CTG chr2 60512394 60512415 60512411 60512416 +
cacatcttgctctcaggtataa

SEQ ID NO: 203049 - DNA, 22 bp, Artificial Sequence
  Synthetic oligonucleotide; CTT chr2 60512402 60512423 60512419 60512424 +
gctctcaggtataaaggatctg

SEQ ID NO: 203050 - DNA, 22 bp, Artificial Sequence
  Synthetic oligonucleotide; TTG chr2 60512403 60512424 60512420 60512425 +
ctctcaggtataaaggatctgt

SEQ ID NO: 203051 - DNA, 22 bp, Artificial Sequence
  Synthetic oligonucleotide; CTC chr2 60512406 60512427 60512423 60512428 +
tcaggtataaaggatctgtctc

SEQ ID NO: 203052 - DNA, 22 bp, Artificial Sequence
  Synthetic oligonucleotide; CTC chr2 60512408 60512429 60512425 60512430 +
aggtataaaggatctgtctcct

SEQ ID NO: 203053 - DNA, 22 bp, Artificial Sequence
  Synthetic oligonucleotide; CTG chr2 60512424 60512445 60512441 60512446 +
tctccttctacctgcccctgtg

SEQ ID NO: 203054 - DNA, 22 bp, Artificial Sequence
  Synthetic oligonucleotide; CTC chr2 60512428 60512449 60512445 60512450 +
cttctacctgcccctgtgccac

SEQ ID NO: 203055 - DNA, 22 bp, Artificial Sequence
  Synthetic oligonucleotide; CTT chr2 60512431 60512452 60512448 60512453 +
ctacctgcccctgtgccacaca

SEQ ID NO: 203056 - DNA, 22 bp, Artificial Sequence
  Synthetic oligonucleotide; TTC chr2 60512432 60512453 60512449 60512454 +
tacctgcccctgtgccacacac

SEQ ID NO: 203057 - DNA, 22 bp, Artificial Sequence
  Synthetic oligonucleotide; CTA chr2 60512434 60512455 60512451 60512456 +
cctgcccctgtgccacacacac

SEQ ID NO: 203058 - DNA, 22 bp, Artificial Sequence
  Synthetic oligonucleotide; CTG chr2 60512438 60512459 60512455 60512460 +
cccctgtgccacacacactcgc

SEQ ID NO: 203059 - DNA, 22 bp, Artificial Sequence
  Synthetic oligonucleotide; CTG chr2 60512444 60512465 60512461 60512466 +
tgccacacacactcgcctctca

SEQ ID NO: 203060 - DNA, 22 bp, Artificial Sequence
  Synthetic oligonucleotide; CTC chr2 60512458 60512479 60512475 60512480 +
gcctctcaaatgagaaaggcag

SEQ ID NO: 203061 - DNA, 22 bp, Artificial Sequence
  Synthetic oligonucleotide; CTC chr2 60512463 60512484 60512480 60512485 +
tcaaatgagaaaggcagctttg

SEQ ID NO: 203062 - DNA, 22 bp, Artificial Sequence
  Synthetic oligonucleotide; CTC chr2 60512465 60512486 60512482 60512487 +
aaatgagaaaggcagctttgag

SEQ ID NO: 203063 - DNA, 22 bp, Artificial Sequence
  Synthetic oligonucleotide; CTT chr2 60512483 60512504 60512500 60512505 +
tgagagaggatgcttgccttcc

SEQ ID NO: 203064 - DNA, 22 bp, Artificial Sequence
  Synthetic oligonucleotide; TTT chr2 60512484 60512505 60512501 60512506 +
gagagaggatgcttgccttccc

SEQ ID NO: 203065 - DNA, 22 bp, Artificial Sequence
  Synthetic oligonucleotide; TTG chr2 60512485 60512506 60512502 60512507 +
agagaggatgcttgccttcccg

SEQ ID NO: 203066 - DNA, 22 bp, Artificial Sequence
  Synthetic oligonucleotide; CTT chr2 60512498 60512519 60512515 60512520 +
gccttcccggctcccctcccaa

SEQ ID NO: 203067 - DNA, 22 bp, Artificial Sequence
  Synthetic oligonucleotide; TTG chr2 60512499 60512520 60512516 60512521 +
ccttcccggctcccctcccaac

SEQ ID NO: 203068 - DNA, 22 bp, Artificial Sequence
  Synthetic oligonucleotide; CTT chr2 60512503 60512524 60512520 60512525 +
cccggctcccctcccaacccag

SEQ ID NO: 203069 - DNA, 22 bp, Artificial Sequence
  Synthetic oligonucleotide; TTC chr2 60512504 60512525 60512521 60512526 +
ccggctcccctcccaacccaga

SEQ ID NO: 203070 - DNA, 22 bp, Artificial Sequence
  Synthetic oligonucleotide; CTC chr2 60512511 60512532 60512528 60512533 +
ccctcccaacccagaacctatc

SEQ ID NO: 203071 - DNA, 22 bp, Artificial Sequence
  Synthetic oligonucleotide; CTC chr2 60512516 60512537 60512533 60512538 +
ccaacccagaacctatcacaat

SEQ ID NO: 203072 - DNA, 22 bp, Artificial Sequence
  Synthetic oligonucleotide; CTA chr2 60512531 60512552 60512548 60512553 +
tcacaatgctctgcagagagta

SEQ ID NO: 203073 - DNA, 22 bp, Artificial Sequence
  Synthetic oligonucleotide; CTC chr2 60512542 60512563 60512559 60512564 +
tgcagagagtacatgctcaaca

SEQ ID NO: 203074 - DNA, 22 bp, Artificial Sequence
  Synthetic oligonucleotide; CTG chr2 60512544 60512565 60512561 60512566 +
cagagagtacatgctcaacaaa

SEQ ID NO: 203075 - DNA, 22 bp, Artificial Sequence
  Synthetic oligonucleotide; CTC chr2 60512560 60512581 60512577 60512582 +
aacaaatccaatgctaaattgt

SEQ ID NO: 203076 - DNA, 22 bp, Artificial Sequence
  Synthetic oligonucleotide; CTA chr2 60512576 60512597 60512593 60512598 +
aattgtaaaaagtgagactaga

SEQ ID NO: 203077 - DNA, 22 bp, Artificial Sequence
  Synthetic oligonucleotide; TTG chr2 60512581 60512602 60512598 60512603 +
taaaaagtgagactagatggta

SEQ ID NO: 203078 - DNA, 22 bp, Artificial Sequence
  Synthetic oligonucleotide; CTA chr2 60512596 60512617 60512613 60512618 +
gatggtatctgcctctcctctc

SEQ ID NO: 203079 - DNA, 22 bp, Artificial Sequence
  Synthetic oligonucleotide; CTG chr2 60512607 60512628 60512624 60512629 +
cctctcctctcagctctaaatt

SEQ ID NO: 203080 - DNA, 22 bp, Artificial Sequence
  Synthetic oligonucleotide; CTC chr2 60512611 60512632 60512628 60512633 +
tcctctcagctctaaattattt

SEQ ID NO: 203081 - DNA, 22 bp, Artificial Sequence
  Synthetic oligonucleotide; CTC chr2 60512613 60512634 60512630 60512635 +
ctctcagctctaaattatttgg

SEQ ID NO: 203082 - DNA, 22 bp, Artificial Sequence
  Synthetic oligonucleotide; CTC chr2 60512616 60512637 60512633 60512638 +
tcagctctaaattatttggtct

SEQ ID NO: 203083 - DNA, 22 bp, Artificial Sequence
  Synthetic oligonucleotide; CTC chr2 60512618 60512639 60512635 60512640 +
agctctaaattatttggtctaa

SEQ ID NO: 203084 - DNA, 22 bp, Artificial Sequence
  Synthetic oligonucleotide; CTC chr2 60512623 60512644 60512640 60512645 +
taaattatttggtctaaagaaa

SEQ ID NO: 203085 - DNA, 22 bp, Artificial Sequence
  Synthetic oligonucleotide; CTA chr2 60512625 60512646 60512642 60512647 +
aattatttggtctaaagaaaac

SEQ ID NO: 203086 - DNA, 22 bp, Artificial Sequence
  Synthetic oligonucleotide; TTA chr2 60512630 60512651 60512647 60512652 +
tttggtctaaagaaaactgaag

SEQ ID NO: 203087 - DNA, 22 bp, Artificial Sequence
  Synthetic oligonucleotide; TTT chr2 60512633 60512654 60512650 60512655 +
ggtctaaagaaaactgaagccc

SEQ ID NO: 203088 - DNA, 22 bp, Artificial Sequence
  Synthetic oligonucleotide; TTG chr2 60512634 60512655 60512651 60512656 +
gtctaaagaaaactgaagcccc

SEQ ID NO: 203089 - DNA, 22 bp, Artificial Sequence
  Synthetic oligonucleotide; CTA chr2 60512639 60512660 60512656 60512661 +
aagaaaactgaagcccccagca

SEQ ID NO: 203090 - DNA, 22 bp, Artificial Sequence
  Synthetic oligonucleotide; CTG chr2 60512649 60512670 60512666 60512671 +
aagcccccagcaactccatttt

SEQ ID NO: 203091 - DNA, 22 bp, Artificial Sequence
  Synthetic oligonucleotide; CTC chr2 60512665 60512686 60512682 60512687 +
cattttgcatatctaattggag

SEQ ID NO: 203092 - DNA, 22 bp, Artificial Sequence
  Synthetic oligonucleotide; TTT chr2 60512670 60512691 60512687 60512692 +
tgcatatctaattggagatggt

SEQ ID NO: 203093 - DNA, 22 bp, Artificial Sequence
  Synthetic oligonucleotide; TTT chr2 60512671 60512692 60512688 60512693 +
gcatatctaattggagatggtt

SEQ ID NO: 203094 - DNA, 22 bp, Artificial Sequence
  Synthetic oligonucleotide; TTG chr2 60512672 60512693 60512689 60512694 +
catatctaattggagatggttt

SEQ ID NO: 203095 - DNA, 22 bp, Artificial Sequence
  Synthetic oligonucleotide; CTA chr2 60512680 60512701 60512697 60512702 +
attggagatggtttcaataata

SEQ ID NO: 203096 - DNA, 22 bp, Artificial Sequence
  Synthetic oligonucleotide; TTG chr2 60512684 60512705 60512701 60512706 +
gagatggtttcaataatataat

SEQ ID NO: 203097 - DNA, 22 bp, Artificial Sequence
  Synthetic oligonucleotide; TTT chr2 60512694 60512715 60512711 60512716 +
caataatataattatcaaggca

SEQ ID NO: 203098 - DNA, 22 bp, Artificial Sequence
  Synthetic oligonucleotide; TTC chr2 60512695 60512716 60512712 60512717 +
aataatataattatcaaggcat

SEQ ID NO: 203099 - DNA, 22 bp, Artificial Sequence
  Synthetic oligonucleotide; TTA chr2 60512708 60512729 60512725 60512730 +
tcaaggcatccctacgttactt

SEQ ID NO: 203100 - DNA, 22 bp, Artificial Sequence
  Synthetic oligonucleotide; CTA chr2 60512722 60512743 60512739 60512744 +
cgttacttgaagttggttcata

SEQ ID NO: 203101 - DNA, 22 bp, Artificial Sequence
  Synthetic oligonucleotide; TTA chr2 60512727 60512748 60512744 60512749 +
cttgaagttggttcataatctg

SEQ ID NO: 203102 - DNA, 22 bp, Artificial Sequence
  Synthetic oligonucleotide; CTT chr2 60512730 60512751 60512747 60512752 +
gaagttggttcataatctggcg

SEQ ID NO: 203103 - DNA, 22 bp, Artificial Sequence
  Synthetic oligonucleotide; TTG chr2 60512731 60512752 60512748 60512753 +
aagttggttcataatctggcga

SEQ ID NO: 203104 - DNA, 22 bp, Artificial Sequence
  Synthetic oligonucleotide; TTG chr2 60512737 60512758 60512754 60512759 +
gttcataatctggcgacgttca

SEQ ID NO: 203105 - DNA, 22 bp, Artificial Sequence
  Synthetic oligonucleotide; TTC chr2 60512741 60512762 60512758 60512763 +
ataatctggcgacgttcacagc

SEQ ID NO: 203106 - DNA, 22 bp, Artificial Sequence
  Synthetic oligonucleotide; CTG chr2 60512749 60512770 60512766 60512771 +
gcgacgttcacagccttatgaa

SEQ ID NO: 203107 - DNA, 22 bp, Artificial Sequence
  Synthetic oligonucleotide; TTC chr2 60512758 60512779 60512775 60512780 +
acagccttatgaagacagttta

SEQ ID NO: 203108 - DNA, 22 bp, Artificial Sequence
  Synthetic oligonucleotide; CTT chr2 60512766 60512787 60512783 60512788 +
atgaagacagtttattctcttt

SEQ ID NO: 203109 - DNA, 22 bp, Artificial Sequence
  Synthetic oligonucleotide; TTA chr2 60512767 60512788 60512784 60512789 +
tgaagacagtttattctctttt

SEQ ID NO: 203110 - DNA, 22 bp, Artificial Sequence
  Synthetic oligonucleotide; TTT chr2 60512779 60512800 60512796 60512801 +
attctcttttagtgtctcaagt

SEQ ID NO: 203111 - DNA, 22 bp, Artificial Sequence
  Synthetic oligonucleotide; TTA chr2 60512780 60512801 60512797 60512802 +
ttctcttttagtgtctcaagta

SEQ ID NO: 203112 - DNA, 22 bp, Artificial Sequence
  Synthetic oligonucleotide; TTC chr2 60512783 60512804 60512800 60512805 +
tcttttagtgtctcaagtatga

SEQ ID NO: 203113 - DNA, 22 bp, Artificial Sequence
  Synthetic oligonucleotide; CTC chr2 60512785 60512806 60512802 60512807 +
ttttagtgtctcaagtatgagt

SEQ ID NO: 203114 - DNA, 22 bp, Artificial Sequence
  Synthetic oligonucleotide; CTT chr2 60512787 60512808 60512804 60512809 +
ttagtgtctcaagtatgagtca

SEQ ID NO: 203115 - DNA, 22 bp, Artificial Sequence
  Synthetic oligonucleotide; TTT chr2 60512788 60512809 60512805 60512810 +
tagtgtctcaagtatgagtcac

SEQ ID NO: 203116 - DNA, 22 bp, Artificial Sequence
  Synthetic oligonucleotide; TTT chr2 60512789 60512810 60512806 60512811 +
agtgtctcaagtatgagtcacc

SEQ ID NO: 203117 - DNA, 22 bp, Artificial Sequence
  Synthetic oligonucleotide; TTA chr2 60512790 60512811 60512807 60512812 +
gtgtctcaagtatgagtcacct

SEQ ID NO: 203118 - DNA, 22 bp, Artificial Sequence
  Synthetic oligonucleotide; CTC chr2 60512797 60512818 60512814 60512819 +
aagtatgagtcacctctgatga

SEQ ID NO: 203119 - DNA, 22 bp, Artificial Sequence
  Synthetic oligonucleotide; CTC chr2 60512813 60512834 60512830 60512835 +
tgatgacggataggagaacaag

SEQ ID NO: 203120 - DNA, 22 bp, Artificial Sequence
  Synthetic oligonucleotide; CTG chr2 60512815 60512836 60512832 60512837 +
atgacggataggagaacaagca

SEQ ID NO: 203121 - DNA, 22 bp, Artificial Sequence
  Synthetic oligonucleotide; TTT chr2 60512842 60512863 60512859 60512864 +
tactacaatacacacctaaagt

SEQ ID NO: 203122 - DNA, 22 bp, Artificial Sequence
  Synthetic oligonucleotide; TTT chr2 60512843 60512864 60512860 60512865 +
actacaatacacacctaaagta

SEQ ID NO: 203123 - DNA, 22 bp, Artificial Sequence
  Synthetic oligonucleotide; TTA chr2 60512844 60512865 60512861 60512866 +
ctacaatacacacctaaagtaa

SEQ ID NO: 203124 - DNA, 22 bp, Artificial Sequence
  Synthetic oligonucleotide; CTA chr2 60512847 60512868 60512864 60512869 +
caatacacacctaaagtaaatg

SEQ ID NO: 203125 - DNA, 22 bp, Artificial Sequence
  Synthetic oligonucleotide; CTA chr2 60512860 60512881 60512877 60512882 +
aagtaaatgaataaacccaacc

SEQ ID NO: 203126 - DNA, 22 bp, Artificial Sequence
  Synthetic oligonucleotide; CTT chr2 60512886 60512907 60512903 60512908 +
tgcccacccacatggcatccat

SEQ ID NO: 203127 - DNA, 22 bp, Artificial Sequence
  Synthetic oligonucleotide; TTT chr2 60512887 60512908 60512904 60512909 +
gcccacccacatggcatccatt

SEQ ID NO: 203128 - DNA, 22 bp, Artificial Sequence
  Synthetic oligonucleotide; TTG chr2 60512888 60512909 60512905 60512910 +
cccacccacatggcatccattt

SEQ ID NO: 203129 - DNA, 22 bp, Artificial Sequence
  Synthetic oligonucleotide; TTT chr2 60512910 60512931 60512927 60512932 +
ggaggagacacagagaaaggag

SEQ ID NO: 203130 - DNA, 22 bp, Artificial Sequence
  Synthetic oligonucleotide; TTG chr2 60512911 60512932 60512928 60512933 +
gaggagacacagagaaaggagt

SEQ ID NO: 203131 - DNA, 22 bp, Artificial Sequence
  Synthetic oligonucleotide; TTT chr2 60512935 60512956 60512952 60512957 +
cacctcttagacgtctcagaga

SEQ ID NO: 203132 - DNA, 22 bp, Artificial Sequence
  Synthetic oligonucleotide; TTC chr2 60512936 60512957 60512953 60512958 +
acctcttagacgtctcagagat

SEQ ID NO: 203133 - DNA, 22 bp, Artificial Sequence
  Synthetic oligonucleotide; CTC chr2 60512941 60512962 60512958 60512963 +
ttagacgtctcagagattaaca

SEQ ID NO: 203134 - DNA, 22 bp, Artificial Sequence
  Synthetic oligonucleotide; CTT chr2 60512943 60512964 60512960 60512965 +
agacgtctcagagattaacatt

SEQ ID NO: 203135 - DNA, 22 bp, Artificial Sequence
  Synthetic oligonucleotide; TTA chr2 60512944 60512965 60512961 60512966 +
gacgtctcagagattaacattt

SEQ ID NO: 203136 - DNA, 22 bp, Artificial Sequence
  Synthetic oligonucleotide; CTC chr2 60512952 60512973 60512969 60512974 +
agagattaacattttctcaaaa

SEQ ID NO: 203137 - DNA, 22 bp, Artificial Sequence
  Synthetic oligonucleotide; TTA chr2 60512960 60512981 60512977 60512982 +
acattttctcaaaaatgaacac

SEQ ID NO: 203138 - DNA, 22 bp, Artificial Sequence
  Synthetic oligonucleotide; TTT chr2 60512966 60512987 60512983 60512988 +
tctcaaaaatgaacacacagag

SEQ ID NO: 203139 - DNA, 22 bp, Artificial Sequence
  Synthetic oligonucleotide; TTT chr2 60512967 60512988 60512984 60512989 +
ctcaaaaatgaacacacagagc

SEQ ID NO: 203140 - DNA, 22 bp, Artificial Sequence
  Synthetic oligonucleotide; TTC chr2 60512968 60512989 60512985 60512990 +
tcaaaaatgaacacacagagca

SEQ ID NO: 203141 - DNA, 22 bp, Artificial Sequence
  Synthetic oligonucleotide; CTC chr2 60512970 60512991 60512987 60512992 +
aaaaatgaacacacagagcaac

SEQ ID NO: 203142 - DNA, 22 bp, Artificial Sequence
  Synthetic oligonucleotide; CTG chr2 60512997 60513018 60513014 60513019 +
acgagtcacagtggaccacacc

SEQ ID NO: 203143 - DNA, 22 bp, Artificial Sequence
  Synthetic oligonucleotide; CTC chr2 60513027 60513048 60513044 60513049 +
tggttaccccctgagaaaggca

SEQ ID NO: 203144 - DNA, 22 bp, Artificial Sequence
  Synthetic oligonucleotide; CTG chr2 60513029 60513050 60513046 60513051 +
gttaccccctgagaaaggcaga

SEQ ID NO: 203145 - DNA, 22 bp, Artificial Sequence
  Synthetic oligonucleotide; TTA chr2 60513033 60513054 60513050 60513055 +
ccccctgagaaaggcagagaaa

SEQ ID NO: 203146 - DNA, 22 bp, Artificial Sequence
  Synthetic oligonucleotide; CTG chr2 60513040 60513061 60513057 60513062 +
agaaaggcagagaaaggacccc

SEQ ID NO: 203147 - DNA, 22 bp, Artificial Sequence
  Synthetic oligonucleotide; TTT chr2 60513079 60513100 60513096 60513101 +
gaggagaggttcagggatcatg

SEQ ID NO: 203148 - DNA, 22 bp, Artificial Sequence
  Synthetic oligonucleotide; TTG chr2 60513080 60513101 60513097 60513102 +
aggagaggttcagggatcatga

SEQ ID NO: 203149 - DNA, 22 bp, Artificial Sequence
  Synthetic oligonucleotide; TTC chr2 60513091 60513112 60513108 60513113 +
agggatcatgaggactcaccac

SEQ ID NO: 203150 - DNA, 22 bp, Artificial Sequence
  Synthetic oligonucleotide; CTC chr2 60513108 60513129 60513125 60513130 +
accaccccactgaaatccatgg

SEQ ID NO: 203151 - DNA, 22 bp, Artificial Sequence
  Synthetic oligonucleotide; CTG chr2 60513120 60513141 60513137 60513142 +
aaatccatggatagtctagcct

SEQ ID NO: 203152 - DNA, 22 bp, Artificial Sequence
  Synthetic oligonucleotide; CTA chr2 60513138 60513159 60513155 60513160 +
gcctgtgaggggttgggggtgg

SEQ ID NO: 203153 - DNA, 22 bp, Artificial Sequence
  Synthetic oligonucleotide; CTG chr2 60513143 60513164 60513160 60513165 +
tgaggggttgggggtggcaaat

SEQ ID NO: 203154 - DNA, 22 bp, Artificial Sequence
  Synthetic oligonucleotide; TTG chr2 60513153 60513174 60513170 60513175 +
ggggtggcaaattactttatct

SEQ ID NO: 203155 - DNA, 22 bp, Artificial Sequence
  Synthetic oligonucleotide; TTA chr2 60513167 60513188 60513184 60513189 +
ctttatctttctcatctttgag

SEQ ID NO: 203156 - DNA, 22 bp, Artificial Sequence
  Synthetic oligonucleotide; CTT chr2 60513170 60513191 60513187 60513192 +
tatctttctcatctttgagcgg

SEQ ID NO: 203157 - DNA, 22 bp, Artificial Sequence
  Synthetic oligonucleotide; TTT chr2 60513171 60513192 60513188 60513193 +
atctttctcatctttgagcggc

SEQ ID NO: 203158 - DNA, 22 bp, Artificial Sequence
  Synthetic oligonucleotide; TTA chr2 60513172 60513193 60513189 60513194 +
tctttctcatctttgagcggct

SEQ ID NO: 203159 - DNA, 22 bp, Artificial Sequence
  Synthetic oligonucleotide; CTT chr2 60513176 60513197 60513193 60513198 +
tctcatctttgagcggctcttc

SEQ ID NO: 203160 - DNA, 22 bp, Artificial Sequence
  Synthetic oligonucleotide; TTT chr2 60513177 60513198 60513194 60513199 +
ctcatctttgagcggctcttcc

SEQ ID NO: 203161 - DNA, 22 bp, Artificial Sequence
  Synthetic oligonucleotide; TTC chr2 60513178 60513199 60513195 60513200 +
tcatctttgagcggctcttccc

SEQ ID NO: 203162 - DNA, 22 bp, Artificial Sequence
  Synthetic oligonucleotide; CTC chr2 60513180 60513201 60513197 60513202 +
atctttgagcggctcttcccca

SEQ ID NO: 203163 - DNA, 22 bp, Artificial Sequence
  Synthetic oligonucleotide; CTT chr2 60513185 60513206 60513202 60513207 +
tgagcggctcttccccagagtc

SEQ ID NO: 203164 - DNA, 22 bp, Artificial Sequence
  Synthetic oligonucleotide; TTT chr2 60513186 60513207 60513203 60513208 +
gagcggctcttccccagagtca

SEQ ID NO: 203165 - DNA, 22 bp, Artificial Sequence
  Synthetic oligonucleotide; TTG chr2 60513187 60513208 60513204 60513209 +
agcggctcttccccagagtcag

SEQ ID NO: 203166 - DNA, 22 bp, Artificial Sequence
  Synthetic oligonucleotide; CTC chr2 60513195 60513216 60513212 60513217 +
ttccccagagtcaggatgactc

SEQ ID NO: 203167 - DNA, 22 bp, Artificial Sequence
  Synthetic oligonucleotide; CTT chr2 60513197 60513218 60513214 60513219 +
ccccagagtcaggatgactctc

SEQ ID NO: 203168 - DNA, 22 bp, Artificial Sequence
  Synthetic oligonucleotide; TTC chr2 60513198 60513219 60513215 60513220 +
cccagagtcaggatgactctca

SEQ ID NO: 203169 - DNA, 22 bp, Artificial Sequence
  Synthetic oligonucleotide; CTC chr2 60513217 60513238 60513234 60513239 +
tcactaggtttcaggtacatcc

SEQ ID NO: 203170 - DNA, 22 bp, Artificial Sequence
  Synthetic oligonucleotide; CTC chr2 60513219 60513240 60513236 60513241 +
actaggtttcaggtacatcccc

SEQ ID NO: 203171 - DNA, 22 bp, Artificial Sequence
  Synthetic oligonucleotide; CTA chr2 60513223 60513244 60513240 60513245 +
ggtttcaggtacatccccatca

SEQ ID NO: 203172 - DNA, 22 bp, Artificial Sequence
  Synthetic oligonucleotide; TTT chr2 60513228 60513249 60513245 60513250 +
caggtacatccccatcatgccc

SEQ ID NO: 203173 - DNA, 22 bp, Artificial Sequence
  Synthetic oligonucleotide; TTC chr2 60513229 60513250 60513246 60513251 +
aggtacatccccatcatgcccc

SEQ ID NO: 203174 - DNA, 22 bp, Artificial Sequence
  Synthetic oligonucleotide; CTC chr2 60513257 60513278 60513274 60513279 +
cagtctctgcagctgacacggc

SEQ ID NO: 203175 - DNA, 22 bp, Artificial Sequence
  Synthetic oligonucleotide; CTC chr2 60513264 60513285 60513281 60513286 +
tgcagctgacacggctccaaga

SEQ ID NO: 203176 - DNA, 22 bp, Artificial Sequence
  Synthetic oligonucleotide; CTG chr2 60513266 60513287 60513283 60513288 +
cagctgacacggctccaagatg

SEQ ID NO: 203177 - DNA, 22 bp, Artificial Sequence
  Synthetic oligonucleotide; CTG chr2 60513272 60513293 60513289 60513294 +
acacggctccaagatgctaaat

SEQ ID NO: 203178 - DNA, 22 bp, Artificial Sequence
  Synthetic oligonucleotide; CTC chr2 60513281 60513302 60513298 60513303 +
caagatgctaaatatgagacaa

SEQ ID NO: 203179 - DNA, 22 bp, Artificial Sequence
  Synthetic oligonucleotide; CTA chr2 60513291 60513312 60513308 60513313 +
aatatgagacaaggaggggaca

SEQ ID NO: 203180 - DNA, 22 bp, Artificial Sequence
  Synthetic oligonucleotide; TTT chr2 60513321 60513342 60513338 60513343 +
agtcccaggagtggcactagaa

SEQ ID NO: 203181 - DNA, 22 bp, Artificial Sequence
  Synthetic oligonucleotide; TTA chr2 60513322 60513343 60513339 60513344 +
gtcccaggagtggcactagaag

SEQ ID NO: 203182 - DNA, 22 bp, Artificial Sequence
  Synthetic oligonucleotide; CTA chr2 60513340 60513361 60513357 60513362 +
gaaggagtccctgctccctcag

SEQ ID NO: 203183 - DNA, 22 bp, Artificial Sequence
  Synthetic oligonucleotide; CTG chr2 60513353 60513374 60513370 60513375 +
ctccctcaggagccatctgccg

SEQ ID NO: 203184 - DNA, 22 bp, Artificial Sequence
  Synthetic oligonucleotide; CTC chr2 60513356 60513377 60513373 60513378 +
cctcaggagccatctgccgggt

SEQ ID NO: 203185 - DNA, 22 bp, Artificial Sequence
  Synthetic oligonucleotide; CTC chr2 60513360 60513381 60513377 60513382 +
aggagccatctgccgggtgctt

SEQ ID NO: 203186 - DNA, 22 bp, Artificial Sequence
  Synthetic oligonucleotide; CTG chr2 60513372 60513393 60513389 60513394 +
ccgggtgcttctggagatgctg

SEQ ID NO: 203187 - DNA, 22 bp, Artificial Sequence
  Synthetic oligonucleotide; CTT chr2 60513382 60513403 60513399 60513404 +
ctggagatgctgcctccacgcc

SEQ ID NO: 203188 - DNA, 22 bp, Artificial Sequence
  Synthetic oligonucleotide; TTC chr2 60513383 60513404 60513400 60513405 +
tggagatgctgcctccacgccc

SEQ ID NO: 203189 - DNA, 22 bp, Artificial Sequence
  Synthetic oligonucleotide; CTG chr2 60513385 60513406 60513402 60513407 +
gagatgctgcctccacgcccca

SEQ ID NO: 203190 - DNA, 22 bp, Artificial Sequence
  Synthetic oligonucleotide; CTG chr2 60513394 60513415 60513411 60513416 +
cctccacgccccacttgaggct

SEQ ID NO: 203191 - DNA, 22 bp, Artificial Sequence
  Synthetic oligonucleotide; CTC chr2 60513398 60513419 60513415 60513420 +
cacgccccacttgaggctgtcc

SEQ ID NO: 203192 - DNA, 22 bp, Artificial Sequence
  Synthetic oligonucleotide; CTT chr2 60513410 60513431 60513427 60513432 +
gaggctgtccacagcagaaacc

SEQ ID NO: 203193 - DNA, 22 bp, Artificial Sequence
  Synthetic oligonucleotide; TTG chr2 60513411 60513432 60513428 60513433 +
aggctgtccacagcagaaacca

SEQ ID NO: 203194 - DNA, 22 bp, Artificial Sequence
  Synthetic oligonucleotide; CTG chr2 60513417 60513438 60513434 60513439 +
tccacagcagaaaccagcgccc

SEQ ID NO: 203195 - DNA, 22 bp, Artificial Sequence
  Synthetic oligonucleotide; CTC chr2 60513449 60513470 60513466 60513471 +
aagccagccaccccatgggaac

SEQ ID NO: 203196 - DNA, 22 bp, Artificial Sequence
  Synthetic oligonucleotide; CTT chr2 60513476 60513497 60513493 60513498 +
tggcaggtgtgggtgttgggtt

SEQ ID NO: 203197 - DNA, 22 bp, Artificial Sequence
  Synthetic oligonucleotide; TTT chr2 60513477 60513498 60513494 60513499 +
ggcaggtgtgggtgttgggtta

SEQ ID NO: 203198 - DNA, 22 bp, Artificial Sequence
  Synthetic oligonucleotide; TTG chr2 60513478 60513499 60513495 60513500 +
gcaggtgtgggtgttgggttag

SEQ ID NO: 203199 - DNA, 22 bp, Artificial Sequence
  Synthetic oligonucleotide; TTG chr2 60513494 60513515 60513511 60513516 +
ggttagcctctagccagaactc

SEQ ID NO: 203200 - DNA, 22 bp, Artificial Sequence
  Synthetic oligonucleotide; TTA chr2 60513499 60513520 60513516 60513521 +
gcctctagccagaactcctgct

SEQ ID NO: 203201 - DNA, 22 bp, Artificial Sequence
  Synthetic oligonucleotide; CTC chr2 60513504 60513525 60513521 60513526 +
tagccagaactcctgctgcttc

SEQ ID NO: 203202 - DNA, 22 bp, Artificial Sequence
  Synthetic oligonucleotide; CTA chr2 60513506 60513527 60513523 60513528 +
gccagaactcctgctgcttctc

SEQ ID NO: 203203 - DNA, 22 bp, Artificial Sequence
  Synthetic oligonucleotide; CTC chr2 60513516 60513537 60513533 60513538 +
ctgctgcttctctctttgtgga

SEQ ID NO: 203204 - DNA, 22 bp, Artificial Sequence
  Synthetic oligonucleotide; CTG chr2 60513519 60513540 60513536 60513541 +
ctgcttctctctttgtggagca

SEQ ID NO: 203205 - DNA, 22 bp, Artificial Sequence
  Synthetic oligonucleotide; CTG chr2 60513522 60513543 60513539 60513544 +
cttctctctttgtggagcaaat

SEQ ID NO: 203206 - DNA, 22 bp, Artificial Sequence
  Synthetic oligonucleotide; CTT chr2 60513525 60513546 60513542 60513547 +
ctctctttgtggagcaaatctt

SEQ ID NO: 203207 - DNA, 22 bp, Artificial Sequence
  Synthetic oligonucleotide; TTC chr2 60513526 60513547 60513543 60513548 +
tctctttgtggagcaaatcttc

SEQ ID NO: 203208 - DNA, 22 bp, Artificial Sequence
  Synthetic oligonucleotide; CTC chr2 60513528 60513549 60513545 60513550 +
tctttgtggagcaaatcttcat

SEQ ID NO: 203209 - DNA, 22 bp, Artificial Sequence
  Synthetic oligonucleotide; CTC chr2 60513530 60513551 60513547 60513552 +
tttgtggagcaaatcttcatgt

SEQ ID NO: 203210 - DNA, 22 bp, Artificial Sequence
  Synthetic oligonucleotide; CTT chr2 60513532 60513553 60513549 60513554 +
tgtggagcaaatcttcatgtcc

SEQ ID NO: 203211 - DNA, 22 bp, Artificial Sequence
  Synthetic oligonucleotide; TTT chr2 60513533 60513554 60513550 60513555 +
gtggagcaaatcttcatgtcct

SEQ ID NO: 203212 - DNA, 22 bp, Artificial Sequence
  Synthetic oligonucleotide; TTG chr2 60513534 60513555 60513551 60513556 +
tggagcaaatcttcatgtcctg

SEQ ID NO: 203213 - DNA, 22 bp, Artificial Sequence
  Synthetic oligonucleotide; CTT chr2 60513547 60513568 60513564 60513569 +
catgtcctgtctggatcttccc

SEQ ID NO: 203214 - DNA, 22 bp, Artificial Sequence
  Synthetic oligonucleotide; TTC chr2 60513548 60513569 60513565 60513570 +
atgtcctgtctggatcttccca

SEQ ID NO: 203215 - DNA, 22 bp, Artificial Sequence
  Synthetic oligonucleotide; CTG chr2 60513556 60513577 60513573 60513578 +
tctggatcttcccagtcctgcc

SEQ ID NO: 203216 - DNA, 22 bp, Artificial Sequence
  Synthetic oligonucleotide; CTG chr2 60513560 60513581 60513577 60513582 +
gatcttcccagtcctgccctct

SEQ ID NO: 203217 - DNA, 22 bp, Artificial Sequence
  Synthetic oligonucleotide; CTT chr2 60513566 60513587 60513583 60513588 +
cccagtcctgccctctctcttc

SEQ ID NO: 203218 - DNA, 22 bp, Artificial Sequence
  Synthetic oligonucleotide; TTC chr2 60513567 60513588 60513584 60513589 +
ccagtcctgccctctctcttct

SEQ ID NO: 203219 - DNA, 22 bp, Artificial Sequence
  Synthetic oligonucleotide; CTG chr2 60513576 60513597 60513593 60513598 +
ccctctctcttctgaatcttcc

SEQ ID NO: 203220 - DNA, 22 bp, Artificial Sequence
  Synthetic oligonucleotide; CTC chr2 60513581 60513602 60513598 60513603 +
tctcttctgaatcttcccaccc

SEQ ID NO: 203221 - DNA, 22 bp, Artificial Sequence
  Synthetic oligonucleotide; CTC chr2 60513583 60513604 60513600 60513605 +
tcttctgaatcttcccaccctt

SEQ ID NO: 203222 - DNA, 22 bp, Artificial Sequence
  Synthetic oligonucleotide; CTC chr2 60513585 60513606 60513602 60513607 +
ttctgaatcttcccacccttcc

SEQ ID NO: 203223 - DNA, 22 bp, Artificial Sequence
  Synthetic oligonucleotide; CTT chr2 60513587 60513608 60513604 60513609 +
ctgaatcttcccacccttccaa

SEQ ID NO: 203224 - DNA, 22 bp, Artificial Sequence
  Synthetic oligonucleotide; TTC chr2 60513588 60513609 60513605 60513610 +
tgaatcttcccacccttccaag

SEQ ID NO: 203225 - DNA, 22 bp, Artificial Sequence
  Synthetic oligonucleotide; CTG chr2 60513590 60513611 60513607 60513612 +
aatcttcccacccttccaaggg

SEQ ID NO: 203226 - DNA, 22 bp, Artificial Sequence
  Synthetic oligonucleotide; CTT chr2 60513596 60513617 60513613 60513618 +
cccacccttccaagggcctgct

SEQ ID NO: 203227 - DNA, 22 bp, Artificial Sequence
  Synthetic oligonucleotide; TTC chr2 60513597 60513618 60513614 60513619 +
ccacccttccaagggcctgctg

SEQ ID NO: 203228 - DNA, 22 bp, Artificial Sequence
  Synthetic oligonucleotide; CTT chr2 60513605 60513626 60513622 60513627 +
ccaagggcctgctgcctaatcc

SEQ ID NO: 203229 - DNA, 22 bp, Artificial Sequence
  Synthetic oligonucleotide; TTC chr2 60513606 60513627 60513623 60513628 +
caagggcctgctgcctaatcca

SEQ ID NO: 203230 - DNA, 22 bp, Artificial Sequence
  Synthetic oligonucleotide; CTG chr2 60513616 60513637 60513633 60513638 +
ctgcctaatccatctccccact

SEQ ID NO: 203231 - DNA, 22 bp, Artificial Sequence
  Synthetic oligonucleotide; CTG chr2 60513619 60513640 60513636 60513641 +
cctaatccatctccccactcac

SEQ ID NO: 203232 - DNA, 22 bp, Artificial Sequence
  Synthetic oligonucleotide; CTA chr2 60513623 60513644 60513640 60513645 +
atccatctccccactcacacgc

SEQ ID NO: 203233 - DNA, 22 bp, Artificial Sequence
  Synthetic oligonucleotide; CTC chr2 60513632 60513653 60513649 60513654 +
cccactcacacgctaaagtaaa

SEQ ID NO: 203234 - DNA, 22 bp, Artificial Sequence
  Synthetic oligonucleotide; CTC chr2 60513639 60513660 60513656 60513661 +
acacgctaaagtaaatgaataa

SEQ ID NO: 203235 - DNA, 22 bp, Artificial Sequence
  Synthetic oligonucleotide; CTA chr2 60513647 60513668 60513664 60513669 +
aagtaaatgaataaacccaaca

SEQ ID NO: 203236 - DNA, 22 bp, Artificial Sequence
  Synthetic oligonucleotide; CTC chr2 60513679 60513700 60513696 60513701 +
atccctgatcaggactgaaaaa

SEQ ID NO: 203237 - DNA, 22 bp, Artificial Sequence
  Synthetic oligonucleotide; CTG chr2 60513686 60513707 60513703 60513708 +
atcaggactgaaaaaagaaaaa

SEQ ID NO: 203238 - DNA, 22 bp, Artificial Sequence
  Synthetic oligonucleotide; CTG chr2 60513696 60513717 60513713 60513718 +
aaaaaagaaaaagaaatagcct

SEQ ID NO: 203239 - DNA, 22 bp, Artificial Sequence
  Synthetic oligonucleotide; CTC chr2 60513719 60513740 60513736 60513741 +
ccatcacaccactctctgggaa

SEQ ID NO: 203240 - DNA, 22 bp, Artificial Sequence
  Synthetic oligonucleotide; CTC chr2 60513733 60513754 60513750 60513755 +
tctgggaaaatagaactgagtc

SEQ ID NO: 203241 - DNA, 22 bp, Artificial Sequence
  Synthetic oligonucleotide; CTC chr2 60513735 60513756 60513752 60513757 +
tgggaaaatagaactgagtcct

SEQ ID NO: 203242 - DNA, 22 bp, Artificial Sequence
  Synthetic oligonucleotide; CTG chr2 60513737 60513758 60513754 60513759 +
ggaaaatagaactgagtcctag

SEQ ID NO: 203243 - DNA, 22 bp, Artificial Sequence
  Synthetic oligonucleotide; CTG chr2 60513751 60513772 60513768 60513773 +
agtcctagctctagcactgggc

SEQ ID NO: 203244 - DNA, 22 bp, Artificial Sequence
  Synthetic oligonucleotide; CTA chr2 60513758 60513779 60513775 60513780 +
gctctagcactgggcacagctg

SEQ ID NO: 203245 - DNA, 22 bp, Artificial Sequence
  Synthetic oligonucleotide; CTC chr2 60513762 60513783 60513779 60513784 +
tagcactgggcacagctgggtc

SEQ ID NO: 203246 - DNA, 22 bp, Artificial Sequence
  Synthetic oligonucleotide; CTA chr2 60513764 60513785 60513781 60513786 +
gcactgggcacagctgggtcag

SEQ ID NO: 203247 - DNA, 22 bp, Artificial Sequence
  Synthetic oligonucleotide; CTG chr2 60513770 60513791 60513787 60513792 +
ggcacagctgggtcagcaccta

SEQ ID NO: 203248 - DNA, 22 bp, Artificial Sequence
  Synthetic oligonucleotide; CTG chr2 60513780 60513801 60513797 60513802 +
ggtcagcacctacgaagggtcc

SEQ ID NO: 203249 - DNA, 22 bp, Artificial Sequence
  Synthetic oligonucleotide; CTA chr2 60513792 60513813 60513809 60513814 +
cgaagggtcctatgcagtgaac

SEQ ID NO: 203250 - DNA, 22 bp, Artificial Sequence
  Synthetic oligonucleotide; CTA chr2 60513804 60513825 60513821 60513826 +
tgcagtgaacaccttgcagtct

SEQ ID NO: 203251 - DNA, 22 bp, Artificial Sequence
  Synthetic oligonucleotide; CTT chr2 60513819 60513840 60513836 60513841 +
gcagtctgaagggcagactctc

SEQ ID NO: 203252 - DNA, 22 bp, Artificial Sequence
  Synthetic oligonucleotide; TTG chr2 60513820 60513841 60513837 60513842 +
cagtctgaagggcagactctct

SEQ ID NO: 203253 - DNA, 22 bp, Artificial Sequence
  Synthetic oligonucleotide; CTG chr2 60513827 60513848 60513844 60513849 +
aagggcagactctctcttctca

SEQ ID NO: 203254 - DNA, 22 bp, Artificial Sequence
  Synthetic oligonucleotide; CTC chr2 60513839 60513860 60513856 60513861 +
tctcttctcaacaagccagaga

SEQ ID NO: 203255 - DNA, 22 bp, Artificial Sequence
  Synthetic oligonucleotide; CTC chr2 60513841 60513862 60513858 60513863 +
tcttctcaacaagccagagatt

SEQ ID NO: 203256 - DNA, 22 bp, Artificial Sequence
  Synthetic oligonucleotide; CTC chr2 60513843 60513864 60513860 60513865 +
ttctcaacaagccagagattct

SEQ ID NO: 203257 - DNA, 22 bp, Artificial Sequence
  Synthetic oligonucleotide; CTT chr2 60513845 60513866 60513862 60513867 +
ctcaacaagccagagattctct

SEQ ID NO: 203258 - DNA, 22 bp, Artificial Sequence
  Synthetic oligonucleotide; TTC chr2 60513846 60513867 60513863 60513868 +
tcaacaagccagagattctctg

SEQ ID NO: 203259 - DNA, 22 bp, Artificial Sequence
  Synthetic oligonucleotide; CTC chr2 60513848 60513869 60513865 60513870 +
aacaagccagagattctctgcc

SEQ ID NO: 203260 - DNA, 22 bp, Artificial Sequence
  Synthetic oligonucleotide; TTC chr2 60513864 60513885 60513881 60513886 +
tctgccttccagacaggcacct

SEQ ID NO: 203261 - DNA, 22 bp, Artificial Sequence
  Synthetic oligonucleotide; CTC chr2 60513866 60513887 60513883 60513888 +
tgccttccagacaggcacctcc

SEQ ID NO: 203262 - DNA, 22 bp, Artificial Sequence
  Synthetic oligonucleotide; CTG chr2 60513868 60513889 60513885 60513890 +
ccttccagacaggcacctccat

SEQ ID NO: 203263 - DNA, 22 bp, Artificial Sequence
  Synthetic oligonucleotide; CTT chr2 60513872 60513893 60513889 60513894 +
ccagacaggcacctccatgaag

SEQ ID NO: 203264 - DNA, 22 bp, Artificial Sequence
  Synthetic oligonucleotide; TTC chr2 60513873 60513894 60513890 60513895 +
cagacaggcacctccatgaaga

SEQ ID NO: 203265 - DNA, 22 bp, Artificial Sequence
  Synthetic oligonucleotide; CTC chr2 60513887 60513908 60513904 60513909 +
catgaagagaagctgttcctgg

SEQ ID NO: 203266 - DNA, 22 bp, Artificial Sequence
  Synthetic oligonucleotide; CTG chr2 60513902 60513923 60513919 60513924 +
ttcctggcttgtggtgagcaaa

SEQ ID NO: 203267 - DNA, 22 bp, Artificial Sequence
  Synthetic oligonucleotide; TTC chr2 60513905 60513926 60513922 60513927 +
ctggcttgtggtgagcaaaact

SEQ ID NO: 203268 - DNA, 22 bp, Artificial Sequence
  Synthetic oligonucleotide; CTG chr2 60513908 60513929 60513925 60513930 +
gcttgtggtgagcaaaactccc

SEQ ID NO: 203269 - DNA, 22 bp, Artificial Sequence
  Synthetic oligonucleotide; CTT chr2 60513912 60513933 60513929 60513934 +
gtggtgagcaaaactccctgga

SEQ ID NO: 203270 - DNA, 22 bp, Artificial Sequence
  Synthetic oligonucleotide; TTG chr2 60513913 60513934 60513930 60513935 +
tggtgagcaaaactccctggat

SEQ ID NO: 203271 - DNA, 22 bp, Artificial Sequence
  Synthetic oligonucleotide; CTC chr2 60513928 60513949 60513945 60513950 +
cctggattgagtcgagacctgg

SEQ ID NO: 203272 - DNA, 22 bp, Artificial Sequence
  Synthetic oligonucleotide; CTG chr2 60513932 60513953 60513949 60513954 +
gattgagtcgagacctggattc

SEQ ID NO: 203273 - DNA, 22 bp, Artificial Sequence
  Synthetic oligonucleotide; TTG chr2 60513937 60513958 60513954 60513959 +
agtcgagacctggattctagtt

SEQ ID NO: 203274 - DNA, 22 bp, Artificial Sequence
  Synthetic oligonucleotide; CTG chr2 60513949 60513970 60513966 60513971 +
gattctagttccactactttga

SEQ ID NO: 203275 - DNA, 22 bp, Artificial Sequence
  Synthetic oligonucleotide; TTC chr2 60513954 60513975 60513971 60513976 +
tagttccactactttgaattct

SEQ ID NO: 203276 - DNA, 22 bp, Artificial Sequence
  Synthetic oligonucleotide; CTA chr2 60513956 60513977 60513973 60513978 +
gttccactactttgaattctct

SEQ ID NO: 203277 - DNA, 22 bp, Artificial Sequence
  Synthetic oligonucleotide; TTC chr2 60513960 60513981 60513977 60513982 +
cactactttgaattctctaggt

SEQ ID NO: 203278 - DNA, 22 bp, Artificial Sequence
  Synthetic oligonucleotide; CTA chr2 60513965 60513986 60513982 60513987 +
ctttgaattctctaggttcaca

SEQ ID NO: 203279 - DNA, 22 bp, Artificial Sequence
  Synthetic oligonucleotide; CTT chr2 60513968 60513989 60513985 60513990 +
tgaattctctaggttcacagtc

SEQ ID NO: 203280 - DNA, 22 bp, Artificial Sequence
  Synthetic oligonucleotide; TTT chr2 60513969 60513990 60513986 60513991 +
gaattctctaggttcacagtcc

SEQ ID NO: 203281 - DNA, 22 bp, Artificial Sequence
  Synthetic oligonucleotide; TTG chr2 60513970 60513991 60513987 60513992 +
aattctctaggttcacagtcct

SEQ ID NO: 203282 - DNA, 22 bp, Artificial Sequence
  Synthetic oligonucleotide; TTC chr2 60513975 60513996 60513992 60513997 +
tctaggttcacagtcctaaatc

SEQ ID NO: 203283 - DNA, 22 bp, Artificial Sequence
  Synthetic oligonucleotide; CTC chr2 60513977 60513998 60513994 60513999 +
taggttcacagtcctaaatcct

SEQ ID NO: 203284 - DNA, 22 bp, Artificial Sequence
  Synthetic oligonucleotide; CTA chr2 60513979 60514000 60513996 60514001 +
ggttcacagtcctaaatcctca

SEQ ID NO: 203285 - DNA, 22 bp, Artificial Sequence
  Synthetic oligonucleotide; TTC chr2 60513984 60514005 60514001 60514006 +
acagtcctaaatcctcagagaa

SEQ ID NO: 203286 - DNA, 22 bp, Artificial Sequence
  Synthetic oligonucleotide; CTA chr2 60513993 60514014 60514010 60514015 +
aatcctcagagaaggacagact

SEQ ID NO: 203287 - DNA, 22 bp, Artificial Sequence
  Synthetic oligonucleotide; CTC chr2 60514000 60514021 60514017 60514022 +
agagaaggacagacttgagggc

SEQ ID NO: 203288 - DNA, 22 bp, Artificial Sequence
  Synthetic oligonucleotide; CTT chr2 60514016 60514037 60514033 60514038 +
gagggcagacagccacaggtgg

SEQ ID NO: 203289 - DNA, 22 bp, Artificial Sequence
  Synthetic oligonucleotide; TTG chr2 60514017 60514038 60514034 60514039 +
agggcagacagccacaggtggc

SEQ ID NO: 203290 - DNA, 22 bp, Artificial Sequence
  Synthetic oligonucleotide; CTG chr2 60514042 60514063 60514059 60514064 +
gcatgggctgaggcagcacaca

SEQ ID NO: 203291 - DNA, 22 bp, Artificial Sequence
  Synthetic oligonucleotide; CTG chr2 60514052 60514073 60514069 60514074 +
aggcagcacacaaggactctga

SEQ ID NO: 203292 - DNA, 22 bp, Artificial Sequence
  Synthetic oligonucleotide; CTC chr2 60514071 60514092 60514088 60514093 +
tgagccacaccagccatctcct

SEQ ID NO: 203293 - DNA, 22 bp, Artificial Sequence
  Synthetic oligonucleotide; CTG chr2 60514073 60514094 60514090 60514095 +
agccacaccagccatctccttg

SEQ ID NO: 203294 - DNA, 22 bp, Artificial Sequence
  Synthetic oligonucleotide; CTC chr2 60514091 60514112 60514108 60514113 +
cttgtggactttcctgagagca

SEQ ID NO: 203295 - DNA, 22 bp, Artificial Sequence
  Synthetic oligonucleotide; CTT chr2 60514094 60514115 60514111 60514116 +
gtggactttcctgagagcacgt

SEQ ID NO: 203296 - DNA, 22 bp, Artificial Sequence
  Synthetic oligonucleotide; TTG chr2 60514095 60514116 60514112 60514117 +
tggactttcctgagagcacgtg

SEQ ID NO: 203297 - DNA, 22 bp, Artificial Sequence
  Synthetic oligonucleotide; CTT chr2 60514102 60514123 60514119 60514124 +
tcctgagagcacgtgcagctag

SEQ ID NO: 203298 - DNA, 22 bp, Artificial Sequence
  Synthetic oligonucleotide; TTT chr2 60514103 60514124 60514120 60514125 +
cctgagagcacgtgcagctagc

SEQ ID NO: 203299 - DNA, 22 bp, Artificial Sequence
  Synthetic oligonucleotide; TTC chr2 60514104 60514125 60514121 60514126 +
ctgagagcacgtgcagctagca

SEQ ID NO: 203300 - DNA, 22 bp, Artificial Sequence
  Synthetic oligonucleotide; CTG chr2 60514107 60514128 60514124 60514129 +
agagcacgtgcagctagcagtg

SEQ ID NO: 203301 - DNA, 22 bp, Artificial Sequence
  Synthetic oligonucleotide; CTA chr2 60514123 60514144 60514140 60514145 +
gcagtgctccaagcactctctg

SEQ ID NO: 203302 - DNA, 22 bp, Artificial Sequence
  Synthetic oligonucleotide; CTC chr2 60514132 60514153 60514149 60514154 +
caagcactctctgagaggcttc

SEQ ID NO: 203303 - DNA, 22 bp, Artificial Sequence
  Synthetic oligonucleotide; CTC chr2 60514141 60514162 60514158 60514163 +
tctgagaggcttccaggctgga

SEQ ID NO: 203304 - DNA, 22 bp, Artificial Sequence
  Synthetic oligonucleotide; CTC chr2 60514143 60514164 60514160 60514165 +
tgagaggcttccaggctggagc

SEQ ID NO: 203305 - DNA, 22 bp, Artificial Sequence
  Synthetic oligonucleotide; CTG chr2 60514145 60514166 60514162 60514167 +
agaggcttccaggctggagctc

SEQ ID NO: 203306 - DNA, 22 bp, Artificial Sequence
  Synthetic oligonucleotide; CTT chr2 60514153 60514174 60514170 60514175 +
ccaggctggagctctgagaggc

SEQ ID NO: 203307 - DNA, 22 bp, Artificial Sequence
  Synthetic oligonucleotide; TTC chr2 60514154 60514175 60514171 60514176 +
caggctggagctctgagaggct

SEQ ID NO: 203308 - DNA, 22 bp, Artificial Sequence
  Synthetic oligonucleotide; CTG chr2 60514161 60514182 60514178 60514183 +
gagctctgagaggcttccaggc

SEQ ID NO: 203309 - DNA, 22 bp, Artificial Sequence
  Synthetic oligonucleotide; CTC chr2 60514167 60514188 60514184 60514189 +
tgagaggcttccaggctgggct

SEQ ID NO: 203310 - DNA, 22 bp, Artificial Sequence
  Synthetic oligonucleotide; CTG chr2 60514169 60514190 60514186 60514191 +
agaggcttccaggctgggctac

SEQ ID NO: 203311 - DNA, 22 bp, Artificial Sequence
  Synthetic oligonucleotide; CTT chr2 60514177 60514198 60514194 60514199 +
ccaggctgggctacctccagcc

SEQ ID NO: 203312 - DNA, 22 bp, Artificial Sequence
  Synthetic oligonucleotide; TTC chr2 60514178 60514199 60514195 60514200 +
caggctgggctacctccagcca

SEQ ID NO: 203313 - DNA, 22 bp, Artificial Sequence
  Synthetic oligonucleotide; CTG chr2 60514185 60514206 60514202 60514207 +
ggctacctccagccatgtggtg

SEQ ID NO: 203314 - DNA, 22 bp, Artificial Sequence
  Synthetic oligonucleotide; CTA chr2 60514190 60514211 60514207 60514212 +
cctccagccatgtggtggaaac

SEQ ID NO: 203315 - DNA, 22 bp, Artificial Sequence
  Synthetic oligonucleotide; CTC chr2 60514194 60514215 60514211 60514216 +
cagccatgtggtggaaactggt

SEQ ID NO: 203316 - DNA, 22 bp, Artificial Sequence
  Synthetic oligonucleotide; CTG chr2 60514214 60514235 60514231 60514236 +
gtagcaaaggaagcccagaagg

SEQ ID NO: 203317 - DNA, 22 bp, Artificial Sequence
  Synthetic oligonucleotide; CTG chr2 60514246 60514267 60514263 60514268 +
aactagaaggctaaggaacacc

SEQ ID NO: 203318 - DNA, 22 bp, Artificial Sequence
  Synthetic oligonucleotide; CTA chr2 60514251 60514272 60514268 60514273 +
gaaggctaaggaacaccccggc

SEQ ID NO: 203319 - DNA, 22 bp, Artificial Sequence
  Synthetic oligonucleotide; CTA chr2 60514259 60514280 60514276 60514281 +
aggaacaccccggccactggtg

SEQ ID NO: 203320 - DNA, 22 bp, Artificial Sequence
  Synthetic oligonucleotide; CTG chr2 60514278 60514299 60514295 60514300 +
gtgggatcgcagtgctgagcca

SEQ ID NO: 203321 - DNA, 22 bp, Artificial Sequence
  Synthetic oligonucleotide; CTG chr2 60514295 60514316 60514312 60514317 +
agccatgagccctaccaggcaa

SEQ ID NO: 203322 - DNA, 22 bp, Artificial Sequence
  Synthetic oligonucleotide; CTA chr2 60514309 60514330 60514326 60514331 +
ccaggcaacccatttctgggca

SEQ ID NO: 203323 - DNA, 22 bp, Artificial Sequence
  Synthetic oligonucleotide; TTT chr2 60514324 60514345 60514341 60514346 +
ctgggcagtcccaagacttgga

SEQ ID NO: 203324 - DNA, 22 bp, Artificial Sequence
  Synthetic oligonucleotide; TTC chr2 60514325 60514346 60514342 60514347 +
tgggcagtcccaagacttggag

SEQ ID NO: 203325 - DNA, 22 bp, Artificial Sequence
  Synthetic oligonucleotide; CTG chr2 60514327 60514348 60514344 60514349 +
ggcagtcccaagacttggagaa

SEQ ID NO: 203326 - DNA, 22 bp, Artificial Sequence
  Synthetic oligonucleotide; CTT chr2 60514343 60514364 60514360 60514365 +
ggagaacaagccatctgaaaat

SEQ ID NO: 203327 - DNA, 22 bp, Artificial Sequence
  Synthetic oligonucleotide; TTG chr2 60514344 60514365 60514361 60514366 +
gagaacaagccatctgaaaata

SEQ ID NO: 203328 - DNA, 22 bp, Artificial Sequence
  Synthetic oligonucleotide; CTG chr2 60514360 60514381 60514377 60514382 +
aaaatagaattaaatagccagg

SEQ ID NO: 203329 - DNA, 22 bp, Artificial Sequence
  Synthetic oligonucleotide; TTA chr2 60514372 60514393 60514389 60514394 +
aatagccaggtgcggtggctca

SEQ ID NO: 203330 - DNA, 22 bp, Artificial Sequence
  Synthetic oligonucleotide; CTC chr2 60514393 60514414 60514410 60514415 +
acacctgtaatctcagcatttt

SEQ ID NO: 203331 - DNA, 22 bp, Artificial Sequence
  Synthetic oligonucleotide; CTG chr2 60514400 60514421 60514417 60514422 +
taatctcagcattttgggaggc

SEQ ID NO: 203332 - DNA, 22 bp, Artificial Sequence
  Synthetic oligonucleotide; CTC chr2 60514407 60514428 60514424 60514429 +
agcattttgggaggccgaggcg

SEQ ID NO: 203333 - DNA, 22 bp, Artificial Sequence
  Synthetic oligonucleotide; TTT chr2 60514414 60514435 60514431 60514436 +
tgggaggccgaggcgtgtgggt

SEQ ID NO: 203334 - DNA, 22 bp, Artificial Sequence
  Synthetic oligonucleotide; TTT chr2 60514415 60514436 60514432 60514437 +
gggaggccgaggcgtgtgggtc

SEQ ID NO: 203335 - DNA, 22 bp, Artificial Sequence
  Synthetic oligonucleotide; TTG chr2 60514416 60514437 60514433 60514438 +
ggaggccgaggcgtgtgggtca

SEQ ID NO: 203336 - DNA, 22 bp, Artificial Sequence
  Synthetic oligonucleotide; CTG chr2 60514442 60514463 60514459 60514464 +
aggtcaggagttcaagaccagc

SEQ ID NO: 203337 - DNA, 22 bp, Artificial Sequence
  Synthetic oligonucleotide; TTC chr2 60514455 60514476 60514472 60514477 +
aagaccagcctagccaacatgg

SEQ ID NO: 203338 - DNA, 22 bp, Artificial Sequence
  Synthetic oligonucleotide; CTA chr2 60514467 60514488 60514484 60514489 +
gccaacatggtgaaaccccatc

SEQ ID NO: 203339 - DNA, 22 bp, Artificial Sequence
  Synthetic oligonucleotide; CTC chr2 60514491 60514512 60514508 60514513 +
tacttaaaaaaaaaaaaaaaaa

SEQ ID NO: 203340 - DNA, 22 bp, Artificial Sequence
  Synthetic oligonucleotide; CTA chr2 60514493 60514514 60514510 60514515 +
cttaaaaaaaaaaaaaaaaaaa

SEQ ID NO: 203341 - DNA, 22 bp, Artificial Sequence
  Synthetic oligonucleotide; CTT chr2 60514496 60514517 60514513 60514518 +
aaaaaaaaaaaaaaaaaaaaaa

SEQ ID NO: 203342 - DNA, 22 bp, Artificial Sequence
  Synthetic oligonucleotide; TTA chr2 60514497 60514518 60514514 60514519 +
aaaaaaaaaaaaaaaaaaaaaa

SEQ ID NO: 203343 - DNA, 22 bp, Artificial Sequence
  Synthetic oligonucleotide; CTA chr2 60514546 60514567 60514563 60514568 +
taatcccagctacttgggaggc

SEQ ID NO: 203344 - DNA, 22 bp, Artificial Sequence
  Synthetic oligonucleotide; CTA chr2 60514558 60514579 60514575 60514580 +
cttgggaggctgaggcaggaga

SEQ ID NO: 203345 - DNA, 22 bp, Artificial Sequence
  Synthetic oligonucleotide; CTT chr2 60514561 60514582 60514578 60514583 +
gggaggctgaggcaggagaatc

SEQ ID NO: 203346 - DNA, 22 bp, Artificial Sequence
  Synthetic oligonucleotide; TTG chr2 60514562 60514583 60514579 60514584 +
ggaggctgaggcaggagaatca

SEQ ID NO: 203347 - DNA, 22 bp, Artificial Sequence
  Synthetic oligonucleotide; CTG chr2 60514570 60514591 60514587 60514592 +
aggcaggagaatcacttgaacc

SEQ ID NO: 203348 - DNA, 22 bp, Artificial Sequence
  Synthetic oligonucleotide; CTT chr2 60514587 60514608 60514604 60514609 +
gaacctgggaggcggaggctgc

SEQ ID NO: 203349 - DNA, 22 bp, Artificial Sequence
  Synthetic oligonucleotide; TTG chr2 60514588 60514609 60514605 60514610 +
aacctgggaggcggaggctgca

SEQ ID NO: 203350 - DNA, 22 bp, Artificial Sequence
  Synthetic oligonucleotide; CTG chr2 60514594 60514615 60514611 60514616 +
ggaggcggaggctgcaatgagc

SEQ ID NO: 203351 - DNA, 22 bp, Artificial Sequence
  Synthetic oligonucleotide; CTG chr2 60514608 60514629 60514625 60514630 +
caatgagccgagatcgtagcac

SEQ ID NO: 203352 - DNA, 22 bp, Artificial Sequence
  Synthetic oligonucleotide; CTG chr2 60514632 60514653 60514649 60514654 +
cactccagcctgggcgacagag

SEQ ID NO: 203353 - DNA, 22 bp, Artificial Sequence
  Synthetic oligonucleotide; CTC chr2 60514637 60514658 60514654 60514659 +
cagcctgggcgacagagcgaga

SEQ ID NO: 203354 - DNA, 22 bp, Artificial Sequence
  Synthetic oligonucleotide; CTG chr2 60514644 60514665 60514661 60514666 +
ggcgacagagcgagactccatc

SEQ ID NO: 203355 - DNA, 22 bp, Artificial Sequence
  Synthetic oligonucleotide; CTC chr2 60514662 60514683 60514679 60514684 +
catctcaaaaaaaaaaaaaaat

SEQ ID NO: 203356 - DNA, 22 bp, Artificial Sequence
  Synthetic oligonucleotide; CTC chr2 60514668 60514689 60514685 60514690 +
aaaaaaaaaaaaaaattaaatt

SEQ ID NO: 203357 - DNA, 22 bp, Artificial Sequence
  Synthetic oligonucleotide; TTA chr2 60514686 60514707 60514703 60514708 +
aattgggtgggggagtttctta

SEQ ID NO: 203358 - DNA, 22 bp, Artificial Sequence
  Synthetic oligonucleotide; TTG chr2 60514691 60514712 60514708 60514713 +
ggtgggggagtttcttaggaaa

SEQ ID NO: 203359 - DNA, 22 bp, Artificial Sequence
  Synthetic oligonucleotide; TTT chr2 60514704 60514725 60514721 60514726 +
cttaggaaaaaaatcagagttg

SEQ ID NO: 203360 - DNA, 22 bp, Artificial Sequence
  Synthetic oligonucleotide; TTC chr2 60514705 60514726 60514722 60514727 +
ttaggaaaaaaatcagagttgt

SEQ ID NO: 203361 - DNA, 22 bp, Artificial Sequence
  Synthetic oligonucleotide; CTT chr2 60514707 60514728 60514724 60514729 +
aggaaaaaaatcagagttgtgc

SEQ ID NO: 203362 - DNA, 22 bp, Artificial Sequence
  Synthetic oligonucleotide; TTA chr2 60514708 60514729 60514725 60514730 +
ggaaaaaaatcagagttgtgca

SEQ ID NO: 203363 - DNA, 22 bp, Artificial Sequence
  Synthetic oligonucleotide; TTG chr2 60514726 60514747 60514743 60514748 +
tgcaaataaatctagttggtct

SEQ ID NO: 203364 - DNA, 22 bp, Artificial Sequence
  Synthetic oligonucleotide; CTA chr2 60514740 60514761 60514757 60514762 +
gttggtctgactgtctttacaa

SEQ ID NO: 203365 - DNA, 22 bp, Artificial Sequence
  Synthetic oligonucleotide; TTG chr2 60514744 60514765 60514761 60514766 +
gtctgactgtctttacaacaca

SEQ ID NO: 203366 - DNA, 22 bp, Artificial Sequence
  Synthetic oligonucleotide; CTG chr2 60514749 60514770 60514766 60514771 +
actgtctttacaacacaatgaa

SEQ ID NO: 203367 - DNA, 22 bp, Artificial Sequence
  Synthetic oligonucleotide; CTG chr2 60514753 60514774 60514770 60514775 +
tctttacaacacaatgaaaggg

SEQ ID NO: 203368 - DNA, 22 bp, Artificial Sequence
  Synthetic oligonucleotide; CTT chr2 60514757 60514778 60514774 60514779 +
tacaacacaatgaaagggtaag

SEQ ID NO: 203369 - DNA, 22 bp, Artificial Sequence
  Synthetic oligonucleotide; TTT chr2 60514758 60514779 60514775 60514780 +
acaacacaatgaaagggtaagg

SEQ ID NO: 203370 - DNA, 22 bp, Artificial Sequence
  Synthetic oligonucleotide; TTA chr2 60514759 60514780 60514776 60514781 +
caacacaatgaaagggtaaggc

SEQ ID NO: 203371 - DNA, 22 bp, Artificial Sequence
  Synthetic oligonucleotide; CTG chr2 60514795 60514816 60514812 60514817 +
tgaattccattgataagagagg

SEQ ID NO: 203372 - DNA, 22 bp, Artificial Sequence
  Synthetic oligonucleotide; TTC chr2 60514802 60514823 60514819 60514824 +
cattgataagagaggatttccc

SEQ ID NO: 203373 - DNA, 22 bp, Artificial Sequence
  Synthetic oligonucleotide; TTG chr2 60514807 60514828 60514824 60514829 +
ataagagaggatttccctactc

SEQ ID NO: 203374 - DNA, 22 bp, Artificial Sequence
  Synthetic oligonucleotide; TTT chr2 60514821 60514842 60514838 60514843 +
ccctactcaaatatcaaaggtc

SEQ ID NO: 203375 - DNA, 22 bp, Artificial Sequence
  Synthetic oligonucleotide; TTC chr2 60514822 60514843 60514839 60514844 +
cctactcaaatatcaaaggtct

SEQ ID NO: 203376 - DNA, 22 bp, Artificial Sequence
  Synthetic oligonucleotide; CTA chr2 60514826 60514847 60514843 60514848 +
ctcaaatatcaaaggtcttgca

SEQ ID NO: 203377 - DNA, 22 bp, Artificial Sequence
  Synthetic oligonucleotide; CTC chr2 60514829 60514850 60514846 60514851 +
aaatatcaaaggtcttgcatac

SEQ ID NO: 203378 - DNA, 22 bp, Artificial Sequence
  Synthetic oligonucleotide; CTT chr2 60514845 60514866 60514862 60514867 +
gcatacacatacactaaaacag

SEQ ID NO: 203379 - DNA, 22 bp, Artificial Sequence
  Synthetic oligonucleotide; TTG chr2 60514846 60514867 60514863 60514868 +
catacacatacactaaaacaga

SEQ ID NO: 203380 - DNA, 22 bp, Artificial Sequence
  Synthetic oligonucleotide; CTA chr2 60514861 60514882 60514878 60514883 +
aaacagaaaaaagaaaaaaaaa

SEQ ID NO: 203381 - DNA, 22 bp, Artificial Sequence
  Synthetic oligonucleotide; CTT chr2 60514922 60514943 60514939 60514944 +
ttaaactcatccaagagccagt

SEQ ID NO: 203382 - DNA, 22 bp, Artificial Sequence
  Synthetic oligonucleotide; TTT chr2 60514923 60514944 60514940 60514945 +
taaactcatccaagagccagtc

SEQ ID NO: 203383 - DNA, 22 bp, Artificial Sequence
  Synthetic oligonucleotide; TTT chr2 60514924 60514945 60514941 60514946 +
aaactcatccaagagccagtca

SEQ ID NO: 203384 - DNA, 22 bp, Artificial Sequence
  Synthetic oligonucleotide; TTA chr2 60514925 60514946 60514942 60514947 +
aactcatccaagagccagtcaa

SEQ ID NO: 203385 - DNA, 22 bp, Artificial Sequence
  Synthetic oligonucleotide; CTC chr2 60514930 60514951 60514947 60514952 +
atccaagagccagtcaaagcca

SEQ ID NO: 203386 - DNA, 22 bp, Artificial Sequence
  Synthetic oligonucleotide; CTT chr2 60514980 60515001 60514997 60515002 +
ccgaactcagccgttctccctc

SEQ ID NO: 203387 - DNA, 22 bp, Artificial Sequence
  Synthetic oligonucleotide; TTC chr2 60514981 60515002 60514998 60515003 +
cgaactcagccgttctccctct

SEQ ID NO: 203388 - DNA, 22 bp, Artificial Sequence
  Synthetic oligonucleotide; CTC chr2 60514988 60515009 60515005 60515010 +
agccgttctccctctggtgaga

SEQ ID NO: 203389 - DNA, 22 bp, Artificial Sequence
  Synthetic oligonucleotide; TTC chr2 60514996 60515017 60515013 60515018 +
tccctctggtgagacaggctct

SEQ ID NO: 203390 - DNA, 22 bp, Artificial Sequence
  Synthetic oligonucleotide; CTC chr2 60514998 60515019 60515015 60515020 +
cctctggtgagacaggctctag

SEQ ID NO: 203391 - DNA, 22 bp, Artificial Sequence
  Synthetic oligonucleotide; CTC chr2 60515002 60515023 60515019 60515024 +
tggtgagacaggctctagcttg

SEQ ID NO: 203392 - DNA, 22 bp, Artificial Sequence
  Synthetic oligonucleotide; CTG chr2 60515004 60515025 60515021 60515026 +
gtgagacaggctctagcttgtt

SEQ ID NO: 203393 - DNA, 22 bp, Artificial Sequence
  Synthetic oligonucleotide; CTC chr2 60515017 60515038 60515034 60515039 +
tagcttgtttccagaatgccac

SEQ ID NO: 203394 - DNA, 22 bp, Artificial Sequence
  Synthetic oligonucleotide; CTA chr2 60515019 60515040 60515036 60515041 +
gcttgtttccagaatgccacta

SEQ ID NO: 203395 - DNA, 22 bp, Artificial Sequence
  Synthetic oligonucleotide; CTT chr2 60515023 60515044 60515040 60515045 +
gtttccagaatgccactaccag

SEQ ID NO: 203396 - DNA, 22 bp, Artificial Sequence
  Synthetic oligonucleotide; TTG chr2 60515024 60515045 60515041 60515046 +
tttccagaatgccactaccagc

SEQ ID NO: 203397 - DNA, 22 bp, Artificial Sequence
  Synthetic oligonucleotide; TTT chr2 60515027 60515048 60515044 60515049 +
ccagaatgccactaccagcttc

SEQ ID NO: 203398 - DNA, 22 bp, Artificial Sequence
  Synthetic oligonucleotide; TTC chr2 60515028 60515049 60515045 60515050 +
cagaatgccactaccagcttcc

SEQ ID NO: 203399 - DNA, 22 bp, Artificial Sequence
  Synthetic oligonucleotide; CTA chr2 60515041 60515062 60515058 60515063 +
ccagcttcccacacctccaggg

SEQ ID NO: 203400 - DNA, 22 bp, Artificial Sequence
  Synthetic oligonucleotide; CTT chr2 60515048 60515069 60515065 60515070 +
cccacacctccaggggaccccc

SEQ ID NO: 203401 - DNA, 22 bp, Artificial Sequence
  Synthetic oligonucleotide; TTC chr2 60515049 60515070 60515066 60515071 +
ccacacctccaggggaccccct

SEQ ID NO: 203402 - DNA, 22 bp, Artificial Sequence
  Synthetic oligonucleotide; CTC chr2 60515058 60515079 60515075 60515080 +
caggggaccccctaactccaaa

SEQ ID NO: 203403 - DNA, 22 bp, Artificial Sequence
  Synthetic oligonucleotide; CTA chr2 60515072 60515093 60515089 60515094 +
actccaaagtgttgcccagacc

SEQ ID NO: 203404 - DNA, 22 bp, Artificial Sequence
  Synthetic oligonucleotide; CTC chr2 60515076 60515097 60515093 60515098 +
caaagtgttgcccagacctaag

SEQ ID NO: 203405 - DNA, 22 bp, Artificial Sequence
  Synthetic oligonucleotide; TTG chr2 60515086 60515107 60515103 60515108 +
cccagacctaaggatcctcccc

SEQ ID NO: 203406 - DNA, 22 bp, Artificial Sequence
  Synthetic oligonucleotide; CTA chr2 60515096 60515117 60515113 60515118 +
aggatcctcccccacgtgctcc

SEQ ID NO: 203407 - DNA, 22 bp, Artificial Sequence
  Synthetic oligonucleotide; CTC chr2 60515105 60515126 60515122 60515127 +
ccccacgtgctccttccccaac

SEQ ID NO: 203408 - DNA, 22 bp, Artificial Sequence
  Synthetic oligonucleotide; CTC chr2 60515117 60515138 60515134 60515139 +
cttccccaacactggcttccag

SEQ ID NO: 203409 - DNA, 22 bp, Artificial Sequence
  Synthetic oligonucleotide; CTT chr2 60515120 60515141 60515137 60515142 +
ccccaacactggcttccaggtg

SEQ ID NO: 203410 - DNA, 22 bp, Artificial Sequence
  Synthetic oligonucleotide; TTC chr2 60515121 60515142 60515138 60515143 +
cccaacactggcttccaggtga

SEQ ID NO: 203411 - DNA, 22 bp, Artificial Sequence
  Synthetic oligonucleotide; CTG chr2 60515131 60515152 60515148 60515153 +
gcttccaggtgagcgagacaga

SEQ ID NO: 203412 - DNA, 22 bp, Artificial Sequence
  Synthetic oligonucleotide; CTT chr2 60515135 60515156 60515152 60515157 +
ccaggtgagcgagacagaatct

SEQ ID NO: 203413 - DNA, 22 bp, Artificial Sequence
  Synthetic oligonucleotide; TTC chr2 60515136 60515157 60515153 60515158 +
caggtgagcgagacagaatctg

SEQ ID NO: 203414 - DNA, 22 bp, Artificial Sequence
  Synthetic oligonucleotide; CTG chr2 60515158 60515179 60515175 60515180 +
caagcagagttcactgcttgac

SEQ ID NO: 203415 - DNA, 22 bp, Artificial Sequence
  Synthetic oligonucleotide; TTC chr2 60515170 60515191 60515187 60515192 +
actgcttgaccatggggtgaaa

SEQ ID NO: 203416 - DNA, 22 bp, Artificial Sequence
  Synthetic oligonucleotide; CTG chr2 60515174 60515195 60515191 60515196 +
cttgaccatggggtgaaagcca

SEQ ID NO: 203417 - DNA, 22 bp, Artificial Sequence
  Synthetic oligonucleotide; CTT chr2 60515177 60515198 60515194 60515199 +
gaccatggggtgaaagccacaa

SEQ ID NO: 203418 - DNA, 22 bp, Artificial Sequence
  Synthetic oligonucleotide; TTG chr2 60515178 60515199 60515195 60515200 +
accatggggtgaaagccacaaa

SEQ ID NO: 203419 - DNA, 22 bp, Artificial Sequence
  Synthetic oligonucleotide; CTA chr2 60515214 60515235 60515231 60515236 +
tcccaaccccagcactttcact

SEQ ID NO: 203420 - DNA, 22 bp, Artificial Sequence
  Synthetic oligonucleotide; CTT chr2 60515231 60515252 60515248 60515253 +
tcactttttcactttctcccca

SEQ ID NO: 203421 - DNA, 22 bp, Artificial Sequence
  Synthetic oligonucleotide; TTT chr2 60515232 60515253 60515249 60515254 +
cactttttcactttctccccag

SEQ ID NO: 203422 - DNA, 22 bp, Artificial Sequence
  Synthetic oligonucleotide; TTC chr2 60515233 60515254 60515250 60515255 +
actttttcactttctccccagg

SEQ ID NO: 203423 - DNA, 22 bp, Artificial Sequence
  Synthetic oligonucleotide; CTT chr2 60515237 60515258 60515254 60515259 +
tttcactttctccccagggagg

SEQ ID NO: 203424 - DNA, 22 bp, Artificial Sequence
  Synthetic oligonucleotide; TTT chr2 60515238 60515259 60515255 60515260 +
ttcactttctccccagggagga

SEQ ID NO: 203425 - DNA, 22 bp, Artificial Sequence
  Synthetic oligonucleotide; TTT chr2 60515239 60515260 60515256 60515261 +
tcactttctccccagggaggaa

SEQ ID NO: 203426 - DNA, 22 bp, Artificial Sequence
  Synthetic oligonucleotide; TTT chr2 60515240 60515261 60515257 60515262 +
cactttctccccagggaggaag

SEQ ID NO: 203427 - DNA, 22 bp, Artificial Sequence
  Synthetic oligonucleotide; TTC chr2 60515241 60515262 60515258 60515263 +
actttctccccagggaggaagg

SEQ ID NO: 203428 - DNA, 22 bp, Artificial Sequence
  Synthetic oligonucleotide; CTT chr2 60515245 60515266 60515262 60515267 +
tctccccagggaggaaggggga

SEQ ID NO: 203429 - DNA, 22 bp, Artificial Sequence
  Synthetic oligonucleotide; TTT chr2 60515246 60515267 60515263 60515268 +
ctccccagggaggaagggggaa

SEQ ID NO: 203430 - DNA, 22 bp, Artificial Sequence
  Synthetic oligonucleotide; TTC chr2 60515247 60515268 60515264 60515269 +
tccccagggaggaagggggaaa

SEQ ID NO: 203431 - DNA, 22 bp, Artificial Sequence
  Synthetic oligonucleotide; CTC chr2 60515249 60515270 60515266 60515271 +
cccagggaggaagggggaaata

SEQ ID NO: 203432 - DNA, 22 bp, Artificial Sequence
  Synthetic oligonucleotide; CTT chr2 60515276 60515297 60515293 60515298 +
gcccagcctcacaccttccctg

SEQ ID NO: 203433 - DNA, 22 bp, Artificial Sequence
  Synthetic oligonucleotide; TTG chr2 60515277 60515298 60515294 60515299 +
cccagcctcacaccttccctgg

SEQ ID NO: 203434 - DNA, 22 bp, Artificial Sequence
  Synthetic oligonucleotide; CTC chr2 60515286 60515307 60515303 60515308 +
acaccttccctggacagggagc

SEQ ID NO: 203435 - DNA, 22 bp, Artificial Sequence
  Synthetic oligonucleotide; CTT chr2 60515293 60515314 60515310 60515315 +
ccctggacagggagctggggat

SEQ ID NO: 203436 - DNA, 22 bp, Artificial Sequence
  Synthetic oligonucleotide; TTC chr2 60515294 60515315 60515311 60515316 +
cctggacagggagctggggatc

SEQ ID NO: 203437 - DNA, 22 bp, Artificial Sequence
  Synthetic oligonucleotide; CTG chr2 60515298 60515319 60515315 60515320 +
gacagggagctggggatccatt

SEQ ID NO: 203438 - DNA, 22 bp, Artificial Sequence
  Synthetic oligonucleotide; CTG chr2 60515310 60515331 60515327 60515332 +
gggatccattcaaagcccggtc

SEQ ID NO: 203439 - DNA, 22 bp, Artificial Sequence
  Synthetic oligonucleotide; TTC chr2 60515321 60515342 60515338 60515343 +
aaagcccggtctttctctgttc

SEQ ID NO: 203440 - DNA, 22 bp, Artificial Sequence
  Synthetic oligonucleotide; CTT chr2 60515334 60515355 60515351 60515356 +
tctctgttcaatcaagcagcgt

SEQ ID NO: 203441 - DNA, 22 bp, Artificial Sequence
  Synthetic oligonucleotide; TTT chr2 60515335 60515356 60515352 60515357 +
ctctgttcaatcaagcagcgtg

SEQ ID NO: 203442 - DNA, 22 bp, Artificial Sequence
  Synthetic oligonucleotide; TTC chr2 60515336 60515357 60515353 60515358 +
tctgttcaatcaagcagcgtga

SEQ ID NO: 203443 - DNA, 22 bp, Artificial Sequence
  Synthetic oligonucleotide; CTC chr2 60515338 60515359 60515355 60515360 +
tgttcaatcaagcagcgtgagc

SEQ ID NO: 203444 - DNA, 22 bp, Artificial Sequence
  Synthetic oligonucleotide; CTG chr2 60515340 60515361 60515357 60515362 +
ttcaatcaagcagcgtgagcaa

SEQ ID NO: 203445 - DNA, 22 bp, Artificial Sequence
  Synthetic oligonucleotide; TTC chr2 60515343 60515364 60515360 60515365 +
aatcaagcagcgtgagcaaagt

SEQ ID NO: 203446 - DNA, 22 bp, Artificial Sequence
  Synthetic oligonucleotide; TTA chr2 60515373 60515394 60515390 60515395 +
aatactacatatgaaccagcat

SEQ ID NO: 203447 - DNA, 22 bp, Artificial Sequence
  Synthetic oligonucleotide; CTA chr2 60515380 60515401 60515397 60515402 +
catatgaaccagcattatgtta

SEQ ID NO: 203448 - DNA, 22 bp, Artificial Sequence
  Synthetic oligonucleotide; TTA chr2 60515397 60515418 60515414 60515419 +
tgttaggcaccaagaaggcaca

SEQ ID NO: 203449 - DNA, 22 bp, Artificial Sequence
  Synthetic oligonucleotide; TTA chr2 60515402 60515423 60515419 60515424 +
ggcaccaagaaggcacaaaaaa

SEQ ID NO: 203450 - DNA, 22 bp, Artificial Sequence
  Synthetic oligonucleotide; CTC chr2 60515437 60515458 60515454 60515459 +
ctgccctccaaaaggttataat

SEQ ID NO: 203451 - DNA, 22 bp, Artificial Sequence
  Synthetic oligonucleotide; CTG chr2 60515440 60515461 60515457 60515462 +
ccctccaaaaggttataatttg

SEQ ID NO: 203452 - DNA, 22 bp, Artificial Sequence
  Synthetic oligonucleotide; CTC chr2 60515445 60515466 60515462 60515467 +
caaaaggttataatttgaggag

SEQ ID NO: 203453 - DNA, 22 bp, Artificial Sequence
  Synthetic oligonucleotide; TTA chr2 60515455 60515476 60515472 60515477 +
taatttgaggaggagaaaatac

SEQ ID NO: 203454 - DNA, 22 bp, Artificial Sequence
  Synthetic oligonucleotide; TTT chr2 60515461 60515482 60515478 60515483 +
gaggaggagaaaatacacccac

SEQ ID NO: 203455 - DNA, 22 bp, Artificial Sequence
  Synthetic oligonucleotide; TTG chr2 60515462 60515483 60515479 60515484 +
aggaggagaaaatacacccacg

SEQ ID NO: 203456 - DNA, 22 bp, Artificial Sequence
  Synthetic oligonucleotide; CTG chr2 60515504 60515525 60515521 60515526 +
atccccttttaactaatcccag

SEQ ID NO: 203457 - DNA, 22 bp, Artificial Sequence
  Synthetic oligonucleotide; CTT chr2 60515512 60515533 60515529 60515534 +
ttaactaatcccagagtgacac

SEQ ID NO: 203458 - DNA, 22 bp, Artificial Sequence
  Synthetic oligonucleotide; TTT chr2 60515513 60515534 60515530 60515535 +
taactaatcccagagtgacacc

SEQ ID NO: 203459 - DNA, 22 bp, Artificial Sequence
  Synthetic oligonucleotide; TTT chr2 60515514 60515535 60515531 60515536 +
aactaatcccagagtgacacct

SEQ ID NO: 203460 - DNA, 22 bp, Artificial Sequence
  Synthetic oligonucleotide; TTA chr2 60515515 60515536 60515532 60515537 +
actaatcccagagtgacacctc

SEQ ID NO: 203461 - DNA, 22 bp, Artificial Sequence
  Synthetic oligonucleotide; CTA chr2 60515519 60515540 60515536 60515541 +
atcccagagtgacacctcctcc

SEQ ID NO: 203462 - DNA, 22 bp, Artificial Sequence
  Synthetic oligonucleotide; CTC chr2 60515537 60515558 60515554 60515559 +
ctccaaagaaagccaagttgct

SEQ ID NO: 203463 - DNA, 22 bp, Artificial Sequence
  Synthetic oligonucleotide; CTC chr2 60515540 60515561 60515557 60515562 +
caaagaaagccaagttgctgac

SEQ ID NO: 203464 - DNA, 22 bp, Artificial Sequence
  Synthetic oligonucleotide; TTG chr2 60515557 60515578 60515574 60515579 +
ctgacagagtcaggccttccta

SEQ ID NO: 203465 - DNA, 22 bp, Artificial Sequence
  Synthetic oligonucleotide; CTG chr2 60515560 60515581 60515577 60515582 +
acagagtcaggccttcctagtt

SEQ ID NO: 203466 - DNA, 22 bp, Artificial Sequence
  Synthetic oligonucleotide; CTT chr2 60515575 60515596 60515592 60515597 +
cctagttacctagaaaaatggc

SEQ ID NO: 203467 - DNA, 22 bp, Artificial Sequence
  Synthetic oligonucleotide; TTC chr2 60515576 60515597 60515593 60515598 +
ctagttacctagaaaaatggcc

SEQ ID NO: 203468 - DNA, 22 bp, Artificial Sequence
  Synthetic oligonucleotide; CTA chr2 60515579 60515600 60515596 60515601 +
gttacctagaaaaatggcctgg

SEQ ID NO: 203469 - DNA, 22 bp, Artificial Sequence
  Synthetic oligonucleotide; TTA chr2 60515583 60515604 60515600 60515605 +
cctagaaaaatggcctggggag

SEQ ID NO: 203470 - DNA, 22 bp, Artificial Sequence
  Synthetic oligonucleotide; CTA chr2 60515587 60515608 60515604 60515609 +
gaaaaatggcctggggaggtcc

SEQ ID NO: 203471 - DNA, 22 bp, Artificial Sequence
  Synthetic oligonucleotide; CTG chr2 60515600 60515621 60515617 60515622 +
gggaggtccagcccactagaag

SEQ ID NO: 203472 - DNA, 22 bp, Artificial Sequence
  Synthetic oligonucleotide; CTA chr2 60515618 60515639 60515635 60515640 +
gaaggagatacagaaacaagcc

SEQ ID NO: 203473 - DNA, 22 bp, Artificial Sequence
  Synthetic oligonucleotide; CTC chr2 60515643 60515664 60515660 60515665 +
cataaatatctgtgggacccag

SEQ ID NO: 203474 - DNA, 22 bp, Artificial Sequence
  Synthetic oligonucleotide; CTG chr2 60515655 60515676 60515672 60515677 +
tgggacccagctacctctctga

SEQ ID NO: 203475 - DNA, 22 bp, Artificial Sequence
  Synthetic oligonucleotide; CTA chr2 60515668 60515689 60515685 60515690 +
cctctctgaaacacagcccagt

SEQ ID NO: 203476 - DNA, 22 bp, Artificial Sequence
  Synthetic oligonucleotide; CTC chr2 60515672 60515693 60515689 60515694 +
tctgaaacacagcccagtgctt

SEQ ID NO: 203477 - DNA, 22 bp, Artificial Sequence
  Synthetic oligonucleotide; CTC chr2 60515674 60515695 60515691 60515696 +
tgaaacacagcccagtgctttc

SEQ ID NO: 203478 - DNA, 22 bp, Artificial Sequence
  Synthetic oligonucleotide; CTG chr2 60515676 60515697 60515693 60515698 +
aaacacagcccagtgctttcag

SEQ ID NO: 203479 - DNA, 22 bp, Artificial Sequence
  Synthetic oligonucleotide; CTT chr2 60515694 60515715 60515711 60515716 +
tcaggcagggagaaagtggtgg

SEQ ID NO: 203480 - DNA, 22 bp, Artificial Sequence
  Synthetic oligonucleotide; TTT chr2 60515695 60515716 60515712 60515717 +
caggcagggagaaagtggtggt

SEQ ID NO: 203481 - DNA, 22 bp, Artificial Sequence
  Synthetic oligonucleotide; TTC chr2 60515696 60515717 60515713 60515718 +
aggcagggagaaagtggtggtg

SEQ ID NO: 203482 - DNA, 22 bp, Artificial Sequence
  Synthetic oligonucleotide; CTG chr2 60515746 60515767 60515763 60515768 +
acacagacatgggggcttccaa

SEQ ID NO: 203483 - DNA, 22 bp, Artificial Sequence
  Synthetic oligonucleotide; CTT chr2 60515764 60515785 60515781 60515786 +
ccaaatgactcttgatcaccca

SEQ ID NO: 203484 - DNA, 22 bp, Artificial Sequence
  Synthetic oligonucleotide; TTC chr2 60515765 60515786 60515782 60515787 +
caaatgactcttgatcacccaa

SEQ ID NO: 203485 - DNA, 22 bp, Artificial Sequence
  Synthetic oligonucleotide; CTC chr2 60515775 60515796 60515792 60515797 +
ttgatcacccaactttccagct

SEQ ID NO: 203486 - DNA, 22 bp, Artificial Sequence
  Synthetic oligonucleotide; CTT chr2 60515777 60515798 60515794 60515799 +
gatcacccaactttccagcttc

SEQ ID NO: 203487 - DNA, 22 bp, Artificial Sequence
  Synthetic oligonucleotide; TTG chr2 60515778 60515799 60515795 60515800 +
atcacccaactttccagcttcc

SEQ ID NO: 203488 - DNA, 22 bp, Artificial Sequence
  Synthetic oligonucleotide; CTT chr2 60515790 60515811 60515807 60515812 +
tccagcttccccatttctgccc

SEQ ID NO: 203489 - DNA, 22 bp, Artificial Sequence
  Synthetic oligonucleotide; TTT chr2 60515791 60515812 60515808 60515813 +
ccagcttccccatttctgcccc

SEQ ID NO: 203490 - DNA, 22 bp, Artificial Sequence
  Synthetic oligonucleotide; TTC chr2 60515792 60515813 60515809 60515814 +
cagcttccccatttctgcccct

SEQ ID NO: 203491 - DNA, 22 bp, Artificial Sequence
  Synthetic oligonucleotide; CTT chr2 60515798 60515819 60515815 60515820 +
ccccatttctgcccctgacttg

SEQ ID NO: 203492 - DNA, 22 bp, Artificial Sequence
  Synthetic oligonucleotide; TTC chr2 60515799 60515820 60515816 60515821 +
cccatttctgcccctgacttga

SEQ ID NO: 203493 - DNA, 22 bp, Artificial Sequence
  Synthetic oligonucleotide; TTT chr2 60515806 60515827 60515823 60515828 +
ctgcccctgacttgagctccca

SEQ ID NO: 203494 - DNA, 22 bp, Artificial Sequence
  Synthetic oligonucleotide; TTC chr2 60515807 60515828 60515824 60515829 +
tgcccctgacttgagctcccag

SEQ ID NO: 203495 - DNA, 22 bp, Artificial Sequence
  Synthetic oligonucleotide; CTG chr2 60515809 60515830 60515826 60515831 +
cccctgacttgagctcccaggc

SEQ ID NO: 203496 - DNA, 22 bp, Artificial Sequence
  Synthetic oligonucleotide; CTG chr2 60515815 60515836 60515832 60515837 +
acttgagctcccaggccactca

SEQ ID NO: 203497 - DNA, 22 bp, Artificial Sequence
  Synthetic oligonucleotide; CTT chr2 60515819 60515840 60515836 60515841 +
gagctcccaggccactcaaccc

SEQ ID NO: 203498 - DNA, 22 bp, Artificial Sequence
  Synthetic oligonucleotide; TTG chr2 60515820 60515841 60515837 60515842 +
agctcccaggccactcaaccca

SEQ ID NO: 203499 - DNA, 22 bp, Artificial Sequence
  Synthetic oligonucleotide; CTC chr2 60515825 60515846 60515842 60515847 +
ccaggccactcaacccactgtg

SEQ ID NO: 203500 - DNA, 22 bp, Artificial Sequence
  Synthetic oligonucleotide; CTC chr2 60515836 60515857 60515853 60515858 +
aacccactgtgaggtcttactg

SEQ ID NO: 203501 - DNA, 22 bp, Artificial Sequence
  Synthetic oligonucleotide; CTG chr2 60515845 60515866 60515862 60515867 +
tgaggtcttactgtggggatta

SEQ ID NO: 203502 - DNA, 22 bp, Artificial Sequence
  Synthetic oligonucleotide; CTT chr2 60515854 60515875 60515871 60515876 +
actgtggggattaccgagtcac

SEQ ID NO: 203503 - DNA, 22 bp, Artificial Sequence
  Synthetic oligonucleotide; TTA chr2 60515855 60515876 60515872 60515877 +
ctgtggggattaccgagtcacc

SEQ ID NO: 203504 - DNA, 22 bp, Artificial Sequence
  Synthetic oligonucleotide; CTG chr2 60515858 60515879 60515875 60515880 +
tggggattaccgagtcaccacc

SEQ ID NO: 203505 - DNA, 22 bp, Artificial Sequence
  Synthetic oligonucleotide; TTA chr2 60515867 60515888 60515884 60515889 +
ccgagtcaccaccaggctgcgc

SEQ ID NO: 203506 - DNA, 22 bp, Artificial Sequence
  Synthetic oligonucleotide; CTG chr2 60515886 60515907 60515903 60515908 +
cgctgaacaggaagtgaacaag

SEQ ID NO: 203507 - DNA, 22 bp, Artificial Sequence
  Synthetic oligonucleotide; CTG chr2 60515891 60515912 60515908 60515913 +
aacaggaagtgaacaagtcaat

SEQ ID NO: 203508 - DNA, 22 bp, Artificial Sequence
  Synthetic oligonucleotide; TTC chr2 60515915 60515936 60515932 60515937 +
gagaaagatccaataagggaat

SEQ ID NO: 203509 - DNA, 22 bp, Artificial Sequence
  Synthetic oligonucleotide; TTC chr2 60515941 60515962 60515958 60515963 +
tctgggcaccgctgggccaaca

SEQ ID NO: 203510 - DNA, 22 bp, Artificial Sequence
  Synthetic oligonucleotide; CTC chr2 60515943 60515964 60515960 60515965 +
tgggcaccgctgggccaacacc

SEQ ID NO: 203511 - DNA, 22 bp, Artificial Sequence
  Synthetic oligonucleotide; CTG chr2 60515945 60515966 60515962 60515967 +
ggcaccgctgggccaacaccca

SEQ ID NO: 203512 - DNA, 22 bp, Artificial Sequence
  Synthetic oligonucleotide; CTG chr2 60515955 60515976 60515972 60515977 +
ggccaacacccacggaggggtc

SEQ ID NO: 203513 - DNA, 22 bp, Artificial Sequence
  Synthetic oligonucleotide; CTG chr2 60515980 60516001 60515997 60516002 +
gaatacaaataccctggagtct

SEQ ID NO: 203514 - DNA, 22 bp, Artificial Sequence
  Synthetic oligonucleotide; CTG chr2 60515996 60516017 60516013 60516018 +
gagtctgaagggcggtggcccc

SEQ ID NO: 203515 - DNA, 22 bp, Artificial Sequence
  Synthetic oligonucleotide; CTG chr2 60516003 60516024 60516020 60516025 +
aagggcggtggcccctcttctc

SEQ ID NO: 203516 - DNA, 22 bp, Artificial Sequence
  Synthetic oligonucleotide; CTC chr2 60516020 60516041 60516037 60516042 +
ttctcaccacttcaattatgtc

SEQ ID NO: 203517 - DNA, 22 bp, Artificial Sequence
  Synthetic oligonucleotide; CTT chr2 60516022 60516043 60516039 60516044 +
ctcaccacttcaattatgtctt

SEQ ID NO: 203518 - DNA, 22 bp, Artificial Sequence
  Synthetic oligonucleotide; TTC chr2 60516023 60516044 60516040 60516045 +
tcaccacttcaattatgtcttc

SEQ ID NO: 203519 - DNA, 22 bp, Artificial Sequence
  Synthetic oligonucleotide; CTC chr2 60516025 60516046 60516042 60516047 +
accacttcaattatgtcttcat

SEQ ID NO: 203520 - DNA, 22 bp, Artificial Sequence
  Synthetic oligonucleotide; CTT chr2 60516032 60516053 60516049 60516054 +
caattatgtcttcattgaactg

SEQ ID NO: 203521 - DNA, 22 bp, Artificial Sequence
  Synthetic oligonucleotide; TTC chr2 60516033 60516054 60516050 60516055 +
aattatgtcttcattgaactgg

SEQ ID NO: 203522 - DNA, 22 bp, Artificial Sequence
  Synthetic oligonucleotide; TTA chr2 60516038 60516059 60516055 60516060 +
tgtcttcattgaactgggttat

SEQ ID NO: 203523 - DNA, 22 bp, Artificial Sequence
  Synthetic oligonucleotide; CTT chr2 60516044 60516065 60516061 60516066 +
cattgaactgggttatgaaaaa

SEQ ID NO: 203524 - DNA, 22 bp, Artificial Sequence
  Synthetic oligonucleotide; TTC chr2 60516045 60516066 60516062 60516067 +
attgaactgggttatgaaaaag

SEQ ID NO: 203525 - DNA, 22 bp, Artificial Sequence
  Synthetic oligonucleotide; TTG chr2 60516049 60516070 60516066 60516071 +
aactgggttatgaaaaagggaa

SEQ ID NO: 203526 - DNA, 22 bp, Artificial Sequence
  Synthetic oligonucleotide; CTG chr2 60516054 60516075 60516071 60516076 +
ggttatgaaaaagggaagcagg

SEQ ID NO: 203527 - DNA, 22 bp, Artificial Sequence
  Synthetic oligonucleotide; TTA chr2 60516059 60516080 60516076 60516081 +
tgaaaaagggaagcagggattg

SEQ ID NO: 203528 - DNA, 22 bp, Artificial Sequence
  Synthetic oligonucleotide; TTG chr2 60516081 60516102 60516098 60516103 +
aaaatctagccttgtggccata

SEQ ID NO: 203529 - DNA, 22 bp, Artificial Sequence
  Synthetic oligonucleotide; CTA chr2 60516089 60516110 60516106 60516111 +
gccttgtggccataagcctgtg

SEQ ID NO: 203530 - DNA, 22 bp, Artificial Sequence
  Synthetic oligonucleotide; CTT chr2 60516094 60516115 60516111 60516116 +
gtggccataagcctgtgatgac

SEQ ID NO: 203531 - DNA, 22 bp, Artificial Sequence
  Synthetic oligonucleotide; TTG chr2 60516095 60516116 60516112 60516117 +
tggccataagcctgtgatgact

SEQ ID NO: 203532 - DNA, 22 bp, Artificial Sequence
  Synthetic oligonucleotide; CTG chr2 60516109 60516130 60516126 60516131 +
tgatgactcatgccagctttgg

SEQ ID NO: 203533 - DNA, 22 bp, Artificial Sequence
  Synthetic oligonucleotide; CTC chr2 60516118 60516139 60516135 60516140 +
atgccagctttgggtgctctaa

SEQ ID NO: 203534 - DNA, 22 bp, Artificial Sequence
  Synthetic oligonucleotide; CTT chr2 60516128 60516149 60516145 60516150 +
tgggtgctctaagatgctttcc

SEQ ID NO: 203535 - DNA, 22 bp, Artificial Sequence
  Synthetic oligonucleotide; TTT chr2 60516129 60516150 60516146 60516151 +
gggtgctctaagatgctttccc

SEQ ID NO: 203536 - DNA, 22 bp, Artificial Sequence
  Synthetic oligonucleotide; TTG chr2 60516130 60516151 60516147 60516152 +
ggtgctctaagatgctttccca

SEQ ID NO: 203537 - DNA, 22 bp, Artificial Sequence
  Synthetic oligonucleotide; CTC chr2 60516137 60516158 60516154 60516159 +
taagatgctttcccatgtctgt

SEQ ID NO: 203538 - DNA, 22 bp, Artificial Sequence
  Synthetic oligonucleotide; CTA chr2 60516139 60516160 60516156 60516161 +
agatgctttcccatgtctgtaa

SEQ ID NO: 203539 - DNA, 22 bp, Artificial Sequence
  Synthetic oligonucleotide; CTT chr2 60516147 60516168 60516164 60516169 +
tcccatgtctgtaatgcttttc

SEQ ID NO: 203540 - DNA, 22 bp, Artificial Sequence
  Synthetic oligonucleotide; TTT chr2 60516148 60516169 60516165 60516170 +
cccatgtctgtaatgcttttca

SEQ ID NO: 203541 - DNA, 22 bp, Artificial Sequence
  Synthetic oligonucleotide; TTC chr2 60516149 60516170 60516166 60516171 +
ccatgtctgtaatgcttttcat

SEQ ID NO: 203542 - DNA, 22 bp, Artificial Sequence
  Synthetic oligonucleotide; CTG chr2 60516158 60516179 60516175 60516180 +
taatgcttttcatatcatccta

SEQ ID NO: 203543 - DNA, 22 bp, Artificial Sequence
  Synthetic oligonucleotide; CTT chr2 60516166 60516187 60516183 60516188 +
ttcatatcatcctacacactca

SEQ ID NO: 203544 - DNA, 22 bp, Artificial Sequence
  Synthetic oligonucleotide; TTT chr2 60516167 60516188 60516184 60516189 +
tcatatcatcctacacactcac

SEQ ID NO: 203545 - DNA, 22 bp, Artificial Sequence
  Synthetic oligonucleotide; TTT chr2 60516168 60516189 60516185 60516190 +
catatcatcctacacactcact

SEQ ID NO: 203546 - DNA, 22 bp, Artificial Sequence
  Synthetic oligonucleotide; TTC chr2 60516169 60516190 60516186 60516191 +
atatcatcctacacactcactg

SEQ ID NO: 203547 - DNA, 22 bp, Artificial Sequence
  Synthetic oligonucleotide; CTA chr2 60516180 60516201 60516197 60516202 +
cacactcactgtcacctctcct

SEQ ID NO: 203548 - DNA, 22 bp, Artificial Sequence
  Synthetic oligonucleotide; CTC chr2 60516187 60516208 60516204 60516209 +
actgtcacctctcctcacccca

SEQ ID NO: 203549 - DNA, 22 bp, Artificial Sequence
  Synthetic oligonucleotide; CTG chr2 60516191 60516212 60516208 60516213 +
tcacctctcctcaccccagcac

SEQ ID NO: 203550 - DNA, 22 bp, Artificial Sequence
  Synthetic oligonucleotide; CTC chr2 60516198 60516219 60516215 60516220 +
tcctcaccccagcacacagaaa

SEQ ID NO: 203551 - DNA, 22 bp, Artificial Sequence
  Synthetic oligonucleotide; CTC chr2 60516200 60516221 60516217 60516222 +
ctcaccccagcacacagaaaag

SEQ ID NO: 203552 - DNA, 22 bp, Artificial Sequence
  Synthetic oligonucleotide; CTC chr2 60516203 60516224 60516220 60516225 +
accccagcacacagaaaagatg

SEQ ID NO: 203553 - DNA, 22 bp, Artificial Sequence
  Synthetic oligonucleotide; CTT chr2 60516230 60516251 60516247 60516252 +
attatgtgcacttaggttttgt

SEQ ID NO: 203554 - DNA, 22 bp, Artificial Sequence
  Synthetic oligonucleotide; TTA chr2 60516231 60516252 60516248 60516253 +
ttatgtgcacttaggttttgtt

SEQ ID NO: 203555 - DNA, 22 bp, Artificial Sequence
  Synthetic oligonucleotide; TTA chr2 60516234 60516255 60516251 60516256 +
tgtgcacttaggttttgttgta

SEQ ID NO: 203556 - DNA, 22 bp, Artificial Sequence
  Synthetic oligonucleotide; CTT chr2 60516243 60516264 60516260 60516265 +
aggttttgttgtactattaaac

SEQ ID NO: 203557 - DNA, 22 bp, Artificial Sequence
  Synthetic oligonucleotide; TTA chr2 60516244 60516265 60516261 60516266 +
ggttttgttgtactattaaaca

SEQ ID NO: 203558 - DNA, 22 bp, Artificial Sequence
  Synthetic oligonucleotide; TTT chr2 60516249 60516270 60516266 60516271 +
tgttgtactattaaacacaatg

SEQ ID NO: 203559 - DNA, 22 bp, Artificial Sequence
  Synthetic oligonucleotide; TTT chr2 60516250 60516271 60516267 60516272 +
gttgtactattaaacacaatga

SEQ ID NO: 203560 - DNA, 22 bp, Artificial Sequence
  Synthetic oligonucleotide; TTG chr2 60516251 60516272 60516268 60516273 +
ttgtactattaaacacaatgac

SEQ ID NO: 203561 - DNA, 22 bp, Artificial Sequence
  Synthetic oligonucleotide; TTG chr2 60516254 60516275 60516271 60516276 +
tactattaaacacaatgaccca

SEQ ID NO: 203562 - DNA, 22 bp, Artificial Sequence
  Synthetic oligonucleotide; CTA chr2 60516259 60516280 60516276 60516281 +
ttaaacacaatgacccactcct

SEQ ID NO: 203563 - DNA, 22 bp, Artificial Sequence
  Synthetic oligonucleotide; TTA chr2 60516262 60516283 60516279 60516284 +
aacacaatgacccactcctatt

SEQ ID NO: 203564 - DNA, 22 bp, Artificial Sequence
  Synthetic oligonucleotide; CTC chr2 60516279 60516300 60516296 60516301 +
ctattattaaaacacaggtttt

SEQ ID NO: 203565 - DNA, 22 bp, Artificial Sequence
  Synthetic oligonucleotide; CTA chr2 60516282 60516303 60516299 60516304 +
ttattaaaacacaggttttgct

SEQ ID NO: 203566 - DNA, 22 bp, Artificial Sequence
  Synthetic oligonucleotide; TTA chr2 60516285 60516306 60516302 60516307 +
ttaaaacacaggttttgctgga

SEQ ID NO: 203567 - DNA, 22 bp, Artificial Sequence
  Synthetic oligonucleotide; TTA chr2 60516288 60516309 60516305 60516310 +
aaacacaggttttgctggaaac

SEQ ID NO: 203568 - DNA, 22 bp, Artificial Sequence
  Synthetic oligonucleotide; TTT chr2 60516300 60516321 60516317 60516322 +
tgctggaaactcaaaaaagact

SEQ ID NO: 203569 - DNA, 22 bp, Artificial Sequence
  Synthetic oligonucleotide; TTT chr2 60516301 60516322 60516318 60516323 +
gctggaaactcaaaaaagactt

SEQ ID NO: 203570 - DNA, 22 bp, Artificial Sequence
  Synthetic oligonucleotide; TTG chr2 60516302 60516323 60516319 60516324 +
ctggaaactcaaaaaagacttg

SEQ ID NO: 203571 - DNA, 22 bp, Artificial Sequence
  Synthetic oligonucleotide; CTG chr2 60516305 60516326 60516322 60516327 +
gaaactcaaaaaagacttggct

SEQ ID NO: 203572 - DNA, 22 bp, Artificial Sequence
  Synthetic oligonucleotide; CTC chr2 60516312 60516333 60516329 60516334 +
aaaaaagacttggctctgctgg

SEQ ID NO: 203573 - DNA, 22 bp, Artificial Sequence
  Synthetic oligonucleotide; CTT chr2 60516323 60516344 60516340 60516345 +
ggctctgctggctcacagggaa

SEQ ID NO: 203574 - DNA, 22 bp, Artificial Sequence
  Synthetic oligonucleotide; TTG chr2 60516324 60516345 60516341 60516346 +
gctctgctggctcacagggaat

SEQ ID NO: 203575 - DNA, 22 bp, Artificial Sequence
  Synthetic oligonucleotide; CTC chr2 60516328 60516349 60516345 60516350 +
tgctggctcacagggaatctgg

SEQ ID NO: 203576 - DNA, 22 bp, Artificial Sequence
  Synthetic oligonucleotide; CTG chr2 60516330 60516351 60516347 60516352 +
ctggctcacagggaatctgggc

SEQ ID NO: 203577 - DNA, 22 bp, Artificial Sequence
  Synthetic oligonucleotide; CTG chr2 60516333 60516354 60516350 60516355 +
gctcacagggaatctgggctcc

SEQ ID NO: 203578 - DNA, 22 bp, Artificial Sequence
  Synthetic oligonucleotide; CTC chr2 60516337 60516358 60516354 60516359 +
acagggaatctgggctccgctc

SEQ ID NO: 203579 - DNA, 22 bp, Artificial Sequence
  Synthetic oligonucleotide; CTG chr2 60516349 60516370 60516366 60516371 +
ggctccgctcttccaaaacctt

SEQ ID NO: 203580 - DNA, 22 bp, Artificial Sequence
  Synthetic oligonucleotide; CTC chr2 60516354 60516375 60516371 60516376 +
cgctcttccaaaacctttgttc

SEQ ID NO: 203581 - DNA, 22 bp, Artificial Sequence
  Synthetic oligonucleotide; CTC chr2 60516359 60516380 60516376 60516381 +
ttccaaaacctttgttctccag

SEQ ID NO: 203582 - DNA, 22 bp, Artificial Sequence
  Synthetic oligonucleotide; CTT chr2 60516361 60516382 60516378 60516383 +
ccaaaacctttgttctccagat

SEQ ID NO: 203583 - DNA, 22 bp, Artificial Sequence
  Synthetic oligonucleotide; TTC chr2 60516362 60516383 60516379 60516384 +
caaaacctttgttctccagatg

SEQ ID NO: 203584 - DNA, 22 bp, Artificial Sequence
  Synthetic oligonucleotide; CTT chr2 60516371 60516392 60516388 60516393 +
tgttctccagatgtcagtgcaa

SEQ ID NO: 203585 - DNA, 22 bp, Artificial Sequence
  Synthetic oligonucleotide; TTT chr2 60516372 60516393 60516389 60516394 +
gttctccagatgtcagtgcaaa

SEQ ID NO: 203586 - DNA, 22 bp, Artificial Sequence
  Synthetic oligonucleotide; TTG chr2 60516373 60516394 60516390 60516395 +
ttctccagatgtcagtgcaaag

SEQ ID NO: 203587 - DNA, 22 bp, Artificial Sequence
  Synthetic oligonucleotide; TTC chr2 60516376 60516397 60516393 60516398 +
tccagatgtcagtgcaaagtta

SEQ ID NO: 203588 - DNA, 22 bp, Artificial Sequence
  Synthetic oligonucleotide; CTC chr2 60516378 60516399 60516395 60516400 +
cagatgtcagtgcaaagttatg

SEQ ID NO: 203589 - DNA, 22 bp, Artificial Sequence
  Synthetic oligonucleotide; TTA chr2 60516398 60516419 60516415 60516420 +
tgaacagctctccccctgagct

SEQ ID NO: 203590 - DNA, 22 bp, Artificial Sequence
  Synthetic oligonucleotide; CTC chr2 60516408 60516429 60516425 60516430 +
tccccctgagctaacttaccga

SEQ ID NO: 203591 - DNA, 22 bp, Artificial Sequence
  Synthetic oligonucleotide; CTC chr2 60516410 60516431 60516427 60516432 +
cccctgagctaacttaccgagc

SEQ ID NO: 203592 - DNA, 22 bp, Artificial Sequence
  Synthetic oligonucleotide; CTG chr2 60516416 60516437 60516433 60516438 +
agctaacttaccgagcagtaag

SEQ ID NO: 203593 - DNA, 22 bp, Artificial Sequence
  Synthetic oligonucleotide; CTA chr2 60516421 60516442 60516438 60516443 +
acttaccgagcagtaagtgagg

SEQ ID NO: 203594 - DNA, 22 bp, Artificial Sequence
  Synthetic oligonucleotide; CTT chr2 60516425 60516446 60516442 60516447 +
accgagcagtaagtgaggcaag

SEQ ID NO: 203595 - DNA, 22 bp, Artificial Sequence
  Synthetic oligonucleotide; TTA chr2 60516426 60516447 60516443 60516448 +
ccgagcagtaagtgaggcaaga

SEQ ID NO: 203596 - DNA, 22 bp, Artificial Sequence
  Synthetic oligonucleotide; CTC chr2 60516458 60516479 60516475 60516480 +
actatatttctcagcctccatg

SEQ ID NO: 203597 - DNA, 22 bp, Artificial Sequence
  Synthetic oligonucleotide; CTA chr2 60516462 60516483 60516479 60516484 +
tatttctcagcctccatgaagt

SEQ ID NO: 203598 - DNA, 22 bp, Artificial Sequence
  Synthetic oligonucleotide; TTT chr2 60516467 60516488 60516484 60516489 +
ctcagcctccatgaagtcgtca

SEQ ID NO: 203599 - DNA, 22 bp, Artificial Sequence
  Synthetic oligonucleotide; TTC chr2 60516468 60516489 60516485 60516490 +
tcagcctccatgaagtcgtcac

SEQ ID NO: 203600 - DNA, 22 bp, Artificial Sequence
  Synthetic oligonucleotide; CTC chr2 60516470 60516491 60516487 60516492 +
agcctccatgaagtcgtcactg

SEQ ID NO: 203601 - DNA, 22 bp, Artificial Sequence
  Synthetic oligonucleotide; CTC chr2 60516476 60516497 60516493 60516498 +
catgaagtcgtcactgggagag

SEQ ID NO: 203602 - DNA, 22 bp, Artificial Sequence
  Synthetic oligonucleotide; CTG chr2 60516492 60516513 60516509 60516514 +
ggagaggagccaagagggaggg

SEQ ID NO: 203603 - DNA, 22 bp, Artificial Sequence
  Synthetic oligonucleotide; CTT chr2 60516522 60516543 60516539 60516544 +
aggagacaagatcgtaactcac

SEQ ID NO: 203604 - DNA, 22 bp, Artificial Sequence
  Synthetic oligonucleotide; TTA chr2 60516523 60516544 60516540 60516545 +
ggagacaagatcgtaactcacc

SEQ ID NO: 203605 - DNA, 22 bp, Artificial Sequence
  Synthetic oligonucleotide; CTC chr2 60516542 60516563 60516559 60516564 +
accgtcatccggggaagtggag

SEQ ID NO: 203606 - DNA, 22 bp, Artificial Sequence
  Synthetic oligonucleotide; CTC chr2 60516581 60516602 60516598 60516603 +
gtgtcaggagtggagagctaag

SEQ ID NO: 203607 - DNA, 22 bp, Artificial Sequence
  Synthetic oligonucleotide; CTA chr2 60516601 60516622 60516618 60516623 +
agctcaatatggacaaggacag

SEQ ID NO: 203608 - DNA, 22 bp, Artificial Sequence
  Synthetic oligonucleotide; CTC chr2 60516606 60516627 60516623 60516628 +
aatatggacaaggacagagagg

SEQ ID NO: 203609 - DNA, 22 bp, Artificial Sequence
  Synthetic oligonucleotide; CTG chr2 60516636 60516657 60516653 60516658 +
ggatgggagaaatgtggcatca

SEQ ID NO: 203610 - DNA, 22 bp, Artificial Sequence
  Synthetic oligonucleotide; CTG chr2 60516667 60516688 60516684 60516689 +
ggagtgaaagtttaactgccct

SEQ ID NO: 203611 - DNA, 22 bp, Artificial Sequence
  Synthetic oligonucleotide; TTT chr2 60516680 60516701 60516697 60516702 +
aactgccctcaaagatggctga

SEQ ID NO: 203612 - DNA, 22 bp, Artificial Sequence
  Synthetic oligonucleotide; TTA chr2 60516681 60516702 60516698 60516703 +
actgccctcaaagatggctgac

SEQ ID NO: 203613 - DNA, 22 bp, Artificial Sequence
  Synthetic oligonucleotide; CTG chr2 60516685 60516706 60516702 60516707 +
ccctcaaagatggctgacaaag

SEQ ID NO: 203614 - DNA, 22 bp, Artificial Sequence
  Synthetic oligonucleotide; CTC chr2 60516690 60516711 60516707 60516712 +
aaagatggctgacaaagatcta

SEQ ID NO: 203615 - DNA, 22 bp, Artificial Sequence
  Synthetic oligonucleotide; CTG chr2 60516701 60516722 60516718 60516723 +
acaaagatctagcattcctagt

SEQ ID NO: 203616 - DNA, 22 bp, Artificial Sequence
  Synthetic oligonucleotide; CTA chr2 60516712 60516733 60516729 60516734 +
gcattcctagtggacaccaagc

SEQ ID NO: 203617 - DNA, 22 bp, Artificial Sequence
  Synthetic oligonucleotide; TTC chr2 60516718 60516739 60516735 60516740 +
ctagtggacaccaagctgagca

SEQ ID NO: 203618 - DNA, 22 bp, Artificial Sequence
  Synthetic oligonucleotide; CTA chr2 60516721 60516742 60516738 60516743 +
gtggacaccaagctgagcatga

SEQ ID NO: 203619 - DNA, 22 bp, Artificial Sequence
  Synthetic oligonucleotide; CTG chr2 60516736 60516757 60516753 60516758 +
agcatgagtcatcaatgaagca

SEQ ID NO: 203620 - DNA, 22 bp, Artificial Sequence
  Synthetic oligonucleotide; CTG chr2 60516761 60516782 60516778 60516783 +
gtttttaaaaaagcaagcagga

SEQ ID NO: 203621 - DNA, 22 bp, Artificial Sequence
  Synthetic oligonucleotide; TTT chr2 60516765 60516786 60516782 60516787 +
ttaaaaaagcaagcaggacata

SEQ ID NO: 203622 - DNA, 22 bp, Artificial Sequence
  Synthetic oligonucleotide; TTT chr2 60516766 60516787 60516783 60516788 +
taaaaaagcaagcaggacataa

SEQ ID NO: 203623 - DNA, 22 bp, Artificial Sequence
  Synthetic oligonucleotide; TTT chr2 60516767 60516788 60516784 60516789 +
aaaaaagcaagcaggacataag

SEQ ID NO: 203624 - DNA, 22 bp, Artificial Sequence
  Synthetic oligonucleotide; TTA chr2 60516768 60516789 60516785 60516790 +
aaaaagcaagcaggacataaga

SEQ ID NO: 203625 - DNA, 22 bp, Artificial Sequence
  Synthetic oligonucleotide; CTA chr2 60516807 60516828 60516824 60516829 +
aagaatgtggaaaacactaaga

SEQ ID NO: 203626 - DNA, 22 bp, Artificial Sequence
  Synthetic oligonucleotide; CTA chr2 60516826 60516847 60516843 60516848 +
agatatcttgccattggactct

SEQ ID NO: 203627 - DNA, 22 bp, Artificial Sequence
  Synthetic oligonucleotide; CTT chr2 60516835 60516856 60516852 60516857 +
gccattggactctgtagttatc

SEQ ID NO: 203628 - DNA, 22 bp, Artificial Sequence
  Synthetic oligonucleotide; TTG chr2 60516836 60516857 60516853 60516858 +
ccattggactctgtagttatca

SEQ ID NO: 203629 - DNA, 22 bp, Artificial Sequence
  Synthetic oligonucleotide; TTG chr2 60516842 60516863 60516859 60516864 +
gactctgtagttatcagactaa

SEQ ID NO: 203630 - DNA, 22 bp, Artificial Sequence
  Synthetic oligonucleotide; CTC chr2 60516847 60516868 60516864 60516869 +
tgtagttatcagactaatgttt

SEQ ID NO: 203631 - DNA, 22 bp, Artificial Sequence
  Synthetic oligonucleotide; CTG chr2 60516849 60516870 60516866 60516871 +
tagttatcagactaatgtttga

SEQ ID NO: 203632 - DNA, 22 bp, Artificial Sequence
  Synthetic oligonucleotide; TTA chr2 60516855 60516876 60516872 60516877 +
tcagactaatgtttgagtaaaa

SEQ ID NO: 203633 - DNA, 22 bp, Artificial Sequence
  Synthetic oligonucleotide; CTA chr2 60516863 60516884 60516880 60516885 +
atgtttgagtaaaagagctgga

SEQ ID NO: 203634 - DNA, 22 bp, Artificial Sequence
  Synthetic oligonucleotide; TTT chr2 60516869 60516890 60516886 60516891 +
gagtaaaagagctggaaaacca

SEQ ID NO: 203635 - DNA, 22 bp, Artificial Sequence
  Synthetic oligonucleotide; TTG chr2 60516870 60516891 60516887 60516892 +
agtaaaagagctggaaaaccag

SEQ ID NO: 203636 - DNA, 22 bp, Artificial Sequence
  Synthetic oligonucleotide; CTG chr2 60516883 60516904 60516900 60516905 +
gaaaaccagcagattctaaaga

SEQ ID NO: 203637 - DNA, 22 bp, Artificial Sequence
  Synthetic oligonucleotide; TTC chr2 60516899 60516920 60516916 60516921 +
taaagagaggcatagaaacaat

SEQ ID NO: 203638 - DNA, 22 bp, Artificial Sequence
  Synthetic oligonucleotide; CTA chr2 60516901 60516922 60516918 60516923 +
aagagaggcatagaaacaataa

SEQ ID NO: 203639 - DNA, 22 bp, Artificial Sequence
  Synthetic oligonucleotide; TTA chr2 60516931 60516952 60516948 60516953 +
caagataatagatccatgagtt

SEQ ID NO: 203640 - DNA, 22 bp, Artificial Sequence
  Synthetic oligonucleotide; TTC chr2 60516954 60516975 60516971 60516976 +
aggttcaggaaagagattattt

SEQ ID NO: 203641 - DNA, 22 bp, Artificial Sequence
  Synthetic oligonucleotide; TTC chr2 60516960 60516981 60516977 60516982 +
aggaaagagattatttaggaag

SEQ ID NO: 203642 - DNA, 22 bp, Artificial Sequence
  Synthetic oligonucleotide; TTA chr2 60516973 60516994 60516990 60516995 +
tttaggaagaagaagtggcgga

SEQ ID NO: 203643 - DNA, 22 bp, Artificial Sequence
  Synthetic oligonucleotide; TTT chr2 60516976 60516997 60516993 60516998 +
aggaagaagaagtggcggagaa

SEQ ID NO: 203644 - DNA, 22 bp, Artificial Sequence
  Synthetic oligonucleotide; TTA chr2 60516977 60516998 60516994 60516999 +
ggaagaagaagtggcggagaat

SEQ ID NO: 203645 - DNA, 22 bp, Artificial Sequence
  Synthetic oligonucleotide; TTT chr2 60517029 60517050 60517046 60517051 +
cagcccaaagctggtgatgaga

SEQ ID NO: 203646 - DNA, 22 bp, Artificial Sequence
  Synthetic oligonucleotide; TTC chr2 60517030 60517051 60517047 60517052 +
agcccaaagctggtgatgagat

SEQ ID NO: 203647 - DNA, 22 bp, Artificial Sequence
  Synthetic oligonucleotide; CTG chr2 60517042 60517063 60517059 60517064 +
gtgatgagatactttgtcgtct

SEQ ID NO: 203648 - DNA, 22 bp, Artificial Sequence
  Synthetic oligonucleotide; CTT chr2 60517056 60517077 60517073 60517078 +
tgtcgtctctggaatgaagagg

SEQ ID NO: 203649 - DNA, 22 bp, Artificial Sequence
  Synthetic oligonucleotide; TTT chr2 60517057 60517078 60517074 60517079 +
gtcgtctctggaatgaagagga

SEQ ID NO: 203650 - DNA, 22 bp, Artificial Sequence
  Synthetic oligonucleotide; TTG chr2 60517058 60517079 60517075 60517080 +
tcgtctctggaatgaagaggaa

SEQ ID NO: 203651 - DNA, 22 bp, Artificial Sequence
  Synthetic oligonucleotide; CTC chr2 60517065 60517086 60517082 60517087 +
tggaatgaagaggaaatgggtt

SEQ ID NO: 203652 - DNA, 22 bp, Artificial Sequence
  Synthetic oligonucleotide; CTG chr2 60517067 60517088 60517084 60517089 +
gaatgaagaggaaatgggttta

SEQ ID NO: 203653 - DNA, 22 bp, Artificial Sequence
  Synthetic oligonucleotide; TTT chr2 60517088 60517109 60517105 60517110 +
aaaatgaagcataagggatcga

SEQ ID NO: 203654 - DNA, 22 bp, Artificial Sequence
  Synthetic oligonucleotide; TTA chr2 60517089 60517110 60517106 60517111 +
aaatgaagcataagggatcgaa

SEQ ID NO: 203655 - DNA, 22 bp, Artificial Sequence
  Synthetic oligonucleotide; TTT chr2 60517132 60517153 60517149 60517154 +
cctgcgattgagaggtgtcttt

SEQ ID NO: 203656 - DNA, 22 bp, Artificial Sequence
  Synthetic oligonucleotide; TTC chr2 60517133 60517154 60517150 60517155 +
ctgcgattgagaggtgtcttta

SEQ ID NO: 203657 - DNA, 22 bp, Artificial Sequence
  Synthetic oligonucleotide; CTG chr2 60517136 60517157 60517153 60517158 +
cgattgagaggtgtctttaaaa

SEQ ID NO: 203658 - DNA, 22 bp, Artificial Sequence
  Synthetic oligonucleotide; TTG chr2 60517142 60517163 60517159 60517164 +
agaggtgtctttaaaaatagaa

SEQ ID NO: 203659 - DNA, 22 bp, Artificial Sequence
  Synthetic oligonucleotide; CTT chr2 60517153 60517174 60517170 60517175 +
taaaaatagaactagggtggtg

SEQ ID NO: 203660 - DNA, 22 bp, Artificial Sequence
  Synthetic oligonucleotide; TTT chr2 60517154 60517175 60517171 60517176 +
aaaaatagaactagggtggtga

SEQ ID NO: 203661 - DNA, 22 bp, Artificial Sequence
  Synthetic oligonucleotide; TTA chr2 60517155 60517176 60517172 60517177 +
aaaatagaactagggtggtgag

SEQ ID NO: 203662 - DNA, 22 bp, Artificial Sequence
  Synthetic oligonucleotide; CTA chr2 60517167 60517188 60517184 60517189 +
gggtggtgaggaagaggttggg

SEQ ID NO: 203663 - DNA, 22 bp, Artificial Sequence
  Synthetic oligonucleotide; TTG chr2 60517187 60517208 60517204 60517209 +
ggctggccaattctggagggcc

SEQ ID NO: 203664 - DNA, 22 bp, Artificial Sequence
  Synthetic oligonucleotide; CTG chr2 60517192 60517213 60517209 60517214 +
gccaattctggagggccatctg

SEQ ID NO: 203665 - DNA, 22 bp, Artificial Sequence
  Synthetic oligonucleotide; TTC chr2 60517200 60517221 60517217 60517222 +
tggagggccatctgcccctgag

SEQ ID NO: 203666 - DNA, 22 bp, Artificial Sequence
  Synthetic oligonucleotide; CTG chr2 60517202 60517223 60517219 60517224 +
gagggccatctgcccctgagag

SEQ ID NO: 203667 - DNA, 22 bp, Artificial Sequence
  Synthetic oligonucleotide; CTG chr2 60517214 60517235 60517231 60517236 +
cccctgagagggtacacgttcc

SEQ ID NO: 203668 - DNA, 22 bp, Artificial Sequence
  Synthetic oligonucleotide; CTG chr2 60517220 60517241 60517237 60517242 +
agagggtacacgttccttcacc

SEQ ID NO: 203669 - DNA, 22 bp, Artificial Sequence
  Synthetic oligonucleotide; TTC chr2 60517235 60517256 60517252 60517257 +
cttcaccaccccaactccatct

SEQ ID NO: 203670 - DNA, 22 bp, Artificial Sequence
  Synthetic oligonucleotide; CTT chr2 60517238 60517259 60517255 60517260 +
caccaccccaactccatctact

SEQ ID NO: 203671 - DNA, 22 bp, Artificial Sequence
  Synthetic oligonucleotide; TTC chr2 60517239 60517260 60517256 60517261 +
accaccccaactccatctactc

SEQ ID NO: 203672 - DNA, 22 bp, Artificial Sequence
  Synthetic oligonucleotide; CTC chr2 60517252 60517273 60517269 60517274 +
catctactccattatctccagt

SEQ ID NO: 203673 - DNA, 22 bp, Artificial Sequence
  Synthetic oligonucleotide; CTA chr2 60517258 60517279 60517275 60517280 +
ctccattatctccagttatctg

SEQ ID NO: 203674 - DNA, 22 bp, Artificial Sequence
  Synthetic oligonucleotide; CTC chr2 60517261 60517282 60517278 60517283 +
cattatctccagttatctgaat

SEQ ID NO: 203675 - DNA, 22 bp, Artificial Sequence
  Synthetic oligonucleotide; TTA chr2 60517266 60517287 60517283 60517288 +
tctccagttatctgaataaaaa

SEQ ID NO: 203676 - DNA, 22 bp, Artificial Sequence
  Synthetic oligonucleotide; CTC chr2 60517270 60517291 60517287 60517292 +
cagttatctgaataaaaaagcc

SEQ ID NO: 203677 - DNA, 22 bp, Artificial Sequence
  Synthetic oligonucleotide; TTA chr2 60517276 60517297 60517293 60517298 +
tctgaataaaaaagccaagcta

SEQ ID NO: 203678 - DNA, 22 bp, Artificial Sequence
  Synthetic oligonucleotide; CTG chr2 60517280 60517301 60517297 60517302 +
aataaaaaagccaagctattcc

SEQ ID NO: 203679 - DNA, 22 bp, Artificial Sequence
  Synthetic oligonucleotide; CTA chr2 60517298 60517319 60517315 60517320 +
ttccctgggcacaccatgtaaa

SEQ ID NO: 203680 - DNA, 22 bp, Artificial Sequence
  Synthetic oligonucleotide; TTC chr2 60517301 60517322 60517318 60517323 +
cctgggcacaccatgtaaaccc

SEQ ID NO: 203681 - DNA, 22 bp, Artificial Sequence
  Synthetic oligonucleotide; CTG chr2 60517305 60517326 60517322 60517327 +
ggcacaccatgtaaaccccaga

SEQ ID NO: 203682 - DNA, 22 bp, Artificial Sequence
  Synthetic oligonucleotide; CTT chr2 60517339 60517360 60517356 60517361 +
tgggagccctagcaggaaaggt

SEQ ID NO: 203683 - DNA, 22 bp, Artificial Sequence
  Synthetic oligonucleotide; TTT chr2 60517340 60517361 60517357 60517362 +
gggagccctagcaggaaaggtg

SEQ ID NO: 203684 - DNA, 22 bp, Artificial Sequence
  Synthetic oligonucleotide; TTG chr2 60517341 60517362 60517358 60517363 +
ggagccctagcaggaaaggtgg

SEQ ID NO: 203685 - DNA, 22 bp, Artificial Sequence
  Synthetic oligonucleotide; CTA chr2 60517350 60517371 60517367 60517372 +
gcaggaaaggtggtaggaagac

SEQ ID NO: 203686 - DNA, 22 bp, Artificial Sequence
  Synthetic oligonucleotide; TTC chr2 60517440 60517461 60517457 60517462 +
tctgcaacagcacaggtgattg

SEQ ID NO: 203687 - DNA, 22 bp, Artificial Sequence
  Synthetic oligonucleotide; CTC chr2 60517442 60517463 60517459 60517464 +
tgcaacagcacaggtgattggg

SEQ ID NO: 203688 - DNA, 22 bp, Artificial Sequence
  Synthetic oligonucleotide; CTG chr2 60517444 60517465 60517461 60517466 +
caacagcacaggtgattgggtg

SEQ ID NO: 203689 - DNA, 22 bp, Artificial Sequence
  Synthetic oligonucleotide; TTG chr2 60517462 60517483 60517479 60517484 +
ggtggtggttttgttgcttggg

SEQ ID NO: 203690 - DNA, 22 bp, Artificial Sequence
  Synthetic oligonucleotide; TTT chr2 60517473 60517494 60517490 60517495 +
tgttgcttgggttttaccatgg

SEQ ID NO: 203691 - DNA, 22 bp, Artificial Sequence
  Synthetic oligonucleotide; TTT chr2 60517474 60517495 60517491 60517496 +
gttgcttgggttttaccatggg

SEQ ID NO: 203692 - DNA, 22 bp, Artificial Sequence
  Synthetic oligonucleotide; TTG chr2 60517475 60517496 60517492 60517497 +
ttgcttgggttttaccatgggc

SEQ ID NO: 203693 - DNA, 22 bp, Artificial Sequence
  Synthetic oligonucleotide; TTG chr2 60517478 60517499 60517495 60517500 +
cttgggttttaccatgggctcc

SEQ ID NO: 203694 - DNA, 22 bp, Artificial Sequence
  Synthetic oligonucleotide; CTT chr2 60517481 60517502 60517498 60517503 +
gggttttaccatgggctcccca

SEQ ID NO: 203695 - DNA, 22 bp, Artificial Sequence
  Synthetic oligonucleotide; TTG chr2 60517482 60517503 60517499 60517504 +
ggttttaccatgggctccccag

SEQ ID NO: 203696 - DNA, 22 bp, Artificial Sequence
  Synthetic oligonucleotide; TTT chr2 60517487 60517508 60517504 60517509 +
taccatgggctccccaggttag

SEQ ID NO: 203697 - DNA, 22 bp, Artificial Sequence
  Synthetic oligonucleotide; TTT chr2 60517488 60517509 60517505 60517510 +
accatgggctccccaggttagc

SEQ ID NO: 203698 - DNA, 22 bp, Artificial Sequence
  Synthetic oligonucleotide; TTA chr2 60517489 60517510 60517506 60517511 +
ccatgggctccccaggttagca

SEQ ID NO: 203699 - DNA, 22 bp, Artificial Sequence
  Synthetic oligonucleotide; CTC chr2 60517499 60517520 60517516 60517521 +
cccaggttagcactgccacaaa

SEQ ID NO: 203700 - DNA, 22 bp, Artificial Sequence
  Synthetic oligonucleotide; TTA chr2 60517508 60517529 60517525 60517530 +
gcactgccacaaaagcaccagg

SEQ ID NO: 203701 - DNA, 22 bp, Artificial Sequence
  Synthetic oligonucleotide; CTG chr2 60517514 60517535 60517531 60517536 +
ccacaaaagcaccaggctcttc

SEQ ID NO: 203702 - DNA, 22 bp, Artificial Sequence
  Synthetic oligonucleotide; CTC chr2 60517533 60517554 60517550 60517555 +
ttcaacaaagctccagttaaga

SEQ ID NO: 203703 - DNA, 22 bp, Artificial Sequence
  Synthetic oligonucleotide; CTT chr2 60517535 60517556 60517552 60517557 +
caacaaagctccagttaagaaa

SEQ ID NO: 203704 - DNA, 22 bp, Artificial Sequence
  Synthetic oligonucleotide; TTC chr2 60517536 60517557 60517553 60517558 +
aacaaagctccagttaagaaaa

SEQ ID NO: 203705 - DNA, 22 bp, Artificial Sequence
  Synthetic oligonucleotide; CTC chr2 60517546 60517567 60517563 60517568 +
cagttaagaaaagcattccagc

SEQ ID NO: 203706 - DNA, 22 bp, Artificial Sequence
  Synthetic oligonucleotide; TTA chr2 60517552 60517573 60517569 60517574 +
agaaaagcattccagccatcac

SEQ ID NO: 203707 - DNA, 22 bp, Artificial Sequence
  Synthetic oligonucleotide; TTC chr2 60517564 60517585 60517581 60517586 +
cagccatcaccgataaaagcgt

SEQ ID NO: 203708 - DNA, 22 bp, Artificial Sequence
  Synthetic oligonucleotide; TTC chr2 60517598 60517619 60517615 60517620 +
ctctgcaaagcacatgcgggcc

SEQ ID NO: 203709 - DNA, 22 bp, Artificial Sequence
  Synthetic oligonucleotide; CTC chr2 60517601 60517622 60517618 60517623 +
tgcaaagcacatgcgggccacc

SEQ ID NO: 203710 - DNA, 22 bp, Artificial Sequence
  Synthetic oligonucleotide; CTG chr2 60517603 60517624 60517620 60517625 +
caaagcacatgcgggccacctc

SEQ ID NO: 203711 - DNA, 22 bp, Artificial Sequence
  Synthetic oligonucleotide; CTC chr2 60517625 60517646 60517642 60517647 +
tggctcctgctggccatggaga

SEQ ID NO: 203712 - DNA, 22 bp, Artificial Sequence
  Synthetic oligonucleotide; CTG chr2 60517627 60517648 60517644 60517649 +
gctcctgctggccatggagagg

SEQ ID NO: 203713 - DNA, 22 bp, Artificial Sequence
  Synthetic oligonucleotide; CTC chr2 60517631 60517652 60517648 60517653 +
ctgctggccatggagaggccat

SEQ ID NO: 203714 - DNA, 22 bp, Artificial Sequence
  Synthetic oligonucleotide; CTG chr2 60517634 60517655 60517651 60517656 +
ctggccatggagaggccatgtg

SEQ ID NO: 203715 - DNA, 22 bp, Artificial Sequence
  Synthetic oligonucleotide; CTG chr2 60517637 60517658 60517654 60517659 +
gccatggagaggccatgtgcga

SEQ ID NO: 203716 - DNA, 22 bp, Artificial Sequence
  Synthetic oligonucleotide; TTG chr2 60517662 60517683 60517679 60517684 +
gtacagtcagccaggaatgaaa

SEQ ID NO: 203717 - DNA, 22 bp, Artificial Sequence
  Synthetic oligonucleotide; CTC chr2 60517702 60517723 60517719 60517724 +
tgggccaagtctaccactgcct

SEQ ID NO: 203718 - DNA, 22 bp, Artificial Sequence
  Synthetic oligonucleotide; CTG chr2 60517704 60517725 60517721 60517726 +
ggccaagtctaccactgcctag

SEQ ID NO: 203719 - DNA, 22 bp, Artificial Sequence
  Synthetic oligonucleotide; CTA chr2 60517715 60517736 60517732 60517737 +
ccactgcctagcaagtagactc

SEQ ID NO: 203720 - DNA, 22 bp, Artificial Sequence
  Synthetic oligonucleotide; CTG chr2 60517721 60517742 60517738 60517743 +
cctagcaagtagactctggcac

SEQ ID NO: 203721 - DNA, 22 bp, Artificial Sequence
  Synthetic oligonucleotide; CTA chr2 60517725 60517746 60517742 60517747 +
gcaagtagactctggcactcac

SEQ ID NO: 203722 - DNA, 22 bp, Artificial Sequence
  Synthetic oligonucleotide; CTC chr2 60517737 60517758 60517754 60517759 +
tggcactcactcccctcttagc

SEQ ID NO: 203723 - DNA, 22 bp, Artificial Sequence
  Synthetic oligonucleotide; CTG chr2 60517739 60517760 60517756 60517761 +
gcactcactcccctcttagcct

SEQ ID NO: 203724 - DNA, 22 bp, Artificial Sequence
  Synthetic oligonucleotide; CTC chr2 60517745 60517766 60517762 60517767 +
actcccctcttagcctcaacct

SEQ ID NO: 203725 - DNA, 22 bp, Artificial Sequence
  Synthetic oligonucleotide; CTC chr2 60517749 60517770 60517766 60517771 +
ccctcttagcctcaacctttct

SEQ ID NO: 203726 - DNA, 22 bp, Artificial Sequence
  Synthetic oligonucleotide; CTC chr2 60517754 60517775 60517771 60517776 +
ttagcctcaacctttctcatct

SEQ ID NO: 203727 - DNA, 22 bp, Artificial Sequence
  Synthetic oligonucleotide; CTT chr2 60517756 60517777 60517773 60517778 +
agcctcaacctttctcatctgt

SEQ ID NO: 203728 - DNA, 22 bp, Artificial Sequence
  Synthetic oligonucleotide; TTA chr2 60517757 60517778 60517774 60517779 +
gcctcaacctttctcatctgta

SEQ ID NO: 203729 - DNA, 22 bp, Artificial Sequence
  Synthetic oligonucleotide; CTC chr2 60517762 60517783 60517779 60517784 +
aacctttctcatctgtaaaatg

SEQ ID NO: 203730 - DNA, 22 bp, Artificial Sequence
  Synthetic oligonucleotide; CTT chr2 60517768 60517789 60517785 60517790 +
tctcatctgtaaaatgacaggg

SEQ ID NO: 203731 - DNA, 22 bp, Artificial Sequence
  Synthetic oligonucleotide; TTT chr2 60517769 60517790 60517786 60517791 +
ctcatctgtaaaatgacagggt

SEQ ID NO: 203732 - DNA, 22 bp, Artificial Sequence
  Synthetic oligonucleotide; TTC chr2 60517770 60517791 60517787 60517792 +
tcatctgtaaaatgacagggtt

SEQ ID NO: 203733 - DNA, 22 bp, Artificial Sequence
  Synthetic oligonucleotide; CTC chr2 60517772 60517793 60517789 60517794 +
atctgtaaaatgacagggttaa

SEQ ID NO: 203734 - DNA, 22 bp, Artificial Sequence
  Synthetic oligonucleotide; CTG chr2 60517777 60517798 60517794 60517799 +
taaaatgacagggttaatgata

SEQ ID NO: 203735 - DNA, 22 bp, Artificial Sequence
  Synthetic oligonucleotide; TTA chr2 60517793 60517814 60517810 60517815 +
atgatatgacttcacaagtcta

SEQ ID NO: 203736 - DNA, 22 bp, Artificial Sequence
  Synthetic oligonucleotide; CTT chr2 60517805 60517826 60517822 60517827 +
cacaagtctatgtctacataga

SEQ ID NO: 203737 - DNA, 22 bp, Artificial Sequence
  Synthetic oligonucleotide; TTC chr2 60517806 60517827 60517823 60517828 +
acaagtctatgtctacatagaa

SEQ ID NO: 203738 - DNA, 22 bp, Artificial Sequence
  Synthetic oligonucleotide; CTA chr2 60517815 60517836 60517832 60517837 +
tgtctacatagaagatgctcaa

SEQ ID NO: 203739 - DNA, 22 bp, Artificial Sequence
  Synthetic oligonucleotide; CTA chr2 60517821 60517842 60517838 60517843 +
catagaagatgctcaataagta

SEQ ID NO: 203740 - DNA, 22 bp, Artificial Sequence
  Synthetic oligonucleotide; CTC chr2 60517835 60517856 60517852 60517857 +
aataagtattcactttggcttt

SEQ ID NO: 203741 - DNA, 22 bp, Artificial Sequence
  Synthetic oligonucleotide; TTC chr2 60517846 60517867 60517863 60517868 +
actttggctttccacgaaggaa

SEQ ID NO: 203742 - DNA, 22 bp, Artificial Sequence
  Synthetic oligonucleotide; CTT chr2 60517850 60517871 60517867 60517872 +
tggctttccacgaaggaaacta

SEQ ID NO: 203743 - DNA, 22 bp, Artificial Sequence
  Synthetic oligonucleotide; TTT chr2 60517851 60517872 60517868 60517873 +
ggctttccacgaaggaaactat

SEQ ID NO: 203744 - DNA, 22 bp, Artificial Sequence
  Synthetic oligonucleotide; TTG chr2 60517852 60517873 60517869 60517874 +
gctttccacgaaggaaactatc

SEQ ID NO: 203745 - DNA, 22 bp, Artificial Sequence
  Synthetic oligonucleotide; CTT chr2 60517856 60517877 60517873 60517878 +
tccacgaaggaaactatctatg

SEQ ID NO: 203746 - DNA, 22 bp, Artificial Sequence
  Synthetic oligonucleotide; TTT chr2 60517857 60517878 60517874 60517879 +
ccacgaaggaaactatctatgc

SEQ ID NO: 203747 - DNA, 22 bp, Artificial Sequence
  Synthetic oligonucleotide; TTC chr2 60517858 60517879 60517875 60517880 +
cacgaaggaaactatctatgct

SEQ ID NO: 203748 - DNA, 22 bp, Artificial Sequence
  Synthetic oligonucleotide; CTA chr2 60517872 60517893 60517889 60517894 +
tctatgctcaaagagctgtgct

SEQ ID NO: 203749 - DNA, 22 bp, Artificial Sequence
  Synthetic oligonucleotide; CTA chr2 60517876 60517897 60517893 60517898 +
tgctcaaagagctgtgctttct

SEQ ID NO: 203750 - DNA, 22 bp, Artificial Sequence
  Synthetic oligonucleotide; CTC chr2 60517881 60517902 60517898 60517903 +
aaagagctgtgctttcttctat

SEQ ID NO: 203751 - DNA, 22 bp, Artificial Sequence
  Synthetic oligonucleotide; CTG chr2 60517890 60517911 60517907 60517912 +
tgctttcttctatgattcctca

SEQ ID NO: 203752 - DNA, 22 bp, Artificial Sequence
  Synthetic oligonucleotide; CTT chr2 60517895 60517916 60517912 60517917 +
tcttctatgattcctcagaaac

SEQ ID NO: 203753 - DNA, 22 bp, Artificial Sequence
  Synthetic oligonucleotide; TTT chr2 60517896 60517917 60517913 60517918 +
cttctatgattcctcagaaact

SEQ ID NO: 203754 - DNA, 22 bp, Artificial Sequence
  Synthetic oligonucleotide; TTC chr2 60517897 60517918 60517914 60517919 +
ttctatgattcctcagaaactc

SEQ ID NO: 203755 - DNA, 22 bp, Artificial Sequence
  Synthetic oligonucleotide; CTT chr2 60517899 60517920 60517916 60517921 +
ctatgattcctcagaaactctt

SEQ ID NO: 203756 - DNA, 22 bp, Artificial Sequence
  Synthetic oligonucleotide; TTC chr2 60517900 60517921 60517917 60517922 +
tatgattcctcagaaactcttg

SEQ ID NO: 203757 - DNA, 22 bp, Artificial Sequence
  Synthetic oligonucleotide; CTA chr2 60517902 60517923 60517919 60517924 +
tgattcctcagaaactcttgtc

SEQ ID NO: 203758 - DNA, 22 bp, Artificial Sequence
  Synthetic oligonucleotide; TTC chr2 60517908 60517929 60517925 60517930 +
ctcagaaactcttgtcgactag

SEQ ID NO: 203759 - DNA, 22 bp, Artificial Sequence
  Synthetic oligonucleotide; CTC chr2 60517911 60517932 60517928 60517933 +
agaaactcttgtcgactagagg

SEQ ID NO: 203760 - DNA, 22 bp, Artificial Sequence
  Synthetic oligonucleotide; CTC chr2 60517919 60517940 60517936 60517941 +
ttgtcgactagaggaacaagaa

SEQ ID NO: 203761 - DNA, 22 bp, Artificial Sequence
  Synthetic oligonucleotide; CTT chr2 60517921 60517942 60517938 60517943 +
gtcgactagaggaacaagaacc

SEQ ID NO: 203762 - DNA, 22 bp, Artificial Sequence
  Synthetic oligonucleotide; TTG chr2 60517922 60517943 60517939 60517944 +
tcgactagaggaacaagaacct

SEQ ID NO: 203763 - DNA, 22 bp, Artificial Sequence
  Synthetic oligonucleotide; CTA chr2 60517929 60517950 60517946 60517951 +
gaggaacaagaaccttactcta

SEQ ID NO: 203764 - DNA, 22 bp, Artificial Sequence
  Synthetic oligonucleotide; CTT chr2 60517945 60517966 60517962 60517967 +
actctaaaacccaattttaggg

SEQ ID NO: 203765 - DNA, 22 bp, Artificial Sequence
  Synthetic oligonucleotide; TTA chr2 60517946 60517967 60517963 60517968 +
ctctaaaacccaattttagggg

SEQ ID NO: 203766 - DNA, 22 bp, Artificial Sequence
  Synthetic oligonucleotide; CTC chr2 60517949 60517970 60517966 60517971 +
taaaacccaattttaggggagg

SEQ ID NO: 203767 - DNA, 22 bp, Artificial Sequence
  Synthetic oligonucleotide; CTA chr2 60517951 60517972 60517968 60517973 +
aaacccaattttaggggaggag

SEQ ID NO: 203768 - DNA, 22 bp, Artificial Sequence
  Synthetic oligonucleotide; TTT chr2 60517962 60517983 60517979 60517984 +
taggggaggagagaaaattttt

SEQ ID NO: 203769 - DNA, 22 bp, Artificial Sequence
  Synthetic oligonucleotide; TTT chr2 60517963 60517984 60517980 60517985 +
aggggaggagagaaaattttta

SEQ ID NO: 203770 - DNA, 22 bp, Artificial Sequence
  Synthetic oligonucleotide; TTA chr2 60517964 60517985 60517981 60517986 +
ggggaggagagaaaatttttaa

SEQ ID NO: 203771 - DNA, 22 bp, Artificial Sequence
  Synthetic oligonucleotide; TTT chr2 60517982 60518003 60517999 60518004 +
ttaaaagactttaaattaatta

SEQ ID NO: 203772 - DNA, 22 bp, Artificial Sequence
  Synthetic oligonucleotide; TTT chr2 60517983 60518004 60518000 60518005 +
taaaagactttaaattaattac

SEQ ID NO: 203773 - DNA, 22 bp, Artificial Sequence
  Synthetic oligonucleotide; TTT chr2 60517984 60518005 60518001 60518006 +
aaaagactttaaattaattact

SEQ ID NO: 203774 - DNA, 22 bp, Artificial Sequence
  Synthetic oligonucleotide; TTA chr2 60517985 60518006 60518002 60518007 +
aaagactttaaattaattactt

SEQ ID NO: 203775 - DNA, 22 bp, Artificial Sequence
  Synthetic oligonucleotide; CTT chr2 60517993 60518014 60518010 60518015 +
taaattaattacttgaaggcca

SEQ ID NO: 203776 - DNA, 22 bp, Artificial Sequence
  Synthetic oligonucleotide; TTT chr2 60517994 60518015 60518011 60518016 +
aaattaattacttgaaggccag

SEQ ID NO: 203777 - DNA, 22 bp, Artificial Sequence
  Synthetic oligonucleotide; TTA chr2 60517995 60518016 60518012 60518017 +
aattaattacttgaaggccaga

SEQ ID NO: 203778 - DNA, 22 bp, Artificial Sequence
  Synthetic oligonucleotide; TTA chr2 60518000 60518021 60518017 60518022 +
attacttgaaggccagaggcat

SEQ ID NO: 203779 - DNA, 22 bp, Artificial Sequence
  Synthetic oligonucleotide; TTA chr2 60518004 60518025 60518021 60518026 +
cttgaaggccagaggcatttgc

SEQ ID NO: 203780 - DNA, 22 bp, Artificial Sequence
  Synthetic oligonucleotide; CTT chr2 60518007 60518028 60518024 60518029 +
gaaggccagaggcatttgctta

SEQ ID NO: 203781 - DNA, 22 bp, Artificial Sequence
  Synthetic oligonucleotide; TTG chr2 60518008 60518029 60518025 60518030 +
aaggccagaggcatttgcttat

SEQ ID NO: 203782 - DNA, 22 bp, Artificial Sequence
  Synthetic oligonucleotide; TTT chr2 60518024 60518045 60518041 60518046 +
gcttatgcctataatctcagaa

SEQ ID NO: 203783 - DNA, 22 bp, Artificial Sequence
  Synthetic oligonucleotide; TTG chr2 60518025 60518046 60518042 60518047 +
cttatgcctataatctcagaaa

SEQ ID NO: 203784 - DNA, 22 bp, Artificial Sequence
  Synthetic oligonucleotide; CTT chr2 60518028 60518049 60518045 60518050 +
atgcctataatctcagaaattt

SEQ ID NO: 203785 - DNA, 22 bp, Artificial Sequence
  Synthetic oligonucleotide; TTA chr2 60518029 60518050 60518046 60518051 +
tgcctataatctcagaaatttg

SEQ ID NO: 203786 - DNA, 22 bp, Artificial Sequence
  Synthetic oligonucleotide; CTA chr2 60518035 60518056 60518052 60518057 +
taatctcagaaatttggaaggc

SEQ ID NO: 203787 - DNA, 22 bp, Artificial Sequence
  Synthetic oligonucleotide; CTC chr2 60518042 60518063 60518059 60518064 +
agaaatttggaaggccacagag

SEQ ID NO: 203788 - DNA, 22 bp, Artificial Sequence
  Synthetic oligonucleotide; TTT chr2 60518050 60518071 60518067 60518072 +
ggaaggccacagagggaagatt

SEQ ID NO: 203789 - DNA, 22 bp, Artificial Sequence
  Synthetic oligonucleotide; TTG chr2 60518051 60518072 60518068 60518073 +
gaaggccacagagggaagattg

SEQ ID NO: 203790 - DNA, 22 bp, Artificial Sequence
  Synthetic oligonucleotide; TTG chr2 60518073 60518094 60518090 60518095 +
cttgaagctaggagttcaagac

SEQ ID NO: 203791 - DNA, 22 bp, Artificial Sequence
  Synthetic oligonucleotide; CTT chr2 60518076 60518097 60518093 60518098 +
gaagctaggagttcaagaccag

SEQ ID NO: 203792 - DNA, 22 bp, Artificial Sequence
  Synthetic oligonucleotide; TTG chr2 60518077 60518098 60518094 60518099 +
aagctaggagttcaagaccagc

SEQ ID NO: 203793 - DNA, 22 bp, Artificial Sequence
  Synthetic oligonucleotide; CTA chr2 60518083 60518104 60518100 60518105 +
ggagttcaagaccagcctgggc

SEQ ID NO: 203794 - DNA, 22 bp, Artificial Sequence
  Synthetic oligonucleotide; TTC chr2 60518090 60518111 60518107 60518112 +
aagaccagcctgggcaacatag

SEQ ID NO: 203795 - DNA, 22 bp, Artificial Sequence
  Synthetic oligonucleotide; CTG chr2 60518102 60518123 60518119 60518124 +
ggcaacatagcaaaaccctgtc

SEQ ID NO: 203796 - DNA, 22 bp, Artificial Sequence
  Synthetic oligonucleotide; CTG chr2 60518122 60518143 60518139 60518144 +
tctctacaaaaagcttaataaa

SEQ ID NO: 203797 - DNA, 22 bp, Artificial Sequence
  Synthetic oligonucleotide; CTC chr2 60518126 60518147 60518143 60518148 +
tacaaaaagcttaataaataaa

SEQ ID NO: 203798 - DNA, 22 bp, Artificial Sequence
  Synthetic oligonucleotide; CTA chr2 60518128 60518149 60518145 60518150 +
caaaaagcttaataaataaaat

SEQ ID NO: 203799 - DNA, 22 bp, Artificial Sequence
  Synthetic oligonucleotide; CTT chr2 60518138 60518159 60518155 60518160 +
aataaataaaataaaataattg

SEQ ID NO: 203800 - DNA, 22 bp, Artificial Sequence
  Synthetic oligonucleotide; TTA chr2 60518139 60518160 60518156 60518161 +
ataaataaaataaaataattgc

SEQ ID NO: 203801 - DNA, 22 bp, Artificial Sequence
  Synthetic oligonucleotide; TTG chr2 60518160 60518181 60518177 60518182 +
ctgagatttagctatcttttca

SEQ ID NO: 203802 - DNA, 22 bp, Artificial Sequence
  Synthetic oligonucleotide; CTG chr2 60518163 60518184 60518180 60518185 +
agatttagctatcttttcaaag

SEQ ID NO: 203803 - DNA, 22 bp, Artificial Sequence
  Synthetic oligonucleotide; TTT chr2 60518169 60518190 60518186 60518191 +
agctatcttttcaaagaaaata

SEQ ID NO: 203804 - DNA, 22 bp, Artificial Sequence
  Synthetic oligonucleotide; TTA chr2 60518170 60518191 60518187 60518192 +
gctatcttttcaaagaaaatat

SEQ ID NO: 203805 - DNA, 22 bp, Artificial Sequence
  Synthetic oligonucleotide; CTA chr2 60518174 60518195 60518191 60518196 +
tcttttcaaagaaaatataaaa

SEQ ID NO: 203806 - DNA, 22 bp, Artificial Sequence
  Synthetic oligonucleotide; CTT chr2 60518178 60518199 60518195 60518200 +
ttcaaagaaaatataaaatttg

SEQ ID NO: 203807 - DNA, 22 bp, Artificial Sequence
  Synthetic oligonucleotide; TTT chr2 60518179 60518200 60518196 60518201 +
tcaaagaaaatataaaatttgg

SEQ ID NO: 203808 - DNA, 22 bp, Artificial Sequence
  Synthetic oligonucleotide; TTT chr2 60518180 60518201 60518197 60518202 +
caaagaaaatataaaatttggc

SEQ ID NO: 203809 - DNA, 22 bp, Artificial Sequence
  Synthetic oligonucleotide; TTC chr2 60518181 60518202 60518198 60518203 +
aaagaaaatataaaatttggcc

SEQ ID NO: 203810 - DNA, 22 bp, Artificial Sequence
  Synthetic oligonucleotide; TTT chr2 60518199 60518220 60518216 60518221 +
ggcccagttttttatctatcaa

SEQ ID NO: 203811 - DNA, 22 bp, Artificial Sequence
  Synthetic oligonucleotide; TTG chr2 60518200 60518221 60518217 60518222 +
gcccagttttttatctatcaaa

SEQ ID NO: 203812 - DNA, 22 bp, Artificial Sequence
  Synthetic oligonucleotide; TTT chr2 60518209 60518230 60518226 60518231 +
tttatctatcaaacctagacct

SEQ ID NO: 203813 - DNA, 22 bp, Artificial Sequence
  Synthetic oligonucleotide; TTT chr2 60518210 60518231 60518227 60518232 +
ttatctatcaaacctagaccta

SEQ ID NO: 203814 - DNA, 22 bp, Artificial Sequence
  Synthetic oligonucleotide; TTT chr2 60518211 60518232 60518228 60518233 +
tatctatcaaacctagacctaa

SEQ ID NO: 203815 - DNA, 22 bp, Artificial Sequence
  Synthetic oligonucleotide; TTT chr2 60518212 60518233 60518229 60518234 +
atctatcaaacctagacctaaa

SEQ ID NO: 203816 - DNA, 22 bp, Artificial Sequence
  Synthetic oligonucleotide; TTA chr2 60518213 60518234 60518230 60518235 +
tctatcaaacctagacctaaaa

SEQ ID NO: 203817 - DNA, 22 bp, Artificial Sequence
  Synthetic oligonucleotide; CTA chr2 60518217 60518238 60518234 60518239 +
tcaaacctagacctaaaatcat

SEQ ID NO: 203818 - DNA, 22 bp, Artificial Sequence
  Synthetic oligonucleotide; CTA chr2 60518226 60518247 60518243 60518248 +
gacctaaaatcatcttgtctca

SEQ ID NO: 203819 - DNA, 22 bp, Artificial Sequence
  Synthetic oligonucleotide; CTA chr2 60518232 60518253 60518249 60518254 +
aaatcatcttgtctcattccct

SEQ ID NO: 203820 - DNA, 22 bp, Artificial Sequence
  Synthetic oligonucleotide; CTT chr2 60518242 60518263 60518259 60518264 +
gtctcattccctctgtcaacat

SEQ ID NO: 203821 - DNA, 22 bp, Artificial Sequence
  Synthetic oligonucleotide; TTG chr2 60518243 60518264 60518260 60518265 +
tctcattccctctgtcaacatc

SEQ ID NO: 203822 - DNA, 22 bp, Artificial Sequence
  Synthetic oligonucleotide; CTC chr2 60518247 60518268 60518264 60518269 +
attccctctgtcaacatctgct

SEQ ID NO: 203823 - DNA, 22 bp, Artificial Sequence
  Synthetic oligonucleotide; TTC chr2 60518251 60518272 60518268 60518273 +
cctctgtcaacatctgctgagc

SEQ ID NO: 203824 - DNA, 22 bp, Artificial Sequence
  Synthetic oligonucleotide; CTC chr2 60518255 60518276 60518272 60518277 +
tgtcaacatctgctgagctctc

SEQ ID NO: 203825 - DNA, 22 bp, Artificial Sequence
  Synthetic oligonucleotide; CTG chr2 60518257 60518278 60518274 60518279 +
tcaacatctgctgagctctcat

SEQ ID NO: 203826 - DNA, 22 bp, Artificial Sequence
  Synthetic oligonucleotide; CTG chr2 60518267 60518288 60518284 60518289 +
ctgagctctcataatacataaa

SEQ ID NO: 203827 - DNA, 22 bp, Artificial Sequence
  Synthetic oligonucleotide; CTG chr2 60518270 60518291 60518287 60518292 +
agctctcataatacataaaaca

SEQ ID NO: 203828 - DNA, 22 bp, Artificial Sequence
  Synthetic oligonucleotide; CTC chr2 60518275 60518296 60518292 60518297 +
tcataatacataaaacatcata

SEQ ID NO: 203829 - DNA, 22 bp, Artificial Sequence
  Synthetic oligonucleotide; CTC chr2 60518277 60518298 60518294 60518299 +
ataatacataaaacatcataga

SEQ ID NO: 203830 - DNA, 22 bp, Artificial Sequence
  Synthetic oligonucleotide; TTA chr2 60518318 60518339 60518335 60518340 +
gacctaccgttccataccagtg

SEQ ID NO: 203831 - DNA, 22 bp, Artificial Sequence
  Synthetic oligonucleotide; CTA chr2 60518324 60518345 60518341 60518346 +
ccgttccataccagtgtgttac

SEQ ID NO: 203832 - DNA, 22 bp, Artificial Sequence
  Synthetic oligonucleotide; TTC chr2 60518330 60518351 60518347 60518352 +
cataccagtgtgttacagcctg

SEQ ID NO: 203833 - DNA, 22 bp, Artificial Sequence
  Synthetic oligonucleotide; TTA chr2 60518345 60518366 60518362 60518367 +
cagcctgtcatgaagcagactc

SEQ ID NO: 203834 - DNA, 22 bp, Artificial Sequence
  Synthetic oligonucleotide; CTG chr2 60518352 60518373 60518369 60518374 +
tcatgaagcagactcagagaat

SEQ ID NO: 203835 - DNA, 22 bp, Artificial Sequence
  Synthetic oligonucleotide; CTC chr2 60518367 60518388 60518384 60518389 +
agagaatttggctactacttag

SEQ ID NO: 203836 - DNA, 22 bp, Artificial Sequence
  Synthetic oligonucleotide; TTT chr2 60518376 60518397 60518393 60518398 +
ggctactacttagtactaacat

SEQ ID NO: 203837 - DNA, 22 bp, Artificial Sequence
  Synthetic oligonucleotide; TTG chr2 60518377 60518398 60518394 60518399 +
gctactacttagtactaacatt

SEQ ID NO: 203838 - DNA, 22 bp, Artificial Sequence
  Synthetic oligonucleotide; CTA chr2 60518381 60518402 60518398 60518403 +
ctacttagtactaacatttaat

SEQ ID NO: 203839 - DNA, 22 bp, Artificial Sequence
  Synthetic oligonucleotide; CTA chr2 60518384 60518405 60518401 60518406 +
cttagtactaacatttaattta

SEQ ID NO: 203840 - DNA, 22 bp, Artificial Sequence
  Synthetic oligonucleotide; CTT chr2 60518387 60518408 60518404 60518409 +
agtactaacatttaatttagtt

SEQ ID NO: 203841 - DNA, 22 bp, Artificial Sequence
  Synthetic oligonucleotide; TTA chr2 60518388 60518409 60518405 60518410 +
gtactaacatttaatttagttt

SEQ ID NO: 203842 - DNA, 22 bp, Artificial Sequence
  Synthetic oligonucleotide; CTA chr2 60518394 60518415 60518411 60518416 +
acatttaatttagttttaaaat

SEQ ID NO: 203843 - DNA, 22 bp, Artificial Sequence
  Synthetic oligonucleotide; TTT chr2 60518400 60518421 60518417 60518422 +
aatttagttttaaaatgtctgc

SEQ ID NO: 203844 - DNA, 22 bp, Artificial Sequence
  Synthetic oligonucleotide; TTA chr2 60518401 60518422 60518418 60518423 +
atttagttttaaaatgtctgcg

SEQ ID NO: 203845 - DNA, 22 bp, Artificial Sequence
  Synthetic oligonucleotide; TTT chr2 60518405 60518426 60518422 60518427 +
agttttaaaatgtctgcgatag

SEQ ID NO: 203846 - DNA, 22 bp, Artificial Sequence
  Synthetic oligonucleotide; TTA chr2 60518406 60518427 60518423 60518428 +
gttttaaaatgtctgcgataga

SEQ ID NO: 203847 - DNA, 22 bp, Artificial Sequence
  Synthetic oligonucleotide; TTT chr2 60518410 60518431 60518427 60518432 +
taaaatgtctgcgatagagcag

SEQ ID NO: 203848 - DNA, 22 bp, Artificial Sequence
  Synthetic oligonucleotide; TTT chr2 60518411 60518432 60518428 60518433 +
aaaatgtctgcgatagagcaga

SEQ ID NO: 203849 - DNA, 22 bp, Artificial Sequence
  Synthetic oligonucleotide; TTA chr2 60518412 60518433 60518429 60518434 +
aaatgtctgcgatagagcagat

SEQ ID NO: 203850 - DNA, 22 bp, Artificial Sequence
  Synthetic oligonucleotide; CTG chr2 60518421 60518442 60518438 60518443 +
cgatagagcagattcaggatta

SEQ ID NO: 203851 - DNA, 22 bp, Artificial Sequence
  Synthetic oligonucleotide; TTC chr2 60518436 60518457 60518453 60518458 +
aggattatgcctgtaagatgac

SEQ ID NO: 203852 - DNA, 22 bp, Artificial Sequence
  Synthetic oligonucleotide; TTA chr2 60518443 60518464 60518460 60518465 +
tgcctgtaagatgacattccaa

SEQ ID NO: 203853 - DNA, 22 bp, Artificial Sequence
  Synthetic oligonucleotide; CTG chr2 60518449 60518470 60518466 60518471 +
taagatgacattccaactcacc

SEQ ID NO: 203854 - DNA, 22 bp, Artificial Sequence
  Synthetic oligonucleotide; TTC chr2 60518462 60518483 60518479 60518484 +
caactcacctgcatttaaatat

SEQ ID NO: 203855 - DNA, 22 bp, Artificial Sequence
  Synthetic oligonucleotide; CTC chr2 60518468 60518489 60518485 60518490 +
acctgcatttaaatatgaataa

SEQ ID NO: 203856 - DNA, 22 bp, Artificial Sequence
  Synthetic oligonucleotide; CTG chr2 60518473 60518494 60518490 60518495 +
catttaaatatgaataaagagt

SEQ ID NO: 203857 - DNA, 22 bp, Artificial Sequence
  Synthetic oligonucleotide; TTT chr2 60518478 60518499 60518495 60518500 +
aaatatgaataaagagtgagca

SEQ ID NO: 203858 - DNA, 22 bp, Artificial Sequence
  Synthetic oligonucleotide; TTA chr2 60518479 60518500 60518496 60518501 +
aatatgaataaagagtgagcag

SEQ ID NO: 203859 - DNA, 22 bp, Artificial Sequence
  Synthetic oligonucleotide; TTT chr2 60518551 60518572 60518568 60518573 +
tagcttcccacacgcaaaggca

SEQ ID NO: 203860 - DNA, 22 bp, Artificial Sequence
  Synthetic oligonucleotide; TTT chr2 60518552 60518573 60518569 60518574 +
agcttcccacacgcaaaggcat

SEQ ID NO: 203861 - DNA, 22 bp, Artificial Sequence
  Synthetic oligonucleotide; TTA chr2 60518553 60518574 60518570 60518575 +
gcttcccacacgcaaaggcatg

SEQ ID NO: 203862 - DNA, 22 bp, Artificial Sequence
  Synthetic oligonucleotide; CTT chr2 60518557 60518578 60518574 60518579 +
cccacacgcaaaggcatggggg

SEQ ID NO: 203863 - DNA, 22 bp, Artificial Sequence
  Synthetic oligonucleotide; TTC chr2 60518558 60518579 60518575 60518580 +
ccacacgcaaaggcatgggggg

SEQ ID NO: 203864 - DNA, 22 bp, Artificial Sequence
  Synthetic oligonucleotide; TTG chr2 60518598 60518619 60518615 60518620 +
ctctagatctgagaatcaccac

SEQ ID NO: 203865 - DNA, 22 bp, Artificial Sequence
  Synthetic oligonucleotide; CTC chr2 60518601 60518622 60518618 60518623 +
tagatctgagaatcaccacaca

SEQ ID NO: 203866 - DNA, 22 bp, Artificial Sequence
  Synthetic oligonucleotide; CTA chr2 60518603 60518624 60518620 60518625 +
gatctgagaatcaccacacacc

SEQ ID NO: 203867 - DNA, 22 bp, Artificial Sequence
  Synthetic oligonucleotide; CTG chr2 60518609 60518630 60518626 60518631 +
agaatcaccacacaccagagag

SEQ ID NO: 203868 - DNA, 22 bp, Artificial Sequence
  Synthetic oligonucleotide; TTG chr2 60518670 60518691 60518687 60518692 +
agaaagagttttaagagcctac

SEQ ID NO: 203869 - DNA, 22 bp, Artificial Sequence
  Synthetic oligonucleotide; TTT chr2 60518681 60518702 60518698 60518703 +
taagagcctactcatcatcaga

SEQ ID NO: 203870 - DNA, 22 bp, Artificial Sequence
  Synthetic oligonucleotide; TTT chr2 60518682 60518703 60518699 60518704 +
aagagcctactcatcatcagag

SEQ ID NO: 203871 - DNA, 22 bp, Artificial Sequence
  Synthetic oligonucleotide; TTA chr2 60518683 60518704 60518700 60518705 +
agagcctactcatcatcagagt

SEQ ID NO: 203872 - DNA, 22 bp, Artificial Sequence
  Synthetic oligonucleotide; CTA chr2 60518691 60518712 60518708 60518713 +
ctcatcatcagagttcacttaa

SEQ ID NO: 203873 - DNA, 22 bp, Artificial Sequence
  Synthetic oligonucleotide; CTC chr2 60518694 60518715 60518711 60518716 +
atcatcagagttcacttaaaag

SEQ ID NO: 203874 - DNA, 22 bp, Artificial Sequence
  Synthetic oligonucleotide; TTC chr2 60518707 60518728 60518724 60518729 +
acttaaaagtccatccagaatc

SEQ ID NO: 203875 - DNA, 22 bp, Artificial Sequence
  Synthetic oligonucleotide; CTT chr2 60518711 60518732 60518728 60518733 +
aaaagtccatccagaatcagaa

SEQ ID NO: 203876 - DNA, 22 bp, Artificial Sequence
  Synthetic oligonucleotide; TTA chr2 60518712 60518733 60518729 60518734 +
aaagtccatccagaatcagaac

SEQ ID NO: 203877 - DNA, 22 bp, Artificial Sequence
  Synthetic oligonucleotide; TTC chr2 60518760 60518781 60518777 60518782 +
ctgggggccgggcgtggatttt

SEQ ID NO: 203878 - DNA, 22 bp, Artificial Sequence
  Synthetic oligonucleotide; CTG chr2 60518763 60518784 60518780 60518785 +
ggggccgggcgtggattttaag

SEQ ID NO: 203879 - DNA, 22 bp, Artificial Sequence
  Synthetic oligonucleotide; TTT chr2 60518781 60518802 60518798 60518803 +
taaggactcatcaattactgtt

SEQ ID NO: 203880 - DNA, 22 bp, Artificial Sequence
  Synthetic oligonucleotide; TTT chr2 60518782 60518803 60518799 60518804 +
aaggactcatcaattactgttc

SEQ ID NO: 203881 - DNA, 22 bp, Artificial Sequence
  Synthetic oligonucleotide; TTA chr2 60518783 60518804 60518800 60518805 +
aggactcatcaattactgttca

SEQ ID NO: 203882 - DNA, 22 bp, Artificial Sequence
  Synthetic oligonucleotide; CTC chr2 60518790 60518811 60518807 60518812 +
atcaattactgttcaagttcag

SEQ ID NO: 203883 - DNA, 22 bp, Artificial Sequence
  Synthetic oligonucleotide; TTA chr2 60518798 60518819 60518815 60518820 +
ctgttcaagttcaggtcaagct

SEQ ID NO: 203884 - DNA, 22 bp, Artificial Sequence
  Synthetic oligonucleotide; CTG chr2 60518801 60518822 60518818 60518823 +
ttcaagttcaggtcaagctgga

SEQ ID NO: 203885 - DNA, 22 bp, Artificial Sequence
  Synthetic oligonucleotide; TTC chr2 60518804 60518825 60518821 60518826 +
aagttcaggtcaagctggatgg

SEQ ID NO: 203886 - DNA, 22 bp, Artificial Sequence
  Synthetic oligonucleotide; TTC chr2 60518810 60518831 60518827 60518832 +
aggtcaagctggatggacacca

SEQ ID NO: 203887 - DNA, 22 bp, Artificial Sequence
  Synthetic oligonucleotide; CTG chr2 60518821 60518842 60518838 60518843 +
gatggacaccatccacatggtg

SEQ ID NO: 203888 - DNA, 22 bp, Artificial Sequence
  Synthetic oligonucleotide; TTG chr2 60518846 60518867 60518863 60518868 +
ctcgatgggcaaagatcaagag

SEQ ID NO: 203889 - DNA, 22 bp, Artificial Sequence
  Synthetic oligonucleotide; CTC chr2 60518849 60518870 60518866 60518871 +
gatgggcaaagatcaagaggca

SEQ ID NO: 203890 - DNA, 22 bp, Artificial Sequence
  Synthetic oligonucleotide; TTC chr2 60518878 60518899 60518895 60518900 +
accaccagccgtatttcctggg

SEQ ID NO: 203891 - DNA, 22 bp, Artificial Sequence
  Synthetic oligonucleotide; TTT chr2 60518894 60518915 60518911 60518916 +
cctggggctgcttgttactgac

SEQ ID NO: 203892 - DNA, 22 bp, Artificial Sequence
  Synthetic oligonucleotide; TTC chr2 60518895 60518916 60518912 60518917 +
ctggggctgcttgttactgaca

SEQ ID NO: 203893 - DNA, 22 bp, Artificial Sequence
  Synthetic oligonucleotide; CTG chr2 60518898 60518919 60518915 60518920 +
gggctgcttgttactgacattc

SEQ ID NO: 203894 - DNA, 22 bp, Artificial Sequence
  Synthetic oligonucleotide; CTG chr2 60518904 60518925 60518921 60518926 +
cttgttactgacattctgtcat

SEQ ID NO: 203895 - DNA, 22 bp, Artificial Sequence
  Synthetic oligonucleotide; CTT chr2 60518907 60518928 60518924 60518929 +
gttactgacattctgtcattca

SEQ ID NO: 203896 - DNA, 22 bp, Artificial Sequence
  Synthetic oligonucleotide; TTG chr2 60518908 60518929 60518925 60518930 +
ttactgacattctgtcattcaa

SEQ ID NO: 203897 - DNA, 22 bp, Artificial Sequence
  Synthetic oligonucleotide; TTA chr2 60518911 60518932 60518928 60518933 +
ctgacattctgtcattcaaggt

SEQ ID NO: 203898 - DNA, 22 bp, Artificial Sequence
  Synthetic oligonucleotide; CTG chr2 60518914 60518935 60518931 60518936 +
acattctgtcattcaaggtggg

SEQ ID NO: 203899 - DNA, 22 bp, Artificial Sequence
  Synthetic oligonucleotide; TTC chr2 60518920 60518941 60518937 60518942 +
tgtcattcaaggtgggtcctga

SEQ ID NO: 203900 - DNA, 22 bp, Artificial Sequence
  Synthetic oligonucleotide; CTG chr2 60518922 60518943 60518939 60518944 +
tcattcaaggtgggtcctgaag

SEQ ID NO: 203901 - DNA, 22 bp, Artificial Sequence
  Synthetic oligonucleotide; TTC chr2 60518928 60518949 60518945 60518950 +
aaggtgggtcctgaagccacag

SEQ ID NO: 203902 - DNA, 22 bp, Artificial Sequence
  Synthetic oligonucleotide; CTG chr2 60518941 60518962 60518958 60518963 +
aagccacagtaagcaccaaatc

SEQ ID NO: 203903 - DNA, 22 bp, Artificial Sequence
  Synthetic oligonucleotide; CTG chr2 60518965 60518986 60518982 60518987 +
ctccctacaatccacagcaaaa

SEQ ID NO: 203904 - DNA, 22 bp, Artificial Sequence
  Synthetic oligonucleotide; CTC chr2 60518968 60518989 60518985 60518990 +
cctacaatccacagcaaaagga

SEQ ID NO: 203905 - DNA, 22 bp, Artificial Sequence
  Synthetic oligonucleotide; CTA chr2 60518972 60518993 60518989 60518994 +
caatccacagcaaaaggagagt

SEQ ID NO: 203906 - DNA, 22 bp, Artificial Sequence
  Synthetic oligonucleotide; TTC chr2 60518996 60519017 60519013 60519018 +
cttcttttaaagagcgatggca

SEQ ID NO: 203907 - DNA, 22 bp, Artificial Sequence
  Synthetic oligonucleotide; CTT chr2 60518999 60519020 60519016 60519021 +
cttttaaagagcgatggcacac

SEQ ID NO: 203908 - DNA, 22 bp, Artificial Sequence
  Synthetic oligonucleotide; TTC chr2 60519000 60519021 60519017 60519022 +
ttttaaagagcgatggcacaca

SEQ ID NO: 203909 - DNA, 22 bp, Artificial Sequence
  Synthetic oligonucleotide; CTT chr2 60519002 60519023 60519019 60519024 +
ttaaagagcgatggcacacatc

SEQ ID NO: 203910 - DNA, 22 bp, Artificial Sequence
  Synthetic oligonucleotide; TTT chr2 60519003 60519024 60519020 60519025 +
taaagagcgatggcacacatct

SEQ ID NO: 203911 - DNA, 22 bp, Artificial Sequence
  Synthetic oligonucleotide; TTT chr2 60519004 60519025 60519021 60519026 +
aaagagcgatggcacacatctc

SEQ ID NO: 203912 - DNA, 22 bp, Artificial Sequence
  Synthetic oligonucleotide; TTA chr2 60519005 60519026 60519022 60519027 +
aagagcgatggcacacatctct

SEQ ID NO: 203913 - DNA, 22 bp, Artificial Sequence
  Synthetic oligonucleotide; CTC chr2 60519026 60519047 60519043 60519048 +
tcaactcttgagagaaaatgga

SEQ ID NO: 203914 - DNA, 22 bp, Artificial Sequence
  Synthetic oligonucleotide; CTC chr2 60519028 60519049 60519045 60519050 +
aactcttgagagaaaatggaca

SEQ ID NO: 203915 - DNA, 22 bp, Artificial Sequence
  Synthetic oligonucleotide; CTC chr2 60519033 60519054 60519050 60519055 +
ttgagagaaaatggacagaagt

SEQ ID NO: 203916 - DNA, 22 bp, Artificial Sequence
  Synthetic oligonucleotide; CTT chr2 60519035 60519056 60519052 60519057 +
gagagaaaatggacagaagtgg

SEQ ID NO: 203917 - DNA, 22 bp, Artificial Sequence
  Synthetic oligonucleotide; TTG chr2 60519036 60519057 60519053 60519058 +
agagaaaatggacagaagtggg

SEQ ID NO: 203918 - DNA, 22 bp, Artificial Sequence
  Synthetic oligonucleotide; TTT chr2 60519062 60519083 60519079 60519084 +
ttcaatcctgataccagcagga

SEQ ID NO: 203919 - DNA, 22 bp, Artificial Sequence
  Synthetic oligonucleotide; TTT chr2 60519063 60519084 60519080 60519085 +
tcaatcctgataccagcaggaa

SEQ ID NO: 203920 - DNA, 22 bp, Artificial Sequence
  Synthetic oligonucleotide; TTT chr2 60519064 60519085 60519081 60519086 +
caatcctgataccagcaggaaa

SEQ ID NO: 203921 - DNA, 22 bp, Artificial Sequence
  Synthetic oligonucleotide; TTC chr2 60519065 60519086 60519082 60519087 +
aatcctgataccagcaggaaac

SEQ ID NO: 203922 - DNA, 22 bp, Artificial Sequence
  Synthetic oligonucleotide; CTG chr2 60519072 60519093 60519089 60519094 +
ataccagcaggaaacagggagt

SEQ ID NO: 203923 - DNA, 22 bp, Artificial Sequence
  Synthetic oligonucleotide; CTC chr2 60519097 60519118 60519114 60519119 +
tggtaggtactaccaaaccaag

SEQ ID NO: 203924 - DNA, 22 bp, Artificial Sequence
  Synthetic oligonucleotide; CTG chr2 60519099 60519120 60519116 60519121 +
gtaggtactaccaaaccaagaa

SEQ ID NO: 203925 - DNA, 22 bp, Artificial Sequence
  Synthetic oligonucleotide; CTA chr2 60519109 60519130 60519126 60519131 +
ccaaaccaagaagcttcttttc

SEQ ID NO: 203926 - DNA, 22 bp, Artificial Sequence
  Synthetic oligonucleotide; CTT chr2 60519125 60519146 60519142 60519147 +
cttttctcccaagtacaccagg

SEQ ID NO: 203927 - DNA, 22 bp, Artificial Sequence
  Synthetic oligonucleotide; TTC chr2 60519126 60519147 60519143 60519148 +
ttttctcccaagtacaccagga

SEQ ID NO: 203928 - DNA, 22 bp, Artificial Sequence
  Synthetic oligonucleotide; CTT chr2 60519128 60519149 60519145 60519150 +
ttctcccaagtacaccaggaac

SEQ ID NO: 203929 - DNA, 22 bp, Artificial Sequence
  Synthetic oligonucleotide; TTT chr2 60519129 60519150 60519146 60519151 +
tctcccaagtacaccaggaacc

SEQ ID NO: 203930 - DNA, 22 bp, Artificial Sequence
  Synthetic oligonucleotide; TTT chr2 60519130 60519151 60519147 60519152 +
ctcccaagtacaccaggaaccc

SEQ ID NO: 203931 - DNA, 22 bp, Artificial Sequence
  Synthetic oligonucleotide; TTC chr2 60519131 60519152 60519148 60519153 +
tcccaagtacaccaggaacccc

SEQ ID NO: 203932 - DNA, 22 bp, Artificial Sequence
  Synthetic oligonucleotide; CTC chr2 60519133 60519154 60519150 60519155 +
ccaagtacaccaggaacccctt

SEQ ID NO: 203933 - DNA, 22 bp, Artificial Sequence
  Synthetic oligonucleotide; CTT chr2 60519155 60519176 60519172 60519177 +
tcaaatacaggcgctacaaaaa

SEQ ID NO: 203934 - DNA, 22 bp, Artificial Sequence
  Synthetic oligonucleotide; TTT chr2 60519156 60519177 60519173 60519178 +
caaatacaggcgctacaaaaaa

SEQ ID NO: 203935 - DNA, 22 bp, Artificial Sequence
  Synthetic oligonucleotide; TTC chr2 60519157 60519178 60519174 60519179 +
aaatacaggcgctacaaaaaaa

SEQ ID NO: 203936 - DNA, 22 bp, Artificial Sequence
  Synthetic oligonucleotide; CTA chr2 60519171 60519192 60519188 60519193 +
caaaaaaagaaataggtgtgaa

SEQ ID NO: 203937 - DNA, 22 bp, Artificial Sequence
  Synthetic oligonucleotide; CTG chr2 60519216 60519237 60519233 60519238 +
aggactatgcatgctctgtcta

SEQ ID NO: 203938 - DNA, 22 bp, Artificial Sequence
  Synthetic oligonucleotide; CTA chr2 60519223 60519244 60519240 60519245 +
tgcatgctctgtctatgggtat

SEQ ID NO: 203939 - DNA, 22 bp, Artificial Sequence
  Synthetic oligonucleotide; CTC chr2 60519232 60519253 60519249 60519254 +
tgtctatgggtatcaacacctt

SEQ ID NO: 203940 - DNA, 22 bp, Artificial Sequence
  Synthetic oligonucleotide; CTG chr2 60519234 60519255 60519251 60519256 +
tctatgggtatcaacaccttta

SEQ ID NO: 203941 - DNA, 22 bp, Artificial Sequence
  Synthetic oligonucleotide; CTA chr2 60519238 60519259 60519255 60519260 +
tgggtatcaacacctttaaggc

SEQ ID NO: 203942 - DNA, 22 bp, Artificial Sequence
  Synthetic oligonucleotide; CTT chr2 60519254 60519275 60519271 60519276 +
taaggcattttgcggtcttttt

SEQ ID NO: 203943 - DNA, 22 bp, Artificial Sequence
  Synthetic oligonucleotide; TTT chr2 60519255 60519276 60519272 60519277 +
aaggcattttgcggtctttttg

SEQ ID NO: 203944 - DNA, 22 bp, Artificial Sequence
  Synthetic oligonucleotide; TTA chr2 60519256 60519277 60519273 60519278 +
aggcattttgcggtctttttga

SEQ ID NO: 203945 - DNA, 22 bp, Artificial Sequence
  Synthetic oligonucleotide; TTT chr2 60519264 60519285 60519281 60519286 +
tgcggtctttttgattctataa

SEQ ID NO: 203946 - DNA, 22 bp, Artificial Sequence
  Synthetic oligonucleotide; TTT chr2 60519265 60519286 60519282 60519287 +
gcggtctttttgattctataac

SEQ ID NO: 203947 - DNA, 22 bp, Artificial Sequence
  Synthetic oligonucleotide; TTG chr2 60519266 60519287 60519283 60519288 +
cggtctttttgattctataacc

SEQ ID NO: 203948 - DNA, 22 bp, Artificial Sequence
  Synthetic oligonucleotide; CTT chr2 60519273 60519294 60519290 60519295 +
tttgattctataacctccatat

SEQ ID NO: 203949 - DNA, 22 bp, Artificial Sequence
  Synthetic oligonucleotide; TTT chr2 60519274 60519295 60519291 60519296 +
ttgattctataacctccatatt

SEQ ID NO: 203950 - DNA, 22 bp, Artificial Sequence
  Synthetic oligonucleotide; TTT chr2 60519275 60519296 60519292 60519297 +
tgattctataacctccatattg

SEQ ID NO: 203951 - DNA, 22 bp, Artificial Sequence
  Synthetic oligonucleotide; TTT chr2 60519276 60519297 60519293 60519298 +
gattctataacctccatattga

SEQ ID NO: 203952 - DNA, 22 bp, Artificial Sequence
  Synthetic oligonucleotide; TTG chr2 60519277 60519298 60519294 60519299 +
attctataacctccatattgag

SEQ ID NO: 203953 - DNA, 22 bp, Artificial Sequence
  Synthetic oligonucleotide; TTC chr2 60519281 60519302 60519298 60519303 +
tataacctccatattgagagac

SEQ ID NO: 203954 - DNA, 22 bp, Artificial Sequence
  Synthetic oligonucleotide; CTA chr2 60519283 60519304 60519300 60519305 +
taacctccatattgagagacat

SEQ ID NO: 203955 - DNA, 22 bp, Artificial Sequence
  Synthetic oligonucleotide; CTC chr2 60519290 60519311 60519307 60519312 +
catattgagagacataaaacac

SEQ ID NO: 203956 - DNA, 22 bp, Artificial Sequence
  Synthetic oligonucleotide; TTG chr2 60519297 60519318 60519314 60519319 +
agagacataaaacacagaacat

SEQ ID NO: 203957 - DNA, 22 bp, Artificial Sequence
  Synthetic oligonucleotide; TTA chr2 60519321 60519342 60519338 60519343 +
cacctgtcaggtgctgggccct

SEQ ID NO: 203958 - DNA, 22 bp, Artificial Sequence
  Synthetic oligonucleotide; CTG chr2 60519327 60519348 60519344 60519349 +
tcaggtgctgggccctgaacta

SEQ ID NO: 203959 - DNA, 22 bp, Artificial Sequence
  Synthetic oligonucleotide; CTG chr2 60519337 60519358 60519354 60519359 +
ggccctgaactatctccaggca

SEQ ID NO: 203960 - DNA, 22 bp, Artificial Sequence
  Synthetic oligonucleotide; CTG chr2 60519344 60519365 60519361 60519366 +
aactatctccaggcagctgaaa

SEQ ID NO: 203961 - DNA, 22 bp, Artificial Sequence
  Synthetic oligonucleotide; CTA chr2 60519349 60519370 60519366 60519371 +
tctccaggcagctgaaagtcag

SEQ ID NO: 203962 - DNA, 22 bp, Artificial Sequence
  Synthetic oligonucleotide; CTC chr2 60519353 60519374 60519370 60519375 +
caggcagctgaaagtcagtaca

SEQ ID NO: 203963 - DNA, 22 bp, Artificial Sequence
  Synthetic oligonucleotide; CTG chr2 60519363 60519384 60519380 60519385 +
aaagtcagtacatcagcttttt

SEQ ID NO: 203964 - DNA, 22 bp, Artificial Sequence
  Synthetic oligonucleotide; CTT chr2 60519382 60519403 60519399 60519404 +
tttaatgatgtgaaagttaaag

SEQ ID NO: 203965 - DNA, 22 bp, Artificial Sequence
  Synthetic oligonucleotide; TTT chr2 60519383 60519404 60519400 60519405 +
ttaatgatgtgaaagttaaaga

SEQ ID NO: 203966 - DNA, 22 bp, Artificial Sequence
  Synthetic oligonucleotide; TTT chr2 60519384 60519405 60519401 60519406 +
taatgatgtgaaagttaaagat

SEQ ID NO: 203967 - DNA, 22 bp, Artificial Sequence
  Synthetic oligonucleotide; TTT chr2 60519385 60519406 60519402 60519407 +
aatgatgtgaaagttaaagatt

SEQ ID NO: 203968 - DNA, 22 bp, Artificial Sequence
  Synthetic oligonucleotide; TTA chr2 60519386 60519407 60519403 60519408 +
atgatgtgaaagttaaagatta

SEQ ID NO: 203969 - DNA, 22 bp, Artificial Sequence
  Synthetic oligonucleotide; TTA chr2 60519401 60519422 60519418 60519423 +
aagattaaaaacatgttggaac

SEQ ID NO: 203970 - DNA, 22 bp, Artificial Sequence
  Synthetic oligonucleotide; TTA chr2 60519408 60519429 60519425 60519430 +
aaaacatgttggaacgcttact

SEQ ID NO: 203971 - DNA, 22 bp, Artificial Sequence
  Synthetic oligonucleotide; TTG chr2 60519419 60519440 60519436 60519441 +
gaacgcttactttatgcagtgc

SEQ ID NO: 203972 - DNA, 22 bp, Artificial Sequence
  Synthetic oligonucleotide; CTT chr2 60519427 60519448 60519444 60519449 +
actttatgcagtgccaaaaatg

SEQ ID NO: 203973 - DNA, 22 bp, Artificial Sequence
  Synthetic oligonucleotide; TTA chr2 60519428 60519449 60519445 60519450 +
ctttatgcagtgccaaaaatgt

SEQ ID NO: 203974 - DNA, 22 bp, Artificial Sequence
  Synthetic oligonucleotide; CTT chr2 60519431 60519452 60519448 60519453 +
tatgcagtgccaaaaatgtgtc

SEQ ID NO: 203975 - DNA, 22 bp, Artificial Sequence
  Synthetic oligonucleotide; TTT chr2 60519432 60519453 60519449 60519454 +
atgcagtgccaaaaatgtgtct

SEQ ID NO: 203976 - DNA, 22 bp, Artificial Sequence
  Synthetic oligonucleotide; TTA chr2 60519433 60519454 60519450 60519455 +
tgcagtgccaaaaatgtgtcta

SEQ ID NO: 203977 - DNA, 22 bp, Artificial Sequence
  Synthetic oligonucleotide; CTA chr2 60519455 60519476 60519472 60519477 +
taacctgtaaggagagatgggt

SEQ ID NO: 203978 - DNA, 22 bp, Artificial Sequence
  Synthetic oligonucleotide; CTG chr2 60519462 60519483 60519479 60519484 +
taaggagagatgggtgtggaac

SEQ ID NO: 203979 - DNA, 22 bp, Artificial Sequence
  Synthetic oligonucleotide; CTG chr2 60519505 60519526 60519522 60519527 +
cactcatgctgcagagaaaaaa

SEQ ID NO: 203980 - DNA, 22 bp, Artificial Sequence
  Synthetic oligonucleotide; CTC chr2 60519510 60519531 60519527 60519532 +
atgctgcagagaaaaaataagg

SEQ ID NO: 203981 - DNA, 22 bp, Artificial Sequence
  Synthetic oligonucleotide; CTG chr2 60519516 60519537 60519533 60519538 +
cagagaaaaaataaggtcctca

SEQ ID NO: 203982 - DNA, 22 bp, Artificial Sequence
  Synthetic oligonucleotide; CTC chr2 60519537 60519558 60519554 60519559 +
acttgcctgcctgcctgcctgc

SEQ ID NO: 203983 - DNA, 22 bp, Artificial Sequence
  Synthetic oligonucleotide; CTT chr2 60519541 60519562 60519558 60519563 +
gcctgcctgcctgcctgcctgc

SEQ ID NO: 203984 - DNA, 22 bp, Artificial Sequence
  Synthetic oligonucleotide; TTG chr2 60519542 60519563 60519559 60519564 +
cctgcctgcctgcctgcctgcc

SEQ ID NO: 203985 - DNA, 22 bp, Artificial Sequence
  Synthetic oligonucleotide; CTG chr2 60519546 60519567 60519563 60519568 +
cctgcctgcctgcctgcctgcc

SEQ ID NO: 203986 - DNA, 22 bp, Artificial Sequence
  Synthetic oligonucleotide; CTG chr2 60519550 60519571 60519567 60519572 +
cctgcctgcctgcctgcctgcc

SEQ ID NO: 203987 - DNA, 22 bp, Artificial Sequence
  Synthetic oligonucleotide; CTG chr2 60519554 60519575 60519571 60519576 +
cctgcctgcctgcctgcctgcc

SEQ ID NO: 203988 - DNA, 22 bp, Artificial Sequence
  Synthetic oligonucleotide; CTG chr2 60519558 60519579 60519575 60519580 +
cctgcctgcctgcctgcctgcc

SEQ ID NO: 203989 - DNA, 22 bp, Artificial Sequence
  Synthetic oligonucleotide; CTG chr2 60519562 60519583 60519579 60519584 +
cctgcctgcctgcctgcctgcc

SEQ ID NO: 203990 - DNA, 22 bp, Artificial Sequence
  Synthetic oligonucleotide; CTG chr2 60519566 60519587 60519583 60519588 +
cctgcctgcctgcctgccttct

SEQ ID NO: 203991 - DNA, 22 bp, Artificial Sequence
  Synthetic oligonucleotide; CTG chr2 60519570 60519591 60519587 60519592 +
cctgcctgcctgccttctttcc

SEQ ID NO: 203992 - DNA, 22 bp, Artificial Sequence
  Synthetic oligonucleotide; CTG chr2 60519574 60519595 60519591 60519596 +
cctgcctgccttctttccttac

SEQ ID NO: 203993 - DNA, 22 bp, Artificial Sequence
  Synthetic oligonucleotide; CTG chr2 60519578 60519599 60519595 60519600 +
cctgccttctttccttacaaga

SEQ ID NO: 203994 - DNA, 22 bp, Artificial Sequence
  Synthetic oligonucleotide; CTG chr2 60519582 60519603 60519599 60519604 +
ccttctttccttacaagagaaa

SEQ ID NO: 203995 - DNA, 22 bp, Artificial Sequence
  Synthetic oligonucleotide; CTT chr2 60519586 60519607 60519603 60519608 +
ctttccttacaagagaaatcgc

SEQ ID NO: 203996 - DNA, 22 bp, Artificial Sequence
  Synthetic oligonucleotide; TTC chr2 60519587 60519608 60519604 60519609 +
tttccttacaagagaaatcgct

SEQ ID NO: 203997 - DNA, 22 bp, Artificial Sequence
  Synthetic oligonucleotide; CTT chr2 60519589 60519610 60519606 60519611 +
tccttacaagagaaatcgctcc

SEQ ID NO: 203998 - DNA, 22 bp, Artificial Sequence
  Synthetic oligonucleotide; TTT chr2 60519590 60519611 60519607 60519612 +
ccttacaagagaaatcgctcct

SEQ ID NO: 203999 - DNA, 22 bp, Artificial Sequence
  Synthetic oligonucleotide; TTC chr2 60519591 60519612 60519608 60519613 +
cttacaagagaaatcgctcctg

SEQ ID NO: 204000 - DNA, 22 bp, Artificial Sequence
  Synthetic oligonucleotide; CTT chr2 60519594 60519615 60519611 60519616 +
acaagagaaatcgctcctgaaa

SEQ ID NO: 204001 - DNA, 22 bp, Artificial Sequence
  Synthetic oligonucleotide; TTA chr2 60519595 60519616 60519612 60519617 +
caagagaaatcgctcctgaaat

SEQ ID NO: 204002 - DNA, 22 bp, Artificial Sequence
  Synthetic oligonucleotide; CTC chr2 60519610 60519631 60519627 60519632 +
ctgaaatctgacgtgctttgca

SEQ ID NO: 204003 - DNA, 22 bp, Artificial Sequence
  Synthetic oligonucleotide; CTG chr2 60519613 60519634 60519630 60519635 +
aaatctgacgtgctttgcaaca

SEQ ID NO: 204004 - DNA, 22 bp, Artificial Sequence
  Synthetic oligonucleotide; CTG chr2 60519620 60519641 60519637 60519642 +
acgtgctttgcaacagcagtaa

SEQ ID NO: 204005 - DNA, 22 bp, Artificial Sequence
  Synthetic oligonucleotide; CTT chr2 60519628 60519649 60519645 60519650 +
tgcaacagcagtaagttgacca

SEQ ID NO: 204006 - DNA, 22 bp, Artificial Sequence
  Synthetic oligonucleotide; TTT chr2 60519629 60519650 60519646 60519651 +
gcaacagcagtaagttgaccac

SEQ ID NO: 204007 - DNA, 22 bp, Artificial Sequence
  Synthetic oligonucleotide; TTG chr2 60519630 60519651 60519647 60519652 +
caacagcagtaagttgaccact

SEQ ID NO: 204008 - DNA, 22 bp, Artificial Sequence
  Synthetic oligonucleotide; TTG chr2 60519646 60519667 60519663 60519668 +
accactggagaaagtgaggctg

SEQ ID NO: 204009 - DNA, 22 bp, Artificial Sequence
  Synthetic oligonucleotide; CTG chr2 60519653 60519674 60519670 60519675 +
gagaaagtgaggctggaaccac

SEQ ID NO: 204010 - DNA, 22 bp, Artificial Sequence
  Synthetic oligonucleotide; CTG chr2 60519668 60519689 60519685 60519690 +
gaaccactggaatcttgtagat

SEQ ID NO: 204011 - DNA, 22 bp, Artificial Sequence
  Synthetic oligonucleotide; CTG chr2 60519677 60519698 60519694 60519699 +
gaatcttgtagatttctgaggc

SEQ ID NO: 204012 - DNA, 22 bp, Artificial Sequence
  Synthetic oligonucleotide; CTT chr2 60519684 60519705 60519701 60519706 +
gtagatttctgaggccagttct

SEQ ID NO: 204013 - DNA, 22 bp, Artificial Sequence
  Synthetic oligonucleotide; TTG chr2 60519685 60519706 60519702 60519707 +
tagatttctgaggccagttctg

SEQ ID NO: 204014 - DNA, 22 bp, Artificial Sequence
  Synthetic oligonucleotide; TTT chr2 60519692 60519713 60519709 60519714 +
ctgaggccagttctgttctgac

SEQ ID NO: 204015 - DNA, 22 bp, Artificial Sequence
  Synthetic oligonucleotide; TTC chr2 60519693 60519714 60519710 60519715 +
tgaggccagttctgttctgaca

SEQ ID NO: 204016 - DNA, 22 bp, Artificial Sequence
  Synthetic oligonucleotide; CTG chr2 60519695 60519716 60519712 60519717 +
aggccagttctgttctgacaca

SEQ ID NO: 204017 - DNA, 22 bp, Artificial Sequence
  Synthetic oligonucleotide; TTC chr2 60519705 60519726 60519722 60519727 +
tgttctgacacatgcagctggg

SEQ ID NO: 204018 - DNA, 22 bp, Artificial Sequence
  Synthetic oligonucleotide; CTG chr2 60519707 60519728 60519724 60519729 +
ttctgacacatgcagctgggag

SEQ ID NO: 204019 - DNA, 22 bp, Artificial Sequence
  Synthetic oligonucleotide; TTC chr2 60519710 60519731 60519727 60519732 +
tgacacatgcagctgggagcca

SEQ ID NO: 204020 - DNA, 22 bp, Artificial Sequence
  Synthetic oligonucleotide; CTG chr2 60519712 60519733 60519729 60519734 +
acacatgcagctgggagccact

SEQ ID NO: 204021 - DNA, 22 bp, Artificial Sequence
  Synthetic oligonucleotide; CTG chr2 60519725 60519746 60519742 60519747 +
ggagccactggtttaggaattc

SEQ ID NO: 204022 - DNA, 22 bp, Artificial Sequence
  Synthetic oligonucleotide; CTG chr2 60519735 60519756 60519752 60519757 +
gtttaggaattcacgtgggcat

SEQ ID NO: 204023 - DNA, 22 bp, Artificial Sequence
  Synthetic oligonucleotide; TTT chr2 60519739 60519760 60519756 60519761 +
aggaattcacgtgggcatggga

SEQ ID NO: 204024 - DNA, 22 bp, Artificial Sequence
  Synthetic oligonucleotide; TTA chr2 60519740 60519761 60519757 60519762 +
ggaattcacgtgggcatgggac

SEQ ID NO: 204025 - DNA, 22 bp, Artificial Sequence
  Synthetic oligonucleotide; TTC chr2 60519747 60519768 60519764 60519769 +
acgtgggcatgggactgtgctt

SEQ ID NO: 204026 - DNA, 22 bp, Artificial Sequence
  Synthetic oligonucleotide; CTG chr2 60519764 60519785 60519781 60519786 +
tgcttattcagaaagggctccc

SEQ ID NO: 204027 - DNA, 22 bp, Artificial Sequence
  Synthetic oligonucleotide; CTT chr2 60519769 60519790 60519786 60519791 +
attcagaaagggctcccagtca

SEQ ID NO: 204028 - DNA, 22 bp, Artificial Sequence
  Synthetic oligonucleotide; TTA chr2 60519770 60519791 60519787 60519792 +
ttcagaaagggctcccagtcac

SEQ ID NO: 204029 - DNA, 22 bp, Artificial Sequence
  Synthetic oligonucleotide; TTC chr2 60519773 60519794 60519790 60519795 +
agaaagggctcccagtcacatc

SEQ ID NO: 204030 - DNA, 22 bp, Artificial Sequence
  Synthetic oligonucleotide; CTC chr2 60519784 60519805 60519801 60519806 +
ccagtcacatcctgtattctcc

SEQ ID NO: 204031 - DNA, 22 bp, Artificial Sequence
  Synthetic oligonucleotide; CTG chr2 60519798 60519819 60519815 60519820 +
tattctcctaaattactccaat

SEQ ID NO: 204032 - DNA, 22 bp, Artificial Sequence
  Synthetic oligonucleotide; TTC chr2 60519803 60519824 60519820 60519825 +
tcctaaattactccaatgacaa

SEQ ID NO: 204033 - DNA, 22 bp, Artificial Sequence
  Synthetic oligonucleotide; CTC chr2 60519805 60519826 60519822 60519827 +
ctaaattactccaatgacaaag

SEQ ID NO: 204034 - DNA, 22 bp, Artificial Sequence
  Synthetic oligonucleotide; CTA chr2 60519808 60519829 60519825 60519830 +
aattactccaatgacaaagaaa

SEQ ID NO: 204035 - DNA, 22 bp, Artificial Sequence
  Synthetic oligonucleotide; TTA chr2 60519813 60519834 60519830 60519835 +
ctccaatgacaaagaaaactca

SEQ ID NO: 204036 - DNA, 22 bp, Artificial Sequence
  Synthetic oligonucleotide; CTC chr2 60519816 60519837 60519833 60519838 +
caatgacaaagaaaactcagtg

SEQ ID NO: 204037 - DNA, 22 bp, Artificial Sequence
  Synthetic oligonucleotide; CTC chr2 60519834 60519855 60519851 60519856 +
agtgaagacaaagagatcgttt

SEQ ID NO: 204038 - DNA, 22 bp, Artificial Sequence
  Synthetic oligonucleotide; TTT chr2 60519856 60519877 60519873 60519878 +
tcataggcattgtcatttgcca

SEQ ID NO: 204039 - DNA, 22 bp, Artificial Sequence
  Synthetic oligonucleotide; TTT chr2 60519857 60519878 60519874 60519879 +
cataggcattgtcatttgccaa

SEQ ID NO: 204040 - DNA, 22 bp, Artificial Sequence
  Synthetic oligonucleotide; TTC chr2 60519858 60519879 60519875 60519880 +
ataggcattgtcatttgccaat

SEQ ID NO: 204041 - DNA, 22 bp, Artificial Sequence
  Synthetic oligonucleotide; TTG chr2 60519868 60519889 60519885 60519890 +
tcatttgccaatccataactca

SEQ ID NO: 204042 - DNA, 22 bp, Artificial Sequence
  Synthetic oligonucleotide; TTT chr2 60519874 60519895 60519891 60519896 +
gccaatccataactcaggaatt

SEQ ID NO: 204043 - DNA, 22 bp, Artificial Sequence
  Synthetic oligonucleotide; TTG chr2 60519875 60519896 60519892 60519897 +
ccaatccataactcaggaattc

SEQ ID NO: 204044 - DNA, 22 bp, Artificial Sequence
  Synthetic oligonucleotide; CTC chr2 60519889 60519910 60519906 60519911 +
aggaattcatggctatgcttgg

SEQ ID NO: 204045 - DNA, 22 bp, Artificial Sequence
  Synthetic oligonucleotide; TTC chr2 60519897 60519918 60519914 60519919 +
atggctatgcttggataattct

SEQ ID NO: 204046 - DNA, 22 bp, Artificial Sequence
  Synthetic oligonucleotide; CTA chr2 60519904 60519925 60519921 60519926 +
tgcttggataattctctctaga

SEQ ID NO: 204047 - DNA, 22 bp, Artificial Sequence
  Synthetic oligonucleotide; CTT chr2 60519909 60519930 60519926 60519931 +
ggataattctctctagacttgg

SEQ ID NO: 204048 - DNA, 22 bp, Artificial Sequence
  Synthetic oligonucleotide; TTG chr2 60519910 60519931 60519927 60519932 +
gataattctctctagacttgga

SEQ ID NO: 204049 - DNA, 22 bp, Artificial Sequence
  Synthetic oligonucleotide; TTC chr2 60519918 60519939 60519935 60519940 +
tctctagacttggagtgttaaa

SEQ ID NO: 204050 - DNA, 22 bp, Artificial Sequence
  Synthetic oligonucleotide; CTC chr2 60519920 60519941 60519937 60519942 +
tctagacttggagtgttaaaag

SEQ ID NO: 204051 - DNA, 22 bp, Artificial Sequence
  Synthetic oligonucleotide; CTC chr2 60519922 60519943 60519939 60519944 +
tagacttggagtgttaaaagtt

SEQ ID NO: 204052 - DNA, 22 bp, Artificial Sequence
  Synthetic oligonucleotide; CTA chr2 60519924 60519945 60519941 60519946 +
gacttggagtgttaaaagtttg

SEQ ID NO: 204053 - DNA, 22 bp, Artificial Sequence
  Synthetic oligonucleotide; CTT chr2 60519929 60519950 60519946 60519951 +
ggagtgttaaaagtttgcacct

SEQ ID NO: 204054 - DNA, 22 bp, Artificial Sequence
  Synthetic oligonucleotide; TTG chr2 60519930 60519951 60519947 60519952 +
gagtgttaaaagtttgcaccta

SEQ ID NO: 204055 - DNA, 22 bp, Artificial Sequence
  Synthetic oligonucleotide; TTA chr2 60519938 60519959 60519955 60519960 +
aaagtttgcacctagttattct

SEQ ID NO: 204056 - DNA, 22 bp, Artificial Sequence
  Synthetic oligonucleotide; TTT chr2 60519945 60519966 60519962 60519967 +
gcacctagttattctcccctct

SEQ ID NO: 204057 - DNA, 22 bp, Artificial Sequence
  Synthetic oligonucleotide; TTG chr2 60519946 60519967 60519963 60519968 +
cacctagttattctcccctctc

SEQ ID NO: 204058 - DNA, 22 bp, Artificial Sequence
  Synthetic oligonucleotide; CTA chr2 60519952 60519973 60519969 60519974 +
gttattctcccctctctctggc

SEQ ID NO: 204059 - DNA, 22 bp, Artificial Sequence
  Synthetic oligonucleotide; TTA chr2 60519956 60519977 60519973 60519978 +
ttctcccctctctctggcagga

SEQ ID NO: 204060 - DNA, 22 bp, Artificial Sequence
  Synthetic oligonucleotide; TTC chr2 60519959 60519980 60519976 60519981 +
tcccctctctctggcaggagaa

SEQ ID NO: 204061 - DNA, 22 bp, Artificial Sequence
  Synthetic oligonucleotide; CTC chr2 60519961 60519982 60519978 60519983 +
ccctctctctggcaggagaatc

SEQ ID NO: 204062 - DNA, 22 bp, Artificial Sequence
  Synthetic oligonucleotide; CTC chr2 60519966 60519987 60519983 60519988 +
tctctggcaggagaatcatgtc

SEQ ID NO: 204063 - DNA, 22 bp, Artificial Sequence
  Synthetic oligonucleotide; CTC chr2 60519968 60519989 60519985 60519990 +
tctggcaggagaatcatgtcac

SEQ ID NO: 204064 - DNA, 22 bp, Artificial Sequence
  Synthetic oligonucleotide; CTC chr2 60519970 60519991 60519987 60519992 +
tggcaggagaatcatgtcactg

SEQ ID NO: 204065 - DNA, 22 bp, Artificial Sequence
  Synthetic oligonucleotide; CTG chr2 60519972 60519993 60519989 60519994 +
gcaggagaatcatgtcactggc

SEQ ID NO: 204066 - DNA, 22 bp, Artificial Sequence
  Synthetic oligonucleotide; CTG chr2 60519992 60520013 60520009 60520014 +
gcaagcaattattgtatcctct

SEQ ID NO: 204067 - DNA, 22 bp, Artificial Sequence
  Synthetic oligonucleotide; TTA chr2 60520003 60520024 60520020 60520025 +
ttgtatcctcttcaaataattc

SEQ ID NO: 204068 - DNA, 22 bp, Artificial Sequence
  Synthetic oligonucleotide; TTG chr2 60520006 60520027 60520023 60520028 +
tatcctcttcaaataattcggc

SEQ ID NO: 204069 - DNA, 22 bp, Artificial Sequence
  Synthetic oligonucleotide; CTC chr2 60520013 60520034 60520030 60520035 +
ttcaaataattcggcctaaatt

SEQ ID NO: 204070 - DNA, 22 bp, Artificial Sequence
  Synthetic oligonucleotide; CTT chr2 60520015 60520036 60520032 60520037 +
caaataattcggcctaaatttt

SEQ ID NO: 204071 - DNA, 22 bp, Artificial Sequence
  Synthetic oligonucleotide; TTC chr2 60520016 60520037 60520033 60520038 +
aaataattcggcctaaattttc

SEQ ID NO: 204072 - DNA, 22 bp, Artificial Sequence
  Synthetic oligonucleotide; TTC chr2 60520025 60520046 60520042 60520047 +
ggcctaaattttcatttatgcc

SEQ ID NO: 204073 - DNA, 22 bp, Artificial Sequence
  Synthetic oligonucleotide; CTA chr2 60520031 60520052 60520048 60520053 +
aattttcatttatgcctgtgta

SEQ ID NO: 204074 - DNA, 22 bp, Artificial Sequence
  Synthetic oligonucleotide; TTT chr2 60520036 60520057 60520053 60520058 +
tcatttatgcctgtgtatttat

SEQ ID NO: 204075 - DNA, 22 bp, Artificial Sequence
  Synthetic oligonucleotide; TTT chr2 60520037 60520058 60520054 60520059 +
catttatgcctgtgtatttatg

SEQ ID NO: 204076 - DNA, 22 bp, Artificial Sequence
  Synthetic oligonucleotide; TTC chr2 60520038 60520059 60520055 60520060 +
atttatgcctgtgtatttatgc

SEQ ID NO: 204077 - DNA, 22 bp, Artificial Sequence
  Synthetic oligonucleotide; TTT chr2 60520042 60520063 60520059 60520064 +
atgcctgtgtatttatgcacaa

SEQ ID NO: 204078 - DNA, 22 bp, Artificial Sequence
  Synthetic oligonucleotide; TTA chr2 60520043 60520064 60520060 60520065 +
tgcctgtgtatttatgcacaaa

SEQ ID NO: 204079 - DNA, 22 bp, Artificial Sequence
  Synthetic oligonucleotide; CTG chr2 60520049 60520070 60520066 60520071 +
tgtatttatgcacaaatgtgtg

SEQ ID NO: 204080 - DNA, 22 bp, Artificial Sequence
  Synthetic oligonucleotide; TTT chr2 60520056 60520077 60520073 60520078 +
atgcacaaatgtgtgtatgata

SEQ ID NO: 204081 - DNA, 22 bp, Artificial Sequence
  Synthetic oligonucleotide; TTA chr2 60520057 60520078 60520074 60520079 +
tgcacaaatgtgtgtatgatat

SEQ ID NO: 204082 - DNA, 22 bp, Artificial Sequence
  Synthetic oligonucleotide; TTA chr2 60520086 60520107 60520103 60520108 +
tggcttctttttctgaaaattg

SEQ ID NO: 204083 - DNA, 22 bp, Artificial Sequence
  Synthetic oligonucleotide; CTT chr2 60520092 60520113 60520109 60520114 +
ctttttctgaaaattgaaaaat

SEQ ID NO: 204084 - DNA, 22 bp, Artificial Sequence
  Synthetic oligonucleotide; TTC chr2 60520093 60520114 60520110 60520115 +
tttttctgaaaattgaaaaatt

SEQ ID NO: 204085 - DNA, 22 bp, Artificial Sequence
  Synthetic oligonucleotide; CTT chr2 60520095 60520116 60520112 60520117 +
tttctgaaaattgaaaaattca

SEQ ID NO: 204086 - DNA, 22 bp, Artificial Sequence
  Synthetic oligonucleotide; TTT chr2 60520096 60520117 60520113 60520118 +
ttctgaaaattgaaaaattcag

SEQ ID NO: 204087 - DNA, 22 bp, Artificial Sequence
  Synthetic oligonucleotide; TTT chr2 60520097 60520118 60520114 60520119 +
tctgaaaattgaaaaattcaga

SEQ ID NO: 204088 - DNA, 22 bp, Artificial Sequence
  Synthetic oligonucleotide; TTT chr2 60520098 60520119 60520115 60520120 +
ctgaaaattgaaaaattcagaa

SEQ ID NO: 204089 - DNA, 22 bp, Artificial Sequence
  Synthetic oligonucleotide; TTC chr2 60520099 60520120 60520116 60520121 +
tgaaaattgaaaaattcagaaa

SEQ ID NO: 204090 - DNA, 22 bp, Artificial Sequence
  Synthetic oligonucleotide; CTG chr2 60520101 60520122 60520118 60520123 +
aaaattgaaaaattcagaaagc

SEQ ID NO: 204091 - DNA, 22 bp, Artificial Sequence
  Synthetic oligonucleotide; TTG chr2 60520108 60520129 60520125 60520130 +
aaaaattcagaaagccaaagat

SEQ ID NO: 204092 - DNA, 22 bp, Artificial Sequence
  Synthetic oligonucleotide; TTC chr2 60520116 60520137 60520133 60520138 +
agaaagccaaagataatagaat

SEQ ID NO: 204093 - DNA, 22 bp, Artificial Sequence
  Synthetic oligonucleotide; CTT chr2 60520145 60520166 60520162 60520167 +
gcgtggcaaggtatattgatta

SEQ ID NO: 204094 - DNA, 22 bp, Artificial Sequence
  Synthetic oligonucleotide; TTG chr2 60520146 60520167 60520163 60520168 +
cgtggcaaggtatattgattag

SEQ ID NO: 204095 - DNA, 22 bp, Artificial Sequence
  Synthetic oligonucleotide; TTG chr2 60520163 60520184 60520180 60520185 +
attaggtaggaatcaaaaataa

SEQ ID NO: 204096 - DNA, 22 bp, Artificial Sequence
  Synthetic oligonucleotide; TTA chr2 60520167 60520188 60520184 60520189 +
ggtaggaatcaaaaataattgc

SEQ ID NO: 204097 - DNA, 22 bp, Artificial Sequence
  Synthetic oligonucleotide; TTG chr2 60520188 60520209 60520205 60520210 +
caaaattatttatgcaggagta

SEQ ID NO: 204098 - DNA, 22 bp, Artificial Sequence
  Synthetic oligonucleotide; TTA chr2 60520196 60520217 60520213 60520218 +
tttatgcaggagtattaaaatt

SEQ ID NO: 204099 - DNA, 22 bp, Artificial Sequence
  Synthetic oligonucleotide; TTT chr2 60520199 60520220 60520216 60520221 +
atgcaggagtattaaaattttc

SEQ ID NO: 204100 - DNA, 22 bp, Artificial Sequence
  Synthetic oligonucleotide; TTA chr2 60520200 60520221 60520217 60520222 +
tgcaggagtattaaaattttcc

SEQ ID NO: 204101 - DNA, 22 bp, Artificial Sequence
  Synthetic oligonucleotide; TTA chr2 60520213 60520234 60520230 60520235 +
aaattttcctcaaaagttccca

SEQ ID NO: 204102 - DNA, 22 bp, Artificial Sequence
  Synthetic oligonucleotide; TTT chr2 60520219 60520240 60520236 60520241 +
tcctcaaaagttcccaggcaaa

SEQ ID NO: 204103 - DNA, 22 bp, Artificial Sequence
  Synthetic oligonucleotide; TTT chr2 60520220 60520241 60520237 60520242 +
cctcaaaagttcccaggcaaat

SEQ ID NO: 204104 - DNA, 22 bp, Artificial Sequence
  Synthetic oligonucleotide; TTC chr2 60520221 60520242 60520238 60520243 +
ctcaaaagttcccaggcaaatg

SEQ ID NO: 204105 - DNA, 22 bp, Artificial Sequence
  Synthetic oligonucleotide; CTC chr2 60520224 60520245 60520241 60520246 +
aaaagttcccaggcaaatgggt

SEQ ID NO: 204106 - DNA, 22 bp, Artificial Sequence
  Synthetic oligonucleotide; TTC chr2 60520232 60520253 60520249 60520254 +
ccaggcaaatgggttcctcttt

SEQ ID NO: 204107 - DNA, 22 bp, Artificial Sequence
  Synthetic oligonucleotide; TTC chr2 60520248 60520269 60520265 60520270 +
ctctttaattttcacccttaca

SEQ ID NO: 204108 - DNA, 22 bp, Artificial Sequence
  Synthetic oligonucleotide; CTC chr2 60520251 60520272 60520268 60520273 +
tttaattttcacccttacaata

SEQ ID NO: 204109 - DNA, 22 bp, Artificial Sequence
  Synthetic oligonucleotide; CTT chr2 60520253 60520274 60520270 60520275 +
taattttcacccttacaataaa

SEQ ID NO: 204110 - DNA, 22 bp, Artificial Sequence
  Synthetic oligonucleotide; TTT chr2 60520254 60520275 60520271 60520276 +
aattttcacccttacaataaac

SEQ ID NO: 204111 - DNA, 22 bp, Artificial Sequence
  Synthetic oligonucleotide; TTA chr2 60520255 60520276 60520272 60520277 +
attttcacccttacaataaact

SEQ ID NO: 204112 - DNA, 22 bp, Artificial Sequence
  Synthetic oligonucleotide; TTT chr2 60520259 60520280 60520276 60520281 +
tcacccttacaataaactcttc

SEQ ID NO: 204113 - DNA, 22 bp, Artificial Sequence
  Synthetic oligonucleotide; TTT chr2 60520260 60520281 60520277 60520282 +
cacccttacaataaactcttct

SEQ ID NO: 204114 - DNA, 22 bp, Artificial Sequence
  Synthetic oligonucleotide; TTC chr2 60520261 60520282 60520278 60520283 +
acccttacaataaactcttctg

SEQ ID NO: 204115 - DNA, 22 bp, Artificial Sequence
  Synthetic oligonucleotide; CTT chr2 60520267 60520288 60520284 60520289 +
acaataaactcttctgcaggtt

SEQ ID NO: 204116 - DNA, 22 bp, Artificial Sequence
  Synthetic oligonucleotide; TTA chr2 60520268 60520289 60520285 60520290 +
caataaactcttctgcaggttt

SEQ ID NO: 204117 - DNA, 22 bp, Artificial Sequence
  Synthetic oligonucleotide; CTC chr2 60520278 60520299 60520295 60520300 +
ttctgcaggttttgtttatttt

SEQ ID NO: 204118 - DNA, 22 bp, Artificial Sequence
  Synthetic oligonucleotide; CTT chr2 60520280 60520301 60520297 60520302 +
ctgcaggttttgtttattttga

SEQ ID NO: 204119 - DNA, 22 bp, Artificial Sequence
  Synthetic oligonucleotide; TTC chr2 60520281 60520302 60520298 60520303 +
tgcaggttttgtttattttgag

SEQ ID NO: 204120 - DNA, 22 bp, Artificial Sequence
  Synthetic oligonucleotide; CTG chr2 60520283 60520304 60520300 60520305 +
caggttttgtttattttgagga

SEQ ID NO: 204121 - DNA, 22 bp, Artificial Sequence
  Synthetic oligonucleotide; TTT chr2 60520290 60520311 60520307 60520312 +
tgtttattttgaggaaacattt

SEQ ID NO: 204122 - DNA, 22 bp, Artificial Sequence
  Synthetic oligonucleotide; TTT chr2 60520291 60520312 60520308 60520313 +
gtttattttgaggaaacatttc

SEQ ID NO: 204123 - DNA, 22 bp, Artificial Sequence
  Synthetic oligonucleotide; TTG chr2 60520292 60520313 60520309 60520314 +
tttattttgaggaaacatttca

SEQ ID NO: 204124 - DNA, 22 bp, Artificial Sequence
  Synthetic oligonucleotide; TTT chr2 60520295 60520316 60520312 60520317 +
attttgaggaaacatttcactt

SEQ ID NO: 204125 - DNA, 22 bp, Artificial Sequence
  Synthetic oligonucleotide; TTA chr2 60520296 60520317 60520313 60520318 +
ttttgaggaaacatttcacttt

SEQ ID NO: 204126 - DNA, 22 bp, Artificial Sequence
  Synthetic oligonucleotide; TTT chr2 60520299 60520320 60520316 60520321 +
tgaggaaacatttcactttttt

SEQ ID NO: 204127 - DNA, 22 bp, Artificial Sequence
  Synthetic oligonucleotide; TTT chr2 60520300 60520321 60520317 60520322 +
gaggaaacatttcacttttttt

SEQ ID NO: 204128 - DNA, 22 bp, Artificial Sequence
  Synthetic oligonucleotide; TTG chr2 60520301 60520322 60520318 60520323 +
aggaaacatttcactttttttt

SEQ ID NO: 204129 - DNA, 22 bp, Artificial Sequence
  Synthetic oligonucleotide; TTT chr2 60520312 60520333 60520329 60520334 +
cactttttttttcaagacatga

SEQ ID NO: 204130 - DNA, 22 bp, Artificial Sequence
  Synthetic oligonucleotide; TTC chr2 60520313 60520334 60520330 60520335 +
actttttttttcaagacatgag

SEQ ID NO: 204131 - DNA, 22 bp, Artificial Sequence
  Synthetic oligonucleotide; CTT chr2 60520317 60520338 60520334 60520339 +
tttttttcaagacatgaggtgt

SEQ ID NO: 204132 - DNA, 22 bp, Artificial Sequence
  Synthetic oligonucleotide; TTT chr2 60520318 60520339 60520335 60520340 +
ttttttcaagacatgaggtgtg

SEQ ID NO: 204133 - DNA, 22 bp, Artificial Sequence
  Synthetic oligonucleotide; TTT chr2 60520319 60520340 60520336 60520341 +
tttttcaagacatgaggtgtga

SEQ ID NO: 204134 - DNA, 22 bp, Artificial Sequence
  Synthetic oligonucleotide; TTT chr2 60520320 60520341 60520337 60520342 +
ttttcaagacatgaggtgtgaa

SEQ ID NO: 204135 - DNA, 22 bp, Artificial Sequence
  Synthetic oligonucleotide; TTT chr2 60520321 60520342 60520338 60520343 +
tttcaagacatgaggtgtgaat

SEQ ID NO: 204136 - DNA, 22 bp, Artificial Sequence
  Synthetic oligonucleotide; TTT chr2 60520322 60520343 60520339 60520344 +
ttcaagacatgaggtgtgaatg

SEQ ID NO: 204137 - DNA, 22 bp, Artificial Sequence
  Synthetic oligonucleotide; TTT chr2 60520323 60520344 60520340 60520345 +
tcaagacatgaggtgtgaatga

SEQ ID NO: 204138 - DNA, 22 bp, Artificial Sequence
  Synthetic oligonucleotide; TTT chr2 60520324 60520345 60520341 60520346 +
caagacatgaggtgtgaatgat

SEQ ID NO: 204139 - DNA, 22 bp, Artificial Sequence
  Synthetic oligonucleotide; TTC chr2 60520325 60520346 60520342 60520347 +
aagacatgaggtgtgaatgatg

SEQ ID NO: 204140 - DNA, 22 bp, Artificial Sequence
  Synthetic oligonucleotide; TTT chr2 60520360 60520381 60520377 60520382 +
ggatatgtaaactgaattattt

SEQ ID NO: 204141 - DNA, 22 bp, Artificial Sequence
  Synthetic oligonucleotide; TTG chr2 60520361 60520382 60520378 60520383 +
gatatgtaaactgaattatttg

SEQ ID NO: 204142 - DNA, 22 bp, Artificial Sequence
  Synthetic oligonucleotide; CTG chr2 60520374 60520395 60520391 60520396 +
aattatttgcataatgcattac

SEQ ID NO: 204143 - DNA, 22 bp, Artificial Sequence
  Synthetic oligonucleotide; TTA chr2 60520379 60520400 60520396 60520401 +
tttgcataatgcattactaatc

SEQ ID NO: 204144 - DNA, 22 bp, Artificial Sequence
  Synthetic oligonucleotide; TTT chr2 60520382 60520403 60520399 60520404 +
gcataatgcattactaatcagt

SEQ ID NO: 204145 - DNA, 22 bp, Artificial Sequence
  Synthetic oligonucleotide; TTG chr2 60520383 60520404 60520400 60520405 +
cataatgcattactaatcagtg

SEQ ID NO: 204146 - DNA, 22 bp, Artificial Sequence
  Synthetic oligonucleotide; TTA chr2 60520395 60520416 60520412 60520417 +
ctaatcagtgagtataaattct

SEQ ID NO: 204147 - DNA, 22 bp, Artificial Sequence
  Synthetic oligonucleotide; CTA chr2 60520398 60520419 60520415 60520420 +
atcagtgagtataaattctgga

SEQ ID NO: 204148 - DNA, 22 bp, Artificial Sequence
  Synthetic oligonucleotide; TTC chr2 60520416 60520437 60520433 60520438 +
tggagtctgaggacctgaaatc

SEQ ID NO: 204149 - DNA, 22 bp, Artificial Sequence
  Synthetic oligonucleotide; CTG chr2 60520418 60520439 60520435 60520440 +
gagtctgaggacctgaaatcaa

SEQ ID NO: 204150 - DNA, 22 bp, Artificial Sequence
  Synthetic oligonucleotide; CTG chr2 60520425 60520446 60520442 60520447 +
aggacctgaaatcaagtgccac

SEQ ID NO: 204151 - DNA, 22 bp, Artificial Sequence
  Synthetic oligonucleotide; CTG chr2 60520433 60520454 60520450 60520455 +
aaatcaagtgccaccaaatttt

SEQ ID NO: 204152 - DNA, 22 bp, Artificial Sequence
  Synthetic oligonucleotide; TTT chr2 60520454 60520475 60520471 60520476 +
tttaaaatctagattataaaag

SEQ ID NO: 204153 - DNA, 22 bp, Artificial Sequence
  Synthetic oligonucleotide; TTT chr2 60520455 60520476 60520472 60520477 +
ttaaaatctagattataaaagt

SEQ ID NO: 204154 - DNA, 22 bp, Artificial Sequence
  Synthetic oligonucleotide; TTT chr2 60520456 60520477 60520473 60520478 +
taaaatctagattataaaagta

SEQ ID NO: 204155 - DNA, 22 bp, Artificial Sequence
  Synthetic oligonucleotide; TTT chr2 60520457 60520478 60520474 60520479 +
aaaatctagattataaaagtaa

SEQ ID NO: 204156 - DNA, 22 bp, Artificial Sequence
  Synthetic oligonucleotide; TTA chr2 60520458 60520479 60520475 60520480 +
aaatctagattataaaagtaaa

SEQ ID NO: 204157 - DNA, 22 bp, Artificial Sequence
  Synthetic oligonucleotide; CTA chr2 60520465 60520486 60520482 60520487 +
gattataaaagtaaagagcatc

SEQ ID NO: 204158 - DNA, 22 bp, Artificial Sequence
  Synthetic oligonucleotide; TTA chr2 60520470 60520491 60520487 60520492 +
taaaagtaaagagcatcaccct

SEQ ID NO: 204159 - DNA, 22 bp, Artificial Sequence
  Synthetic oligonucleotide; CTT chr2 60520493 60520514 60520510 60520515 +
cggtgggataatgtacacattt

SEQ ID NO: 204160 - DNA, 22 bp, Artificial Sequence
  Synthetic oligonucleotide; TTC chr2 60520494 60520515 60520511 60520516 +
ggtgggataatgtacacatttg

SEQ ID NO: 204161 - DNA, 22 bp, Artificial Sequence
  Synthetic oligonucleotide; TTT chr2 60520515 60520536 60520532 60520537 +
gtgtacacattcgcattccgtt

SEQ ID NO: 204162 - DNA, 22 bp, Artificial Sequence
  Synthetic oligonucleotide; TTG chr2 60520516 60520537 60520533 60520538 +
tgtacacattcgcattccgttt

SEQ ID NO: 204163 - DNA, 22 bp, Artificial Sequence
  Synthetic oligonucleotide; TTC chr2 60520527 60520548 60520544 60520549 +
gcattccgtttataagaaggag

SEQ ID NO: 204164 - DNA, 22 bp, Artificial Sequence
  Synthetic oligonucleotide; TTC chr2 60520533 60520554 60520550 60520555 +
cgtttataagaaggagaaatta

SEQ ID NO: 204165 - DNA, 22 bp, Artificial Sequence
  Synthetic oligonucleotide; TTT chr2 60520538 60520559 60520555 60520560 +
ataagaaggagaaattatcctc

SEQ ID NO: 204166 - DNA, 22 bp, Artificial Sequence
  Synthetic oligonucleotide; TTA chr2 60520539 60520560 60520556 60520561 +
taagaaggagaaattatcctca

SEQ ID NO: 204167 - DNA, 22 bp, Artificial Sequence
  Synthetic oligonucleotide; TTA chr2 60520555 60520576 60520572 60520577 +
tcctcacagagttttctgagga

SEQ ID NO: 204168 - DNA, 22 bp, Artificial Sequence
  Synthetic oligonucleotide; CTC chr2 60520560 60520581 60520577 60520582 +
acagagttttctgaggaaaatt

SEQ ID NO: 204169 - DNA, 22 bp, Artificial Sequence
  Synthetic oligonucleotide; TTT chr2 60520569 60520590 60520586 60520591 +
tctgaggaaaattaaataagtg

SEQ ID NO: 204170 - DNA, 22 bp, Artificial Sequence
  Synthetic oligonucleotide; TTT chr2 60520570 60520591 60520587 60520592 +
ctgaggaaaattaaataagtgg

SEQ ID NO: 204171 - DNA, 22 bp, Artificial Sequence
  Synthetic oligonucleotide; TTC chr2 60520571 60520592 60520588 60520593 +
tgaggaaaattaaataagtggc

SEQ ID NO: 204172 - DNA, 22 bp, Artificial Sequence
  Synthetic oligonucleotide; CTG chr2 60520573 60520594 60520590 60520595 +
aggaaaattaaataagtggcct

SEQ ID NO: 204173 - DNA, 22 bp, Artificial Sequence
  Synthetic oligonucleotide; TTA chr2 60520583 60520604 60520600 60520605 +
aataagtggcctttgatgtaaa

SEQ ID NO: 204174 - DNA, 22 bp, Artificial Sequence
  Synthetic oligonucleotide; CTT chr2 60520596 60520617 60520613 60520618 +
tgatgtaaactgttttgctctg

SEQ ID NO: 204175 - DNA, 22 bp, Artificial Sequence
  Synthetic oligonucleotide; TTT chr2 60520597 60520618 60520614 60520619 +
gatgtaaactgttttgctctga

SEQ ID NO: 204176 - DNA, 22 bp, Artificial Sequence
  Synthetic oligonucleotide; TTG chr2 60520598 60520619 60520615 60520620 +
atgtaaactgttttgctctgac

SEQ ID NO: 204177 - DNA, 22 bp, Artificial Sequence
  Synthetic oligonucleotide; CTG chr2 60520608 60520629 60520625 60520630 +
ttttgctctgactcaacactat

SEQ ID NO: 204178 - DNA, 22 bp, Artificial Sequence
  Synthetic oligonucleotide; TTT chr2 60520611 60520632 60520628 60520633 +
tgctctgactcaacactatgag

SEQ ID NO: 204179 - DNA, 22 bp, Artificial Sequence
  Synthetic oligonucleotide; TTT chr2 60520612 60520633 60520629 60520634 +
gctctgactcaacactatgagg

SEQ ID NO: 204180 - DNA, 22 bp, Artificial Sequence
  Synthetic oligonucleotide; TTG chr2 60520613 60520634 60520630 60520635 +
ctctgactcaacactatgaggc

SEQ ID NO: 204181 - DNA, 22 bp, Artificial Sequence
  Synthetic oligonucleotide; CTC chr2 60520616 60520637 60520633 60520638 +
tgactcaacactatgaggcata

SEQ ID NO: 204182 - DNA, 22 bp, Artificial Sequence
  Synthetic oligonucleotide; CTG chr2 60520618 60520639 60520635 60520640 +
actcaacactatgaggcataag

SEQ ID NO: 204183 - DNA, 22 bp, Artificial Sequence
  Synthetic oligonucleotide; CTC chr2 60520622 60520643 60520639 60520644 +
aacactatgaggcataaggtcc

SEQ ID NO: 204184 - DNA, 22 bp, Artificial Sequence
  Synthetic oligonucleotide; CTA chr2 60520629 60520650 60520646 60520651 +
tgaggcataaggtcctaaattc

SEQ ID NO: 204185 - DNA, 22 bp, Artificial Sequence
  Synthetic oligonucleotide; CTA chr2 60520646 60520667 60520663 60520668 +
aattcataggcacaaccacaga

SEQ ID NO: 204186 - DNA, 22 bp, Artificial Sequence
  Synthetic oligonucleotide; TTC chr2 60520651 60520672 60520668 60520673 +
ataggcacaaccacagaagcac

SEQ ID NO: 204187 - DNA, 22 bp, Artificial Sequence
  Synthetic oligonucleotide; TTT chr2 60520693 60520714 60520710 60520715 +
gcatcaaaaagagcagacagtc

SEQ ID NO: 204188 - DNA, 22 bp, Artificial Sequence
  Synthetic oligonucleotide; TTG chr2 60520694 60520715 60520711 60520716 +
catcaaaaagagcagacagtcc

SEQ ID NO: 204189 - DNA, 22 bp, Artificial Sequence
  Synthetic oligonucleotide; TTG chr2 60520736 60520757 60520753 60520758 +
gtcgcctacggaatctacagga

SEQ ID NO: 204190 - DNA, 22 bp, Artificial Sequence
  Synthetic oligonucleotide; CTA chr2 60520744 60520765 60520761 60520766 +
cggaatctacaggaatctgaag

SEQ ID NO: 204191 - DNA, 22 bp, Artificial Sequence
  Synthetic oligonucleotide; CTA chr2 60520753 60520774 60520770 60520775 +
caggaatctgaaggggcagcca

SEQ ID NO: 204192 - DNA, 22 bp, Artificial Sequence
  Synthetic oligonucleotide; CTG chr2 60520763 60520784 60520780 60520785 +
aaggggcagccagacattctgc

SEQ ID NO: 204193 - DNA, 22 bp, Artificial Sequence
  Synthetic oligonucleotide; TTC chr2 60520782 60520803 60520799 60520804 +
tgcctataccacccatcagatc

SEQ ID NO: 204194 - DNA, 22 bp, Artificial Sequence
  Synthetic oligonucleotide; CTG chr2 60520784 60520805 60520801 60520806 +
cctataccacccatcagatcag

SEQ ID NO: 204195 - DNA, 22 bp, Artificial Sequence
  Synthetic oligonucleotide; CTA chr2 60520788 60520809 60520805 60520810 +
taccacccatcagatcagccac

SEQ ID NO: 204196 - DNA, 22 bp, Artificial Sequence
  Synthetic oligonucleotide; CTT chr2 60520839 60520860 60520856 60520861 +
ctccagtgggttcccaccggtg

SEQ ID NO: 204197 - DNA, 22 bp, Artificial Sequence
  Synthetic oligonucleotide; TTC chr2 60520840 60520861 60520857 60520862 +
tccagtgggttcccaccggtgt

SEQ ID NO: 204198 - DNA, 22 bp, Artificial Sequence
  Synthetic oligonucleotide; CTC chr2 60520842 60520863 60520859 60520864 +
cagtgggttcccaccggtgttt

SEQ ID NO: 204199 - DNA, 22 bp, Artificial Sequence
  Synthetic oligonucleotide; TTC chr2 60520852 60520873 60520869 60520874 +
ccaccggtgttttcgtgcaagc

SEQ ID NO: 204200 - DNA, 22 bp, Artificial Sequence
  Synthetic oligonucleotide; TTT chr2 60520864 60520885 60520881 60520886 +
tcgtgcaagcttagccccttct

SEQ ID NO: 204201 - DNA, 22 bp, Artificial Sequence
  Synthetic oligonucleotide; TTT chr2 60520865 60520886 60520882 60520887 +
cgtgcaagcttagccccttctt

SEQ ID NO: 204202 - DNA, 22 bp, Artificial Sequence
  Synthetic oligonucleotide; TTC chr2 60520866 60520887 60520883 60520888 +
gtgcaagcttagccccttcttt

SEQ ID NO: 204203 - DNA, 22 bp, Artificial Sequence
  Synthetic oligonucleotide; CTT chr2 60520876 60520897 60520893 60520898 +
agccccttctttgcagaaaaaa

SEQ ID NO: 204204 - DNA, 22 bp, Artificial Sequence
  Synthetic oligonucleotide; TTA chr2 60520877 60520898 60520894 60520899 +
gccccttctttgcagaaaaaaa

SEQ ID NO: 204205 - DNA, 22 bp, Artificial Sequence
  Synthetic oligonucleotide; CTT chr2 60520884 60520905 60520901 60520906 +
ctttgcagaaaaaaagatattg

SEQ ID NO: 204206 - DNA, 22 bp, Artificial Sequence
  Synthetic oligonucleotide; TTC chr2 60520885 60520906 60520902 60520907 +
tttgcagaaaaaaagatattga

SEQ ID NO: 204207 - DNA, 22 bp, Artificial Sequence
  Synthetic oligonucleotide; CTT chr2 60520887 60520908 60520904 60520909 +
tgcagaaaaaaagatattgatg

SEQ ID NO: 204208 - DNA, 22 bp, Artificial Sequence
  Synthetic oligonucleotide; TTT chr2 60520888 60520909 60520905 60520910 +
gcagaaaaaaagatattgatgt

SEQ ID NO: 204209 - DNA, 22 bp, Artificial Sequence
  Synthetic oligonucleotide; TTG chr2 60520889 60520910 60520906 60520911 +
cagaaaaaaagatattgatgtg

SEQ ID NO: 204210 - DNA, 22 bp, Artificial Sequence
  Synthetic oligonucleotide; TTG chr2 60520906 60520927 60520923 60520928 +
atgtgccaacagtagaaagaag

SEQ ID NO: 204211 - DNA, 22 bp, Artificial Sequence
  Synthetic oligonucleotide; TTA chr2 60520937 60520958 60520954 60520959 +
ttccagctctgtacacaacctt

SEQ ID NO: 204212 - DNA, 22 bp, Artificial Sequence
  Synthetic oligonucleotide; TTC chr2 60520940 60520961 60520957 60520962 +
cagctctgtacacaacctttgt

SEQ ID NO: 204213 - DNA, 22 bp, Artificial Sequence
  Synthetic oligonucleotide; CTC chr2 60520946 60520967 60520963 60520968 +
tgtacacaacctttgtcaaccc

SEQ ID NO: 204214 - DNA, 22 bp, Artificial Sequence
  Synthetic oligonucleotide; CTG chr2 60520948 60520969 60520965 60520970 +
tacacaacctttgtcaacccag

SEQ ID NO: 204215 - DNA, 22 bp, Artificial Sequence
  Synthetic oligonucleotide; CTT chr2 60520959 60520980 60520976 60520981 +
tgtcaacccagcatgataaaac

SEQ ID NO: 204216 - DNA, 22 bp, Artificial Sequence
  Synthetic oligonucleotide; TTT chr2 60520960 60520981 60520977 60520982 +
gtcaacccagcatgataaaacc

SEQ ID NO: 204217 - DNA, 22 bp, Artificial Sequence
  Synthetic oligonucleotide; TTG chr2 60520961 60520982 60520978 60520983 +
tcaacccagcatgataaaacca

SEQ ID NO: 204218 - DNA, 22 bp, Artificial Sequence
  Synthetic oligonucleotide; CTG chr2 60520989 60521010 60521006 60521011 +
ggaaactatttgtctaaacact

SEQ ID NO: 204219 - DNA, 22 bp, Artificial Sequence
  Synthetic oligonucleotide; CTA chr2 60520997 60521018 60521014 60521019 +
tttgtctaaacactttttggaa

SEQ ID NO: 204220 - DNA, 22 bp, Artificial Sequence
  Synthetic oligonucleotide; TTT chr2 60521000 60521021 60521017 60521022 +
gtctaaacactttttggaaagg

SEQ ID NO: 204221 - DNA, 22 bp, Artificial Sequence
  Synthetic oligonucleotide; TTG chr2 60521001 60521022 60521018 60521023 +
tctaaacactttttggaaaggg

SEQ ID NO: 204222 - DNA, 22 bp, Artificial Sequence
  Synthetic oligonucleotide; CTA chr2 60521005 60521026 60521022 60521027 +
aacactttttggaaagggatga

SEQ ID NO: 204223 - DNA, 22 bp, Artificial Sequence
  Synthetic oligonucleotide; CTT chr2 60521012 60521033 60521029 60521034 +
tttggaaagggatgaaatggag

SEQ ID NO: 204224 - DNA, 22 bp, Artificial Sequence
  Synthetic oligonucleotide; TTT chr2 60521013 60521034 60521030 60521035 +
ttggaaagggatgaaatggaga

SEQ ID NO: 204225 - DNA, 22 bp, Artificial Sequence
  Synthetic oligonucleotide; TTT chr2 60521014 60521035 60521031 60521036 +
tggaaagggatgaaatggagag

SEQ ID NO: 204226 - DNA, 22 bp, Artificial Sequence
  Synthetic oligonucleotide; TTT chr2 60521015 60521036 60521032 60521037 +
ggaaagggatgaaatggagagg

SEQ ID NO: 204227 - DNA, 22 bp, Artificial Sequence
  Synthetic oligonucleotide; TTG chr2 60521016 60521037 60521033 60521038 +
gaaagggatgaaatggagagga

SEQ ID NO: 204228 - DNA, 22 bp, Artificial Sequence
  Synthetic oligonucleotide; CTA chr2 60521060 60521081 60521077 60521082 +
gtggtcagcacacacacacaca

SEQ ID NO: 204229 - DNA, 22 bp, Artificial Sequence
  Synthetic oligonucleotide; CTC chr2 60521103 60521124 60521120 60521125 +
acacacacacacacacacacac

SEQ ID NO: 204230 - DNA, 22 bp, Artificial Sequence
  Synthetic oligonucleotide; CTC chr2 60521127 60521148 60521144 60521149 +
acacaaatccttgagggtgcca

SEQ ID NO: 204231 - DNA, 22 bp, Artificial Sequence
  Synthetic oligonucleotide; CTT chr2 60521139 60521160 60521156 60521161 +
gagggtgccaggttacatttct

SEQ ID NO: 204232 - DNA, 22 bp, Artificial Sequence
  Synthetic oligonucleotide; TTG chr2 60521140 60521161 60521157 60521162 +
agggtgccaggttacatttcta

SEQ ID NO: 204233 - DNA, 22 bp, Artificial Sequence
  Synthetic oligonucleotide; TTA chr2 60521154 60521175 60521171 60521176 +
catttctacaacagctgccttc

SEQ ID NO: 204234 - DNA, 22 bp, Artificial Sequence
  Synthetic oligonucleotide; TTT chr2 60521159 60521180 60521176 60521181 +
ctacaacagctgccttccattg

SEQ ID NO: 204235 - DNA, 22 bp, Artificial Sequence
  Synthetic oligonucleotide; TTC chr2 60521160 60521181 60521177 60521182 +
tacaacagctgccttccattgt

SEQ ID NO: 204236 - DNA, 22 bp, Artificial Sequence
  Synthetic oligonucleotide; CTA chr2 60521162 60521183 60521179 60521184 +
caacagctgccttccattgtct

SEQ ID NO: 204237 - DNA, 22 bp, Artificial Sequence
  Synthetic oligonucleotide; CTG chr2 60521171 60521192 60521188 60521193 +
ccttccattgtctactgccagt

SEQ ID NO: 204238 - DNA, 22 bp, Artificial Sequence
  Synthetic oligonucleotide; CTT chr2 60521175 60521196 60521192 60521197 +
ccattgtctactgccagtgaag

SEQ ID NO: 204239 - DNA, 22 bp, Artificial Sequence
  Synthetic oligonucleotide; TTC chr2 60521176 60521197 60521193 60521198 +
cattgtctactgccagtgaagc

SEQ ID NO: 204240 - DNA, 22 bp, Artificial Sequence
  Synthetic oligonucleotide; TTG chr2 60521181 60521202 60521198 60521203 +
tctactgccagtgaagccaaac

SEQ ID NO: 204241 - DNA, 22 bp, Artificial Sequence
  Synthetic oligonucleotide; CTA chr2 60521185 60521206 60521202 60521207 +
ctgccagtgaagccaaaccagc

SEQ ID NO: 204242 - DNA, 22 bp, Artificial Sequence
  Synthetic oligonucleotide; CTG chr2 60521188 60521209 60521205 60521210 +
ccagtgaagccaaaccagccta

SEQ ID NO: 204243 - DNA, 22 bp, Artificial Sequence
  Synthetic oligonucleotide; CTA chr2 60521210 60521231 60521227 60521232 +
aaatttaatttaatctgctgta

SEQ ID NO: 204244 - DNA, 22 bp, Artificial Sequence
  Synthetic oligonucleotide; TTT chr2 60521216 60521237 60521233 60521238 +
aatttaatctgctgtaaaccca

SEQ ID NO: 204245 - DNA, 22 bp, Artificial Sequence
  Synthetic oligonucleotide; TTA chr2 60521217 60521238 60521234 60521239 +
atttaatctgctgtaaacccaa

SEQ ID NO: 204246 - DNA, 22 bp, Artificial Sequence
  Synthetic oligonucleotide; TTT chr2 60521221 60521242 60521238 60521243 +
aatctgctgtaaacccaagtat

SEQ ID NO: 204247 - DNA, 22 bp, Artificial Sequence
  Synthetic oligonucleotide; TTA chr2 60521222 60521243 60521239 60521244 +
atctgctgtaaacccaagtatc

SEQ ID NO: 204248 - DNA, 22 bp, Artificial Sequence
  Synthetic oligonucleotide; CTG chr2 60521227 60521248 60521244 60521249 +
ctgtaaacccaagtatcaggca

SEQ ID NO: 204249 - DNA, 22 bp, Artificial Sequence
  Synthetic oligonucleotide; CTG chr2 60521230 60521251 60521247 60521252 +
taaacccaagtatcaggcactt

SEQ ID NO: 204250 - DNA, 22 bp, Artificial Sequence
  Synthetic oligonucleotide; CTT chr2 60521252 60521273 60521269 60521274 +
agatggcagctaaaagcgccac

SEQ ID NO: 204251 - DNA, 22 bp, Artificial Sequence
  Synthetic oligonucleotide; TTA chr2 60521253 60521274 60521270 60521275 +
gatggcagctaaaagcgccact

SEQ ID NO: 204252 - DNA, 22 bp, Artificial Sequence
  Synthetic oligonucleotide; CTA chr2 60521264 60521285 60521281 60521286 +
aaagcgccactctcagataact

SEQ ID NO: 204253 - DNA, 22 bp, Artificial Sequence
  Synthetic oligonucleotide; CTC chr2 60521276 60521297 60521293 60521298 +
tcagataactgagtgacacttg

SEQ ID NO: 204254 - DNA, 22 bp, Artificial Sequence
  Synthetic oligonucleotide; CTC chr2 60521278 60521299 60521295 60521300 +
agataactgagtgacacttgct

SEQ ID NO: 204255 - DNA, 22 bp, Artificial Sequence
  Synthetic oligonucleotide; CTG chr2 60521287 60521308 60521304 60521309 +
agtgacacttgctaataatagc

SEQ ID NO: 204256 - DNA, 22 bp, Artificial Sequence
  Synthetic oligonucleotide; CTT chr2 60521297 60521318 60521314 60521319 +
gctaataatagcctctgtgtga

SEQ ID NO: 204257 - DNA, 22 bp, Artificial Sequence
  Synthetic oligonucleotide; TTG chr2 60521298 60521319 60521315 60521320 +
ctaataatagcctctgtgtgaa

SEQ ID NO: 204258 - DNA, 22 bp, Artificial Sequence
  Synthetic oligonucleotide; CTA chr2 60521301 60521322 60521318 60521323 +
ataatagcctctgtgtgaagcg

SEQ ID NO: 204259 - DNA, 22 bp, Artificial Sequence
  Synthetic oligonucleotide; CTC chr2 60521312 60521333 60521329 60521334 +
tgtgtgaagcgagagagagcgg

SEQ ID NO: 204260 - DNA, 22 bp, Artificial Sequence
  Synthetic oligonucleotide; CTG chr2 60521314 60521335 60521331 60521336 +
tgtgaagcgagagagagcggac

SEQ ID NO: 204261 - DNA, 22 bp, Artificial Sequence
  Synthetic oligonucleotide; TTT chr2 60521340 60521361 60521357 60521362 +
tgtaaaaccagagggacccggg

SEQ ID NO: 204262 - DNA, 22 bp, Artificial Sequence
  Synthetic oligonucleotide; TTT chr2 60521341 60521362 60521358 60521363 +
gtaaaaccagagggacccgggc

SEQ ID NO: 204263 - DNA, 22 bp, Artificial Sequence
  Synthetic oligonucleotide; TTG chr2 60521342 60521363 60521359 60521364 +
taaaaccagagggacccgggcc

SEQ ID NO: 204264 - DNA, 22 bp, Artificial Sequence
  Synthetic oligonucleotide; CTG chr2 60521366 60521387 60521383 60521388 +
ggcctgggcctgggtctgggaa

SEQ ID NO: 204265 - DNA, 22 bp, Artificial Sequence
  Synthetic oligonucleotide; CTG chr2 60521372 60521393 60521389 60521394 +
ggcctgggtctgggaatggtgt

SEQ ID NO: 204266 - DNA, 22 bp, Artificial Sequence
  Synthetic oligonucleotide; CTG chr2 60521378 60521399 60521395 60521400 +
ggtctgggaatggtgtgatgtg

SEQ ID NO: 204267 - DNA, 22 bp, Artificial Sequence
  Synthetic oligonucleotide; CTG chr2 60521384 60521405 60521401 60521406 +
ggaatggtgtgatgtggttagg

SEQ ID NO: 204268 - DNA, 22 bp, Artificial Sequence
  Synthetic oligonucleotide; TTA chr2 60521404 60521425 60521421 60521426 +
ggccagtctcagcttccaggca

SEQ ID NO: 204269 - DNA, 22 bp, Artificial Sequence
  Synthetic oligonucleotide; CTC chr2 60521414 60521435 60521431 60521436 +
agcttccaggcagcagatacgg

SEQ ID NO: 204270 - DNA, 22 bp, Artificial Sequence
  Synthetic oligonucleotide; CTT chr2 60521419 60521440 60521436 60521441 +
ccaggcagcagatacggcagag

SEQ ID NO: 204271 - DNA, 22 bp, Artificial Sequence
  Synthetic oligonucleotide; TTC chr2 60521420 60521441 60521437 60521442 +
caggcagcagatacggcagaga

SEQ ID NO: 204272 - DNA, 22 bp, Artificial Sequence
  Synthetic oligonucleotide; CTC chr2 60521460 60521481 60521477 60521482 +
ccctgtgacgggctgcacgaag

SEQ ID NO: 204273 - DNA, 22 bp, Artificial Sequence
  Synthetic oligonucleotide; CTG chr2 60521465 60521486 60521482 60521487 +
tgacgggctgcacgaagcccac

SEQ ID NO: 204274 - DNA, 22 bp, Artificial Sequence
  Synthetic oligonucleotide; CTG chr2 60521475 60521496 60521492 60521497 +
cacgaagcccaccagtgaccta

SEQ ID NO: 204275 - DNA, 22 bp, Artificial Sequence
  Synthetic oligonucleotide; CTA chr2 60521497 60521518 60521514 60521519 +
gctttcaagtcacacagcgaca

SEQ ID NO: 204276 - DNA, 22 bp, Artificial Sequence
  Synthetic oligonucleotide; CTT chr2 60521501 60521522 60521518 60521523 +
tcaagtcacacagcgacagtcc

SEQ ID NO: 204277 - DNA, 22 bp, Artificial Sequence
  Synthetic oligonucleotide; TTT chr2 60521502 60521523 60521519 60521524 +
caagtcacacagcgacagtcct

SEQ ID NO: 204278 - DNA, 22 bp, Artificial Sequence
  Synthetic oligonucleotide; TTC chr2 60521503 60521524 60521520 60521525 +
aagtcacacagcgacagtcctg

SEQ ID NO: 204279 - DNA, 22 bp, Artificial Sequence
  Synthetic oligonucleotide; CTG chr2 60521525 60521546 60521542 60521547 +
gcttttgctatctagaagaaca

SEQ ID NO: 204280 - DNA, 22 bp, Artificial Sequence
  Synthetic oligonucleotide; CTT chr2 60521529 60521550 60521546 60521551 +
ttgctatctagaagaacaaaat

SEQ ID NO: 204281 - DNA, 22 bp, Artificial Sequence
  Synthetic oligonucleotide; TTT chr2 60521530 60521551 60521547 60521552 +
tgctatctagaagaacaaaatt

SEQ ID NO: 204282 - DNA, 22 bp, Artificial Sequence
  Synthetic oligonucleotide; TTT chr2 60521531 60521552 60521548 60521553 +
gctatctagaagaacaaaattc

SEQ ID NO: 204283 - DNA, 22 bp, Artificial Sequence
  Synthetic oligonucleotide; TTG chr2 60521532 60521553 60521549 60521554 +
ctatctagaagaacaaaattcc

SEQ ID NO: 204284 - DNA, 22 bp, Artificial Sequence
  Synthetic oligonucleotide; CTA chr2 60521535 60521556 60521552 60521557 +
tctagaagaacaaaattcccct

SEQ ID NO: 204285 - DNA, 22 bp, Artificial Sequence
  Synthetic oligonucleotide; CTA chr2 60521539 60521560 60521556 60521561 +
gaagaacaaaattcccctttcc

SEQ ID NO: 204286 - DNA, 22 bp, Artificial Sequence
  Synthetic oligonucleotide; TTC chr2 60521553 60521574 60521570 60521575 +
ccctttccagctctgcaattgc

SEQ ID NO: 204287 - DNA, 22 bp, Artificial Sequence
  Synthetic oligonucleotide; CTT chr2 60521558 60521579 60521575 60521580 +
tccagctctgcaattgccactc

SEQ ID NO: 204288 - DNA, 22 bp, Artificial Sequence
  Synthetic oligonucleotide; TTT chr2 60521559 60521580 60521576 60521581 +
ccagctctgcaattgccactct

SEQ ID NO: 204289 - DNA, 22 bp, Artificial Sequence
  Synthetic oligonucleotide; TTC chr2 60521560 60521581 60521577 60521582 +
cagctctgcaattgccactctg

SEQ ID NO: 204290 - DNA, 22 bp, Artificial Sequence
  Synthetic oligonucleotide; CTC chr2 60521566 60521587 60521583 60521588 +
tgcaattgccactctgctccct

SEQ ID NO: 204291 - DNA, 22 bp, Artificial Sequence
  Synthetic oligonucleotide; CTG chr2 60521568 60521589 60521585 60521590 +
caattgccactctgctcccttt

SEQ ID NO: 204292 - DNA, 22 bp, Artificial Sequence
  Synthetic oligonucleotide; TTG chr2 60521574 60521595 60521591 60521596 +
ccactctgctccctttcatctt

SEQ ID NO: 204293 - DNA, 22 bp, Artificial Sequence
  Synthetic oligonucleotide; CTC chr2 60521580 60521601 60521597 60521602 +
tgctccctttcatcttccatct

SEQ ID NO: 204294 - DNA, 22 bp, Artificial Sequence
  Synthetic oligonucleotide; CTG chr2 60521582 60521603 60521599 60521604 +
ctccctttcatcttccatcttg

SEQ ID NO: 204295 - DNA, 22 bp, Artificial Sequence
  Synthetic oligonucleotide; CTC chr2 60521585 60521606 60521602 60521607 +
cctttcatcttccatcttgtgc

SEQ ID NO: 204296 - DNA, 22 bp, Artificial Sequence
  Synthetic oligonucleotide; CTT chr2 60521589 60521610 60521606 60521611 +
tcatcttccatcttgtgcccca

SEQ ID NO: 204297 - DNA, 22 bp, Artificial Sequence
  Synthetic oligonucleotide; TTT chr2 60521590 60521611 60521607 60521612 +
catcttccatcttgtgccccag

SEQ ID NO: 204298 - DNA, 22 bp, Artificial Sequence
  Synthetic oligonucleotide; TTC chr2 60521591 60521612 60521608 60521613 +
atcttccatcttgtgccccagt

SEQ ID NO: 204299 - DNA, 22 bp, Artificial Sequence
  Synthetic oligonucleotide; CTT chr2 60521596 60521617 60521613 60521618 +
ccatcttgtgccccagtcctcc

SEQ ID NO: 204300 - DNA, 22 bp, Artificial Sequence
  Synthetic oligonucleotide; TTC chr2 60521597 60521618 60521614 60521619 +
catcttgtgccccagtcctccc

SEQ ID NO: 204301 - DNA, 22 bp, Artificial Sequence
  Synthetic oligonucleotide; CTT chr2 60521603 60521624 60521620 60521625 +
gtgccccagtcctcccttaaag

SEQ ID NO: 204302 - DNA, 22 bp, Artificial Sequence
  Synthetic oligonucleotide; TTG chr2 60521604 60521625 60521621 60521626 +
tgccccagtcctcccttaaagg

SEQ ID NO: 204303 - DNA, 22 bp, Artificial Sequence
  Synthetic oligonucleotide; CTC chr2 60521617 60521638 60521634 60521639 +
ccttaaagggaaggctgcttaa

SEQ ID NO: 204304 - DNA, 22 bp, Artificial Sequence
  Synthetic oligonucleotide; CTT chr2 60521621 60521642 60521638 60521643 +
aaagggaaggctgcttaaccct

SEQ ID NO: 204305 - DNA, 22 bp, Artificial Sequence
  Synthetic oligonucleotide; TTA chr2 60521622 60521643 60521639 60521644 +
aagggaaggctgcttaaccctt

SEQ ID NO: 204306 - DNA, 22 bp, Artificial Sequence
  Synthetic oligonucleotide; CTG chr2 60521634 60521655 60521651 60521656 +
cttaacccttgacgtgttcttt

SEQ ID NO: 204307 - DNA, 22 bp, Artificial Sequence
  Synthetic oligonucleotide; CTT chr2 60521637 60521658 60521654 60521659 +
aacccttgacgtgttctttgtc

SEQ ID NO: 204308 - DNA, 22 bp, Artificial Sequence
  Synthetic oligonucleotide; TTA chr2 60521638 60521659 60521655 60521660 +
acccttgacgtgttctttgtcc

SEQ ID NO: 204309 - DNA, 22 bp, Artificial Sequence
  Synthetic oligonucleotide; CTT chr2 60521644 60521665 60521661 60521666 +
gacgtgttctttgtccccttct

SEQ ID NO: 204310 - DNA, 22 bp, Artificial Sequence
  Synthetic oligonucleotide; TTG chr2 60521645 60521666 60521662 60521667 +
acgtgttctttgtccccttctt

SEQ ID NO: 204311 - DNA, 22 bp, Artificial Sequence
  Synthetic oligonucleotide; TTC chr2 60521653 60521674 60521670 60521675 +
tttgtccccttctttctgagag

SEQ ID NO: 204312 - DNA, 22 bp, Artificial Sequence
  Synthetic oligonucleotide; CTT chr2 60521655 60521676 60521672 60521677 +
tgtccccttctttctgagagtg

SEQ ID NO: 204313 - DNA, 22 bp, Artificial Sequence
  Synthetic oligonucleotide; TTT chr2 60521656 60521677 60521673 60521678 +
gtccccttctttctgagagtgt

SEQ ID NO: 204314 - DNA, 22 bp, Artificial Sequence
  Synthetic oligonucleotide; TTG chr2 60521657 60521678 60521674 60521679 +
tccccttctttctgagagtgtg

SEQ ID NO: 204315 - DNA, 22 bp, Artificial Sequence
  Synthetic oligonucleotide; CTT chr2 60521664 60521685 60521681 60521686 +
ctttctgagagtgtggtcaatc

SEQ ID NO: 204316 - DNA, 22 bp, Artificial Sequence
  Synthetic oligonucleotide; TTC chr2 60521665 60521686 60521682 60521687 +
tttctgagagtgtggtcaatct

SEQ ID NO: 204317 - DNA, 22 bp, Artificial Sequence
  Synthetic oligonucleotide; CTT chr2 60521667 60521688 60521684 60521689 +
tctgagagtgtggtcaatctcc

SEQ ID NO: 204318 - DNA, 22 bp, Artificial Sequence
  Synthetic oligonucleotide; TTT chr2 60521668 60521689 60521685 60521690 +
ctgagagtgtggtcaatctcct

SEQ ID NO: 204319 - DNA, 22 bp, Artificial Sequence
  Synthetic oligonucleotide; TTC chr2 60521669 60521690 60521686 60521691 +
tgagagtgtggtcaatctcctc

SEQ ID NO: 204320 - DNA, 22 bp, Artificial Sequence
  Synthetic oligonucleotide; CTG chr2 60521671 60521692 60521688 60521693 +
agagtgtggtcaatctcctctc

SEQ ID NO: 204321 - DNA, 22 bp, Artificial Sequence
  Synthetic oligonucleotide; CTC chr2 60521688 60521709 60521705 60521710 +
ctctcaggcaaatcatctttct

SEQ ID NO: 204322 - DNA, 22 bp, Artificial Sequence
  Synthetic oligonucleotide; CTC chr2 60521691 60521712 60521708 60521713 +
tcaggcaaatcatctttctcta

SEQ ID NO: 204323 - DNA, 22 bp, Artificial Sequence
  Synthetic oligonucleotide; CTC chr2 60521693 60521714 60521710 60521715 +
aggcaaatcatctttctctaat

SEQ ID NO: 204324 - DNA, 22 bp, Artificial Sequence
  Synthetic oligonucleotide; CTT chr2 60521707 60521728 60521724 60521729 +
tctctaatagccagggctcaaa

SEQ ID NO: 204325 - DNA, 22 bp, Artificial Sequence
  Synthetic oligonucleotide; TTT chr2 60521708 60521729 60521725 60521730 +
ctctaatagccagggctcaaat

SEQ ID NO: 204326 - DNA, 22 bp, Artificial Sequence
  Synthetic oligonucleotide; TTC chr2 60521709 60521730 60521726 60521731 +
tctaatagccagggctcaaatg

SEQ ID NO: 204327 - DNA, 22 bp, Artificial Sequence
  Synthetic oligonucleotide; CTC chr2 60521711 60521732 60521728 60521733 +
taatagccagggctcaaatggc

SEQ ID NO: 204328 - DNA, 22 bp, Artificial Sequence
  Synthetic oligonucleotide; CTA chr2 60521713 60521734 60521730 60521735 +
atagccagggctcaaatggcca

SEQ ID NO: 204329 - DNA, 22 bp, Artificial Sequence
  Synthetic oligonucleotide; CTC chr2 60521726 60521747 60521743 60521748 +
aaatggccaaagaaaggtccca

SEQ ID NO: 204330 - DNA, 22 bp, Artificial Sequence
  Synthetic oligonucleotide; CTT chr2 60521755 60521776 60521772 60521777 +
gtcttcataacactaccagcca

SEQ ID NO: 204331 - DNA, 22 bp, Artificial Sequence
  Synthetic oligonucleotide; TTG chr2 60521756 60521777 60521773 60521778 +
tcttcataacactaccagccac

SEQ ID NO: 204332 - DNA, 22 bp, Artificial Sequence
  Synthetic oligonucleotide; CTT chr2 60521760 60521781 60521777 60521782 +
cataacactaccagccacgtga

SEQ ID NO: 204333 - DNA, 22 bp, Artificial Sequence
  Synthetic oligonucleotide; TTC chr2 60521761 60521782 60521778 60521783 +
ataacactaccagccacgtgag

SEQ ID NO: 204334 - DNA, 22 bp, Artificial Sequence
  Synthetic oligonucleotide; CTA chr2 60521770 60521791 60521787 60521792 +
ccagccacgtgagcacgtccca

SEQ ID NO: 204335 - DNA, 22 bp, Artificial Sequence
  Synthetic oligonucleotide; CTG chr2 60521796 60521817 60521813 60521818 +
cttcttcctgaccctcaccacg

SEQ ID NO: 204336 - DNA, 22 bp, Artificial Sequence
  Synthetic oligonucleotide; CTT chr2 60521799 60521820 60521816 60521821 +
cttcctgaccctcaccacgagg

SEQ ID NO: 204337 - DNA, 22 bp, Artificial Sequence
  Synthetic oligonucleotide; TTC chr2 60521800 60521821 60521817 60521822 +
ttcctgaccctcaccacgaggc

SEQ ID NO: 204338 - DNA, 22 bp, Artificial Sequence
  Synthetic oligonucleotide; CTT chr2 60521802 60521823 60521819 60521824 +
cctgaccctcaccacgaggcac

SEQ ID NO: 204339 - DNA, 22 bp, Artificial Sequence
  Synthetic oligonucleotide; TTC chr2 60521803 60521824 60521820 60521825 +
ctgaccctcaccacgaggcaca

SEQ ID NO: 204340 - DNA, 22 bp, Artificial Sequence
  Synthetic oligonucleotide; CTG chr2 60521806 60521827 60521823 60521828 +
accctcaccacgaggcacagag

SEQ ID NO: 204341 - DNA, 22 bp, Artificial Sequence
  Synthetic oligonucleotide; CTC chr2 60521812 60521833 60521829 60521834 +
accacgaggcacagaggcacct

SEQ ID NO: 204342 - DNA, 22 bp, Artificial Sequence
  Synthetic oligonucleotide; CTG chr2 60521835 60521856 60521852 60521857 +
tgctgaaactcaagcaaacgcc

SEQ ID NO: 204343 - DNA, 22 bp, Artificial Sequence
  Synthetic oligonucleotide; CTG chr2 60521840 60521861 60521857 60521862 +
aaactcaagcaaacgccacatc

SEQ ID NO: 204344 - DNA, 22 bp, Artificial Sequence
  Synthetic oligonucleotide; CTC chr2 60521846 60521867 60521863 60521868 +
aagcaaacgccacatctgactc

SEQ ID NO: 204345 - DNA, 22 bp, Artificial Sequence
  Synthetic oligonucleotide; CTG chr2 60521864 60521885 60521881 60521886 +
actctgcctcatgcactgaaaa

SEQ ID NO: 204346 - DNA, 22 bp, Artificial Sequence
  Synthetic oligonucleotide; CTC chr2 60521868 60521889 60521885 60521890 +
tgcctcatgcactgaaaaagac

SEQ ID NO: 204347 - DNA, 22 bp, Artificial Sequence
  Synthetic oligonucleotide; CTG chr2 60521870 60521891 60521887 60521892 +
cctcatgcactgaaaaagacaa

SEQ ID NO: 204348 - DNA, 22 bp, Artificial Sequence
  Synthetic oligonucleotide; CTC chr2 60521874 60521895 60521891 60521896 +
atgcactgaaaaagacaaggga

SEQ ID NO: 204349 - DNA, 22 bp, Artificial Sequence
  Synthetic oligonucleotide; CTG chr2 60521882 60521903 60521899 60521904 +
aaaaagacaagggatctctgtt

SEQ ID NO: 204350 - DNA, 22 bp, Artificial Sequence
  Synthetic oligonucleotide; CTC chr2 60521900 60521921 60521917 60521922 +
tgttcttccaggagaatggggg

SEQ ID NO: 204351 - DNA, 22 bp, Artificial Sequence
  Synthetic oligonucleotide; CTG chr2 60521902 60521923 60521919 60521924 +
ttcttccaggagaatgggggac

SEQ ID NO: 204352 - DNA, 22 bp, Artificial Sequence
  Synthetic oligonucleotide; TTC chr2 60521905 60521926 60521922 60521927 +
ttccaggagaatgggggacagt

SEQ ID NO: 204353 - DNA, 22 bp, Artificial Sequence
  Synthetic oligonucleotide; CTT chr2 60521907 60521928 60521924 60521929 +
ccaggagaatgggggacagtgc

SEQ ID NO: 204354 - DNA, 22 bp, Artificial Sequence
  Synthetic oligonucleotide; TTC chr2 60521908 60521929 60521925 60521930 +
caggagaatgggggacagtgca

SEQ ID NO: 204355 - DNA, 22 bp, Artificial Sequence
  Synthetic oligonucleotide; CTT chr2 60521944 60521965 60521961 60521966 +
aaatgaccccttcacaatgaac

SEQ ID NO: 204356 - DNA, 22 bp, Artificial Sequence
  Synthetic oligonucleotide; TTA chr2 60521945 60521966 60521962 60521967 +
aatgaccccttcacaatgaact

SEQ ID NO: 204357 - DNA, 22 bp, Artificial Sequence
  Synthetic oligonucleotide; CTT chr2 60521956 60521977 60521973 60521978 +
cacaatgaacttcccagataca

SEQ ID NO: 204358 - DNA, 22 bp, Artificial Sequence
  Synthetic oligonucleotide; TTC chr2 60521957 60521978 60521974 60521979 +
acaatgaacttcccagatacaa

SEQ ID NO: 204359 - DNA, 22 bp, Artificial Sequence
  Synthetic oligonucleotide; CTT chr2 60521968 60521989 60521985 60521990 +
cccagatacaagacttgagctc

SEQ ID NO: 204360 - DNA, 22 bp, Artificial Sequence
  Synthetic oligonucleotide; TTC chr2 60521969 60521990 60521986 60521991 +
ccagatacaagacttgagctca

SEQ ID NO: 204361 - DNA, 22 bp, Artificial Sequence
  Synthetic oligonucleotide; CTT chr2 60521984 60522005 60522001 60522006 +
gagctcacaggtactttcttgc

SEQ ID NO: 204362 - DNA, 22 bp, Artificial Sequence
  Synthetic oligonucleotide; TTG chr2 60521985 60522006 60522002 60522007 +
agctcacaggtactttcttgcc

SEQ ID NO: 204363 - DNA, 22 bp, Artificial Sequence
  Synthetic oligonucleotide; CTC chr2 60521990 60522011 60522007 60522012 +
acaggtactttcttgcccatag

SEQ ID NO: 204364 - DNA, 22 bp, Artificial Sequence
  Synthetic oligonucleotide; CTT chr2 60522000 60522021 60522017 60522022 +
tcttgcccataggacacttgtc

SEQ ID NO: 204365 - DNA, 22 bp, Artificial Sequence
  Synthetic oligonucleotide; TTT chr2 60522001 60522022 60522018 60522023 +
cttgcccataggacacttgtcc

SEQ ID NO: 204366 - DNA, 22 bp, Artificial Sequence
  Synthetic oligonucleotide; TTC chr2 60522002 60522023 60522019 60522024 +
ttgcccataggacacttgtccc

SEQ ID NO: 204367 - DNA, 22 bp, Artificial Sequence
  Synthetic oligonucleotide; CTT chr2 60522004 60522025 60522021 60522026 +
gcccataggacacttgtcccct

SEQ ID NO: 204368 - DNA, 22 bp, Artificial Sequence
  Synthetic oligonucleotide; TTG chr2 60522005 60522026 60522022 60522027 +
cccataggacacttgtcccctt

SEQ ID NO: 204369 - DNA, 22 bp, Artificial Sequence
  Synthetic oligonucleotide; CTT chr2 60522019 60522040 60522036 60522041 +
gtccccttgctacctctgagcc

SEQ ID NO: 204370 - DNA, 22 bp, Artificial Sequence
  Synthetic oligonucleotide; TTG chr2 60522020 60522041 60522037 60522042 +
tccccttgctacctctgagcca

SEQ ID NO: 204371 - DNA, 22 bp, Artificial Sequence
  Synthetic oligonucleotide; CTT chr2 60522027 60522048 60522044 60522049 +
gctacctctgagccaaaccctt

SEQ ID NO: 204372 - DNA, 22 bp, Artificial Sequence
  Synthetic oligonucleotide; TTG chr2 60522028 60522049 60522045 60522050 +
ctacctctgagccaaacccttg

SEQ ID NO: 204373 - DNA, 22 bp, Artificial Sequence
  Synthetic oligonucleotide; CTA chr2 60522031 60522052 60522048 60522053 +
cctctgagccaaacccttggtg

SEQ ID NO: 204374 - DNA, 22 bp, Artificial Sequence
  Synthetic oligonucleotide; CTC chr2 60522035 60522056 60522052 60522057 +
tgagccaaacccttggtgaaga

SEQ ID NO: 204375 - DNA, 22 bp, Artificial Sequence
  Synthetic oligonucleotide; CTG chr2 60522037 60522058 60522054 60522059 +
agccaaacccttggtgaagaaa

SEQ ID NO: 204376 - DNA, 22 bp, Artificial Sequence
  Synthetic oligonucleotide; CTT chr2 60522049 60522070 60522066 60522071 +
ggtgaagaaacaacaccgacta

SEQ ID NO: 204377 - DNA, 22 bp, Artificial Sequence
  Synthetic oligonucleotide; TTG chr2 60522050 60522071 60522067 60522072 +
gtgaagaaacaacaccgactaa

SEQ ID NO: 204378 - DNA, 22 bp, Artificial Sequence
  Synthetic oligonucleotide; CTA chr2 60522071 60522092 60522088 60522093 +
aacaaggccatactgctctcca

SEQ ID NO: 204379 - DNA, 22 bp, Artificial Sequence
  Synthetic oligonucleotide; CTG chr2 60522086 60522107 60522103 60522108 +
ctctccaccagtcaggcaatac

SEQ ID NO: 204380 - DNA, 22 bp, Artificial Sequence
  Synthetic oligonucleotide; CTC chr2 60522089 60522110 60522106 60522111 +
tccaccagtcaggcaatacctt

SEQ ID NO: 204381 - DNA, 22 bp, Artificial Sequence
  Synthetic oligonucleotide; CTC chr2 60522091 60522112 60522108 60522113 +
caccagtcaggcaataccttta

SEQ ID NO: 204382 - DNA, 22 bp, Artificial Sequence
  Synthetic oligonucleotide; CTT chr2 60522111 60522132 60522128 60522133 +
tattttctggaaaaatctcaaa

SEQ ID NO: 204383 - DNA, 22 bp, Artificial Sequence
  Synthetic oligonucleotide; TTT chr2 60522112 60522133 60522129 60522134 +
attttctggaaaaatctcaaat

SEQ ID NO: 204384 - DNA, 22 bp, Artificial Sequence
  Synthetic oligonucleotide; TTA chr2 60522113 60522134 60522130 60522135 +
ttttctggaaaaatctcaaata

SEQ ID NO: 204385 - DNA, 22 bp, Artificial Sequence
  Synthetic oligonucleotide; TTT chr2 60522116 60522137 60522133 60522138 +
tctggaaaaatctcaaatacta

SEQ ID NO: 204386 - DNA, 22 bp, Artificial Sequence
  Synthetic oligonucleotide; TTT chr2 60522117 60522138 60522134 60522139 +
ctggaaaaatctcaaatactac

SEQ ID NO: 204387 - DNA, 22 bp, Artificial Sequence
  Synthetic oligonucleotide; TTC chr2 60522118 60522139 60522135 60522140 +
tggaaaaatctcaaatactaca

SEQ ID NO: 204388 - DNA, 22 bp, Artificial Sequence
  Synthetic oligonucleotide; CTG chr2 60522120 60522141 60522137 60522142 +
gaaaaatctcaaatactacaaa

SEQ ID NO: 204389 - DNA, 22 bp, Artificial Sequence
  Synthetic oligonucleotide; CTC chr2 60522130 60522151 60522147 60522152 +
aaatactacaaaagtagagaga

SEQ ID NO: 204390 - DNA, 22 bp, Artificial Sequence
  Synthetic oligonucleotide; CTA chr2 60522138 60522159 60522155 60522160 +
caaaagtagagagaatgttata

SEQ ID NO: 204391 - DNA, 22 bp, Artificial Sequence
  Synthetic oligonucleotide; TTA chr2 60522158 60522179 60522175 60522180 +
taaatcagtccccaagtccaca

SEQ ID NO: 204392 - DNA, 22 bp, Artificial Sequence
  Synthetic oligonucleotide; CTT chr2 60522184 60522205 60522201 60522206 +
ccagctccaaccaccacagctc

SEQ ID NO: 204393 - DNA, 22 bp, Artificial Sequence
  Synthetic oligonucleotide; TTC chr2 60522185 60522206 60522202 60522207 +
cagctccaaccaccacagctca

SEQ ID NO: 204394 - DNA, 22 bp, Artificial Sequence
  Synthetic oligonucleotide; CTC chr2 60522191 60522212 60522208 60522213 +
caaccaccacagctcacagtca

SEQ ID NO: 204395 - DNA, 22 bp, Artificial Sequence
  Synthetic oligonucleotide; CTC chr2 60522206 60522227 60522223 60522228 +
acagtcattcttgtcttctgta

SEQ ID NO: 204396 - DNA, 22 bp, Artificial Sequence
  Synthetic oligonucleotide; TTC chr2 60522216 60522237 60522233 60522238 +
ttgtcttctgtaaccctatcgc

SEQ ID NO: 204397 - DNA, 22 bp, Artificial Sequence
  Synthetic oligonucleotide; CTT chr2 60522218 60522239 60522235 60522240 +
gtcttctgtaaccctatcgcct

SEQ ID NO: 204398 - DNA, 22 bp, Artificial Sequence
  Synthetic oligonucleotide; TTG chr2 60522219 60522240 60522236 60522241 +
tcttctgtaaccctatcgcctc

SEQ ID NO: 204399 - DNA, 22 bp, Artificial Sequence
  Synthetic oligonucleotide; CTT chr2 60522223 60522244 60522240 60522245 +
ctgtaaccctatcgcctcccta

SEQ ID NO: 204400 - DNA, 22 bp, Artificial Sequence
  Synthetic oligonucleotide; TTC chr2 60522224 60522245 60522241 60522246 +
tgtaaccctatcgcctccctag

SEQ ID NO: 204401 - DNA, 22 bp, Artificial Sequence
  Synthetic oligonucleotide; CTG chr2 60522226 60522247 60522243 60522248 +
taaccctatcgcctccctagcc

SEQ ID NO: 204402 - DNA, 22 bp, Artificial Sequence
  Synthetic oligonucleotide; CTA chr2 60522234 60522255 60522251 60522256 +
tcgcctccctagcccattttat

SEQ ID NO: 204403 - DNA, 22 bp, Artificial Sequence
  Synthetic oligonucleotide; CTC chr2 60522241 60522262 60522258 60522263 +
cctagcccattttattatttaa

SEQ ID NO: 204404 - DNA, 22 bp, Artificial Sequence
  Synthetic oligonucleotide; CTA chr2 60522245 60522266 60522262 60522267 +
gcccattttattatttaagttg

SEQ ID NO: 204405 - DNA, 22 bp, Artificial Sequence
  Synthetic oligonucleotide; TTT chr2 60522253 60522274 60522270 60522275 +
tattatttaagttgatcccaga

SEQ ID NO: 204406 - DNA, 22 bp, Artificial Sequence
  Synthetic oligonucleotide; TTT chr2 60522254 60522275 60522271 60522276 +
attatttaagttgatcccagac

SEQ ID NO: 204407 - DNA, 22 bp, Artificial Sequence
  Synthetic oligonucleotide; TTA chr2 60522255 60522276 60522272 60522277 +
ttatttaagttgatcccagacg

SEQ ID NO: 204408 - DNA, 22 bp, Artificial Sequence
  Synthetic oligonucleotide; TTA chr2 60522258 60522279 60522275 60522280 +
tttaagttgatcccagacgtca

SEQ ID NO: 204409 - DNA, 22 bp, Artificial Sequence
  Synthetic oligonucleotide; TTT chr2 60522261 60522282 60522278 60522283 +
aagttgatcccagacgtcatat

SEQ ID NO: 204410 - DNA, 22 bp, Artificial Sequence
  Synthetic oligonucleotide; TTA chr2 60522262 60522283 60522279 60522284 +
agttgatcccagacgtcatatc

SEQ ID NO: 204411 - DNA, 22 bp, Artificial Sequence
  Synthetic oligonucleotide; TTG chr2 60522267 60522288 60522284 60522289 +
atcccagacgtcatatcatttc

SEQ ID NO: 204412 - DNA, 22 bp, Artificial Sequence
  Synthetic oligonucleotide; TTT chr2 60522288 60522309 60522305 60522310 +
catcagtaaacacctctgtatg

SEQ ID NO: 204413 - DNA, 22 bp, Artificial Sequence
  Synthetic oligonucleotide; TTC chr2 60522289 60522310 60522306 60522311 +
atcagtaaacacctctgtatgt

SEQ ID NO: 204414 - DNA, 22 bp, Artificial Sequence
  Synthetic oligonucleotide; CTC chr2 60522304 60522325 60522321 60522326 +
tgtatgtattttttaaacatag

SEQ ID NO: 204415 - DNA, 22 bp, Artificial Sequence
  Synthetic oligonucleotide; CTG chr2 60522306 60522327 60522323 60522328 +
tatgtattttttaaacatagga

SEQ ID NO: 204416 - DNA, 22 bp, Artificial Sequence
  Synthetic oligonucleotide; TTT chr2 60522315 60522336 60522332 60522337 +
tttaaacataggaactcgtttt

SEQ ID NO: 204417 - DNA, 22 bp, Artificial Sequence
  Synthetic oligonucleotide; TTT chr2 60522316 60522337 60522333 60522338 +
ttaaacataggaactcgttttt

SEQ ID NO: 204418 - DNA, 22 bp, Artificial Sequence
  Synthetic oligonucleotide; TTT chr2 60522317 60522338 60522334 60522339 +
taaacataggaactcgtttttt

SEQ ID NO: 204419 - DNA, 22 bp, Artificial Sequence
  Synthetic oligonucleotide; TTT chr2 60522318 60522339 60522335 60522340 +
aaacataggaactcgttttttt

SEQ ID NO: 204420 - DNA, 22 bp, Artificial Sequence
  Synthetic oligonucleotide; TTA chr2 60522319 60522340 60522336 60522341 +
aacataggaactcgtttttttt

SEQ ID NO: 204421 - DNA, 22 bp, Artificial Sequence
  Synthetic oligonucleotide; CTC chr2 60522332 60522353 60522349 60522354 +
gttttttttcttttaaatacaa

SEQ ID NO: 204422 - DNA, 22 bp, Artificial Sequence
  Synthetic oligonucleotide; TTT chr2 60522336 60522357 60522353 60522358 +
tttttcttttaaatacaactgc

SEQ ID NO: 204423 - DNA, 22 bp, Artificial Sequence
  Synthetic oligonucleotide; TTT chr2 60522337 60522358 60522354 60522359 +
ttttcttttaaatacaactgca

SEQ ID NO: 204424 - DNA, 22 bp, Artificial Sequence
  Synthetic oligonucleotide; TTT chr2 60522338 60522359 60522355 60522360 +
tttcttttaaatacaactgcaa

SEQ ID NO: 204425 - DNA, 22 bp, Artificial Sequence
  Synthetic oligonucleotide; TTT chr2 60522339 60522360 60522356 60522361 +
ttcttttaaatacaactgcaaa

SEQ ID NO: 204426 - DNA, 22 bp, Artificial Sequence
  Synthetic oligonucleotide; TTT chr2 60522340 60522361 60522357 60522362 +
tcttttaaatacaactgcaaaa

SEQ ID NO: 204427 - DNA, 22 bp, Artificial Sequence
  Synthetic oligonucleotide; TTT chr2 60522341 60522362 60522358 60522363 +
cttttaaatacaactgcaaaac

SEQ ID NO: 204428 - DNA, 22 bp, Artificial Sequence
  Synthetic oligonucleotide; TTC chr2 60522342 60522363 60522359 60522364 +
ttttaaatacaactgcaaaacc

SEQ ID NO: 204429 - DNA, 22 bp, Artificial Sequence
  Synthetic oligonucleotide; CTT chr2 60522344 60522365 60522361 60522366 +
ttaaatacaactgcaaaaccat

SEQ ID NO: 204430 - DNA, 22 bp, Artificial Sequence
  Synthetic oligonucleotide; TTT chr2 60522345 60522366 60522362 60522367 +
taaatacaactgcaaaaccatt

SEQ ID NO: 204431 - DNA, 22 bp, Artificial Sequence
  Synthetic oligonucleotide; TTT chr2 60522346 60522367 60522363 60522368 +
aaatacaactgcaaaaccatta

SEQ ID NO: 204432 - DNA, 22 bp, Artificial Sequence
  Synthetic oligonucleotide; TTA chr2 60522347 60522368 60522364 60522369 +
aatacaactgcaaaaccattat

SEQ ID NO: 204433 - DNA, 22 bp, Artificial Sequence
  Synthetic oligonucleotide; CTG chr2 60522357 60522378 60522374 60522379 +
caaaaccattatcacacctaaa

SEQ ID NO: 204434 - DNA, 22 bp, Artificial Sequence
  Synthetic oligonucleotide; TTA chr2 60522368 60522389 60522385 60522390 +
tcacacctaaaaataataaagt

SEQ ID NO: 204435 - DNA, 22 bp, Artificial Sequence
  Synthetic oligonucleotide; CTA chr2 60522377 60522398 60522394 60522399 +
aaaataataaagtcacaaataa

SEQ ID NO: 204436 - DNA, 22 bp, Artificial Sequence
  Synthetic oligonucleotide; TTA chr2 60522411 60522432 60522428 60522433 +
ccaaataggggagttattttaa

SEQ ID NO: 204437 - DNA, 22 bp, Artificial Sequence
  Synthetic oligonucleotide; TTA chr2 60522427 60522448 60522444 60522449 +
ttttaaactcagaaatacttct

SEQ ID NO: 204438 - DNA, 22 bp, Artificial Sequence
  Synthetic oligonucleotide; TTT chr2 60522430 60522451 60522447 60522452 +
taaactcagaaatacttctttc

SEQ ID NO: 204439 - DNA, 22 bp, Artificial Sequence
  Synthetic oligonucleotide; TTT chr2 60522431 60522452 60522448 60522453 +
aaactcagaaatacttctttcc

SEQ ID NO: 204440 - DNA, 22 bp, Artificial Sequence
  Synthetic oligonucleotide; TTA chr2 60522432 60522453 60522449 60522454 +
aactcagaaatacttctttcca

SEQ ID NO: 204441 - DNA, 22 bp, Artificial Sequence
  Synthetic oligonucleotide; CTC chr2 60522437 60522458 60522454 60522459 +
agaaatacttctttccatctgg

SEQ ID NO: 204442 - DNA, 22 bp, Artificial Sequence
  Synthetic oligonucleotide; CTT chr2 60522447 60522468 60522464 60522469 +
ctttccatctgggtcatgtttt

SEQ ID NO: 204443 - DNA, 22 bp, Artificial Sequence
  Synthetic oligonucleotide; TTC chr2 60522448 60522469 60522465 60522470 +
tttccatctgggtcatgttttg

SEQ ID NO: 204444 - DNA, 22 bp, Artificial Sequence
  Synthetic oligonucleotide; CTT chr2 60522450 60522471 60522467 60522472 +
tccatctgggtcatgttttgga

SEQ ID NO: 204445 - DNA, 22 bp, Artificial Sequence
  Synthetic oligonucleotide; TTT chr2 60522451 60522472 60522468 60522473 +
ccatctgggtcatgttttggag

SEQ ID NO: 204446 - DNA, 22 bp, Artificial Sequence
  Synthetic oligonucleotide; TTC chr2 60522452 60522473 60522469 60522474 +
catctgggtcatgttttggagg

SEQ ID NO: 204447 - DNA, 22 bp, Artificial Sequence
  Synthetic oligonucleotide; CTG chr2 60522458 60522479 60522475 60522480 +
ggtcatgttttggaggatccct

SEQ ID NO: 204448 - DNA, 22 bp, Artificial Sequence
  Synthetic oligonucleotide; TTT chr2 60522468 60522489 60522485 60522490 +
tggaggatcccttccagtgagg

SEQ ID NO: 204449 - DNA, 22 bp, Artificial Sequence
  Synthetic oligonucleotide; TTT chr2 60522469 60522490 60522486 60522491 +
ggaggatcccttccagtgaggt

SEQ ID NO: 204450 - DNA, 22 bp, Artificial Sequence
  Synthetic oligonucleotide; TTG chr2 60522470 60522491 60522487 60522492 +
gaggatcccttccagtgaggtt

SEQ ID NO: 204451 - DNA, 22 bp, Artificial Sequence
  Synthetic oligonucleotide; CTT chr2 60522481 60522502 60522498 60522503 +
ccagtgaggttcaagactgaag

SEQ ID NO: 204452 - DNA, 22 bp, Artificial Sequence
  Synthetic oligonucleotide; TTC chr2 60522482 60522503 60522499 60522504 +
cagtgaggttcaagactgaagc

SEQ ID NO: 204453 - DNA, 22 bp, Artificial Sequence
  Synthetic oligonucleotide; TTC chr2 60522493 60522514 60522510 60522515 +
aagactgaagctgccaagaaaa

SEQ ID NO: 204454 - DNA, 22 bp, Artificial Sequence
  Synthetic oligonucleotide; CTG chr2 60522500 60522521 60522517 60522522 +
aagctgccaagaaaagcttcag

SEQ ID NO: 204455 - DNA, 22 bp, Artificial Sequence
  Synthetic oligonucleotide; CTG chr2 60522506 60522527 60522523 60522528 +
ccaagaaaagcttcagagaatc

SEQ ID NO: 204456 - DNA, 22 bp, Artificial Sequence
  Synthetic oligonucleotide; CTT chr2 60522519 60522540 60522536 60522541 +
cagagaatcacactctctaaaa

SEQ ID NO: 204457 - DNA, 22 bp, Artificial Sequence
  Synthetic oligonucleotide; TTC chr2 60522520 60522541 60522537 60522542 +
agagaatcacactctctaaaaa

SEQ ID NO: 204458 - DNA, 22 bp, Artificial Sequence
  Synthetic oligonucleotide; CTC chr2 60522534 60522555 60522551 60522556 +
tctaaaaagggccttgtgtaaa

SEQ ID NO: 204459 - DNA, 22 bp, Artificial Sequence
  Synthetic oligonucleotide; CTC chr2 60522536 60522557 60522553 60522558 +
taaaaagggccttgtgtaaagc

SEQ ID NO: 204460 - DNA, 22 bp, Artificial Sequence
  Synthetic oligonucleotide; CTA chr2 60522538 60522559 60522555 60522560 +
aaaagggccttgtgtaaagcca

SEQ ID NO: 204461 - DNA, 22 bp, Artificial Sequence
  Synthetic oligonucleotide; CTT chr2 60522549 60522570 60522566 60522571 +
gtgtaaagccaccttgcatgtc

SEQ ID NO: 204462 - DNA, 22 bp, Artificial Sequence
  Synthetic oligonucleotide; TTG chr2 60522550 60522571 60522567 60522572 +
tgtaaagccaccttgcatgtca

SEQ ID NO: 204463 - DNA, 22 bp, Artificial Sequence
  Synthetic oligonucleotide; CTT chr2 60522564 60522585 60522581 60522586 +
gcatgtcagcccaagctcctgc

SEQ ID NO: 204464 - DNA, 22 bp, Artificial Sequence
  Synthetic oligonucleotide; TTG chr2 60522565 60522586 60522582 60522587 +
catgtcagcccaagctcctgcc

SEQ ID NO: 204465 - DNA, 22 bp, Artificial Sequence
  Synthetic oligonucleotide; CTC chr2 60522582 60522603 60522599 60522604 +
ctgccccttgcagtcctttgcc

SEQ ID NO: 204466 - DNA, 22 bp, Artificial Sequence
  Synthetic oligonucleotide; CTG chr2 60522585 60522606 60522602 60522607 +
ccccttgcagtcctttgccctg

SEQ ID NO: 204467 - DNA, 22 bp, Artificial Sequence
  Synthetic oligonucleotide; CTT chr2 60522591 60522612 60522608 60522613 +
gcagtcctttgccctgttcagg

SEQ ID NO: 204468 - DNA, 22 bp, Artificial Sequence
  Synthetic oligonucleotide; TTG chr2 60522592 60522613 60522609 60522614 +
cagtcctttgccctgttcaggg

SEQ ID NO: 204469 - DNA, 22 bp, Artificial Sequence
  Synthetic oligonucleotide; CTT chr2 60522600 60522621 60522617 60522622 +
tgccctgttcagggctgaatgc

SEQ ID NO: 204470 - DNA, 22 bp, Artificial Sequence
  Synthetic oligonucleotide; TTT chr2 60522601 60522622 60522618 60522623 +
gccctgttcagggctgaatgca

SEQ ID NO: 204471 - DNA, 22 bp, Artificial Sequence
  Synthetic oligonucleotide; TTG chr2 60522602 60522623 60522619 60522624 +
ccctgttcagggctgaatgcac

SEQ ID NO: 204472 - DNA, 22 bp, Artificial Sequence
  Synthetic oligonucleotide; CTG chr2 60522607 60522628 60522624 60522629 +
ttcagggctgaatgcaccctct

SEQ ID NO: 204473 - DNA, 22 bp, Artificial Sequence
  Synthetic oligonucleotide; TTC chr2 60522610 60522631 60522627 60522632 +
agggctgaatgcaccctctgag

SEQ ID NO: 204474 - DNA, 22 bp, Artificial Sequence
  Synthetic oligonucleotide; CTG chr2 60522617 60522638 60522634 60522639 +
aatgcaccctctgagagtctct

SEQ ID NO: 204475 - DNA, 22 bp, Artificial Sequence
  Synthetic oligonucleotide; CTC chr2 60522628 60522649 60522645 60522650 +
tgagagtctctgtgacagtcct

SEQ ID NO: 204476 - DNA, 22 bp, Artificial Sequence
  Synthetic oligonucleotide; CTG chr2 60522630 60522651 60522647 60522652 +
agagtctctgtgacagtcctcc

SEQ ID NO: 204477 - DNA, 22 bp, Artificial Sequence
  Synthetic oligonucleotide; CTC chr2 60522638 60522659 60522655 60522660 +
tgtgacagtcctcccacatcga

SEQ ID NO: 204478 - DNA, 22 bp, Artificial Sequence
  Synthetic oligonucleotide; CTG chr2 60522640 60522661 60522657 60522662 +
tgacagtcctcccacatcgact

SEQ ID NO: 204479 - DNA, 22 bp, Artificial Sequence
  Synthetic oligonucleotide; CTC chr2 60522651 60522672 60522668 60522673 +
ccacatcgactgccccacaggc

SEQ ID NO: 204480 - DNA, 22 bp, Artificial Sequence
  Synthetic oligonucleotide; CTG chr2 60522663 60522684 60522680 60522685 +
ccccacaggccctgagtctccc

SEQ ID NO: 204481 - DNA, 22 bp, Artificial Sequence
  Synthetic oligonucleotide; CTG chr2 60522677 60522698 60522694 60522699 +
agtctccctcactccccaccat

SEQ ID NO: 204482 - DNA, 22 bp, Artificial Sequence
  Synthetic oligonucleotide; CTC chr2 60522683 60522704 60522700 60522705 +
cctcactccccaccatgtggcc

SEQ ID NO: 204483 - DNA, 22 bp, Artificial Sequence
  Synthetic oligonucleotide; CTC chr2 60522687 60522708 60522704 60522709 +
actccccaccatgtggcccatc

SEQ ID NO: 204484 - DNA, 22 bp, Artificial Sequence
  Synthetic oligonucleotide; CTC chr2 60522691 60522712 60522708 60522713 +
cccaccatgtggcccatcacca

SEQ ID NO: 204485 - DNA, 22 bp, Artificial Sequence
  Synthetic oligonucleotide; CTC chr2 60522735 60522756 60522752 60522757 +
ccagtgttcagaactggaattc

SEQ ID NO: 204486 - DNA, 22 bp, Artificial Sequence
  Synthetic oligonucleotide; TTC chr2 60522744 60522765 60522761 60522766 +
agaactggaattcatttgtctt

SEQ ID NO: 204487 - DNA, 22 bp, Artificial Sequence
  Synthetic oligonucleotide; CTG chr2 60522751 60522772 60522768 60522773 +
gaattcatttgtcttggaagaa

SEQ ID NO: 204488 - DNA, 22 bp, Artificial Sequence
  Synthetic oligonucleotide; TTC chr2 60522757 60522778 60522774 60522779 +
atttgtcttggaagaaagtgtt

SEQ ID NO: 204489 - DNA, 22 bp, Artificial Sequence
  Synthetic oligonucleotide; TTT chr2 60522761 60522782 60522778 60522783 +
gtcttggaagaaagtgttctcc

SEQ ID NO: 204490 - DNA, 22 bp, Artificial Sequence
  Synthetic oligonucleotide; TTG chr2 60522762 60522783 60522779 60522784 +
tcttggaagaaagtgttctcct

SEQ ID NO: 204491 - DNA, 22 bp, Artificial Sequence
  Synthetic oligonucleotide; CTT chr2 60522766 60522787 60522783 60522788 +
ggaagaaagtgttctcctggac

SEQ ID NO: 204492 - DNA, 22 bp, Artificial Sequence
  Synthetic oligonucleotide; TTG chr2 60522767 60522788 60522784 60522789 +
gaagaaagtgttctcctggacg

SEQ ID NO: 204493 - DNA, 22 bp, Artificial Sequence
  Synthetic oligonucleotide; TTC chr2 60522780 60522801 60522797 60522802 +
tcctggacggttctgcacagaa

SEQ ID NO: 204494 - DNA, 22 bp, Artificial Sequence
  Synthetic oligonucleotide; CTC chr2 60522782 60522803 60522799 60522804 +
ctggacggttctgcacagaatt

SEQ ID NO: 204495 - DNA, 22 bp, Artificial Sequence
  Synthetic oligonucleotide; CTG chr2 60522785 60522806 60522802 60522807 +
gacggttctgcacagaattcat

SEQ ID NO: 204496 - DNA, 22 bp, Artificial Sequence
  Synthetic oligonucleotide; TTC chr2 60522793 60522814 60522810 60522815 +
tgcacagaattcattcacagag

SEQ ID NO: 204497 - DNA, 22 bp, Artificial Sequence
  Synthetic oligonucleotide; CTG chr2 60522795 60522816 60522812 60522817 +
cacagaattcattcacagagca

SEQ ID NO: 204498 - DNA, 22 bp, Artificial Sequence
  Synthetic oligonucleotide; TTC chr2 60522805 60522826 60522822 60522827 +
attcacagagcatgtcttggat

SEQ ID NO: 204499 - DNA, 22 bp, Artificial Sequence
  Synthetic oligonucleotide; TTC chr2 60522809 60522830 60522826 60522831 +
acagagcatgtcttggatatac

SEQ ID NO: 204500 - DNA, 22 bp, Artificial Sequence
  Synthetic oligonucleotide; CTT chr2 60522823 60522844 60522840 60522845 +
ggatatacagctgactagatat

SEQ ID NO: 204501 - DNA, 22 bp, Artificial Sequence
  Synthetic oligonucleotide; TTG chr2 60522824 60522845 60522841 60522846 +
gatatacagctgactagatatg

SEQ ID NO: 204502 - DNA, 22 bp, Artificial Sequence
  Synthetic oligonucleotide; CTG chr2 60522836 60522857 60522853 60522858 +
actagatatgtcagttatgttc

SEQ ID NO: 204503 - DNA, 22 bp, Artificial Sequence
  Synthetic oligonucleotide; CTA chr2 60522840 60522861 60522857 60522862 +
gatatgtcagttatgttccaaa

SEQ ID NO: 204504 - DNA, 22 bp, Artificial Sequence
  Synthetic oligonucleotide; TTA chr2 60522853 60522874 60522870 60522875 +
tgttccaaatgggttttcacag

SEQ ID NO: 204505 - DNA, 22 bp, Artificial Sequence
  Synthetic oligonucleotide; TTC chr2 60522858 60522879 60522875 60522880 +
caaatgggttttcacaggtcaa

SEQ ID NO: 204506 - DNA, 22 bp, Artificial Sequence
  Synthetic oligonucleotide; TTT chr2 60522869 60522890 60522886 60522891 +
tcacaggtcaaggttctgcagg

SEQ ID NO: 204507 - DNA, 22 bp, Artificial Sequence
  Synthetic oligonucleotide; TTT chr2 60522870 60522891 60522887 60522892 +
cacaggtcaaggttctgcaggc

SEQ ID NO: 204508 - DNA, 22 bp, Artificial Sequence
  Synthetic oligonucleotide; TTC chr2 60522871 60522892 60522888 60522893 +
acaggtcaaggttctgcaggca

SEQ ID NO: 204509 - DNA, 22 bp, Artificial Sequence
  Synthetic oligonucleotide; TTC chr2 60522885 60522906 60522902 60522907 +
tgcaggcaagagcaaatactat

SEQ ID NO: 204510 - DNA, 22 bp, Artificial Sequence
  Synthetic oligonucleotide; CTG chr2 60522887 60522908 60522904 60522909 +
caggcaagagcaaatactattt

SEQ ID NO: 204511 - DNA, 22 bp, Artificial Sequence
  Synthetic oligonucleotide; CTA chr2 60522906 60522927 60522923 60522928 +
tttttagacaggataaggtcaa

SEQ ID NO: 204512 - DNA, 22 bp, Artificial Sequence
  Synthetic oligonucleotide; TTT chr2 60522909 60522930 60522926 60522931 +
ttagacaggataaggtcaaaat

SEQ ID NO: 204513 - DNA, 22 bp, Artificial Sequence
  Synthetic oligonucleotide; TTT chr2 60522910 60522931 60522927 60522932 +
tagacaggataaggtcaaaatg

SEQ ID NO: 204514 - DNA, 22 bp, Artificial Sequence
  Synthetic oligonucleotide; TTT chr2 60522911 60522932 60522928 60522933 +
agacaggataaggtcaaaatgc

SEQ ID NO: 204515 - DNA, 22 bp, Artificial Sequence
  Synthetic oligonucleotide; TTA chr2 60522912 60522933 60522929 60522934 +
gacaggataaggtcaaaatgct

SEQ ID NO: 204516 - DNA, 22 bp, Artificial Sequence
  Synthetic oligonucleotide; CTT chr2 60522935 60522956 60522952 60522957 +
ttagagacagtgaggtctacaa

SEQ ID NO: 204517 - DNA, 22 bp, Artificial Sequence
  Synthetic oligonucleotide; TTT chr2 60522936 60522957 60522953 60522958 +
tagagacagtgaggtctacaat

SEQ ID NO: 204518 - DNA, 22 bp, Artificial Sequence
  Synthetic oligonucleotide; TTT chr2 60522937 60522958 60522954 60522959 +
agagacagtgaggtctacaata

SEQ ID NO: 204519 - DNA, 22 bp, Artificial Sequence
  Synthetic oligonucleotide; TTA chr2 60522938 60522959 60522955 60522960 +
gagacagtgaggtctacaataa

SEQ ID NO: 204520 - DNA, 22 bp, Artificial Sequence
  Synthetic oligonucleotide; CTA chr2 60522954 60522975 60522971 60522976 +
caataaaacctattgatcagcc

SEQ ID NO: 204521 - DNA, 22 bp, Artificial Sequence
  Synthetic oligonucleotide; CTA chr2 60522966 60522987 60522983 60522988 +
ttgatcagcctctggaactagt

SEQ ID NO: 204522 - DNA, 22 bp, Artificial Sequence
  Synthetic oligonucleotide; TTG chr2 60522969 60522990 60522986 60522991 +
atcagcctctggaactagtgct

SEQ ID NO: 204523 - DNA, 22 bp, Artificial Sequence
  Synthetic oligonucleotide; CTC chr2 60522978 60522999 60522995 60523000 +
tggaactagtgctccagagaga

SEQ ID NO: 204524 - DNA, 22 bp, Artificial Sequence
  Synthetic oligonucleotide; CTG chr2 60522980 60523001 60522997 60523002 +
gaactagtgctccagagagaca

SEQ ID NO: 204525 - DNA, 22 bp, Artificial Sequence
  Synthetic oligonucleotide; CTA chr2 60522986 60523007 60523003 60523008 +
gtgctccagagagacacagaga

SEQ ID NO: 204526 - DNA, 22 bp, Artificial Sequence
  Synthetic oligonucleotide; CTC chr2 60522992 60523013 60523009 60523014 +
cagagagacacagagattgaaa

SEQ ID NO: 204527 - DNA, 22 bp, Artificial Sequence
  Synthetic oligonucleotide; TTG chr2 60523011 60523032 60523028 60523033 +
aaacaaaaattgcctggccgtt

SEQ ID NO: 204528 - DNA, 22 bp, Artificial Sequence
  Synthetic oligonucleotide; TTG chr2 60523023 60523044 60523040 60523045 +
cctggccgttttctctgtagac

SEQ ID NO: 204529 - DNA, 22 bp, Artificial Sequence
  Synthetic oligonucleotide; CTG chr2 60523027 60523048 60523044 60523049 +
gccgttttctctgtagactctg

SEQ ID NO: 204530 - DNA, 22 bp, Artificial Sequence
  Synthetic oligonucleotide; TTT chr2 60523034 60523055 60523051 60523056 +
tctctgtagactctgtgggtaa

SEQ ID NO: 204531 - DNA, 22 bp, Artificial Sequence
  Synthetic oligonucleotide; TTT chr2 60523035 60523056 60523052 60523057 +
ctctgtagactctgtgggtaaa

SEQ ID NO: 204532 - DNA, 22 bp, Artificial Sequence
  Synthetic oligonucleotide; TTC chr2 60523036 60523057 60523053 60523058 +
tctgtagactctgtgggtaaaa

SEQ ID NO: 204533 - DNA, 22 bp, Artificial Sequence
  Synthetic oligonucleotide; CTC chr2 60523038 60523059 60523055 60523060 +
tgtagactctgtgggtaaaagc

SEQ ID NO: 204534 - DNA, 22 bp, Artificial Sequence
  Synthetic oligonucleotide; CTG chr2 60523040 60523061 60523057 60523062 +
tagactctgtgggtaaaagctt

SEQ ID NO: 204535 - DNA, 22 bp, Artificial Sequence
  Synthetic oligonucleotide; CTC chr2 60523047 60523068 60523064 60523069 +
tgtgggtaaaagcttgttggac

SEQ ID NO: 204536 - DNA, 22 bp, Artificial Sequence
  Synthetic oligonucleotide; CTG chr2 60523049 60523070 60523066 60523071 +
tgggtaaaagcttgttggactt

SEQ ID NO: 204537 - DNA, 22 bp, Artificial Sequence
  Synthetic oligonucleotide; CTT chr2 60523062 60523083 60523079 60523084 +
gttggacttaatatctttcagg

SEQ ID NO: 204538 - DNA, 22 bp, Artificial Sequence
  Synthetic oligonucleotide; TTG chr2 60523063 60523084 60523080 60523085 +
ttggacttaatatctttcagga

SEQ ID NO: 204539 - DNA, 22 bp, Artificial Sequence
  Synthetic oligonucleotide; TTG chr2 60523066 60523087 60523083 60523088 +
gacttaatatctttcaggatat

SEQ ID NO: 204540 - DNA, 22 bp, Artificial Sequence
  Synthetic oligonucleotide; CTT chr2 60523071 60523092 60523088 60523093 +
aatatctttcaggatataaaat

SEQ ID NO: 204541 - DNA, 22 bp, Artificial Sequence
  Synthetic oligonucleotide; TTA chr2 60523072 60523093 60523089 60523094 +
atatctttcaggatataaaata

SEQ ID NO: 204542 - DNA, 22 bp, Artificial Sequence
  Synthetic oligonucleotide; CTT chr2 60523079 60523100 60523096 60523101 +
tcaggatataaaataagtaaga

SEQ ID NO: 204543 - DNA, 22 bp, Artificial Sequence
  Synthetic oligonucleotide; TTT chr2 60523080 60523101 60523097 60523102 +
caggatataaaataagtaagaa

SEQ ID NO: 204544 - DNA, 22 bp, Artificial Sequence
  Synthetic oligonucleotide; TTC chr2 60523081 60523102 60523098 60523103 +
aggatataaaataagtaagaag

SEQ ID NO: 204545 - DNA, 22 bp, Artificial Sequence
  Synthetic oligonucleotide; CTG chr2 60523109 60523130 60523126 60523131 +
tgtacagattactgaagtccat

SEQ ID NO: 204546 - DNA, 22 bp, Artificial Sequence
  Synthetic oligonucleotide; TTA chr2 60523120 60523141 60523137 60523142 +
ctgaagtccatttaaccagatg

SEQ ID NO: 204547 - DNA, 22 bp, Artificial Sequence
  Synthetic oligonucleotide; CTG chr2 60523123 60523144 60523140 60523145 +
aagtccatttaaccagatgcag

SEQ ID NO: 204548 - DNA, 22 bp, Artificial Sequence
  Synthetic oligonucleotide; TTT chr2 60523133 60523154 60523150 60523155 +
aaccagatgcagaggcaggtca

SEQ ID NO: 204549 - DNA, 22 bp, Artificial Sequence
  Synthetic oligonucleotide; TTA chr2 60523134 60523155 60523151 60523156 +
accagatgcagaggcaggtcac

SEQ ID NO: 204550 - DNA, 22 bp, Artificial Sequence
  Synthetic oligonucleotide; CTC chr2 60523169 60523190 60523186 60523191 +
atggcagaaccgtaaagaaggg

SEQ ID NO: 204551 - DNA, 22 bp, Artificial Sequence
  Synthetic oligonucleotide; TTT chr2 60523197 60523218 60523214 60523219 +
caaggcaacacgtgttgcaacc

SEQ ID NO: 204552 - DNA, 22 bp, Artificial Sequence
  Synthetic oligonucleotide; TTC chr2 60523198 60523219 60523215 60523220 +
aaggcaacacgtgttgcaacct

SEQ ID NO: 204553 - DNA, 22 bp, Artificial Sequence
  Synthetic oligonucleotide; TTG chr2 60523214 60523235 60523231 60523236 +
caacctagagaaagaataaaca

SEQ ID NO: 204554 - DNA, 22 bp, Artificial Sequence
  Synthetic oligonucleotide; CTA chr2 60523221 60523242 60523238 60523243 +
gagaaagaataaacaccagtct

SEQ ID NO: 204555 - DNA, 22 bp, Artificial Sequence
  Synthetic oligonucleotide; CTT chr2 60523244 60523265 60523261 60523266 +
ctcaactcaggggaggcacaaa

SEQ ID NO: 204556 - DNA, 22 bp, Artificial Sequence
  Synthetic oligonucleotide; TTC chr2 60523245 60523266 60523262 60523267 +
tcaactcaggggaggcacaaag

SEQ ID NO: 204557 - DNA, 22 bp, Artificial Sequence
  Synthetic oligonucleotide; CTC chr2 60523247 60523268 60523264 60523269 +
aactcaggggaggcacaaagga

SEQ ID NO: 204558 - DNA, 22 bp, Artificial Sequence
  Synthetic oligonucleotide; CTC chr2 60523252 60523273 60523269 60523274 +
aggggaggcacaaaggacagcc

SEQ ID NO: 204559 - DNA, 22 bp, Artificial Sequence
  Synthetic oligonucleotide; CTG chr2 60523276 60523297 60523293 60523298 +
ccatccaggattcctgcttggg

SEQ ID NO: 204560 - DNA, 22 bp, Artificial Sequence
  Synthetic oligonucleotide; TTC chr2 60523289 60523310 60523306 60523311 +
ctgcttgggactgttgctccta

SEQ ID NO: 204561 - DNA, 22 bp, Artificial Sequence
  Synthetic oligonucleotide; CTG chr2 60523292 60523313 60523309 60523314 +
cttgggactgttgctcctaaat

SEQ ID NO: 204562 - DNA, 22 bp, Artificial Sequence
  Synthetic oligonucleotide; CTT chr2 60523295 60523316 60523312 60523317 +
gggactgttgctcctaaatttg

SEQ ID NO: 204563 - DNA, 22 bp, Artificial Sequence
  Synthetic oligonucleotide; TTG chr2 60523296 60523317 60523313 60523318 +
ggactgttgctcctaaatttgc

SEQ ID NO: 204564 - DNA, 22 bp, Artificial Sequence
  Synthetic oligonucleotide; CTG chr2 60523302 60523323 60523319 60523324 +
ttgctcctaaatttgccactat

SEQ ID NO: 204565 - DNA, 22 bp, Artificial Sequence
  Synthetic oligonucleotide; TTG chr2 60523305 60523326 60523322 60523327 +
ctcctaaatttgccactatgat

SEQ ID NO: 204566 - DNA, 22 bp, Artificial Sequence
  Synthetic oligonucleotide; CTC chr2 60523308 60523329 60523325 60523330 +
ctaaatttgccactatgatcct

SEQ ID NO: 204567 - DNA, 22 bp, Artificial Sequence
  Synthetic oligonucleotide; CTA chr2 60523311 60523332 60523328 60523333 +
aatttgccactatgatcctcaa

SEQ ID NO: 204568 - DNA, 22 bp, Artificial Sequence
  Synthetic oligonucleotide; TTT chr2 60523316 60523337 60523333 60523338 +
gccactatgatcctcaatccag

SEQ ID NO: 204569 - DNA, 22 bp, Artificial Sequence
  Synthetic oligonucleotide; TTG chr2 60523317 60523338 60523334 60523339 +
ccactatgatcctcaatccagc

SEQ ID NO: 204570 - DNA, 22 bp, Artificial Sequence
  Synthetic oligonucleotide; CTA chr2 60523323 60523344 60523340 60523345 +
tgatcctcaatccagcgctatg

SEQ ID NO: 204571 - DNA, 22 bp, Artificial Sequence
  Synthetic oligonucleotide; CTC chr2 60523331 60523352 60523348 60523353 +
aatccagcgctatgtgaacaac

SEQ ID NO: 204572 - DNA, 22 bp, Artificial Sequence
  Synthetic oligonucleotide; CTA chr2 60523343 60523364 60523360 60523365 +
tgtgaacaacagactttcagat

SEQ ID NO: 204573 - DNA, 22 bp, Artificial Sequence
  Synthetic oligonucleotide; CTT chr2 60523359 60523380 60523376 60523381 +
tcagataaatagtatggagata

SEQ ID NO: 204574 - DNA, 22 bp, Artificial Sequence
  Synthetic oligonucleotide; TTT chr2 60523360 60523381 60523377 60523382 +
cagataaatagtatggagataa

SEQ ID NO: 204575 - DNA, 22 bp, Artificial Sequence
  Synthetic oligonucleotide; TTC chr2 60523361 60523382 60523378 60523383 +
agataaatagtatggagataat

SEQ ID NO: 204576 - DNA, 22 bp, Artificial Sequence
  Synthetic oligonucleotide; TTT chr2 60523385 60523406 60523402 60523407 +
gcttaagtcagattttgatgaa

SEQ ID NO: 204577 - DNA, 22 bp, Artificial Sequence
  Synthetic oligonucleotide; TTG chr2 60523386 60523407 60523403 60523408 +
cttaagtcagattttgatgaaa

SEQ ID NO: 204578 - DNA, 22 bp, Artificial Sequence
  Synthetic oligonucleotide; CTT chr2 60523389 60523410 60523406 60523411 +
aagtcagattttgatgaaaagt

SEQ ID NO: 204579 - DNA, 22 bp, Artificial Sequence
  Synthetic oligonucleotide; TTA chr2 60523390 60523411 60523407 60523412 +
agtcagattttgatgaaaagtg

SEQ ID NO: 204580 - DNA, 22 bp, Artificial Sequence
  Synthetic oligonucleotide; TTT chr2 60523400 60523421 60523417 60523422 +
tgatgaaaagtggtttctacat

SEQ ID NO: 204581 - DNA, 22 bp, Artificial Sequence
  Synthetic oligonucleotide; TTT chr2 60523401 60523422 60523418 60523423 +
gatgaaaagtggtttctacatg

SEQ ID NO: 204582 - DNA, 22 bp, Artificial Sequence
  Synthetic oligonucleotide; TTG chr2 60523402 60523423 60523419 60523424 +
atgaaaagtggtttctacatgg

SEQ ID NO: 204583 - DNA, 22 bp, Artificial Sequence
  Synthetic oligonucleotide; TTT chr2 60523416 60523437 60523433 60523438 +
ctacatggatagctttcaaaaa

SEQ ID NO: 204584 - DNA, 22 bp, Artificial Sequence
  Synthetic oligonucleotide; TTC chr2 60523417 60523438 60523434 60523439 +
tacatggatagctttcaaaaac

SEQ ID NO: 204585 - DNA, 22 bp, Artificial Sequence
  Synthetic oligonucleotide; CTA chr2 60523419 60523440 60523436 60523441 +
catggatagctttcaaaaactt

SEQ ID NO: 204586 - DNA, 22 bp, Artificial Sequence
  Synthetic oligonucleotide; CTT chr2 60523431 60523452 60523448 60523453 +
tcaaaaacttctatattgattt

SEQ ID NO: 204587 - DNA, 22 bp, Artificial Sequence
  Synthetic oligonucleotide; TTT chr2 60523432 60523453 60523449 60523454 +
caaaaacttctatattgatttg

SEQ ID NO: 204588 - DNA, 22 bp, Artificial Sequence
  Synthetic oligonucleotide; TTC chr2 60523433 60523454 60523450 60523455 +
aaaaacttctatattgatttga

SEQ ID NO: 204589 - DNA, 22 bp, Artificial Sequence
  Synthetic oligonucleotide; CTT chr2 60523441 60523462 60523458 60523463 +
ctatattgatttgatggaatca

SEQ ID NO: 204590 - DNA, 22 bp, Artificial Sequence
  Synthetic oligonucleotide; TTC chr2 60523442 60523463 60523459 60523464 +
tatattgatttgatggaatcat

SEQ ID NO: 204591 - DNA, 22 bp, Artificial Sequence
  Synthetic oligonucleotide; CTA chr2 60523444 60523465 60523461 60523466 +
tattgatttgatggaatcatgg

SEQ ID NO: 204592 - DNA, 22 bp, Artificial Sequence
  Synthetic oligonucleotide; TTG chr2 60523449 60523470 60523466 60523471 +
atttgatggaatcatggtgaat

SEQ ID NO: 204593 - DNA, 22 bp, Artificial Sequence
  Synthetic oligonucleotide; TTT chr2 60523453 60523474 60523470 60523475 +
gatggaatcatggtgaattcta

SEQ ID NO: 204594 - DNA, 22 bp, Artificial Sequence
  Synthetic oligonucleotide; TTG chr2 60523454 60523475 60523471 60523476 +
atggaatcatggtgaattctaa

SEQ ID NO: 204595 - DNA, 22 bp, Artificial Sequence
  Synthetic oligonucleotide; TTC chr2 60523473 60523494 60523490 60523495 +
taaagactttcctattctctct

SEQ ID NO: 204596 - DNA, 22 bp, Artificial Sequence
  Synthetic oligonucleotide; CTA chr2 60523475 60523496 60523492 60523497 +
aagactttcctattctctctct

SEQ ID NO: 204597 - DNA, 22 bp, Artificial Sequence
  Synthetic oligonucleotide; CTT chr2 60523482 60523503 60523499 60523504 +
tcctattctctctctctccctt

SEQ ID NO: 204598 - DNA, 22 bp, Artificial Sequence
  Synthetic oligonucleotide; TTT chr2 60523483 60523504 60523500 60523505 +
cctattctctctctctcccttt

SEQ ID NO: 204599 - DNA, 22 bp, Artificial Sequence
  Synthetic oligonucleotide; TTC chr2 60523484 60523505 60523501 60523506 +
ctattctctctctctccctttc

SEQ ID NO: 204600 - DNA, 22 bp, Artificial Sequence
  Synthetic oligonucleotide; CTA chr2 60523487 60523508 60523504 60523509 +
ttctctctctctccctttctac

SEQ ID NO: 204601 - DNA, 22 bp, Artificial Sequence
  Synthetic oligonucleotide; TTC chr2 60523490 60523511 60523507 60523512 +
tctctctctccctttctacaca

SEQ ID NO: 204602 - DNA, 22 bp, Artificial Sequence
  Synthetic oligonucleotide; CTC chr2 60523492 60523513 60523509 60523514 +
tctctctccctttctacacaca

SEQ ID NO: 204603 - DNA, 22 bp, Artificial Sequence
  Synthetic oligonucleotide; CTC chr2 60523494 60523515 60523511 60523516 +
tctctccctttctacacacaca

SEQ ID NO: 204604 - DNA, 22 bp, Artificial Sequence
  Synthetic oligonucleotide; CTC chr2 60523496 60523517 60523513 60523518 +
tctccctttctacacacacaca

SEQ ID NO: 204605 - DNA, 22 bp, Artificial Sequence
  Synthetic oligonucleotide; CTC chr2 60523498 60523519 60523515 60523520 +
tccctttctacacacacacagg

SEQ ID NO: 204606 - DNA, 22 bp, Artificial Sequence
  Synthetic oligonucleotide; CTC chr2 60523500 60523521 60523517 60523522 +
cctttctacacacacacaggca

SEQ ID NO: 204607 - DNA, 22 bp, Artificial Sequence
  Synthetic oligonucleotide; CTT chr2 60523504 60523525 60523521 60523526 +
tctacacacacacaggcacaca

SEQ ID NO: 204608 - DNA, 22 bp, Artificial Sequence
  Synthetic oligonucleotide; TTT chr2 60523505 60523526 60523522 60523527 +
ctacacacacacaggcacacaa

SEQ ID NO: 204609 - DNA, 22 bp, Artificial Sequence
  Synthetic oligonucleotide; TTC chr2 60523506 60523527 60523523 60523528 +
tacacacacacaggcacacaac

SEQ ID NO: 204610 - DNA, 22 bp, Artificial Sequence
  Synthetic oligonucleotide; CTA chr2 60523508 60523529 60523525 60523530 +
cacacacacaggcacacaacta

SEQ ID NO: 204611 - DNA, 22 bp, Artificial Sequence
  Synthetic oligonucleotide; CTA chr2 60523530 60523551 60523547 60523552 +
tatatatattcatacatgcata

SEQ ID NO: 204612 - DNA, 22 bp, Artificial Sequence
  Synthetic oligonucleotide; TTC chr2 60523541 60523562 60523558 60523563 +
atacatgcatatacgtatgtat

SEQ ID NO: 204613 - DNA, 22 bp, Artificial Sequence
  Synthetic oligonucleotide; CTT chr2 60523618 60523639 60523635 60523640 +
tatcttatgatgacagtgttga

SEQ ID NO: 204614 - DNA, 22 bp, Artificial Sequence
  Synthetic oligonucleotide; TTT chr2 60523619 60523640 60523636 60523641 +
atcttatgatgacagtgttgat

SEQ ID NO: 204615 - DNA, 22 bp, Artificial Sequence
  Synthetic oligonucleotide; TTA chr2 60523620 60523641 60523637 60523642 +
tcttatgatgacagtgttgatg

SEQ ID NO: 204616 - DNA, 22 bp, Artificial Sequence
  Synthetic oligonucleotide; CTT chr2 60523624 60523645 60523641 60523646 +
atgatgacagtgttgatgtgtt

SEQ ID NO: 204617 - DNA, 22 bp, Artificial Sequence
  Synthetic oligonucleotide; TTA chr2 60523625 60523646 60523642 60523647 +
tgatgacagtgttgatgtgttt

SEQ ID NO: 204618 - DNA, 22 bp, Artificial Sequence
  Synthetic oligonucleotide; TTG chr2 60523639 60523660 60523656 60523661 +
atgtgtttggggattttttttt

SEQ ID NO: 204619 - DNA, 22 bp, Artificial Sequence
  Synthetic oligonucleotide; TTT chr2 60523647 60523668 60523664 60523669 +
ggggatttttttttttttcaaa

SEQ ID NO: 204620 - DNA, 22 bp, Artificial Sequence
  Synthetic oligonucleotide; TTG chr2 60523648 60523669 60523665 60523670 +
gggatttttttttttttcaaaa

SEQ ID NO: 204621 - DNA, 22 bp, Artificial Sequence
  Synthetic oligonucleotide; TTT chr2 60523655 60523676 60523672 60523677 +
ttttttttttcaaaaagagtta

SEQ ID NO: 204622 - DNA, 22 bp, Artificial Sequence
  Synthetic oligonucleotide; TTT chr2 60523656 60523677 60523673 60523678 +
tttttttttcaaaaagagttaa

SEQ ID NO: 204623 - DNA, 22 bp, Artificial Sequence
  Synthetic oligonucleotide; TTT chr2 60523657 60523678 60523674 60523679 +
ttttttttcaaaaagagttaat

SEQ ID NO: 204624 - DNA, 22 bp, Artificial Sequence
  Synthetic oligonucleotide; TTT chr2 60523658 60523679 60523675 60523680 +
tttttttcaaaaagagttaata

SEQ ID NO: 204625 - DNA, 22 bp, Artificial Sequence
  Synthetic oligonucleotide; TTT chr2 60523659 60523680 60523676 60523681 +
ttttttcaaaaagagttaataa

SEQ ID NO: 204626 - DNA, 22 bp, Artificial Sequence
  Synthetic oligonucleotide; TTT chr2 60523660 60523681 60523677 60523682 +
tttttcaaaaagagttaataag

SEQ ID NO: 204627 - DNA, 22 bp, Artificial Sequence
  Synthetic oligonucleotide; TTT chr2 60523661 60523682 60523678 60523683 +
ttttcaaaaagagttaataagc

SEQ ID NO: 204628 - DNA, 22 bp, Artificial Sequence
  Synthetic oligonucleotide; TTT chr2 60523662 60523683 60523679 60523684 +
tttcaaaaagagttaataagcc

SEQ ID NO: 204629 - DNA, 22 bp, Artificial Sequence
  Synthetic oligonucleotide; TTT chr2 60523663 60523684 60523680 60523685 +
ttcaaaaagagttaataagcct

SEQ ID NO: 204630 - DNA, 22 bp, Artificial Sequence
  Synthetic oligonucleotide; TTT chr2 60523664 60523685 60523681 60523686 +
tcaaaaagagttaataagcctt

SEQ ID NO: 204631 - DNA, 22 bp, Artificial Sequence
  Synthetic oligonucleotide; TTT chr2 60523665 60523686 60523682 60523687 +
caaaaagagttaataagccttt

SEQ ID NO: 204632 - DNA, 22 bp, Artificial Sequence
  Synthetic oligonucleotide; TTC chr2 60523666 60523687 60523683 60523688 +
aaaaagagttaataagcctttt

SEQ ID NO: 204633 - DNA, 22 bp, Artificial Sequence
  Synthetic oligonucleotide; TTA chr2 60523677 60523698 60523694 60523699 +
ataagccttttataggtgtacc

SEQ ID NO: 204634 - DNA, 22 bp, Artificial Sequence
  Synthetic oligonucleotide; CTT chr2 60523686 60523707 60523703 60523708 +
ttataggtgtaccacacaagac

SEQ ID NO: 204635 - DNA, 22 bp, Artificial Sequence
  Synthetic oligonucleotide; TTT chr2 60523687 60523708 60523704 60523709 +
tataggtgtaccacacaagact

SEQ ID NO: 204636 - DNA, 22 bp, Artificial Sequence
  Synthetic oligonucleotide; TTT chr2 60523688 60523709 60523705 60523710 +
ataggtgtaccacacaagactc

SEQ ID NO: 204637 - DNA, 22 bp, Artificial Sequence
  Synthetic oligonucleotide; TTA chr2 60523689 60523710 60523706 60523711 +
taggtgtaccacacaagactcc

SEQ ID NO: 204638 - DNA, 22 bp, Artificial Sequence
  Synthetic oligonucleotide; CTC chr2 60523710 60523731 60523727 60523732 +
cagtaagcaaaatcattcattg

SEQ ID NO: 204639 - DNA, 22 bp, Artificial Sequence
  Synthetic oligonucleotide; TTC chr2 60523728 60523749 60523745 60523750 +
attgccaggcaaaacttgagaa

SEQ ID NO: 204640 - DNA, 22 bp, Artificial Sequence
  Synthetic oligonucleotide; TTG chr2 60523732 60523753 60523749 60523754 +
ccaggcaaaacttgagaaatac

SEQ ID NO: 204641 - DNA, 22 bp, Artificial Sequence
  Synthetic oligonucleotide; CTT chr2 60523745 60523766 60523762 60523767 +
gagaaatacatttagaaatcat

SEQ ID NO: 204642 - DNA, 22 bp, Artificial Sequence
  Synthetic oligonucleotide; TTG chr2 60523746 60523767 60523763 60523768 +
agaaatacatttagaaatcata

SEQ ID NO: 204643 - DNA, 22 bp, Artificial Sequence
  Synthetic oligonucleotide; TTT chr2 60523758 60523779 60523775 60523780 +
agaaatcatacgagcacacagg

SEQ ID NO: 204644 - DNA, 22 bp, Artificial Sequence
  Synthetic oligonucleotide; TTA chr2 60523759 60523780 60523776 60523781 +
gaaatcatacgagcacacagga

SEQ ID NO: 204645 - DNA, 22 bp, Artificial Sequence
  Synthetic oligonucleotide; CTC chr2 60523785 60523806 60523802 60523807 +
aatcaagtaaatgaatcaccaa

SEQ ID NO: 204646 - DNA, 22 bp, Artificial Sequence
  Synthetic oligonucleotide; CTG chr2 60523824 60523845 60523841 60523846 +
gaaaattacttaactagcccaa

SEQ ID NO: 204647 - DNA, 22 bp, Artificial Sequence
  Synthetic oligonucleotide; TTA chr2 60523832 60523853 60523849 60523854 +
cttaactagcccaaacgttcaa

SEQ ID NO: 204648 - DNA, 22 bp, Artificial Sequence
  Synthetic oligonucleotide; CTT chr2 60523835 60523856 60523852 60523857 +
aactagcccaaacgttcaagaa

SEQ ID NO: 204649 - DNA, 22 bp, Artificial Sequence
  Synthetic oligonucleotide; TTA chr2 60523836 60523857 60523853 60523858 +
actagcccaaacgttcaagaat

SEQ ID NO: 204650 - DNA, 22 bp, Artificial Sequence
  Synthetic oligonucleotide; CTA chr2 60523840 60523861 60523857 60523862 +
gcccaaacgttcaagaattgac

SEQ ID NO: 204651 - DNA, 22 bp, Artificial Sequence
  Synthetic oligonucleotide; TTC chr2 60523852 60523873 60523869 60523874 +
aagaattgaccaaggtttaagc

SEQ ID NO: 204652 - DNA, 22 bp, Artificial Sequence
  Synthetic oligonucleotide; TTG chr2 60523860 60523881 60523877 60523882 +
accaaggtttaagcagtaaacc

SEQ ID NO: 204653 - DNA, 22 bp, Artificial Sequence
  Synthetic oligonucleotide; TTT chr2 60523870 60523891 60523887 60523892 +
aagcagtaaaccctaaataatt

SEQ ID NO: 204654 - DNA, 22 bp, Artificial Sequence
  Synthetic oligonucleotide; TTA chr2 60523871 60523892 60523888 60523893 +
agcagtaaaccctaaataattt

SEQ ID NO: 204655 - DNA, 22 bp, Artificial Sequence
  Synthetic oligonucleotide; CTA chr2 60523885 60523906 60523902 60523907 +
aataatttatttaagccaaata

SEQ ID NO: 204656 - DNA, 22 bp, Artificial Sequence
  Synthetic oligonucleotide; TTT chr2 60523893 60523914 60523910 60523915 +
atttaagccaaataggagcttt

SEQ ID NO: 204657 - DNA, 22 bp, Artificial Sequence
  Synthetic oligonucleotide; TTA chr2 60523894 60523915 60523911 60523916 +
tttaagccaaataggagcttta

SEQ ID NO: 204658 - DNA, 22 bp, Artificial Sequence
  Synthetic oligonucleotide; TTT chr2 60523897 60523918 60523914 60523919 +
aagccaaataggagctttaagc

SEQ ID NO: 204659 - DNA, 22 bp, Artificial Sequence
  Synthetic oligonucleotide; TTA chr2 60523898 60523919 60523915 60523920 +
agccaaataggagctttaagca

SEQ ID NO: 204660 - DNA, 22 bp, Artificial Sequence
  Synthetic oligonucleotide; CTT chr2 60523914 60523935 60523931 60523936 +
taagcacagacattaatgtaat

SEQ ID NO: 204661 - DNA, 22 bp, Artificial Sequence
  Synthetic oligonucleotide; TTT chr2 60523915 60523936 60523932 60523937 +
aagcacagacattaatgtaatg

SEQ ID NO: 204662 - DNA, 22 bp, Artificial Sequence
  Synthetic oligonucleotide; TTA chr2 60523916 60523937 60523933 60523938 +
agcacagacattaatgtaatgg

SEQ ID NO: 204663 - DNA, 22 bp, Artificial Sequence
  Synthetic oligonucleotide; TTA chr2 60523929 60523950 60523946 60523951 +
atgtaatggactatcccatctt

SEQ ID NO: 204664 - DNA, 22 bp, Artificial Sequence
  Synthetic oligonucleotide; CTA chr2 60523942 60523963 60523959 60523964 +
tcccatcttaaacttcagccag

SEQ ID NO: 204665 - DNA, 22 bp, Artificial Sequence
  Synthetic oligonucleotide; CTT chr2 60523951 60523972 60523968 60523973 +
aaacttcagccagagatctaaa

SEQ ID NO: 204666 - DNA, 22 bp, Artificial Sequence
  Synthetic oligonucleotide; TTA chr2 60523952 60523973 60523969 60523974 +
aacttcagccagagatctaaaa

SEQ ID NO: 204667 - DNA, 22 bp, Artificial Sequence
  Synthetic oligonucleotide; CTT chr2 60523957 60523978 60523974 60523979 +
cagccagagatctaaaactttg

SEQ ID NO: 204668 - DNA, 22 bp, Artificial Sequence
  Synthetic oligonucleotide; TTC chr2 60523958 60523979 60523975 60523980 +
agccagagatctaaaactttga

SEQ ID NO: 204669 - DNA, 22 bp, Artificial Sequence
  Synthetic oligonucleotide; CTA chr2 60523971 60523992 60523988 60523993 +
aaactttgaagtcaattatgtt

SEQ ID NO: 204670 - DNA, 22 bp, Artificial Sequence
  Synthetic oligonucleotide; CTT chr2 60523977 60523998 60523994 60523999 +
tgaagtcaattatgttcccata

SEQ ID NO: 204671 - DNA, 22 bp, Artificial Sequence
  Synthetic oligonucleotide; TTT chr2 60523978 60523999 60523995 60524000 +
gaagtcaattatgttcccataa

SEQ ID NO: 204672 - DNA, 22 bp, Artificial Sequence
  Synthetic oligonucleotide; TTG chr2 60523979 60524000 60523996 60524001 +
aagtcaattatgttcccataaa

SEQ ID NO: 204673 - DNA, 22 bp, Artificial Sequence
  Synthetic oligonucleotide; TTA chr2 60523989 60524010 60524006 60524011 +
tgttcccataaatacctctcca

SEQ ID NO: 204674 - DNA, 22 bp, Artificial Sequence
  Synthetic oligonucleotide; TTC chr2 60523994 60524015 60524011 60524016 +
ccataaatacctctccattatc

SEQ ID NO: 204675 - DNA, 22 bp, Artificial Sequence
  Synthetic oligonucleotide; CTC chr2 60524007 60524028 60524024 60524029 +
tccattatcaggggtgctttat

SEQ ID NO: 204676 - DNA, 22 bp, Artificial Sequence
  Synthetic oligonucleotide; CTC chr2 60524009 60524030 60524026 60524031 +
cattatcaggggtgctttattg

SEQ ID NO: 204677 - DNA, 22 bp, Artificial Sequence
  Synthetic oligonucleotide; TTA chr2 60524014 60524035 60524031 60524036 +
tcaggggtgctttattgtttga

SEQ ID NO: 204678 - DNA, 22 bp, Artificial Sequence
  Synthetic oligonucleotide; CTT chr2 60524026 60524047 60524043 60524048 +
tattgtttgagagactccggac

SEQ ID NO: 204679 - DNA, 22 bp, Artificial Sequence
  Synthetic oligonucleotide; TTT chr2 60524027 60524048 60524044 60524049 +
attgtttgagagactccggacc

SEQ ID NO: 204680 - DNA, 22 bp, Artificial Sequence
  Synthetic oligonucleotide; TTA chr2 60524028 60524049 60524045 60524050 +
ttgtttgagagactccggacca

SEQ ID NO: 204681 - DNA, 22 bp, Artificial Sequence
  Synthetic oligonucleotide; TTG chr2 60524031 60524052 60524048 60524053 +
tttgagagactccggaccacag

SEQ ID NO: 204682 - DNA, 22 bp, Artificial Sequence
  Synthetic oligonucleotide; TTT chr2 60524034 60524055 60524051 60524056 +
gagagactccggaccacaggaa

SEQ ID NO: 204683 - DNA, 22 bp, Artificial Sequence
  Synthetic oligonucleotide; TTG chr2 60524035 60524056 60524052 60524057 +
agagactccggaccacaggaac

SEQ ID NO: 204684 - DNA, 22 bp, Artificial Sequence
  Synthetic oligonucleotide; CTC chr2 60524043 60524064 60524060 60524065 +
cggaccacaggaactagtgtga

SEQ ID NO: 204685 - DNA, 22 bp, Artificial Sequence
  Synthetic oligonucleotide; CTA chr2 60524059 60524080 60524076 60524081 +
gtgtgaaaactggagggtatct

SEQ ID NO: 204686 - DNA, 22 bp, Artificial Sequence
  Synthetic oligonucleotide; CTG chr2 60524071 60524092 60524088 60524093 +
gagggtatcttcatttatcatc

SEQ ID NO: 204687 - DNA, 22 bp, Artificial Sequence
  Synthetic oligonucleotide; CTT chr2 60524082 60524103 60524099 60524104 +
catttatcatccgctcccattt

SEQ ID NO: 204688 - DNA, 22 bp, Artificial Sequence
  Synthetic oligonucleotide; TTC chr2 60524083 60524104 60524100 60524105 +
atttatcatccgctcccatttc

SEQ ID NO: 204689 - DNA, 22 bp, Artificial Sequence
  Synthetic oligonucleotide; TTT chr2 60524087 60524108 60524104 60524109 +
atcatccgctcccatttcgcaa

SEQ ID NO: 204690 - DNA, 22 bp, Artificial Sequence
  Synthetic oligonucleotide; TTA chr2 60524088 60524109 60524105 60524110 +
tcatccgctcccatttcgcaaa

SEQ ID NO: 204691 - DNA, 22 bp, Artificial Sequence
  Synthetic oligonucleotide; CTC chr2 60524098 60524119 60524115 60524120 +
ccatttcgcaaacaaaatatgc

SEQ ID NO: 204692 - DNA, 22 bp, Artificial Sequence
  Synthetic oligonucleotide; TTT chr2 60524104 60524125 60524121 60524126 +
cgcaaacaaaatatgccatggt

SEQ ID NO: 204693 - DNA, 22 bp, Artificial Sequence
  Synthetic oligonucleotide; TTC chr2 60524105 60524126 60524122 60524127 +
gcaaacaaaatatgccatggta

SEQ ID NO: 204694 - DNA, 22 bp, Artificial Sequence
  Synthetic oligonucleotide; CTA chr2 60524138 60524159 60524155 60524160 +
tatatcacattgtgacacagct

SEQ ID NO: 204695 - DNA, 22 bp, Artificial Sequence
  Synthetic oligonucleotide; TTG chr2 60524150 60524171 60524167 60524172 +
tgacacagctgaccgcattagt

SEQ ID NO: 204696 - DNA, 22 bp, Artificial Sequence
  Synthetic oligonucleotide; CTG chr2 60524161 60524182 60524178 60524183 +
accgcattagtgagccaagact

SEQ ID NO: 204697 - DNA, 22 bp, Artificial Sequence
  Synthetic oligonucleotide; TTA chr2 60524170 60524191 60524187 60524192 +
gtgagccaagactgtcctagcg

SEQ ID NO: 204698 - DNA, 22 bp, Artificial Sequence
  Synthetic oligonucleotide; CTG chr2 60524184 60524205 60524201 60524206 +
tcctagcggcagcttcctatca

SEQ ID NO: 204699 - DNA, 22 bp, Artificial Sequence
  Synthetic oligonucleotide; CTA chr2 60524189 60524210 60524206 60524211 +
gcggcagcttcctatcatgcat

SEQ ID NO: 204700 - DNA, 22 bp, Artificial Sequence
  Synthetic oligonucleotide; CTT chr2 60524199 60524220 60524216 60524221 +
cctatcatgcattaacaataca

SEQ ID NO: 204701 - DNA, 22 bp, Artificial Sequence
  Synthetic oligonucleotide; TTC chr2 60524200 60524221 60524217 60524222 +
ctatcatgcattaacaatacaa

SEQ ID NO: 204702 - DNA, 22 bp, Artificial Sequence
  Synthetic oligonucleotide; CTA chr2 60524203 60524224 60524220 60524225 +
tcatgcattaacaatacaacgg

SEQ ID NO: 204703 - DNA, 22 bp, Artificial Sequence
  Synthetic oligonucleotide; TTA chr2 60524213 60524234 60524230 60524235 +
acaatacaacggctgatacatt

SEQ ID NO: 204704 - DNA, 22 bp, Artificial Sequence
  Synthetic oligonucleotide; CTG chr2 60524228 60524249 60524245 60524250 +
atacatttgcacaacacaataa

SEQ ID NO: 204705 - DNA, 22 bp, Artificial Sequence
  Synthetic oligonucleotide; TTT chr2 60524236 60524257 60524253 60524258 +
gcacaacacaataagaggtggg

SEQ ID NO: 204706 - DNA, 22 bp, Artificial Sequence
  Synthetic oligonucleotide; TTG chr2 60524237 60524258 60524254 60524259 +
cacaacacaataagaggtgggg

SEQ ID NO: 204707 - DNA, 22 bp, Artificial Sequence
  Synthetic oligonucleotide; TTG chr2 60524276 60524297 60524293 60524298 +
ggctatgaaatcctaaacttca

SEQ ID NO: 204708 - DNA, 22 bp, Artificial Sequence
  Synthetic oligonucleotide; CTA chr2 60524281 60524302 60524298 60524303 +
tgaaatcctaaacttcatgtct

SEQ ID NO: 204709 - DNA, 22 bp, Artificial Sequence
  Synthetic oligonucleotide; CTA chr2 60524291 60524312 60524308 60524313 +
aacttcatgtctgaatacataa

SEQ ID NO: 204710 - DNA, 22 bp, Artificial Sequence
  Synthetic oligonucleotide; CTT chr2 60524296 60524317 60524313 60524318 +
catgtctgaatacataattttg

SEQ ID NO: 204711 - DNA, 22 bp, Artificial Sequence
  Synthetic oligonucleotide; TTC chr2 60524297 60524318 60524314 60524319 +
atgtctgaatacataattttgt

SEQ ID NO: 204712 - DNA, 22 bp, Artificial Sequence
  Synthetic oligonucleotide; CTG chr2 60524304 60524325 60524321 60524326 +
aatacataattttgtcacctat

SEQ ID NO: 204713 - DNA, 22 bp, Artificial Sequence
  Synthetic oligonucleotide; TTT chr2 60524316 60524337 60524333 60524338 +
tgtcacctatctctggcatgaa

SEQ ID NO: 204714 - DNA, 22 bp, Artificial Sequence
  Synthetic oligonucleotide; TTT chr2 60524317 60524338 60524334 60524339 +
gtcacctatctctggcatgaat

SEQ ID NO: 204715 - DNA, 22 bp, Artificial Sequence
  Synthetic oligonucleotide; TTG chr2 60524318 60524339 60524335 60524340 +
tcacctatctctggcatgaatg

SEQ ID NO: 204716 - DNA, 22 bp, Artificial Sequence
  Synthetic oligonucleotide; CTA chr2 60524325 60524346 60524342 60524347 +
tctctggcatgaatgttatcat

SEQ ID NO: 204717 - DNA, 22 bp, Artificial Sequence
  Synthetic oligonucleotide; CTC chr2 60524329 60524350 60524346 60524351 +
tggcatgaatgttatcatgctt

SEQ ID NO: 204718 - DNA, 22 bp, Artificial Sequence
  Synthetic oligonucleotide; CTG chr2 60524331 60524352 60524348 60524353 +
gcatgaatgttatcatgctttt

SEQ ID NO: 204719 - DNA, 22 bp, Artificial Sequence
  Synthetic oligonucleotide; TTA chr2 60524343 60524364 60524360 60524365 +
tcatgcttttatttcaggtaat

SEQ ID NO: 204720 - DNA, 22 bp, Artificial Sequence
  Synthetic oligonucleotide; CTT chr2 60524351 60524372 60524368 60524373 +
ttatttcaggtaataatggaag

SEQ ID NO: 204721 - DNA, 22 bp, Artificial Sequence
  Synthetic oligonucleotide; TTT chr2 60524352 60524373 60524369 60524374 +
tatttcaggtaataatggaagg

SEQ ID NO: 204722 - DNA, 22 bp, Artificial Sequence
  Synthetic oligonucleotide; TTT chr2 60524353 60524374 60524370 60524375 +
atttcaggtaataatggaaggg

SEQ ID NO: 204723 - DNA, 22 bp, Artificial Sequence
  Synthetic oligonucleotide; TTA chr2 60524354 60524375 60524371 60524376 +
tttcaggtaataatggaagggg

SEQ ID NO: 204724 - DNA, 22 bp, Artificial Sequence
  Synthetic oligonucleotide; TTT chr2 60524357 60524378 60524374 60524379 +
caggtaataatggaaggggaaa

SEQ ID NO: 204725 - DNA, 22 bp, Artificial Sequence
  Synthetic oligonucleotide; TTC chr2 60524358 60524379 60524375 60524380 +
aggtaataatggaaggggaaag

SEQ ID NO: 204726 - DNA, 22 bp, Artificial Sequence
  Synthetic oligonucleotide; CTC chr2 60524389 60524410 60524406 60524411 +
tggggggctgccattcattcgg

SEQ ID NO: 204727 - DNA, 22 bp, Artificial Sequence
  Synthetic oligonucleotide; CTG chr2 60524391 60524412 60524408 60524413 +
gggggctgccattcattcggcc

SEQ ID NO: 204728 - DNA, 22 bp, Artificial Sequence
  Synthetic oligonucleotide; CTG chr2 60524399 60524420 60524416 60524421 +
ccattcattcggcctgttattt

SEQ ID NO: 204729 - DNA, 22 bp, Artificial Sequence
  Synthetic oligonucleotide; TTC chr2 60524405 60524426 60524422 60524427 +
attcggcctgttatttgctttt

SEQ ID NO: 204730 - DNA, 22 bp, Artificial Sequence
  Synthetic oligonucleotide; TTC chr2 60524409 60524430 60524426 60524431 +
ggcctgttatttgcttttgggt

SEQ ID NO: 204731 - DNA, 22 bp, Artificial Sequence
  Synthetic oligonucleotide; CTG chr2 60524415 60524436 60524432 60524437 +
ttatttgcttttgggttgggtt

SEQ ID NO: 204732 - DNA, 22 bp, Artificial Sequence
  Synthetic oligonucleotide; TTA chr2 60524418 60524439 60524435 60524440 +
tttgcttttgggttgggttagg

SEQ ID NO: 204733 - DNA, 22 bp, Artificial Sequence
  Synthetic oligonucleotide; TTT chr2 60524421 60524442 60524438 60524443 +
gcttttgggttgggttagggct

SEQ ID NO: 204734 - DNA, 22 bp, Artificial Sequence
  Synthetic oligonucleotide; TTG chr2 60524422 60524443 60524439 60524444 +
cttttgggttgggttagggcta

SEQ ID NO: 204735 - DNA, 22 bp, Artificial Sequence
  Synthetic oligonucleotide; CTT chr2 60524425 60524446 60524442 60524447 +
ttgggttgggttagggctaaac

SEQ ID NO: 204736 - DNA, 22 bp, Artificial Sequence
  Synthetic oligonucleotide; TTT chr2 60524426 60524447 60524443 60524448 +
tgggttgggttagggctaaact

SEQ ID NO: 204737 - DNA, 22 bp, Artificial Sequence
  Synthetic oligonucleotide; TTT chr2 60524427 60524448 60524444 60524449 +
gggttgggttagggctaaactt

SEQ ID NO: 204738 - DNA, 22 bp, Artificial Sequence
  Synthetic oligonucleotide; TTG chr2 60524428 60524449 60524445 60524450 +
ggttgggttagggctaaacttt

SEQ ID NO: 204739 - DNA, 22 bp, Artificial Sequence
  Synthetic oligonucleotide; TTG chr2 60524433 60524454 60524450 60524455 +
ggttagggctaaactttatgtt

SEQ ID NO: 204740 - DNA, 22 bp, Artificial Sequence
  Synthetic oligonucleotide; TTA chr2 60524438 60524459 60524455 60524460 +
gggctaaactttatgttccttg

SEQ ID NO: 204741 - DNA, 22 bp, Artificial Sequence
  Synthetic oligonucleotide; CTA chr2 60524444 60524465 60524461 60524466 +
aactttatgttccttgtttttg

SEQ ID NO: 204742 - DNA, 22 bp, Artificial Sequence
  Synthetic oligonucleotide; CTT chr2 60524449 60524470 60524466 60524471 +
tatgttccttgtttttgttttt

SEQ ID NO: 204743 - DNA, 22 bp, Artificial Sequence
  Synthetic oligonucleotide; TTT chr2 60524450 60524471 60524467 60524472 +
atgttccttgtttttgtttttg

SEQ ID NO: 204744 - DNA, 22 bp, Artificial Sequence
  Synthetic oligonucleotide; TTA chr2 60524451 60524472 60524468 60524473 +
tgttccttgtttttgtttttgt

SEQ ID NO: 204745 - DNA, 22 bp, Artificial Sequence
  Synthetic oligonucleotide; TTC chr2 60524456 60524477 60524473 60524478 +
cttgtttttgtttttgtttttt

SEQ ID NO: 204746 - DNA, 22 bp, Artificial Sequence
  Synthetic oligonucleotide; CTT chr2 60524459 60524480 60524476 60524481 +
gtttttgtttttgttttttttt

SEQ ID NO: 204747 - DNA, 22 bp, Artificial Sequence
  Synthetic oligonucleotide; TTG chr2 60524460 60524481 60524477 60524482 +
tttttgtttttgtttttttttc

SEQ ID NO: 204748 - DNA, 22 bp, Artificial Sequence
  Synthetic oligonucleotide; TTT chr2 60524463 60524484 60524480 60524485 +
ttgtttttgtttttttttcttt

SEQ ID NO: 204749 - DNA, 22 bp, Artificial Sequence
  Synthetic oligonucleotide; TTT chr2 60524464 60524485 60524481 60524486 +
tgtttttgtttttttttctttt

SEQ ID NO: 204750 - DNA, 22 bp, Artificial Sequence
  Synthetic oligonucleotide; TTT chr2 60524465 60524486 60524482 60524487 +
gtttttgtttttttttcttttt

SEQ ID NO: 204751 - DNA, 22 bp, Artificial Sequence
  Synthetic oligonucleotide; TTG chr2 60524466 60524487 60524483 60524488 +
tttttgtttttttttctttttt

SEQ ID NO: 204752 - DNA, 22 bp, Artificial Sequence
  Synthetic oligonucleotide; TTT chr2 60524469 60524490 60524486 60524491 +
ttgtttttttttcttttttctt

SEQ ID NO: 204753 - DNA, 22 bp, Artificial Sequence
  Synthetic oligonucleotide; TTT chr2 60524470 60524491 60524487 60524492 +
tgtttttttttcttttttcttg

SEQ ID NO: 204754 - DNA, 22 bp, Artificial Sequence
  Synthetic oligonucleotide; TTT chr2 60524471 60524492 60524488 60524493 +
gtttttttttcttttttcttgt

SEQ ID NO: 204755 - DNA, 22 bp, Artificial Sequence
  Synthetic oligonucleotide; TTG chr2 60524472 60524493 60524489 60524494 +
tttttttttcttttttcttgtt

SEQ ID NO: 204756 - DNA, 22 bp, Artificial Sequence
  Synthetic oligonucleotide; TTT chr2 60524475 60524496 60524492 60524497 +
ttttttcttttttcttgttttt

SEQ ID NO: 204757 - DNA, 22 bp, Artificial Sequence
  Synthetic oligonucleotide; TTT chr2 60524476 60524497 60524493 60524498 +
tttttcttttttcttgtttttt

SEQ ID NO: 204758 - DNA, 22 bp, Artificial Sequence
  Synthetic oligonucleotide; TTT chr2 60524477 60524498 60524494 60524499 +
ttttcttttttcttgtttttta

SEQ ID NO: 204759 - DNA, 22 bp, Artificial Sequence
  Synthetic oligonucleotide; TTT chr2 60524478 60524499 60524495 60524500 +
tttcttttttcttgttttttaa

SEQ ID NO: 204760 - DNA, 22 bp, Artificial Sequence
  Synthetic oligonucleotide; TTT chr2 60524479 60524500 60524496 60524501 +
ttcttttttcttgttttttaag

SEQ ID NO: 204761 - DNA, 22 bp, Artificial Sequence
  Synthetic oligonucleotide; TTT chr2 60524480 60524501 60524497 60524502 +
tcttttttcttgttttttaaga

SEQ ID NO: 204762 - DNA, 22 bp, Artificial Sequence
  Synthetic oligonucleotide; TTT chr2 60524481 60524502 60524498 60524503 +
cttttttcttgttttttaagat

SEQ ID NO: 204763 - DNA, 22 bp, Artificial Sequence
  Synthetic oligonucleotide; TTC chr2 60524482 60524503 60524499 60524504 +
ttttttcttgttttttaagatt

SEQ ID NO: 204764 - DNA, 22 bp, Artificial Sequence
  Synthetic oligonucleotide; CTT chr2 60524484 60524505 60524501 60524506 +
ttttcttgttttttaagatttt

SEQ ID NO: 204765 - DNA, 22 bp, Artificial Sequence
  Synthetic oligonucleotide; TTT chr2 60524485 60524506 60524502 60524507 +
tttcttgttttttaagatttta

SEQ ID NO: 204766 - DNA, 22 bp, Artificial Sequence
  Synthetic oligonucleotide; TTT chr2 60524486 60524507 60524503 60524508 +
ttcttgttttttaagattttat

SEQ ID NO: 204767 - DNA, 22 bp, Artificial Sequence
  Synthetic oligonucleotide; TTT chr2 60524487 60524508 60524504 60524509 +
tcttgttttttaagattttatt

SEQ ID NO: 204768 - DNA, 22 bp, Artificial Sequence
  Synthetic oligonucleotide; TTT chr2 60524488 60524509 60524505 60524510 +
cttgttttttaagattttattt

SEQ ID NO: 204769 - DNA, 22 bp, Artificial Sequence
  Synthetic oligonucleotide; TTC chr2 60524489 60524510 60524506 60524511 +
ttgttttttaagattttatttt

SEQ ID NO: 204770 - DNA, 22 bp, Artificial Sequence
  Synthetic oligonucleotide; CTT chr2 60524491 60524512 60524508 60524513 +
gttttttaagattttattttgt

SEQ ID NO: 204771 - DNA, 22 bp, Artificial Sequence
  Synthetic oligonucleotide; TTG chr2 60524492 60524513 60524509 60524514 +
ttttttaagattttattttgtt

SEQ ID NO: 204772 - DNA, 22 bp, Artificial Sequence
  Synthetic oligonucleotide; TTT chr2 60524495 60524516 60524512 60524517 +
tttaagattttattttgttacc

SEQ ID NO: 204773 - DNA, 22 bp, Artificial Sequence
  Synthetic oligonucleotide; TTT chr2 60524496 60524517 60524513 60524518 +
ttaagattttattttgttacca

SEQ ID NO: 204774 - DNA, 22 bp, Artificial Sequence
  Synthetic oligonucleotide; TTT chr2 60524497 60524518 60524514 60524519 +
taagattttattttgttaccag

SEQ ID NO: 204775 - DNA, 22 bp, Artificial Sequence
  Synthetic oligonucleotide; TTT chr2 60524498 60524519 60524515 60524520 +
aagattttattttgttaccaga

SEQ ID NO: 204776 - DNA, 22 bp, Artificial Sequence
  Synthetic oligonucleotide; TTA chr2 60524499 60524520 60524516 60524521 +
agattttattttgttaccagag

SEQ ID NO: 204777 - DNA, 22 bp, Artificial Sequence
  Synthetic oligonucleotide; TTT chr2 60524505 60524526 60524522 60524527 +
tattttgttaccagagatagaa

SEQ ID NO: 204778 - DNA, 22 bp, Artificial Sequence
  Synthetic oligonucleotide; TTT chr2 60524506 60524527 60524523 60524528 +
attttgttaccagagatagaag

SEQ ID NO: 204779 - DNA, 22 bp, Artificial Sequence
  Synthetic oligonucleotide; TTA chr2 60524507 60524528 60524524 60524529 +
ttttgttaccagagatagaaga

SEQ ID NO: 204780 - DNA, 22 bp, Artificial Sequence
  Synthetic oligonucleotide; TTT chr2 60524510 60524531 60524527 60524532 +
tgttaccagagatagaagagca

SEQ ID NO: 204781 - DNA, 22 bp, Artificial Sequence
  Synthetic oligonucleotide; TTT chr2 60524511 60524532 60524528 60524533 +
gttaccagagatagaagagcat

SEQ ID NO: 204782 - DNA, 22 bp, Artificial Sequence
  Synthetic oligonucleotide; TTG chr2 60524512 60524533 60524529 60524534 +
ttaccagagatagaagagcatg

SEQ ID NO: 204783 - DNA, 22 bp, Artificial Sequence
  Synthetic oligonucleotide; TTA chr2 60524515 60524536 60524532 60524537 +
ccagagatagaagagcatgcaa

SEQ ID NO: 204784 - DNA, 22 bp, Artificial Sequence
  Synthetic oligonucleotide; CTG chr2 60524552 60524573 60524569 60524574 +
attaccagtgcccttacagagc

SEQ ID NO: 204785 - DNA, 22 bp, Artificial Sequence
  Synthetic oligonucleotide; TTA chr2 60524556 60524577 60524573 60524578 +
ccagtgcccttacagagcatgc

SEQ ID NO: 204786 - DNA, 22 bp, Artificial Sequence
  Synthetic oligonucleotide; CTT chr2 60524567 60524588 60524584 60524589 +
acagagcatgcctattaaaaat

SEQ ID NO: 204787 - DNA, 22 bp, Artificial Sequence
  Synthetic oligonucleotide; TTA chr2 60524568 60524589 60524585 60524590 +
cagagcatgcctattaaaaatc

SEQ ID NO: 204788 - DNA, 22 bp, Artificial Sequence
  Synthetic oligonucleotide; CTA chr2 60524581 60524602 60524598 60524603 +
ttaaaaatccccaaaacattat

SEQ ID NO: 204789 - DNA, 22 bp, Artificial Sequence
  Synthetic oligonucleotide; TTA chr2 60524584 60524605 60524601 60524606 +
aaaatccccaaaacattataaa

SEQ ID NO: 204790 - DNA, 22 bp, Artificial Sequence
  Synthetic oligonucleotide; TTA chr2 60524602 60524623 60524619 60524624 +
taaattaaagaggcagtaattt

SEQ ID NO: 204791 - DNA, 22 bp, Artificial Sequence
  Synthetic oligonucleotide; TTA chr2 60524609 60524630 60524626 60524631 +
aagaggcagtaatttaaataaa

SEQ ID NO: 204792 - DNA, 22 bp, Artificial Sequence
  Synthetic oligonucleotide; TTT chr2 60524624 60524645 60524641 60524646 +
aaataaattacctttttattga

SEQ ID NO: 204793 - DNA, 22 bp, Artificial Sequence
  Synthetic oligonucleotide; TTA chr2 60524625 60524646 60524642 60524647 +
aataaattacctttttattgaa

SEQ ID NO: 204794 - DNA, 22 bp, Artificial Sequence
  Synthetic oligonucleotide; TTA chr2 60524634 60524655 60524651 60524656 +
cctttttattgaagctatagat

SEQ ID NO: 204795 - DNA, 22 bp, Artificial Sequence
  Synthetic oligonucleotide; CTT chr2 60524638 60524659 60524655 60524660 +
tttattgaagctatagatctca

SEQ ID NO: 204796 - DNA, 22 bp, Artificial Sequence
  Synthetic oligonucleotide; TTT chr2 60524639 60524660 60524656 60524661 +
ttattgaagctatagatctcaa

SEQ ID NO: 204797 - DNA, 22 bp, Artificial Sequence
  Synthetic oligonucleotide; TTT chr2 60524640 60524661 60524657 60524662 +
tattgaagctatagatctcaag

SEQ ID NO: 204798 - DNA, 22 bp, Artificial Sequence
  Synthetic oligonucleotide; TTT chr2 60524641 60524662 60524658 60524663 +
attgaagctatagatctcaaga

SEQ ID NO: 204799 - DNA, 22 bp, Artificial Sequence
  Synthetic oligonucleotide; TTA chr2 60524642 60524663 60524659 60524664 +
ttgaagctatagatctcaagag

SEQ ID NO: 204800 - DNA, 22 bp, Artificial Sequence
  Synthetic oligonucleotide; TTG chr2 60524645 60524666 60524662 60524667 +
aagctatagatctcaagagtgc

SEQ ID NO: 204801 - DNA, 22 bp, Artificial Sequence
  Synthetic oligonucleotide; CTA chr2 60524651 60524672 60524668 60524673 +
tagatctcaagagtgcctgtgt

SEQ ID NO: 204802 - DNA, 22 bp, Artificial Sequence
  Synthetic oligonucleotide; CTC chr2 60524659 60524680 60524676 60524681 +
aagagtgcctgtgtcctacaag

SEQ ID NO: 204803 - DNA, 22 bp, Artificial Sequence
  Synthetic oligonucleotide; CTG chr2 60524670 60524691 60524687 60524692 +
tgtcctacaaggaacacatatt

SEQ ID NO: 204804 - DNA, 22 bp, Artificial Sequence
  Synthetic oligonucleotide; CTA chr2 60524677 60524698 60524694 60524699 +
caaggaacacatatttcacaac

SEQ ID NO: 204805 - DNA, 22 bp, Artificial Sequence
  Synthetic oligonucleotide; TTT chr2 60524693 60524714 60524710 60524715 +
cacaactgattcatttgcccct

SEQ ID NO: 204806 - DNA, 22 bp, Artificial Sequence
  Synthetic oligonucleotide; TTC chr2 60524694 60524715 60524711 60524716 +
acaactgattcatttgcccctt

SEQ ID NO: 204807 - DNA, 22 bp, Artificial Sequence
  Synthetic oligonucleotide; CTG chr2 60524701 60524722 60524718 60524723 +
attcatttgccccttactctga

SEQ ID NO: 204808 - DNA, 22 bp, Artificial Sequence
  Synthetic oligonucleotide; TTC chr2 60524705 60524726 60524722 60524727 +
atttgccccttactctgagcac

SEQ ID NO: 204809 - DNA, 22 bp, Artificial Sequence
  Synthetic oligonucleotide; TTT chr2 60524709 60524730 60524726 60524731 +
gccccttactctgagcacatgg

SEQ ID NO: 204810 - DNA, 22 bp, Artificial Sequence
  Synthetic oligonucleotide; TTG chr2 60524710 60524731 60524727 60524732 +
ccccttactctgagcacatggg

SEQ ID NO: 204811 - DNA, 22 bp, Artificial Sequence
  Synthetic oligonucleotide; CTT chr2 60524716 60524737 60524733 60524738 +
actctgagcacatgggataata

SEQ ID NO: 204812 - DNA, 22 bp, Artificial Sequence
  Synthetic oligonucleotide; TTA chr2 60524717 60524738 60524734 60524739 +
ctctgagcacatgggataataa

SEQ ID NO: 204813 - DNA, 22 bp, Artificial Sequence
  Synthetic oligonucleotide; CTC chr2 60524720 60524741 60524737 60524742 +
tgagcacatgggataataaaag

SEQ ID NO: 204814 - DNA, 22 bp, Artificial Sequence
  Synthetic oligonucleotide; CTG chr2 60524722 60524743 60524739 60524744 +
agcacatgggataataaaagaa

SEQ ID NO: 204815 - DNA, 22 bp, Artificial Sequence
  Synthetic oligonucleotide; TTT chr2 60524749 60524770 60524766 60524771 +
tagatcatcattatccaaagga

SEQ ID NO: 204816 - DNA, 22 bp, Artificial Sequence
  Synthetic oligonucleotide; TTT chr2 60524750 60524771 60524767 60524772 +
agatcatcattatccaaaggat

SEQ ID NO: 204817 - DNA, 22 bp, Artificial Sequence
  Synthetic oligonucleotide; TTA chr2 60524751 60524772 60524768 60524773 +
gatcatcattatccaaaggata

SEQ ID NO: 204818 - DNA, 22 bp, Artificial Sequence
  Synthetic oligonucleotide; TTA chr2 60524762 60524783 60524779 60524784 +
tccaaaggataactttgaatgc

SEQ ID NO: 204819 - DNA, 22 bp, Artificial Sequence
  Synthetic oligonucleotide; CTT chr2 60524777 60524798 60524794 60524799 +
tgaatgccctttttcagcatgc

SEQ ID NO: 204820 - DNA, 22 bp, Artificial Sequence
  Synthetic oligonucleotide; TTT chr2 60524778 60524799 60524795 60524800 +
gaatgccctttttcagcatgct

SEQ ID NO: 204821 - DNA, 22 bp, Artificial Sequence
  Synthetic oligonucleotide; TTG chr2 60524779 60524800 60524796 60524801 +
aatgccctttttcagcatgctt

SEQ ID NO: 204822 - DNA, 22 bp, Artificial Sequence
  Synthetic oligonucleotide; CTT chr2 60524788 60524809 60524805 60524810 +
tttcagcatgcttctgaaaaca

SEQ ID NO: 204823 - DNA, 22 bp, Artificial Sequence
  Synthetic oligonucleotide; TTT chr2 60524789 60524810 60524806 60524811 +
ttcagcatgcttctgaaaacat

SEQ ID NO: 204824 - DNA, 22 bp, Artificial Sequence
  Synthetic oligonucleotide; TTT chr2 60524790 60524811 60524807 60524812 +
tcagcatgcttctgaaaacatt

SEQ ID NO: 204825 - DNA, 22 bp, Artificial Sequence
  Synthetic oligonucleotide; TTT chr2 60524791 60524812 60524808 60524813 +
cagcatgcttctgaaaacattt

SEQ ID NO: 204826 - DNA, 22 bp, Artificial Sequence
  Synthetic oligonucleotide; TTC chr2 60524792 60524813 60524809 60524814 +
agcatgcttctgaaaacatttc

SEQ ID NO: 204827 - DNA, 22 bp, Artificial Sequence
  Synthetic oligonucleotide; CTT chr2 60524801 60524822 60524818 60524823 +
ctgaaaacatttcatatctcat

SEQ ID NO: 204828 - DNA, 22 bp, Artificial Sequence
  Synthetic oligonucleotide; TTC chr2 60524802 60524823 60524819 60524824 +
tgaaaacatttcatatctcatt

SEQ ID NO: 204829 - DNA, 22 bp, Artificial Sequence
  Synthetic oligonucleotide; CTG chr2 60524804 60524825 60524821 60524826 +
aaaacatttcatatctcattca

SEQ ID NO: 204830 - DNA, 22 bp, Artificial Sequence
  Synthetic oligonucleotide; TTT chr2 60524813 60524834 60524830 60524835 +
catatctcattcaatgccacat

SEQ ID NO: 204831 - DNA, 22 bp, Artificial Sequence
  Synthetic oligonucleotide; TTC chr2 60524814 60524835 60524831 60524836 +
atatctcattcaatgccacata

SEQ ID NO: 204832 - DNA, 22 bp, Artificial Sequence
  Synthetic oligonucleotide; CTC chr2 60524821 60524842 60524838 60524843 +
attcaatgccacatataaatgg

SEQ ID NO: 204833 - DNA, 22 bp, Artificial Sequence
  Synthetic oligonucleotide; TTC chr2 60524825 60524846 60524842 60524847 +
aatgccacatataaatggtatt

SEQ ID NO: 204834 - DNA, 22 bp, Artificial Sequence
  Synthetic oligonucleotide; TTT chr2 60524848 60524869 60524865 60524870 +
gctggacagtgtggaaaacaga

SEQ ID NO: 204835 - DNA, 22 bp, Artificial Sequence
  Synthetic oligonucleotide; TTG chr2 60524849 60524870 60524866 60524871 +
ctggacagtgtggaaaacagaa

SEQ ID NO: 204836 - DNA, 22 bp, Artificial Sequence
  Synthetic oligonucleotide; CTG chr2 60524852 60524873 60524869 60524874 +
gacagtgtggaaaacagaaaca

SEQ ID NO: 204837 - DNA, 22 bp, Artificial Sequence
  Synthetic oligonucleotide; CTA chr2 60524883 60524904 60524900 60524905 +
aaagccaatggtaaacaccaag

SEQ ID NO: 204838 - DNA, 22 bp, Artificial Sequence
  Synthetic oligonucleotide; TTT chr2 60524908 60524929 60524925 60524930 +
aaaaaatggattgcaaagatcg

SEQ ID NO: 204839 - DNA, 22 bp, Artificial Sequence
  Synthetic oligonucleotide; TTA chr2 60524909 60524930 60524926 60524931 +
aaaaatggattgcaaagatcgc

SEQ ID NO: 204840 - DNA, 22 bp, Artificial Sequence
  Synthetic oligonucleotide; TTG chr2 60524921 60524942 60524938 60524943 +
caaagatcgcatgtcccagaac

SEQ ID NO: 204841 - DNA, 22 bp, Artificial Sequence
  Synthetic oligonucleotide; CTT chr2 60524956 60524977 60524973 60524978 +
ttacctacatgatgaataaaaa

SEQ ID NO: 204842 - DNA, 22 bp, Artificial Sequence
  Synthetic oligonucleotide; TTT chr2 60524957 60524978 60524974 60524979 +
tacctacatgatgaataaaaaa

SEQ ID NO: 204843 - DNA, 22 bp, Artificial Sequence
  Synthetic oligonucleotide; TTT chr2 60524958 60524979 60524975 60524980 +
acctacatgatgaataaaaaaa

SEQ ID NO: 204844 - DNA, 22 bp, Artificial Sequence
  Synthetic oligonucleotide; TTA chr2 60524959 60524980 60524976 60524981 +
cctacatgatgaataaaaaaag

SEQ ID NO: 204845 - DNA, 22 bp, Artificial Sequence
  Synthetic oligonucleotide; CTA chr2 60524963 60524984 60524980 60524985 +
catgatgaataaaaaaagaaca

SEQ ID NO: 204846 - DNA, 22 bp, Artificial Sequence
  Synthetic oligonucleotide; TTT chr2 60524988 60525009 60525005 60525010 +
tccctcaatttatgctgtcttc

SEQ ID NO: 204847 - DNA, 22 bp, Artificial Sequence
  Synthetic oligonucleotide; TTT chr2 60524989 60525010 60525006 60525011 +
ccctcaatttatgctgtcttca

SEQ ID NO: 204848 - DNA, 22 bp, Artificial Sequence
  Synthetic oligonucleotide; TTC chr2 60524990 60525011 60525007 60525012 +
cctcaatttatgctgtcttcaa

SEQ ID NO: 204849 - DNA, 22 bp, Artificial Sequence
  Synthetic oligonucleotide; CTC chr2 60524994 60525015 60525011 60525016 +
aatttatgctgtcttcaacact

SEQ ID NO: 204850 - DNA, 22 bp, Artificial Sequence
  Synthetic oligonucleotide; TTT chr2 60524999 60525020 60525016 60525021 +
atgctgtcttcaacactaacag

SEQ ID NO: 204851 - DNA, 22 bp, Artificial Sequence
  Synthetic oligonucleotide; TTA chr2 60525000 60525021 60525017 60525022 +
tgctgtcttcaacactaacaga

SEQ ID NO: 204852 - DNA, 22 bp, Artificial Sequence
  Synthetic oligonucleotide; CTG chr2 60525005 60525026 60525022 60525027 +
tcttcaacactaacagagggag

SEQ ID NO: 204853 - DNA, 22 bp, Artificial Sequence
  Synthetic oligonucleotide; CTT chr2 60525009 60525030 60525026 60525031 +
caacactaacagagggagagtt

SEQ ID NO: 204854 - DNA, 22 bp, Artificial Sequence
  Synthetic oligonucleotide; TTC chr2 60525010 60525031 60525027 60525032 +
aacactaacagagggagagttc

SEQ ID NO: 204855 - DNA, 22 bp, Artificial Sequence
  Synthetic oligonucleotide; CTA chr2 60525017 60525038 60525034 60525039 +
acagagggagagttcttctaaa

SEQ ID NO: 204856 - DNA, 22 bp, Artificial Sequence
  Synthetic oligonucleotide; TTC chr2 60525032 60525053 60525049 60525054 +
ttctaaacatgttgcatcggat

SEQ ID NO: 204857 - DNA, 22 bp, Artificial Sequence
  Synthetic oligonucleotide; CTT chr2 60525034 60525055 60525051 60525056 +
ctaaacatgttgcatcggatgc

SEQ ID NO: 204858 - DNA, 22 bp, Artificial Sequence
  Synthetic oligonucleotide; TTC chr2 60525035 60525056 60525052 60525057 +
taaacatgttgcatcggatgcc

SEQ ID NO: 204859 - DNA, 22 bp, Artificial Sequence
  Synthetic oligonucleotide; CTA chr2 60525037 60525058 60525054 60525059 +
aacatgttgcatcggatgcctt

SEQ ID NO: 204860 - DNA, 22 bp, Artificial Sequence
  Synthetic oligonucleotide; TTG chr2 60525046 60525067 60525063 60525068 +
catcggatgcctttaacaagca

SEQ ID NO: 204861 - DNA, 22 bp, Artificial Sequence
  Synthetic oligonucleotide; CTT chr2 60525059 60525080 60525076 60525081 +
taacaagcaaaaattcctaact

SEQ ID NO: 204862 - DNA, 22 bp, Artificial Sequence
  Synthetic oligonucleotide; TTT chr2 60525060 60525081 60525077 60525082 +
aacaagcaaaaattcctaactc

SEQ ID NO: 204863 - DNA, 22 bp, Artificial Sequence
  Synthetic oligonucleotide; TTA chr2 60525061 60525082 60525078 60525083 +
acaagcaaaaattcctaactcc

SEQ ID NO: 204864 - DNA, 22 bp, Artificial Sequence
  Synthetic oligonucleotide; TTC chr2 60525075 60525096 60525092 60525097 +
ctaactccagggactcagcata

SEQ ID NO: 204865 - DNA, 22 bp, Artificial Sequence
  Synthetic oligonucleotide; CTA chr2 60525078 60525099 60525095 60525100 +
actccagggactcagcatatgt

SEQ ID NO: 204866 - DNA, 22 bp, Artificial Sequence
  Synthetic oligonucleotide; CTC chr2 60525082 60525103 60525099 60525104 +
cagggactcagcatatgtaggc

SEQ ID NO: 204867 - DNA, 22 bp, Artificial Sequence
  Synthetic oligonucleotide; CTC chr2 60525091 60525112 60525108 60525113 +
agcatatgtaggctatgtccat

SEQ ID NO: 204868 - DNA, 22 bp, Artificial Sequence
  Synthetic oligonucleotide; CTA chr2 60525106 60525127 60525123 60525128 +
tgtccatacagagaaaccagct

SEQ ID NO: 204869 - DNA, 22 bp, Artificial Sequence
  Synthetic oligonucleotide; CTT chr2 60525129 60525150 60525146 60525151 +
ttgggaggaggaaggaggaaaa

SEQ ID NO: 204870 - DNA, 22 bp, Artificial Sequence
  Synthetic oligonucleotide; TTT chr2 60525130 60525151 60525147 60525152 +
tgggaggaggaaggaggaaaat

SEQ ID NO: 204871 - DNA, 22 bp, Artificial Sequence
  Synthetic oligonucleotide; TTT chr2 60525131 60525152 60525148 60525153 +
gggaggaggaaggaggaaaata

SEQ ID NO: 204872 - DNA, 22 bp, Artificial Sequence
  Synthetic oligonucleotide; TTG chr2 60525132 60525153 60525149 60525154 +
ggaggaggaaggaggaaaatat

SEQ ID NO: 204873 - DNA, 22 bp, Artificial Sequence
  Synthetic oligonucleotide; CTG chr2 60525159 60525180 60525176 60525181 +
aattcagtcagttaattgaatt

SEQ ID NO: 204874 - DNA, 22 bp, Artificial Sequence
  Synthetic oligonucleotide; TTC chr2 60525164 60525185 60525181 60525186 +
agtcagttaattgaatttaaaa

SEQ ID NO: 204875 - DNA, 22 bp, Artificial Sequence
  Synthetic oligonucleotide; TTA chr2 60525173 60525194 60525190 60525195 +
attgaatttaaaatacctggtt

SEQ ID NO: 204876 - DNA, 22 bp, Artificial Sequence
  Synthetic oligonucleotide; TTG chr2 60525177 60525198 60525194 60525199 +
aatttaaaatacctggttgttt

SEQ ID NO: 204877 - DNA, 22 bp, Artificial Sequence
  Synthetic oligonucleotide; TTT chr2 60525182 60525203 60525199 60525204 +
aaaatacctggttgtttgaatt

SEQ ID NO: 204878 - DNA, 22 bp, Artificial Sequence
  Synthetic oligonucleotide; TTA chr2 60525183 60525204 60525200 60525205 +
aaatacctggttgtttgaattc

SEQ ID NO: 204879 - DNA, 22 bp, Artificial Sequence
  Synthetic oligonucleotide; CTG chr2 60525192 60525213 60525209 60525214 +
gttgtttgaattcaactatttc

SEQ ID NO: 204880 - DNA, 22 bp, Artificial Sequence
  Synthetic oligonucleotide; TTG chr2 60525196 60525217 60525213 60525218 +
tttgaattcaactatttctttt

SEQ ID NO: 204881 - DNA, 22 bp, Artificial Sequence
  Synthetic oligonucleotide; TTT chr2 60525199 60525220 60525216 60525221 +
gaattcaactatttctttttca

SEQ ID NO: 204882 - DNA, 22 bp, Artificial Sequence
  Synthetic oligonucleotide; TTG chr2 60525200 60525221 60525217 60525222 +
aattcaactatttctttttcaa

SEQ ID NO: 204883 - DNA, 22 bp, Artificial Sequence
  Synthetic oligonucleotide; TTC chr2 60525205 60525226 60525222 60525227 +
aactatttctttttcaaaaacg

SEQ ID NO: 204884 - DNA, 22 bp, Artificial Sequence
  Synthetic oligonucleotide; CTA chr2 60525210 60525231 60525227 60525232 +
tttctttttcaaaaacgtactt

SEQ ID NO: 204885 - DNA, 22 bp, Artificial Sequence
  Synthetic oligonucleotide; TTT chr2 60525213 60525234 60525230 60525235 +
ctttttcaaaaacgtacttcta

SEQ ID NO: 204886 - DNA, 22 bp, Artificial Sequence
  Synthetic oligonucleotide; TTC chr2 60525214 60525235 60525231 60525236 +
tttttcaaaaacgtacttctat

SEQ ID NO: 204887 - DNA, 22 bp, Artificial Sequence
  Synthetic oligonucleotide; CTT chr2 60525216 60525237 60525233 60525238 +
tttcaaaaacgtacttctattt

SEQ ID NO: 204888 - DNA, 22 bp, Artificial Sequence
  Synthetic oligonucleotide; TTT chr2 60525217 60525238 60525234 60525239 +
ttcaaaaacgtacttctatttt

SEQ ID NO: 204889 - DNA, 22 bp, Artificial Sequence
  Synthetic oligonucleotide; TTT chr2 60525218 60525239 60525235 60525240 +
tcaaaaacgtacttctattttg

SEQ ID NO: 204890 - DNA, 22 bp, Artificial Sequence
  Synthetic oligonucleotide; TTT chr2 60525219 60525240 60525236 60525241 +
caaaaacgtacttctattttga

SEQ ID NO: 204891 - DNA, 22 bp, Artificial Sequence
  Synthetic oligonucleotide; TTC chr2 60525220 60525241 60525237 60525242 +
aaaaacgtacttctattttgat

SEQ ID NO: 204892 - DNA, 22 bp, Artificial Sequence
  Synthetic oligonucleotide; CTT chr2 60525232 60525253 60525249 60525254 +
ctattttgatgtagttacattt

SEQ ID NO: 204893 - DNA, 22 bp, Artificial Sequence
  Synthetic oligonucleotide; TTC chr2 60525233 60525254 60525250 60525255 +
tattttgatgtagttacatttg

SEQ ID NO: 204894 - DNA, 22 bp, Artificial Sequence
  Synthetic oligonucleotide; CTA chr2 60525235 60525256 60525252 60525257 +
ttttgatgtagttacatttgcc

SEQ ID NO: 204895 - DNA, 22 bp, Artificial Sequence
  Synthetic oligonucleotide; TTT chr2 60525238 60525259 60525255 60525260 +
tgatgtagttacatttgcccaa

SEQ ID NO: 204896 - DNA, 22 bp, Artificial Sequence
  Synthetic oligonucleotide; TTT chr2 60525239 60525260 60525256 60525261 +
gatgtagttacatttgcccaaa

SEQ ID NO: 204897 - DNA, 22 bp, Artificial Sequence
  Synthetic oligonucleotide; TTG chr2 60525240 60525261 60525257 60525262 +
atgtagttacatttgcccaaaa

SEQ ID NO: 204898 - DNA, 22 bp, Artificial Sequence
  Synthetic oligonucleotide; TTA chr2 60525249 60525270 60525266 60525271 +
catttgcccaaaaaagcaaact

SEQ ID NO: 204899 - DNA, 22 bp, Artificial Sequence
  Synthetic oligonucleotide; TTT chr2 60525254 60525275 60525271 60525276 +
gcccaaaaaagcaaacttggag

SEQ ID NO: 204900 - DNA, 22 bp, Artificial Sequence
  Synthetic oligonucleotide; TTG chr2 60525255 60525276 60525272 60525277 +
cccaaaaaagcaaacttggaga

SEQ ID NO: 204901 - DNA, 22 bp, Artificial Sequence
  Synthetic oligonucleotide; CTT chr2 60525272 60525293 60525289 60525294 +
ggagaaaatacacattacattc

SEQ ID NO: 204902 - DNA, 22 bp, Artificial Sequence
  Synthetic oligonucleotide; TTG chr2 60525273 60525294 60525290 60525295 +
gagaaaatacacattacattct

SEQ ID NO: 204903 - DNA, 22 bp, Artificial Sequence
  Synthetic oligonucleotide; TTA chr2 60525289 60525310 60525306 60525311 +
cattctttggagtttttcaaaa

SEQ ID NO: 204904 - DNA, 22 bp, Artificial Sequence
  Synthetic oligonucleotide; TTC chr2 60525294 60525315 60525311 60525316 +
tttggagtttttcaaaaaaaac

SEQ ID NO: 204905 - DNA, 22 bp, Artificial Sequence
  Synthetic oligonucleotide; CTT chr2 60525296 60525317 60525313 60525318 +
tggagtttttcaaaaaaaacag

SEQ ID NO: 204906 - DNA, 22 bp, Artificial Sequence
  Synthetic oligonucleotide; TTT chr2 60525297 60525318 60525314 60525319 +
ggagtttttcaaaaaaaacagc

SEQ ID NO: 204907 - DNA, 22 bp, Artificial Sequence
  Synthetic oligonucleotide; TTG chr2 60525298 60525319 60525315 60525320 +
gagtttttcaaaaaaaacagct

SEQ ID NO: 204908 - DNA, 22 bp, Artificial Sequence
  Synthetic oligonucleotide; TTT chr2 60525304 60525325 60525321 60525326 +
ttcaaaaaaaacagcttgcaac

SEQ ID NO: 204909 - DNA, 22 bp, Artificial Sequence
  Synthetic oligonucleotide; TTT chr2 60525305 60525326 60525322 60525327 +
tcaaaaaaaacagcttgcaaca

SEQ ID NO: 204910 - DNA, 22 bp, Artificial Sequence
  Synthetic oligonucleotide; TTT chr2 60525306 60525327 60525323 60525328 +
caaaaaaaacagcttgcaacaa

SEQ ID NO: 204911 - DNA, 22 bp, Artificial Sequence
  Synthetic oligonucleotide; TTC chr2 60525307 60525328 60525324 60525329 +
aaaaaaaacagcttgcaacaat

SEQ ID NO: 204912 - DNA, 22 bp, Artificial Sequence
  Synthetic oligonucleotide; CTT chr2 60525321 60525342 60525338 60525343 +
gcaacaattaaaagatggagaa

SEQ ID NO: 204913 - DNA, 22 bp, Artificial Sequence
  Synthetic oligonucleotide; TTG chr2 60525322 60525343 60525339 60525344 +
caacaattaaaagatggagaaa

SEQ ID NO: 204914 - DNA, 22 bp, Artificial Sequence
  Synthetic oligonucleotide; TTA chr2 60525331 60525352 60525348 60525353 +
aaagatggagaaatcttataag

SEQ ID NO: 204915 - DNA, 22 bp, Artificial Sequence
  Synthetic oligonucleotide; CTT chr2 60525348 60525369 60525365 60525370 +
ataaggctggaaacttctgtga

SEQ ID NO: 204916 - DNA, 22 bp, Artificial Sequence
  Synthetic oligonucleotide; TTA chr2 60525349 60525370 60525366 60525371 +
taaggctggaaacttctgtgaa

SEQ ID NO: 204917 - DNA, 22 bp, Artificial Sequence
  Synthetic oligonucleotide; CTG chr2 60525357 60525378 60525374 60525379 +
gaaacttctgtgaattatcacc

SEQ ID NO: 204918 - DNA, 22 bp, Artificial Sequence
  Synthetic oligonucleotide; CTT chr2 60525364 60525385 60525381 60525386 +
ctgtgaattatcaccattccat

SEQ ID NO: 204919 - DNA, 22 bp, Artificial Sequence
  Synthetic oligonucleotide; TTC chr2 60525365 60525386 60525382 60525387 +
tgtgaattatcaccattccatt

SEQ ID NO: 204920 - DNA, 22 bp, Artificial Sequence
  Synthetic oligonucleotide; CTG chr2 60525367 60525388 60525384 60525389 +
tgaattatcaccattccattat

SEQ ID NO: 204921 - DNA, 22 bp, Artificial Sequence
  Synthetic oligonucleotide; TTA chr2 60525374 60525395 60525391 60525396 +
tcaccattccattatactgcac

SEQ ID NO: 204922 - DNA, 22 bp, Artificial Sequence
  Synthetic oligonucleotide; TTC chr2 60525383 60525404 60525400 60525405 +
cattatactgcacttcaatttt

SEQ ID NO: 204923 - DNA, 22 bp, Artificial Sequence
  Synthetic oligonucleotide; TTA chr2 60525388 60525409 60525405 60525410 +
tactgcacttcaattttgcttc

SEQ ID NO: 204924 - DNA, 22 bp, Artificial Sequence
  Synthetic oligonucleotide; CTG chr2 60525393 60525414 60525410 60525415 +
cacttcaattttgcttccagca

SEQ ID NO: 204925 - DNA, 22 bp, Artificial Sequence
  Synthetic oligonucleotide; CTT chr2 60525398 60525419 60525415 60525420 +
caattttgcttccagcaatttg

SEQ ID NO: 204926 - DNA, 22 bp, Artificial Sequence
  Synthetic oligonucleotide; TTC chr2 60525399 60525420 60525416 60525421 +
aattttgcttccagcaatttga

SEQ ID NO: 204927 - DNA, 22 bp, Artificial Sequence
  Synthetic oligonucleotide; TTT chr2 60525404 60525425 60525421 60525426 +
tgcttccagcaatttgaaagat

SEQ ID NO: 204928 - DNA, 22 bp, Artificial Sequence
  Synthetic oligonucleotide; TTT chr2 60525405 60525426 60525422 60525427 +
gcttccagcaatttgaaagatg

SEQ ID NO: 204929 - DNA, 22 bp, Artificial Sequence
  Synthetic oligonucleotide; TTG chr2 60525406 60525427 60525423 60525428 +
cttccagcaatttgaaagatgc

SEQ ID NO: 204930 - DNA, 22 bp, Artificial Sequence
  Synthetic oligonucleotide; CTT chr2 60525409 60525430 60525426 60525431 +
ccagcaatttgaaagatgcctt

SEQ ID NO: 204931 - DNA, 22 bp, Artificial Sequence
  Synthetic oligonucleotide; TTC chr2 60525410 60525431 60525427 60525432 +
cagcaatttgaaagatgccttt

SEQ ID NO: 204932 - DNA, 22 bp, Artificial Sequence
  Synthetic oligonucleotide; TTT chr2 60525419 60525440 60525436 60525441 +
gaaagatgcctttaagctttct

SEQ ID NO: 204933 - DNA, 22 bp, Artificial Sequence
  Synthetic oligonucleotide; TTG chr2 60525420 60525441 60525437 60525442 +
aaagatgcctttaagctttctg

SEQ ID NO: 204934 - DNA, 22 bp, Artificial Sequence
  Synthetic oligonucleotide; CTT chr2 60525431 60525452 60525448 60525453 +
taagctttctgttggggaatca

SEQ ID NO: 204935 - DNA, 22 bp, Artificial Sequence
  Synthetic oligonucleotide; TTT chr2 60525432 60525453 60525449 60525454 +
aagctttctgttggggaatcac

SEQ ID NO: 204936 - DNA, 22 bp, Artificial Sequence
  Synthetic oligonucleotide; TTA chr2 60525433 60525454 60525450 60525455 +
agctttctgttggggaatcacg

SEQ ID NO: 204937 - DNA, 22 bp, Artificial Sequence
  Synthetic oligonucleotide; CTT chr2 60525438 60525459 60525455 60525460 +
tctgttggggaatcacgaatcc

SEQ ID NO: 204938 - DNA, 22 bp, Artificial Sequence
  Synthetic oligonucleotide; TTT chr2 60525439 60525460 60525456 60525461 +
ctgttggggaatcacgaatcca

SEQ ID NO: 204939 - DNA, 22 bp, Artificial Sequence
  Synthetic oligonucleotide; TTC chr2 60525440 60525461 60525457 60525462 +
tgttggggaatcacgaatccaa

SEQ ID NO: 204940 - DNA, 22 bp, Artificial Sequence
  Synthetic oligonucleotide; CTG chr2 60525442 60525463 60525459 60525464 +
ttggggaatcacgaatccaagc

SEQ ID NO: 204941 - DNA, 22 bp, Artificial Sequence
  Synthetic oligonucleotide; TTG chr2 60525445 60525466 60525462 60525467 +
gggaatcacgaatccaagcctt

SEQ ID NO: 204942 - DNA, 22 bp, Artificial Sequence
  Synthetic oligonucleotide; CTT chr2 60525467 60525488 60525484 60525489 +
aatctccaccatagcttccatc

SEQ ID NO: 204943 - DNA, 22 bp, Artificial Sequence
  Synthetic oligonucleotide; TTA chr2 60525468 60525489 60525485 60525490 +
atctccaccatagcttccatct

SEQ ID NO: 204944 - DNA, 22 bp, Artificial Sequence
  Synthetic oligonucleotide; CTC chr2 60525473 60525494 60525490 60525495 +
caccatagcttccatctttgag

SEQ ID NO: 204945 - DNA, 22 bp, Artificial Sequence
  Synthetic oligonucleotide; CTT chr2 60525484 60525505 60525501 60525506 +
ccatctttgaggcaaatcaaga

SEQ ID NO: 204946 - DNA, 22 bp, Artificial Sequence
  Synthetic oligonucleotide; TTC chr2 60525485 60525506 60525502 60525507 +
catctttgaggcaaatcaagaa

SEQ ID NO: 204947 - DNA, 22 bp, Artificial Sequence
  Synthetic oligonucleotide; CTT chr2 60525491 60525512 60525508 60525513 +
tgaggcaaatcaagaaaataat

SEQ ID NO: 204948 - DNA, 22 bp, Artificial Sequence
  Synthetic oligonucleotide; TTT chr2 60525492 60525513 60525509 60525514 +
gaggcaaatcaagaaaataata

SEQ ID NO: 204949 - DNA, 22 bp, Artificial Sequence
  Synthetic oligonucleotide; TTG chr2 60525493 60525514 60525510 60525515 +
aggcaaatcaagaaaataatat

SEQ ID NO: 204950 - DNA, 22 bp, Artificial Sequence
  Synthetic oligonucleotide; TTC chr2 60525517 60525538 60525534 60525539 +
tgctgtctttgcaggtgagccc

SEQ ID NO: 204951 - DNA, 22 bp, Artificial Sequence
  Synthetic oligonucleotide; CTG chr2 60525519 60525540 60525536 60525541 +
ctgtctttgcaggtgagcccca

SEQ ID NO: 204952 - DNA, 22 bp, Artificial Sequence
  Synthetic oligonucleotide; CTG chr2 60525522 60525543 60525539 60525544 +
tctttgcaggtgagccccattc

SEQ ID NO: 204953 - DNA, 22 bp, Artificial Sequence
  Synthetic oligonucleotide; CTT chr2 60525526 60525547 60525543 60525548 +
tgcaggtgagccccattcagca

SEQ ID NO: 204954 - DNA, 22 bp, Artificial Sequence
  Synthetic oligonucleotide; TTT chr2 60525527 60525548 60525544 60525549 +
gcaggtgagccccattcagcaa

SEQ ID NO: 204955 - DNA, 22 bp, Artificial Sequence
  Synthetic oligonucleotide; TTG chr2 60525528 60525549 60525545 60525550 +
caggtgagccccattcagcaac

SEQ ID NO: 204956 - DNA, 22 bp, Artificial Sequence
  Synthetic oligonucleotide; TTC chr2 60525544 60525565 60525561 60525566 +
agcaactagattccaaaaaata

SEQ ID NO: 204957 - DNA, 22 bp, Artificial Sequence
  Synthetic oligonucleotide; CTA chr2 60525552 60525573 60525569 60525574 +
gattccaaaaaatagcagggag

SEQ ID NO: 204958 - DNA, 22 bp, Artificial Sequence
  Synthetic oligonucleotide; TTC chr2 60525557 60525578 60525574 60525579 +
caaaaaatagcagggagaaaac

SEQ ID NO: 204959 - DNA, 22 bp, Artificial Sequence
  Synthetic oligonucleotide; CTG chr2 60525581 60525602 60525598 60525603 +
gtcagtggtgttcatactatgc

SEQ ID NO: 204960 - DNA, 22 bp, Artificial Sequence
  Synthetic oligonucleotide; TTC chr2 60525594 60525615 60525611 60525616 +
atactatgctagaacatcatgg

SEQ ID NO: 204961 - DNA, 22 bp, Artificial Sequence
  Synthetic oligonucleotide; CTA chr2 60525600 60525621 60525617 60525622 +
tgctagaacatcatggggactt

SEQ ID NO: 204962 - DNA, 22 bp, Artificial Sequence
  Synthetic oligonucleotide; CTA chr2 60525605 60525626 60525622 60525627 +
gaacatcatggggacttagaga

SEQ ID NO: 204963 - DNA, 22 bp, Artificial Sequence
  Synthetic oligonucleotide; CTT chr2 60525622 60525643 60525639 60525644 +
agagacccacccagtccaaact

SEQ ID NO: 204964 - DNA, 22 bp, Artificial Sequence
  Synthetic oligonucleotide; TTA chr2 60525623 60525644 60525640 60525645 +
gagacccacccagtccaaacta

SEQ ID NO: 204965 - DNA, 22 bp, Artificial Sequence
  Synthetic oligonucleotide; CTA chr2 60525645 60525666 60525662 60525667 +
tctattttacctactttacaag

SEQ ID NO: 204966 - DNA, 22 bp, Artificial Sequence
  Synthetic oligonucleotide; CTA chr2 60525649 60525670 60525666 60525671 +
ttttacctactttacaagacaa

SEQ ID NO: 204967 - DNA, 22 bp, Artificial Sequence
  Synthetic oligonucleotide; TTT chr2 60525652 60525673 60525669 60525674 +
tacctactttacaagacaagga

SEQ ID NO: 204968 - DNA, 22 bp, Artificial Sequence
  Synthetic oligonucleotide; TTT chr2 60525653 60525674 60525670 60525675 +
acctactttacaagacaaggaa

SEQ ID NO: 204969 - DNA, 22 bp, Artificial Sequence
  Synthetic oligonucleotide; TTA chr2 60525654 60525675 60525671 60525676 +
cctactttacaagacaaggaaa

SEQ ID NO: 204970 - DNA, 22 bp, Artificial Sequence
  Synthetic oligonucleotide; CTA chr2 60525658 60525679 60525675 60525680 +
ctttacaagacaaggaaacaaa

SEQ ID NO: 204971 - DNA, 22 bp, Artificial Sequence
  Synthetic oligonucleotide; CTT chr2 60525661 60525682 60525678 60525683 +
tacaagacaaggaaacaaatgc

SEQ ID NO: 204972 - DNA, 22 bp, Artificial Sequence
  Synthetic oligonucleotide; TTT chr2 60525662 60525683 60525679 60525684 +
acaagacaaggaaacaaatgct

SEQ ID NO: 204973 - DNA, 22 bp, Artificial Sequence
  Synthetic oligonucleotide; TTA chr2 60525663 60525684 60525680 60525685 +
caagacaaggaaacaaatgcta

SEQ ID NO: 204974 - DNA, 22 bp, Artificial Sequence
  Synthetic oligonucleotide; CTA chr2 60525685 60525706 60525702 60525707 +
acaggtgaagggagcccaaaat

SEQ ID NO: 204975 - DNA, 22 bp, Artificial Sequence
  Synthetic oligonucleotide; CTC chr2 60525710 60525731 60525727 60525732 +
acagcatgatacaataagggtc

SEQ ID NO: 204976 - DNA, 22 bp, Artificial Sequence
  Synthetic oligonucleotide; CTG chr2 60525749 60525770 60525766 60525771 +
gttttcagatcagtgtctctct

SEQ ID NO: 204977 - DNA, 22 bp, Artificial Sequence
  Synthetic oligonucleotide; TTT chr2 60525753 60525774 60525770 60525775 +
tcagatcagtgtctctctgtta

SEQ ID NO: 204978 - DNA, 22 bp, Artificial Sequence
  Synthetic oligonucleotide; TTT chr2 60525754 60525775 60525771 60525776 +
cagatcagtgtctctctgttaa

SEQ ID NO: 204979 - DNA, 22 bp, Artificial Sequence
  Synthetic oligonucleotide; TTC chr2 60525755 60525776 60525772 60525777 +
agatcagtgtctctctgttaac

SEQ ID NO: 204980 - DNA, 22 bp, Artificial Sequence
  Synthetic oligonucleotide; CTC chr2 60525768 60525789 60525785 60525790 +
tctgttaacactaaaagtcaaa

SEQ ID NO: 204981 - DNA, 22 bp, Artificial Sequence
  Synthetic oligonucleotide; CTC chr2 60525770 60525791 60525787 60525792 +
tgttaacactaaaagtcaaagt

SEQ ID NO: 204982 - DNA, 22 bp, Artificial Sequence
  Synthetic oligonucleotide; CTG chr2 60525772 60525793 60525789 60525794 +
ttaacactaaaagtcaaagttt

SEQ ID NO: 204983 - DNA, 22 bp, Artificial Sequence
  Synthetic oligonucleotide; TTA chr2 60525775 60525796 60525792 60525797 +
acactaaaagtcaaagtttggt

SEQ ID NO: 204984 - DNA, 22 bp, Artificial Sequence
  Synthetic oligonucleotide; CTA chr2 60525781 60525802 60525798 60525803 +
aaagtcaaagtttggttctgga

SEQ ID NO: 204985 - DNA, 22 bp, Artificial Sequence
  Synthetic oligonucleotide; TTT chr2 60525794 60525815 60525811 60525816 +
ggttctggaaaatctgtaatgc

SEQ ID NO: 204986 - DNA, 22 bp, Artificial Sequence
  Synthetic oligonucleotide; TTG chr2 60525795 60525816 60525812 60525817 +
gttctggaaaatctgtaatgcc

SEQ ID NO: 204987 - DNA, 22 bp, Artificial Sequence
  Synthetic oligonucleotide; TTC chr2 60525799 60525820 60525816 60525821 +
tggaaaatctgtaatgcccaaa

SEQ ID NO: 204988 - DNA, 22 bp, Artificial Sequence
  Synthetic oligonucleotide; CTG chr2 60525801 60525822 60525818 60525823 +
gaaaatctgtaatgcccaaaag

SEQ ID NO: 204989 - DNA, 22 bp, Artificial Sequence
  Synthetic oligonucleotide; CTG chr2 60525810 60525831 60525827 60525832 +
taatgcccaaaagaccttaaat

SEQ ID NO: 204990 - DNA, 22 bp, Artificial Sequence
  Synthetic oligonucleotide; CTT chr2 60525828 60525849 60525845 60525850 +
aaatgccctccccccaaaccag

SEQ ID NO: 204991 - DNA, 22 bp, Artificial Sequence
  Synthetic oligonucleotide; TTA chr2 60525829 60525850 60525846 60525851 +
aatgccctccccccaaaccagt

SEQ ID NO: 204992 - DNA, 22 bp, Artificial Sequence
  Synthetic oligonucleotide; CTC chr2 60525838 60525859 60525855 60525860 +
cccccaaaccagtcttggtaat

SEQ ID NO: 204993 - DNA, 22 bp, Artificial Sequence
  Synthetic oligonucleotide; CTT chr2 60525854 60525875 60525871 60525876 +
ggtaatttctccatggctttca

SEQ ID NO: 204994 - DNA, 22 bp, Artificial Sequence
  Synthetic oligonucleotide; TTG chr2 60525855 60525876 60525872 60525877 +
gtaatttctccatggctttcac

SEQ ID NO: 204995 - DNA, 22 bp, Artificial Sequence
  Synthetic oligonucleotide; TTT chr2 60525862 60525883 60525879 60525884 +
ctccatggctttcacagaaggg

SEQ ID NO: 204996 - DNA, 22 bp, Artificial Sequence
  Synthetic oligonucleotide; TTC chr2 60525863 60525884 60525880 60525885 +
tccatggctttcacagaagggt

SEQ ID NO: 204997 - DNA, 22 bp, Artificial Sequence
  Synthetic oligonucleotide; CTC chr2 60525865 60525886 60525882 60525887 +
catggctttcacagaagggtaa

SEQ ID NO: 204998 - DNA, 22 bp, Artificial Sequence
  Synthetic oligonucleotide; CTT chr2 60525873 60525894 60525890 60525895 +
tcacagaagggtaaatgtctac

SEQ ID NO: 204999 - DNA, 22 bp, Artificial Sequence
  Synthetic oligonucleotide; TTT chr2 60525874 60525895 60525891 60525896 +
cacagaagggtaaatgtctact

SEQ ID NO: 205000 - DNA, 22 bp, Artificial Sequence
  Synthetic oligonucleotide; TTC chr2 60525875 60525896 60525892 60525897 +
acagaagggtaaatgtctactt

SEQ ID NO: 205001 - DNA, 22 bp, Artificial Sequence
  Synthetic oligonucleotide; CTA chr2 60525894 60525915 60525911 60525916 +
cttggaaggcctttactaattt

SEQ ID NO: 205002 - DNA, 22 bp, Artificial Sequence
  Synthetic oligonucleotide; CTT chr2 60525897 60525918 60525914 60525919 +
ggaaggcctttactaattttta

SEQ ID NO: 205003 - DNA, 22 bp, Artificial Sequence
  Synthetic oligonucleotide; TTG chr2 60525898 60525919 60525915 60525920 +
gaaggcctttactaatttttat

SEQ ID NO: 205004 - DNA, 22 bp, Artificial Sequence
  Synthetic oligonucleotide; CTT chr2 60525907 60525928 60525924 60525929 +
tactaatttttatgttatcttc

SEQ ID NO: 205005 - DNA, 22 bp, Artificial Sequence
  Synthetic oligonucleotide; TTT chr2 60525908 60525929 60525925 60525930 +
actaatttttatgttatcttct

SEQ ID NO: 205006 - DNA, 22 bp, Artificial Sequence
  Synthetic oligonucleotide; TTA chr2 60525909 60525930 60525926 60525931 +
ctaatttttatgttatcttctt

SEQ ID NO: 205007 - DNA, 22 bp, Artificial Sequence
  Synthetic oligonucleotide; CTA chr2 60525912 60525933 60525929 60525934 +
atttttatgttatcttcttcct

SEQ ID NO: 205008 - DNA, 22 bp, Artificial Sequence
  Synthetic oligonucleotide; TTT chr2 60525916 60525937 60525933 60525938 +
ttatgttatcttcttccttcat

SEQ ID NO: 205009 - DNA, 22 bp, Artificial Sequence
  Synthetic oligonucleotide; TTT chr2 60525917 60525938 60525934 60525939 +
tatgttatcttcttccttcatt

SEQ ID NO: 205010 - DNA, 22 bp, Artificial Sequence
  Synthetic oligonucleotide; TTT chr2 60525918 60525939 60525935 60525940 +
atgttatcttcttccttcattc

SEQ ID NO: 205011 - DNA, 22 bp, Artificial Sequence
  Synthetic oligonucleotide; TTA chr2 60525919 60525940 60525936 60525941 +
tgttatcttcttccttcattcg

SEQ ID NO: 205012 - DNA, 22 bp, Artificial Sequence
  Synthetic oligonucleotide; TTA chr2 60525924 60525945 60525941 60525946 +
tcttcttccttcattcgtgttt

SEQ ID NO: 205013 - DNA, 22 bp, Artificial Sequence
  Synthetic oligonucleotide; CTT chr2 60525928 60525949 60525945 60525950 +
cttccttcattcgtgtttggta

SEQ ID NO: 205014 - DNA, 22 bp, Artificial Sequence
  Synthetic oligonucleotide; TTC chr2 60525929 60525950 60525946 60525951 +
ttccttcattcgtgtttggtaa

SEQ ID NO: 205015 - DNA, 22 bp, Artificial Sequence
  Synthetic oligonucleotide; CTT chr2 60525931 60525952 60525948 60525953 +
ccttcattcgtgtttggtaatc

SEQ ID NO: 205016 - DNA, 22 bp, Artificial Sequence
  Synthetic oligonucleotide; TTC chr2 60525932 60525953 60525949 60525954 +
cttcattcgtgtttggtaatca

SEQ ID NO: 205017 - DNA, 22 bp, Artificial Sequence
  Synthetic oligonucleotide; CTT chr2 60525935 60525956 60525952 60525957 +
cattcgtgtttggtaatcaaaa

SEQ ID NO: 205018 - DNA, 22 bp, Artificial Sequence
  Synthetic oligonucleotide; TTC chr2 60525936 60525957 60525953 60525958 +
attcgtgtttggtaatcaaaaa

SEQ ID NO: 205019 - DNA, 22 bp, Artificial Sequence
  Synthetic oligonucleotide; TTC chr2 60525940 60525961 60525957 60525962 +
gtgtttggtaatcaaaaatagt

SEQ ID NO: 205020 - DNA, 22 bp, Artificial Sequence
  Synthetic oligonucleotide; TTT chr2 60525946 60525967 60525963 60525968 +
ggtaatcaaaaatagtttatca

SEQ ID NO: 205021 - DNA, 22 bp, Artificial Sequence
  Synthetic oligonucleotide; TTG chr2 60525947 60525968 60525964 60525969 +
gtaatcaaaaatagtttatcat

SEQ ID NO: 205022 - DNA, 22 bp, Artificial Sequence
  Synthetic oligonucleotide; TTT chr2 60525964 60525985 60525981 60525986 +
atcataatgctctcaattggaa

SEQ ID NO: 205023 - DNA, 22 bp, Artificial Sequence
  Synthetic oligonucleotide; TTA chr2 60525965 60525986 60525982 60525987 +
tcataatgctctcaattggaag

SEQ ID NO: 205024 - DNA, 22 bp, Artificial Sequence
  Synthetic oligonucleotide; CTC chr2 60525976 60525997 60525993 60525998 +
tcaattggaaggtcttcatact

SEQ ID NO: 205025 - DNA, 22 bp, Artificial Sequence
  Synthetic oligonucleotide; CTC chr2 60525978 60525999 60525995 60526000 +
aattggaaggtcttcatactac

SEQ ID NO: 205026 - DNA, 22 bp, Artificial Sequence
  Synthetic oligonucleotide; TTG chr2 60525983 60526004 60526000 60526005 +
gaaggtcttcatactacaggca

SEQ ID NO: 205027 - DNA, 22 bp, Artificial Sequence
  Synthetic oligonucleotide; CTT chr2 60525992 60526013 60526009 60526014 +
catactacaggcagatactgtt

SEQ ID NO: 205028 - DNA, 22 bp, Artificial Sequence
  Synthetic oligonucleotide; TTC chr2 60525993 60526014 60526010 60526015 +
atactacaggcagatactgtta

SEQ ID NO: 205029 - DNA, 22 bp, Artificial Sequence
  Synthetic oligonucleotide; CTA chr2 60525999 60526020 60526016 60526021 +
caggcagatactgttattttct

SEQ ID NO: 205030 - DNA, 22 bp, Artificial Sequence
  Synthetic oligonucleotide; CTG chr2 60526012 60526033 60526029 60526034 +
ttattttctggtagaggatggc

SEQ ID NO: 205031 - DNA, 22 bp, Artificial Sequence
  Synthetic oligonucleotide; TTA chr2 60526015 60526036 60526032 60526037 +
ttttctggtagaggatggcagc

SEQ ID NO: 205032 - DNA, 22 bp, Artificial Sequence
  Synthetic oligonucleotide; TTT chr2 60526018 60526039 60526035 60526040 +
tctggtagaggatggcagcagg

SEQ ID NO: 205033 - DNA, 22 bp, Artificial Sequence
  Synthetic oligonucleotide; TTT chr2 60526019 60526040 60526036 60526041 +
ctggtagaggatggcagcaggg

SEQ ID NO: 205034 - DNA, 22 bp, Artificial Sequence
  Synthetic oligonucleotide; TTC chr2 60526020 60526041 60526037 60526042 +
tggtagaggatggcagcagggc

SEQ ID NO: 205035 - DNA, 22 bp, Artificial Sequence
  Synthetic oligonucleotide; CTG chr2 60526022 60526043 60526039 60526044 +
gtagaggatggcagcagggctg

SEQ ID NO: 205036 - DNA, 22 bp, Artificial Sequence
  Synthetic oligonucleotide; CTG chr2 60526044 60526065 60526061 60526066 +
ggaaaaaagaatgtggtttttt

SEQ ID NO: 205037 - DNA, 22 bp, Artificial Sequence
  Synthetic oligonucleotide; TTT chr2 60526063 60526084 60526080 60526085 +
ttttctaaccacagtaggtttt

SEQ ID NO: 205038 - DNA, 22 bp, Artificial Sequence
  Synthetic oligonucleotide; TTT chr2 60526064 60526085 60526081 60526086 +
tttctaaccacagtaggttttt

SEQ ID NO: 205039 - DNA, 22 bp, Artificial Sequence
  Synthetic oligonucleotide; TTT chr2 60526065 60526086 60526082 60526087 +
ttctaaccacagtaggtttttt

SEQ ID NO: 205040 - DNA, 22 bp, Artificial Sequence
  Synthetic oligonucleotide; TTT chr2 60526066 60526087 60526083 60526088 +
tctaaccacagtaggttttttc

SEQ ID NO: 205041 - DNA, 22 bp, Artificial Sequence
  Synthetic oligonucleotide; TTT chr2 60526067 60526088 60526084 60526089 +
ctaaccacagtaggttttttct

SEQ ID NO: 205042 - DNA, 22 bp, Artificial Sequence
  Synthetic oligonucleotide; TTC chr2 60526068 60526089 60526085 60526090 +
taaccacagtaggttttttcta

SEQ ID NO: 205043 - DNA, 22 bp, Artificial Sequence
  Synthetic oligonucleotide; CTA chr2 60526070 60526091 60526087 60526092 +
accacagtaggttttttctata

SEQ ID NO: 205044 - DNA, 22 bp, Artificial Sequence
  Synthetic oligonucleotide; TTT chr2 60526084 60526105 60526101 60526106 +
tttctataacaatgatttcact

SEQ ID NO: 205045 - DNA, 22 bp, Artificial Sequence
  Synthetic oligonucleotide; TTT chr2 60526085 60526106 60526102 60526107 +
ttctataacaatgatttcactt

SEQ ID NO: 205046 - DNA, 22 bp, Artificial Sequence
  Synthetic oligonucleotide; TTT chr2 60526086 60526107 60526103 60526108 +
tctataacaatgatttcacttt

SEQ ID NO: 205047 - DNA, 22 bp, Artificial Sequence
  Synthetic oligonucleotide; TTT chr2 60526087 60526108 60526104 60526109 +
ctataacaatgatttcactttc

SEQ ID NO: 205048 - DNA, 22 bp, Artificial Sequence
  Synthetic oligonucleotide; TTC chr2 60526088 60526109 60526105 60526110 +
tataacaatgatttcactttct

SEQ ID NO: 205049 - DNA, 22 bp, Artificial Sequence
  Synthetic oligonucleotide; CTA chr2 60526090 60526111 60526107 60526112 +
taacaatgatttcactttctag

SEQ ID NO: 205050 - DNA, 22 bp, Artificial Sequence
  Synthetic oligonucleotide; TTT chr2 60526102 60526123 60526119 60526124 +
cactttctagatataaaacagg

SEQ ID NO: 205051 - DNA, 22 bp, Artificial Sequence
  Synthetic oligonucleotide; TTC chr2 60526103 60526124 60526120 60526125 +
actttctagatataaaacaggc

SEQ ID NO: 205052 - DNA, 22 bp, Artificial Sequence
  Synthetic oligonucleotide; CTT chr2 60526107 60526128 60526124 60526129 +
tctagatataaaacaggcatgg

SEQ ID NO: 205053 - DNA, 22 bp, Artificial Sequence
  Synthetic oligonucleotide; TTT chr2 60526108 60526129 60526125 60526130 +
ctagatataaaacaggcatggt

SEQ ID NO: 205054 - DNA, 22 bp, Artificial Sequence
  Synthetic oligonucleotide; TTC chr2 60526109 60526130 60526126 60526131 +
tagatataaaacaggcatggtt

SEQ ID NO: 205055 - DNA, 22 bp, Artificial Sequence
  Synthetic oligonucleotide; CTA chr2 60526111 60526132 60526128 60526133 +
gatataaaacaggcatggtttc

SEQ ID NO: 205056 - DNA, 22 bp, Artificial Sequence
  Synthetic oligonucleotide; TTT chr2 60526132 60526153 60526149 60526154 +
ctctcaccctgaacttctgcaa

SEQ ID NO: 205057 - DNA, 22 bp, Artificial Sequence
  Synthetic oligonucleotide; TTC chr2 60526133 60526154 60526150 60526155 +
tctcaccctgaacttctgcaaa

SEQ ID NO: 205058 - DNA, 22 bp, Artificial Sequence
  Synthetic oligonucleotide; CTC chr2 60526135 60526156 60526152 60526157 +
tcaccctgaacttctgcaaaat

SEQ ID NO: 205059 - DNA, 22 bp, Artificial Sequence
  Synthetic oligonucleotide; CTC chr2 60526137 60526158 60526154 60526159 +
accctgaacttctgcaaaatct

SEQ ID NO: 205060 - DNA, 22 bp, Artificial Sequence
  Synthetic oligonucleotide; CTG chr2 60526143 60526164 60526160 60526165 +
aacttctgcaaaatctagattt

SEQ ID NO: 205061 - DNA, 22 bp, Artificial Sequence
  Synthetic oligonucleotide; CTT chr2 60526148 60526169 60526165 60526170 +
ctgcaaaatctagatttgatca

SEQ ID NO: 205062 - DNA, 22 bp, Artificial Sequence
  Synthetic oligonucleotide; TTC chr2 60526149 60526170 60526166 60526171 +
tgcaaaatctagatttgatcaa

SEQ ID NO: 205063 - DNA, 22 bp, Artificial Sequence
  Synthetic oligonucleotide; CTG chr2 60526151 60526172 60526168 60526173 +
caaaatctagatttgatcaaat

SEQ ID NO: 205064 - DNA, 22 bp, Artificial Sequence
  Synthetic oligonucleotide; CTA chr2 60526160 60526181 60526177 60526182 +
gatttgatcaaattcagaaact

SEQ ID NO: 205065 - DNA, 22 bp, Artificial Sequence
  Synthetic oligonucleotide; TTT chr2 60526165 60526186 60526182 60526187 +
gatcaaattcagaaactggtga

SEQ ID NO: 205066 - DNA, 22 bp, Artificial Sequence
  Synthetic oligonucleotide; TTG chr2 60526166 60526187 60526183 60526188 +
atcaaattcagaaactggtgat

SEQ ID NO: 205067 - DNA, 22 bp, Artificial Sequence
  Synthetic oligonucleotide; TTC chr2 60526175 60526196 60526192 60526197 +
agaaactggtgatttgatcaaa

SEQ ID NO: 205068 - DNA, 22 bp, Artificial Sequence
  Synthetic oligonucleotide; CTG chr2 60526183 60526204 60526200 60526205 +
gtgatttgatcaaattcagaat

SEQ ID NO: 205069 - DNA, 22 bp, Artificial Sequence
  Synthetic oligonucleotide; TTT chr2 60526190 60526211 60526207 60526212 +
gatcaaattcagaatcccatat

SEQ ID NO: 205070 - DNA, 22 bp, Artificial Sequence
  Synthetic oligonucleotide; TTG chr2 60526191 60526212 60526208 60526213 +
atcaaattcagaatcccatatt

SEQ ID NO: 205071 - DNA, 22 bp, Artificial Sequence
  Synthetic oligonucleotide; TTC chr2 60526200 60526221 60526217 60526222 +
agaatcccatattttgggatga

SEQ ID NO: 205072 - DNA, 22 bp, Artificial Sequence
  Synthetic oligonucleotide; TTT chr2 60526214 60526235 60526231 60526236 +
tgggatgatgtgttctagcaga

SEQ ID NO: 205073 - DNA, 22 bp, Artificial Sequence
  Synthetic oligonucleotide; TTT chr2 60526215 60526236 60526232 60526237 +
gggatgatgtgttctagcagaa

SEQ ID NO: 205074 - DNA, 22 bp, Artificial Sequence
  Synthetic oligonucleotide; TTG chr2 60526216 60526237 60526233 60526238 +
ggatgatgtgttctagcagaaa

SEQ ID NO: 205075 - DNA, 22 bp, Artificial Sequence
  Synthetic oligonucleotide; TTC chr2 60526229 60526250 60526246 60526251 +
tagcagaaagctattggttggc

SEQ ID NO: 205076 - DNA, 22 bp, Artificial Sequence
  Synthetic oligonucleotide; CTA chr2 60526231 60526252 60526248 60526253 +
gcagaaagctattggttggcta

SEQ ID NO: 205077 - DNA, 22 bp, Artificial Sequence
  Synthetic oligonucleotide; CTA chr2 60526242 60526263 60526259 60526264 +
ttggttggctatattttgctct

SEQ ID NO: 205078 - DNA, 22 bp, Artificial Sequence
  Synthetic oligonucleotide; TTG chr2 60526245 60526266 60526262 60526267 +
gttggctatattttgctctttc

SEQ ID NO: 205079 - DNA, 22 bp, Artificial Sequence
  Synthetic oligonucleotide; TTG chr2 60526249 60526270 60526266 60526271 +
gctatattttgctctttcttcc

SEQ ID NO: 205080 - DNA, 22 bp, Artificial Sequence
  Synthetic oligonucleotide; CTA chr2 60526253 60526274 60526270 60526275 +
tattttgctctttcttccccaa

SEQ ID NO: 205081 - DNA, 22 bp, Artificial Sequence
  Synthetic oligonucleotide; TTT chr2 60526258 60526279 60526275 60526280 +
tgctctttcttccccaaaagat

SEQ ID NO: 205082 - DNA, 22 bp, Artificial Sequence
  Synthetic oligonucleotide; TTT chr2 60526259 60526280 60526276 60526281 +
gctctttcttccccaaaagatt

SEQ ID NO: 205083 - DNA, 22 bp, Artificial Sequence
  Synthetic oligonucleotide; TTG chr2 60526260 60526281 60526277 60526282 +
ctctttcttccccaaaagattt

SEQ ID NO: 205084 - DNA, 22 bp, Artificial Sequence
  Synthetic oligonucleotide; CTC chr2 60526263 60526284 60526280 60526285 +
tttcttccccaaaagattttta

SEQ ID NO: 205085 - DNA, 22 bp, Artificial Sequence
  Synthetic oligonucleotide; CTT chr2 60526265 60526286 60526282 60526287 +
tcttccccaaaagatttttaaa

SEQ ID NO: 205086 - DNA, 22 bp, Artificial Sequence
  Synthetic oligonucleotide; TTT chr2 60526266 60526287 60526283 60526288 +
cttccccaaaagatttttaaat

SEQ ID NO: 205087 - DNA, 22 bp, Artificial Sequence
  Synthetic oligonucleotide; TTC chr2 60526267 60526288 60526284 60526289 +
ttccccaaaagatttttaaata

SEQ ID NO: 205088 - DNA, 22 bp, Artificial Sequence
  Synthetic oligonucleotide; CTT chr2 60526269 60526290 60526286 60526291 +
ccccaaaagatttttaaatagt

SEQ ID NO: 205089 - DNA, 22 bp, Artificial Sequence
  Synthetic oligonucleotide; TTC chr2 60526270 60526291 60526287 60526292 +
cccaaaagatttttaaatagtt

SEQ ID NO: 205090 - DNA, 22 bp, Artificial Sequence
  Synthetic oligonucleotide; TTT chr2 60526282 60526303 60526299 60526304 +
ttaaatagttttcatctttaaa

SEQ ID NO: 205091 - DNA, 22 bp, Artificial Sequence
  Synthetic oligonucleotide; TTT chr2 60526283 60526304 60526300 60526305 +
taaatagttttcatctttaaaa

SEQ ID NO: 205092 - DNA, 22 bp, Artificial Sequence
  Synthetic oligonucleotide; TTT chr2 60526284 60526305 60526301 60526306 +
aaatagttttcatctttaaaag

SEQ ID NO: 205093 - DNA, 22 bp, Artificial Sequence
  Synthetic oligonucleotide; TTA chr2 60526285 60526306 60526302 60526307 +
aatagttttcatctttaaaagg

SEQ ID NO: 205094 - DNA, 22 bp, Artificial Sequence
  Synthetic oligonucleotide; TTT chr2 60526293 60526314 60526310 60526315 +
tcatctttaaaaggatttcaac

SEQ ID NO: 205095 - DNA, 22 bp, Artificial Sequence
  Synthetic oligonucleotide; TTT chr2 60526294 60526315 60526311 60526316 +
catctttaaaaggatttcaact

SEQ ID NO: 205096 - DNA, 22 bp, Artificial Sequence
  Synthetic oligonucleotide; TTC chr2 60526295 60526316 60526312 60526317 +
atctttaaaaggatttcaactt

SEQ ID NO: 205097 - DNA, 22 bp, Artificial Sequence
  Synthetic oligonucleotide; CTT chr2 60526300 60526321 60526317 60526322 +
taaaaggatttcaacttcagat

SEQ ID NO: 205098 - DNA, 22 bp, Artificial Sequence
  Synthetic oligonucleotide; TTT chr2 60526301 60526322 60526318 60526323 +
aaaaggatttcaacttcagatt

SEQ ID NO: 205099 - DNA, 22 bp, Artificial Sequence
  Synthetic oligonucleotide; TTA chr2 60526302 60526323 60526319 60526324 +
aaaggatttcaacttcagattg

SEQ ID NO: 205100 - DNA, 22 bp, Artificial Sequence
  Synthetic oligonucleotide; TTT chr2 60526311 60526332 60526328 60526333 +
caacttcagattgtgcccacgc

SEQ ID NO: 205101 - DNA, 22 bp, Artificial Sequence
  Synthetic oligonucleotide; TTC chr2 60526312 60526333 60526329 60526334 +
aacttcagattgtgcccacgcc

SEQ ID NO: 205102 - DNA, 22 bp, Artificial Sequence
  Synthetic oligonucleotide; CTT chr2 60526317 60526338 60526334 60526339 +
cagattgtgcccacgccaaagt

SEQ ID NO: 205103 - DNA, 22 bp, Artificial Sequence
  Synthetic oligonucleotide; TTC chr2 60526318 60526339 60526335 60526340 +
agattgtgcccacgccaaagtc

SEQ ID NO: 205104 - DNA, 22 bp, Artificial Sequence
  Synthetic oligonucleotide; TTG chr2 60526324 60526345 60526341 60526346 +
tgcccacgccaaagtctctata

SEQ ID NO: 205105 - DNA, 22 bp, Artificial Sequence
  Synthetic oligonucleotide; CTC chr2 60526342 60526363 60526359 60526364 +
tatacatctaatcaataaataa

SEQ ID NO: 205106 - DNA, 22 bp, Artificial Sequence
  Synthetic oligonucleotide; CTA chr2 60526344 60526365 60526361 60526366 +
tacatctaatcaataaataaat

SEQ ID NO: 205107 - DNA, 22 bp, Artificial Sequence
  Synthetic oligonucleotide; CTA chr2 60526352 60526373 60526369 60526374 +
atcaataaataaataagacaaa

SEQ ID NO: 205108 - DNA, 22 bp, Artificial Sequence
  Synthetic oligonucleotide; TTT chr2 60526391 60526412 60526408 60526413 +
atcctttaccatttgggaagtg

SEQ ID NO: 205109 - DNA, 22 bp, Artificial Sequence
  Synthetic oligonucleotide; TTA chr2 60526392 60526413 60526409 60526414 +
tcctttaccatttgggaagtgt

SEQ ID NO: 205110 - DNA, 22 bp, Artificial Sequence
  Synthetic oligonucleotide; CTT chr2 60526397 60526418 60526414 60526419 +
taccatttgggaagtgtacatt

SEQ ID NO: 205111 - DNA, 22 bp, Artificial Sequence
  Synthetic oligonucleotide; TTT chr2 60526398 60526419 60526415 60526420 +
accatttgggaagtgtacatta

SEQ ID NO: 205112 - DNA, 22 bp, Artificial Sequence
  Synthetic oligonucleotide; TTA chr2 60526399 60526420 60526416 60526421 +
ccatttgggaagtgtacattaa

SEQ ID NO: 205113 - DNA, 22 bp, Artificial Sequence
  Synthetic oligonucleotide; TTT chr2 60526405 60526426 60526422 60526427 +
gggaagtgtacattaattactg

SEQ ID NO: 205114 - DNA, 22 bp, Artificial Sequence
  Synthetic oligonucleotide; TTG chr2 60526406 60526427 60526423 60526428 +
ggaagtgtacattaattactgc

SEQ ID NO: 205115 - DNA, 22 bp, Artificial Sequence
  Synthetic oligonucleotide; TTA chr2 60526420 60526441 60526437 60526442 +
attactgcagattgtctcctat

SEQ ID NO: 205116 - DNA, 22 bp, Artificial Sequence
  Synthetic oligonucleotide; TTA chr2 60526424 60526445 60526441 60526446 +
ctgcagattgtctcctatgcat

SEQ ID NO: 205117 - DNA, 22 bp, Artificial Sequence
  Synthetic oligonucleotide; CTG chr2 60526427 60526448 60526444 60526449 +
cagattgtctcctatgcatctc

SEQ ID NO: 205118 - DNA, 22 bp, Artificial Sequence
  Synthetic oligonucleotide; TTG chr2 60526434 60526455 60526451 60526456 +
tctcctatgcatctccccccac

SEQ ID NO: 205119 - DNA, 22 bp, Artificial Sequence
  Synthetic oligonucleotide; CTC chr2 60526438 60526459 60526455 60526460 +
ctatgcatctccccccaccccc

SEQ ID NO: 205120 - DNA, 22 bp, Artificial Sequence
  Synthetic oligonucleotide; CTA chr2 60526441 60526462 60526458 60526463 +
tgcatctccccccaccccctct

SEQ ID NO: 205121 - DNA, 22 bp, Artificial Sequence
  Synthetic oligonucleotide; CTC chr2 60526449 60526470 60526466 60526471 +
cccccaccccctctgcatcgca

SEQ ID NO: 205122 - DNA, 22 bp, Artificial Sequence
  Synthetic oligonucleotide; CTC chr2 60526462 60526483 60526479 60526484 +
tgcatcgcagacagcagtgctc

SEQ ID NO: 205123 - DNA, 22 bp, Artificial Sequence
  Synthetic oligonucleotide; CTG chr2 60526464 60526485 60526481 60526486 +
catcgcagacagcagtgctcaa

SEQ ID NO: 205124 - DNA, 22 bp, Artificial Sequence
  Synthetic oligonucleotide; CTC chr2 60526484 60526505 60526501 60526506 +
aaaagggtccgcaaaataaaaa

SEQ ID NO: 205125 - DNA, 22 bp, Artificial Sequence
  Synthetic oligonucleotide; TTA chr2 60526521 60526542 60526538 60526543 +
aatgggtatttataattagaac

SEQ ID NO: 205126 - DNA, 22 bp, Artificial Sequence
  Synthetic oligonucleotide; TTT chr2 60526532 60526553 60526549 60526554 +
ataattagaacttaataatttg

SEQ ID NO: 205127 - DNA, 22 bp, Artificial Sequence
  Synthetic oligonucleotide; TTA chr2 60526533 60526554 60526550 60526555 +
taattagaacttaataatttgc

SEQ ID NO: 205128 - DNA, 22 bp, Artificial Sequence
  Synthetic oligonucleotide; TTA chr2 60526539 60526560 60526556 60526561 +
gaacttaataatttgcatcagg

SEQ ID NO: 205129 - DNA, 22 bp, Artificial Sequence
  Synthetic oligonucleotide; CTT chr2 60526545 60526566 60526562 60526567 +
aataatttgcatcagggacaaa

SEQ ID NO: 205130 - DNA, 22 bp, Artificial Sequence
  Synthetic oligonucleotide; TTA chr2 60526546 60526567 60526563 60526568 +
ataatttgcatcagggacaaat

SEQ ID NO: 205131 - DNA, 22 bp, Artificial Sequence
  Synthetic oligonucleotide; TTT chr2 60526553 60526574 60526570 60526575 +
gcatcagggacaaatgagctct

SEQ ID NO: 205132 - DNA, 22 bp, Artificial Sequence
  Synthetic oligonucleotide; TTG chr2 60526554 60526575 60526571 60526576 +
catcagggacaaatgagctctg

SEQ ID NO: 205133 - DNA, 22 bp, Artificial Sequence
  Synthetic oligonucleotide; CTC chr2 60526574 60526595 60526591 60526596 +
tgattttaatctgcagcgcatt

SEQ ID NO: 205134 - DNA, 22 bp, Artificial Sequence
  Synthetic oligonucleotide; CTG chr2 60526576 60526597 60526593 60526598 +
attttaatctgcagcgcattta

SEQ ID NO: 205135 - DNA, 22 bp, Artificial Sequence
  Synthetic oligonucleotide; TTT chr2 60526580 60526601 60526597 60526602 +
taatctgcagcgcatttagatt

SEQ ID NO: 205136 - DNA, 22 bp, Artificial Sequence
  Synthetic oligonucleotide; TTT chr2 60526581 60526602 60526598 60526603 +
aatctgcagcgcatttagatta

SEQ ID NO: 205137 - DNA, 22 bp, Artificial Sequence
  Synthetic oligonucleotide; TTA chr2 60526582 60526603 60526599 60526604 +
atctgcagcgcatttagattag

SEQ ID NO: 205138 - DNA, 22 bp, Artificial Sequence
  Synthetic oligonucleotide; CTG chr2 60526587 60526608 60526604 60526609 +
cagcgcatttagattagcccaa

SEQ ID NO: 205139 - DNA, 22 bp, Artificial Sequence
  Synthetic oligonucleotide; TTT chr2 60526597 60526618 60526614 60526619 +
agattagcccaaagatagtgta

SEQ ID NO: 205140 - DNA, 22 bp, Artificial Sequence
  Synthetic oligonucleotide; TTA chr2 60526598 60526619 60526615 60526620 +
gattagcccaaagatagtgtaa

SEQ ID NO: 205141 - DNA, 22 bp, Artificial Sequence
  Synthetic oligonucleotide; TTA chr2 60526603 60526624 60526620 60526625 +
gcccaaagatagtgtaatttga

SEQ ID NO: 205142 - DNA, 22 bp, Artificial Sequence
  Synthetic oligonucleotide; TTT chr2 60526623 60526644 60526640 60526645 +
gatggtttataggcctcctctc

SEQ ID NO: 205143 - DNA, 22 bp, Artificial Sequence
  Synthetic oligonucleotide; TTG chr2 60526624 60526645 60526641 60526646 +
atggtttataggcctcctctcg

SEQ ID NO: 205144 - DNA, 22 bp, Artificial Sequence
  Synthetic oligonucleotide; TTT chr2 60526631 60526652 60526648 60526653 +
ataggcctcctctcggattatg

SEQ ID NO: 205145 - DNA, 22 bp, Artificial Sequence
  Synthetic oligonucleotide; TTA chr2 60526632 60526653 60526649 60526654 +
taggcctcctctcggattatga

SEQ ID NO: 205146 - DNA, 22 bp, Artificial Sequence
  Synthetic oligonucleotide; CTC chr2 60526640 60526661 60526657 60526662 +
ctctcggattatgaaacaatac

SEQ ID NO: 205147 - DNA, 22 bp, Artificial Sequence
  Synthetic oligonucleotide; CTC chr2 60526643 60526664 60526660 60526665 +
tcggattatgaaacaataccaa

SEQ ID NO: 205148 - DNA, 22 bp, Artificial Sequence
  Synthetic oligonucleotide; CTC chr2 60526645 60526666 60526662 60526667 +
ggattatgaaacaataccaagc

SEQ ID NO: 205149 - DNA, 22 bp, Artificial Sequence
  Synthetic oligonucleotide; TTA chr2 60526651 60526672 60526668 60526673 +
tgaaacaataccaagccttcaa

SEQ ID NO: 205150 - DNA, 22 bp, Artificial Sequence
  Synthetic oligonucleotide; CTT chr2 60526670 60526691 60526687 60526692 +
caagtgcagtgtgtctatgtca

SEQ ID NO: 205151 - DNA, 22 bp, Artificial Sequence
  Synthetic oligonucleotide; TTC chr2 60526671 60526692 60526688 60526693 +
aagtgcagtgtgtctatgtcag

SEQ ID NO: 205152 - DNA, 22 bp, Artificial Sequence
  Synthetic oligonucleotide; CTA chr2 60526687 60526708 60526704 60526709 +
tgtcaggagggtgttaaagaag

SEQ ID NO: 205153 - DNA, 22 bp, Artificial Sequence
  Synthetic oligonucleotide; TTA chr2 60526703 60526724 60526720 60526725 +
aagaagaagatgcaatgaaaat

SEQ ID NO: 205154 - DNA, 22 bp, Artificial Sequence
  Synthetic oligonucleotide; TTT chr2 60526729 60526750 60526746 60526751 +
gacaacgtgaaagcagccataa

SEQ ID NO: 205155 - DNA, 22 bp, Artificial Sequence
  Synthetic oligonucleotide; TTG chr2 60526730 60526751 60526747 60526752 +
acaacgtgaaagcagccataaa

SEQ ID NO: 205156 - DNA, 22 bp, Artificial Sequence
  Synthetic oligonucleotide; TTA chr2 60526755 60526776 60526772 60526777 +
catgacaactgtgtaaaagtca

SEQ ID NO: 205157 - DNA, 22 bp, Artificial Sequence
  Synthetic oligonucleotide; CTG chr2 60526766 60526787 60526783 60526788 +
tgtaaaagtcatgatgaaacaa

SEQ ID NO: 205158 - DNA, 22 bp, Artificial Sequence
  Synthetic oligonucleotide; CTG chr2 60526799 60526820 60526816 60526821 +
acctataatgcgtctgattcat

SEQ ID NO: 205159 - DNA, 22 bp, Artificial Sequence
  Synthetic oligonucleotide; CTA chr2 60526804 60526825 60526821 60526826 +
taatgcgtctgattcattgtga

SEQ ID NO: 205160 - DNA, 22 bp, Artificial Sequence
  Synthetic oligonucleotide; CTG chr2 60526815 60526836 60526832 60526837 +
attcattgtgacacacacaact

SEQ ID NO: 205161 - DNA, 22 bp, Artificial Sequence
  Synthetic oligonucleotide; TTC chr2 60526819 60526840 60526836 60526841 +
attgtgacacacacaactccct

SEQ ID NO: 205162 - DNA, 22 bp, Artificial Sequence
  Synthetic oligonucleotide; TTG chr2 60526823 60526844 60526840 60526845 +
tgacacacacaactccctgcgc

SEQ ID NO: 205163 - DNA, 22 bp, Artificial Sequence
  Synthetic oligonucleotide; CTC chr2 60526838 60526859 60526855 60526860 +
cctgcgctaatctctgcccagc

SEQ ID NO: 205164 - DNA, 22 bp, Artificial Sequence
  Synthetic oligonucleotide; CTG chr2 60526842 60526863 60526859 60526864 +
cgctaatctctgcccagccaac

SEQ ID NO: 205165 - DNA, 22 bp, Artificial Sequence
  Synthetic oligonucleotide; CTA chr2 60526847 60526868 60526864 60526869 +
atctctgcccagccaacgcatt

SEQ ID NO: 205166 - DNA, 22 bp, Artificial Sequence
  Synthetic oligonucleotide; CTC chr2 60526852 60526873 60526869 60526874 +
tgcccagccaacgcattcttaa

SEQ ID NO: 205167 - DNA, 22 bp, Artificial Sequence
  Synthetic oligonucleotide; CTG chr2 60526854 60526875 60526871 60526876 +
cccagccaacgcattcttaagc

SEQ ID NO: 205168 - DNA, 22 bp, Artificial Sequence
  Synthetic oligonucleotide; TTC chr2 60526870 60526891 60526887 60526892 +
ttaagcggggaactacttagca

SEQ ID NO: 205169 - DNA, 22 bp, Artificial Sequence
  Synthetic oligonucleotide; CTT chr2 60526872 60526893 60526889 60526894 +
aagcggggaactacttagcacc

SEQ ID NO: 205170 - DNA, 22 bp, Artificial Sequence
  Synthetic oligonucleotide; TTA chr2 60526873 60526894 60526890 60526895 +
agcggggaactacttagcacca

SEQ ID NO: 205171 - DNA, 22 bp, Artificial Sequence
  Synthetic oligonucleotide; CTA chr2 60526885 60526906 60526902 60526907 +
cttagcaccaggaacgttgtaa

SEQ ID NO: 205172 - DNA, 22 bp, Artificial Sequence
  Synthetic oligonucleotide; CTT chr2 60526888 60526909 60526905 60526910 +
agcaccaggaacgttgtaaatt

SEQ ID NO: 205173 - DNA, 22 bp, Artificial Sequence
  Synthetic oligonucleotide; TTA chr2 60526889 60526910 60526906 60526911 +
gcaccaggaacgttgtaaatta

SEQ ID NO: 205174 - DNA, 22 bp, Artificial Sequence
  Synthetic oligonucleotide; TTG chr2 60526904 60526925 60526921 60526926 +
taaattatcactagtcaacagc

SEQ ID NO: 205175 - DNA, 22 bp, Artificial Sequence
  Synthetic oligonucleotide; TTA chr2 60526911 60526932 60526928 60526933 +
tcactagtcaacagcattgatt

SEQ ID NO: 205176 - DNA, 22 bp, Artificial Sequence
  Synthetic oligonucleotide; CTA chr2 60526917 60526938 60526934 60526939 +
gtcaacagcattgatttttagt

SEQ ID NO: 205177 - DNA, 22 bp, Artificial Sequence
  Synthetic oligonucleotide; TTG chr2 60526930 60526951 60526947 60526952 +
atttttagtcgacatttcaatc

SEQ ID NO: 205178 - DNA, 22 bp, Artificial Sequence
  Synthetic oligonucleotide; TTT chr2 60526934 60526955 60526951 60526956 +
ttagtcgacatttcaatcaggt

SEQ ID NO: 205179 - DNA, 22 bp, Artificial Sequence
  Synthetic oligonucleotide; TTT chr2 60526935 60526956 60526952 60526957 +
tagtcgacatttcaatcaggtt

SEQ ID NO: 205180 - DNA, 22 bp, Artificial Sequence
  Synthetic oligonucleotide; TTT chr2 60526936 60526957 60526953 60526958 +
agtcgacatttcaatcaggttg

SEQ ID NO: 205181 - DNA, 22 bp, Artificial Sequence
  Synthetic oligonucleotide; TTA chr2 60526937 60526958 60526954 60526959 +
gtcgacatttcaatcaggttga

SEQ ID NO: 205182 - DNA, 22 bp, Artificial Sequence
  Synthetic oligonucleotide; TTT chr2 60526947 60526968 60526964 60526969 +
caatcaggttgaagtagaaata

SEQ ID NO: 205183 - DNA, 22 bp, Artificial Sequence
  Synthetic oligonucleotide; TTC chr2 60526948 60526969 60526965 60526970 +
aatcaggttgaagtagaaatac

SEQ ID NO: 205184 - DNA, 22 bp, Artificial Sequence
  Synthetic oligonucleotide; TTG chr2 60526958 60526979 60526975 60526980 +
aagtagaaatactacccggctc

SEQ ID NO: 205185 - DNA, 22 bp, Artificial Sequence
  Synthetic oligonucleotide; CTA chr2 60526972 60526993 60526989 60526994 +
cccggctcatccaacagcctct

SEQ ID NO: 205186 - DNA, 22 bp, Artificial Sequence
  Synthetic oligonucleotide; CTC chr2 60526980 60527001 60526997 60527002 +
atccaacagcctcttaaccagt

SEQ ID NO: 205187 - DNA, 22 bp, Artificial Sequence
  Synthetic oligonucleotide; CTC chr2 60526993 60527014 60527010 60527015 +
ttaaccagtccactgcccctct

SEQ ID NO: 205188 - DNA, 22 bp, Artificial Sequence
  Synthetic oligonucleotide; CTT chr2 60526995 60527016 60527012 60527017 +
aaccagtccactgcccctctga

SEQ ID NO: 205189 - DNA, 22 bp, Artificial Sequence
  Synthetic oligonucleotide; TTA chr2 60526996 60527017 60527013 60527018 +
accagtccactgcccctctgag

SEQ ID NO: 205190 - DNA, 22 bp, Artificial Sequence
  Synthetic oligonucleotide; CTG chr2 60527008 60527029 60527025 60527030 +
cccctctgaggtctccccggtt

SEQ ID NO: 205191 - DNA, 22 bp, Artificial Sequence
  Synthetic oligonucleotide; CTC chr2 60527014 60527035 60527031 60527036 +
tgaggtctccccggttatggct

SEQ ID NO: 205192 - DNA, 22 bp, Artificial Sequence
  Synthetic oligonucleotide; CTG chr2 60527016 60527037 60527033 60527038 +
aggtctccccggttatggcttt

SEQ ID NO: 205193 - DNA, 22 bp, Artificial Sequence
  Synthetic oligonucleotide; CTC chr2 60527023 60527044 60527040 60527045 +
cccggttatggctttgctaaat

SEQ ID NO: 205194 - DNA, 22 bp, Artificial Sequence
  Synthetic oligonucleotide; TTA chr2 60527031 60527052 60527048 60527053 +
tggctttgctaaatttccattg

SEQ ID NO: 205195 - DNA, 22 bp, Artificial Sequence
  Synthetic oligonucleotide; CTT chr2 60527037 60527058 60527054 60527059 +
tgctaaatttccattgctctca

SEQ ID NO: 205196 - DNA, 22 bp, Artificial Sequence
  Synthetic oligonucleotide; TTT chr2 60527038 60527059 60527055 60527060 +
gctaaatttccattgctctcac

SEQ ID NO: 205197 - DNA, 22 bp, Artificial Sequence
  Synthetic oligonucleotide; TTG chr2 60527039 60527060 60527056 60527061 +
ctaaatttccattgctctcacc

SEQ ID NO: 205198 - DNA, 22 bp, Artificial Sequence
  Synthetic oligonucleotide; CTA chr2 60527042 60527063 60527059 60527064 +
aatttccattgctctcaccatt

SEQ ID NO: 205199 - DNA, 22 bp, Artificial Sequence
  Synthetic oligonucleotide; TTT chr2 60527047 60527068 60527064 60527069 +
ccattgctctcaccattcgata

SEQ ID NO: 205200 - DNA, 22 bp, Artificial Sequence
  Synthetic oligonucleotide; TTC chr2 60527048 60527069 60527065 60527070 +
cattgctctcaccattcgatat

SEQ ID NO: 205201 - DNA, 22 bp, Artificial Sequence
  Synthetic oligonucleotide; TTG chr2 60527053 60527074 60527070 60527075 +
ctctcaccattcgatatttatt

SEQ ID NO: 205202 - DNA, 22 bp, Artificial Sequence
  Synthetic oligonucleotide; CTC chr2 60527056 60527077 60527073 60527078 +
tcaccattcgatatttattgta

SEQ ID NO: 205203 - DNA, 22 bp, Artificial Sequence
  Synthetic oligonucleotide; CTC chr2 60527058 60527079 60527075 60527080 +
accattcgatatttattgtagc

SEQ ID NO: 205204 - DNA, 22 bp, Artificial Sequence
  Synthetic oligonucleotide; TTC chr2 60527065 60527086 60527082 60527087 +
gatatttattgtagctttgcca

SEQ ID NO: 205205 - DNA, 22 bp, Artificial Sequence
  Synthetic oligonucleotide; TTT chr2 60527072 60527093 60527089 60527094 +
attgtagctttgccacatccag

SEQ ID NO: 205206 - DNA, 22 bp, Artificial Sequence
  Synthetic oligonucleotide; TTA chr2 60527073 60527094 60527090 60527095 +
ttgtagctttgccacatccagg

SEQ ID NO: 205207 - DNA, 22 bp, Artificial Sequence
  Synthetic oligonucleotide; TTG chr2 60527076 60527097 60527093 60527098 +
tagctttgccacatccaggcac

SEQ ID NO: 205208 - DNA, 22 bp, Artificial Sequence
  Synthetic oligonucleotide; CTT chr2 60527082 60527103 60527099 60527104 +
tgccacatccaggcacttggcc

SEQ ID NO: 205209 - DNA, 22 bp, Artificial Sequence
  Synthetic oligonucleotide; TTT chr2 60527083 60527104 60527100 60527105 +
gccacatccaggcacttggcct

SEQ ID NO: 205210 - DNA, 22 bp, Artificial Sequence
  Synthetic oligonucleotide; TTG chr2 60527084 60527105 60527101 60527106 +
ccacatccaggcacttggcctg

SEQ ID NO: 205211 - DNA, 22 bp, Artificial Sequence
  Synthetic oligonucleotide; CTT chr2 60527100 60527121 60527117 60527122 +
ggcctgaagggtcaccggcctg

SEQ ID NO: 205212 - DNA, 22 bp, Artificial Sequence
  Synthetic oligonucleotide; TTG chr2 60527101 60527122 60527118 60527123 +
gcctgaagggtcaccggcctgc

SEQ ID NO: 205213 - DNA, 22 bp, Artificial Sequence
  Synthetic oligonucleotide; CTG chr2 60527106 60527127 60527123 60527128 +
aagggtcaccggcctgcctctt

SEQ ID NO: 205214 - DNA, 22 bp, Artificial Sequence
  Synthetic oligonucleotide; CTG chr2 60527122 60527143 60527139 60527144 +
cctcttgggacatcaaatttgt

SEQ ID NO: 205215 - DNA, 22 bp, Artificial Sequence
  Synthetic oligonucleotide; CTC chr2 60527126 60527147 60527143 60527148 +
ttgggacatcaaatttgtgctt

SEQ ID NO: 205216 - DNA, 22 bp, Artificial Sequence
  Synthetic oligonucleotide; CTT chr2 60527128 60527149 60527145 60527150 +
gggacatcaaatttgtgcttac

SEQ ID NO: 205217 - DNA, 22 bp, Artificial Sequence
  Synthetic oligonucleotide; TTG chr2 60527129 60527150 60527146 60527151 +
ggacatcaaatttgtgcttacc

SEQ ID NO: 205218 - DNA, 22 bp, Artificial Sequence
  Synthetic oligonucleotide; TTT chr2 60527142 60527163 60527159 60527164 +
gtgcttacctaacgaaggcaga

SEQ ID NO: 205219 - DNA, 22 bp, Artificial Sequence
  Synthetic oligonucleotide; TTG chr2 60527143 60527164 60527160 60527165 +
tgcttacctaacgaaggcagaa

SEQ ID NO: 205220 - DNA, 22 bp, Artificial Sequence
  Synthetic oligonucleotide; CTT chr2 60527148 60527169 60527165 60527170 +
acctaacgaaggcagaaacaga

SEQ ID NO: 205221 - DNA, 22 bp, Artificial Sequence
  Synthetic oligonucleotide; TTA chr2 60527149 60527170 60527166 60527171 +
cctaacgaaggcagaaacagaa

SEQ ID NO: 205222 - DNA, 22 bp, Artificial Sequence
  Synthetic oligonucleotide; CTA chr2 60527153 60527174 60527170 60527175 +
acgaaggcagaaacagaaaaag

SEQ ID NO: 205223 - DNA, 22 bp, Artificial Sequence
  Synthetic oligonucleotide; CTG chr2 60527213 60527234 60527230 60527235 +
attttcactgattttcaaggga

SEQ ID NO: 205224 - DNA, 22 bp, Artificial Sequence
  Synthetic oligonucleotide; TTT chr2 60527217 60527238 60527234 60527239 +
tcactgattttcaagggaagag

SEQ ID NO: 205225 - DNA, 22 bp, Artificial Sequence
  Synthetic oligonucleotide; TTT chr2 60527218 60527239 60527235 60527240 +
cactgattttcaagggaagaga

SEQ ID NO: 205226 - DNA, 22 bp, Artificial Sequence
  Synthetic oligonucleotide; TTC chr2 60527219 60527240 60527236 60527241 +
actgattttcaagggaagagaa

SEQ ID NO: 205227 - DNA, 22 bp, Artificial Sequence
  Synthetic oligonucleotide; CTG chr2 60527223 60527244 60527240 60527245 +
attttcaagggaagagaaggaa

SEQ ID NO: 205228 - DNA, 22 bp, Artificial Sequence
  Synthetic oligonucleotide; TTT chr2 60527227 60527248 60527244 60527249 +
tcaagggaagagaaggaaaact

SEQ ID NO: 205229 - DNA, 22 bp, Artificial Sequence
  Synthetic oligonucleotide; TTT chr2 60527228 60527249 60527245 60527250 +
caagggaagagaaggaaaacta

SEQ ID NO: 205230 - DNA, 22 bp, Artificial Sequence
  Synthetic oligonucleotide; TTC chr2 60527229 60527250 60527246 60527251 +
aagggaagagaaggaaaactag

SEQ ID NO: 205231 - DNA, 22 bp, Artificial Sequence
  Synthetic oligonucleotide; CTA chr2 60527250 60527271 60527267 60527272 +
gggggtgcgagcgagggaaata

SEQ ID NO: 205232 - DNA, 22 bp, Artificial Sequence
  Synthetic oligonucleotide; TTC chr2 60527282 60527303 60527299 60527304 +
taaagccatgatacgcctttta

SEQ ID NO: 205233 - DNA, 22 bp, Artificial Sequence
  Synthetic oligonucleotide; CTA chr2 60527284 60527305 60527301 60527306 +
aagccatgatacgccttttatc

SEQ ID NO: 205234 - DNA, 22 bp, Artificial Sequence
  Synthetic oligonucleotide; CTT chr2 60527301 60527322 60527318 60527323 +
ttatcatttcagctttatcatt

SEQ ID NO: 205235 - DNA, 22 bp, Artificial Sequence
  Synthetic oligonucleotide; TTT chr2 60527302 60527323 60527319 60527324 +
tatcatttcagctttatcattt

SEQ ID NO: 205236 - DNA, 22 bp, Artificial Sequence
  Synthetic oligonucleotide; TTT chr2 60527303 60527324 60527320 60527325 +
atcatttcagctttatcatttc

SEQ ID NO: 205237 - DNA, 22 bp, Artificial Sequence
  Synthetic oligonucleotide; TTA chr2 60527304 60527325 60527321 60527326 +
tcatttcagctttatcatttca

SEQ ID NO: 205238 - DNA, 22 bp, Artificial Sequence
  Synthetic oligonucleotide; TTT chr2 60527310 60527331 60527327 60527332 +
cagctttatcatttcagtctag

SEQ ID NO: 205239 - DNA, 22 bp, Artificial Sequence
  Synthetic oligonucleotide; TTC chr2 60527311 60527332 60527328 60527333 +
agctttatcatttcagtctagg

SEQ ID NO: 205240 - DNA, 22 bp, Artificial Sequence
  Synthetic oligonucleotide; CTT chr2 60527316 60527337 60527333 60527338 +
tatcatttcagtctaggagacc

SEQ ID NO: 205241 - DNA, 22 bp, Artificial Sequence
  Synthetic oligonucleotide; TTT chr2 60527317 60527338 60527334 60527339 +
atcatttcagtctaggagaccc

SEQ ID NO: 205242 - DNA, 22 bp, Artificial Sequence
  Synthetic oligonucleotide; TTA chr2 60527318 60527339 60527335 60527340 +
tcatttcagtctaggagaccca

SEQ ID NO: 205243 - DNA, 22 bp, Artificial Sequence
  Synthetic oligonucleotide; TTT chr2 60527324 60527345 60527341 60527346 +
cagtctaggagacccagcaaat

SEQ ID NO: 205244 - DNA, 22 bp, Artificial Sequence
  Synthetic oligonucleotide; TTC chr2 60527325 60527346 60527342 60527347 +
agtctaggagacccagcaaata

SEQ ID NO: 205245 - DNA, 22 bp, Artificial Sequence
  Synthetic oligonucleotide; CTA chr2 60527331 60527352 60527348 60527353 +
ggagacccagcaaataaaacta

SEQ ID NO: 205246 - DNA, 22 bp, Artificial Sequence
  Synthetic oligonucleotide; CTA chr2 60527353 60527374 60527370 60527375 +
agagcttctcttccagggtgac

SEQ ID NO: 205247 - DNA, 22 bp, Artificial Sequence
  Synthetic oligonucleotide; CTT chr2 60527360 60527381 60527377 60527382 +
ctcttccagggtgacaagggag

SEQ ID NO: 205248 - DNA, 22 bp, Artificial Sequence
  Synthetic oligonucleotide; TTC chr2 60527361 60527382 60527378 60527383 +
tcttccagggtgacaagggaga

SEQ ID NO: 205249 - DNA, 22 bp, Artificial Sequence
  Synthetic oligonucleotide; CTC chr2 60527363 60527384 60527380 60527385 +
ttccagggtgacaagggagaac

SEQ ID NO: 205250 - DNA, 22 bp, Artificial Sequence
  Synthetic oligonucleotide; CTT chr2 60527365 60527386 60527382 60527387 +
ccagggtgacaagggagaacca

SEQ ID NO: 205251 - DNA, 22 bp, Artificial Sequence
  Synthetic oligonucleotide; TTC chr2 60527366 60527387 60527383 60527388 +
cagggtgacaagggagaaccac

SEQ ID NO: 205252 - DNA, 22 bp, Artificial Sequence
  Synthetic oligonucleotide; CTA chr2 60527390 60527411 60527407 60527412 +
cactcttgacccaagggtatgt

SEQ ID NO: 205253 - DNA, 22 bp, Artificial Sequence
  Synthetic oligonucleotide; CTC chr2 60527395 60527416 60527412 60527417 +
ttgacccaagggtatgtagaga

SEQ ID NO: 205254 - DNA, 22 bp, Artificial Sequence
  Synthetic oligonucleotide; CTT chr2 60527397 60527418 60527414 60527419 +
gacccaagggtatgtagagaca

SEQ ID NO: 205255 - DNA, 22 bp, Artificial Sequence
  Synthetic oligonucleotide; TTG chr2 60527398 60527419 60527415 60527420 +
acccaagggtatgtagagacaa

SEQ ID NO: 205256 - DNA, 22 bp, Artificial Sequence
  Synthetic oligonucleotide; CTT chr2 60527458 60527479 60527475 60527480 +
gcatgacctccattgaggacgt

SEQ ID NO: 205257 - DNA, 22 bp, Artificial Sequence
  Synthetic oligonucleotide; TTG chr2 60527459 60527480 60527476 60527481 +
catgacctccattgaggacgtc

SEQ ID NO: 205258 - DNA, 22 bp, Artificial Sequence
  Synthetic oligonucleotide; CTC chr2 60527468 60527489 60527485 60527490 +
cattgaggacgtccatgccccg

SEQ ID NO: 205259 - DNA, 22 bp, Artificial Sequence
  Synthetic oligonucleotide; TTG chr2 60527473 60527494 60527490 60527495 +
aggacgtccatgccccgggaca

SEQ ID NO: 205260 - DNA, 22 bp, Artificial Sequence
  Synthetic oligonucleotide; CTT chr2 60527519 60527540 60527536 60527541 +
tggagctcttgacccacatgga

SEQ ID NO: 205261 - DNA, 22 bp, Artificial Sequence
  Synthetic oligonucleotide; TTT chr2 60527520 60527541 60527537 60527542 +
ggagctcttgacccacatggat

SEQ ID NO: 205262 - DNA, 22 bp, Artificial Sequence
  Synthetic oligonucleotide; TTG chr2 60527521 60527542 60527538 60527543 +
gagctcttgacccacatggatt

SEQ ID NO: 205263 - DNA, 22 bp, Artificial Sequence
  Synthetic oligonucleotide; CTC chr2 60527527 60527548 60527544 60527549 +
ttgacccacatggattctcagc

SEQ ID NO: 205264 - DNA, 22 bp, Artificial Sequence
  Synthetic oligonucleotide; CTT chr2 60527529 60527550 60527546 60527551 +
gacccacatggattctcagcag

SEQ ID NO: 205265 - DNA, 22 bp, Artificial Sequence
  Synthetic oligonucleotide; TTG chr2 60527530 60527551 60527547 60527552 +
acccacatggattctcagcagc

SEQ ID NO: 205266 - DNA, 22 bp, Artificial Sequence
  Synthetic oligonucleotide; TTC chr2 60527544 60527565 60527561 60527566 +
tcagcagccacctccatcccac

SEQ ID NO: 205267 - DNA, 22 bp, Artificial Sequence
  Synthetic oligonucleotide; CTC chr2 60527546 60527567 60527563 60527568 +
agcagccacctccatcccacct

SEQ ID NO: 205268 - DNA, 22 bp, Artificial Sequence
  Synthetic oligonucleotide; CTC chr2 60527558 60527579 60527575 60527580 +
catcccacctcaaactcagaag

SEQ ID NO: 205269 - DNA, 22 bp, Artificial Sequence
  Synthetic oligonucleotide; CTC chr2 60527569 60527590 60527586 60527591 +
aaactcagaagacaacctggat

SEQ ID NO: 205270 - DNA, 22 bp, Artificial Sequence
  Synthetic oligonucleotide; CTC chr2 60527575 60527596 60527592 60527597 +
agaagacaacctggatgtgacc

SEQ ID NO: 205271 - DNA, 22 bp, Artificial Sequence
  Synthetic oligonucleotide; CTG chr2 60527588 60527609 60527605 60527610 +
gatgtgaccgacaacttctttg

SEQ ID NO: 205272 - DNA, 22 bp, Artificial Sequence
  Synthetic oligonucleotide; CTT chr2 60527605 60527626 60527622 60527627 +
ctttgtgatggatctgaacagc

SEQ ID NO: 205273 - DNA, 22 bp, Artificial Sequence
  Synthetic oligonucleotide; TTC chr2 60527606 60527627 60527623 60527628 +
tttgtgatggatctgaacagcc

SEQ ID NO: 205274 - DNA, 22 bp, Artificial Sequence
  Synthetic oligonucleotide; CTT chr2 60527608 60527629 60527625 60527630 +
tgtgatggatctgaacagcctc

SEQ ID NO: 205275 - DNA, 22 bp, Artificial Sequence
  Synthetic oligonucleotide; TTT chr2 60527609 60527630 60527626 60527631 +
gtgatggatctgaacagcctcc

SEQ ID NO: 205276 - DNA, 22 bp, Artificial Sequence
  Synthetic oligonucleotide; TTG chr2 60527610 60527631 60527627 60527632 +
tgatggatctgaacagcctccc

SEQ ID NO: 205277 - DNA, 22 bp, Artificial Sequence
  Synthetic oligonucleotide; CTG chr2 60527621 60527642 60527638 60527643 +
aacagcctcccttggttctagc

SEQ ID NO: 205278 - DNA, 22 bp, Artificial Sequence
  Synthetic oligonucleotide; CTC chr2 60527630 60527651 60527647 60527652 +
ccttggttctagcagaaggact

SEQ ID NO: 205279 - DNA, 22 bp, Artificial Sequence
  Synthetic oligonucleotide; CTT chr2 60527634 60527655 60527651 60527656 +
ggttctagcagaaggacttacc

SEQ ID NO: 205280 - DNA, 22 bp, Artificial Sequence
  Synthetic oligonucleotide; TTG chr2 60527635 60527656 60527652 60527657 +
gttctagcagaaggacttacca

SEQ ID NO: 205281 - DNA, 22 bp, Artificial Sequence
  Synthetic oligonucleotide; TTC chr2 60527639 60527660 60527656 60527661 +
tagcagaaggacttaccaagtg

SEQ ID NO: 205282 - DNA, 22 bp, Artificial Sequence
  Synthetic oligonucleotide; CTA chr2 60527641 60527662 60527658 60527663 +
gcagaaggacttaccaagtgag

SEQ ID NO: 205283 - DNA, 22 bp, Artificial Sequence
  Synthetic oligonucleotide; CTT chr2 60527653 60527674 60527670 60527675 +
accaagtgagcagagctcccat

SEQ ID NO: 205284 - DNA, 22 bp, Artificial Sequence
  Synthetic oligonucleotide; TTA chr2 60527654 60527675 60527671 60527676 +
ccaagtgagcagagctcccatc

SEQ ID NO: 205285 - DNA, 22 bp, Artificial Sequence
  Synthetic oligonucleotide; CTC chr2 60527671 60527692 60527688 60527693 +
ccatccgatactcgccagtgct

SEQ ID NO: 205286 - DNA, 22 bp, Artificial Sequence
  Synthetic oligonucleotide; CTC chr2 60527684 60527705 60527701 60527706 +
gccagtgctgaggccaactctt

SEQ ID NO: 205287 - DNA, 22 bp, Artificial Sequence
  Synthetic oligonucleotide; CTG chr2 60527694 60527715 60527711 60527716 +
aggccaactcttccactcctcc

SEQ ID NO: 205288 - DNA, 22 bp, Artificial Sequence
  Synthetic oligonucleotide; CTC chr2 60527704 60527725 60527721 60527726 +
ttccactcctcccacggggcct

SEQ ID NO: 205289 - DNA, 22 bp, Artificial Sequence
  Synthetic oligonucleotide; CTT chr2 60527706 60527727 60527723 60527728 +
ccactcctcccacggggcctcc

SEQ ID NO: 205290 - DNA, 22 bp, Artificial Sequence
  Synthetic oligonucleotide; TTC chr2 60527707 60527728 60527724 60527729 +
cactcctcccacggggcctccg

SEQ ID NO: 205291 - DNA, 22 bp, Artificial Sequence
  Synthetic oligonucleotide; CTC chr2 60527712 60527733 60527729 60527734 +
ctcccacggggcctccgcatga

SEQ ID NO: 205292 - DNA, 22 bp, Artificial Sequence
  Synthetic oligonucleotide; CTC chr2 60527715 60527736 60527732 60527737 +
ccacggggcctccgcatgaagt

SEQ ID NO: 205293 - DNA, 22 bp, Artificial Sequence
  Synthetic oligonucleotide; CTC chr2 60527727 60527748 60527744 60527749 +
cgcatgaagtaggcgcttctca

SEQ ID NO: 205294 - DNA, 22 bp, Artificial Sequence
  Synthetic oligonucleotide; CTT chr2 60527745 60527766 60527762 60527767 +
ctcaactaccaaatgattctga

SEQ ID NO: 205295 - DNA, 22 bp, Artificial Sequence
  Synthetic oligonucleotide; TTC chr2 60527746 60527767 60527763 60527768 +
tcaactaccaaatgattctgaa

SEQ ID NO: 205296 - DNA, 22 bp, Artificial Sequence
  Synthetic oligonucleotide; CTC chr2 60527748 60527769 60527765 60527770 +
aactaccaaatgattctgaaat

SEQ ID NO: 205297 - DNA, 22 bp, Artificial Sequence
  Synthetic oligonucleotide; CTA chr2 60527753 60527774 60527770 60527775 +
ccaaatgattctgaaattctct

SEQ ID NO: 205298 - DNA, 22 bp, Artificial Sequence
  Synthetic oligonucleotide; TTC chr2 60527764 60527785 60527781 60527786 +
tgaaattctctcagtggaggtc

SEQ ID NO: 205299 - DNA, 22 bp, Artificial Sequence
  Synthetic oligonucleotide; CTG chr2 60527766 60527787 60527783 60527788 +
aaattctctcagtggaggtcta

SEQ ID NO: 205300 - DNA, 22 bp, Artificial Sequence
  Synthetic oligonucleotide; TTC chr2 60527772 60527793 60527789 60527794 +
tctcagtggaggtctatgttag

SEQ ID NO: 205301 - DNA, 22 bp, Artificial Sequence
  Synthetic oligonucleotide; CTC chr2 60527774 60527795 60527791 60527796 +
tcagtggaggtctatgttagcc

SEQ ID NO: 205302 - DNA, 22 bp, Artificial Sequence
  Synthetic oligonucleotide; CTC chr2 60527776 60527797 60527793 60527798 +
agtggaggtctatgttagcctg

SEQ ID NO: 205303 - DNA, 22 bp, Artificial Sequence
  Synthetic oligonucleotide; CTA chr2 60527788 60527809 60527805 60527810 +
tgttagcctggccaatttgaaa

SEQ ID NO: 205304 - DNA, 22 bp, Artificial Sequence
  Synthetic oligonucleotide; TTA chr2 60527793 60527814 60527810 60527815 +
gcctggccaatttgaaaggatg

SEQ ID NO: 205305 - DNA, 22 bp, Artificial Sequence
  Synthetic oligonucleotide; CTG chr2 60527798 60527819 60527815 60527820 +
gccaatttgaaaggatggagaa

SEQ ID NO: 205306 - DNA, 22 bp, Artificial Sequence
  Synthetic oligonucleotide; TTT chr2 60527806 60527827 60527823 60527828 +
gaaaggatggagaatacaggaa

SEQ ID NO: 205307 - DNA, 22 bp, Artificial Sequence
  Synthetic oligonucleotide; TTG chr2 60527807 60527828 60527824 60527829 +
aaaggatggagaatacaggaaa

SEQ ID NO: 205308 - DNA, 22 bp, Artificial Sequence
  Synthetic oligonucleotide; TTT chr2 60527841 60527862 60527858 60527863 +
ggttttggaatacattgtgtaa

SEQ ID NO: 205309 - DNA, 22 bp, Artificial Sequence
  Synthetic oligonucleotide; TTG chr2 60527842 60527863 60527859 60527864 +
gttttggaatacattgtgtaat

SEQ ID NO: 205310 - DNA, 22 bp, Artificial Sequence
  Synthetic oligonucleotide; TTT chr2 60527846 60527867 60527863 60527868 +
tggaatacattgtgtaatccat

SEQ ID NO: 205311 - DNA, 22 bp, Artificial Sequence
  Synthetic oligonucleotide; TTT chr2 60527847 60527868 60527864 60527869 +
ggaatacattgtgtaatccatc

SEQ ID NO: 205312 - DNA, 22 bp, Artificial Sequence
  Synthetic oligonucleotide; TTG chr2 60527848 60527869 60527865 60527870 +
gaatacattgtgtaatccatct

SEQ ID NO: 205313 - DNA, 22 bp, Artificial Sequence
  Synthetic oligonucleotide; TTG chr2 60527858 60527879 60527875 60527880 +
tgtaatccatctgcaacgaacc

SEQ ID NO: 205314 - DNA, 22 bp, Artificial Sequence
  Synthetic oligonucleotide; CTG chr2 60527871 60527892 60527888 60527893 +
caacgaacctcaggtcttgctt

SEQ ID NO: 205315 - DNA, 22 bp, Artificial Sequence
  Synthetic oligonucleotide; CTC chr2 60527882 60527903 60527899 60527904 +
aggtcttgcttcagcaaatatt

SEQ ID NO: 205316 - DNA, 22 bp, Artificial Sequence
  Synthetic oligonucleotide; CTT chr2 60527889 60527910 60527906 60527911 +
gcttcagcaaatattaatagcg

SEQ ID NO: 205317 - DNA, 22 bp, Artificial Sequence
  Synthetic oligonucleotide; TTG chr2 60527890 60527911 60527907 60527912 +
cttcagcaaatattaatagcgt

SEQ ID NO: 205318 - DNA, 22 bp, Artificial Sequence
  Synthetic oligonucleotide; CTT chr2 60527893 60527914 60527910 60527915 +
cagcaaatattaatagcgtcag

SEQ ID NO: 205319 - DNA, 22 bp, Artificial Sequence
  Synthetic oligonucleotide; TTC chr2 60527894 60527915 60527911 60527916 +
agcaaatattaatagcgtcagg

SEQ ID NO: 205320 - DNA, 22 bp, Artificial Sequence
  Synthetic oligonucleotide; TTA chr2 60527905 60527926 60527922 60527927 +
atagcgtcagggcagcctgtgg

SEQ ID NO: 205321 - DNA, 22 bp, Artificial Sequence
  Synthetic oligonucleotide; CTG chr2 60527924 60527945 60527941 60527946 +
tggagtgactgggagaggccac

SEQ ID NO: 205322 - DNA, 22 bp, Artificial Sequence
  Synthetic oligonucleotide; CTG chr2 60527935 60527956 60527952 60527957 +
ggagaggccaccacgcagctga

SEQ ID NO: 205323 - DNA, 22 bp, Artificial Sequence
  Synthetic oligonucleotide; CTG chr2 60527956 60527977 60527973 60527978 +
aaaacttgcctctggggaagcc

SEQ ID NO: 205324 - DNA, 22 bp, Artificial Sequence
  Synthetic oligonucleotide; CTT chr2 60527963 60527984 60527980 60527985 +
gcctctggggaagccacatgcg

SEQ ID NO: 205325 - DNA, 22 bp, Artificial Sequence
  Synthetic oligonucleotide; TTG chr2 60527964 60527985 60527981 60527986 +
cctctggggaagccacatgcgg

SEQ ID NO: 205326 - DNA, 22 bp, Artificial Sequence
  Synthetic oligonucleotide; CTC chr2 60527968 60527989 60527985 60527990 +
tggggaagccacatgcggatca

SEQ ID NO: 205327 - DNA, 22 bp, Artificial Sequence
  Synthetic oligonucleotide; CTG chr2 60527970 60527991 60527987 60527992 +
gggaagccacatgcggatcata

SEQ ID NO: 205328 - DNA, 22 bp, Artificial Sequence
  Synthetic oligonucleotide; CTG chr2 60528000 60528021 60528017 60528022 +
ttgactgcagtttccattcaaa

SEQ ID NO: 205329 - DNA, 22 bp, Artificial Sequence
  Synthetic oligonucleotide; TTG chr2 60528003 60528024 60528020 60528025 +
actgcagtttccattcaaaact

SEQ ID NO: 205330 - DNA, 22 bp, Artificial Sequence
  Synthetic oligonucleotide; CTG chr2 60528007 60528028 60528024 60528029 +
cagtttccattcaaaacttccc

SEQ ID NO: 205331 - DNA, 22 bp, Artificial Sequence
  Synthetic oligonucleotide; TTT chr2 60528013 60528034 60528030 60528035 +
ccattcaaaacttccctcaagt

SEQ ID NO: 205332 - DNA, 22 bp, Artificial Sequence
  Synthetic oligonucleotide; TTC chr2 60528014 60528035 60528031 60528036 +
cattcaaaacttccctcaagtt

SEQ ID NO: 205333 - DNA, 22 bp, Artificial Sequence
  Synthetic oligonucleotide; TTC chr2 60528019 60528040 60528036 60528041 +
aaaacttccctcaagtttccag

SEQ ID NO: 205334 - DNA, 22 bp, Artificial Sequence
  Synthetic oligonucleotide; CTT chr2 60528026 60528047 60528043 60528048 +
ccctcaagtttccagcatgcct

SEQ ID NO: 205335 - DNA, 22 bp, Artificial Sequence
  Synthetic oligonucleotide; TTC chr2 60528027 60528048 60528044 60528049 +
cctcaagtttccagcatgcctt

SEQ ID NO: 205336 - DNA, 22 bp, Artificial Sequence
  Synthetic oligonucleotide; CTC chr2 60528031 60528052 60528048 60528053 +
aagtttccagcatgccttccgg

SEQ ID NO: 205337 - DNA, 22 bp, Artificial Sequence
  Synthetic oligonucleotide; TTT chr2 60528037 60528058 60528054 60528059 +
ccagcatgccttccggacttgc

SEQ ID NO: 205338 - DNA, 22 bp, Artificial Sequence
  Synthetic oligonucleotide; TTC chr2 60528038 60528059 60528055 60528060 +
cagcatgccttccggacttgcc

SEQ ID NO: 205339 - DNA, 22 bp, Artificial Sequence
  Synthetic oligonucleotide; CTT chr2 60528049 60528070 60528066 60528071 +
ccggacttgccttaccacagcc

SEQ ID NO: 205340 - DNA, 22 bp, Artificial Sequence
  Synthetic oligonucleotide; TTC chr2 60528050 60528071 60528067 60528072 +
cggacttgccttaccacagcct

SEQ ID NO: 205341 - DNA, 22 bp, Artificial Sequence
  Synthetic oligonucleotide; CTT chr2 60528057 60528078 60528074 60528079 +
gccttaccacagccttgttcag

SEQ ID NO: 205342 - DNA, 22 bp, Artificial Sequence
  Synthetic oligonucleotide; TTG chr2 60528058 60528079 60528075 60528080 +
ccttaccacagccttgttcagc

SEQ ID NO: 205343 - DNA, 22 bp, Artificial Sequence
  Synthetic oligonucleotide; CTT chr2 60528062 60528083 60528079 60528084 +
accacagccttgttcagccaga

SEQ ID NO: 205344 - DNA, 22 bp, Artificial Sequence
  Synthetic oligonucleotide; TTA chr2 60528063 60528084 60528080 60528085 +
ccacagccttgttcagccagaa

SEQ ID NO: 205345 - DNA, 22 bp, Artificial Sequence
  Synthetic oligonucleotide; CTT chr2 60528073 60528094 60528090 60528095 +
gttcagccagaaatgaaaacct

SEQ ID NO: 205346 - DNA, 22 bp, Artificial Sequence
  Synthetic oligonucleotide; TTG chr2 60528074 60528095 60528091 60528096 +
ttcagccagaaatgaaaacctc

SEQ ID NO: 205347 - DNA, 22 bp, Artificial Sequence
  Synthetic oligonucleotide; TTC chr2 60528077 60528098 60528094 60528099 +
agccagaaatgaaaacctcctc

SEQ ID NO: 205348 - DNA, 22 bp, Artificial Sequence
  Synthetic oligonucleotide; CTC chr2 60528096 60528117 60528113 60528118 +
ctcgaagcagattatgaccccc

SEQ ID NO: 205349 - DNA, 22 bp, Artificial Sequence
  Synthetic oligonucleotide; CTC chr2 60528099 60528120 60528116 60528121 +
gaagcagattatgaccccccag

SEQ ID NO: 205350 - DNA, 22 bp, Artificial Sequence
  Synthetic oligonucleotide; TTA chr2 60528110 60528131 60528127 60528132 +
tgaccccccagaacccatcgtc

SEQ ID NO: 205351 - DNA, 22 bp, Artificial Sequence
  Synthetic oligonucleotide; CTA chr2 60528135 60528156 60528152 60528157 +
agaaacaccactgccacgcaca

SEQ ID NO: 205352 - DNA, 22 bp, Artificial Sequence
  Synthetic oligonucleotide; CTG chr2 60528148 60528169 60528165 60528170 +
ccacgcacactcactcacactc

SEQ ID NO: 205353 - DNA, 22 bp, Artificial Sequence
  Synthetic oligonucleotide; CTC chr2 60528160 60528181 60528177 60528182 +
actcacactcagtctctccctc

SEQ ID NO: 205354 - DNA, 22 bp, Artificial Sequence
  Synthetic oligonucleotide; CTC chr2 60528164 60528185 60528181 60528186 +
acactcagtctctccctccctg

SEQ ID NO: 205355 - DNA, 22 bp, Artificial Sequence
  Synthetic oligonucleotide; CTC chr2 60528170 60528191 60528187 60528192 +
agtctctccctccctgtataat

SEQ ID NO: 205356 - DNA, 22 bp, Artificial Sequence
  Synthetic oligonucleotide; CTC chr2 60528176 60528197 60528193 60528198 +
tccctccctgtataattctgat

SEQ ID NO: 205357 - DNA, 22 bp, Artificial Sequence
  Synthetic oligonucleotide; CTC chr2 60528178 60528199 60528195 60528200 +
cctccctgtataattctgattc

SEQ ID NO: 205358 - DNA, 22 bp, Artificial Sequence
  Synthetic oligonucleotide; CTC chr2 60528182 60528203 60528199 60528204 +
cctgtataattctgattctccc

SEQ ID NO: 205359 - DNA, 22 bp, Artificial Sequence
  Synthetic oligonucleotide; CTG chr2 60528186 60528207 60528203 60528208 +
tataattctgattctccccagc

SEQ ID NO: 205360 - DNA, 22 bp, Artificial Sequence
  Synthetic oligonucleotide; TTC chr2 60528194 60528215 60528211 60528216 +
tgattctccccagcctttgaag

SEQ ID NO: 205361 - DNA, 22 bp, Artificial Sequence
  Synthetic oligonucleotide; CTG chr2 60528196 60528217 60528213 60528218 +
attctccccagcctttgaaggt

SEQ ID NO: 205362 - DNA, 22 bp, Artificial Sequence
  Synthetic oligonucleotide; TTC chr2 60528200 60528221 60528217 60528222 +
tccccagcctttgaaggtacga

SEQ ID NO: 205363 - DNA, 22 bp, Artificial Sequence
  Synthetic oligonucleotide; CTC chr2 60528202 60528223 60528219 60528224 +
cccagcctttgaaggtacgatc

SEQ ID NO: 205364 - DNA, 22 bp, Artificial Sequence
  Synthetic oligonucleotide; CTT chr2 60528211 60528232 60528228 60528233 +
tgaaggtacgatccgagaagta

SEQ ID NO: 205365 - DNA, 22 bp, Artificial Sequence
  Synthetic oligonucleotide; TTT chr2 60528212 60528233 60528229 60528234 +
gaaggtacgatccgagaagtaa

SEQ ID NO: 205366 - DNA, 22 bp, Artificial Sequence
  Synthetic oligonucleotide; TTG chr2 60528213 60528234 60528230 60528235 +
aaggtacgatccgagaagtaaa

SEQ ID NO: 205367 - DNA, 22 bp, Artificial Sequence
  Synthetic oligonucleotide; CTG chr2 60528261 60528282 60528278 60528283 +
ctgcaggccaagcctcaccact

SEQ ID NO: 205368 - DNA, 22 bp, Artificial Sequence
  Synthetic oligonucleotide; CTG chr2 60528264 60528285 60528281 60528286 +
caggccaagcctcaccacttct

SEQ ID NO: 205369 - DNA, 22 bp, Artificial Sequence
  Synthetic oligonucleotide; CTC chr2 60528277 60528298 60528294 60528299 +
accacttcttaaaagtccgagc

SEQ ID NO: 205370 - DNA, 22 bp, Artificial Sequence
  Synthetic oligonucleotide; CTT chr2 60528284 60528305 60528301 60528306 +
cttaaaagtccgagcttagttt

SEQ ID NO: 205371 - DNA, 22 bp, Artificial Sequence
  Synthetic oligonucleotide; TTC chr2 60528285 60528306 60528302 60528307 +
ttaaaagtccgagcttagtttc

SEQ ID NO: 205372 - DNA, 22 bp, Artificial Sequence
  Synthetic oligonucleotide; CTT chr2 60528287 60528308 60528304 60528309 +
aaaagtccgagcttagtttctc

SEQ ID NO: 205373 - DNA, 22 bp, Artificial Sequence
  Synthetic oligonucleotide; TTA chr2 60528288 60528309 60528305 60528310 +
aaagtccgagcttagtttctca

SEQ ID NO: 205374 - DNA, 22 bp, Artificial Sequence
  Synthetic oligonucleotide; CTT chr2 60528301 60528322 60528318 60528323 +
agtttctcattcagcccactgc

SEQ ID NO: 205375 - DNA, 22 bp, Artificial Sequence
  Synthetic oligonucleotide; TTA chr2 60528302 60528323 60528319 60528324 +
gtttctcattcagcccactgca

SEQ ID NO: 205376 - DNA, 22 bp, Artificial Sequence
  Synthetic oligonucleotide; TTT chr2 60528306 60528327 60528323 60528328 +
ctcattcagcccactgcagtct

SEQ ID NO: 205377 - DNA, 22 bp, Artificial Sequence
  Synthetic oligonucleotide; TTC chr2 60528307 60528328 60528324 60528329 +
tcattcagcccactgcagtctc

SEQ ID NO: 205378 - DNA, 22 bp, Artificial Sequence
  Synthetic oligonucleotide; CTC chr2 60528309 60528330 60528326 60528331 +
attcagcccactgcagtctcct

SEQ ID NO: 205379 - DNA, 22 bp, Artificial Sequence
  Synthetic oligonucleotide; TTC chr2 60528313 60528334 60528330 60528335 +
agcccactgcagtctcctgacc

SEQ ID NO: 205380 - DNA, 22 bp, Artificial Sequence
  Synthetic oligonucleotide; CTG chr2 60528322 60528343 60528339 60528344 +
cagtctcctgaccaagccacac

SEQ ID NO: 205381 - DNA, 22 bp, Artificial Sequence
  Synthetic oligonucleotide; CTC chr2 60528329 60528350 60528346 60528351 +
ctgaccaagccacacacaaaca

SEQ ID NO: 205382 - DNA, 22 bp, Artificial Sequence
  Synthetic oligonucleotide; CTG chr2 60528332 60528353 60528349 60528354 +
accaagccacacacaaacagta

SEQ ID NO: 205383 - DNA, 22 bp, Artificial Sequence
  Synthetic oligonucleotide; CTC chr2 60528361 60528382 60528378 60528383 +
ctccctctgtttctcaggaccc

SEQ ID NO: 205384 - DNA, 22 bp, Artificial Sequence
  Synthetic oligonucleotide; CTC chr2 60528364 60528385 60528381 60528386 +
cctctgtttctcaggaccctca

SEQ ID NO: 205385 - DNA, 22 bp, Artificial Sequence
  Synthetic oligonucleotide; CTC chr2 60528368 60528389 60528385 60528390 +
tgtttctcaggaccctcacttg

SEQ ID NO: 205386 - DNA, 22 bp, Artificial Sequence
  Synthetic oligonucleotide; CTG chr2 60528370 60528391 60528387 60528392 +
tttctcaggaccctcacttgat

SEQ ID NO: 205387 - DNA, 22 bp, Artificial Sequence
  Synthetic oligonucleotide; TTT chr2 60528373 60528394 60528390 60528395 +
ctcaggaccctcacttgatttc

SEQ ID NO: 205388 - DNA, 22 bp, Artificial Sequence
  Synthetic oligonucleotide; TTC chr2 60528374 60528395 60528391 60528396 +
tcaggaccctcacttgatttca

SEQ ID NO: 205389 - DNA, 22 bp, Artificial Sequence
  Synthetic oligonucleotide; CTC chr2 60528376 60528397 60528393 60528398 +
aggaccctcacttgatttcagg

SEQ ID NO: 205390 - DNA, 22 bp, Artificial Sequence
  Synthetic oligonucleotide; CTC chr2 60528385 60528406 60528402 60528407 +
acttgatttcaggctcattctg

SEQ ID NO: 205391 - DNA, 22 bp, Artificial Sequence
  Synthetic oligonucleotide; CTT chr2 60528389 60528410 60528406 60528411 +
gatttcaggctcattctggaca

SEQ ID NO: 205392 - DNA, 22 bp, Artificial Sequence
  Synthetic oligonucleotide; TTG chr2 60528390 60528411 60528407 60528412 +
atttcaggctcattctggacag

SEQ ID NO: 205393 - DNA, 22 bp, Artificial Sequence
  Synthetic oligonucleotide; TTT chr2 60528394 60528415 60528411 60528416 +
caggctcattctggacagatgg

SEQ ID NO: 205394 - DNA, 22 bp, Artificial Sequence
  Synthetic oligonucleotide; TTC chr2 60528395 60528416 60528412 60528417 +
aggctcattctggacagatggg

SEQ ID NO: 205395 - DNA, 22 bp, Artificial Sequence
  Synthetic oligonucleotide; CTC chr2 60528401 60528422 60528418 60528423 +
attctggacagatggggaaatg

SEQ ID NO: 205396 - DNA, 22 bp, Artificial Sequence
  Synthetic oligonucleotide; TTC chr2 60528405 60528426 60528422 60528427 +
tggacagatggggaaatgacta

SEQ ID NO: 205397 - DNA, 22 bp, Artificial Sequence
  Synthetic oligonucleotide; CTG chr2 60528407 60528428 60528424 60528429 +
gacagatggggaaatgactact

SEQ ID NO: 205398 - DNA, 22 bp, Artificial Sequence
  Synthetic oligonucleotide; CTA chr2 60528427 60528448 60528444 60528449 +
cttgcaaagcaggattccttac

SEQ ID NO: 205399 - DNA, 22 bp, Artificial Sequence
  Synthetic oligonucleotide; CTT chr2 60528430 60528451 60528447 60528452 +
gcaaagcaggattccttacatt

SEQ ID NO: 205400 - DNA, 22 bp, Artificial Sequence
  Synthetic oligonucleotide; TTG chr2 60528431 60528452 60528448 60528453 +
caaagcaggattccttacattg

SEQ ID NO: 205401 - DNA, 22 bp, Artificial Sequence
  Synthetic oligonucleotide; TTC chr2 60528444 60528465 60528461 60528466 +
cttacattgcaacttttcccaa

SEQ ID NO: 205402 - DNA, 22 bp, Artificial Sequence
  Synthetic oligonucleotide; CTT chr2 60528447 60528468 60528464 60528469 +
acattgcaacttttcccaacag

SEQ ID NO: 205403 - DNA, 22 bp, Artificial Sequence
  Synthetic oligonucleotide; TTA chr2 60528448 60528469 60528465 60528470 +
cattgcaacttttcccaacagc

SEQ ID NO: 205404 - DNA, 22 bp, Artificial Sequence
  Synthetic oligonucleotide; TTG chr2 60528453 60528474 60528470 60528475 +
caacttttcccaacagctccgt

SEQ ID NO: 205405 - DNA, 22 bp, Artificial Sequence
  Synthetic oligonucleotide; CTT chr2 60528459 60528480 60528476 60528481 +
ttcccaacagctccgtgctcct

SEQ ID NO: 205406 - DNA, 22 bp, Artificial Sequence
  Synthetic oligonucleotide; TTT chr2 60528460 60528481 60528477 60528482 +
tcccaacagctccgtgctcctt

SEQ ID NO: 205407 - DNA, 22 bp, Artificial Sequence
  Synthetic oligonucleotide; TTT chr2 60528461 60528482 60528478 60528483 +
cccaacagctccgtgctccttc

SEQ ID NO: 205408 - DNA, 22 bp, Artificial Sequence
  Synthetic oligonucleotide; TTC chr2 60528462 60528483 60528479 60528484 +
ccaacagctccgtgctccttca

SEQ ID NO: 205409 - DNA, 22 bp, Artificial Sequence
  Synthetic oligonucleotide; CTC chr2 60528472 60528493 60528489 60528494 +
cgtgctccttcaatatgcccag

SEQ ID NO: 205410 - DNA, 22 bp, Artificial Sequence
  Synthetic oligonucleotide; CTC chr2 60528479 60528500 60528496 60528501 +
cttcaatatgcccagaactgga

SEQ ID NO: 205411 - DNA, 22 bp, Artificial Sequence
  Synthetic oligonucleotide; CTT chr2 60528482 60528503 60528499 60528504 +
caatatgcccagaactggaggg

SEQ ID NO: 205412 - DNA, 22 bp, Artificial Sequence
  Synthetic oligonucleotide; TTC chr2 60528483 60528504 60528500 60528505 +
aatatgcccagaactggagggg

SEQ ID NO: 205413 - DNA, 22 bp, Artificial Sequence
  Synthetic oligonucleotide; CTG chr2 60528499 60528520 60528516 60528521 +
gaggggaacattcttctctttc

SEQ ID NO: 205414 - DNA, 22 bp, Artificial Sequence
  Synthetic oligonucleotide; TTC chr2 60528512 60528533 60528529 60528534 +
ttctctttcccagaagattgaa

SEQ ID NO: 205415 - DNA, 22 bp, Artificial Sequence
  Synthetic oligonucleotide; CTT chr2 60528514 60528535 60528531 60528536 +
ctctttcccagaagattgaaaa

SEQ ID NO: 205416 - DNA, 22 bp, Artificial Sequence
  Synthetic oligonucleotide; TTC chr2 60528515 60528536 60528532 60528537 +
tctttcccagaagattgaaaaa

SEQ ID NO: 205417 - DNA, 22 bp, Artificial Sequence
  Synthetic oligonucleotide; CTC chr2 60528517 60528538 60528534 60528539 +
tttcccagaagattgaaaaact

SEQ ID NO: 205418 - DNA, 22 bp, Artificial Sequence
  Synthetic oligonucleotide; CTT chr2 60528519 60528540 60528536 60528541 +
tcccagaagattgaaaaacttg

SEQ ID NO: 205419 - DNA, 22 bp, Artificial Sequence
  Synthetic oligonucleotide; TTT chr2 60528520 60528541 60528537 60528542 +
cccagaagattgaaaaacttga

SEQ ID NO: 205420 - DNA, 22 bp, Artificial Sequence
  Synthetic oligonucleotide; TTC chr2 60528521 60528542 60528538 60528543 +
ccagaagattgaaaaacttgac

SEQ ID NO: 205421 - DNA, 22 bp, Artificial Sequence
  Synthetic oligonucleotide; TTG chr2 60528532 60528553 60528549 60528554 +
aaaaacttgaccacagaaccca

SEQ ID NO: 205422 - DNA, 22 bp, Artificial Sequence
  Synthetic oligonucleotide; CTT chr2 60528540 60528561 60528557 60528562 +
gaccacagaacccatgggaggg

SEQ ID NO: 205423 - DNA, 22 bp, Artificial Sequence
  Synthetic oligonucleotide; TTG chr2 60528541 60528562 60528558 60528563 +
accacagaacccatgggaggga

SEQ ID NO: 205424 - DNA, 22 bp, Artificial Sequence
  Synthetic oligonucleotide; CTG chr2 60528569 60528590 60528586 60528591 +
tccagcaccagagcttcctgcc

SEQ ID NO: 205425 - DNA, 22 bp, Artificial Sequence
  Synthetic oligonucleotide; CTT chr2 60528585 60528606 60528602 60528607 +
cctgcccagttgttgcctggca

SEQ ID NO: 205426 - DNA, 22 bp, Artificial Sequence
  Synthetic oligonucleotide; TTC chr2 60528586 60528607 60528603 60528608 +
ctgcccagttgttgcctggcac

SEQ ID NO: 205427 - DNA, 22 bp, Artificial Sequence
  Synthetic oligonucleotide; CTG chr2 60528589 60528610 60528606 60528611 +
cccagttgttgcctggcaccgc

SEQ ID NO: 205428 - DNA, 22 bp, Artificial Sequence
  Synthetic oligonucleotide; TTG chr2 60528597 60528618 60528614 60528619 +
ttgcctggcaccgctgaagaaa

SEQ ID NO: 205429 - DNA, 22 bp, Artificial Sequence
  Synthetic oligonucleotide; TTG chr2 60528600 60528621 60528617 60528622 +
cctggcaccgctgaagaaagct

SEQ ID NO: 205430 - DNA, 22 bp, Artificial Sequence
  Synthetic oligonucleotide; CTG chr2 60528604 60528625 60528621 60528626 +
gcaccgctgaagaaagctgcaa

SEQ ID NO: 205431 - DNA, 22 bp, Artificial Sequence
  Synthetic oligonucleotide; CTG chr2 60528613 60528634 60528630 60528635 +
aagaaagctgcaaacgtactga

SEQ ID NO: 205432 - DNA, 22 bp, Artificial Sequence
  Synthetic oligonucleotide; CTG chr2 60528623 60528644 60528640 60528645 +
caaacgtactgaagaggtagca

SEQ ID NO: 205433 - DNA, 22 bp, Artificial Sequence
  Synthetic oligonucleotide; CTG chr2 60528634 60528655 60528651 60528656 +
aagaggtagcagagggtggcgg

SEQ ID NO: 205434 - DNA, 22 bp, Artificial Sequence
  Synthetic oligonucleotide; TTG chr2 60528674 60528695 60528691 60528696 +
aacaactgtggaccctcaggga

SEQ ID NO: 205435 - DNA, 22 bp, Artificial Sequence
  Synthetic oligonucleotide; CTG chr2 60528682 60528703 60528699 60528704 +
tggaccctcagggaagtcattt

SEQ ID NO: 205436 - DNA, 22 bp, Artificial Sequence
  Synthetic oligonucleotide; CTC chr2 60528691 60528712 60528708 60528713 +
agggaagtcatttaacccttga

SEQ ID NO: 205437 - DNA, 22 bp, Artificial Sequence
  Synthetic oligonucleotide; TTT chr2 60528704 60528725 60528721 60528726 +
aacccttgatgaaccccaattt

SEQ ID NO: 205438 - DNA, 22 bp, Artificial Sequence
  Synthetic oligonucleotide; TTA chr2 60528705 60528726 60528722 60528727 +
acccttgatgaaccccaatttc

SEQ ID NO: 205439 - DNA, 22 bp, Artificial Sequence
  Synthetic oligonucleotide; CTT chr2 60528711 60528732 60528728 60528733 +
gatgaaccccaatttcctcctc

SEQ ID NO: 205440 - DNA, 22 bp, Artificial Sequence
  Synthetic oligonucleotide; TTG chr2 60528712 60528733 60528729 60528734 +
atgaaccccaatttcctcctct

SEQ ID NO: 205441 - DNA, 22 bp, Artificial Sequence
  Synthetic oligonucleotide; TTT chr2 60528726 60528747 60528743 60528748 +
cctcctctaccaaatgaggcta

SEQ ID NO: 205442 - DNA, 22 bp, Artificial Sequence
  Synthetic oligonucleotide; TTC chr2 60528727 60528748 60528744 60528749 +
ctcctctaccaaatgaggctaa

SEQ ID NO: 205443 - DNA, 22 bp, Artificial Sequence
  Synthetic oligonucleotide; CTC chr2 60528730 60528751 60528747 60528752 +
ctctaccaaatgaggctaatgg

SEQ ID NO: 205444 - DNA, 22 bp, Artificial Sequence
  Synthetic oligonucleotide; CTC chr2 60528733 60528754 60528750 60528755 +
taccaaatgaggctaatgggag

SEQ ID NO: 205445 - DNA, 22 bp, Artificial Sequence
  Synthetic oligonucleotide; CTA chr2 60528735 60528756 60528752 60528757 +
ccaaatgaggctaatgggagtg

SEQ ID NO: 205446 - DNA, 22 bp, Artificial Sequence
  Synthetic oligonucleotide; CTA chr2 60528748 60528769 60528765 60528770 +
atgggagtgtttcctttccgag

SEQ ID NO: 205447 - DNA, 22 bp, Artificial Sequence
  Synthetic oligonucleotide; TTT chr2 60528760 60528781 60528777 60528782 +
cctttccgaggttgttgtggga

SEQ ID NO: 205448 - DNA, 22 bp, Artificial Sequence
  Synthetic oligonucleotide; TTC chr2 60528761 60528782 60528778 60528783 +
ctttccgaggttgttgtgggat

SEQ ID NO: 205449 - DNA, 22 bp, Artificial Sequence
  Synthetic oligonucleotide; CTT chr2 60528764 60528785 60528781 60528786 +
tccgaggttgttgtgggatgga

SEQ ID NO: 205450 - DNA, 22 bp, Artificial Sequence
  Synthetic oligonucleotide; TTT chr2 60528765 60528786 60528782 60528787 +
ccgaggttgttgtgggatggaa

SEQ ID NO: 205451 - DNA, 22 bp, Artificial Sequence
  Synthetic oligonucleotide; TTC chr2 60528766 60528787 60528783 60528788 +
cgaggttgttgtgggatggaat

SEQ ID NO: 205452 - DNA, 22 bp, Artificial Sequence
  Synthetic oligonucleotide; TTG chr2 60528774 60528795 60528791 60528796 +
ttgtgggatggaatatcaatgt

SEQ ID NO: 205453 - DNA, 22 bp, Artificial Sequence
  Synthetic oligonucleotide; TTG chr2 60528777 60528798 60528794 60528799 +
tgggatggaatatcaatgtgtc

SEQ ID NO: 205454 - DNA, 22 bp, Artificial Sequence
  Synthetic oligonucleotide; TTC chr2 60528830 60528851 60528847 60528852 +
tggaggtgcagcccccggagcg

SEQ ID NO: 205455 - DNA, 22 bp, Artificial Sequence
  Synthetic oligonucleotide; CTG chr2 60528832 60528853 60528849 60528854 +
gaggtgcagcccccggagcgag

SEQ ID NO: 205456 - DNA, 22 bp, Artificial Sequence
  Synthetic oligonucleotide; CTG chr2 60528863 60528884 60528880 60528885 +
tgctttccctcatttacttctc

SEQ ID NO: 205457 - DNA, 22 bp, Artificial Sequence
  Synthetic oligonucleotide; CTT chr2 60528868 60528889 60528885 60528890 +
tccctcatttacttctcacatg

SEQ ID NO: 205458 - DNA, 22 bp, Artificial Sequence
  Synthetic oligonucleotide; TTT chr2 60528869 60528890 60528886 60528891 +
ccctcatttacttctcacatgg

SEQ ID NO: 205459 - DNA, 22 bp, Artificial Sequence
  Synthetic oligonucleotide; TTC chr2 60528870 60528891 60528887 60528892 +
cctcatttacttctcacatgga

SEQ ID NO: 205460 - DNA, 22 bp, Artificial Sequence
  Synthetic oligonucleotide; CTC chr2 60528874 60528895 60528891 60528896 +
atttacttctcacatggactct

SEQ ID NO: 205461 - DNA, 22 bp, Artificial Sequence
  Synthetic oligonucleotide; TTT chr2 60528878 60528899 60528895 60528900 +
acttctcacatggactctatga

SEQ ID NO: 205462 - DNA, 22 bp, Artificial Sequence
  Synthetic oligonucleotide; TTA chr2 60528879 60528900 60528896 60528901 +
cttctcacatggactctatgag

SEQ ID NO: 205463 - DNA, 22 bp, Artificial Sequence
  Synthetic oligonucleotide; CTT chr2 60528882 60528903 60528899 60528904 +
ctcacatggactctatgaggta

SEQ ID NO: 205464 - DNA, 22 bp, Artificial Sequence
  Synthetic oligonucleotide; TTC chr2 60528883 60528904 60528900 60528905 +
tcacatggactctatgaggtaa

SEQ ID NO: 205465 - DNA, 22 bp, Artificial Sequence
  Synthetic oligonucleotide; CTC chr2 60528885 60528906 60528902 60528907 +
acatggactctatgaggtaagg

SEQ ID NO: 205466 - DNA, 22 bp, Artificial Sequence
  Synthetic oligonucleotide; CTC chr2 60528895 60528916 60528912 60528917 +
tatgaggtaagggaccttgagt

SEQ ID NO: 205467 - DNA, 22 bp, Artificial Sequence
  Synthetic oligonucleotide; CTA chr2 60528897 60528918 60528914 60528919 +
tgaggtaagggaccttgagtta

SEQ ID NO: 205468 - DNA, 22 bp, Artificial Sequence
  Synthetic oligonucleotide; CTT chr2 60528913 60528934 60528930 60528935 +
gagttatctccatttcacagag

SEQ ID NO: 205469 - DNA, 22 bp, Artificial Sequence
  Synthetic oligonucleotide; TTG chr2 60528914 60528935 60528931 60528936 +
agttatctccatttcacagaga

SEQ ID NO: 205470 - DNA, 22 bp, Artificial Sequence
  Synthetic oligonucleotide; TTA chr2 60528919 60528940 60528936 60528941 +
tctccatttcacagagaggtga

SEQ ID NO: 205471 - DNA, 22 bp, Artificial Sequence
  Synthetic oligonucleotide; CTC chr2 60528923 60528944 60528940 60528945 +
catttcacagagaggtgaaatg

SEQ ID NO: 205472 - DNA, 22 bp, Artificial Sequence
  Synthetic oligonucleotide; TTT chr2 60528928 60528949 60528945 60528950 +
cacagagaggtgaaatgattcc

SEQ ID NO: 205473 - DNA, 22 bp, Artificial Sequence
  Synthetic oligonucleotide; TTC chr2 60528929 60528950 60528946 60528951 +
acagagaggtgaaatgattccc

SEQ ID NO: 205474 - DNA, 22 bp, Artificial Sequence
  Synthetic oligonucleotide; TTC chr2 60528949 60528970 60528966 60528971 +
cctcagactctcccaaccagct

SEQ ID NO: 205475 - DNA, 22 bp, Artificial Sequence
  Synthetic oligonucleotide; CTC chr2 60528953 60528974 60528970 60528975 +
agactctcccaaccagctagca

SEQ ID NO: 205476 - DNA, 22 bp, Artificial Sequence
  Synthetic oligonucleotide; CTC chr2 60528959 60528980 60528976 60528981 +
tcccaaccagctagcagtaaca

SEQ ID NO: 205477 - DNA, 22 bp, Artificial Sequence
  Synthetic oligonucleotide; CTC chr2 60528961 60528982 60528978 60528983 +
ccaaccagctagcagtaacata

SEQ ID NO: 205478 - DNA, 22 bp, Artificial Sequence
  Synthetic oligonucleotide; CTA chr2 60528972 60528993 60528989 60528994 +
gcagtaacatagaaatctgaac

SEQ ID NO: 205479 - DNA, 22 bp, Artificial Sequence
  Synthetic oligonucleotide; CTG chr2 60528991 60529012 60529008 60529013 +
aacccagagtaactgtgtcaca

SEQ ID NO: 205480 - DNA, 22 bp, Artificial Sequence
  Synthetic oligonucleotide; CTG chr2 60529006 60529027 60529023 60529028 +
tgtcacacacccaggcaggcac

SEQ ID NO: 205481 - DNA, 22 bp, Artificial Sequence
  Synthetic oligonucleotide; CTC chr2 60529035 60529056 60529052 60529057 +
tcgtaaggcaacacacgtctat

SEQ ID NO: 205482 - DNA, 22 bp, Artificial Sequence
  Synthetic oligonucleotide; CTC chr2 60529037 60529058 60529054 60529059 +
gtaaggcaacacacgtctatgg

SEQ ID NO: 205483 - DNA, 22 bp, Artificial Sequence
  Synthetic oligonucleotide; CTA chr2 60529056 60529077 60529073 60529078 +
tggggagaggggactcccaccc

SEQ ID NO: 205484 - DNA, 22 bp, Artificial Sequence
  Synthetic oligonucleotide; CTC chr2 60529072 60529093 60529089 60529094 +
ccacccacgagggagctgccac

SEQ ID NO: 205485 - DNA, 22 bp, Artificial Sequence
  Synthetic oligonucleotide; CTG chr2 60529090 60529111 60529107 60529112 +
ccaccagaaacataatgagacc

SEQ ID NO: 205486 - DNA, 22 bp, Artificial Sequence
  Synthetic oligonucleotide; CTG chr2 60529115 60529136 60529132 60529137 +
agctctttagacccccacctgc

SEQ ID NO: 205487 - DNA, 22 bp, Artificial Sequence
  Synthetic oligonucleotide; CTC chr2 60529120 60529141 60529137 60529142 +
tttagacccccacctgccctgc

SEQ ID NO: 205488 - DNA, 22 bp, Artificial Sequence
  Synthetic oligonucleotide; CTT chr2 60529122 60529143 60529139 60529144 +
tagacccccacctgccctgctc

SEQ ID NO: 205489 - DNA, 22 bp, Artificial Sequence
  Synthetic oligonucleotide; TTT chr2 60529123 60529144 60529140 60529145 +
agacccccacctgccctgctct

SEQ ID NO: 205490 - DNA, 22 bp, Artificial Sequence
  Synthetic oligonucleotide; TTA chr2 60529124 60529145 60529141 60529146 +
gacccccacctgccctgctctt

SEQ ID NO: 205491 - DNA, 22 bp, Artificial Sequence
  Synthetic oligonucleotide; CTG chr2 60529136 60529157 60529153 60529158 +
ccctgctcttctctcatcccaa

SEQ ID NO: 205492 - DNA, 22 bp, Artificial Sequence
  Synthetic oligonucleotide; CTG chr2 60529141 60529162 60529158 60529163 +
ctcttctctcatcccaacctgc

SEQ ID NO: 205493 - DNA, 22 bp, Artificial Sequence
  Synthetic oligonucleotide; CTC chr2 60529144 60529165 60529161 60529166 +
ttctctcatcccaacctgctca

SEQ ID NO: 205494 - DNA, 22 bp, Artificial Sequence
  Synthetic oligonucleotide; CTT chr2 60529146 60529167 60529163 60529168 +
ctctcatcccaacctgctcacc

SEQ ID NO: 205495 - DNA, 22 bp, Artificial Sequence
  Synthetic oligonucleotide; TTC chr2 60529147 60529168 60529164 60529169 +
tctcatcccaacctgctcaccc

SEQ ID NO: 205496 - DNA, 22 bp, Artificial Sequence
  Synthetic oligonucleotide; CTC chr2 60529149 60529170 60529166 60529171 +
tcatcccaacctgctcacccca

SEQ ID NO: 205497 - DNA, 22 bp, Artificial Sequence
  Synthetic oligonucleotide; CTC chr2 60529151 60529172 60529168 60529173 +
atcccaacctgctcaccccata

SEQ ID NO: 205498 - DNA, 22 bp, Artificial Sequence
  Synthetic oligonucleotide; CTG chr2 60529162 60529183 60529179 60529184 +
ctcaccccataatgggggaact

SEQ ID NO: 205499 - DNA, 22 bp, Artificial Sequence
  Synthetic oligonucleotide; CTC chr2 60529165 60529186 60529182 60529187 +
accccataatgggggaactact

SEQ ID NO: 205500 - DNA, 22 bp, Artificial Sequence
  Synthetic oligonucleotide; CTA chr2 60529185 60529206 60529202 60529207 +
ctttgagaccccaggagcacac

SEQ ID NO: 205501 - DNA, 22 bp, Artificial Sequence
  Synthetic oligonucleotide; CTT chr2 60529188 60529209 60529205 60529210 +
tgagaccccaggagcacacagt

SEQ ID NO: 205502 - DNA, 22 bp, Artificial Sequence
  Synthetic oligonucleotide; TTT chr2 60529189 60529210 60529206 60529211 +
gagaccccaggagcacacagtt

SEQ ID NO: 205503 - DNA, 22 bp, Artificial Sequence
  Synthetic oligonucleotide; TTG chr2 60529190 60529211 60529207 60529212 +
agaccccaggagcacacagttc

SEQ ID NO: 205504 - DNA, 22 bp, Artificial Sequence
  Synthetic oligonucleotide; TTC chr2 60529212 60529233 60529229 60529234 +
caagccatgagtcataaccgta

SEQ ID NO: 205505 - DNA, 22 bp, Artificial Sequence
  Synthetic oligonucleotide; CTT chr2 60529248 60529269 60529265 60529270 +
ttgtgacatgttttaccatgtg

SEQ ID NO: 205506 - DNA, 22 bp, Artificial Sequence
  Synthetic oligonucleotide; TTT chr2 60529249 60529270 60529266 60529271 +
tgtgacatgttttaccatgtgc

SEQ ID NO: 205507 - DNA, 22 bp, Artificial Sequence
  Synthetic oligonucleotide; TTT chr2 60529250 60529271 60529267 60529272 +
gtgacatgttttaccatgtgcc

SEQ ID NO: 205508 - DNA, 22 bp, Artificial Sequence
  Synthetic oligonucleotide; TTG chr2 60529251 60529272 60529268 60529273 +
tgacatgttttaccatgtgccc

SEQ ID NO: 205509 - DNA, 22 bp, Artificial Sequence
  Synthetic oligonucleotide; TTT chr2 60529261 60529282 60529278 60529283 +
taccatgtgcccagcactgagc

SEQ ID NO: 205510 - DNA, 22 bp, Artificial Sequence
  Synthetic oligonucleotide; TTT chr2 60529262 60529283 60529279 60529284 +
accatgtgcccagcactgagcc

SEQ ID NO: 205511 - DNA, 22 bp, Artificial Sequence
  Synthetic oligonucleotide; TTA chr2 60529263 60529284 60529280 60529285 +
ccatgtgcccagcactgagccc

SEQ ID NO: 205512 - DNA, 22 bp, Artificial Sequence
  Synthetic oligonucleotide; CTG chr2 60529280 60529301 60529297 60529302 +
agcccagcgcccccacatgctc

SEQ ID NO: 205513 - DNA, 22 bp, Artificial Sequence
  Synthetic oligonucleotide; CTC chr2 60529302 60529323 60529319 60529324 +
tcataggatgctcaaaggccct

SEQ ID NO: 205514 - DNA, 22 bp, Artificial Sequence
  Synthetic oligonucleotide; CTC chr2 60529304 60529325 60529321 60529326 +
ataggatgctcaaaggccctat

SEQ ID NO: 205515 - DNA, 22 bp, Artificial Sequence
  Synthetic oligonucleotide; CTC chr2 60529315 60529336 60529332 60529337 +
aaaggccctatgaggcaagccc

SEQ ID NO: 205516 - DNA, 22 bp, Artificial Sequence
  Synthetic oligonucleotide; CTA chr2 60529325 60529346 60529342 60529347 +
tgaggcaagccccgtgattctc

SEQ ID NO: 205517 - DNA, 22 bp, Artificial Sequence
  Synthetic oligonucleotide; TTC chr2 60529345 60529366 60529362 60529367 +
tccccactttacagattgagga

SEQ ID NO: 205518 - DNA, 22 bp, Artificial Sequence
  Synthetic oligonucleotide; CTC chr2 60529347 60529368 60529364 60529369 +
cccactttacagattgaggaag

SEQ ID NO: 205519 - DNA, 22 bp, Artificial Sequence
  Synthetic oligonucleotide; CTT chr2 60529354 60529375 60529371 60529376 +
tacagattgaggaagcggaggc

SEQ ID NO: 205520 - DNA, 22 bp, Artificial Sequence
  Synthetic oligonucleotide; TTT chr2 60529355 60529376 60529372 60529377 +
acagattgaggaagcggaggct

SEQ ID NO: 205521 - DNA, 22 bp, Artificial Sequence
  Synthetic oligonucleotide; TTA chr2 60529356 60529377 60529373 60529378 +
cagattgaggaagcggaggctt

SEQ ID NO: 205522 - DNA, 22 bp, Artificial Sequence
  Synthetic oligonucleotide; TTG chr2 60529363 60529384 60529380 60529385 +
aggaagcggaggcttagggaat

SEQ ID NO: 205523 - DNA, 22 bp, Artificial Sequence
  Synthetic oligonucleotide; CTT chr2 60529378 60529399 60529395 60529400 +
agggaatgaaatctgcccaagg

SEQ ID NO: 205524 - DNA, 22 bp, Artificial Sequence
  Synthetic oligonucleotide; TTA chr2 60529379 60529400 60529396 60529401 +
gggaatgaaatctgcccaaggt

SEQ ID NO: 205525 - DNA, 22 bp, Artificial Sequence
  Synthetic oligonucleotide; CTG chr2 60529393 60529414 60529410 60529415 +
cccaaggttgcacaactagaaa

SEQ ID NO: 205526 - DNA, 22 bp, Artificial Sequence
  Synthetic oligonucleotide; TTG chr2 60529403 60529424 60529420 60529425 +
cacaactagaaatggtattact

SEQ ID NO: 205527 - DNA, 22 bp, Artificial Sequence
  Synthetic oligonucleotide; CTA chr2 60529411 60529432 60529428 60529433 +
gaaatggtattacttctttacc

SEQ ID NO: 205528 - DNA, 22 bp, Artificial Sequence
  Synthetic oligonucleotide; TTA chr2 60529423 60529444 60529440 60529445 +
cttctttaccctcagcctaaac

SEQ ID NO: 205529 - DNA, 22 bp, Artificial Sequence
  Synthetic oligonucleotide; CTT chr2 60529426 60529447 60529443 60529448 +
ctttaccctcagcctaaaccat

SEQ ID NO: 205530 - DNA, 22 bp, Artificial Sequence
  Synthetic oligonucleotide; TTC chr2 60529427 60529448 60529444 60529449 +
tttaccctcagcctaaaccatt

SEQ ID NO: 205531 - DNA, 22 bp, Artificial Sequence
  Synthetic oligonucleotide; CTT chr2 60529429 60529450 60529446 60529451 +
taccctcagcctaaaccatttt

SEQ ID NO: 205532 - DNA, 22 bp, Artificial Sequence
  Synthetic oligonucleotide; TTT chr2 60529430 60529451 60529447 60529452 +
accctcagcctaaaccatttta

SEQ ID NO: 205533 - DNA, 22 bp, Artificial Sequence
  Synthetic oligonucleotide; TTA chr2 60529431 60529452 60529448 60529453 +
ccctcagcctaaaccattttat

SEQ ID NO: 205534 - DNA, 22 bp, Artificial Sequence
  Synthetic oligonucleotide; CTC chr2 60529436 60529457 60529453 60529458 +
agcctaaaccattttatttcgt

SEQ ID NO: 205535 - DNA, 22 bp, Artificial Sequence
  Synthetic oligonucleotide; CTA chr2 60529442 60529463 60529459 60529464 +
aaccattttatttcgtgtaatc

SEQ ID NO: 205536 - DNA, 22 bp, Artificial Sequence
  Synthetic oligonucleotide; TTT chr2 60529450 60529471 60529467 60529472 +
tatttcgtgtaatcaaagagaa

SEQ ID NO: 205537 - DNA, 22 bp, Artificial Sequence
  Synthetic oligonucleotide; TTT chr2 60529451 60529472 60529468 60529473 +
atttcgtgtaatcaaagagaag

SEQ ID NO: 205538 - DNA, 22 bp, Artificial Sequence
  Synthetic oligonucleotide; TTA chr2 60529452 60529473 60529469 60529474 +
tttcgtgtaatcaaagagaaga

SEQ ID NO: 205539 - DNA, 22 bp, Artificial Sequence
  Synthetic oligonucleotide; TTT chr2 60529455 60529476 60529472 60529477 +
cgtgtaatcaaagagaagaaga

SEQ ID NO: 205540 - DNA, 22 bp, Artificial Sequence
  Synthetic oligonucleotide; TTC chr2 60529456 60529477 60529473 60529478 +
gtgtaatcaaagagaagaagaa

SEQ ID NO: 205541 - DNA, 22 bp, Artificial Sequence
  Synthetic oligonucleotide; TTT chr2 60529514 60529535 60529531 60529536 +
cccctctttctgtccctcctcc

SEQ ID NO: 205542 - DNA, 22 bp, Artificial Sequence
  Synthetic oligonucleotide; TTC chr2 60529515 60529536 60529532 60529537 +
ccctctttctgtccctcctccc

SEQ ID NO: 205543 - DNA, 22 bp, Artificial Sequence
  Synthetic oligonucleotide; CTC chr2 60529520 60529541 60529537 60529542 +
tttctgtccctcctccctttct

SEQ ID NO: 205544 - DNA, 22 bp, Artificial Sequence
  Synthetic oligonucleotide; CTT chr2 60529522 60529543 60529539 60529544 +
tctgtccctcctccctttctta

SEQ ID NO: 205545 - DNA, 22 bp, Artificial Sequence
  Synthetic oligonucleotide; TTT chr2 60529523 60529544 60529540 60529545 +
ctgtccctcctccctttcttac

SEQ ID NO: 205546 - DNA, 22 bp, Artificial Sequence
  Synthetic oligonucleotide; TTC chr2 60529524 60529545 60529541 60529546 +
tgtccctcctccctttcttacc

SEQ ID NO: 205547 - DNA, 22 bp, Artificial Sequence
  Synthetic oligonucleotide; CTG chr2 60529526 60529547 60529543 60529548 +
tccctcctccctttcttaccag

SEQ ID NO: 205548 - DNA, 22 bp, Artificial Sequence
  Synthetic oligonucleotide; CTC chr2 60529532 60529553 60529549 60529554 +
ctccctttcttaccagctcagg

SEQ ID NO: 205549 - DNA, 22 bp, Artificial Sequence
  Synthetic oligonucleotide; CTC chr2 60529535 60529556 60529552 60529557 +
cctttcttaccagctcaggtta

SEQ ID NO: 205550 - DNA, 22 bp, Artificial Sequence
  Synthetic oligonucleotide; CTT chr2 60529539 60529560 60529556 60529561 +
tcttaccagctcaggttacaaa

SEQ ID NO: 205551 - DNA, 22 bp, Artificial Sequence
  Synthetic oligonucleotide; TTT chr2 60529540 60529561 60529557 60529562 +
cttaccagctcaggttacaaag

SEQ ID NO: 205552 - DNA, 22 bp, Artificial Sequence
  Synthetic oligonucleotide; TTC chr2 60529541 60529562 60529558 60529563 +
ttaccagctcaggttacaaaga

SEQ ID NO: 205553 - DNA, 22 bp, Artificial Sequence
  Synthetic oligonucleotide; CTT chr2 60529543 60529564 60529560 60529565 +
accagctcaggttacaaagaca

SEQ ID NO: 205554 - DNA, 22 bp, Artificial Sequence
  Synthetic oligonucleotide; TTA chr2 60529544 60529565 60529561 60529566 +
ccagctcaggttacaaagacat

SEQ ID NO: 205555 - DNA, 22 bp, Artificial Sequence
  Synthetic oligonucleotide; CTC chr2 60529551 60529572 60529568 60529573 +
aggttacaaagacatctaggtg

SEQ ID NO: 205556 - DNA, 22 bp, Artificial Sequence
  Synthetic oligonucleotide; TTA chr2 60529557 60529578 60529574 60529579 +
caaagacatctaggtgggagag

SEQ ID NO: 205557 - DNA, 22 bp, Artificial Sequence
  Synthetic oligonucleotide; CTA chr2 60529569 60529590 60529586 60529591 +
ggtgggagagaagactgcctct

SEQ ID NO: 205558 - DNA, 22 bp, Artificial Sequence
  Synthetic oligonucleotide; CTG chr2 60529586 60529607 60529603 60529608 +
cctctaagggcttggctgagtt

SEQ ID NO: 205559 - DNA, 22 bp, Artificial Sequence
  Synthetic oligonucleotide; CTC chr2 60529590 60529611 60529607 60529612 +
taagggcttggctgagttggcg

SEQ ID NO: 205560 - DNA, 22 bp, Artificial Sequence
  Synthetic oligonucleotide; CTA chr2 60529592 60529613 60529609 60529614 +
agggcttggctgagttggcggg

SEQ ID NO: 205561 - DNA, 22 bp, Artificial Sequence
  Synthetic oligonucleotide; CTT chr2 60529599 60529620 60529616 60529621 +
ggctgagttggcgggcgggagc

SEQ ID NO: 205562 - DNA, 22 bp, Artificial Sequence
  Synthetic oligonucleotide; TTG chr2 60529600 60529621 60529617 60529622 +
gctgagttggcgggcgggagcg

SEQ ID NO: 205563 - DNA, 22 bp, Artificial Sequence
  Synthetic oligonucleotide; CTG chr2 60529604 60529625 60529621 60529626 +
agttggcgggcgggagcggggg

SEQ ID NO: 205564 - DNA, 22 bp, Artificial Sequence
  Synthetic oligonucleotide; TTG chr2 60529609 60529630 60529626 60529631 +
gcgggcgggagcgggggcaggt

SEQ ID NO: 205565 - DNA, 22 bp, Artificial Sequence
  Synthetic oligonucleotide; TTT chr2 60529664 60529685 60529681 60529686 +
tcccagtttttatttgctacta

SEQ ID NO: 205566 - DNA, 22 bp, Artificial Sequence
  Synthetic oligonucleotide; TTT chr2 60529665 60529686 60529682 60529687 +
cccagtttttatttgctactag

SEQ ID NO: 205567 - DNA, 22 bp, Artificial Sequence
  Synthetic oligonucleotide; TTC chr2 60529666 60529687 60529683 60529688 +
ccagtttttatttgctactaga

SEQ ID NO: 205568 - DNA, 22 bp, Artificial Sequence
  Synthetic oligonucleotide; TTT chr2 60529673 60529694 60529690 60529695 +
ttatttgctactagaaaaggag

SEQ ID NO: 205569 - DNA, 22 bp, Artificial Sequence
  Synthetic oligonucleotide; TTT chr2 60529674 60529695 60529691 60529696 +
tatttgctactagaaaaggaga

SEQ ID NO: 205570 - DNA, 22 bp, Artificial Sequence
  Synthetic oligonucleotide; TTT chr2 60529675 60529696 60529692 60529697 +
atttgctactagaaaaggagaa

SEQ ID NO: 205571 - DNA, 22 bp, Artificial Sequence
  Synthetic oligonucleotide; TTA chr2 60529676 60529697 60529693 60529698 +
tttgctactagaaaaggagaag

SEQ ID NO: 205572 - DNA, 22 bp, Artificial Sequence
  Synthetic oligonucleotide; TTT chr2 60529679 60529700 60529696 60529701 +
gctactagaaaaggagaaggaa

SEQ ID NO: 205573 - DNA, 22 bp, Artificial Sequence
  Synthetic oligonucleotide; TTG chr2 60529680 60529701 60529697 60529702 +
ctactagaaaaggagaaggaaa

SEQ ID NO: 205574 - DNA, 22 bp, Artificial Sequence
  Synthetic oligonucleotide; CTA chr2 60529683 60529704 60529700 60529705 +
ctagaaaaggagaaggaaatcc

SEQ ID NO: 205575 - DNA, 22 bp, Artificial Sequence
  Synthetic oligonucleotide; CTA chr2 60529686 60529707 60529703 60529708 +
gaaaaggagaaggaaatcctgc

SEQ ID NO: 205576 - DNA, 22 bp, Artificial Sequence
  Synthetic oligonucleotide; CTG chr2 60529707 60529728 60529724 60529729 +
cctcccttatgaggcctagcca

SEQ ID NO: 205577 - DNA, 22 bp, Artificial Sequence
  Synthetic oligonucleotide; CTC chr2 60529711 60529732 60529728 60529733 +
ccttatgaggcctagccagggg

SEQ ID NO: 205578 - DNA, 22 bp, Artificial Sequence
  Synthetic oligonucleotide; CTT chr2 60529715 60529736 60529732 60529737 +
atgaggcctagccaggggaagt

SEQ ID NO: 205579 - DNA, 22 bp, Artificial Sequence
  Synthetic oligonucleotide; TTA chr2 60529716 60529737 60529733 60529738 +
tgaggcctagccaggggaagta

SEQ ID NO: 205580 - DNA, 22 bp, Artificial Sequence
  Synthetic oligonucleotide; CTA chr2 60529725 60529746 60529742 60529747 +
gccaggggaagtaaatgtgatt

SEQ ID NO: 205581 - DNA, 22 bp, Artificial Sequence
  Synthetic oligonucleotide; TTT chr2 60529748 60529769 60529765 60529770 +
tatcacattttatatagatgtg

SEQ ID NO: 205582 - DNA, 22 bp, Artificial Sequence
  Synthetic oligonucleotide; TTT chr2 60529749 60529770 60529766 60529771 +
atcacattttatatagatgtgc

SEQ ID NO: 205583 - DNA, 22 bp, Artificial Sequence
  Synthetic oligonucleotide; TTA chr2 60529750 60529771 60529767 60529772 +
tcacattttatatagatgtgca

SEQ ID NO: 205584 - DNA, 22 bp, Artificial Sequence
  Synthetic oligonucleotide; TTT chr2 60529758 60529779 60529775 60529780 +
tatatagatgtgcacaatggtg

SEQ ID NO: 205585 - DNA, 22 bp, Artificial Sequence
  Synthetic oligonucleotide; TTT chr2 60529759 60529780 60529776 60529781 +
atatagatgtgcacaatggtgc

SEQ ID NO: 205586 - DNA, 22 bp, Artificial Sequence
  Synthetic oligonucleotide; TTA chr2 60529760 60529781 60529777 60529782 +
tatagatgtgcacaatggtgcc

SEQ ID NO: 205587 - DNA, 22 bp, Artificial Sequence
  Synthetic oligonucleotide; CTT chr2 60529784 60529805 60529801 60529806 +
ttcaagtctatgatgggaaaaa

SEQ ID NO: 205588 - DNA, 22 bp, Artificial Sequence
  Synthetic oligonucleotide; TTT chr2 60529785 60529806 60529802 60529807 +
tcaagtctatgatgggaaaaat

SEQ ID NO: 205589 - DNA, 22 bp, Artificial Sequence
  Synthetic oligonucleotide; TTT chr2 60529786 60529807 60529803 60529808 +
caagtctatgatgggaaaaata

SEQ ID NO: 205590 - DNA, 22 bp, Artificial Sequence
  Synthetic oligonucleotide; TTC chr2 60529787 60529808 60529804 60529809 +
aagtctatgatgggaaaaatat

SEQ ID NO: 205591 - DNA, 22 bp, Artificial Sequence
  Synthetic oligonucleotide; CTA chr2 60529794 60529815 60529811 60529816 +
tgatgggaaaaatattttttat

SEQ ID NO: 205592 - DNA, 22 bp, Artificial Sequence
  Synthetic oligonucleotide; TTT chr2 60529811 60529832 60529828 60529833 +
tttattgtgtgaatatcatttc

SEQ ID NO: 205593 - DNA, 22 bp, Artificial Sequence
  Synthetic oligonucleotide; TTT chr2 60529812 60529833 60529829 60529834 +
ttattgtgtgaatatcatttca

SEQ ID NO: 205594 - DNA, 22 bp, Artificial Sequence
  Synthetic oligonucleotide; TTT chr2 60529813 60529834 60529830 60529835 +
tattgtgtgaatatcatttcag

SEQ ID NO: 205595 - DNA, 22 bp, Artificial Sequence
  Synthetic oligonucleotide; TTT chr2 60529814 60529835 60529831 60529836 +
attgtgtgaatatcatttcaga

SEQ ID NO: 205596 - DNA, 22 bp, Artificial Sequence
  Synthetic oligonucleotide; TTA chr2 60529815 60529836 60529832 60529837 +
ttgtgtgaatatcatttcagac

SEQ ID NO: 205597 - DNA, 22 bp, Artificial Sequence
  Synthetic oligonucleotide; TTG chr2 60529818 60529839 60529835 60529840 +
tgtgaatatcatttcagacagg

SEQ ID NO: 205598 - DNA, 22 bp, Artificial Sequence
  Synthetic oligonucleotide; TTT chr2 60529832 60529853 60529849 60529854 +
cagacaggtccccaaaccactt

SEQ ID NO: 205599 - DNA, 22 bp, Artificial Sequence
  Synthetic oligonucleotide; TTC chr2 60529833 60529854 60529850 60529855 +
agacaggtccccaaaccacttg

SEQ ID NO: 205600 - DNA, 22 bp, Artificial Sequence
  Synthetic oligonucleotide; CTT chr2 60529854 60529875 60529871 60529876 +
gaaagccctggtgtcccctagg

SEQ ID NO: 205601 - DNA, 22 bp, Artificial Sequence
  Synthetic oligonucleotide; TTG chr2 60529855 60529876 60529872 60529877 +
aaagccctggtgtcccctaggt

SEQ ID NO: 205602 - DNA, 22 bp, Artificial Sequence
  Synthetic oligonucleotide; CTG chr2 60529864 60529885 60529881 60529886 +
gtgtcccctaggtgggattcta

SEQ ID NO: 205603 - DNA, 22 bp, Artificial Sequence
  Synthetic oligonucleotide; CTA chr2 60529874 60529895 60529891 60529896 +
ggtgggattctatgaacccagc

SEQ ID NO: 205604 - DNA, 22 bp, Artificial Sequence
  Synthetic oligonucleotide; TTC chr2 60529884 60529905 60529901 60529906 +
tatgaacccagctttagcccca

SEQ ID NO: 205605 - DNA, 22 bp, Artificial Sequence
  Synthetic oligonucleotide; CTA chr2 60529886 60529907 60529903 60529908 +
tgaacccagctttagccccagc

SEQ ID NO: 205606 - DNA, 22 bp, Artificial Sequence
  Synthetic oligonucleotide; CTT chr2 60529898 60529919 60529915 60529920 +
tagccccagcagctcctctggt

SEQ ID NO: 205607 - DNA, 22 bp, Artificial Sequence
  Synthetic oligonucleotide; TTT chr2 60529899 60529920 60529916 60529921 +
agccccagcagctcctctggtg

SEQ ID NO: 205608 - DNA, 22 bp, Artificial Sequence
  Synthetic oligonucleotide; TTA chr2 60529900 60529921 60529917 60529922 +
gccccagcagctcctctggtgg

SEQ ID NO: 205609 - DNA, 22 bp, Artificial Sequence
  Synthetic oligonucleotide; CTC chr2 60529913 60529934 60529930 60529935 +
ctctggtgggaactagaacatg

SEQ ID NO: 205610 - DNA, 22 bp, Artificial Sequence
  Synthetic oligonucleotide; CTC chr2 60529916 60529937 60529933 60529938 +
tggtgggaactagaacatgcct

SEQ ID NO: 205611 - DNA, 22 bp, Artificial Sequence
  Synthetic oligonucleotide; CTG chr2 60529918 60529939 60529935 60529940 +
gtgggaactagaacatgcctcc

SEQ ID NO: 205612 - DNA, 22 bp, Artificial Sequence
  Synthetic oligonucleotide; CTA chr2 60529928 60529949 60529945 60529950 +
gaacatgcctcctgccagttag

SEQ ID NO: 205613 - DNA, 22 bp, Artificial Sequence
  Synthetic oligonucleotide; CTC chr2 60529939 60529960 60529956 60529961 +
ctgccagttagtaacagggaaa

SEQ ID NO: 205614 - DNA, 22 bp, Artificial Sequence
  Synthetic oligonucleotide; CTG chr2 60529942 60529963 60529959 60529964 +
ccagttagtaacagggaaattc

SEQ ID NO: 205615 - DNA, 22 bp, Artificial Sequence
  Synthetic oligonucleotide; TTA chr2 60529949 60529970 60529966 60529971 +
gtaacagggaaattcaattact

SEQ ID NO: 205616 - DNA, 22 bp, Artificial Sequence
  Synthetic oligonucleotide; TTC chr2 60529964 60529985 60529981 60529986 +
aattacttcgccacttgtggca

SEQ ID NO: 205617 - DNA, 22 bp, Artificial Sequence
  Synthetic oligonucleotide; TTA chr2 60529969 60529990 60529986 60529991 +
cttcgccacttgtggcaggagg

SEQ ID NO: 205618 - DNA, 22 bp, Artificial Sequence
  Synthetic oligonucleotide; CTT chr2 60529972 60529993 60529989 60529994 +
cgccacttgtggcaggagggca

SEQ ID NO: 205619 - DNA, 22 bp, Artificial Sequence
  Synthetic oligonucleotide; TTC chr2 60529973 60529994 60529990 60529995 +
gccacttgtggcaggagggcaa

SEQ ID NO: 205620 - DNA, 22 bp, Artificial Sequence
  Synthetic oligonucleotide; CTT chr2 60529980 60530001 60529997 60530002 +
gtggcaggagggcaaagactgc

SEQ ID NO: 205621 - DNA, 22 bp, Artificial Sequence
  Synthetic oligonucleotide; TTG chr2 60529981 60530002 60529998 60530003 +
tggcaggagggcaaagactgca

SEQ ID NO: 205622 - DNA, 22 bp, Artificial Sequence
  Synthetic oligonucleotide; CTG chr2 60530001 60530022 60530018 60530023 +
cacattaaaagagctaaaaatg

SEQ ID NO: 205623 - DNA, 22 bp, Artificial Sequence
  Synthetic oligonucleotide; TTA chr2 60530008 60530029 60530025 60530030 +
aaagagctaaaaatgtcaggaa

SEQ ID NO: 205624 - DNA, 22 bp, Artificial Sequence
  Synthetic oligonucleotide; CTA chr2 60530017 60530038 60530034 60530039 +
aaaatgtcaggaagttattggg

SEQ ID NO: 205625 - DNA, 22 bp, Artificial Sequence
  Synthetic oligonucleotide; TTA chr2 60530034 60530055 60530051 60530056 +
ttgggatgatgactcctgcttg

SEQ ID NO: 205626 - DNA, 22 bp, Artificial Sequence
  Synthetic oligonucleotide; TTG chr2 60530037 60530058 60530054 60530059 +
ggatgatgactcctgcttgcca

SEQ ID NO: 205627 - DNA, 22 bp, Artificial Sequence
  Synthetic oligonucleotide; CTC chr2 60530049 60530070 60530066 60530071 +
ctgcttgccaacattcatatat

SEQ ID NO: 205628 - DNA, 22 bp, Artificial Sequence
  Synthetic oligonucleotide; CTG chr2 60530052 60530073 60530069 60530074 +
cttgccaacattcatatatgaa

SEQ ID NO: 205629 - DNA, 22 bp, Artificial Sequence
  Synthetic oligonucleotide; CTT chr2 60530055 60530076 60530072 60530077 +
gccaacattcatatatgaatgc

SEQ ID NO: 205630 - DNA, 22 bp, Artificial Sequence
  Synthetic oligonucleotide; TTG chr2 60530056 60530077 60530073 60530078 +
ccaacattcatatatgaatgca

SEQ ID NO: 205631 - DNA, 22 bp, Artificial Sequence
  Synthetic oligonucleotide; TTC chr2 60530065 60530086 60530082 60530087 +
atatatgaatgcataatgtcac

SEQ ID NO: 205632 - DNA, 22 bp, Artificial Sequence
  Synthetic oligonucleotide; CTA chr2 60530096 60530117 60530113 60530118 +
aaaaacacaggaagaggccaag

SEQ ID NO: 205633 - DNA, 22 bp, Artificial Sequence
  Synthetic oligonucleotide; TTT chr2 60530163 60530184 60530180 60530185 +
gccatcggtcctgggtcctgcc

SEQ ID NO: 205634 - DNA, 22 bp, Artificial Sequence
  Synthetic oligonucleotide; TTG chr2 60530164 60530185 60530181 60530186 +
ccatcggtcctgggtcctgccc

SEQ ID NO: 205635 - DNA, 22 bp, Artificial Sequence
  Synthetic oligonucleotide; CTG chr2 60530176 60530197 60530193 60530198 +
ggtcctgcccaggaaaggctgc

SEQ ID NO: 205636 - DNA, 22 bp, Artificial Sequence
  Synthetic oligonucleotide; CTG chr2 60530183 60530204 60530200 60530205 +
cccaggaaaggctgcgcctcta

SEQ ID NO: 205637 - DNA, 22 bp, Artificial Sequence
  Synthetic oligonucleotide; CTG chr2 60530197 60530218 60530214 60530219 +
cgcctctaacaagagcaccttt

SEQ ID NO: 205638 - DNA, 22 bp, Artificial Sequence
  Synthetic oligonucleotide; CTC chr2 60530203 60530224 60530220 60530225 +
taacaagagcaccttttcccca

SEQ ID NO: 205639 - DNA, 22 bp, Artificial Sequence
  Synthetic oligonucleotide; CTA chr2 60530205 60530226 60530222 60530227 +
acaagagcaccttttccccacc

SEQ ID NO: 205640 - DNA, 22 bp, Artificial Sequence
  Synthetic oligonucleotide; CTT chr2 60530218 60530239 60530235 60530240 +
ttccccacccctggcctttctt

SEQ ID NO: 205641 - DNA, 22 bp, Artificial Sequence
  Synthetic oligonucleotide; TTT chr2 60530219 60530240 60530236 60530241 +
tccccacccctggcctttcttg

SEQ ID NO: 205642 - DNA, 22 bp, Artificial Sequence
  Synthetic oligonucleotide; TTT chr2 60530220 60530241 60530237 60530242 +
ccccacccctggcctttcttga

SEQ ID NO: 205643 - DNA, 22 bp, Artificial Sequence
  Synthetic oligonucleotide; TTC chr2 60530221 60530242 60530238 60530243 +
cccacccctggcctttcttgag

SEQ ID NO: 205644 - DNA, 22 bp, Artificial Sequence
  Synthetic oligonucleotide; CTG chr2 60530231 60530252 60530248 60530253 +
gcctttcttgagccttccttga

SEQ ID NO: 205645 - DNA, 22 bp, Artificial Sequence
  Synthetic oligonucleotide; CTT chr2 60530236 60530257 60530253 60530258 +
tcttgagccttccttgagcctt

SEQ ID NO: 205646 - DNA, 22 bp, Artificial Sequence
  Synthetic oligonucleotide; TTT chr2 60530237 60530258 60530254 60530259 +
cttgagccttccttgagccttc

SEQ ID NO: 205647 - DNA, 22 bp, Artificial Sequence
  Synthetic oligonucleotide; TTC chr2 60530238 60530259 60530255 60530260 +
ttgagccttccttgagccttcc

SEQ ID NO: 205648 - DNA, 22 bp, Artificial Sequence
  Synthetic oligonucleotide; CTT chr2 60530240 60530261 60530257 60530262 +
gagccttccttgagccttcctt

SEQ ID NO: 205649 - DNA, 22 bp, Artificial Sequence
  Synthetic oligonucleotide; TTG chr2 60530241 60530262 60530258 60530263 +
agccttccttgagccttccttg

SEQ ID NO: 205650 - DNA, 22 bp, Artificial Sequence
  Synthetic oligonucleotide; CTT chr2 60530247 60530268 60530264 60530269 +
ccttgagccttccttgcatatt

SEQ ID NO: 205651 - DNA, 22 bp, Artificial Sequence
  Synthetic oligonucleotide; TTC chr2 60530248 60530269 60530265 60530270 +
cttgagccttccttgcatatta

SEQ ID NO: 205652 - DNA, 22 bp, Artificial Sequence
  Synthetic oligonucleotide; CTT chr2 60530251 60530272 60530268 60530273 +
gagccttccttgcatattatcg

SEQ ID NO: 205653 - DNA, 22 bp, Artificial Sequence
  Synthetic oligonucleotide; TTG chr2 60530252 60530273 60530269 60530274 +
agccttccttgcatattatcgt

SEQ ID NO: 205654 - DNA, 22 bp, Artificial Sequence
  Synthetic oligonucleotide; CTT chr2 60530258 60530279 60530275 60530280 +
ccttgcatattatcgttctcag

SEQ ID NO: 205655 - DNA, 22 bp, Artificial Sequence
  Synthetic oligonucleotide; TTC chr2 60530259 60530280 60530276 60530281 +
cttgcatattatcgttctcagc

SEQ ID NO: 205656 - DNA, 22 bp, Artificial Sequence
  Synthetic oligonucleotide; CTT chr2 60530262 60530283 60530279 60530284 +
gcatattatcgttctcagccac

SEQ ID NO: 205657 - DNA, 22 bp, Artificial Sequence
  Synthetic oligonucleotide; TTG chr2 60530263 60530284 60530280 60530285 +
catattatcgttctcagccacc

SEQ ID NO: 205658 - DNA, 22 bp, Artificial Sequence
  Synthetic oligonucleotide; TTA chr2 60530270 60530291 60530287 60530292 +
tcgttctcagccaccgacagct

SEQ ID NO: 205659 - DNA, 22 bp, Artificial Sequence
  Synthetic oligonucleotide; TTC chr2 60530276 60530297 60530293 60530298 +
tcagccaccgacagcttaattc

SEQ ID NO: 205660 - DNA, 22 bp, Artificial Sequence
  Synthetic oligonucleotide; CTC chr2 60530278 60530299 60530295 60530300 +
agccaccgacagcttaattcac

SEQ ID NO: 205661 - DNA, 22 bp, Artificial Sequence
  Synthetic oligonucleotide; CTT chr2 60530293 60530314 60530310 60530315 +
aattcacaggcccttccaacaa

SEQ ID NO: 205662 - DNA, 22 bp, Artificial Sequence
  Synthetic oligonucleotide; TTA chr2 60530294 60530315 60530311 60530316 +
attcacaggcccttccaacaag

SEQ ID NO: 205663 - DNA, 22 bp, Artificial Sequence
  Synthetic oligonucleotide; TTC chr2 60530298 60530319 60530315 60530320 +
acaggcccttccaacaagttaa

SEQ ID NO: 205664 - DNA, 22 bp, Artificial Sequence
  Synthetic oligonucleotide; CTT chr2 60530308 60530329 60530325 60530330 +
ccaacaagttaaacttcagcca

SEQ ID NO: 205665 - DNA, 22 bp, Artificial Sequence
  Synthetic oligonucleotide; TTC chr2 60530309 60530330 60530326 60530331 +
caacaagttaaacttcagccat

SEQ ID NO: 205666 - DNA, 22 bp, Artificial Sequence
  Synthetic oligonucleotide; TTA chr2 60530319 60530340 60530336 60530341 +
aacttcagccatttaaaaaaaa

SEQ ID NO: 205667 - DNA, 22 bp, Artificial Sequence
  Synthetic oligonucleotide; CTT chr2 60530324 60530345 60530341 60530346 +
cagccatttaaaaaaaaaaaaa

SEQ ID NO: 205668 - DNA, 22 bp, Artificial Sequence
  Synthetic oligonucleotide; TTC chr2 60530325 60530346 60530342 60530347 +
agccatttaaaaaaaaaaaaaa

SEQ ID NO: 205669 - DNA, 22 bp, Artificial Sequence
  Synthetic oligonucleotide; TTT chr2 60530333 60530354 60530350 60530355 +
aaaaaaaaaaaaaaaaaagagt

SEQ ID NO: 205670 - DNA, 22 bp, Artificial Sequence
  Synthetic oligonucleotide; TTA chr2 60530334 60530355 60530351 60530356 +
aaaaaaaaaaaaaaaaagagtt

SEQ ID NO: 205671 - DNA, 22 bp, Artificial Sequence
  Synthetic oligonucleotide; TTT chr2 60530357 60530378 60530374 60530379 +
ccactgatttcttacctgcaca

SEQ ID NO: 205672 - DNA, 22 bp, Artificial Sequence
  Synthetic oligonucleotide; TTC chr2 60530358 60530379 60530375 60530380 +
cactgatttcttacctgcacac

SEQ ID NO: 205673 - DNA, 22 bp, Artificial Sequence
  Synthetic oligonucleotide; CTG chr2 60530363 60530384 60530380 60530385 +
atttcttacctgcacacgcagg

SEQ ID NO: 205674 - DNA, 22 bp, Artificial Sequence
  Synthetic oligonucleotide; TTT chr2 60530367 60530388 60530384 60530389 +
cttacctgcacacgcaggcacg

SEQ ID NO: 205675 - DNA, 22 bp, Artificial Sequence
  Synthetic oligonucleotide; TTC chr2 60530368 60530389 60530385 60530390 +
ttacctgcacacgcaggcacgc

SEQ ID NO: 205676 - DNA, 22 bp, Artificial Sequence
  Synthetic oligonucleotide; CTT chr2 60530370 60530391 60530387 60530392 +
acctgcacacgcaggcacgccg

SEQ ID NO: 205677 - DNA, 22 bp, Artificial Sequence
  Synthetic oligonucleotide; TTA chr2 60530371 60530392 60530388 60530393 +
cctgcacacgcaggcacgccgg

SEQ ID NO: 205678 - DNA, 22 bp, Artificial Sequence
  Synthetic oligonucleotide; CTG chr2 60530375 60530396 60530392 60530397 +
cacacgcaggcacgccggccac

SEQ ID NO: 205679 - DNA, 22 bp, Artificial Sequence
  Synthetic oligonucleotide; CTG chr2 60530411 60530432 60530428 60530433 +
caccacgagctctcacacctgg

SEQ ID NO: 205680 - DNA, 22 bp, Artificial Sequence
  Synthetic oligonucleotide; CTC chr2 60530423 60530444 60530440 60530445 +
tcacacctggtcgcctgaacac

SEQ ID NO: 205681 - DNA, 22 bp, Artificial Sequence
  Synthetic oligonucleotide; CTC chr2 60530425 60530446 60530442 60530447 +
acacctggtcgcctgaacacaa

SEQ ID NO: 205682 - DNA, 22 bp, Artificial Sequence
  Synthetic oligonucleotide; CTG chr2 60530432 60530453 60530449 60530454 +
gtcgcctgaacacaaccaaacc

SEQ ID NO: 205683 - DNA, 22 bp, Artificial Sequence
  Synthetic oligonucleotide; CTG chr2 60530440 60530461 60530457 60530462 +
aacacaaccaaacccttcccat

SEQ ID NO: 205684 - DNA, 22 bp, Artificial Sequence
  Synthetic oligonucleotide; CTT chr2 60530457 60530478 60530474 60530479 +
cccatctggccctcgggttact

SEQ ID NO: 205685 - DNA, 22 bp, Artificial Sequence
  Synthetic oligonucleotide; TTC chr2 60530458 60530479 60530475 60530480 +
ccatctggccctcgggttactg

SEQ ID NO: 205686 - DNA, 22 bp, Artificial Sequence
  Synthetic oligonucleotide; CTG chr2 60530465 60530486 60530482 60530487 +
gccctcgggttactggcgttat

SEQ ID NO: 205687 - DNA, 22 bp, Artificial Sequence
  Synthetic oligonucleotide; CTC chr2 60530471 60530492 60530488 60530493 +
gggttactggcgttatcacaac

SEQ ID NO: 205688 - DNA, 22 bp, Artificial Sequence
  Synthetic oligonucleotide; TTA chr2 60530477 60530498 60530494 60530499 +
ctggcgttatcacaactttttt

SEQ ID NO: 205689 - DNA, 22 bp, Artificial Sequence
  Synthetic oligonucleotide; CTG chr2 60530480 60530501 60530497 60530502 +
gcgttatcacaactttttttcc

SEQ ID NO: 205690 - DNA, 22 bp, Artificial Sequence
  Synthetic oligonucleotide; TTA chr2 60530486 60530507 60530503 60530508 +
tcacaactttttttcccaacgg

SEQ ID NO: 205691 - DNA, 22 bp, Artificial Sequence
  Synthetic oligonucleotide; CTT chr2 60530495 60530516 60530512 60530517 +
tttttcccaacggcaagccagg

SEQ ID NO: 205692 - DNA, 22 bp, Artificial Sequence
  Synthetic oligonucleotide; TTT chr2 60530496 60530517 60530513 60530518 +
ttttcccaacggcaagccagga

SEQ ID NO: 205693 - DNA, 22 bp, Artificial Sequence
  Synthetic oligonucleotide; TTT chr2 60530497 60530518 60530514 60530519 +
tttcccaacggcaagccaggaa

SEQ ID NO: 205694 - DNA, 22 bp, Artificial Sequence
  Synthetic oligonucleotide; TTT chr2 60530498 60530519 60530515 60530520 +
ttcccaacggcaagccaggaaa

SEQ ID NO: 205695 - DNA, 22 bp, Artificial Sequence
  Synthetic oligonucleotide; TTT chr2 60530499 60530520 60530516 60530521 +
tcccaacggcaagccaggaaag

SEQ ID NO: 205696 - DNA, 22 bp, Artificial Sequence
  Synthetic oligonucleotide; TTT chr2 60530500 60530521 60530517 60530522 +
cccaacggcaagccaggaaaga

SEQ ID NO: 205697 - DNA, 22 bp, Artificial Sequence
  Synthetic oligonucleotide; TTC chr2 60530501 60530522 60530518 60530523 +
ccaacggcaagccaggaaagat

SEQ ID NO: 205698 - DNA, 22 bp, Artificial Sequence
  Synthetic oligonucleotide; CTG chr2 60530554 60530575 60530571 60530576 +
gcctcaactggttcagaggagg

SEQ ID NO: 205699 - DNA, 22 bp, Artificial Sequence
  Synthetic oligonucleotide; CTC chr2 60530559 60530580 60530576 60530581 +
aactggttcagaggagggaaaa

SEQ ID NO: 205700 - DNA, 22 bp, Artificial Sequence
  Synthetic oligonucleotide; CTG chr2 60530564 60530585 60530581 60530586 +
gttcagaggagggaaaaaattg

SEQ ID NO: 205701 - DNA, 22 bp, Artificial Sequence
  Synthetic oligonucleotide; TTC chr2 60530568 60530589 60530585 60530590 +
agaggagggaaaaaattgagct

SEQ ID NO: 205702 - DNA, 22 bp, Artificial Sequence
  Synthetic oligonucleotide; TTG chr2 60530586 60530607 60530603 60530608 +
agctgtgcgtctcttttttttt

SEQ ID NO: 205703 - DNA, 22 bp, Artificial Sequence
  Synthetic oligonucleotide; CTG chr2 60530591 60530612 60530608 60530613 +
tgcgtctctttttttttttatt

SEQ ID NO: 205704 - DNA, 22 bp, Artificial Sequence
  Synthetic oligonucleotide; CTC chr2 60530599 60530620 60530616 60530621 +
tttttttttttattttttattt

SEQ ID NO: 205705 - DNA, 22 bp, Artificial Sequence
  Synthetic oligonucleotide; CTT chr2 60530601 60530622 60530618 60530623 +
tttttttttattttttattttt

SEQ ID NO: 205706 - DNA, 22 bp, Artificial Sequence
  Synthetic oligonucleotide; TTT chr2 60530602 60530623 60530619 60530624 +
ttttttttattttttatttttt

SEQ ID NO: 205707 - DNA, 22 bp, Artificial Sequence
  Synthetic oligonucleotide; TTT chr2 60530603 60530624 60530620 60530625 +
tttttttattttttattttttt

SEQ ID NO: 205708 - DNA, 22 bp, Artificial Sequence
  Synthetic oligonucleotide; TTT chr2 60530604 60530625 60530621 60530626 +
ttttttattttttatttttttg

SEQ ID NO: 205709 - DNA, 22 bp, Artificial Sequence
  Synthetic oligonucleotide; TTT chr2 60530605 60530626 60530622 60530627 +
tttttattttttatttttttgc

SEQ ID NO: 205710 - DNA, 22 bp, Artificial Sequence
  Synthetic oligonucleotide; TTT chr2 60530606 60530627 60530623 60530628 +
ttttattttttatttttttgcc

SEQ ID NO: 205711 - DNA, 22 bp, Artificial Sequence
  Synthetic oligonucleotide; TTT chr2 60530607 60530628 60530624 60530629 +
tttattttttatttttttgcct

SEQ ID NO: 205712 - DNA, 22 bp, Artificial Sequence
  Synthetic oligonucleotide; TTT chr2 60530608 60530629 60530625 60530630 +
ttattttttatttttttgcctt

SEQ ID NO: 205713 - DNA, 22 bp, Artificial Sequence
  Synthetic oligonucleotide; TTT chr2 60530609 60530630 60530626 60530631 +
tattttttatttttttgccttt

SEQ ID NO: 205714 - DNA, 22 bp, Artificial Sequence
  Synthetic oligonucleotide; TTT chr2 60530610 60530631 60530627 60530632 +
attttttatttttttgccttta

SEQ ID NO: 205715 - DNA, 22 bp, Artificial Sequence
  Synthetic oligonucleotide; TTA chr2 60530611 60530632 60530628 60530633 +
ttttttatttttttgcctttag

SEQ ID NO: 205716 - DNA, 22 bp, Artificial Sequence
  Synthetic oligonucleotide; TTT chr2 60530614 60530635 60530631 60530636 +
tttatttttttgcctttagcca

SEQ ID NO: 205717 - DNA, 22 bp, Artificial Sequence
  Synthetic oligonucleotide; TTT chr2 60530615 60530636 60530632 60530637 +
ttatttttttgcctttagccaa

SEQ ID NO: 205718 - DNA, 22 bp, Artificial Sequence
  Synthetic oligonucleotide; TTT chr2 60530616 60530637 60530633 60530638 +
tatttttttgcctttagccaaa

SEQ ID NO: 205719 - DNA, 22 bp, Artificial Sequence
  Synthetic oligonucleotide; TTT chr2 60530617 60530638 60530634 60530639 +
atttttttgcctttagccaaaa

SEQ ID NO: 205720 - DNA, 22 bp, Artificial Sequence
  Synthetic oligonucleotide; TTA chr2 60530618 60530639 60530635 60530640 +
tttttttgcctttagccaaaag

SEQ ID NO: 205721 - DNA, 22 bp, Artificial Sequence
  Synthetic oligonucleotide; TTT chr2 60530621 60530642 60530638 60530643 +
ttttgcctttagccaaaagacc

SEQ ID NO: 205722 - DNA, 22 bp, Artificial Sequence
  Synthetic oligonucleotide; TTT chr2 60530622 60530643 60530639 60530644 +
tttgcctttagccaaaagacca

SEQ ID NO: 205723 - DNA, 22 bp, Artificial Sequence
  Synthetic oligonucleotide; TTT chr2 60530623 60530644 60530640 60530645 +
ttgcctttagccaaaagaccag

SEQ ID NO: 205724 - DNA, 22 bp, Artificial Sequence
  Synthetic oligonucleotide; TTT chr2 60530624 60530645 60530641 60530646 +
tgcctttagccaaaagaccagg

SEQ ID NO: 205725 - DNA, 22 bp, Artificial Sequence
  Synthetic oligonucleotide; TTT chr2 60530625 60530646 60530642 60530647 +
gcctttagccaaaagaccaggg

SEQ ID NO: 205726 - DNA, 22 bp, Artificial Sequence
  Synthetic oligonucleotide; TTG chr2 60530626 60530647 60530643 60530648 +
cctttagccaaaagaccaggga

SEQ ID NO: 205727 - DNA, 22 bp, Artificial Sequence
  Synthetic oligonucleotide; CTT chr2 60530630 60530651 60530647 60530652 +
tagccaaaagaccagggagcat

SEQ ID NO: 205728 - DNA, 22 bp, Artificial Sequence
  Synthetic oligonucleotide; TTT chr2 60530631 60530652 60530648 60530653 +
agccaaaagaccagggagcatt

SEQ ID NO: 205729 - DNA, 22 bp, Artificial Sequence
  Synthetic oligonucleotide; TTA chr2 60530632 60530653 60530649 60530654 +
gccaaaagaccagggagcattt

SEQ ID NO: 205730 - DNA, 22 bp, Artificial Sequence
  Synthetic oligonucleotide; TTT chr2 60530654 60530675 60530671 60530676 +
gatgtacagtcagcaggtattt

SEQ ID NO: 205731 - DNA, 22 bp, Artificial Sequence
  Synthetic oligonucleotide; TTG chr2 60530655 60530676 60530672 60530677 +
atgtacagtcagcaggtattta

SEQ ID NO: 205732 - DNA, 22 bp, Artificial Sequence
  Synthetic oligonucleotide; TTT chr2 60530676 60530697 60530693 60530698 +
aaaaaagaaagaaagaaaaagg

SEQ ID NO: 205733 - DNA, 22 bp, Artificial Sequence
  Synthetic oligonucleotide; TTA chr2 60530677 60530698 60530694 60530699 +
aaaaagaaagaaagaaaaagga

SEQ ID NO: 205734 - DNA, 22 bp, Artificial Sequence
  Synthetic oligonucleotide; CTG chr2 60530713 60530734 60530730 60530735 +
aaaaggcttggctgcactgggg

SEQ ID NO: 205735 - DNA, 22 bp, Artificial Sequence
  Synthetic oligonucleotide; CTT chr2 60530722 60530743 60530739 60530744 +
ggctgcactggggccctgacac

SEQ ID NO: 205736 - DNA, 22 bp, Artificial Sequence
  Synthetic oligonucleotide; TTG chr2 60530723 60530744 60530740 60530745 +
gctgcactggggccctgacacg

SEQ ID NO: 205737 - DNA, 22 bp, Artificial Sequence
  Synthetic oligonucleotide; CTG chr2 60530727 60530748 60530744 60530749 +
cactggggccctgacacgctct

SEQ ID NO: 205738 - DNA, 22 bp, Artificial Sequence
  Synthetic oligonucleotide; CTG chr2 60530732 60530753 60530749 60530754 +
gggccctgacacgctctcatct

SEQ ID NO: 205739 - DNA, 22 bp, Artificial Sequence
  Synthetic oligonucleotide; CTG chr2 60530740 60530761 60530757 60530762 +
acacgctctcatctaaagcctg

SEQ ID NO: 205740 - DNA, 22 bp, Artificial Sequence
  Synthetic oligonucleotide; CTC chr2 60530748 60530769 60530765 60530770 +
tcatctaaagcctggccctcgg

SEQ ID NO: 205741 - DNA, 22 bp, Artificial Sequence
  Synthetic oligonucleotide; CTC chr2 60530750 60530771 60530767 60530772 +
atctaaagcctggccctcggcc

SEQ ID NO: 205742 - DNA, 22 bp, Artificial Sequence
  Synthetic oligonucleotide; CTA chr2 60530755 60530776 60530772 60530777 +
aagcctggccctcggccaagtt

SEQ ID NO: 205743 - DNA, 22 bp, Artificial Sequence
  Synthetic oligonucleotide; CTG chr2 60530762 60530783 60530779 60530784 +
gccctcggccaagttcatctgt

SEQ ID NO: 205744 - DNA, 22 bp, Artificial Sequence
  Synthetic oligonucleotide; CTC chr2 60530768 60530789 60530785 60530790 +
ggccaagttcatctgttaatgg

SEQ ID NO: 205745 - DNA, 22 bp, Artificial Sequence
  Synthetic oligonucleotide; TTC chr2 60530778 60530799 60530795 60530800 +
atctgttaatggacaaccacaa

SEQ ID NO: 205746 - DNA, 22 bp, Artificial Sequence
  Synthetic oligonucleotide; CTG chr2 60530783 60530804 60530800 60530805 +
ttaatggacaaccacaaccagg

SEQ ID NO: 205747 - DNA, 22 bp, Artificial Sequence
  Synthetic oligonucleotide; TTA chr2 60530786 60530807 60530803 60530808 +
atggacaaccacaaccagggcc

SEQ ID NO: 205748 - DNA, 22 bp, Artificial Sequence
  Synthetic oligonucleotide; CTG chr2 60530810 60530831 60530827 60530832 +
cacctcccccacctcccactac

SEQ ID NO: 205749 - DNA, 22 bp, Artificial Sequence
  Synthetic oligonucleotide; CTC chr2 60530816 60530837 60530833 60530838 +
ccccacctcccactacccctcc

SEQ ID NO: 205750 - DNA, 22 bp, Artificial Sequence
  Synthetic oligonucleotide; CTC chr2 60530825 60530846 60530842 60530847 +
ccactacccctcctgagtcttc

SEQ ID NO: 205751 - DNA, 22 bp, Artificial Sequence
  Synthetic oligonucleotide; CTA chr2 60530831 60530852 60530848 60530853 +
cccctcctgagtcttctctgtt

SEQ ID NO: 205752 - DNA, 22 bp, Artificial Sequence
  Synthetic oligonucleotide; CTC chr2 60530837 60530858 60530854 60530859 +
ctgagtcttctctgttctccta

SEQ ID NO: 205753 - DNA, 22 bp, Artificial Sequence
  Synthetic oligonucleotide; CTG chr2 60530840 60530861 60530857 60530862 +
agtcttctctgttctcctacct

SEQ ID NO: 205754 - DNA, 22 bp, Artificial Sequence
  Synthetic oligonucleotide; CTT chr2 60530846 60530867 60530863 60530868 +
ctctgttctcctacctctttcg

SEQ ID NO: 205755 - DNA, 22 bp, Artificial Sequence
  Synthetic oligonucleotide; TTC chr2 60530847 60530868 60530864 60530869 +
tctgttctcctacctctttcga

SEQ ID NO: 205756 - DNA, 22 bp, Artificial Sequence
  Synthetic oligonucleotide; CTC chr2 60530849 60530870 60530866 60530871 +
tgttctcctacctctttcgagc

SEQ ID NO: 205757 - DNA, 22 bp, Artificial Sequence
  Synthetic oligonucleotide; CTG chr2 60530851 60530872 60530868 60530873 +
ttctcctacctctttcgagctc

SEQ ID NO: 205758 - DNA, 22 bp, Artificial Sequence
  Synthetic oligonucleotide; TTC chr2 60530854 60530875 60530871 60530876 +
tcctacctctttcgagctccta

SEQ ID NO: 205759 - DNA, 22 bp, Artificial Sequence
  Synthetic oligonucleotide; CTC chr2 60530856 60530877 60530873 60530878 +
ctacctctttcgagctcctaaa

SEQ ID NO: 205760 - DNA, 22 bp, Artificial Sequence
  Synthetic oligonucleotide; CTA chr2 60530859 60530880 60530876 60530881 +
cctctttcgagctcctaaaaac

SEQ ID NO: 205761 - DNA, 22 bp, Artificial Sequence
  Synthetic oligonucleotide; CTC chr2 60530863 60530884 60530880 60530885 +
tttcgagctcctaaaaactaga

SEQ ID NO: 205762 - DNA, 22 bp, Artificial Sequence
  Synthetic oligonucleotide; CTT chr2 60530865 60530886 60530882 60530887 +
tcgagctcctaaaaactagaca

SEQ ID NO: 205763 - DNA, 22 bp, Artificial Sequence
  Synthetic oligonucleotide; TTT chr2 60530866 60530887 60530883 60530888 +
cgagctcctaaaaactagacat

SEQ ID NO: 205764 - DNA, 22 bp, Artificial Sequence
  Synthetic oligonucleotide; TTC chr2 60530867 60530888 60530884 60530889 +
gagctcctaaaaactagacatc

SEQ ID NO: 205765 - DNA, 22 bp, Artificial Sequence
  Synthetic oligonucleotide; CTC chr2 60530873 60530894 60530890 60530895 +
ctaaaaactagacatcgattat

SEQ ID NO: 205766 - DNA, 22 bp, Artificial Sequence
  Synthetic oligonucleotide; CTA chr2 60530876 60530897 60530893 60530898 +
aaaactagacatcgattatgtc

SEQ ID NO: 205767 - DNA, 22 bp, Artificial Sequence
  Synthetic oligonucleotide; CTA chr2 60530883 60530904 60530900 60530905 +
gacatcgattatgtctgcgctt

SEQ ID NO: 205768 - DNA, 22 bp, Artificial Sequence
  Synthetic oligonucleotide; TTA chr2 60530894 60530915 60530911 60530916 +
tgtctgcgcttttccctttcta

SEQ ID NO: 205769 - DNA, 22 bp, Artificial Sequence
  Synthetic oligonucleotide; CTG chr2 60530900 60530921 60530917 60530922 +
cgcttttccctttctattcaag

SEQ ID NO: 205770 - DNA, 22 bp, Artificial Sequence
  Synthetic oligonucleotide; CTT chr2 60530905 60530926 60530922 60530927 +
ttccctttctattcaagataaa

SEQ ID NO: 205771 - DNA, 22 bp, Artificial Sequence
  Synthetic oligonucleotide; TTT chr2 60530906 60530927 60530923 60530928 +
tccctttctattcaagataaac

SEQ ID NO: 205772 - DNA, 22 bp, Artificial Sequence
  Synthetic oligonucleotide; TTT chr2 60530907 60530928 60530924 60530929 +
ccctttctattcaagataaaca

SEQ ID NO: 205773 - DNA, 22 bp, Artificial Sequence
  Synthetic oligonucleotide; TTC chr2 60530908 60530929 60530925 60530930 +
cctttctattcaagataaacaa

SEQ ID NO: 205774 - DNA, 22 bp, Artificial Sequence
  Synthetic oligonucleotide; CTT chr2 60530912 60530933 60530929 60530934 +
tctattcaagataaacaaagtg

SEQ ID NO: 205775 - DNA, 22 bp, Artificial Sequence
  Synthetic oligonucleotide; TTT chr2 60530913 60530934 60530930 60530935 +
ctattcaagataaacaaagtgc

SEQ ID NO: 205776 - DNA, 22 bp, Artificial Sequence
  Synthetic oligonucleotide; TTC chr2 60530914 60530935 60530931 60530936 +
tattcaagataaacaaagtgct

SEQ ID NO: 205777 - DNA, 22 bp, Artificial Sequence
  Synthetic oligonucleotide; CTA chr2 60530916 60530937 60530933 60530938 +
ttcaagataaacaaagtgcttc

SEQ ID NO: 205778 - DNA, 22 bp, Artificial Sequence
  Synthetic oligonucleotide; TTC chr2 60530919 60530940 60530936 60530941 +
aagataaacaaagtgcttcaag

SEQ ID NO: 205779 - DNA, 22 bp, Artificial Sequence
  Synthetic oligonucleotide; CTT chr2 60530937 60530958 60530954 60530959 +
caagttcagggcgcaccctggg

SEQ ID NO: 205780 - DNA, 22 bp, Artificial Sequence
  Synthetic oligonucleotide; TTC chr2 60530938 60530959 60530955 60530960 +
aagttcagggcgcaccctggga

SEQ ID NO: 205781 - DNA, 22 bp, Artificial Sequence
  Synthetic oligonucleotide; TTC chr2 60530944 60530965 60530961 60530966 +
agggcgcaccctgggacccctg

SEQ ID NO: 205782 - DNA, 22 bp, Artificial Sequence
  Synthetic oligonucleotide; CTG chr2 60530957 60530978 60530974 60530979 +
ggacccctgacaaaacaatcta

SEQ ID NO: 205783 - DNA, 22 bp, Artificial Sequence
  Synthetic oligonucleotide; CTG chr2 60530966 60530987 60530983 60530988 +
acaaaacaatctatcattctgt

SEQ ID NO: 205784 - DNA, 22 bp, Artificial Sequence
  Synthetic oligonucleotide; CTA chr2 60530979 60531000 60530996 60531001 +
tcattctgtctgctaaaccagt

SEQ ID NO: 205785 - DNA, 22 bp, Artificial Sequence
  Synthetic oligonucleotide; TTC chr2 60530985 60531006 60531002 60531007 +
tgtctgctaaaccagtctggct

SEQ ID NO: 205786 - DNA, 22 bp, Artificial Sequence
  Synthetic oligonucleotide; CTG chr2 60530987 60531008 60531004 60531009 +
tctgctaaaccagtctggctac

SEQ ID NO: 205787 - DNA, 22 bp, Artificial Sequence
  Synthetic oligonucleotide; CTG chr2 60530991 60531012 60531008 60531013 +
ctaaaccagtctggctacacca

SEQ ID NO: 205788 - DNA, 22 bp, Artificial Sequence
  Synthetic oligonucleotide; CTA chr2 60530994 60531015 60531011 60531016 +
aaccagtctggctacaccatgg

SEQ ID NO: 205789 - DNA, 22 bp, Artificial Sequence
  Synthetic oligonucleotide; CTG chr2 60531004 60531025 60531021 60531026 +
gctacaccatggccagggagag

SEQ ID NO: 205790 - DNA, 22 bp, Artificial Sequence
  Synthetic oligonucleotide; CTA chr2 60531008 60531029 60531025 60531030 +
caccatggccagggagagtaac

SEQ ID NO: 205791 - DNA, 22 bp, Artificial Sequence
  Synthetic oligonucleotide; CTC chr2 60531034 60531055 60531051 60531056 +
ccaatgtacaattttccctttg

SEQ ID NO: 205792 - DNA, 22 bp, Artificial Sequence
  Synthetic oligonucleotide; TTT chr2 60531048 60531069 60531065 60531070 +
tccctttgtgctccttccctct

SEQ ID NO: 205793 - DNA, 22 bp, Artificial Sequence
  Synthetic oligonucleotide; TTT chr2 60531049 60531070 60531066 60531071 +
ccctttgtgctccttccctctt

SEQ ID NO: 205794 - DNA, 22 bp, Artificial Sequence
  Synthetic oligonucleotide; TTC chr2 60531050 60531071 60531067 60531072 +
cctttgtgctccttccctcttg

SEQ ID NO: 205795 - DNA, 22 bp, Artificial Sequence
  Synthetic oligonucleotide; CTT chr2 60531054 60531075 60531071 60531076 +
tgtgctccttccctcttgccac

SEQ ID NO: 205796 - DNA, 22 bp, Artificial Sequence
  Synthetic oligonucleotide; TTT chr2 60531055 60531076 60531072 60531077 +
gtgctccttccctcttgccact

SEQ ID NO: 205797 - DNA, 22 bp, Artificial Sequence
  Synthetic oligonucleotide; TTG chr2 60531056 60531077 60531073 60531078 +
tgctccttccctcttgccacta

SEQ ID NO: 205798 - DNA, 22 bp, Artificial Sequence
  Synthetic oligonucleotide; CTC chr2 60531061 60531082 60531078 60531083 +
cttccctcttgccactaacctc

SEQ ID NO: 205799 - DNA, 22 bp, Artificial Sequence
  Synthetic oligonucleotide; CTT chr2 60531064 60531085 60531081 60531086 +
ccctcttgccactaacctcttt

SEQ ID NO: 205800 - DNA, 22 bp, Artificial Sequence
  Synthetic oligonucleotide; TTC chr2 60531065 60531086 60531082 60531087 +
cctcttgccactaacctctttt

SEQ ID NO: 205801 - DNA, 22 bp, Artificial Sequence
  Synthetic oligonucleotide; CTC chr2 60531069 60531090 60531086 60531091 +
ttgccactaacctcttttcttt

SEQ ID NO: 205802 - DNA, 22 bp, Artificial Sequence
  Synthetic oligonucleotide; CTT chr2 60531071 60531092 60531088 60531093 +
gccactaacctcttttctttac

SEQ ID NO: 205803 - DNA, 22 bp, Artificial Sequence
  Synthetic oligonucleotide; TTG chr2 60531072 60531093 60531089 60531094 +
ccactaacctcttttctttacc

SEQ ID NO: 205804 - DNA, 22 bp, Artificial Sequence
  Synthetic oligonucleotide; CTA chr2 60531078 60531099 60531095 60531100 +
acctcttttctttaccaccttc

SEQ ID NO: 205805 - DNA, 22 bp, Artificial Sequence
  Synthetic oligonucleotide; CTC chr2 60531083 60531104 60531100 60531105 +
ttttctttaccaccttctccgg

SEQ ID NO: 205806 - DNA, 22 bp, Artificial Sequence
  Synthetic oligonucleotide; CTT chr2 60531085 60531106 60531102 60531107 +
ttctttaccaccttctccggag

SEQ ID NO: 205807 - DNA, 22 bp, Artificial Sequence
  Synthetic oligonucleotide; TTT chr2 60531086 60531107 60531103 60531108 +
tctttaccaccttctccggagc

SEQ ID NO: 205808 - DNA, 22 bp, Artificial Sequence
  Synthetic oligonucleotide; TTT chr2 60531087 60531108 60531104 60531109 +
ctttaccaccttctccggagca

SEQ ID NO: 205809 - DNA, 22 bp, Artificial Sequence
  Synthetic oligonucleotide; TTC chr2 60531088 60531109 60531105 60531110 +
tttaccaccttctccggagcag

SEQ ID NO: 205810 - DNA, 22 bp, Artificial Sequence
  Synthetic oligonucleotide; CTT chr2 60531090 60531111 60531107 60531112 +
taccaccttctccggagcagat

SEQ ID NO: 205811 - DNA, 22 bp, Artificial Sequence
  Synthetic oligonucleotide; TTT chr2 60531091 60531112 60531108 60531113 +
accaccttctccggagcagatg

SEQ ID NO: 205812 - DNA, 22 bp, Artificial Sequence
  Synthetic oligonucleotide; TTA chr2 60531092 60531113 60531109 60531114 +
ccaccttctccggagcagatgg

SEQ ID NO: 205813 - DNA, 22 bp, Artificial Sequence
  Synthetic oligonucleotide; CTT chr2 60531099 60531120 60531116 60531121 +
ctccggagcagatggacttgac

SEQ ID NO: 205814 - DNA, 22 bp, Artificial Sequence
  Synthetic oligonucleotide; TTC chr2 60531100 60531121 60531117 60531122 +
tccggagcagatggacttgacc

SEQ ID NO: 205815 - DNA, 22 bp, Artificial Sequence
  Synthetic oligonucleotide; CTC chr2 60531102 60531123 60531119 60531124 +
cggagcagatggacttgaccac

SEQ ID NO: 205816 - DNA, 22 bp, Artificial Sequence
  Synthetic oligonucleotide; CTT chr2 60531118 60531139 60531135 60531140 +
gaccactttgcttaagcccctc

SEQ ID NO: 205817 - DNA, 22 bp, Artificial Sequence
  Synthetic oligonucleotide; TTG chr2 60531119 60531140 60531136 60531141 +
accactttgcttaagcccctcc

SEQ ID NO: 205818 - DNA, 22 bp, Artificial Sequence
  Synthetic oligonucleotide; CTT chr2 60531126 60531147 60531143 60531148 +
tgcttaagcccctcctggcaac

SEQ ID NO: 205819 - DNA, 22 bp, Artificial Sequence
  Synthetic oligonucleotide; TTT chr2 60531127 60531148 60531144 60531149 +
gcttaagcccctcctggcaacc

SEQ ID NO: 205820 - DNA, 22 bp, Artificial Sequence
  Synthetic oligonucleotide; TTG chr2 60531128 60531149 60531145 60531150 +
cttaagcccctcctggcaacct

SEQ ID NO: 205821 - DNA, 22 bp, Artificial Sequence
  Synthetic oligonucleotide; CTT chr2 60531131 60531152 60531148 60531153 +
aagcccctcctggcaacctcag

SEQ ID NO: 205822 - DNA, 22 bp, Artificial Sequence
  Synthetic oligonucleotide; TTA chr2 60531132 60531153 60531149 60531154 +
agcccctcctggcaacctcaga

SEQ ID NO: 205823 - DNA, 22 bp, Artificial Sequence
  Synthetic oligonucleotide; CTC chr2 60531140 60531161 60531157 60531162 +
ctggcaacctcagaaattagag

SEQ ID NO: 205824 - DNA, 22 bp, Artificial Sequence
  Synthetic oligonucleotide; CTG chr2 60531143 60531164 60531160 60531165 +
gcaacctcagaaattagagaaa

SEQ ID NO: 205825 - DNA, 22 bp, Artificial Sequence
  Synthetic oligonucleotide; CTC chr2 60531151 60531172 60531168 60531173 +
agaaattagagaaaaaaaaaaa

SEQ ID NO: 205826 - DNA, 22 bp, Artificial Sequence
  Synthetic oligonucleotide; TTA chr2 60531159 60531180 60531176 60531181 +
gagaaaaaaaaaaaaagagctc

SEQ ID NO: 205827 - DNA, 22 bp, Artificial Sequence
  Synthetic oligonucleotide; CTC chr2 60531181 60531202 60531198 60531203 +
ctggctaccctactccggtcca

SEQ ID NO: 205828 - DNA, 22 bp, Artificial Sequence
  Synthetic oligonucleotide; CTG chr2 60531184 60531205 60531201 60531206 +
gctaccctactccggtccaggt

SEQ ID NO: 205829 - DNA, 22 bp, Artificial Sequence
  Synthetic oligonucleotide; CTA chr2 60531188 60531209 60531205 60531210 +
ccctactccggtccaggttttt

SEQ ID NO: 205830 - DNA, 22 bp, Artificial Sequence
  Synthetic oligonucleotide; CTA chr2 60531193 60531214 60531210 60531215 +
ctccggtccaggtttttctcct

SEQ ID NO: 205831 - DNA, 22 bp, Artificial Sequence
  Synthetic oligonucleotide; CTC chr2 60531196 60531217 60531213 60531218 +
cggtccaggtttttctcctccc

SEQ ID NO: 205832 - DNA, 22 bp, Artificial Sequence
  Synthetic oligonucleotide; TTT chr2 60531208 60531229 60531225 60531230 +
ttctcctccctctgtgttgccc

SEQ ID NO: 205833 - DNA, 22 bp, Artificial Sequence
  Synthetic oligonucleotide; TTT chr2 60531209 60531230 60531226 60531231 +
tctcctccctctgtgttgcccg

SEQ ID NO: 205834 - DNA, 22 bp, Artificial Sequence
  Synthetic oligonucleotide; TTT chr2 60531210 60531231 60531227 60531232 +
ctcctccctctgtgttgcccga

SEQ ID NO: 205835 - DNA, 22 bp, Artificial Sequence
  Synthetic oligonucleotide; TTC chr2 60531211 60531232 60531228 60531233 +
tcctccctctgtgttgcccgac

SEQ ID NO: 205836 - DNA, 22 bp, Artificial Sequence
  Synthetic oligonucleotide; CTC chr2 60531213 60531234 60531230 60531235 +
ctccctctgtgttgcccgacgg

SEQ ID NO: 205837 - DNA, 22 bp, Artificial Sequence
  Synthetic oligonucleotide; CTC chr2 60531216 60531237 60531233 60531238 +
cctctgtgttgcccgacggtcc

SEQ ID NO: 205838 - DNA, 22 bp, Artificial Sequence
  Synthetic oligonucleotide; CTC chr2 60531220 60531241 60531237 60531242 +
tgtgttgcccgacggtcctgca

SEQ ID NO: 205839 - DNA, 22 bp, Artificial Sequence
  Synthetic oligonucleotide; CTG chr2 60531222 60531243 60531239 60531244 +
tgttgcccgacggtcctgcaca

SEQ ID NO: 205840 - DNA, 22 bp, Artificial Sequence
  Synthetic oligonucleotide; TTG chr2 60531227 60531248 60531244 60531249 +
cccgacggtcctgcacacacag

SEQ ID NO: 205841 - DNA, 22 bp, Artificial Sequence
  Synthetic oligonucleotide; CTG chr2 60531240 60531261 60531257 60531262 +
cacacacagacacaaatcccgt

SEQ ID NO: 205842 - DNA, 22 bp, Artificial Sequence
  Synthetic oligonucleotide; TTG chr2 60531264 60531285 60531281 60531286 +
gacccacagaatcttttcgacc

SEQ ID NO: 205843 - DNA, 22 bp, Artificial Sequence
  Synthetic oligonucleotide; CTT chr2 60531279 60531300 60531296 60531301 +
ttcgaccctctcacactaacac

SEQ ID NO: 205844 - DNA, 22 bp, Artificial Sequence
  Synthetic oligonucleotide; TTT chr2 60531280 60531301 60531297 60531302 +
tcgaccctctcacactaacact

SEQ ID NO: 205845 - DNA, 22 bp, Artificial Sequence
  Synthetic oligonucleotide; TTT chr2 60531281 60531302 60531298 60531303 +
cgaccctctcacactaacacta

SEQ ID NO: 205846 - DNA, 22 bp, Artificial Sequence
  Synthetic oligonucleotide; TTC chr2 60531282 60531303 60531299 60531304 +
gaccctctcacactaacactaa

SEQ ID NO: 205847 - DNA, 22 bp, Artificial Sequence
  Synthetic oligonucleotide; CTC chr2 60531289 60531310 60531306 60531311 +
tcacactaacactaaaccagaa

SEQ ID NO: 205848 - DNA, 22 bp, Artificial Sequence
  Synthetic oligonucleotide; CTC chr2 60531291 60531312 60531308 60531313 +
acactaacactaaaccagaaaa

SEQ ID NO: 205849 - DNA, 22 bp, Artificial Sequence
  Synthetic oligonucleotide; CTA chr2 60531297 60531318 60531314 60531319 +
acactaaaccagaaaataaatt

SEQ ID NO: 205850 - DNA, 22 bp, Artificial Sequence
  Synthetic oligonucleotide; CTA chr2 60531303 60531324 60531320 60531325 +
aaccagaaaataaattaaatac

SEQ ID NO: 205851 - DNA, 22 bp, Artificial Sequence
  Synthetic oligonucleotide; TTA chr2 60531320 60531341 60531337 60531342 +
aatactgggactgccccctcct

SEQ ID NO: 205852 - DNA, 22 bp, Artificial Sequence
  Synthetic oligonucleotide; CTG chr2 60531327 60531348 60531344 60531349 +
ggactgccccctcctttgcgtt

SEQ ID NO: 205853 - DNA, 22 bp, Artificial Sequence
  Synthetic oligonucleotide; CTG chr2 60531333 60531354 60531350 60531355 +
ccccctcctttgcgttctgcaa

SEQ ID NO: 205854 - DNA, 22 bp, Artificial Sequence
  Synthetic oligonucleotide; CTC chr2 60531340 60531361 60531357 60531362 +
ctttgcgttctgcaagaatatt

SEQ ID NO: 205855 - DNA, 22 bp, Artificial Sequence
  Synthetic oligonucleotide; CTT chr2 60531343 60531364 60531360 60531365 +
tgcgttctgcaagaatatttta

SEQ ID NO: 205856 - DNA, 22 bp, Artificial Sequence
  Synthetic oligonucleotide; TTT chr2 60531344 60531365 60531361 60531366 +
gcgttctgcaagaatattttaa

SEQ ID NO: 205857 - DNA, 22 bp, Artificial Sequence
  Synthetic oligonucleotide; TTG chr2 60531345 60531366 60531362 60531367 +
cgttctgcaagaatattttaag

SEQ ID NO: 205858 - DNA, 22 bp, Artificial Sequence
  Synthetic oligonucleotide; TTC chr2 60531350 60531371 60531367 60531372 +
tgcaagaatattttaagtgagt

SEQ ID NO: 205859 - DNA, 22 bp, Artificial Sequence
  Synthetic oligonucleotide; CTG chr2 60531352 60531373 60531369 60531374 +
caagaatattttaagtgagttt

SEQ ID NO: 205860 - DNA, 22 bp, Artificial Sequence
  Synthetic oligonucleotide; TTT chr2 60531363 60531384 60531380 60531385 +
taagtgagttttgttttaaatc

SEQ ID NO: 205861 - DNA, 22 bp, Artificial Sequence
  Synthetic oligonucleotide; TTT chr2 60531364 60531385 60531381 60531386 +
aagtgagttttgttttaaatca

SEQ ID NO: 205862 - DNA, 22 bp, Artificial Sequence
  Synthetic oligonucleotide; TTA chr2 60531365 60531386 60531382 60531387 +
agtgagttttgttttaaatcat

SEQ ID NO: 205863 - DNA, 22 bp, Artificial Sequence
  Synthetic oligonucleotide; TTT chr2 60531374 60531395 60531391 60531396 +
tgttttaaatcatatccattaa

SEQ ID NO: 205864 - DNA, 22 bp, Artificial Sequence
  Synthetic oligonucleotide; TTT chr2 60531375 60531396 60531392 60531397 +
gttttaaatcatatccattaat

SEQ ID NO: 205865 - DNA, 22 bp, Artificial Sequence
  Synthetic oligonucleotide; TTG chr2 60531376 60531397 60531393 60531398 +
ttttaaatcatatccattaatt

SEQ ID NO: 205866 - DNA, 22 bp, Artificial Sequence
  Synthetic oligonucleotide; TTT chr2 60531379 60531400 60531396 60531401 +
taaatcatatccattaatttac

SEQ ID NO: 205867 - DNA, 22 bp, Artificial Sequence
  Synthetic oligonucleotide; TTT chr2 60531380 60531401 60531397 60531402 +
aaatcatatccattaatttacc

SEQ ID NO: 205868 - DNA, 22 bp, Artificial Sequence
  Synthetic oligonucleotide; TTA chr2 60531381 60531402 60531398 60531403 +
aatcatatccattaatttaccc

SEQ ID NO: 205869 - DNA, 22 bp, Artificial Sequence
  Synthetic oligonucleotide; TTA chr2 60531395 60531416 60531412 60531417 +
atttaccctgacttgcaattaa

SEQ ID NO: 205870 - DNA, 22 bp, Artificial Sequence
  Synthetic oligonucleotide; TTT chr2 60531399 60531420 60531416 60531421 +
accctgacttgcaattaaatgc

SEQ ID NO: 205871 - DNA, 22 bp, Artificial Sequence
  Synthetic oligonucleotide; TTA chr2 60531400 60531421 60531417 60531422 +
ccctgacttgcaattaaatgca

SEQ ID NO: 205872 - DNA, 22 bp, Artificial Sequence
  Synthetic oligonucleotide; CTG chr2 60531405 60531426 60531422 60531427 +
acttgcaattaaatgcaagcac

SEQ ID NO: 205873 - DNA, 22 bp, Artificial Sequence
  Synthetic oligonucleotide; CTT chr2 60531409 60531430 60531426 60531431 +
gcaattaaatgcaagcacactt

SEQ ID NO: 205874 - DNA, 22 bp, Artificial Sequence
  Synthetic oligonucleotide; TTG chr2 60531410 60531431 60531427 60531432 +
caattaaatgcaagcacacttt

SEQ ID NO: 205875 - DNA, 22 bp, Artificial Sequence
  Synthetic oligonucleotide; TTA chr2 60531416 60531437 60531433 60531438 +
aatgcaagcacactttttacaa

SEQ ID NO: 205876 - DNA, 22 bp, Artificial Sequence
  Synthetic oligonucleotide; CTT chr2 60531431 60531452 60531448 60531453 +
tttacaaccagtacggaatgca

SEQ ID NO: 205877 - DNA, 22 bp, Artificial Sequence
  Synthetic oligonucleotide; TTT chr2 60531432 60531453 60531449 60531454 +
ttacaaccagtacggaatgcat

SEQ ID NO: 205878 - DNA, 22 bp, Artificial Sequence
  Synthetic oligonucleotide; TTT chr2 60531433 60531454 60531450 60531455 +
tacaaccagtacggaatgcatt

SEQ ID NO: 205879 - DNA, 22 bp, Artificial Sequence
  Synthetic oligonucleotide; TTT chr2 60531434 60531455 60531451 60531456 +
acaaccagtacggaatgcatta

SEQ ID NO: 205880 - DNA, 22 bp, Artificial Sequence
  Synthetic oligonucleotide; TTA chr2 60531435 60531456 60531452 60531457 +
caaccagtacggaatgcattaa

SEQ ID NO: 205881 - DNA, 22 bp, Artificial Sequence
  Synthetic oligonucleotide; TTA chr2 60531456 60531477 60531473 60531478 +
attataactacaaatggtcaaa

SEQ ID NO: 205882 - DNA, 22 bp, Artificial Sequence
  Synthetic oligonucleotide; TTA chr2 60531460 60531481 60531477 60531482 +
taactacaaatggtcaaatgag

SEQ ID NO: 205883 - DNA, 22 bp, Artificial Sequence
  Synthetic oligonucleotide; CTA chr2 60531466 60531487 60531483 60531488 +
caaatggtcaaatgagagcaag

SEQ ID NO: 205884 - DNA, 22 bp, Artificial Sequence
  Synthetic oligonucleotide; CTC chr2 60531495 60531516 60531512 60531517 +
caaaaaatattaataaaataca

SEQ ID NO: 205885 - DNA, 22 bp, Artificial Sequence
  Synthetic oligonucleotide; TTA chr2 60531507 60531528 60531524 60531529 +
ataaaatacataataaataata

SEQ ID NO: 205886 - DNA, 22 bp, Artificial Sequence
  Synthetic oligonucleotide; TTA chr2 60531532 60531553 60531549 60531554 +
atgaaacaaaaatagattcata

SEQ ID NO: 205887 - DNA, 22 bp, Artificial Sequence
  Synthetic oligonucleotide; TTC chr2 60531551 60531572 60531568 60531573 +
ataagccttggccagggctttt

SEQ ID NO: 205888 - DNA, 22 bp, Artificial Sequence
  Synthetic oligonucleotide; CTT chr2 60531560 60531581 60531577 60531582 +
ggccagggcttttattatttca

SEQ ID NO: 205889 - DNA, 22 bp, Artificial Sequence
  Synthetic oligonucleotide; TTG chr2 60531561 60531582 60531578 60531583 +
gccagggcttttattatttcat

SEQ ID NO: 205890 - DNA, 22 bp, Artificial Sequence
  Synthetic oligonucleotide; CTT chr2 60531571 60531592 60531588 60531593 +
ttattatttcatgcaaggggaa

SEQ ID NO: 205891 - DNA, 22 bp, Artificial Sequence
  Synthetic oligonucleotide; TTT chr2 60531572 60531593 60531589 60531594 +
tattatttcatgcaaggggaaa

SEQ ID NO: 205892 - DNA, 22 bp, Artificial Sequence
  Synthetic oligonucleotide; TTT chr2 60531573 60531594 60531590 60531595 +
attatttcatgcaaggggaaag

SEQ ID NO: 205893 - DNA, 22 bp, Artificial Sequence
  Synthetic oligonucleotide; TTA chr2 60531574 60531595 60531591 60531596 +
ttatttcatgcaaggggaaagt

SEQ ID NO: 205894 - DNA, 22 bp, Artificial Sequence
  Synthetic oligonucleotide; TTA chr2 60531577 60531598 60531594 60531599 +
tttcatgcaaggggaaagtcca

SEQ ID NO: 205895 - DNA, 22 bp, Artificial Sequence
  Synthetic oligonucleotide; TTT chr2 60531580 60531601 60531597 60531602 +
catgcaaggggaaagtccagcc

SEQ ID NO: 205896 - DNA, 22 bp, Artificial Sequence
  Synthetic oligonucleotide; TTC chr2 60531581 60531602 60531598 60531603 +
atgcaaggggaaagtccagcca

SEQ ID NO: 205897 - DNA, 22 bp, Artificial Sequence
  Synthetic oligonucleotide; CTT chr2 60531612 60531633 60531629 60531634 +
gctccatacactttggcaggac

SEQ ID NO: 205898 - DNA, 22 bp, Artificial Sequence
  Synthetic oligonucleotide; TTG chr2 60531613 60531634 60531630 60531635 +
ctccatacactttggcaggact

SEQ ID NO: 205899 - DNA, 22 bp, Artificial Sequence
  Synthetic oligonucleotide; CTC chr2 60531616 60531637 60531633 60531638 +
catacactttggcaggactcag

SEQ ID NO: 205900 - DNA, 22 bp, Artificial Sequence
  Synthetic oligonucleotide; CTT chr2 60531625 60531646 60531642 60531647 +
tggcaggactcagaccaaccac

SEQ ID NO: 205901 - DNA, 22 bp, Artificial Sequence
  Synthetic oligonucleotide; TTT chr2 60531626 60531647 60531643 60531648 +
ggcaggactcagaccaaccact

SEQ ID NO: 205902 - DNA, 22 bp, Artificial Sequence
  Synthetic oligonucleotide; TTG chr2 60531627 60531648 60531644 60531649 +
gcaggactcagaccaaccacta

SEQ ID NO: 205903 - DNA, 22 bp, Artificial Sequence
  Synthetic oligonucleotide; CTC chr2 60531636 60531657 60531653 60531658 +
agaccaaccactaccattaaac

SEQ ID NO: 205904 - DNA, 22 bp, Artificial Sequence
  Synthetic oligonucleotide; CTA chr2 60531649 60531670 60531666 60531671 +
ccattaaactcaagagcgtgtt

SEQ ID NO: 205905 - DNA, 22 bp, Artificial Sequence
  Synthetic oligonucleotide; TTA chr2 60531655 60531676 60531672 60531677 +
aactcaagagcgtgttttggca

SEQ ID NO: 205906 - DNA, 22 bp, Artificial Sequence
  Synthetic oligonucleotide; CTC chr2 60531660 60531681 60531677 60531682 +
aagagcgtgttttggcagtgcc

SEQ ID NO: 205907 - DNA, 22 bp, Artificial Sequence
  Synthetic oligonucleotide; TTT chr2 60531672 60531693 60531689 60531694 +
tggcagtgccctggcattgggg

SEQ ID NO: 205908 - DNA, 22 bp, Artificial Sequence
  Synthetic oligonucleotide; TTT chr2 60531673 60531694 60531690 60531695 +
ggcagtgccctggcattggggg

SEQ ID NO: 205909 - DNA, 22 bp, Artificial Sequence
  Synthetic oligonucleotide; TTG chr2 60531674 60531695 60531691 60531696 +
gcagtgccctggcattgggggg

SEQ ID NO: 205910 - DNA, 22 bp, Artificial Sequence
  Synthetic oligonucleotide; CTG chr2 60531685 60531706 60531702 60531707 +
gcattggggggccctgtgcaga

SEQ ID NO: 205911 - DNA, 22 bp, Artificial Sequence
  Synthetic oligonucleotide; TTG chr2 60531691 60531712 60531708 60531713 +
gggggccctgtgcagacaccac

SEQ ID NO: 205912 - DNA, 22 bp, Artificial Sequence
  Synthetic oligonucleotide; CTG chr2 60531701 60531722 60531718 60531723 +
tgcagacaccaccaggagacgc

SEQ ID NO: 205913 - DNA, 22 bp, Artificial Sequence
  Synthetic oligonucleotide; CTG chr2 60531725 60531746 60531742 60531747 +
accccagtacccaaggcagggt

SEQ ID NO: 205914 - DNA, 22 bp, Artificial Sequence
  Synthetic oligonucleotide; CTT chr2 60531759 60531780 60531776 60531781 +
attcagcctttccatgtggtcg

SEQ ID NO: 205915 - DNA, 22 bp, Artificial Sequence
  Synthetic oligonucleotide; TTA chr2 60531760 60531781 60531777 60531782 +
ttcagcctttccatgtggtcgg

SEQ ID NO: 205916 - DNA, 22 bp, Artificial Sequence
  Synthetic oligonucleotide; TTC chr2 60531763 60531784 60531780 60531785 +
agcctttccatgtggtcgggaa

SEQ ID NO: 205917 - DNA, 22 bp, Artificial Sequence
  Synthetic oligonucleotide; CTT chr2 60531769 60531790 60531786 60531791 +
tccatgtggtcgggaagttacc

SEQ ID NO: 205918 - DNA, 22 bp, Artificial Sequence
  Synthetic oligonucleotide; TTT chr2 60531770 60531791 60531787 60531792 +
ccatgtggtcgggaagttaccc

SEQ ID NO: 205919 - DNA, 22 bp, Artificial Sequence
  Synthetic oligonucleotide; TTC chr2 60531771 60531792 60531788 60531793 +
catgtggtcgggaagttaccca

SEQ ID NO: 205920 - DNA, 22 bp, Artificial Sequence
  Synthetic oligonucleotide; TTA chr2 60531789 60531810 60531806 60531811 +
cccacaggctgcttccctcttc

SEQ ID NO: 205921 - DNA, 22 bp, Artificial Sequence
  Synthetic oligonucleotide; CTG chr2 60531800 60531821 60531817 60531822 +
cttccctcttcctaaccaccct

SEQ ID NO: 205922 - DNA, 22 bp, Artificial Sequence
  Synthetic oligonucleotide; CTT chr2 60531803 60531824 60531820 60531825 +
ccctcttcctaaccaccctctc

SEQ ID NO: 205923 - DNA, 22 bp, Artificial Sequence
  Synthetic oligonucleotide; TTC chr2 60531804 60531825 60531821 60531826 +
cctcttcctaaccaccctctct

SEQ ID NO: 205924 - DNA, 22 bp, Artificial Sequence
  Synthetic oligonucleotide; CTC chr2 60531808 60531829 60531825 60531830 +
ttcctaaccaccctctctgccg

SEQ ID NO: 205925 - DNA, 22 bp, Artificial Sequence
  Synthetic oligonucleotide; CTT chr2 60531810 60531831 60531827 60531832 +
cctaaccaccctctctgccggc

SEQ ID NO: 205926 - DNA, 22 bp, Artificial Sequence
  Synthetic oligonucleotide; TTC chr2 60531811 60531832 60531828 60531833 +
ctaaccaccctctctgccggcc

SEQ ID NO: 205927 - DNA, 22 bp, Artificial Sequence
  Synthetic oligonucleotide; CTA chr2 60531814 60531835 60531831 60531836 +
accaccctctctgccggccgca

SEQ ID NO: 205928 - DNA, 22 bp, Artificial Sequence
  Synthetic oligonucleotide; CTC chr2 60531823 60531844 60531840 60531845 +
tctgccggccgcagctgttctg

SEQ ID NO: 205929 - DNA, 22 bp, Artificial Sequence
  Synthetic oligonucleotide; CTC chr2 60531825 60531846 60531842 60531847 +
tgccggccgcagctgttctgtc

SEQ ID NO: 205930 - DNA, 22 bp, Artificial Sequence
  Synthetic oligonucleotide; CTG chr2 60531827 60531848 60531844 60531849 +
ccggccgcagctgttctgtcag

SEQ ID NO: 205931 - DNA, 22 bp, Artificial Sequence
  Synthetic oligonucleotide; CTG chr2 60531840 60531861 60531857 60531862 +
ttctgtcagtgtccaccctgcc

SEQ ID NO: 205932 - DNA, 22 bp, Artificial Sequence
  Synthetic oligonucleotide; TTC chr2 60531843 60531864 60531860 60531865 +
tgtcagtgtccaccctgcccct

SEQ ID NO: 205933 - DNA, 22 bp, Artificial Sequence
  Synthetic oligonucleotide; CTG chr2 60531845 60531866 60531862 60531867 +
tcagtgtccaccctgcccctca

SEQ ID NO: 205934 - DNA, 22 bp, Artificial Sequence
  Synthetic oligonucleotide; CTG chr2 60531860 60531881 60531877 60531882 +
cccctcaaaggacaaatgaaat

SEQ ID NO: 205935 - DNA, 22 bp, Artificial Sequence
  Synthetic oligonucleotide; CTC chr2 60531866 60531887 60531883 60531888 +
aaaggacaaatgaaatccccca

SEQ ID NO: 205936 - DNA, 22 bp, Artificial Sequence
  Synthetic oligonucleotide; CTA chr2 60531914 60531935 60531931 60531936 +
aatgaagaactcaagactaggg

SEQ ID NO: 205937 - DNA, 22 bp, Artificial Sequence
  Synthetic oligonucleotide; CTC chr2 60531926 60531947 60531943 60531948 +
aagactagggcaccatgagcat

SEQ ID NO: 205938 - DNA, 22 bp, Artificial Sequence
  Synthetic oligonucleotide; CTA chr2 60531933 60531954 60531950 60531955 +
gggcaccatgagcatctgggtt

SEQ ID NO: 205939 - DNA, 22 bp, Artificial Sequence
  Synthetic oligonucleotide; CTG chr2 60531951 60531972 60531968 60531973 +
ggttaaggctcggaatcctgca

SEQ ID NO: 205940 - DNA, 22 bp, Artificial Sequence
  Synthetic oligonucleotide; TTA chr2 60531956 60531977 60531973 60531978 +
aggctcggaatcctgcaccagc

SEQ ID NO: 205941 - DNA, 22 bp, Artificial Sequence
  Synthetic oligonucleotide; CTC chr2 60531962 60531983 60531979 60531984 +
ggaatcctgcaccagcgttgga

SEQ ID NO: 205942 - DNA, 22 bp, Artificial Sequence
  Synthetic oligonucleotide; CTG chr2 60531971 60531992 60531988 60531993 +
caccagcgttggaagctgcctt

SEQ ID NO: 205943 - DNA, 22 bp, Artificial Sequence
  Synthetic oligonucleotide; TTG chr2 60531982 60532003 60531999 60532004 +
gaagctgcctttgttcctgcca

SEQ ID NO: 205944 - DNA, 22 bp, Artificial Sequence
  Synthetic oligonucleotide; CTG chr2 60531989 60532010 60532006 60532011 +
cctttgttcctgccacaccgcc

SEQ ID NO: 205945 - DNA, 22 bp, Artificial Sequence
  Synthetic oligonucleotide; CTT chr2 60531993 60532014 60532010 60532015 +
tgttcctgccacaccgccgggc

SEQ ID NO: 205946 - DNA, 22 bp, Artificial Sequence
  Synthetic oligonucleotide; TTT chr2 60531994 60532015 60532011 60532016 +
gttcctgccacaccgccgggcc

SEQ ID NO: 205947 - DNA, 22 bp, Artificial Sequence
  Synthetic oligonucleotide; TTG chr2 60531995 60532016 60532012 60532017 +
ttcctgccacaccgccgggccc

SEQ ID NO: 205948 - DNA, 22 bp, Artificial Sequence
  Synthetic oligonucleotide; TTC chr2 60531998 60532019 60532015 60532020 +
ctgccacaccgccgggcccctg

SEQ ID NO: 205949 - DNA, 22 bp, Artificial Sequence
  Synthetic oligonucleotide; CTG chr2 60532001 60532022 60532018 60532023 +
ccacaccgccgggcccctgcta

SEQ ID NO: 205950 - DNA, 22 bp, Artificial Sequence
  Synthetic oligonucleotide; CTG chr2 60532020 60532041 60532037 60532042 +
ctaacctgtctccacaacactc

SEQ ID NO: 205951 - DNA, 22 bp, Artificial Sequence
  Synthetic oligonucleotide; CTA chr2 60532023 60532044 60532040 60532045 +
acctgtctccacaacactcagc

SEQ ID NO: 205952 - DNA, 22 bp, Artificial Sequence
  Synthetic oligonucleotide; CTG chr2 60532028 60532049 60532045 60532050 +
tctccacaacactcagcctcac

SEQ ID NO: 205953 - DNA, 22 bp, Artificial Sequence
  Synthetic oligonucleotide; CTC chr2 60532032 60532053 60532049 60532054 +
cacaacactcagcctcacgcct

SEQ ID NO: 205954 - DNA, 22 bp, Artificial Sequence
  Synthetic oligonucleotide; CTC chr2 60532042 60532063 60532059 60532064 +
agcctcacgcctcaccccagca

SEQ ID NO: 205955 - DNA, 22 bp, Artificial Sequence
  Synthetic oligonucleotide; CTC chr2 60532048 60532069 60532065 60532070 +
acgcctcaccccagcactccct

SEQ ID NO: 205956 - DNA, 22 bp, Artificial Sequence
  Synthetic oligonucleotide; CTC chr2 60532055 60532076 60532072 60532077 +
accccagcactccctgcctctg

SEQ ID NO: 205957 - DNA, 22 bp, Artificial Sequence
  Synthetic oligonucleotide; CTC chr2 60532067 60532088 60532084 60532089 +
cctgcctctgcccctcccccca

SEQ ID NO: 205958 - DNA, 22 bp, Artificial Sequence
  Synthetic oligonucleotide; CTG chr2 60532071 60532092 60532088 60532093 +
cctctgcccctccccccaaatc

SEQ ID NO: 205959 - DNA, 22 bp, Artificial Sequence
  Synthetic oligonucleotide; CTC chr2 60532075 60532096 60532092 60532097 +
tgcccctccccccaaatccaac

SEQ ID NO: 205960 - DNA, 22 bp, Artificial Sequence
  Synthetic oligonucleotide; CTG chr2 60532077 60532098 60532094 60532099 +
cccctccccccaaatccaacac

SEQ ID NO: 205961 - DNA, 22 bp, Artificial Sequence
  Synthetic oligonucleotide; CTC chr2 60532083 60532104 60532100 60532105 +
cccccaaatccaacacacccac

SEQ ID NO: 205962 - DNA, 22 bp, Artificial Sequence
  Synthetic oligonucleotide; CTA chr2 60532121 60532142 60532138 60532143 +
attaagatcaggaagaaatttg

SEQ ID NO: 205963 - DNA, 22 bp, Artificial Sequence
  Synthetic oligonucleotide; TTA chr2 60532125 60532146 60532142 60532147 +
agatcaggaagaaatttgcatt

SEQ ID NO: 205964 - DNA, 22 bp, Artificial Sequence
  Synthetic oligonucleotide; TTT chr2 60532142 60532163 60532159 60532164 +
gcattttcttttcactgtaccc

SEQ ID NO: 205965 - DNA, 22 bp, Artificial Sequence
  Synthetic oligonucleotide; TTG chr2 60532143 60532164 60532160 60532165 +
cattttcttttcactgtacccc

SEQ ID NO: 205966 - DNA, 22 bp, Artificial Sequence
  Synthetic oligonucleotide; TTT chr2 60532148 60532169 60532165 60532170 +
tcttttcactgtacccccagta

SEQ ID NO: 205967 - DNA, 22 bp, Artificial Sequence
  Synthetic oligonucleotide; TTT chr2 60532149 60532170 60532166 60532171 +
cttttcactgtacccccagtaa

SEQ ID NO: 205968 - DNA, 22 bp, Artificial Sequence
  Synthetic oligonucleotide; TTC chr2 60532150 60532171 60532167 60532172 +
ttttcactgtacccccagtaat

SEQ ID NO: 205969 - DNA, 22 bp, Artificial Sequence
  Synthetic oligonucleotide; CTT chr2 60532152 60532173 60532169 60532174 +
ttcactgtacccccagtaatca

SEQ ID NO: 205970 - DNA, 22 bp, Artificial Sequence
  Synthetic oligonucleotide; TTT chr2 60532153 60532174 60532170 60532175 +
tcactgtacccccagtaatcac

SEQ ID NO: 205971 - DNA, 22 bp, Artificial Sequence
  Synthetic oligonucleotide; TTT chr2 60532154 60532175 60532171 60532176 +
cactgtacccccagtaatcaca

SEQ ID NO: 205972 - DNA, 22 bp, Artificial Sequence
  Synthetic oligonucleotide; TTC chr2 60532155 60532176 60532172 60532177 +
actgtacccccagtaatcacag

SEQ ID NO: 205973 - DNA, 22 bp, Artificial Sequence
  Synthetic oligonucleotide; CTG chr2 60532159 60532180 60532176 60532181 +
tacccccagtaatcacagaagt

SEQ ID NO: 205974 - DNA, 22 bp, Artificial Sequence
  Synthetic oligonucleotide; TTC chr2 60532183 60532204 60532200 60532205 +
ttcaaattttgagaattttgtt

SEQ ID NO: 205975 - DNA, 22 bp, Artificial Sequence
  Synthetic oligonucleotide; CTT chr2 60532185 60532206 60532202 60532207 +
caaattttgagaattttgttcc

SEQ ID NO: 205976 - DNA, 22 bp, Artificial Sequence
  Synthetic oligonucleotide; TTC chr2 60532186 60532207 60532203 60532208 +
aaattttgagaattttgttcct

SEQ ID NO: 205977 - DNA, 22 bp, Artificial Sequence
  Synthetic oligonucleotide; TTT chr2 60532192 60532213 60532209 60532214 +
tgagaattttgttcctctgcta

SEQ ID NO: 205978 - DNA, 22 bp, Artificial Sequence
  Synthetic oligonucleotide; TTT chr2 60532193 60532214 60532210 60532215 +
gagaattttgttcctctgctaa

SEQ ID NO: 205979 - DNA, 22 bp, Artificial Sequence
  Synthetic oligonucleotide; TTG chr2 60532194 60532215 60532211 60532216 +
agaattttgttcctctgctaat

SEQ ID NO: 205980 - DNA, 22 bp, Artificial Sequence
  Synthetic oligonucleotide; TTT chr2 60532201 60532222 60532218 60532223 +
tgttcctctgctaattatttcc

SEQ ID NO: 205981 - DNA, 22 bp, Artificial Sequence
  Synthetic oligonucleotide; TTT chr2 60532202 60532223 60532219 60532224 +
gttcctctgctaattatttccc

SEQ ID NO: 205982 - DNA, 22 bp, Artificial Sequence
  Synthetic oligonucleotide; TTG chr2 60532203 60532224 60532220 60532225 +
ttcctctgctaattatttccct

SEQ ID NO: 205983 - DNA, 22 bp, Artificial Sequence
  Synthetic oligonucleotide; TTC chr2 60532206 60532227 60532223 60532228 +
ctctgctaattatttccctcat

SEQ ID NO: 205984 - DNA, 22 bp, Artificial Sequence
  Synthetic oligonucleotide; CTC chr2 60532209 60532230 60532226 60532231 +
tgctaattatttccctcatttt

SEQ ID NO: 205985 - DNA, 22 bp, Artificial Sequence
  Synthetic oligonucleotide; CTG chr2 60532211 60532232 60532228 60532233 +
ctaattatttccctcattttgc

SEQ ID NO: 205986 - DNA, 22 bp, Artificial Sequence
  Synthetic oligonucleotide; CTA chr2 60532214 60532235 60532231 60532236 +
attatttccctcattttgcatt

SEQ ID NO: 205987 - DNA, 22 bp, Artificial Sequence
  Synthetic oligonucleotide; TTA chr2 60532218 60532239 60532235 60532240 +
tttccctcattttgcatttcaa

SEQ ID NO: 205988 - DNA, 22 bp, Artificial Sequence
  Synthetic oligonucleotide; TTT chr2 60532221 60532242 60532238 60532243 +
ccctcattttgcatttcaaggc

SEQ ID NO: 205989 - DNA, 22 bp, Artificial Sequence
  Synthetic oligonucleotide; TTC chr2 60532222 60532243 60532239 60532244 +
cctcattttgcatttcaaggca

SEQ ID NO: 205990 - DNA, 22 bp, Artificial Sequence
  Synthetic oligonucleotide; CTC chr2 60532226 60532247 60532243 60532248 +
attttgcatttcaaggcacaaa

SEQ ID NO: 205991 - DNA, 22 bp, Artificial Sequence
  Synthetic oligonucleotide; TTT chr2 60532230 60532251 60532247 60532252 +
tgcatttcaaggcacaaagaca

SEQ ID NO: 205992 - DNA, 22 bp, Artificial Sequence
  Synthetic oligonucleotide; TTT chr2 60532231 60532252 60532248 60532253 +
gcatttcaaggcacaaagacag

SEQ ID NO: 205993 - DNA, 22 bp, Artificial Sequence
  Synthetic oligonucleotide; TTG chr2 60532232 60532253 60532249 60532254 +
catttcaaggcacaaagacagt

SEQ ID NO: 205994 - DNA, 22 bp, Artificial Sequence
  Synthetic oligonucleotide; TTT chr2 60532237 60532258 60532254 60532259 +
caaggcacaaagacagtctatc

SEQ ID NO: 205995 - DNA, 22 bp, Artificial Sequence
  Synthetic oligonucleotide; TTC chr2 60532238 60532259 60532255 60532260 +
aaggcacaaagacagtctatct

SEQ ID NO: 205996 - DNA, 22 bp, Artificial Sequence
  Synthetic oligonucleotide; CTA chr2 60532257 60532278 60532274 60532279 +
tctcactggtggtctattaata

SEQ ID NO: 205997 - DNA, 22 bp, Artificial Sequence
  Synthetic oligonucleotide; CTC chr2 60532261 60532282 60532278 60532283 +
actggtggtctattaatagttt

SEQ ID NO: 205998 - DNA, 22 bp, Artificial Sequence
  Synthetic oligonucleotide; CTG chr2 60532265 60532286 60532282 60532287 +
gtggtctattaatagtttgaag

SEQ ID NO: 205999 - DNA, 22 bp, Artificial Sequence
  Synthetic oligonucleotide; CTA chr2 60532273 60532294 60532290 60532295 +
ttaatagtttgaagttttgagc

SEQ ID NO: 206000 - DNA, 22 bp, Artificial Sequence
  Synthetic oligonucleotide; TTA chr2 60532276 60532297 60532293 60532298 +
atagtttgaagttttgagcgtc

SEQ ID NO: 206001 - DNA, 22 bp, Artificial Sequence
  Synthetic oligonucleotide; TTT chr2 60532283 60532304 60532300 60532305 +
gaagttttgagcgtcagaaggt

SEQ ID NO: 206002 - DNA, 22 bp, Artificial Sequence
  Synthetic oligonucleotide; TTG chr2 60532284 60532305 60532301 60532306 +
aagttttgagcgtcagaaggtg

SEQ ID NO: 206003 - DNA, 22 bp, Artificial Sequence
  Synthetic oligonucleotide; TTT chr2 60532290 60532311 60532307 60532312 +
tgagcgtcagaaggtggttgtt

SEQ ID NO: 206004 - DNA, 22 bp, Artificial Sequence
  Synthetic oligonucleotide; TTT chr2 60532291 60532312 60532308 60532313 +
gagcgtcagaaggtggttgttg

SEQ ID NO: 206005 - DNA, 22 bp, Artificial Sequence
  Synthetic oligonucleotide; TTG chr2 60532292 60532313 60532309 60532314 +
agcgtcagaaggtggttgttgc

SEQ ID NO: 206006 - DNA, 22 bp, Artificial Sequence
  Synthetic oligonucleotide; TTG chr2 60532310 60532331 60532327 60532332 +
ttgctttttggtttttgggttt

SEQ ID NO: 206007 - DNA, 22 bp, Artificial Sequence
  Synthetic oligonucleotide; TTG chr2 60532313 60532334 60532330 60532335 +
ctttttggtttttgggtttttt

SEQ ID NO: 206008 - DNA, 22 bp, Artificial Sequence
  Synthetic oligonucleotide; CTT chr2 60532316 60532337 60532333 60532338 +
tttggtttttgggttttttttt

SEQ ID NO: 206009 - DNA, 22 bp, Artificial Sequence
  Synthetic oligonucleotide; TTT chr2 60532317 60532338 60532334 60532339 +
ttggtttttgggtttttttttt

SEQ ID NO: 206010 - DNA, 22 bp, Artificial Sequence
  Synthetic oligonucleotide; TTT chr2 60532318 60532339 60532335 60532340 +
tggtttttgggttttttttttt

SEQ ID NO: 206011 - DNA, 22 bp, Artificial Sequence
  Synthetic oligonucleotide; TTT chr2 60532319 60532340 60532336 60532341 +
ggtttttgggtttttttttttt

SEQ ID NO: 206012 - DNA, 22 bp, Artificial Sequence
  Synthetic oligonucleotide; TTG chr2 60532320 60532341 60532337 60532342 +
gtttttgggttttttttttttt

SEQ ID NO: 206013 - DNA, 22 bp, Artificial Sequence
  Synthetic oligonucleotide; TTT chr2 60532324 60532345 60532341 60532346 +
ttgggtttttttttttttcctt

SEQ ID NO: 206014 - DNA, 22 bp, Artificial Sequence
  Synthetic oligonucleotide; TTT chr2 60532325 60532346 60532342 60532347 +
tgggtttttttttttttccttt

SEQ ID NO: 206015 - DNA, 22 bp, Artificial Sequence
  Synthetic oligonucleotide; TTT chr2 60532326 60532347 60532343 60532348 +
gggtttttttttttttcctttt

SEQ ID NO: 206016 - DNA, 22 bp, Artificial Sequence
  Synthetic oligonucleotide; TTG chr2 60532327 60532348 60532344 60532349 +
ggtttttttttttttcctttta

SEQ ID NO: 206017 - DNA, 22 bp, Artificial Sequence
  Synthetic oligonucleotide; TTT chr2 60532332 60532353 60532349 60532354 +
ttttttttttccttttaaaact

SEQ ID NO: 206018 - DNA, 22 bp, Artificial Sequence
  Synthetic oligonucleotide; TTT chr2 60532333 60532354 60532350 60532355 +
tttttttttccttttaaaacta

SEQ ID NO: 206019 - DNA, 22 bp, Artificial Sequence
  Synthetic oligonucleotide; TTT chr2 60532334 60532355 60532351 60532356 +
ttttttttccttttaaaactat

SEQ ID NO: 206020 - DNA, 22 bp, Artificial Sequence
  Synthetic oligonucleotide; TTT chr2 60532335 60532356 60532352 60532357 +
tttttttccttttaaaactatt

SEQ ID NO: 206021 - DNA, 22 bp, Artificial Sequence
  Synthetic oligonucleotide; TTT chr2 60532336 60532357 60532353 60532358 +
ttttttccttttaaaactattc

SEQ ID NO: 206022 - DNA, 22 bp, Artificial Sequence
  Synthetic oligonucleotide; TTT chr2 60532337 60532358 60532354 60532359 +
tttttccttttaaaactattct

SEQ ID NO: 206023 - DNA, 22 bp, Artificial Sequence
  Synthetic oligonucleotide; TTT chr2 60532338 60532359 60532355 60532360 +
ttttccttttaaaactattctg

SEQ ID NO: 206024 - DNA, 22 bp, Artificial Sequence
  Synthetic oligonucleotide; TTT chr2 60532339 60532360 60532356 60532361 +
tttccttttaaaactattctgt

SEQ ID NO: 206025 - DNA, 22 bp, Artificial Sequence
  Synthetic oligonucleotide; TTT chr2 60532340 60532361 60532357 60532362 +
ttccttttaaaactattctgtc

SEQ ID NO: 206026 - DNA, 22 bp, Artificial Sequence
  Synthetic oligonucleotide; TTT chr2 60532341 60532362 60532358 60532363 +
tccttttaaaactattctgtca

SEQ ID NO: 206027 - DNA, 22 bp, Artificial Sequence
  Synthetic oligonucleotide; TTT chr2 60532342 60532363 60532359 60532364 +
ccttttaaaactattctgtcat

SEQ ID NO: 206028 - DNA, 22 bp, Artificial Sequence
  Synthetic oligonucleotide; TTC chr2 60532343 60532364 60532360 60532365 +
cttttaaaactattctgtcatt

SEQ ID NO: 206029 - DNA, 22 bp, Artificial Sequence
  Synthetic oligonucleotide; CTT chr2 60532346 60532367 60532363 60532368 +
ttaaaactattctgtcatttcc

SEQ ID NO: 206030 - DNA, 22 bp, Artificial Sequence
  Synthetic oligonucleotide; TTT chr2 60532347 60532368 60532364 60532369 +
taaaactattctgtcatttcca

SEQ ID NO: 206031 - DNA, 22 bp, Artificial Sequence
  Synthetic oligonucleotide; TTT chr2 60532348 60532369 60532365 60532370 +
aaaactattctgtcatttccag

SEQ ID NO: 206032 - DNA, 22 bp, Artificial Sequence
  Synthetic oligonucleotide; TTA chr2 60532349 60532370 60532366 60532371 +
aaactattctgtcatttccagt

SEQ ID NO: 206033 - DNA, 22 bp, Artificial Sequence
  Synthetic oligonucleotide; CTA chr2 60532355 60532376 60532372 60532377 +
ttctgtcatttccagtttttta

SEQ ID NO: 206034 - DNA, 22 bp, Artificial Sequence
  Synthetic oligonucleotide; TTC chr2 60532358 60532379 60532375 60532380 +
tgtcatttccagttttttaaaa

SEQ ID NO: 206035 - DNA, 22 bp, Artificial Sequence
  Synthetic oligonucleotide; CTG chr2 60532360 60532381 60532377 60532382 +
tcatttccagttttttaaaaag

SEQ ID NO: 206036 - DNA, 22 bp, Artificial Sequence
  Synthetic oligonucleotide; TTT chr2 60532366 60532387 60532383 60532388 +
ccagttttttaaaaaggttttg

SEQ ID NO: 206037 - DNA, 22 bp, Artificial Sequence
  Synthetic oligonucleotide; TTC chr2 60532367 60532388 60532384 60532389 +
cagttttttaaaaaggttttgt

SEQ ID NO: 206038 - DNA, 22 bp, Artificial Sequence
  Synthetic oligonucleotide; TTT chr2 60532373 60532394 60532390 60532395 +
tttaaaaaggttttgttttgtt

SEQ ID NO: 206039 - DNA, 22 bp, Artificial Sequence
  Synthetic oligonucleotide; TTT chr2 60532374 60532395 60532391 60532396 +
ttaaaaaggttttgttttgttt

SEQ ID NO: 206040 - DNA, 22 bp, Artificial Sequence
  Synthetic oligonucleotide; TTT chr2 60532375 60532396 60532392 60532397 +
taaaaaggttttgttttgtttt

SEQ ID NO: 206041 - DNA, 22 bp, Artificial Sequence
  Synthetic oligonucleotide; TTT chr2 60532376 60532397 60532393 60532398 +
aaaaaggttttgttttgttttg

SEQ ID NO: 206042 - DNA, 22 bp, Artificial Sequence
  Synthetic oligonucleotide; TTA chr2 60532377 60532398 60532394 60532399 +
aaaaggttttgttttgttttgc

SEQ ID NO: 206043 - DNA, 22 bp, Artificial Sequence
  Synthetic oligonucleotide; TTT chr2 60532386 60532407 60532403 60532408 +
tgttttgttttgctttgttttt

SEQ ID NO: 206044 - DNA, 22 bp, Artificial Sequence
  Synthetic oligonucleotide; TTT chr2 60532387 60532408 60532404 60532409 +
gttttgttttgctttgtttttt

SEQ ID NO: 206045 - DNA, 22 bp, Artificial Sequence
  Synthetic oligonucleotide; TTG chr2 60532388 60532409 60532405 60532410 +
ttttgttttgctttgttttttg

SEQ ID NO: 206046 - DNA, 22 bp, Artificial Sequence
  Synthetic oligonucleotide; TTT chr2 60532391 60532412 60532408 60532413 +
tgttttgctttgttttttgttt

SEQ ID NO: 206047 - DNA, 22 bp, Artificial Sequence
  Synthetic oligonucleotide; TTT chr2 60532392 60532413 60532409 60532414 +
gttttgctttgttttttgtttt

SEQ ID NO: 206048 - DNA, 22 bp, Artificial Sequence
  Synthetic oligonucleotide; TTG chr2 60532393 60532414 60532410 60532415 +
ttttgctttgttttttgttttt

SEQ ID NO: 206049 - DNA, 22 bp, Artificial Sequence
  Synthetic oligonucleotide; TTT chr2 60532396 60532417 60532413 60532418 +
tgctttgttttttgtttttttg

SEQ ID NO: 206050 - DNA, 22 bp, Artificial Sequence
  Synthetic oligonucleotide; TTT chr2 60532397 60532418 60532414 60532419 +
gctttgttttttgtttttttgt

SEQ ID NO: 206051 - DNA, 22 bp, Artificial Sequence
  Synthetic oligonucleotide; TTG chr2 60532398 60532419 60532415 60532420 +
ctttgttttttgtttttttgtt

SEQ ID NO: 206052 - DNA, 22 bp, Artificial Sequence
  Synthetic oligonucleotide; CTT chr2 60532401 60532422 60532418 60532423 +
tgttttttgtttttttgttttt

SEQ ID NO: 206053 - DNA, 22 bp, Artificial Sequence
  Synthetic oligonucleotide; TTT chr2 60532402 60532423 60532419 60532424 +
gttttttgtttttttgtttttc

SEQ ID NO: 206054 - DNA, 22 bp, Artificial Sequence
  Synthetic oligonucleotide; TTG chr2 60532403 60532424 60532420 60532425 +
ttttttgtttttttgtttttct

SEQ ID NO: 206055 - DNA, 22 bp, Artificial Sequence
  Synthetic oligonucleotide; TTT chr2 60532406 60532427 60532423 60532428 +
tttgtttttttgtttttctttt

SEQ ID NO: 206056 - DNA, 22 bp, Artificial Sequence
  Synthetic oligonucleotide; TTT chr2 60532407 60532428 60532424 60532429 +
ttgtttttttgtttttcttttt

SEQ ID NO: 206057 - DNA, 22 bp, Artificial Sequence
  Synthetic oligonucleotide; TTT chr2 60532408 60532429 60532425 60532430 +
tgtttttttgtttttctttttt

SEQ ID NO: 206058 - DNA, 22 bp, Artificial Sequence
  Synthetic oligonucleotide; TTT chr2 60532409 60532430 60532426 60532431 +
gtttttttgtttttcttttttt

SEQ ID NO: 206059 - DNA, 22 bp, Artificial Sequence
  Synthetic oligonucleotide; TTG chr2 60532410 60532431 60532427 60532432 +
tttttttgtttttctttttttg

SEQ ID NO: 206060 - DNA, 22 bp, Artificial Sequence
  Synthetic oligonucleotide; TTT chr2 60532413 60532434 60532430 60532435 +
ttttgtttttctttttttggtg

SEQ ID NO: 206061 - DNA, 22 bp, Artificial Sequence
  Synthetic oligonucleotide; TTT chr2 60532414 60532435 60532431 60532436 +
tttgtttttctttttttggtgg

SEQ ID NO: 206062 - DNA, 22 bp, Artificial Sequence
  Synthetic oligonucleotide; TTT chr2 60532415 60532436 60532432 60532437 +
ttgtttttctttttttggtggt

SEQ ID NO: 206063 - DNA, 22 bp, Artificial Sequence
  Synthetic oligonucleotide; TTT chr2 60532416 60532437 60532433 60532438 +
tgtttttctttttttggtggtg

SEQ ID NO: 206064 - DNA, 22 bp, Artificial Sequence
  Synthetic oligonucleotide; TTT chr2 60532417 60532438 60532434 60532439 +
gtttttctttttttggtggtgg

SEQ ID NO: 206065 - DNA, 22 bp, Artificial Sequence
  Synthetic oligonucleotide; TTG chr2 60532418 60532439 60532435 60532440 +
tttttctttttttggtggtggt

SEQ ID NO: 206066 - DNA, 22 bp, Artificial Sequence
  Synthetic oligonucleotide; TTT chr2 60532421 60532442 60532438 60532443 +
ttctttttttggtggtggtggc

SEQ ID NO: 206067 - DNA, 22 bp, Artificial Sequence
  Synthetic oligonucleotide; TTT chr2 60532422 60532443 60532439 60532444 +
tctttttttggtggtggtggcg

SEQ ID NO: 206068 - DNA, 22 bp, Artificial Sequence
  Synthetic oligonucleotide; TTT chr2 60532423 60532444 60532440 60532445 +
ctttttttggtggtggtggcgt

SEQ ID NO: 206069 - DNA, 22 bp, Artificial Sequence
  Synthetic oligonucleotide; TTC chr2 60532424 60532445 60532441 60532446 +
tttttttggtggtggtggcgtt

SEQ ID NO: 206070 - DNA, 22 bp, Artificial Sequence
  Synthetic oligonucleotide; CTT chr2 60532426 60532447 60532443 60532448 +
tttttggtggtggtggcgttaa

SEQ ID NO: 206071 - DNA, 22 bp, Artificial Sequence
  Synthetic oligonucleotide; TTT chr2 60532427 60532448 60532444 60532449 +
ttttggtggtggtggcgttaat

SEQ ID NO: 206072 - DNA, 22 bp, Artificial Sequence
  Synthetic oligonucleotide; TTT chr2 60532428 60532449 60532445 60532450 +
tttggtggtggtggcgttaatg

SEQ ID NO: 206073 - DNA, 22 bp, Artificial Sequence
  Synthetic oligonucleotide; TTT chr2 60532429 60532450 60532446 60532451 +
ttggtggtggtggcgttaatgt

SEQ ID NO: 206074 - DNA, 22 bp, Artificial Sequence
  Synthetic oligonucleotide; TTT chr2 60532430 60532451 60532447 60532452 +
tggtggtggtggcgttaatgtt

SEQ ID NO: 206075 - DNA, 22 bp, Artificial Sequence
  Synthetic oligonucleotide; TTT chr2 60532431 60532452 60532448 60532453 +
ggtggtggtggcgttaatgttt

SEQ ID NO: 206076 - DNA, 22 bp, Artificial Sequence
  Synthetic oligonucleotide; TTG chr2 60532432 60532453 60532449 60532454 +
gtggtggtggcgttaatgtttc

SEQ ID NO: 206077 - DNA, 22 bp, Artificial Sequence
  Synthetic oligonucleotide; TTA chr2 60532447 60532468 60532464 60532469 +
atgtttcttcagaaagacagct

SEQ ID NO: 206078 - DNA, 22 bp, Artificial Sequence
  Synthetic oligonucleotide; TTT chr2 60532453 60532474 60532470 60532475 +
cttcagaaagacagcttctggg

SEQ ID NO: 206079 - DNA, 22 bp, Artificial Sequence
  Synthetic oligonucleotide; TTC chr2 60532454 60532475 60532471 60532476 +
ttcagaaagacagcttctgggc

SEQ ID NO: 206080 - DNA, 22 bp, Artificial Sequence
  Synthetic oligonucleotide; CTT chr2 60532456 60532477 60532473 60532478 +
cagaaagacagcttctgggcca

SEQ ID NO: 206081 - DNA, 22 bp, Artificial Sequence
  Synthetic oligonucleotide; TTC chr2 60532457 60532478 60532474 60532479 +
agaaagacagcttctgggccac

SEQ ID NO: 206082 - DNA, 22 bp, Artificial Sequence
  Synthetic oligonucleotide; CTT chr2 60532470 60532491 60532487 60532492 +
ctgggccactctgggtattatg

SEQ ID NO: 206083 - DNA, 22 bp, Artificial Sequence
  Synthetic oligonucleotide; TTC chr2 60532471 60532492 60532488 60532493 +
tgggccactctgggtattatga

SEQ ID NO: 206084 - DNA, 22 bp, Artificial Sequence
  Synthetic oligonucleotide; CTG chr2 60532473 60532494 60532490 60532495 +
ggccactctgggtattatgatt

SEQ ID NO: 206085 - DNA, 22 bp, Artificial Sequence
  Synthetic oligonucleotide; CTC chr2 60532481 60532502 60532498 60532503 +
tgggtattatgatttggtttcc

SEQ ID NO: 206086 - DNA, 22 bp, Artificial Sequence
  Synthetic oligonucleotide; CTG chr2 60532483 60532504 60532500 60532505 +
ggtattatgatttggtttcccc

SEQ ID NO: 206087 - DNA, 22 bp, Artificial Sequence
  Synthetic oligonucleotide; TTA chr2 60532490 60532511 60532507 60532512 +
tgatttggtttcccccttacaa

SEQ ID NO: 206088 - DNA, 22 bp, Artificial Sequence
  Synthetic oligonucleotide; TTT chr2 60532496 60532517 60532513 60532518 +
ggtttcccccttacaatagtta

SEQ ID NO: 206089 - DNA, 22 bp, Artificial Sequence
  Synthetic oligonucleotide; TTG chr2 60532497 60532518 60532514 60532519 +
gtttcccccttacaatagttac

SEQ ID NO: 206090 - DNA, 22 bp, Artificial Sequence
  Synthetic oligonucleotide; TTT chr2 60532501 60532522 60532518 60532523 +
cccccttacaatagttactctc

SEQ ID NO: 206091 - DNA, 22 bp, Artificial Sequence
  Synthetic oligonucleotide; TTC chr2 60532502 60532523 60532519 60532524 +
ccccttacaatagttactctct

SEQ ID NO: 206092 - DNA, 22 bp, Artificial Sequence
  Synthetic oligonucleotide; CTT chr2 60532508 60532529 60532525 60532530 +
acaatagttactctctgcctgg

SEQ ID NO: 206093 - DNA, 22 bp, Artificial Sequence
  Synthetic oligonucleotide; TTA chr2 60532509 60532530 60532526 60532531 +
caatagttactctctgcctggt

SEQ ID NO: 206094 - DNA, 22 bp, Artificial Sequence
  Synthetic oligonucleotide; TTA chr2 60532518 60532539 60532535 60532540 +
ctctctgcctggtttactgatt

SEQ ID NO: 206095 - DNA, 22 bp, Artificial Sequence
  Synthetic oligonucleotide; CTC chr2 60532521 60532542 60532538 60532543 +
tctgcctggtttactgatttac

SEQ ID NO: 206096 - DNA, 22 bp, Artificial Sequence
  Synthetic oligonucleotide; CTC chr2 60532523 60532544 60532540 60532545 +
tgcctggtttactgatttacag

SEQ ID NO: 206097 - DNA, 22 bp, Artificial Sequence
  Synthetic oligonucleotide; CTG chr2 60532525 60532546 60532542 60532547 +
cctggtttactgatttacagaa

SEQ ID NO: 206098 - DNA, 22 bp, Artificial Sequence
  Synthetic oligonucleotide; CTG chr2 60532529 60532550 60532546 60532551 +
gtttactgatttacagaacctt

SEQ ID NO: 206099 - DNA, 22 bp, Artificial Sequence
  Synthetic oligonucleotide; TTT chr2 60532533 60532554 60532550 60532555 +
actgatttacagaaccttggta

SEQ ID NO: 206100 - DNA, 22 bp, Artificial Sequence
  Synthetic oligonucleotide; TTA chr2 60532534 60532555 60532551 60532556 +
ctgatttacagaaccttggtat

SEQ ID NO: 206101 - DNA, 22 bp, Artificial Sequence
  Synthetic oligonucleotide; CTG chr2 60532537 60532558 60532554 60532559 +
atttacagaaccttggtatgtg

SEQ ID NO: 206102 - DNA, 22 bp, Artificial Sequence
  Synthetic oligonucleotide; TTT chr2 60532541 60532562 60532558 60532563 +
acagaaccttggtatgtgaatg

SEQ ID NO: 206103 - DNA, 22 bp, Artificial Sequence
  Synthetic oligonucleotide; TTA chr2 60532542 60532563 60532559 60532564 +
cagaaccttggtatgtgaatgg

SEQ ID NO: 206104 - DNA, 22 bp, Artificial Sequence
  Synthetic oligonucleotide; CTT chr2 60532551 60532572 60532568 60532573 +
ggtatgtgaatggcgaaaaaga

SEQ ID NO: 206105 - DNA, 22 bp, Artificial Sequence
  Synthetic oligonucleotide; TTG chr2 60532552 60532573 60532569 60532574 +
gtatgtgaatggcgaaaaagaa

SEQ ID NO: 206106 - DNA, 22 bp, Artificial Sequence
  Synthetic oligonucleotide; TTC chr2 60532601 60532622 60532618 60532623 +
cttggcataaggatatgtttgc

SEQ ID NO: 206107 - DNA, 22 bp, Artificial Sequence
  Synthetic oligonucleotide; CTT chr2 60532604 60532625 60532621 60532626 +
ggcataaggatatgtttgctga

SEQ ID NO: 206108 - DNA, 22 bp, Artificial Sequence
  Synthetic oligonucleotide; TTG chr2 60532605 60532626 60532622 60532627 +
gcataaggatatgtttgctgat

SEQ ID NO: 206109 - DNA, 22 bp, Artificial Sequence
  Synthetic oligonucleotide; TTT chr2 60532621 60532642 60532638 60532643 +
gctgatcaaatttcagatcatg

SEQ ID NO: 206110 - DNA, 22 bp, Artificial Sequence
  Synthetic oligonucleotide; TTG chr2 60532622 60532643 60532639 60532644 +
ctgatcaaatttcagatcatgt

SEQ ID NO: 206111 - DNA, 22 bp, Artificial Sequence
  Synthetic oligonucleotide; CTG chr2 60532625 60532646 60532642 60532647 +
atcaaatttcagatcatgtgtt

SEQ ID NO: 206112 - DNA, 22 bp, Artificial Sequence
  Synthetic oligonucleotide; TTT chr2 60532634 60532655 60532651 60532656 +
cagatcatgtgttgttcattat

SEQ ID NO: 206113 - DNA, 22 bp, Artificial Sequence
  Synthetic oligonucleotide; TTC chr2 60532635 60532656 60532652 60532657 +
agatcatgtgttgttcattatt

SEQ ID NO: 206114 - DNA, 22 bp, Artificial Sequence
  Synthetic oligonucleotide; TTG chr2 60532648 60532669 60532665 60532670 +
ttcattattatgactttacttg

SEQ ID NO: 206115 - DNA, 22 bp, Artificial Sequence
  Synthetic oligonucleotide; TTC chr2 60532651 60532672 60532668 60532673 +
attattatgactttacttgaaa

SEQ ID NO: 206116 - DNA, 22 bp, Artificial Sequence
  Synthetic oligonucleotide; TTA chr2 60532655 60532676 60532672 60532677 +
ttatgactttacttgaaaaaca

SEQ ID NO: 206117 - DNA, 22 bp, Artificial Sequence
  Synthetic oligonucleotide; TTA chr2 60532658 60532679 60532675 60532680 +
tgactttacttgaaaaacagtt

SEQ ID NO: 206118 - DNA, 22 bp, Artificial Sequence
  Synthetic oligonucleotide; CTT chr2 60532664 60532685 60532681 60532686 +
tacttgaaaaacagtttgccac

SEQ ID NO: 206119 - DNA, 22 bp, Artificial Sequence
  Synthetic oligonucleotide; TTT chr2 60532665 60532686 60532682 60532687 +
acttgaaaaacagtttgccaca

SEQ ID NO: 206120 - DNA, 22 bp, Artificial Sequence
  Synthetic oligonucleotide; TTA chr2 60532666 60532687 60532683 60532688 +
cttgaaaaacagtttgccacag

SEQ ID NO: 206121 - DNA, 22 bp, Artificial Sequence
  Synthetic oligonucleotide; CTT chr2 60532669 60532690 60532686 60532691 +
gaaaaacagtttgccacagtga

SEQ ID NO: 206122 - DNA, 22 bp, Artificial Sequence
  Synthetic oligonucleotide; TTG chr2 60532670 60532691 60532687 60532692 +
aaaaacagtttgccacagtgag

SEQ ID NO: 206123 - DNA, 22 bp, Artificial Sequence
  Synthetic oligonucleotide; TTT chr2 60532681 60532702 60532698 60532703 +
gccacagtgagatggattcact

SEQ ID NO: 206124 - DNA, 22 bp, Artificial Sequence
  Synthetic oligonucleotide; TTG chr2 60532682 60532703 60532699 60532704 +
ccacagtgagatggattcactt

SEQ ID NO: 206125 - DNA, 22 bp, Artificial Sequence
  Synthetic oligonucleotide; TTC chr2 60532700 60532721 60532717 60532722 +
acttatatgctttctacccctc

SEQ ID NO: 206126 - DNA, 22 bp, Artificial Sequence
  Synthetic oligonucleotide; CTT chr2 60532704 60532725 60532721 60532726 +
atatgctttctacccctccact

SEQ ID NO: 206127 - DNA, 22 bp, Artificial Sequence
  Synthetic oligonucleotide; TTA chr2 60532705 60532726 60532722 60532727 +
tatgctttctacccctccactc

SEQ ID NO: 206128 - DNA, 22 bp, Artificial Sequence
  Synthetic oligonucleotide; CTT chr2 60532712 60532733 60532729 60532734 +
tctacccctccactccctttaa

SEQ ID NO: 206129 - DNA, 22 bp, Artificial Sequence
  Synthetic oligonucleotide; TTT chr2 60532713 60532734 60532730 60532735 +
ctacccctccactccctttaag

SEQ ID NO: 206130 - DNA, 22 bp, Artificial Sequence
  Synthetic oligonucleotide; TTC chr2 60532714 60532735 60532731 60532736 +
tacccctccactccctttaagt

SEQ ID NO: 206131 - DNA, 22 bp, Artificial Sequence
  Synthetic oligonucleotide; CTA chr2 60532716 60532737 60532733 60532738 +
cccctccactccctttaagtac

SEQ ID NO: 206132 - DNA, 22 bp, Artificial Sequence
  Synthetic oligonucleotide; CTC chr2 60532722 60532743 60532739 60532744 +
cactccctttaagtacttcgaa

SEQ ID NO: 206133 - DNA, 22 bp, Artificial Sequence
  Synthetic oligonucleotide; CTC chr2 60532727 60532748 60532744 60532749 +
cctttaagtacttcgaaaaaca

SEQ ID NO: 206134 - DNA, 22 bp, Artificial Sequence
  Synthetic oligonucleotide; CTT chr2 60532731 60532752 60532748 60532753 +
taagtacttcgaaaaacagtac

SEQ ID NO: 206135 - DNA, 22 bp, Artificial Sequence
  Synthetic oligonucleotide; TTT chr2 60532732 60532753 60532749 60532754 +
aagtacttcgaaaaacagtaca

SEQ ID NO: 206136 - DNA, 22 bp, Artificial Sequence
  Synthetic oligonucleotide; TTA chr2 60532733 60532754 60532750 60532755 +
agtacttcgaaaaacagtacaa

SEQ ID NO: 206137 - DNA, 22 bp, Artificial Sequence
  Synthetic oligonucleotide; CTT chr2 60532740 60532761 60532757 60532762 +
cgaaaaacagtacaattttttt

SEQ ID NO: 206138 - DNA, 22 bp, Artificial Sequence
  Synthetic oligonucleotide; TTC chr2 60532741 60532762 60532758 60532763 +
gaaaaacagtacaattttttta

SEQ ID NO: 206139 - DNA, 22 bp, Artificial Sequence
  Synthetic oligonucleotide; TTT chr2 60532758 60532779 60532775 60532780 +
ttttaaaggtagatttaaagca

SEQ ID NO: 206140 - DNA, 22 bp, Artificial Sequence
  Synthetic oligonucleotide; TTT chr2 60532759 60532780 60532776 60532781 +
tttaaaggtagatttaaagcat

SEQ ID NO: 206141 - DNA, 22 bp, Artificial Sequence
  Synthetic oligonucleotide; TTT chr2 60532760 60532781 60532777 60532782 +
ttaaaggtagatttaaagcatt

SEQ ID NO: 206142 - DNA, 22 bp, Artificial Sequence
  Synthetic oligonucleotide; TTT chr2 60532761 60532782 60532778 60532783 +
taaaggtagatttaaagcatta

SEQ ID NO: 206143 - DNA, 22 bp, Artificial Sequence
  Synthetic oligonucleotide; TTT chr2 60532762 60532783 60532779 60532784 +
aaaggtagatttaaagcattaa

SEQ ID NO: 206144 - DNA, 22 bp, Artificial Sequence
  Synthetic oligonucleotide; TTA chr2 60532763 60532784 60532780 60532785 +
aaggtagatttaaagcattaac

SEQ ID NO: 206145 - DNA, 22 bp, Artificial Sequence
  Synthetic oligonucleotide; TTT chr2 60532774 60532795 60532791 60532796 +
aaagcattaactggtttggatt

SEQ ID NO: 206146 - DNA, 22 bp, Artificial Sequence
  Synthetic oligonucleotide; TTA chr2 60532775 60532796 60532792 60532797 +
aagcattaactggtttggatta

SEQ ID NO: 206147 - DNA, 22 bp, Artificial Sequence
  Synthetic oligonucleotide; TTA chr2 60532783 60532804 60532800 60532805 +
actggtttggattaaaacaatg

SEQ ID NO: 206148 - DNA, 22 bp, Artificial Sequence
  Synthetic oligonucleotide; CTG chr2 60532787 60532808 60532804 60532809 +
gtttggattaaaacaatgtttc

SEQ ID NO: 206149 - DNA, 22 bp, Artificial Sequence
  Synthetic oligonucleotide; TTT chr2 60532791 60532812 60532808 60532813 +
ggattaaaacaatgtttcacca

SEQ ID NO: 206150 - DNA, 22 bp, Artificial Sequence
  Synthetic oligonucleotide; TTG chr2 60532792 60532813 60532809 60532814 +
gattaaaacaatgtttcaccat

SEQ ID NO: 206151 - DNA, 22 bp, Artificial Sequence
  Synthetic oligonucleotide; TTA chr2 60532797 60532818 60532814 60532819 +
aaacaatgtttcaccatctgta

SEQ ID NO: 206152 - DNA, 22 bp, Artificial Sequence
  Synthetic oligonucleotide; TTT chr2 60532808 60532829 60532825 60532830 +
caccatctgtaaattccctgaa

SEQ ID NO: 206153 - DNA, 22 bp, Artificial Sequence
  Synthetic oligonucleotide; TTC chr2 60532809 60532830 60532826 60532831 +
accatctgtaaattccctgaaa

SEQ ID NO: 206154 - DNA, 22 bp, Artificial Sequence
  Synthetic oligonucleotide; CTG chr2 60532817 60532838 60532834 60532839 +
taaattccctgaaaatacattt

SEQ ID NO: 206155 - DNA, 22 bp, Artificial Sequence
  Synthetic oligonucleotide; TTC chr2 60532824 60532845 60532841 60532846 +
cctgaaaatacattttcaaaag

SEQ ID NO: 206156 - DNA, 22 bp, Artificial Sequence
  Synthetic oligonucleotide; CTG chr2 60532828 60532849 60532845 60532850 +
aaaatacattttcaaaagactt

SEQ ID NO: 206157 - DNA, 22 bp, Artificial Sequence
  Synthetic oligonucleotide; TTT chr2 60532839 60532860 60532856 60532861 +
tcaaaagacttatgcaaagcca

SEQ ID NO: 206158 - DNA, 22 bp, Artificial Sequence
  Synthetic oligonucleotide; TTT chr2 60532840 60532861 60532857 60532862 +
caaaagacttatgcaaagccac

SEQ ID NO: 206159 - DNA, 22 bp, Artificial Sequence
  Synthetic oligonucleotide; TTC chr2 60532841 60532862 60532858 60532863 +
aaaagacttatgcaaagccaca

SEQ ID NO: 206160 - DNA, 22 bp, Artificial Sequence
  Synthetic oligonucleotide; CTT chr2 60532850 60532871 60532867 60532872 +
atgcaaagccacatgattttga

SEQ ID NO: 206161 - DNA, 22 bp, Artificial Sequence
  Synthetic oligonucleotide; TTA chr2 60532851 60532872 60532868 60532873 +
tgcaaagccacatgattttgaa

SEQ ID NO: 206162 - DNA, 22 bp, Artificial Sequence
  Synthetic oligonucleotide; TTT chr2 60532869 60532890 60532886 60532891 +
tgaaggagctaatgagattgtc

SEQ ID NO: 206163 - DNA, 22 bp, Artificial Sequence
  Synthetic oligonucleotide; TTT chr2 60532870 60532891 60532887 60532892 +
gaaggagctaatgagattgtcc

SEQ ID NO: 206164 - DNA, 22 bp, Artificial Sequence
  Synthetic oligonucleotide; TTG chr2 60532871 60532892 60532888 60532893 +
aaggagctaatgagattgtccc

SEQ ID NO: 206165 - DNA, 22 bp, Artificial Sequence
  Synthetic oligonucleotide; CTA chr2 60532880 60532901 60532897 60532902 +
atgagattgtcccaccaccaaa

SEQ ID NO: 206166 - DNA, 22 bp, Artificial Sequence
  Synthetic oligonucleotide; TTG chr2 60532889 60532910 60532906 60532911 +
tcccaccaccaaaatttaatgg

SEQ ID NO: 206167 - DNA, 22 bp, Artificial Sequence
  Synthetic oligonucleotide; TTT chr2 60532906 60532927 60532923 60532928 +
aatggtgacttaagaaattcta

SEQ ID NO: 206168 - DNA, 22 bp, Artificial Sequence
  Synthetic oligonucleotide; TTA chr2 60532907 60532928 60532924 60532929 +
atggtgacttaagaaattctaa

SEQ ID NO: 206169 - DNA, 22 bp, Artificial Sequence
  Synthetic oligonucleotide; CTT chr2 60532917 60532938 60532934 60532939 +
aagaaattctaatactttttat

SEQ ID NO: 206170 - DNA, 22 bp, Artificial Sequence
  Synthetic oligonucleotide; TTA chr2 60532918 60532939 60532935 60532940 +
agaaattctaatactttttatt

SEQ ID NO: 206171 - DNA, 22 bp, Artificial Sequence
  Synthetic oligonucleotide; TTC chr2 60532926 60532947 60532943 60532948 +
taatactttttatttacttcct

SEQ ID NO: 206172 - DNA, 22 bp, Artificial Sequence
  Synthetic oligonucleotide; CTA chr2 60532928 60532949 60532945 60532950 +
atactttttatttacttcctgt

SEQ ID NO: 206173 - DNA, 22 bp, Artificial Sequence
  Synthetic oligonucleotide; CTT chr2 60532934 60532955 60532951 60532956 +
tttatttacttcctgtagaatt

SEQ ID NO: 206174 - DNA, 22 bp, Artificial Sequence
  Synthetic oligonucleotide; TTT chr2 60532935 60532956 60532952 60532957 +
ttatttacttcctgtagaatta

SEQ ID NO: 206175 - DNA, 22 bp, Artificial Sequence
  Synthetic oligonucleotide; TTT chr2 60532936 60532957 60532953 60532958 +
tatttacttcctgtagaattat

SEQ ID NO: 206176 - DNA, 22 bp, Artificial Sequence
  Synthetic oligonucleotide; TTT chr2 60532937 60532958 60532954 60532959 +
atttacttcctgtagaattatt

SEQ ID NO: 206177 - DNA, 22 bp, Artificial Sequence
  Synthetic oligonucleotide; TTA chr2 60532938 60532959 60532955 60532960 +
tttacttcctgtagaattattt

SEQ ID NO: 206178 - DNA, 22 bp, Artificial Sequence
  Synthetic oligonucleotide; TTT chr2 60532941 60532962 60532958 60532963 +
acttcctgtagaattatttgtg

SEQ ID NO: 206179 - DNA, 22 bp, Artificial Sequence
  Synthetic oligonucleotide; TTA chr2 60532942 60532963 60532959 60532964 +
cttcctgtagaattatttgtgt

SEQ ID NO: 206180 - DNA, 22 bp, Artificial Sequence
  Synthetic oligonucleotide; CTT chr2 60532945 60532966 60532962 60532967 +
cctgtagaattatttgtgtact

SEQ ID NO: 206181 - DNA, 22 bp, Artificial Sequence
  Synthetic oligonucleotide; TTC chr2 60532946 60532967 60532963 60532968 +
ctgtagaattatttgtgtactt

SEQ ID NO: 206182 - DNA, 22 bp, Artificial Sequence
  Synthetic oligonucleotide; CTG chr2 60532949 60532970 60532966 60532971 +
tagaattatttgtgtacttgac

SEQ ID NO: 206183 - DNA, 22 bp, Artificial Sequence
  Synthetic oligonucleotide; TTA chr2 60532957 60532978 60532974 60532979 +
tttgtgtacttgacatttatac

SEQ ID NO: 206184 - DNA, 22 bp, Artificial Sequence
  Synthetic oligonucleotide; TTT chr2 60532960 60532981 60532977 60532982 +
gtgtacttgacatttatacagt

SEQ ID NO: 206185 - DNA, 22 bp, Artificial Sequence
  Synthetic oligonucleotide; TTG chr2 60532961 60532982 60532978 60532983 +
tgtacttgacatttatacagtt

SEQ ID NO: 206186 - DNA, 22 bp, Artificial Sequence
  Synthetic oligonucleotide; CTT chr2 60532968 60532989 60532985 60532990 +
gacatttatacagtttctccat

SEQ ID NO: 206187 - DNA, 22 bp, Artificial Sequence
  Synthetic oligonucleotide; TTG chr2 60532969 60532990 60532986 60532991 +
acatttatacagtttctccatt

SEQ ID NO: 206188 - DNA, 22 bp, Artificial Sequence
  Synthetic oligonucleotide; TTT chr2 60532975 60532996 60532992 60532997 +
atacagtttctccattatataa

SEQ ID NO: 206189 - DNA, 22 bp, Artificial Sequence
  Synthetic oligonucleotide; TTA chr2 60532976 60532997 60532993 60532998 +
tacagtttctccattatataac

SEQ ID NO: 206190 - DNA, 22 bp, Artificial Sequence
  Synthetic oligonucleotide; TTT chr2 60532984 60533005 60533001 60533006 +
ctccattatataacaatctacc

SEQ ID NO: 206191 - DNA, 22 bp, Artificial Sequence
  Synthetic oligonucleotide; TTC chr2 60532985 60533006 60533002 60533007 +
tccattatataacaatctaccc

SEQ ID NO: 206192 - DNA, 22 bp, Artificial Sequence
  Synthetic oligonucleotide; CTC chr2 60532987 60533008 60533004 60533009 +
cattatataacaatctaccctg

SEQ ID NO: 206193 - DNA, 22 bp, Artificial Sequence
  Synthetic oligonucleotide; TTA chr2 60532992 60533013 60533009 60533014 +
tataacaatctaccctgggtac

SEQ ID NO: 206194 - DNA, 22 bp, Artificial Sequence
  Synthetic oligonucleotide; CTA chr2 60533004 60533025 60533021 60533026 +
ccctgggtacactagattatgc

SEQ ID NO: 206195 - DNA, 22 bp, Artificial Sequence
  Synthetic oligonucleotide; CTG chr2 60533009 60533030 60533026 60533031 +
ggtacactagattatgccaatc

SEQ ID NO: 206196 - DNA, 22 bp, Artificial Sequence
  Synthetic oligonucleotide; CTA chr2 60533018 60533039 60533035 60533040 +
gattatgccaatctattagaat

SEQ ID NO: 206197 - DNA, 22 bp, Artificial Sequence
  Synthetic oligonucleotide; TTA chr2 60533023 60533044 60533040 60533045 +
tgccaatctattagaatgaaat

SEQ ID NO: 206198 - DNA, 22 bp, Artificial Sequence
  Synthetic oligonucleotide; CTA chr2 60533033 60533054 60533050 60533055 +
ttagaatgaaatttgtactcca

SEQ ID NO: 206199 - DNA, 22 bp, Artificial Sequence
  Synthetic oligonucleotide; TTA chr2 60533036 60533057 60533053 60533058 +
gaatgaaatttgtactccatat

SEQ ID NO: 206200 - DNA, 22 bp, Artificial Sequence
  Synthetic oligonucleotide; TTT chr2 60533047 60533068 60533064 60533069 +
gtactccatataagcagaagtt

SEQ ID NO: 206201 - DNA, 22 bp, Artificial Sequence
  Synthetic oligonucleotide; TTG chr2 60533048 60533069 60533065 60533070 +
tactccatataagcagaagttt

SEQ ID NO: 206202 - DNA, 22 bp, Artificial Sequence
  Synthetic oligonucleotide; CTC chr2 60533053 60533074 60533070 60533075 +
catataagcagaagtttccagt

SEQ ID NO: 206203 - DNA, 22 bp, Artificial Sequence
  Synthetic oligonucleotide; TTT chr2 60533070 60533091 60533087 60533092 +
ccagtcacttttgacttaccat

SEQ ID NO: 206204 - DNA, 22 bp, Artificial Sequence
  Synthetic oligonucleotide; TTC chr2 60533071 60533092 60533088 60533093 +
cagtcacttttgacttaccatt

SEQ ID NO: 206205 - DNA, 22 bp, Artificial Sequence
  Synthetic oligonucleotide; CTT chr2 60533080 60533101 60533097 60533102 +
ttgacttaccattatgtttcaa

SEQ ID NO: 206206 - DNA, 22 bp, Artificial Sequence
  Synthetic oligonucleotide; TTT chr2 60533081 60533102 60533098 60533103 +
tgacttaccattatgtttcaat

SEQ ID NO: 206207 - DNA, 22 bp, Artificial Sequence
  Synthetic oligonucleotide; TTT chr2 60533082 60533103 60533099 60533104 +
gacttaccattatgtttcaatg

SEQ ID NO: 206208 - DNA, 22 bp, Artificial Sequence
  Synthetic oligonucleotide; TTG chr2 60533083 60533104 60533100 60533105 +
acttaccattatgtttcaatgt

SEQ ID NO: 206209 - DNA, 22 bp, Artificial Sequence
  Synthetic oligonucleotide; CTT chr2 60533087 60533108 60533104 60533109 +
accattatgtttcaatgtaaag

SEQ ID NO: 206210 - DNA, 22 bp, Artificial Sequence
  Synthetic oligonucleotide; TTA chr2 60533088 60533109 60533105 60533110 +
ccattatgtttcaatgtaaagt

SEQ ID NO: 206211 - DNA, 22 bp, Artificial Sequence
  Synthetic oligonucleotide; TTA chr2 60533094 60533115 60533111 60533116 +
tgtttcaatgtaaagtgttatt

SEQ ID NO: 206212 - DNA, 22 bp, Artificial Sequence
  Synthetic oligonucleotide; TTT chr2 60533099 60533120 60533116 60533121 +
caatgtaaagtgttattatagc

SEQ ID NO: 206213 - DNA, 22 bp, Artificial Sequence
  Synthetic oligonucleotide; TTC chr2 60533100 60533121 60533117 60533122 +
aatgtaaagtgttattatagca

SEQ ID NO: 206214 - DNA, 22 bp, Artificial Sequence
  Synthetic oligonucleotide; TTA chr2 60533114 60533135 60533131 60533136 +
ttatagcagagtataaagcaca

SEQ ID NO: 206215 - DNA, 22 bp, Artificial Sequence
  Synthetic oligonucleotide; TTA chr2 60533117 60533138 60533134 60533139 +
tagcagagtataaagcacagct

SEQ ID NO: 206216 - DNA, 22 bp, Artificial Sequence
  Synthetic oligonucleotide; CTC chr2 60533140 60533161 60533157 60533162 +
ctccatgctcacgtttttaact

SEQ ID NO: 206217 - DNA, 22 bp, Artificial Sequence
  Synthetic oligonucleotide; CTC chr2 60533143 60533164 60533160 60533165 +
catgctcacgtttttaactcta

SEQ ID NO: 206218 - DNA, 22 bp, Artificial Sequence
  Synthetic oligonucleotide; CTC chr2 60533150 60533171 60533167 60533172 +
acgtttttaactctaatactgt

SEQ ID NO: 206219 - DNA, 22 bp, Artificial Sequence
  Synthetic oligonucleotide; TTT chr2 60533156 60533177 60533173 60533178 +
ttaactctaatactgtaatctt

SEQ ID NO: 206220 - DNA, 22 bp, Artificial Sequence
  Synthetic oligonucleotide; TTT chr2 60533157 60533178 60533174 60533179 +
taactctaatactgtaatcttt

SEQ ID NO: 206221 - DNA, 22 bp, Artificial Sequence
  Synthetic oligonucleotide; TTT chr2 60533158 60533179 60533175 60533180 +
aactctaatactgtaatctttc

SEQ ID NO: 206222 - DNA, 22 bp, Artificial Sequence
  Synthetic oligonucleotide; TTA chr2 60533159 60533180 60533176 60533181 +
actctaatactgtaatctttct

SEQ ID NO: 206223 - DNA, 22 bp, Artificial Sequence
  Synthetic oligonucleotide; CTC chr2 60533163 60533184 60533180 60533185 +
taatactgtaatctttcttgct

SEQ ID NO: 206224 - DNA, 22 bp, Artificial Sequence
  Synthetic oligonucleotide; CTA chr2 60533165 60533186 60533182 60533187 +
atactgtaatctttcttgctgc

SEQ ID NO: 206225 - DNA, 22 bp, Artificial Sequence
  Synthetic oligonucleotide; CTG chr2 60533171 60533192 60533188 60533193 +
taatctttcttgctgcttctag

SEQ ID NO: 206226 - DNA, 22 bp, Artificial Sequence
  Synthetic oligonucleotide; CTT chr2 60533178 60533199 60533195 60533200 +
tcttgctgcttctagggctgtg

SEQ ID NO: 206227 - DNA, 22 bp, Artificial Sequence
  Synthetic oligonucleotide; TTT chr2 60533179 60533200 60533196 60533201 +
cttgctgcttctagggctgtgt

SEQ ID NO: 206228 - DNA, 22 bp, Artificial Sequence
  Synthetic oligonucleotide; TTC chr2 60533180 60533201 60533197 60533202 +
ttgctgcttctagggctgtgtc

SEQ ID NO: 206229 - DNA, 22 bp, Artificial Sequence
  Synthetic oligonucleotide; CTT chr2 60533182 60533203 60533199 60533204 +
gctgcttctagggctgtgtcag

SEQ ID NO: 206230 - DNA, 22 bp, Artificial Sequence
  Synthetic oligonucleotide; TTG chr2 60533183 60533204 60533200 60533205 +
ctgcttctagggctgtgtcagt

SEQ ID NO: 206231 - DNA, 22 bp, Artificial Sequence
  Synthetic oligonucleotide; CTG chr2 60533186 60533207 60533203 60533208 +
cttctagggctgtgtcagtgtt

SEQ ID NO: 206232 - DNA, 22 bp, Artificial Sequence
  Synthetic oligonucleotide; CTT chr2 60533189 60533210 60533206 60533211 +
ctagggctgtgtcagtgtttac

SEQ ID NO: 206233 - DNA, 22 bp, Artificial Sequence
  Synthetic oligonucleotide; TTC chr2 60533190 60533211 60533207 60533212 +
tagggctgtgtcagtgtttaca

SEQ ID NO: 206234 - DNA, 22 bp, Artificial Sequence
  Synthetic oligonucleotide; CTA chr2 60533192 60533213 60533209 60533214 +
gggctgtgtcagtgtttacatt

SEQ ID NO: 206235 - DNA, 22 bp, Artificial Sequence
  Synthetic oligonucleotide; CTG chr2 60533198 60533219 60533215 60533220 +
tgtcagtgtttacattcctgga

SEQ ID NO: 206236 - DNA, 22 bp, Artificial Sequence
  Synthetic oligonucleotide; TTT chr2 60533209 60533230 60533226 60533231 +
acattcctggaagttaaataaa

SEQ ID NO: 206237 - DNA, 22 bp, Artificial Sequence
  Synthetic oligonucleotide; TTA chr2 60533210 60533231 60533227 60533232 +
cattcctggaagttaaataaac

SEQ ID NO: 206238 - DNA, 22 bp, Artificial Sequence
  Synthetic oligonucleotide; TTC chr2 60533215 60533236 60533232 60533237 +
ctggaagttaaataaaccgaca

SEQ ID NO: 206239 - DNA, 22 bp, Artificial Sequence
  Synthetic oligonucleotide; CTG chr2 60533218 60533239 60533235 60533240 +
gaagttaaataaaccgacatgg

SEQ ID NO: 206240 - DNA, 22 bp, Artificial Sequence
  Synthetic oligonucleotide; TTA chr2 60533225 60533246 60533242 60533247 +
aataaaccgacatggcaaaact

SEQ ID NO: 206241 - DNA, 22 bp, Artificial Sequence
  Synthetic oligonucleotide; CTC chr2 60533248 60533269 60533265 60533270 +
ctggatagactgaataataagg

SEQ ID NO: 206242 - DNA, 22 bp, Artificial Sequence
  Synthetic oligonucleotide; CTG chr2 60533251 60533272 60533268 60533273 +
gatagactgaataataaggctt

SEQ ID NO: 206243 - DNA, 22 bp, Artificial Sequence
  Synthetic oligonucleotide; CTG chr2 60533260 60533281 60533277 60533282 +
aataataaggcttgtgatgact

SEQ ID NO: 206244 - DNA, 22 bp, Artificial Sequence
  Synthetic oligonucleotide; CTT chr2 60533273 60533294 60533290 60533295 +
gtgatgactaaattgtttactt

SEQ ID NO: 206245 - DNA, 22 bp, Artificial Sequence
  Synthetic oligonucleotide; TTG chr2 60533274 60533295 60533291 60533296 +
tgatgactaaattgtttacttt

SEQ ID NO: 206246 - DNA, 22 bp, Artificial Sequence
  Synthetic oligonucleotide; CTA chr2 60533283 60533304 60533300 60533305 +
aattgtttactttttaccttgt

SEQ ID NO: 206247 - DNA, 22 bp, Artificial Sequence
  Synthetic oligonucleotide; TTG chr2 60533288 60533309 60533305 60533310 +
tttactttttaccttgttagga

SEQ ID NO: 206248 - DNA, 22 bp, Artificial Sequence
  Synthetic oligonucleotide; TTT chr2 60533291 60533312 60533308 60533313 +
actttttaccttgttaggatcc

SEQ ID NO: 206249 - DNA, 22 bp, Artificial Sequence
  Synthetic oligonucleotide; TTA chr2 60533292 60533313 60533309 60533314 +
ctttttaccttgttaggatccc

SEQ ID NO: 206250 - DNA, 22 bp, Artificial Sequence
  Synthetic oligonucleotide; CTT chr2 60533295 60533316 60533312 60533317 +
tttaccttgttaggatcccttt

SEQ ID NO: 206251 - DNA, 22 bp, Artificial Sequence
  Synthetic oligonucleotide; TTT chr2 60533296 60533317 60533313 60533318 +
ttaccttgttaggatccctttc

SEQ ID NO: 206252 - DNA, 22 bp, Artificial Sequence
  Synthetic oligonucleotide; TTT chr2 60533297 60533318 60533314 60533319 +
taccttgttaggatccctttct

SEQ ID NO: 206253 - DNA, 22 bp, Artificial Sequence
  Synthetic oligonucleotide; TTT chr2 60533298 60533319 60533315 60533320 +
accttgttaggatccctttctt

SEQ ID NO: 206254 - DNA, 22 bp, Artificial Sequence
  Synthetic oligonucleotide; TTA chr2 60533299 60533320 60533316 60533321 +
ccttgttaggatccctttcttg

SEQ ID NO: 206255 - DNA, 22 bp, Artificial Sequence
  Synthetic oligonucleotide; CTT chr2 60533303 60533324 60533320 60533325 +
gttaggatccctttcttgtaaa

SEQ ID NO: 206256 - DNA, 22 bp, Artificial Sequence
  Synthetic oligonucleotide; TTG chr2 60533304 60533325 60533321 60533326 +
ttaggatccctttcttgtaaag

SEQ ID NO: 206257 - DNA, 22 bp, Artificial Sequence
  Synthetic oligonucleotide; TTA chr2 60533307 60533328 60533324 60533329 +
ggatccctttcttgtaaagttt

SEQ ID NO: 206258 - DNA, 22 bp, Artificial Sequence
  Synthetic oligonucleotide; CTT chr2 60533316 60533337 60533333 60533338 +
tcttgtaaagtttgggggagag

SEQ ID NO: 206259 - DNA, 22 bp, Artificial Sequence
  Synthetic oligonucleotide; TTT chr2 60533317 60533338 60533334 60533339 +
cttgtaaagtttgggggagaga

SEQ ID NO: 206260 - DNA, 22 bp, Artificial Sequence
  Synthetic oligonucleotide; TTC chr2 60533318 60533339 60533335 60533340 +
ttgtaaagtttgggggagagag

SEQ ID NO: 206261 - DNA, 22 bp, Artificial Sequence
  Synthetic oligonucleotide; CTT chr2 60533320 60533341 60533337 60533342 +
gtaaagtttgggggagagagag

SEQ ID NO: 206262 - DNA, 22 bp, Artificial Sequence
  Synthetic oligonucleotide; TTG chr2 60533321 60533342 60533338 60533343 +
taaagtttgggggagagagaga

SEQ ID NO: 206263 - DNA, 22 bp, Artificial Sequence
  Synthetic oligonucleotide; TTT chr2 60533329 60533350 60533346 60533351 +
gggggagagagagaggagagaa

SEQ ID NO: 206264 - DNA, 22 bp, Artificial Sequence
  Synthetic oligonucleotide; TTG chr2 60533330 60533351 60533347 60533352 +
ggggagagagagaggagagaaa

SEQ ID NO: 206265 - DNA, 22 bp, Artificial Sequence
  Synthetic oligonucleotide; TTT chr2 60533399 60533420 60533416 60533421 +
atacactggcttccatatgtca

SEQ ID NO: 206266 - DNA, 22 bp, Artificial Sequence
  Synthetic oligonucleotide; TTA chr2 60533400 60533421 60533417 60533422 +
tacactggcttccatatgtcac

SEQ ID NO: 206267 - DNA, 22 bp, Artificial Sequence
  Synthetic oligonucleotide; CTG chr2 60533407 60533428 60533424 60533429 +
gcttccatatgtcacaaagacc

SEQ ID NO: 206268 - DNA, 22 bp, Artificial Sequence
  Synthetic oligonucleotide; CTT chr2 60533411 60533432 60533428 60533433 +
ccatatgtcacaaagaccttcc

SEQ ID NO: 206269 - DNA, 22 bp, Artificial Sequence
  Synthetic oligonucleotide; TTC chr2 60533412 60533433 60533429 60533434 +
catatgtcacaaagaccttcct

SEQ ID NO: 206270 - DNA, 22 bp, Artificial Sequence
  Synthetic oligonucleotide; CTT chr2 60533431 60533452 60533448 60533453 +
cctatccacagccaacgcgact

SEQ ID NO: 206271 - DNA, 22 bp, Artificial Sequence
  Synthetic oligonucleotide; TTC chr2 60533432 60533453 60533449 60533454 +
ctatccacagccaacgcgactg

SEQ ID NO: 206272 - DNA, 22 bp, Artificial Sequence
  Synthetic oligonucleotide; CTA chr2 60533435 60533456 60533452 60533457 +
tccacagccaacgcgactgaag

SEQ ID NO: 206273 - DNA, 22 bp, Artificial Sequence
  Synthetic oligonucleotide; CTG chr2 60533454 60533475 60533471 60533476 +
aagcagcatgcataagttagtg

SEQ ID NO: 206274 - DNA, 22 bp, Artificial Sequence
  Synthetic oligonucleotide; TTA chr2 60533473 60533494 60533490 60533495 +
gtgttgcttgttttgttttctt

SEQ ID NO: 206275 - DNA, 22 bp, Artificial Sequence
  Synthetic oligonucleotide; TTG chr2 60533479 60533500 60533496 60533501 +
cttgttttgttttcttaaatac

SEQ ID NO: 206276 - DNA, 22 bp, Artificial Sequence
  Synthetic oligonucleotide; CTT chr2 60533482 60533503 60533499 60533504 +
gttttgttttcttaaataccgg

SEQ ID NO: 206277 - DNA, 22 bp, Artificial Sequence
  Synthetic oligonucleotide; TTG chr2 60533483 60533504 60533500 60533505 +
ttttgttttcttaaataccggg

SEQ ID NO: 206278 - DNA, 22 bp, Artificial Sequence
  Synthetic oligonucleotide; TTT chr2 60533486 60533507 60533503 60533508 +
tgttttcttaaataccgggtca

SEQ ID NO: 206279 - DNA, 22 bp, Artificial Sequence
  Synthetic oligonucleotide; TTT chr2 60533487 60533508 60533504 60533509 +
gttttcttaaataccgggtcag

SEQ ID NO: 206280 - DNA, 22 bp, Artificial Sequence
  Synthetic oligonucleotide; TTG chr2 60533488 60533509 60533505 60533510 +
ttttcttaaataccgggtcagc

SEQ ID NO: 206281 - DNA, 22 bp, Artificial Sequence
  Synthetic oligonucleotide; TTT chr2 60533491 60533512 60533508 60533513 +
tcttaaataccgggtcagctga

SEQ ID NO: 206282 - DNA, 22 bp, Artificial Sequence
  Synthetic oligonucleotide; TTT chr2 60533492 60533513 60533509 60533514 +
cttaaataccgggtcagctgaa

SEQ ID NO: 206283 - DNA, 22 bp, Artificial Sequence
  Synthetic oligonucleotide; TTC chr2 60533493 60533514 60533510 60533515 +
ttaaataccgggtcagctgaat

SEQ ID NO: 206284 - DNA, 22 bp, Artificial Sequence
  Synthetic oligonucleotide; CTT chr2 60533495 60533516 60533512 60533517 +
aaataccgggtcagctgaatac

SEQ ID NO: 206285 - DNA, 22 bp, Artificial Sequence
  Synthetic oligonucleotide; TTA chr2 60533496 60533517 60533513 60533518 +
aataccgggtcagctgaatacc

SEQ ID NO: 206286 - DNA, 22 bp, Artificial Sequence
  Synthetic oligonucleotide; CTG chr2 60533512 60533533 60533529 60533534 +
aatacccctttctccactgccc

SEQ ID NO: 206287 - DNA, 22 bp, Artificial Sequence
  Synthetic oligonucleotide; CTT chr2 60533522 60533543 60533539 60533544 +
tctccactgcccactcagcccc

SEQ ID NO: 206288 - DNA, 22 bp, Artificial Sequence
  Synthetic oligonucleotide; TTT chr2 60533523 60533544 60533540 60533545 +
ctccactgcccactcagcccca

SEQ ID NO: 206289 - DNA, 22 bp, Artificial Sequence
  Synthetic oligonucleotide; TTC chr2 60533524 60533545 60533541 60533546 +
tccactgcccactcagccccac

SEQ ID NO: 206290 - DNA, 22 bp, Artificial Sequence
  Synthetic oligonucleotide; CTC chr2 60533526 60533547 60533543 60533548 +
cactgcccactcagccccacat

SEQ ID NO: 206291 - DNA, 22 bp, Artificial Sequence
  Synthetic oligonucleotide; CTG chr2 60533531 60533552 60533548 60533553 +
cccactcagccccacataaagt

SEQ ID NO: 206292 - DNA, 22 bp, Artificial Sequence
  Synthetic oligonucleotide; CTC chr2 60533538 60533559 60533555 60533560 +
agccccacataaagtatgaaga

SEQ ID NO: 206293 - DNA, 22 bp, Artificial Sequence
  Synthetic oligonucleotide; TTT chr2 60533563 60533584 60533580 60533585 +
tttttgaccattttcaaatagc

SEQ ID NO: 206294 - DNA, 22 bp, Artificial Sequence
  Synthetic oligonucleotide; TTT chr2 60533564 60533585 60533581 60533586 +
ttttgaccattttcaaatagca

SEQ ID NO: 206295 - DNA, 22 bp, Artificial Sequence
  Synthetic oligonucleotide; TTT chr2 60533565 60533586 60533582 60533587 +
tttgaccattttcaaatagcaa

SEQ ID NO: 206296 - DNA, 22 bp, Artificial Sequence
  Synthetic oligonucleotide; TTT chr2 60533566 60533587 60533583 60533588 +
ttgaccattttcaaatagcaaa

SEQ ID NO: 206297 - DNA, 22 bp, Artificial Sequence
  Synthetic oligonucleotide; TTT chr2 60533567 60533588 60533584 60533589 +
tgaccattttcaaatagcaaat

SEQ ID NO: 206298 - DNA, 22 bp, Artificial Sequence
  Synthetic oligonucleotide; TTT chr2 60533568 60533589 60533585 60533590 +
gaccattttcaaatagcaaatt

SEQ ID NO: 206299 - DNA, 22 bp, Artificial Sequence
  Synthetic oligonucleotide; TTG chr2 60533569 60533590 60533586 60533591 +
accattttcaaatagcaaatta

SEQ ID NO: 206300 - DNA, 22 bp, Artificial Sequence
  Synthetic oligonucleotide; TTT chr2 60533576 60533597 60533593 60533598 +
tcaaatagcaaattatccatta

SEQ ID NO: 206301 - DNA, 22 bp, Artificial Sequence
  Synthetic oligonucleotide; TTT chr2 60533577 60533598 60533594 60533599 +
caaatagcaaattatccattag

SEQ ID NO: 206302 - DNA, 22 bp, Artificial Sequence
  Synthetic oligonucleotide; TTC chr2 60533578 60533599 60533595 60533600 +
aaatagcaaattatccattaga

SEQ ID NO: 206303 - DNA, 22 bp, Artificial Sequence
  Synthetic oligonucleotide; TTA chr2 60533591 60533612 60533608 60533613 +
tccattagatttcatcatatct

SEQ ID NO: 206304 - DNA, 22 bp, Artificial Sequence
  Synthetic oligonucleotide; TTA chr2 60533598 60533619 60533615 60533620 +
gatttcatcatatcttagtaaa

SEQ ID NO: 206305 - DNA, 22 bp, Artificial Sequence
  Synthetic oligonucleotide; TTT chr2 60533603 60533624 60533620 60533625 +
catcatatcttagtaaagcaat

SEQ ID NO: 206306 - DNA, 22 bp, Artificial Sequence
  Synthetic oligonucleotide; TTC chr2 60533604 60533625 60533621 60533626 +
atcatatcttagtaaagcaatt

SEQ ID NO: 206307 - DNA, 22 bp, Artificial Sequence
  Synthetic oligonucleotide; CTT chr2 60533614 60533635 60533631 60533636 +
agtaaagcaattacatcaagaa

SEQ ID NO: 206308 - DNA, 22 bp, Artificial Sequence
  Synthetic oligonucleotide; TTA chr2 60533615 60533636 60533632 60533637 +
gtaaagcaattacatcaagaaa

SEQ ID NO: 206309 - DNA, 22 bp, Artificial Sequence
  Synthetic oligonucleotide; TTA chr2 60533627 60533648 60533644 60533649 +
catcaagaaaatgatagtgcgt

SEQ ID NO: 206310 - DNA, 22 bp, Artificial Sequence
  Synthetic oligonucleotide; TTA chr2 60533662 60533683 60533679 60533684 +
tgcatgcagttggccggagacc

SEQ ID NO: 206311 - DNA, 22 bp, Artificial Sequence
  Synthetic oligonucleotide; TTG chr2 60533674 60533695 60533691 60533696 +
gccggagaccaaaggctgtgaa

SEQ ID NO: 206312 - DNA, 22 bp, Artificial Sequence
  Synthetic oligonucleotide; CTG chr2 60533692 60533713 60533709 60533714 +
tgaagtcggagagggcagaatc

SEQ ID NO: 206313 - DNA, 22 bp, Artificial Sequence
  Synthetic oligonucleotide; CTC chr2 60533718 60533739 60533735 60533740 +
gacacacacaaataaaaagccc

SEQ ID NO: 206314 - DNA, 22 bp, Artificial Sequence
  Synthetic oligonucleotide; CTG chr2 60533743 60533764 60533760 60533765 +
gatctcacagatggaccccatc

SEQ ID NO: 206315 - DNA, 22 bp, Artificial Sequence
  Synthetic oligonucleotide; CTC chr2 60533749 60533770 60533766 60533771 +
acagatggaccccatcagttca

SEQ ID NO: 206316 - DNA, 22 bp, Artificial Sequence
  Synthetic oligonucleotide; TTC chr2 60533770 60533791 60533787 60533792 +
atcttactgcctaaaaagttca

SEQ ID NO: 206317 - DNA, 22 bp, Artificial Sequence
  Synthetic oligonucleotide; CTT chr2 60533775 60533796 60533792 60533797 +
actgcctaaaaagttcatgcac

SEQ ID NO: 206318 - DNA, 22 bp, Artificial Sequence
  Synthetic oligonucleotide; TTA chr2 60533776 60533797 60533793 60533798 +
ctgcctaaaaagttcatgcact

SEQ ID NO: 206319 - DNA, 22 bp, Artificial Sequence
  Synthetic oligonucleotide; CTG chr2 60533779 60533800 60533796 60533801 +
cctaaaaagttcatgcacttaa

SEQ ID NO: 206320 - DNA, 22 bp, Artificial Sequence
  Synthetic oligonucleotide; CTA chr2 60533783 60533804 60533800 60533805 +
aaaagttcatgcacttaataat

SEQ ID NO: 206321 - DNA, 22 bp, Artificial Sequence
  Synthetic oligonucleotide; TTC chr2 60533791 60533812 60533808 60533813 +
atgcacttaataatttatttgt

SEQ ID NO: 206322 - DNA, 22 bp, Artificial Sequence
  Synthetic oligonucleotide; CTT chr2 60533799 60533820 60533816 60533821 +
aataatttatttgtgttctgga

SEQ ID NO: 206323 - DNA, 22 bp, Artificial Sequence
  Synthetic oligonucleotide; TTA chr2 60533800 60533821 60533817 60533822 +
ataatttatttgtgttctggat

SEQ ID NO: 206324 - DNA, 22 bp, Artificial Sequence
  Synthetic oligonucleotide; TTT chr2 60533807 60533828 60533824 60533829 +
atttgtgttctggatactgttt

SEQ ID NO: 206325 - DNA, 22 bp, Artificial Sequence
  Synthetic oligonucleotide; TTA chr2 60533808 60533829 60533825 60533830 +
tttgtgttctggatactgtttc

SEQ ID NO: 206326 - DNA, 22 bp, Artificial Sequence
  Synthetic oligonucleotide; TTT chr2 60533811 60533832 60533828 60533833 +
gtgttctggatactgtttccca

SEQ ID NO: 206327 - DNA, 22 bp, Artificial Sequence
  Synthetic oligonucleotide; TTG chr2 60533812 60533833 60533829 60533834 +
tgttctggatactgtttcccag

SEQ ID NO: 206328 - DNA, 22 bp, Artificial Sequence
  Synthetic oligonucleotide; TTC chr2 60533817 60533838 60533834 60533839 +
tggatactgtttcccagctgaa

SEQ ID NO: 206329 - DNA, 22 bp, Artificial Sequence
  Synthetic oligonucleotide; CTG chr2 60533819 60533840 60533836 60533841 +
gatactgtttcccagctgaata

SEQ ID NO: 206330 - DNA, 22 bp, Artificial Sequence
  Synthetic oligonucleotide; CTG chr2 60533826 60533847 60533843 60533848 +
tttcccagctgaatattaacaa

SEQ ID NO: 206331 - DNA, 22 bp, Artificial Sequence
  Synthetic oligonucleotide; TTT chr2 60533829 60533850 60533846 60533851 +
cccagctgaatattaacaactt

SEQ ID NO: 206332 - DNA, 22 bp, Artificial Sequence
  Synthetic oligonucleotide; TTC chr2 60533830 60533851 60533847 60533852 +
ccagctgaatattaacaacttt

SEQ ID NO: 206333 - DNA, 22 bp, Artificial Sequence
  Synthetic oligonucleotide; CTG chr2 60533837 60533858 60533854 60533859 +
aatattaacaactttaaactga

SEQ ID NO: 206334 - DNA, 22 bp, Artificial Sequence
  Synthetic oligonucleotide; TTA chr2 60533844 60533865 60533861 60533866 +
acaactttaaactgaagcatgc

SEQ ID NO: 206335 - DNA, 22 bp, Artificial Sequence
  Synthetic oligonucleotide; CTT chr2 60533851 60533872 60533868 60533873 +
taaactgaagcatgcttttagc

SEQ ID NO: 206336 - DNA, 22 bp, Artificial Sequence
  Synthetic oligonucleotide; TTT chr2 60533852 60533873 60533869 60533874 +
aaactgaagcatgcttttagca

SEQ ID NO: 206337 - DNA, 22 bp, Artificial Sequence
  Synthetic oligonucleotide; TTA chr2 60533853 60533874 60533870 60533875 +
aactgaagcatgcttttagcat

SEQ ID NO: 206338 - DNA, 22 bp, Artificial Sequence
  Synthetic oligonucleotide; CTG chr2 60533858 60533879 60533875 60533880 +
aagcatgcttttagcatggtat

SEQ ID NO: 206339 - DNA, 22 bp, Artificial Sequence
  Synthetic oligonucleotide; CTT chr2 60533868 60533889 60533885 60533890 +
ttagcatggtatggatggaagt

SEQ ID NO: 206340 - DNA, 22 bp, Artificial Sequence
  Synthetic oligonucleotide; TTT chr2 60533869 60533890 60533886 60533891 +
tagcatggtatggatggaagtc

SEQ ID NO: 206341 - DNA, 22 bp, Artificial Sequence
  Synthetic oligonucleotide; TTT chr2 60533870 60533891 60533887 60533892 +
agcatggtatggatggaagtca

SEQ ID NO: 206342 - DNA, 22 bp, Artificial Sequence
  Synthetic oligonucleotide; TTA chr2 60533871 60533892 60533888 60533893 +
gcatggtatggatggaagtcac

SEQ ID NO: 206343 - DNA, 22 bp, Artificial Sequence
  Synthetic oligonucleotide; CTA chr2 60533908 60533929 60533925 60533930 +
ggtccctcggaggttaaaatta

SEQ ID NO: 206344 - DNA, 22 bp, Artificial Sequence
  Synthetic oligonucleotide; CTC chr2 60533916 60533937 60533933 60533938 +
ggaggttaaaattatagttatg

SEQ ID NO: 206345 - DNA, 22 bp, Artificial Sequence
  Synthetic oligonucleotide; TTA chr2 60533924 60533945 60533941 60533946 +
aaattatagttatgtttcttac

SEQ ID NO: 206346 - DNA, 22 bp, Artificial Sequence
  Synthetic oligonucleotide; TTA chr2 60533930 60533951 60533947 60533952 +
tagttatgtttcttacacactg

SEQ ID NO: 206347 - DNA, 22 bp, Artificial Sequence
  Synthetic oligonucleotide; TTA chr2 60533936 60533957 60533953 60533958 +
tgtttcttacacactgttcatt

SEQ ID NO: 206348 - DNA, 22 bp, Artificial Sequence
  Synthetic oligonucleotide; TTT chr2 60533941 60533962 60533958 60533963 +
cttacacactgttcattttcca

SEQ ID NO: 206349 - DNA, 22 bp, Artificial Sequence
  Synthetic oligonucleotide; TTC chr2 60533942 60533963 60533959 60533964 +
ttacacactgttcattttccat

SEQ ID NO: 206350 - DNA, 22 bp, Artificial Sequence
  Synthetic oligonucleotide; CTT chr2 60533944 60533965 60533961 60533966 +
acacactgttcattttccatca

SEQ ID NO: 206351 - DNA, 22 bp, Artificial Sequence
  Synthetic oligonucleotide; TTA chr2 60533945 60533966 60533962 60533967 +
cacactgttcattttccatcac

SEQ ID NO: 206352 - DNA, 22 bp, Artificial Sequence
  Synthetic oligonucleotide; CTG chr2 60533952 60533973 60533969 60533974 +
ttcattttccatcacaatttat

SEQ ID NO: 206353 - DNA, 22 bp, Artificial Sequence
  Synthetic oligonucleotide; TTC chr2 60533955 60533976 60533972 60533977 +
attttccatcacaatttatttt

SEQ ID NO: 206354 - DNA, 22 bp, Artificial Sequence
  Synthetic oligonucleotide; TTT chr2 60533959 60533980 60533976 60533981 +
tccatcacaatttattttcttt

SEQ ID NO: 206355 - DNA, 22 bp, Artificial Sequence
  Synthetic oligonucleotide; TTT chr2 60533960 60533981 60533977 60533982 +
ccatcacaatttattttctttc

SEQ ID NO: 206356 - DNA, 22 bp, Artificial Sequence
  Synthetic oligonucleotide; TTC chr2 60533961 60533982 60533978 60533983 +
catcacaatttattttctttca

SEQ ID NO: 206357 - DNA, 22 bp, Artificial Sequence
  Synthetic oligonucleotide; TTT chr2 60533972 60533993 60533989 60533994 +
attttctttcattaaacattcg

SEQ ID NO: 206358 - DNA, 22 bp, Artificial Sequence
  Synthetic oligonucleotide; TTA chr2 60533973 60533994 60533990 60533995 +
ttttctttcattaaacattcgt

SEQ ID NO: 206359 - DNA, 22 bp, Artificial Sequence
  Synthetic oligonucleotide; TTT chr2 60533976 60533997 60533993 60533998 +
tctttcattaaacattcgtttt

SEQ ID NO: 206360 - DNA, 22 bp, Artificial Sequence
  Synthetic oligonucleotide; TTT chr2 60533977 60533998 60533994 60533999 +
ctttcattaaacattcgtttta

SEQ ID NO: 206361 - DNA, 22 bp, Artificial Sequence
  Synthetic oligonucleotide; TTC chr2 60533978 60533999 60533995 60534000 +
tttcattaaacattcgttttaa

SEQ ID NO: 206362 - DNA, 22 bp, Artificial Sequence
  Synthetic oligonucleotide; CTT chr2 60533980 60534001 60533997 60534002 +
tcattaaacattcgttttaatc

SEQ ID NO: 206363 - DNA, 22 bp, Artificial Sequence
  Synthetic oligonucleotide; TTT chr2 60533981 60534002 60533998 60534003 +
cattaaacattcgttttaatca

SEQ ID NO: 206364 - DNA, 22 bp, Artificial Sequence
  Synthetic oligonucleotide; TTC chr2 60533982 60534003 60533999 60534004 +
attaaacattcgttttaatcag

SEQ ID NO: 206365 - DNA, 22 bp, Artificial Sequence
  Synthetic oligonucleotide; TTA chr2 60533986 60534007 60534003 60534008 +
aacattcgttttaatcagaata

SEQ ID NO: 206366 - DNA, 22 bp, Artificial Sequence
  Synthetic oligonucleotide; TTC chr2 60533993 60534014 60534010 60534015 +
gttttaatcagaatatcagtta

SEQ ID NO: 206367 - DNA, 22 bp, Artificial Sequence
  Synthetic oligonucleotide; TTT chr2 60533997 60534018 60534014 60534019 +
taatcagaatatcagttacact

SEQ ID NO: 206368 - DNA, 22 bp, Artificial Sequence
  Synthetic oligonucleotide; TTT chr2 60533998 60534019 60534015 60534020 +
aatcagaatatcagttacactg

SEQ ID NO: 206369 - DNA, 22 bp, Artificial Sequence
  Synthetic oligonucleotide; TTA chr2 60533999 60534020 60534016 60534021 +
atcagaatatcagttacactgt

SEQ ID NO: 206370 - DNA, 22 bp, Artificial Sequence
  Synthetic oligonucleotide; TTA chr2 60534015 60534036 60534032 60534037 +
cactgttctgattctgcttgtt

SEQ ID NO: 206371 - DNA, 22 bp, Artificial Sequence
  Synthetic oligonucleotide; CTG chr2 60534020 60534041 60534037 60534042 +
ttctgattctgcttgttaacca

SEQ ID NO: 206372 - DNA, 22 bp, Artificial Sequence
  Synthetic oligonucleotide; TTC chr2 60534023 60534044 60534040 60534045 +
tgattctgcttgttaaccagtg

SEQ ID NO: 206373 - DNA, 22 bp, Artificial Sequence
  Synthetic oligonucleotide; CTG chr2 60534025 60534046 60534042 60534047 +
attctgcttgttaaccagtgat

SEQ ID NO: 206374 - DNA, 22 bp, Artificial Sequence
  Synthetic oligonucleotide; TTC chr2 60534029 60534050 60534046 60534051 +
tgcttgttaaccagtgataaac

SEQ ID NO: 206375 - DNA, 22 bp, Artificial Sequence
  Synthetic oligonucleotide; CTG chr2 60534031 60534052 60534048 60534053 +
cttgttaaccagtgataaactc

SEQ ID NO: 206376 - DNA, 22 bp, Artificial Sequence
  Synthetic oligonucleotide; CTT chr2 60534034 60534055 60534051 60534056 +
gttaaccagtgataaactcata

SEQ ID NO: 206377 - DNA, 22 bp, Artificial Sequence
  Synthetic oligonucleotide; TTG chr2 60534035 60534056 60534052 60534057 +
ttaaccagtgataaactcataa

SEQ ID NO: 206378 - DNA, 22 bp, Artificial Sequence
  Synthetic oligonucleotide; TTA chr2 60534038 60534059 60534055 60534060 +
accagtgataaactcataaacc

SEQ ID NO: 206379 - DNA, 22 bp, Artificial Sequence
  Synthetic oligonucleotide; CTC chr2 60534053 60534074 60534070 60534075 +
ataaaccaaagatgaacatcaa

SEQ ID NO: 206380 - DNA, 22 bp, Artificial Sequence
  Synthetic oligonucleotide; TTA chr2 60534092 60534113 60534109 60534114 +
ttcaacagcaaaggcaaacacc

SEQ ID NO: 206381 - DNA, 22 bp, Artificial Sequence
  Synthetic oligonucleotide; TTC chr2 60534095 60534116 60534112 60534117 +
aacagcaaaggcaaacaccaaa

SEQ ID NO: 206382 - DNA, 22 bp, Artificial Sequence
  Synthetic oligonucleotide; CTC chr2 60534128 60534149 60534145 60534150 +
tcaaaaatcggaaaccgttagt

SEQ ID NO: 206383 - DNA, 22 bp, Artificial Sequence
  Synthetic oligonucleotide; CTC chr2 60534130 60534151 60534147 60534152 +
aaaaatcggaaaccgttagtta

SEQ ID NO: 206384 - DNA, 22 bp, Artificial Sequence
  Synthetic oligonucleotide; TTA chr2 60534148 60534169 60534165 60534170 +
gttagcaccttgttttcaccac

SEQ ID NO: 206385 - DNA, 22 bp, Artificial Sequence
  Synthetic oligonucleotide; TTA chr2 60534152 60534173 60534169 60534174 +
gcaccttgttttcaccaccagg

SEQ ID NO: 206386 - DNA, 22 bp, Artificial Sequence
  Synthetic oligonucleotide; CTT chr2 60534159 60534180 60534176 60534181 +
gttttcaccaccagggcactcg

SEQ ID NO: 206387 - DNA, 22 bp, Artificial Sequence
  Synthetic oligonucleotide; TTG chr2 60534160 60534181 60534177 60534182 +
ttttcaccaccagggcactcgt

SEQ ID NO: 206388 - DNA, 22 bp, Artificial Sequence
  Synthetic oligonucleotide; TTT chr2 60534163 60534184 60534180 60534185 +
tcaccaccagggcactcgtgta

SEQ ID NO: 206389 - DNA, 22 bp, Artificial Sequence
  Synthetic oligonucleotide; TTT chr2 60534164 60534185 60534181 60534186 +
caccaccagggcactcgtgtac

SEQ ID NO: 206390 - DNA, 22 bp, Artificial Sequence
  Synthetic oligonucleotide; TTC chr2 60534165 60534186 60534182 60534187 +
accaccagggcactcgtgtacc

SEQ ID NO: 206391 - DNA, 22 bp, Artificial Sequence
  Synthetic oligonucleotide; CTC chr2 60534180 60534201 60534197 60534202 +
gtgtaccttgagggagacactg

SEQ ID NO: 206392 - DNA, 22 bp, Artificial Sequence
  Synthetic oligonucleotide; CTT chr2 60534189 60534210 60534206 60534211 +
gagggagacactgggagcccag

SEQ ID NO: 206393 - DNA, 22 bp, Artificial Sequence
  Synthetic oligonucleotide; TTG chr2 60534190 60534211 60534207 60534212 +
agggagacactgggagcccagg

SEQ ID NO: 206394 - DNA, 22 bp, Artificial Sequence
  Synthetic oligonucleotide; CTG chr2 60534202 60534223 60534219 60534224 +
ggagcccagggagcctggagac

SEQ ID NO: 206395 - DNA, 22 bp, Artificial Sequence
  Synthetic oligonucleotide; CTG chr2 60534219 60534240 60534236 60534241 +
gagaccaggatatactttggtg

SEQ ID NO: 206396 - DNA, 22 bp, Artificial Sequence
  Synthetic oligonucleotide; CTT chr2 60534236 60534257 60534253 60534258 +
tggtgatgaggggaggacacat

SEQ ID NO: 206397 - DNA, 22 bp, Artificial Sequence
  Synthetic oligonucleotide; TTT chr2 60534237 60534258 60534254 60534259 +
ggtgatgaggggaggacacatt

SEQ ID NO: 206398 - DNA, 22 bp, Artificial Sequence
  Synthetic oligonucleotide; TTG chr2 60534238 60534259 60534255 60534260 +
gtgatgaggggaggacacattg

SEQ ID NO: 206399 - DNA, 22 bp, Artificial Sequence
  Synthetic oligonucleotide; TTG chr2 60534260 60534281 60534277 60534282 +
tagctcagagcagcagctgaat

SEQ ID NO: 206400 - DNA, 22 bp, Artificial Sequence
  Synthetic oligonucleotide; CTC chr2 60534266 60534287 60534283 60534288 +
agagcagcagctgaatgagaaa

SEQ ID NO: 206401 - DNA, 22 bp, Artificial Sequence
  Synthetic oligonucleotide; CTG chr2 60534279 60534300 60534296 60534301 +
aatgagaaaacttacttgatct

SEQ ID NO: 206402 - DNA, 22 bp, Artificial Sequence
  Synthetic oligonucleotide; CTT chr2 60534292 60534313 60534309 60534314 +
acttgatctaaaagataaaaga

SEQ ID NO: 206403 - DNA, 22 bp, Artificial Sequence
  Synthetic oligonucleotide; TTA chr2 60534293 60534314 60534310 60534315 +
cttgatctaaaagataaaagag

SEQ ID NO: 206404 - DNA, 22 bp, Artificial Sequence
  Synthetic oligonucleotide; CTT chr2 60534296 60534317 60534313 60534318 +
gatctaaaagataaaagagtca

SEQ ID NO: 206405 - DNA, 22 bp, Artificial Sequence
  Synthetic oligonucleotide; TTG chr2 60534297 60534318 60534314 60534319 +
atctaaaagataaaagagtcag

SEQ ID NO: 206406 - DNA, 22 bp, Artificial Sequence
  Synthetic oligonucleotide; CTA chr2 60534302 60534323 60534319 60534324 +
aaagataaaagagtcagccaaa

SEQ ID NO: 206407 - DNA, 22 bp, Artificial Sequence
  Synthetic oligonucleotide; CTT chr2 60534341 60534362 60534358 60534363 +
taggtgccagccatctatctaa

SEQ ID NO: 206408 - DNA, 22 bp, Artificial Sequence
  Synthetic oligonucleotide; TTT chr2 60534342 60534363 60534359 60534364 +
aggtgccagccatctatctaaa

SEQ ID NO: 206409 - DNA, 22 bp, Artificial Sequence
  Synthetic oligonucleotide; TTA chr2 60534343 60534364 60534360 60534365 +
ggtgccagccatctatctaaag

SEQ ID NO: 206410 - DNA, 22 bp, Artificial Sequence
  Synthetic oligonucleotide; CTA chr2 60534358 60534379 60534375 60534380 +
tctaaagaagaaacctaaagca

SEQ ID NO: 206411 - DNA, 22 bp, Artificial Sequence
  Synthetic oligonucleotide; CTA chr2 60534362 60534383 60534379 60534384 +
aagaagaaacctaaagcattgt

SEQ ID NO: 206412 - DNA, 22 bp, Artificial Sequence
  Synthetic oligonucleotide; CTA chr2 60534375 60534396 60534392 60534397 +
aagcattgttagaaaggtttgt

SEQ ID NO: 206413 - DNA, 22 bp, Artificial Sequence
  Synthetic oligonucleotide; TTG chr2 60534383 60534404 60534400 60534405 +
ttagaaaggtttgtagttctgt

SEQ ID NO: 206414 - DNA, 22 bp, Artificial Sequence
  Synthetic oligonucleotide; TTA chr2 60534386 60534407 60534403 60534408 +
gaaaggtttgtagttctgtagc

SEQ ID NO: 206415 - DNA, 22 bp, Artificial Sequence
  Synthetic oligonucleotide; TTT chr2 60534395 60534416 60534412 60534417 +
gtagttctgtagccttccctcc

SEQ ID NO: 206416 - DNA, 22 bp, Artificial Sequence
  Synthetic oligonucleotide; TTG chr2 60534396 60534417 60534413 60534418 +
tagttctgtagccttccctcct

SEQ ID NO: 206417 - DNA, 22 bp, Artificial Sequence
  Synthetic oligonucleotide; TTC chr2 60534402 60534423 60534419 60534424 +
tgtagccttccctcctccaaag

SEQ ID NO: 206418 - DNA, 22 bp, Artificial Sequence
  Synthetic oligonucleotide; CTG chr2 60534404 60534425 60534421 60534426 +
tagccttccctcctccaaagga

SEQ ID NO: 206419 - DNA, 22 bp, Artificial Sequence
  Synthetic oligonucleotide; CTT chr2 60534411 60534432 60534428 60534433 +
ccctcctccaaaggaggaacct

SEQ ID NO: 206420 - DNA, 22 bp, Artificial Sequence
  Synthetic oligonucleotide; TTC chr2 60534412 60534433 60534429 60534434 +
cctcctccaaaggaggaacctg

SEQ ID NO: 206421 - DNA, 22 bp, Artificial Sequence
  Synthetic oligonucleotide; CTC chr2 60534416 60534437 60534433 60534438 +
ctccaaaggaggaacctgatgt

SEQ ID NO: 206422 - DNA, 22 bp, Artificial Sequence
  Synthetic oligonucleotide; CTC chr2 60534419 60534440 60534436 60534441 +
caaaggaggaacctgatgtctt

SEQ ID NO: 206423 - DNA, 22 bp, Artificial Sequence
  Synthetic oligonucleotide; CTG chr2 60534434 60534455 60534451 60534456 +
atgtcttaatacactataatag

SEQ ID NO: 206424 - DNA, 22 bp, Artificial Sequence
  Synthetic oligonucleotide; CTT chr2 60534441 60534462 60534458 60534463 +
aatacactataatagccaaggc

SEQ ID NO: 206425 - DNA, 22 bp, Artificial Sequence
  Synthetic oligonucleotide; TTA chr2 60534442 60534463 60534459 60534464 +
atacactataatagccaaggct

SEQ ID NO: 206426 - DNA, 22 bp, Artificial Sequence
  Synthetic oligonucleotide; CTA chr2 60534450 60534471 60534467 60534472 +
taatagccaaggcttcctgcca

SEQ ID NO: 206427 - DNA, 22 bp, Artificial Sequence
  Synthetic oligonucleotide; CTT chr2 60534465 60534486 60534482 60534487 +
cctgccatcaaactgctaacaa

SEQ ID NO: 206428 - DNA, 22 bp, Artificial Sequence
  Synthetic oligonucleotide; TTC chr2 60534466 60534487 60534483 60534488 +
ctgccatcaaactgctaacaat

SEQ ID NO: 206429 - DNA, 22 bp, Artificial Sequence
  Synthetic oligonucleotide; CTG chr2 60534469 60534490 60534486 60534491 +
ccatcaaactgctaacaataaa

SEQ ID NO: 206430 - DNA, 22 bp, Artificial Sequence
  Synthetic oligonucleotide; CTG chr2 60534480 60534501 60534497 60534502 +
ctaacaataaaactgccctgca

SEQ ID NO: 206431 - DNA, 22 bp, Artificial Sequence
  Synthetic oligonucleotide; CTA chr2 60534483 60534504 60534500 60534505 +
acaataaaactgccctgcaatg

SEQ ID NO: 206432 - DNA, 22 bp, Artificial Sequence
  Synthetic oligonucleotide; CTG chr2 60534495 60534516 60534512 60534517 +
ccctgcaatgttcgtggggaac

SEQ ID NO: 206433 - DNA, 22 bp, Artificial Sequence
  Synthetic oligonucleotide; CTG chr2 60534500 60534521 60534517 60534522 +
caatgttcgtggggaacagaaa

SEQ ID NO: 206434 - DNA, 22 bp, Artificial Sequence
  Synthetic oligonucleotide; TTC chr2 60534508 60534529 60534525 60534530 +
gtggggaacagaaacaggcaat

SEQ ID NO: 206435 - DNA, 22 bp, Artificial Sequence
  Synthetic oligonucleotide; TTT chr2 60534538 60534559 60534555 60534560 +
ctctatgtatctggaagtgcct

SEQ ID NO: 206436 - DNA, 22 bp, Artificial Sequence
  Synthetic oligonucleotide; TTC chr2 60534539 60534560 60534556 60534561 +
tctatgtatctggaagtgcctc

SEQ ID NO: 206437 - DNA, 22 bp, Artificial Sequence
  Synthetic oligonucleotide; CTC chr2 60534541 60534562 60534558 60534563 +
tatgtatctggaagtgcctcaa

SEQ ID NO: 206438 - DNA, 22 bp, Artificial Sequence
  Synthetic oligonucleotide; CTA chr2 60534543 60534564 60534560 60534565 +
tgtatctggaagtgcctcaatc

SEQ ID NO: 206439 - DNA, 22 bp, Artificial Sequence
  Synthetic oligonucleotide; CTG chr2 60534551 60534572 60534568 60534573 +
gaagtgcctcaatcatatactt

SEQ ID NO: 206440 - DNA, 22 bp, Artificial Sequence
  Synthetic oligonucleotide; CTC chr2 60534561 60534582 60534578 60534583 +
aatcatatacttaaattttaca

SEQ ID NO: 206441 - DNA, 22 bp, Artificial Sequence
  Synthetic oligonucleotide; CTT chr2 60534573 60534594 60534590 60534595 +
aaattttacagtcttctcccca

SEQ ID NO: 206442 - DNA, 22 bp, Artificial Sequence
  Synthetic oligonucleotide; TTA chr2 60534574 60534595 60534591 60534596 +
aattttacagtcttctccccaa

SEQ ID NO: 206443 - DNA, 22 bp, Artificial Sequence
  Synthetic oligonucleotide; TTT chr2 60534579 60534600 60534596 60534601 +
tacagtcttctccccaaatgag

SEQ ID NO: 206444 - DNA, 22 bp, Artificial Sequence
  Synthetic oligonucleotide; TTT chr2 60534580 60534601 60534597 60534602 +
acagtcttctccccaaatgaga

SEQ ID NO: 206445 - DNA, 22 bp, Artificial Sequence
  Synthetic oligonucleotide; TTA chr2 60534581 60534602 60534598 60534603 +
cagtcttctccccaaatgagaa

SEQ ID NO: 206446 - DNA, 22 bp, Artificial Sequence
  Synthetic oligonucleotide; CTT chr2 60534588 60534609 60534605 60534610 +
ctccccaaatgagaacgatttc

SEQ ID NO: 206447 - DNA, 22 bp, Artificial Sequence
  Synthetic oligonucleotide; TTC chr2 60534589 60534610 60534606 60534611 +
tccccaaatgagaacgatttcc

SEQ ID NO: 206448 - DNA, 22 bp, Artificial Sequence
  Synthetic oligonucleotide; CTC chr2 60534591 60534612 60534608 60534613 +
cccaaatgagaacgatttccag

SEQ ID NO: 206449 - DNA, 22 bp, Artificial Sequence
  Synthetic oligonucleotide; TTT chr2 60534609 60534630 60534626 60534631 +
ccagccaacacgttcacaaact

SEQ ID NO: 206450 - DNA, 22 bp, Artificial Sequence
  Synthetic oligonucleotide; TTC chr2 60534610 60534631 60534627 60534632 +
cagccaacacgttcacaaactg

SEQ ID NO: 206451 - DNA, 22 bp, Artificial Sequence
  Synthetic oligonucleotide; TTC chr2 60534624 60534645 60534641 60534646 +
acaaactgtacttaacgttaaa

SEQ ID NO: 206452 - DNA, 22 bp, Artificial Sequence
  Synthetic oligonucleotide; CTG chr2 60534632 60534653 60534649 60534654 +
tacttaacgttaaaagaaaacg

SEQ ID NO: 206453 - DNA, 22 bp, Artificial Sequence
  Synthetic oligonucleotide; CTT chr2 60534637 60534658 60534654 60534659 +
aacgttaaaagaaaacggataa

SEQ ID NO: 206454 - DNA, 22 bp, Artificial Sequence
  Synthetic oligonucleotide; TTA chr2 60534638 60534659 60534655 60534660 +
acgttaaaagaaaacggataaa

SEQ ID NO: 206455 - DNA, 22 bp, Artificial Sequence
  Synthetic oligonucleotide; TTA chr2 60534644 60534665 60534661 60534666 +
aaagaaaacggataaaacatat

SEQ ID NO: 206456 - DNA, 22 bp, Artificial Sequence
  Synthetic oligonucleotide; TTA chr2 60534673 60534694 60534690 60534695 +
ctcaaggttagacttctaattc

SEQ ID NO: 206457 - DNA, 22 bp, Artificial Sequence
  Synthetic oligonucleotide; CTC chr2 60534676 60534697 60534693 60534698 +
aaggttagacttctaattcctc

SEQ ID NO: 206458 - DNA, 22 bp, Artificial Sequence
  Synthetic oligonucleotide; TTA chr2 60534683 60534704 60534700 60534705 +
gacttctaattcctcaattcac

SEQ ID NO: 206459 - DNA, 22 bp, Artificial Sequence
  Synthetic oligonucleotide; CTT chr2 60534688 60534709 60534705 60534710 +
ctaattcctcaattcactaaag

SEQ ID NO: 206460 - DNA, 22 bp, Artificial Sequence
  Synthetic oligonucleotide; TTC chr2 60534689 60534710 60534706 60534711 +
taattcctcaattcactaaagg

SEQ ID NO: 206461 - DNA, 22 bp, Artificial Sequence
  Synthetic oligonucleotide; CTA chr2 60534691 60534712 60534708 60534713 +
attcctcaattcactaaaggaa

SEQ ID NO: 206462 - DNA, 22 bp, Artificial Sequence
  Synthetic oligonucleotide; TTC chr2 60534695 60534716 60534712 60534717 +
ctcaattcactaaaggaaactt

SEQ ID NO: 206463 - DNA, 22 bp, Artificial Sequence
  Synthetic oligonucleotide; CTC chr2 60534698 60534719 60534715 60534720 +
aattcactaaaggaaacttggc

SEQ ID NO: 206464 - DNA, 22 bp, Artificial Sequence
  Synthetic oligonucleotide; TTC chr2 60534703 60534724 60534720 60534725 +
actaaaggaaacttggcaagaa

SEQ ID NO: 206465 - DNA, 22 bp, Artificial Sequence
  Synthetic oligonucleotide; CTA chr2 60534707 60534728 60534724 60534729 +
aaggaaacttggcaagaagatg

SEQ ID NO: 206466 - DNA, 22 bp, Artificial Sequence
  Synthetic oligonucleotide; CTT chr2 60534717 60534738 60534734 60534739 +
ggcaagaagatgcatcattttg

SEQ ID NO: 206467 - DNA, 22 bp, Artificial Sequence
  Synthetic oligonucleotide; TTG chr2 60534718 60534739 60534735 60534740 +
gcaagaagatgcatcattttgc

SEQ ID NO: 206468 - DNA, 22 bp, Artificial Sequence
  Synthetic oligonucleotide; TTT chr2 60534737 60534758 60534754 60534759 +
tgctcctttctactggggcatc

SEQ ID NO: 206469 - DNA, 22 bp, Artificial Sequence
  Synthetic oligonucleotide; TTT chr2 60534738 60534759 60534755 60534760 +
gctcctttctactggggcatct

SEQ ID NO: 206470 - DNA, 22 bp, Artificial Sequence
  Synthetic oligonucleotide; TTG chr2 60534739 60534760 60534756 60534761 +
ctcctttctactggggcatctg

SEQ ID NO: 206471 - DNA, 22 bp, Artificial Sequence
  Synthetic oligonucleotide; CTC chr2 60534742 60534763 60534759 60534764 +
ctttctactggggcatctgagg

SEQ ID NO: 206472 - DNA, 22 bp, Artificial Sequence
  Synthetic oligonucleotide; CTT chr2 60534745 60534766 60534762 60534767 +
tctactggggcatctgaggagg

SEQ ID NO: 206473 - DNA, 22 bp, Artificial Sequence
  Synthetic oligonucleotide; TTT chr2 60534746 60534767 60534763 60534768 +
ctactggggcatctgaggagga

SEQ ID NO: 206474 - DNA, 22 bp, Artificial Sequence
  Synthetic oligonucleotide; TTC chr2 60534747 60534768 60534764 60534769 +
tactggggcatctgaggaggag

SEQ ID NO: 206475 - DNA, 22 bp, Artificial Sequence
  Synthetic oligonucleotide; CTA chr2 60534749 60534770 60534766 60534771 +
ctggggcatctgaggaggagag

SEQ ID NO: 206476 - DNA, 22 bp, Artificial Sequence
  Synthetic oligonucleotide; CTG chr2 60534752 60534773 60534769 60534774 +
gggcatctgaggaggagagcca

SEQ ID NO: 206477 - DNA, 22 bp, Artificial Sequence
  Synthetic oligonucleotide; CTG chr2 60534761 60534782 60534778 60534783 +
aggaggagagccactgaggcag

SEQ ID NO: 206478 - DNA, 22 bp, Artificial Sequence
  Synthetic oligonucleotide; CTG chr2 60534777 60534798 60534794 60534799 +
aggcagctaatacacaaaacat

SEQ ID NO: 206479 - DNA, 22 bp, Artificial Sequence
  Synthetic oligonucleotide; CTA chr2 60534786 60534807 60534803 60534808 +
atacacaaaacatgatcaaaag

SEQ ID NO: 206480 - DNA, 22 bp, Artificial Sequence
  Synthetic oligonucleotide; TTA chr2 60534814 60534835 60534831 60534836 +
acaacagcttcatatgcaaatt

SEQ ID NO: 206481 - DNA, 22 bp, Artificial Sequence
  Synthetic oligonucleotide; CTT chr2 60534824 60534845 60534841 60534846 +
catatgcaaattacattaatga

SEQ ID NO: 206482 - DNA, 22 bp, Artificial Sequence
  Synthetic oligonucleotide; TTC chr2 60534825 60534846 60534842 60534847 +
atatgcaaattacattaatgaa

SEQ ID NO: 206483 - DNA, 22 bp, Artificial Sequence
  Synthetic oligonucleotide; TTA chr2 60534837 60534858 60534854 60534859 +
cattaatgaaggagtgcaaagt

SEQ ID NO: 206484 - DNA, 22 bp, Artificial Sequence
  Synthetic oligonucleotide; TTA chr2 60534842 60534863 60534859 60534864 +
atgaaggagtgcaaagtcatca

SEQ ID NO: 206485 - DNA, 22 bp, Artificial Sequence
  Synthetic oligonucleotide; TTA chr2 60534873 60534894 60534890 60534895 +
aatatgtcaaatctcttggtga

SEQ ID NO: 206486 - DNA, 22 bp, Artificial Sequence
  Synthetic oligonucleotide; CTC chr2 60534888 60534909 60534905 60534910 +
ttggtgaacttttaatcttgag

SEQ ID NO: 206487 - DNA, 22 bp, Artificial Sequence
  Synthetic oligonucleotide; CTT chr2 60534890 60534911 60534907 60534912 +
ggtgaacttttaatcttgagaa

SEQ ID NO: 206488 - DNA, 22 bp, Artificial Sequence
  Synthetic oligonucleotide; TTG chr2 60534891 60534912 60534908 60534913 +
gtgaacttttaatcttgagaag

SEQ ID NO: 206489 - DNA, 22 bp, Artificial Sequence
  Synthetic oligonucleotide; CTT chr2 60534899 60534920 60534916 60534921 +
ttaatcttgagaagaaaaaaca

SEQ ID NO: 206490 - DNA, 22 bp, Artificial Sequence
  Synthetic oligonucleotide; TTT chr2 60534900 60534921 60534917 60534922 +
taatcttgagaagaaaaaacac

SEQ ID NO: 206491 - DNA, 22 bp, Artificial Sequence
  Synthetic oligonucleotide; TTT chr2 60534901 60534922 60534918 60534923 +
aatcttgagaagaaaaaacact

SEQ ID NO: 206492 - DNA, 22 bp, Artificial Sequence
  Synthetic oligonucleotide; TTA chr2 60534902 60534923 60534919 60534924 +
atcttgagaagaaaaaacactg

SEQ ID NO: 206493 - DNA, 22 bp, Artificial Sequence
  Synthetic oligonucleotide; CTT chr2 60534907 60534928 60534924 60534929 +
gagaagaaaaaacactgcttta

SEQ ID NO: 206494 - DNA, 22 bp, Artificial Sequence
  Synthetic oligonucleotide; TTG chr2 60534908 60534929 60534925 60534930 +
agaagaaaaaacactgctttaa

SEQ ID NO: 206495 - DNA, 22 bp, Artificial Sequence
  Synthetic oligonucleotide; CTG chr2 60534924 60534945 60534941 60534946 +
ctttaatttttttacatcatca

SEQ ID NO: 206496 - DNA, 22 bp, Artificial Sequence
  Synthetic oligonucleotide; CTT chr2 60534927 60534948 60534944 60534949 +
taatttttttacatcatcaatt

SEQ ID NO: 206497 - DNA, 22 bp, Artificial Sequence
  Synthetic oligonucleotide; TTT chr2 60534928 60534949 60534945 60534950 +
aatttttttacatcatcaattt

SEQ ID NO: 206498 - DNA, 22 bp, Artificial Sequence
  Synthetic oligonucleotide; TTA chr2 60534929 60534950 60534946 60534951 +
atttttttacatcatcaatttt

SEQ ID NO: 206499 - DNA, 22 bp, Artificial Sequence
  Synthetic oligonucleotide; TTT chr2 60534933 60534954 60534950 60534955 +
ttttacatcatcaattttgcaa

SEQ ID NO: 206500 - DNA, 22 bp, Artificial Sequence
  Synthetic oligonucleotide; TTT chr2 60534934 60534955 60534951 60534956 +
tttacatcatcaattttgcaag

SEQ ID NO: 206501 - DNA, 22 bp, Artificial Sequence
  Synthetic oligonucleotide; TTT chr2 60534935 60534956 60534952 60534957 +
ttacatcatcaattttgcaaga

SEQ ID NO: 206502 - DNA, 22 bp, Artificial Sequence
  Synthetic oligonucleotide; TTT chr2 60534936 60534957 60534953 60534958 +
tacatcatcaattttgcaagat

SEQ ID NO: 206503 - DNA, 22 bp, Artificial Sequence
  Synthetic oligonucleotide; TTT chr2 60534937 60534958 60534954 60534959 +
acatcatcaattttgcaagatt

SEQ ID NO: 206504 - DNA, 22 bp, Artificial Sequence
  Synthetic oligonucleotide; TTA chr2 60534938 60534959 60534955 60534960 +
catcatcaattttgcaagattg

SEQ ID NO: 206505 - DNA, 22 bp, Artificial Sequence
  Synthetic oligonucleotide; TTT chr2 60534950 60534971 60534967 60534972 +
tgcaagattgaaaatctaagaa

SEQ ID NO: 206506 - DNA, 22 bp, Artificial Sequence
  Synthetic oligonucleotide; TTT chr2 60534951 60534972 60534968 60534973 +
gcaagattgaaaatctaagaat

SEQ ID NO: 206507 - DNA, 22 bp, Artificial Sequence
  Synthetic oligonucleotide; TTG chr2 60534952 60534973 60534969 60534974 +
caagattgaaaatctaagaatc

SEQ ID NO: 206508 - DNA, 22 bp, Artificial Sequence
  Synthetic oligonucleotide; TTG chr2 60534960 60534981 60534977 60534982 +
aaaatctaagaatcttggtgct

SEQ ID NO: 206509 - DNA, 22 bp, Artificial Sequence
  Synthetic oligonucleotide; CTA chr2 60534968 60534989 60534985 60534990 +
agaatcttggtgctataaacaa

SEQ ID NO: 206510 - DNA, 22 bp, Artificial Sequence
  Synthetic oligonucleotide; CTT chr2 60534976 60534997 60534993 60534998 +
ggtgctataaacaattttcacc

SEQ ID NO: 206511 - DNA, 22 bp, Artificial Sequence
  Synthetic oligonucleotide; TTG chr2 60534977 60534998 60534994 60534999 +
gtgctataaacaattttcacct

SEQ ID NO: 206512 - DNA, 22 bp, Artificial Sequence
  Synthetic oligonucleotide; CTA chr2 60534983 60535004 60535000 60535005 +
taaacaattttcaccttttttt

SEQ ID NO: 206513 - DNA, 22 bp, Artificial Sequence
  Synthetic oligonucleotide; TTT chr2 60534993 60535014 60535010 60535015 +
tcaccttttttttctccttcag

SEQ ID NO: 206514 - DNA, 22 bp, Artificial Sequence
  Synthetic oligonucleotide; TTT chr2 60534994 60535015 60535011 60535016 +
caccttttttttctccttcagc

SEQ ID NO: 206515 - DNA, 22 bp, Artificial Sequence
  Synthetic oligonucleotide; TTC chr2 60534995 60535016 60535012 60535017 +
accttttttttctccttcagca

SEQ ID NO: 206516 - DNA, 22 bp, Artificial Sequence
  Synthetic oligonucleotide; CTT chr2 60535000 60535021 60535017 60535022 +
ttttttctccttcagcaggctg

SEQ ID NO: 206517 - DNA, 22 bp, Artificial Sequence
  Synthetic oligonucleotide; TTT chr2 60535001 60535022 60535018 60535023 +
tttttctccttcagcaggctga

SEQ ID NO: 206518 - DNA, 22 bp, Artificial Sequence
  Synthetic oligonucleotide; TTT chr2 60535002 60535023 60535019 60535024 +
ttttctccttcagcaggctgac

SEQ ID NO: 206519 - DNA, 22 bp, Artificial Sequence
  Synthetic oligonucleotide; TTT chr2 60535003 60535024 60535020 60535025 +
tttctccttcagcaggctgaca

SEQ ID NO: 206520 - DNA, 22 bp, Artificial Sequence
  Synthetic oligonucleotide; TTT chr2 60535004 60535025 60535021 60535026 +
ttctccttcagcaggctgacag

SEQ ID NO: 206521 - DNA, 22 bp, Artificial Sequence
  Synthetic oligonucleotide; TTT chr2 60535005 60535026 60535022 60535027 +
tctccttcagcaggctgacagg

SEQ ID NO: 206522 - DNA, 22 bp, Artificial Sequence
  Synthetic oligonucleotide; TTT chr2 60535006 60535027 60535023 60535028 +
ctccttcagcaggctgacaggc

SEQ ID NO: 206523 - DNA, 22 bp, Artificial Sequence
  Synthetic oligonucleotide; TTC chr2 60535007 60535028 60535024 60535029 +
tccttcagcaggctgacaggcc

SEQ ID NO: 206524 - DNA, 22 bp, Artificial Sequence
  Synthetic oligonucleotide; CTC chr2 60535009 60535030 60535026 60535031 +
cttcagcaggctgacaggccag

SEQ ID NO: 206525 - DNA, 22 bp, Artificial Sequence
  Synthetic oligonucleotide; CTT chr2 60535012 60535033 60535029 60535034 +
cagcaggctgacaggccagcct

SEQ ID NO: 206526 - DNA, 22 bp, Artificial Sequence
  Synthetic oligonucleotide; TTC chr2 60535013 60535034 60535030 60535035 +
agcaggctgacaggccagcctg

SEQ ID NO: 206527 - DNA, 22 bp, Artificial Sequence
  Synthetic oligonucleotide; CTG chr2 60535022 60535043 60535039 60535044 +
acaggccagcctgatgtgcacc

SEQ ID NO: 206528 - DNA, 22 bp, Artificial Sequence
  Synthetic oligonucleotide; CTG chr2 60535035 60535056 60535052 60535057 +
atgtgcaccgaatgtacatgtt

SEQ ID NO: 206529 - DNA, 22 bp, Artificial Sequence
  Synthetic oligonucleotide; TTA chr2 60535058 60535079 60535075 60535080 +
ataggccaatcaaaaatgcaaa

SEQ ID NO: 206530 - DNA, 22 bp, Artificial Sequence
  Synthetic oligonucleotide; TTC chr2 60535087 60535108 60535104 60535109 +
gcaattactggaaggacctaat

SEQ ID NO: 206531 - DNA, 22 bp, Artificial Sequence
  Synthetic oligonucleotide; TTA chr2 60535094 60535115 60535111 60535116 +
ctggaaggacctaatggtcatt

SEQ ID NO: 206532 - DNA, 22 bp, Artificial Sequence
  Synthetic oligonucleotide; CTG chr2 60535097 60535118 60535114 60535119 +
gaaggacctaatggtcattaga

SEQ ID NO: 206533 - DNA, 22 bp, Artificial Sequence
  Synthetic oligonucleotide; CTA chr2 60535107 60535128 60535124 60535129 +
atggtcattagaatttacaact

SEQ ID NO: 206534 - DNA, 22 bp, Artificial Sequence
  Synthetic oligonucleotide; TTA chr2 60535117 60535138 60535134 60535139 +
gaatttacaactaggtaatgaa

SEQ ID NO: 206535 - DNA, 22 bp, Artificial Sequence
  Synthetic oligonucleotide; TTT chr2 60535123 60535144 60535140 60535145 +
acaactaggtaatgaactgaag

SEQ ID NO: 206536 - DNA, 22 bp, Artificial Sequence
  Synthetic oligonucleotide; TTA chr2 60535124 60535145 60535141 60535146 +
caactaggtaatgaactgaagt

SEQ ID NO: 206537 - DNA, 22 bp, Artificial Sequence
  Synthetic oligonucleotide; CTA chr2 60535130 60535151 60535147 60535152 +
ggtaatgaactgaagtctgccc

SEQ ID NO: 206538 - DNA, 22 bp, Artificial Sequence
  Synthetic oligonucleotide; CTG chr2 60535142 60535163 60535159 60535164 +
aagtctgcccacaccatgcata

SEQ ID NO: 206539 - DNA, 22 bp, Artificial Sequence
  Synthetic oligonucleotide; CTG chr2 60535149 60535170 60535166 60535171 +
cccacaccatgcatattcataa

SEQ ID NO: 206540 - DNA, 22 bp, Artificial Sequence
  Synthetic oligonucleotide; TTC chr2 60535167 60535188 60535184 60535189 +
ataaagcaatttagcctttgaa

SEQ ID NO: 206541 - DNA, 22 bp, Artificial Sequence
  Synthetic oligonucleotide; TTT chr2 60535179 60535200 60535196 60535201 +
agcctttgaagattaaagaagt

SEQ ID NO: 206542 - DNA, 22 bp, Artificial Sequence
  Synthetic oligonucleotide; TTA chr2 60535180 60535201 60535197 60535202 +
gcctttgaagattaaagaagtg

SEQ ID NO: 206543 - DNA, 22 bp, Artificial Sequence
  Synthetic oligonucleotide; CTT chr2 60535185 60535206 60535202 60535207 +
tgaagattaaagaagtgcttaa

SEQ ID NO: 206544 - DNA, 22 bp, Artificial Sequence
  Synthetic oligonucleotide; TTT chr2 60535186 60535207 60535203 60535208 +
gaagattaaagaagtgcttaaa

SEQ ID NO: 206545 - DNA, 22 bp, Artificial Sequence
  Synthetic oligonucleotide; TTG chr2 60535187 60535208 60535204 60535209 +
aagattaaagaagtgcttaaaa

SEQ ID NO: 206546 - DNA, 22 bp, Artificial Sequence
  Synthetic oligonucleotide; TTA chr2 60535194 60535215 60535211 60535216 +
aagaagtgcttaaaattcaaat

SEQ ID NO: 206547 - DNA, 22 bp, Artificial Sequence
  Synthetic oligonucleotide; CTT chr2 60535205 60535226 60535222 60535227 +
aaaattcaaatgagctttagca

SEQ ID NO: 206548 - DNA, 22 bp, Artificial Sequence
  Synthetic oligonucleotide; TTA chr2 60535206 60535227 60535223 60535228 +
aaattcaaatgagctttagcaa

SEQ ID NO: 206549 - DNA, 22 bp, Artificial Sequence
  Synthetic oligonucleotide; TTC chr2 60535212 60535233 60535229 60535234 +
aaatgagctttagcaaattatc

SEQ ID NO: 206550 - DNA, 22 bp, Artificial Sequence
  Synthetic oligonucleotide; CTT chr2 60535222 60535243 60535239 60535244 +
tagcaaattatcagtaagattc

SEQ ID NO: 206551 - DNA, 22 bp, Artificial Sequence
  Synthetic oligonucleotide; TTT chr2 60535223 60535244 60535240 60535245 +
agcaaattatcagtaagattca

SEQ ID NO: 206552 - DNA, 22 bp, Artificial Sequence
  Synthetic oligonucleotide; TTA chr2 60535224 60535245 60535241 60535246 +
gcaaattatcagtaagattcat

SEQ ID NO: 206553 - DNA, 22 bp, Artificial Sequence
  Synthetic oligonucleotide; TTA chr2 60535232 60535253 60535249 60535254 +
tcagtaagattcatccaaaaag

SEQ ID NO: 206554 - DNA, 22 bp, Artificial Sequence
  Synthetic oligonucleotide; TTC chr2 60535244 60535265 60535261 60535266 +
atccaaaaagcaaagggttttt

SEQ ID NO: 206555 - DNA, 22 bp, Artificial Sequence
  Synthetic oligonucleotide; TTT chr2 60535264 60535285 60535281 60535286 +
ttcttcctatgatttcctcatt

SEQ ID NO: 206556 - DNA, 22 bp, Artificial Sequence
  Synthetic oligonucleotide; TTT chr2 60535265 60535286 60535282 60535287 +
tcttcctatgatttcctcattt

SEQ ID NO: 206557 - DNA, 22 bp, Artificial Sequence
  Synthetic oligonucleotide; TTT chr2 60535266 60535287 60535283 60535288 +
cttcctatgatttcctcatttt

SEQ ID NO: 206558 - DNA, 22 bp, Artificial Sequence
  Synthetic oligonucleotide; TTC chr2 60535267 60535288 60535284 60535289 +
ttcctatgatttcctcattttt

SEQ ID NO: 206559 - DNA, 22 bp, Artificial Sequence
  Synthetic oligonucleotide; CTT chr2 60535269 60535290 60535286 60535291 +
cctatgatttcctcattttttt

SEQ ID NO: 206560 - DNA, 22 bp, Artificial Sequence
  Synthetic oligonucleotide; TTC chr2 60535270 60535291 60535287 60535292 +
ctatgatttcctcattttttta

SEQ ID NO: 206561 - DNA, 22 bp, Artificial Sequence
  Synthetic oligonucleotide; CTA chr2 60535273 60535294 60535290 60535295 +
tgatttcctcatttttttaatg

SEQ ID NO: 206562 - DNA, 22 bp, Artificial Sequence
  Synthetic oligonucleotide; TTT chr2 60535279 60535300 60535296 60535301 +
cctcatttttttaatgcaaaat

SEQ ID NO: 206563 - DNA, 22 bp, Artificial Sequence
  Synthetic oligonucleotide; TTC chr2 60535280 60535301 60535297 60535302 +
ctcatttttttaatgcaaaatt

SEQ ID NO: 206564 - DNA, 22 bp, Artificial Sequence
  Synthetic oligonucleotide; CTC chr2 60535283 60535304 60535300 60535305 +
atttttttaatgcaaaattgta

SEQ ID NO: 206565 - DNA, 22 bp, Artificial Sequence
  Synthetic oligonucleotide; TTT chr2 60535287 60535308 60535304 60535309 +
ttttaatgcaaaattgtaatat

SEQ ID NO: 206566 - DNA, 22 bp, Artificial Sequence
  Synthetic oligonucleotide; TTT chr2 60535288 60535309 60535305 60535310 +
tttaatgcaaaattgtaatatc

SEQ ID NO: 206567 - DNA, 22 bp, Artificial Sequence
  Synthetic oligonucleotide; TTT chr2 60535289 60535310 60535306 60535311 +
ttaatgcaaaattgtaatatct

SEQ ID NO: 206568 - DNA, 22 bp, Artificial Sequence
  Synthetic oligonucleotide; TTT chr2 60535290 60535311 60535307 60535312 +
taatgcaaaattgtaatatctt

SEQ ID NO: 206569 - DNA, 22 bp, Artificial Sequence
  Synthetic oligonucleotide; TTT chr2 60535291 60535312 60535308 60535313 +
aatgcaaaattgtaatatcttc

SEQ ID NO: 206570 - DNA, 22 bp, Artificial Sequence
  Synthetic oligonucleotide; TTA chr2 60535292 60535313 60535309 60535314 +
atgcaaaattgtaatatcttcc

SEQ ID NO: 206571 - DNA, 22 bp, Artificial Sequence
  Synthetic oligonucleotide; TTG chr2 60535303 60535324 60535320 60535325 +
taatatcttccagactgagctt

SEQ ID NO: 206572 - DNA, 22 bp, Artificial Sequence
  Synthetic oligonucleotide; CTT chr2 60535312 60535333 60535329 60535334 +
ccagactgagcttaaactaaac

SEQ ID NO: 206573 - DNA, 22 bp, Artificial Sequence
  Synthetic oligonucleotide; TTC chr2 60535313 60535334 60535330 60535335 +
cagactgagcttaaactaaaca

SEQ ID NO: 206574 - DNA, 22 bp, Artificial Sequence
  Synthetic oligonucleotide; CTG chr2 60535320 60535341 60535337 60535342 +
agcttaaactaaacatagagct

SEQ ID NO: 206575 - DNA, 22 bp, Artificial Sequence
  Synthetic oligonucleotide; CTT chr2 60535325 60535346 60535342 60535347 +
aaactaaacatagagcttctag

SEQ ID NO: 206576 - DNA, 22 bp, Artificial Sequence
  Synthetic oligonucleotide; TTA chr2 60535326 60535347 60535343 60535348 +
aactaaacatagagcttctagt

SEQ ID NO: 206577 - DNA, 22 bp, Artificial Sequence
  Synthetic oligonucleotide; CTA chr2 60535331 60535352 60535348 60535353 +
aacatagagcttctagtcaagc

SEQ ID NO: 206578 - DNA, 22 bp, Artificial Sequence
  Synthetic oligonucleotide; CTT chr2 60535343 60535364 60535360 60535365 +
ctagtcaagccaaaggggctaa

SEQ ID NO: 206579 - DNA, 22 bp, Artificial Sequence
  Synthetic oligonucleotide; TTC chr2 60535344 60535365 60535361 60535366 +
tagtcaagccaaaggggctaag

SEQ ID NO: 206580 - DNA, 22 bp, Artificial Sequence
  Synthetic oligonucleotide; CTA chr2 60535346 60535367 60535363 60535368 +
gtcaagccaaaggggctaagat

SEQ ID NO: 206581 - DNA, 22 bp, Artificial Sequence
  Synthetic oligonucleotide; CTA chr2 60535364 60535385 60535381 60535386 +
agatacaaacagaggctgcaaa

SEQ ID NO: 206582 - DNA, 22 bp, Artificial Sequence
  Synthetic oligonucleotide; CTG chr2 60535382 60535403 60535399 60535404 +
caaacatcgtcacggactttgt

SEQ ID NO: 206583 - DNA, 22 bp, Artificial Sequence
  Synthetic oligonucleotide; CTT chr2 60535401 60535422 60535418 60535423 +
tgttcataaaactaagccctta

SEQ ID NO: 206584 - DNA, 22 bp, Artificial Sequence
  Synthetic oligonucleotide; TTT chr2 60535402 60535423 60535419 60535424 +
gttcataaaactaagcccttaa

SEQ ID NO: 206585 - DNA, 22 bp, Artificial Sequence
  Synthetic oligonucleotide; TTG chr2 60535403 60535424 60535420 60535425 +
ttcataaaactaagcccttaag

SEQ ID NO: 206586 - DNA, 22 bp, Artificial Sequence
  Synthetic oligonucleotide; TTC chr2 60535406 60535427 60535423 60535428 +
ataaaactaagcccttaagagc

SEQ ID NO: 206587 - DNA, 22 bp, Artificial Sequence
  Synthetic oligonucleotide; CTA chr2 60535415 60535436 60535432 60535437 +
agcccttaagagccaaacctat

SEQ ID NO: 206588 - DNA, 22 bp, Artificial Sequence
  Synthetic oligonucleotide; CTT chr2 60535422 60535443 60535439 60535444 +
aagagccaaacctatctctaaa

SEQ ID NO: 206589 - DNA, 22 bp, Artificial Sequence
  Synthetic oligonucleotide; TTA chr2 60535423 60535444 60535440 60535445 +
agagccaaacctatctctaaac

SEQ ID NO: 206590 - DNA, 22 bp, Artificial Sequence
  Synthetic oligonucleotide; CTA chr2 60535436 60535457 60535453 60535458 +
tctctaaacatggtaatttatc

SEQ ID NO: 206591 - DNA, 22 bp, Artificial Sequence
  Synthetic oligonucleotide; CTC chr2 60535440 60535461 60535457 60535462 +
taaacatggtaatttatcaaaa

SEQ ID NO: 206592 - DNA, 22 bp, Artificial Sequence
  Synthetic oligonucleotide; CTA chr2 60535442 60535463 60535459 60535464 +
aacatggtaatttatcaaaaac

SEQ ID NO: 206593 - DNA, 22 bp, Artificial Sequence
  Synthetic oligonucleotide; TTT chr2 60535455 60535476 60535472 60535477 +
atcaaaaacagcccagagtcgc

SEQ ID NO: 206594 - DNA, 22 bp, Artificial Sequence
  Synthetic oligonucleotide; TTA chr2 60535456 60535477 60535473 60535478 +
tcaaaaacagcccagagtcgct

SEQ ID NO: 206595 - DNA, 22 bp, Artificial Sequence
  Synthetic oligonucleotide; CTC chr2 60535479 60535500 60535496 60535501 +
ataggcaatactgcatagtcct

SEQ ID NO: 206596 - DNA, 22 bp, Artificial Sequence
  Synthetic oligonucleotide; CTG chr2 60535492 60535513 60535509 60535514 +
catagtcctccaacagaacaga

SEQ ID NO: 206597 - DNA, 22 bp, Artificial Sequence
  Synthetic oligonucleotide; CTC chr2 60535502 60535523 60535519 60535524 +
caacagaacagattaacacgag

SEQ ID NO: 206598 - DNA, 22 bp, Artificial Sequence
  Synthetic oligonucleotide; TTA chr2 60535517 60535538 60535534 60535539 +
acacgagtccctccacccttcc

SEQ ID NO: 206599 - DNA, 22 bp, Artificial Sequence
  Synthetic oligonucleotide; CTC chr2 60535530 60535551 60535547 60535552 +
cacccttccaaaaagccttttc

SEQ ID NO: 206600 - DNA, 22 bp, Artificial Sequence
  Synthetic oligonucleotide; CTT chr2 60535537 60535558 60535554 60535559 +
ccaaaaagccttttccccctca

SEQ ID NO: 206601 - DNA, 22 bp, Artificial Sequence
  Synthetic oligonucleotide; TTC chr2 60535538 60535559 60535555 60535560 +
caaaaagccttttccccctcaa

SEQ ID NO: 206602 - DNA, 22 bp, Artificial Sequence
  Synthetic oligonucleotide; CTT chr2 60535549 60535570 60535566 60535571 +
ttccccctcaagttgtctctcc

SEQ ID NO: 206603 - DNA, 22 bp, Artificial Sequence
  Synthetic oligonucleotide; TTT chr2 60535550 60535571 60535567 60535572 +
tccccctcaagttgtctctcct

SEQ ID NO: 206604 - DNA, 22 bp, Artificial Sequence
  Synthetic oligonucleotide; TTT chr2 60535551 60535572 60535568 60535573 +
ccccctcaagttgtctctcctg

SEQ ID NO: 206605 - DNA, 22 bp, Artificial Sequence
  Synthetic oligonucleotide; TTC chr2 60535552 60535573 60535569 60535574 +
cccctcaagttgtctctcctgt

SEQ ID NO: 206606 - DNA, 22 bp, Artificial Sequence
  Synthetic oligonucleotide; CTC chr2 60535558 60535579 60535575 60535580 +
aagttgtctctcctgtgtaaac

SEQ ID NO: 206607 - DNA, 22 bp, Artificial Sequence
  Synthetic oligonucleotide; TTG chr2 60535564 60535585 60535581 60535586 +
tctctcctgtgtaaacatccac

SEQ ID NO: 206608 - DNA, 22 bp, Artificial Sequence
  Synthetic oligonucleotide; CTC chr2 60535568 60535589 60535585 60535590 +
tcctgtgtaaacatccactgtg

SEQ ID NO: 206609 - DNA, 22 bp, Artificial Sequence
  Synthetic oligonucleotide; CTC chr2 60535570 60535591 60535587 60535592 +
ctgtgtaaacatccactgtggt

SEQ ID NO: 206610 - DNA, 22 bp, Artificial Sequence
  Synthetic oligonucleotide; CTG chr2 60535573 60535594 60535590 60535595 +
tgtaaacatccactgtggtata

SEQ ID NO: 206611 - DNA, 22 bp, Artificial Sequence
  Synthetic oligonucleotide; CTG chr2 60535588 60535609 60535605 60535610 +
tggtataaaaacagctttttca

SEQ ID NO: 206612 - DNA, 22 bp, Artificial Sequence
  Synthetic oligonucleotide; CTT chr2 60535605 60535626 60535622 60535627 +
tttcattggcttggagtggcat

SEQ ID NO: 206613 - DNA, 22 bp, Artificial Sequence
  Synthetic oligonucleotide; TTT chr2 60535606 60535627 60535623 60535628 +
ttcattggcttggagtggcatt

SEQ ID NO: 206614 - DNA, 22 bp, Artificial Sequence
  Synthetic oligonucleotide; TTT chr2 60535607 60535628 60535624 60535629 +
tcattggcttggagtggcatta

SEQ ID NO: 206615 - DNA, 22 bp, Artificial Sequence
  Synthetic oligonucleotide; TTT chr2 60535608 60535629 60535625 60535630 +
cattggcttggagtggcattaa

SEQ ID NO: 206616 - DNA, 22 bp, Artificial Sequence
  Synthetic oligonucleotide; TTC chr2 60535609 60535630 60535626 60535631 +
attggcttggagtggcattaat

SEQ ID NO: 206617 - DNA, 22 bp, Artificial Sequence
  Synthetic oligonucleotide; TTG chr2 60535613 60535634 60535630 60535635 +
gcttggagtggcattaatttta

SEQ ID NO: 206618 - DNA, 22 bp, Artificial Sequence
  Synthetic oligonucleotide; CTT chr2 60535617 60535638 60535634 60535639 +
ggagtggcattaattttagaag

SEQ ID NO: 206619 - DNA, 22 bp, Artificial Sequence
  Synthetic oligonucleotide; TTG chr2 60535618 60535639 60535635 60535640 +
gagtggcattaattttagaagt

SEQ ID NO: 206620 - DNA, 22 bp, Artificial Sequence
  Synthetic oligonucleotide; TTA chr2 60535629 60535650 60535646 60535651 +
attttagaagtttctgcttcca

SEQ ID NO: 206621 - DNA, 22 bp, Artificial Sequence
  Synthetic oligonucleotide; TTT chr2 60535633 60535654 60535650 60535655 +
tagaagtttctgcttccaaagg

SEQ ID NO: 206622 - DNA, 22 bp, Artificial Sequence
  Synthetic oligonucleotide; TTT chr2 60535634 60535655 60535651 60535656 +
agaagtttctgcttccaaaggg

SEQ ID NO: 206623 - DNA, 22 bp, Artificial Sequence
  Synthetic oligonucleotide; TTA chr2 60535635 60535656 60535652 60535657 +
gaagtttctgcttccaaaggga

SEQ ID NO: 206624 - DNA, 22 bp, Artificial Sequence
  Synthetic oligonucleotide; TTT chr2 60535642 60535663 60535659 60535664 +
ctgcttccaaagggaaaccagc

SEQ ID NO: 206625 - DNA, 22 bp, Artificial Sequence
  Synthetic oligonucleotide; TTC chr2 60535643 60535664 60535660 60535665 +
tgcttccaaagggaaaccagca

SEQ ID NO: 206626 - DNA, 22 bp, Artificial Sequence
  Synthetic oligonucleotide; CTG chr2 60535645 60535666 60535662 60535667 +
cttccaaagggaaaccagcaag

SEQ ID NO: 206627 - DNA, 22 bp, Artificial Sequence
  Synthetic oligonucleotide; CTT chr2 60535648 60535669 60535665 60535670 +
ccaaagggaaaccagcaagaaa

SEQ ID NO: 206628 - DNA, 22 bp, Artificial Sequence
  Synthetic oligonucleotide; TTC chr2 60535649 60535670 60535666 60535671 +
caaagggaaaccagcaagaaag

SEQ ID NO: 206629 - DNA, 22 bp, Artificial Sequence
  Synthetic oligonucleotide; CTG chr2 60535703 60535724 60535720 60535725 +
gtttacttctgaggagtgcaaa

SEQ ID NO: 206630 - DNA, 22 bp, Artificial Sequence
  Synthetic oligonucleotide; TTT chr2 60535707 60535728 60535724 60535729 +
acttctgaggagtgcaaatcct

SEQ ID NO: 206631 - DNA, 22 bp, Artificial Sequence
  Synthetic oligonucleotide; TTA chr2 60535708 60535729 60535725 60535730 +
cttctgaggagtgcaaatcctg

SEQ ID NO: 206632 - DNA, 22 bp, Artificial Sequence
  Synthetic oligonucleotide; CTT chr2 60535711 60535732 60535728 60535733 +
ctgaggagtgcaaatcctgttg

SEQ ID NO: 206633 - DNA, 22 bp, Artificial Sequence
  Synthetic oligonucleotide; TTC chr2 60535712 60535733 60535729 60535734 +
tgaggagtgcaaatcctgttgc

SEQ ID NO: 206634 - DNA, 22 bp, Artificial Sequence
  Synthetic oligonucleotide; CTG chr2 60535714 60535735 60535731 60535736 +
aggagtgcaaatcctgttgctt

SEQ ID NO: 206635 - DNA, 22 bp, Artificial Sequence
  Synthetic oligonucleotide; CTG chr2 60535730 60535751 60535747 60535752 +
ttgcttgagatttgcctttctg

SEQ ID NO: 206636 - DNA, 22 bp, Artificial Sequence
  Synthetic oligonucleotide; TTG chr2 60535733 60535754 60535750 60535755 +
cttgagatttgcctttctgatt

SEQ ID NO: 206637 - DNA, 22 bp, Artificial Sequence
  Synthetic oligonucleotide; CTT chr2 60535736 60535757 60535753 60535758 +
gagatttgcctttctgatttcc

SEQ ID NO: 206638 - DNA, 22 bp, Artificial Sequence
  Synthetic oligonucleotide; TTG chr2 60535737 60535758 60535754 60535759 +
agatttgcctttctgatttcct

SEQ ID NO: 206639 - DNA, 22 bp, Artificial Sequence
  Synthetic oligonucleotide; TTT chr2 60535743 60535764 60535760 60535765 +
gcctttctgatttcctccattc

SEQ ID NO: 206640 - DNA, 22 bp, Artificial Sequence
  Synthetic oligonucleotide; TTG chr2 60535744 60535765 60535761 60535766 +
cctttctgatttcctccattcg

SEQ ID NO: 206641 - DNA, 22 bp, Artificial Sequence
  Synthetic oligonucleotide; CTT chr2 60535748 60535769 60535765 60535770 +
tctgatttcctccattcggcac

SEQ ID NO: 206642 - DNA, 22 bp, Artificial Sequence
  Synthetic oligonucleotide; TTT chr2 60535749 60535770 60535766 60535771 +
ctgatttcctccattcggcacc

SEQ ID NO: 206643 - DNA, 22 bp, Artificial Sequence
  Synthetic oligonucleotide; TTC chr2 60535750 60535771 60535767 60535772 +
tgatttcctccattcggcacca

SEQ ID NO: 206644 - DNA, 22 bp, Artificial Sequence
  Synthetic oligonucleotide; CTG chr2 60535752 60535773 60535769 60535774 +
atttcctccattcggcaccagc

SEQ ID NO: 206645 - DNA, 22 bp, Artificial Sequence
  Synthetic oligonucleotide; TTT chr2 60535756 60535777 60535773 60535778 +
cctccattcggcaccagccgca

SEQ ID NO: 206646 - DNA, 22 bp, Artificial Sequence
  Synthetic oligonucleotide; TTC chr2 60535757 60535778 60535774 60535779 +
ctccattcggcaccagccgcat

SEQ ID NO: 206647 - DNA, 22 bp, Artificial Sequence
  Synthetic oligonucleotide; CTC chr2 60535760 60535781 60535777 60535782 +
cattcggcaccagccgcattta

SEQ ID NO: 206648 - DNA, 22 bp, Artificial Sequence
  Synthetic oligonucleotide; TTC chr2 60535765 60535786 60535782 60535787 +
ggcaccagccgcatttaatcca

SEQ ID NO: 206649 - DNA, 22 bp, Artificial Sequence
  Synthetic oligonucleotide; TTT chr2 60535781 60535802 60535798 60535803 +
aatccatggtgaacgggtcatg

SEQ ID NO: 206650 - DNA, 22 bp, Artificial Sequence
  Synthetic oligonucleotide; TTA chr2 60535782 60535803 60535799 60535804 +
atccatggtgaacgggtcatgc

SEQ ID NO: 206651 - DNA, 22 bp, Artificial Sequence
  Synthetic oligonucleotide; CTG chr2 60535816 60535837 60535833 60535838 +
acattcagaaagttgtggtgtc

SEQ ID NO: 206652 - DNA, 22 bp, Artificial Sequence
  Synthetic oligonucleotide; TTC chr2 60535822 60535843 60535839 60535844 +
agaaagttgtggtgtccaccca

SEQ ID NO: 206653 - DNA, 22 bp, Artificial Sequence
  Synthetic oligonucleotide; TTG chr2 60535831 60535852 60535848 60535853 +
tggtgtccacccaccaccacca

SEQ ID NO: 206654 - DNA, 22 bp, Artificial Sequence
  Synthetic oligonucleotide; TTA chr2 60535867 60535888 60535884 60535889 +
ttagagagtatcgtgggaacct

SEQ ID NO: 206655 - DNA, 22 bp, Artificial Sequence
  Synthetic oligonucleotide; TTA chr2 60535870 60535891 60535887 60535892 +
gagagtatcgtgggaacctgga

SEQ ID NO: 206656 - DNA, 22 bp, Artificial Sequence
  Synthetic oligonucleotide; CTG chr2 60535890 60535911 60535907 60535912 +
gatttgcaggctttccaattac

SEQ ID NO: 206657 - DNA, 22 bp, Artificial Sequence
  Synthetic oligonucleotide; TTT chr2 60535895 60535916 60535912 60535917 +
gcaggctttccaattactagtc

SEQ ID NO: 206658 - DNA, 22 bp, Artificial Sequence
  Synthetic oligonucleotide; TTG chr2 60535896 60535917 60535913 60535918 +
caggctttccaattactagtct

SEQ ID NO: 206659 - DNA, 22 bp, Artificial Sequence
  Synthetic oligonucleotide; CTT chr2 60535903 60535924 60535920 60535925 +
tccaattactagtctggagaag

SEQ ID NO: 206660 - DNA, 22 bp, Artificial Sequence
  Synthetic oligonucleotide; TTT chr2 60535904 60535925 60535921 60535926 +
ccaattactagtctggagaaga

SEQ ID NO: 206661 - DNA, 22 bp, Artificial Sequence
  Synthetic oligonucleotide; TTC chr2 60535905 60535926 60535922 60535927 +
caattactagtctggagaagaa

SEQ ID NO: 206662 - DNA, 22 bp, Artificial Sequence
  Synthetic oligonucleotide; TTA chr2 60535911 60535932 60535928 60535933 +
ctagtctggagaagaatccttt

SEQ ID NO: 206663 - DNA, 22 bp, Artificial Sequence
  Synthetic oligonucleotide; CTA chr2 60535914 60535935 60535931 60535936 +
gtctggagaagaatcctttgct

SEQ ID NO: 206664 - DNA, 22 bp, Artificial Sequence
  Synthetic oligonucleotide; CTG chr2 60535919 60535940 60535936 60535941 +
gagaagaatcctttgcttgaat

SEQ ID NO: 206665 - DNA, 22 bp, Artificial Sequence
  Synthetic oligonucleotide; CTT chr2 60535932 60535953 60535949 60535954 +
tgcttgaatgctaactcacacc

SEQ ID NO: 206666 - DNA, 22 bp, Artificial Sequence
  Synthetic oligonucleotide; TTT chr2 60535933 60535954 60535950 60535955 +
gcttgaatgctaactcacacct

SEQ ID NO: 206667 - DNA, 22 bp, Artificial Sequence
  Synthetic oligonucleotide; TTG chr2 60535934 60535955 60535951 60535956 +
cttgaatgctaactcacacctt

SEQ ID NO: 206668 - DNA, 22 bp, Artificial Sequence
  Synthetic oligonucleotide; CTT chr2 60535937 60535958 60535954 60535959 +
gaatgctaactcacaccttgct

SEQ ID NO: 206669 - DNA, 22 bp, Artificial Sequence
  Synthetic oligonucleotide; TTG chr2 60535938 60535959 60535955 60535960 +
aatgctaactcacaccttgcta

SEQ ID NO: 206670 - DNA, 22 bp, Artificial Sequence
  Synthetic oligonucleotide; CTA chr2 60535945 60535966 60535962 60535967 +
actcacaccttgctaacctcct

SEQ ID NO: 206671 - DNA, 22 bp, Artificial Sequence
  Synthetic oligonucleotide; CTC chr2 60535949 60535970 60535966 60535971 +
acaccttgctaacctcctgaca

SEQ ID NO: 206672 - DNA, 22 bp, Artificial Sequence
  Synthetic oligonucleotide; CTT chr2 60535956 60535977 60535973 60535978 +
gctaacctcctgacatttaaaa

SEQ ID NO: 206673 - DNA, 22 bp, Artificial Sequence
  Synthetic oligonucleotide; TTG chr2 60535957 60535978 60535974 60535979 +
ctaacctcctgacatttaaaaa

SEQ ID NO: 206674 - DNA, 22 bp, Artificial Sequence
  Synthetic oligonucleotide; CTA chr2 60535960 60535981 60535977 60535982 +
acctcctgacatttaaaaaatt

SEQ ID NO: 206675 - DNA, 22 bp, Artificial Sequence
  Synthetic oligonucleotide; CTC chr2 60535965 60535986 60535982 60535987 +
ctgacatttaaaaaattctagt

SEQ ID NO: 206676 - DNA, 22 bp, Artificial Sequence
  Synthetic oligonucleotide; CTG chr2 60535968 60535989 60535985 60535990 +
acatttaaaaaattctagtgac

SEQ ID NO: 206677 - DNA, 22 bp, Artificial Sequence
  Synthetic oligonucleotide; TTT chr2 60535974 60535995 60535991 60535996 +
aaaaaattctagtgacagaatt

SEQ ID NO: 206678 - DNA, 22 bp, Artificial Sequence
  Synthetic oligonucleotide; TTA chr2 60535975 60535996 60535992 60535997 +
aaaaattctagtgacagaattc

SEQ ID NO: 206679 - DNA, 22 bp, Artificial Sequence
  Synthetic oligonucleotide; TTC chr2 60535983 60536004 60536000 60536005 +
tagtgacagaattcccaatgaa

SEQ ID NO: 206680 - DNA, 22 bp, Artificial Sequence
  Synthetic oligonucleotide; CTA chr2 60535985 60536006 60536002 60536007 +
gtgacagaattcccaatgaact

SEQ ID NO: 206681 - DNA, 22 bp, Artificial Sequence
  Synthetic oligonucleotide; TTC chr2 60535997 60536018 60536014 60536019 +
ccaatgaactcctcctcttcct

SEQ ID NO: 206682 - DNA, 22 bp, Artificial Sequence
  Synthetic oligonucleotide; CTC chr2 60536008 60536029 60536025 60536030 +
ctcctcttcctcccaaccccaa

SEQ ID NO: 206683 - DNA, 22 bp, Artificial Sequence
  Synthetic oligonucleotide; CTC chr2 60536011 60536032 60536028 60536033 +
ctcttcctcccaaccccaacct

SEQ ID NO: 206684 - DNA, 22 bp, Artificial Sequence
  Synthetic oligonucleotide; CTC chr2 60536014 60536035 60536031 60536036 +
ttcctcccaaccccaacctctc

SEQ ID NO: 206685 - DNA, 22 bp, Artificial Sequence
  Synthetic oligonucleotide; CTT chr2 60536016 60536037 60536033 60536038 +
cctcccaaccccaacctctcca

SEQ ID NO: 206686 - DNA, 22 bp, Artificial Sequence
  Synthetic oligonucleotide; TTC chr2 60536017 60536038 60536034 60536039 +
ctcccaaccccaacctctccaa

SEQ ID NO: 206687 - DNA, 22 bp, Artificial Sequence
  Synthetic oligonucleotide; CTC chr2 60536020 60536041 60536037 60536042 +
ccaaccccaacctctccaaccc

SEQ ID NO: 206688 - DNA, 22 bp, Artificial Sequence
  Synthetic oligonucleotide; CTC chr2 60536034 60536055 60536051 60536056 +
tccaacccaggtgaaagcaaga

SEQ ID NO: 206689 - DNA, 22 bp, Artificial Sequence
  Synthetic oligonucleotide; CTC chr2 60536036 60536057 60536053 60536058 +
caacccaggtgaaagcaagaaa

SEQ ID NO: 206690 - DNA, 22 bp, Artificial Sequence
  Synthetic oligonucleotide; TTA chr2 60536068 60536089 60536085 60536090 +
agtcctatctcagctggtgtgc

SEQ ID NO: 206691 - DNA, 22 bp, Artificial Sequence
  Synthetic oligonucleotide; CTA chr2 60536075 60536096 60536092 60536097 +
tctcagctggtgtgcaagtcag

SEQ ID NO: 206692 - DNA, 22 bp, Artificial Sequence
  Synthetic oligonucleotide; CTC chr2 60536079 60536100 60536096 60536101 +
agctggtgtgcaagtcagactg

SEQ ID NO: 206693 - DNA, 22 bp, Artificial Sequence
  Synthetic oligonucleotide; CTG chr2 60536084 60536105 60536101 60536106 +
gtgtgcaagtcagactgagaat

SEQ ID NO: 206694 - DNA, 22 bp, Artificial Sequence
  Synthetic oligonucleotide; CTG chr2 60536101 60536122 60536118 60536123 +
agaataacagcttcgaaaggcc

SEQ ID NO: 206695 - DNA, 22 bp, Artificial Sequence
  Synthetic oligonucleotide; CTT chr2 60536114 60536135 60536131 60536136 +
cgaaaggccacgtgtcccagct

SEQ ID NO: 206696 - DNA, 22 bp, Artificial Sequence
  Synthetic oligonucleotide; TTC chr2 60536115 60536136 60536132 60536137 +
gaaaggccacgtgtcccagctt

SEQ ID NO: 206697 - DNA, 22 bp, Artificial Sequence
  Synthetic oligonucleotide; CTT chr2 60536137 60536158 60536154 60536159 +
accgctccactgctagacccaa

SEQ ID NO: 206698 - DNA, 22 bp, Artificial Sequence
  Synthetic oligonucleotide; TTA chr2 60536138 60536159 60536155 60536160 +
ccgctccactgctagacccaaa

SEQ ID NO: 206699 - DNA, 22 bp, Artificial Sequence
  Synthetic oligonucleotide; CTC chr2 60536144 60536165 60536161 60536166 +
cactgctagacccaaaagctct

SEQ ID NO: 206700 - DNA, 22 bp, Artificial Sequence
  Synthetic oligonucleotide; CTG chr2 60536149 60536170 60536166 60536171 +
ctagacccaaaagctctctgct

SEQ ID NO: 206701 - DNA, 22 bp, Artificial Sequence
  Synthetic oligonucleotide; CTA chr2 60536152 60536173 60536169 60536174 +
gacccaaaagctctctgctgtg

SEQ ID NO: 206702 - DNA, 22 bp, Artificial Sequence
  Synthetic oligonucleotide; CTC chr2 60536165 60536186 60536182 60536187 +
tctgctgtggggatttcatttg

SEQ ID NO: 206703 - DNA, 22 bp, Artificial Sequence
  Synthetic oligonucleotide; CTC chr2 60536167 60536188 60536184 60536189 +
tgctgtggggatttcatttgaa

SEQ ID NO: 206704 - DNA, 22 bp, Artificial Sequence
  Synthetic oligonucleotide; CTG chr2 60536169 60536190 60536186 60536191 +
ctgtggggatttcatttgaact

SEQ ID NO: 206705 - DNA, 22 bp, Artificial Sequence
  Synthetic oligonucleotide; CTG chr2 60536172 60536193 60536189 60536194 +
tggggatttcatttgaactgct

SEQ ID NO: 206706 - DNA, 22 bp, Artificial Sequence
  Synthetic oligonucleotide; TTT chr2 60536181 60536202 60536198 60536203 +
catttgaactgctatcgaagaa

SEQ ID NO: 206707 - DNA, 22 bp, Artificial Sequence
  Synthetic oligonucleotide; TTC chr2 60536182 60536203 60536199 60536204 +
atttgaactgctatcgaagaat

SEQ ID NO: 206708 - DNA, 22 bp, Artificial Sequence
  Synthetic oligonucleotide; TTT chr2 60536186 60536207 60536203 60536208 +
gaactgctatcgaagaatattc

SEQ ID NO: 206709 - DNA, 22 bp, Artificial Sequence
  Synthetic oligonucleotide; TTG chr2 60536187 60536208 60536204 60536209 +
aactgctatcgaagaatattcc

SEQ ID NO: 206710 - DNA, 22 bp, Artificial Sequence
  Synthetic oligonucleotide; CTG chr2 60536192 60536213 60536209 60536214 +
ctatcgaagaatattccaagaa

SEQ ID NO: 206711 - DNA, 22 bp, Artificial Sequence
  Synthetic oligonucleotide; CTA chr2 60536195 60536216 60536212 60536217 +
tcgaagaatattccaagaacct

SEQ ID NO: 206712 - DNA, 22 bp, Artificial Sequence
  Synthetic oligonucleotide; TTC chr2 60536208 60536229 60536225 60536230 +
caagaacctctctccgcaccct

SEQ ID NO: 206713 - DNA, 22 bp, Artificial Sequence
  Synthetic oligonucleotide; CTC chr2 60536218 60536239 60536235 60536240 +
tctccgcacccttctccccctc

SEQ ID NO: 206714 - DNA, 22 bp, Artificial Sequence
  Synthetic oligonucleotide; CTC chr2 60536220 60536241 60536237 60536242 +
tccgcacccttctccccctctc

SEQ ID NO: 206715 - DNA, 22 bp, Artificial Sequence
  Synthetic oligonucleotide; CTC chr2 60536222 60536243 60536239 60536244 +
cgcacccttctccccctctctc

SEQ ID NO: 206716 - DNA, 22 bp, Artificial Sequence
  Synthetic oligonucleotide; CTT chr2 60536231 60536252 60536248 60536253 +
ctccccctctctcccccagcct

SEQ ID NO: 206717 - DNA, 22 bp, Artificial Sequence
  Synthetic oligonucleotide; TTC chr2 60536232 60536253 60536249 60536254 +
tccccctctctcccccagcctc

SEQ ID NO: 206718 - DNA, 22 bp, Artificial Sequence
  Synthetic oligonucleotide; CTC chr2 60536234 60536255 60536251 60536256 +
cccctctctcccccagcctcag

SEQ ID NO: 206719 - DNA, 22 bp, Artificial Sequence
  Synthetic oligonucleotide; CTC chr2 60536240 60536261 60536257 60536262 +
tctcccccagcctcagactttc

SEQ ID NO: 206720 - DNA, 22 bp, Artificial Sequence
  Synthetic oligonucleotide; CTC chr2 60536242 60536263 60536259 60536264 +
tcccccagcctcagactttctc

SEQ ID NO: 206721 - DNA, 22 bp, Artificial Sequence
  Synthetic oligonucleotide; CTC chr2 60536244 60536265 60536261 60536266 +
ccccagcctcagactttctcct

SEQ ID NO: 206722 - DNA, 22 bp, Artificial Sequence
  Synthetic oligonucleotide; CTC chr2 60536254 60536275 60536271 60536276 +
agactttctcctagagttgatc

SEQ ID NO: 206723 - DNA, 22 bp, Artificial Sequence
  Synthetic oligonucleotide; CTT chr2 60536260 60536281 60536277 60536282 +
tctcctagagttgatcttaccg

SEQ ID NO: 206724 - DNA, 22 bp, Artificial Sequence
  Synthetic oligonucleotide; TTT chr2 60536261 60536282 60536278 60536283 +
ctcctagagttgatcttaccgg

SEQ ID NO: 206725 - DNA, 22 bp, Artificial Sequence
  Synthetic oligonucleotide; TTC chr2 60536262 60536283 60536279 60536284 +
tcctagagttgatcttaccgga

SEQ ID NO: 206726 - DNA, 22 bp, Artificial Sequence
  Synthetic oligonucleotide; CTC chr2 60536264 60536285 60536281 60536286 +
ctagagttgatcttaccggaaa

SEQ ID NO: 206727 - DNA, 22 bp, Artificial Sequence
  Synthetic oligonucleotide; CTA chr2 60536267 60536288 60536284 60536289 +
gagttgatcttaccggaaatgt

SEQ ID NO: 206728 - DNA, 22 bp, Artificial Sequence
  Synthetic oligonucleotide; TTG chr2 60536273 60536294 60536290 60536295 +
atcttaccggaaatgtggatgt

SEQ ID NO: 206729 - DNA, 22 bp, Artificial Sequence
  Synthetic oligonucleotide; CTT chr2 60536278 60536299 60536295 60536300 +
accggaaatgtggatgttatca

SEQ ID NO: 206730 - DNA, 22 bp, Artificial Sequence
  Synthetic oligonucleotide; TTA chr2 60536279 60536300 60536296 60536301 +
ccggaaatgtggatgttatcaa

SEQ ID NO: 206731 - DNA, 22 bp, Artificial Sequence
  Synthetic oligonucleotide; TTA chr2 60536297 60536318 60536314 60536319 +
tcaaggaaatcggaaagagaag

SEQ ID NO: 206732 - DNA, 22 bp, Artificial Sequence
  Synthetic oligonucleotide; CTC chr2 60536332 60536353 60536349 60536354 +
aggtactaccccctgatttctt

SEQ ID NO: 206733 - DNA, 22 bp, Artificial Sequence
  Synthetic oligonucleotide; CTA chr2 60536340 60536361 60536357 60536362 +
ccccctgatttcttaactctct

SEQ ID NO: 206734 - DNA, 22 bp, Artificial Sequence
  Synthetic oligonucleotide; CTG chr2 60536347 60536368 60536364 60536369 +
atttcttaactctcttatcctt

SEQ ID NO: 206735 - DNA, 22 bp, Artificial Sequence
  Synthetic oligonucleotide; TTT chr2 60536351 60536372 60536368 60536373 +
cttaactctcttatccttgggc

SEQ ID NO: 206736 - DNA, 22 bp, Artificial Sequence
  Synthetic oligonucleotide; TTC chr2 60536352 60536373 60536369 60536374 +
ttaactctcttatccttgggcc

SEQ ID NO: 206737 - DNA, 22 bp, Artificial Sequence
  Synthetic oligonucleotide; CTT chr2 60536354 60536375 60536371 60536376 +
aactctcttatccttgggccct

SEQ ID NO: 206738 - DNA, 22 bp, Artificial Sequence
  Synthetic oligonucleotide; TTA chr2 60536355 60536376 60536372 60536377 +
actctcttatccttgggccctg

SEQ ID NO: 206739 - DNA, 22 bp, Artificial Sequence
  Synthetic oligonucleotide; CTC chr2 60536359 60536380 60536376 60536381 +
tcttatccttgggccctgctca

SEQ ID NO: 206740 - DNA, 22 bp, Artificial Sequence
  Synthetic oligonucleotide; CTC chr2 60536361 60536382 60536378 60536383 +
ttatccttgggccctgctcaga

SEQ ID NO: 206741 - DNA, 22 bp, Artificial Sequence
  Synthetic oligonucleotide; CTT chr2 60536363 60536384 60536380 60536385 +
atccttgggccctgctcagaaa

SEQ ID NO: 206742 - DNA, 22 bp, Artificial Sequence
  Synthetic oligonucleotide; TTA chr2 60536364 60536385 60536381 60536386 +
tccttgggccctgctcagaaat

SEQ ID NO: 206743 - DNA, 22 bp, Artificial Sequence
  Synthetic oligonucleotide; CTT chr2 60536369 60536390 60536386 60536391 +
gggccctgctcagaaatgtgcc

SEQ ID NO: 206744 - DNA, 22 bp, Artificial Sequence
  Synthetic oligonucleotide; TTG chr2 60536370 60536391 60536387 60536392 +
ggccctgctcagaaatgtgcca

SEQ ID NO: 206745 - DNA, 22 bp, Artificial Sequence
  Synthetic oligonucleotide; CTG chr2 60536377 60536398 60536394 60536399 +
ctcagaaatgtgccacatttta

SEQ ID NO: 206746 - DNA, 22 bp, Artificial Sequence
  Synthetic oligonucleotide; CTC chr2 60536380 60536401 60536397 60536402 +
agaaatgtgccacattttaaca

SEQ ID NO: 206747 - DNA, 22 bp, Artificial Sequence
  Synthetic oligonucleotide; TTT chr2 60536397 60536418 60536414 60536419 +
taacatttattagaaaggatag

SEQ ID NO: 206748 - DNA, 22 bp, Artificial Sequence
  Synthetic oligonucleotide; TTT chr2 60536398 60536419 60536415 60536420 +
aacatttattagaaaggatagg

SEQ ID NO: 206749 - DNA, 22 bp, Artificial Sequence
  Synthetic oligonucleotide; TTA chr2 60536399 60536420 60536416 60536421 +
acatttattagaaaggatagga

SEQ ID NO: 206750 - DNA, 22 bp, Artificial Sequence
  Synthetic oligonucleotide; TTT chr2 60536405 60536426 60536422 60536427 +
attagaaaggataggatgcaga

SEQ ID NO: 206751 - DNA, 22 bp, Artificial Sequence
  Synthetic oligonucleotide; TTA chr2 60536406 60536427 60536423 60536428 +
ttagaaaggataggatgcagag

SEQ ID NO: 206752 - DNA, 22 bp, Artificial Sequence
  Synthetic oligonucleotide; TTA chr2 60536409 60536430 60536426 60536431 +
gaaaggataggatgcagagctg

SEQ ID NO: 206753 - DNA, 22 bp, Artificial Sequence
  Synthetic oligonucleotide; CTG chr2 60536431 60536452 60536448 60536453 +
catggaacccacatccacaacc

SEQ ID NO: 206754 - DNA, 22 bp, Artificial Sequence
  Synthetic oligonucleotide; CTG chr2 60536458 60536479 60536475 60536480 +
tatgagccacaggtccacagtc

SEQ ID NO: 206755 - DNA, 22 bp, Artificial Sequence
  Synthetic oligonucleotide; CTG chr2 60536483 60536504 60536500 60536505 +
accaattccgtttgacactaat

SEQ ID NO: 206756 - DNA, 22 bp, Artificial Sequence
  Synthetic oligonucleotide; TTC chr2 60536491 60536512 60536508 60536513 +
cgtttgacactaatgttactct

SEQ ID NO: 206757 - DNA, 22 bp, Artificial Sequence
  Synthetic oligonucleotide; TTT chr2 60536496 60536517 60536513 60536518 +
gacactaatgttactctacatg

SEQ ID NO: 206758 - DNA, 22 bp, Artificial Sequence
  Synthetic oligonucleotide; TTG chr2 60536497 60536518 60536514 60536519 +
acactaatgttactctacatga

SEQ ID NO: 206759 - DNA, 22 bp, Artificial Sequence
  Synthetic oligonucleotide; CTA chr2 60536503 60536524 60536520 60536525 +
atgttactctacatgagtagag

SEQ ID NO: 206760 - DNA, 22 bp, Artificial Sequence
  Synthetic oligonucleotide; TTA chr2 60536509 60536530 60536526 60536531 +
ctctacatgagtagagttcaat

SEQ ID NO: 206761 - DNA, 22 bp, Artificial Sequence
  Synthetic oligonucleotide; CTC chr2 60536512 60536533 60536529 60536534 +
tacatgagtagagttcaatgag

SEQ ID NO: 206762 - DNA, 22 bp, Artificial Sequence
  Synthetic oligonucleotide; CTA chr2 60536514 60536535 60536531 60536536 +
catgagtagagttcaatgaggg

SEQ ID NO: 206763 - DNA, 22 bp, Artificial Sequence
  Synthetic oligonucleotide; TTC chr2 60536528 60536549 60536545 60536550 +
aatgagggttgatatgggatgt

SEQ ID NO: 206764 - DNA, 22 bp, Artificial Sequence
  Synthetic oligonucleotide; TTG chr2 60536539 60536560 60536556 60536561 +
atatgggatgtgacagggcaaa

SEQ ID NO: 206765 - DNA, 22 bp, Artificial Sequence
  Synthetic oligonucleotide; TTA chr2 60536570 60536591 60536587 60536592 +
gattaaaaacaaaagtttagaa

SEQ ID NO: 206766 - DNA, 22 bp, Artificial Sequence
  Synthetic oligonucleotide; TTA chr2 60536575 60536596 60536592 60536597 +
aaaacaaaagtttagaaaccaa

SEQ ID NO: 206767 - DNA, 22 bp, Artificial Sequence
  Synthetic oligonucleotide; TTT chr2 60536588 60536609 60536605 60536610 +
agaaaccaatgctacactacag

SEQ ID NO: 206768 - DNA, 22 bp, Artificial Sequence
  Synthetic oligonucleotide; TTA chr2 60536589 60536610 60536606 60536611 +
gaaaccaatgctacactacaga

SEQ ID NO: 206769 - DNA, 22 bp, Artificial Sequence
  Synthetic oligonucleotide; CTA chr2 60536602 60536623 60536619 60536624 +
cactacagagcaaatgggactt

SEQ ID NO: 206770 - DNA, 22 bp, Artificial Sequence
  Synthetic oligonucleotide; CTA chr2 60536607 60536628 60536624 60536629 +
cagagcaaatgggacttgaagg

SEQ ID NO: 206771 - DNA, 22 bp, Artificial Sequence
  Synthetic oligonucleotide; CTT chr2 60536624 60536645 60536641 60536646 +
gaaggccaaatttcccctaact

SEQ ID NO: 206772 - DNA, 22 bp, Artificial Sequence
  Synthetic oligonucleotide; TTG chr2 60536625 60536646 60536642 60536647 +
aaggccaaatttcccctaactg

SEQ ID NO: 206773 - DNA, 22 bp, Artificial Sequence
  Synthetic oligonucleotide; TTT chr2 60536637 60536658 60536654 60536659 +
cccctaactgccttcaagtgat

SEQ ID NO: 206774 - DNA, 22 bp, Artificial Sequence
  Synthetic oligonucleotide; TTC chr2 60536638 60536659 60536655 60536660 +
ccctaactgccttcaagtgatt

SEQ ID NO: 206775 - DNA, 22 bp, Artificial Sequence
  Synthetic oligonucleotide; CTA chr2 60536643 60536664 60536660 60536665 +
actgccttcaagtgattttccc

SEQ ID NO: 206776 - DNA, 22 bp, Artificial Sequence
  Synthetic oligonucleotide; CTG chr2 60536647 60536668 60536664 60536669 +
ccttcaagtgattttccctatt

SEQ ID NO: 206777 - DNA, 22 bp, Artificial Sequence
  Synthetic oligonucleotide; CTT chr2 60536651 60536672 60536668 60536673 +
caagtgattttccctattagag

SEQ ID NO: 206778 - DNA, 22 bp, Artificial Sequence
  Synthetic oligonucleotide; TTC chr2 60536652 60536673 60536669 60536674 +
aagtgattttccctattagagc

SEQ ID NO: 206779 - DNA, 22 bp, Artificial Sequence
  Synthetic oligonucleotide; TTT chr2 60536661 60536682 60536678 60536683 +
tccctattagagcgtttgcctg

SEQ ID NO: 206780 - DNA, 22 bp, Artificial Sequence
  Synthetic oligonucleotide; TTT chr2 60536662 60536683 60536679 60536684 +
ccctattagagcgtttgcctgc

SEQ ID NO: 206781 - DNA, 22 bp, Artificial Sequence
  Synthetic oligonucleotide; TTC chr2 60536663 60536684 60536680 60536685 +
cctattagagcgtttgcctgcc

SEQ ID NO: 206782 - DNA, 22 bp, Artificial Sequence
  Synthetic oligonucleotide; CTA chr2 60536667 60536688 60536684 60536689 +
ttagagcgtttgcctgccaccc

SEQ ID NO: 206783 - DNA, 22 bp, Artificial Sequence
  Synthetic oligonucleotide; TTA chr2 60536670 60536691 60536687 60536692 +
gagcgtttgcctgccacccccc

SEQ ID NO: 206784 - DNA, 22 bp, Artificial Sequence
  Synthetic oligonucleotide; TTT chr2 60536678 60536699 60536695 60536700 +
gcctgccacccccctgctggca

SEQ ID NO: 206785 - DNA, 22 bp, Artificial Sequence
  Synthetic oligonucleotide; TTG chr2 60536679 60536700 60536696 60536701 +
cctgccacccccctgctggcaa

SEQ ID NO: 206786 - DNA, 22 bp, Artificial Sequence
  Synthetic oligonucleotide; CTG chr2 60536683 60536704 60536700 60536705 +
ccacccccctgctggcaacacc

SEQ ID NO: 206787 - DNA, 22 bp, Artificial Sequence
  Synthetic oligonucleotide; CTG chr2 60536694 60536715 60536711 60536716 +
ctggcaacaccgcaatcacatc

SEQ ID NO: 206788 - DNA, 22 bp, Artificial Sequence
  Synthetic oligonucleotide; CTG chr2 60536697 60536718 60536714 60536719 +
gcaacaccgcaatcacatcaga

SEQ ID NO: 206789 - DNA, 22 bp, Artificial Sequence
  Synthetic oligonucleotide; CTT chr2 60536749 60536770 60536766 60536771 +
gagatattcctctttaaataca

SEQ ID NO: 206790 - DNA, 22 bp, Artificial Sequence
  Synthetic oligonucleotide; TTG chr2 60536750 60536771 60536767 60536772 +
agatattcctctttaaatacaa

SEQ ID NO: 206791 - DNA, 22 bp, Artificial Sequence
  Synthetic oligonucleotide; TTC chr2 60536758 60536779 60536775 60536780 +
ctctttaaatacaatacctata

SEQ ID NO: 206792 - DNA, 22 bp, Artificial Sequence
  Synthetic oligonucleotide; CTC chr2 60536761 60536782 60536778 60536783 +
tttaaatacaatacctatatac

SEQ ID NO: 206793 - DNA, 22 bp, Artificial Sequence
  Synthetic oligonucleotide; CTT chr2 60536763 60536784 60536780 60536785 +
taaatacaatacctatatactt

SEQ ID NO: 206794 - DNA, 22 bp, Artificial Sequence
  Synthetic oligonucleotide; TTT chr2 60536764 60536785 60536781 60536786 +
aaatacaatacctatatactta

SEQ ID NO: 206795 - DNA, 22 bp, Artificial Sequence
  Synthetic oligonucleotide; TTA chr2 60536765 60536786 60536782 60536787 +
aatacaatacctatatacttaa

SEQ ID NO: 206796 - DNA, 22 bp, Artificial Sequence
  Synthetic oligonucleotide; CTA chr2 60536778 60536799 60536795 60536800 +
tatacttaatatatagcaatta

SEQ ID NO: 206797 - DNA, 22 bp, Artificial Sequence
  Synthetic oligonucleotide; CTT chr2 60536785 60536806 60536802 60536807 +
aatatatagcaattaacttctg

SEQ ID NO: 206798 - DNA, 22 bp, Artificial Sequence
  Synthetic oligonucleotide; TTA chr2 60536786 60536807 60536803 60536808 +
atatatagcaattaacttctgg

SEQ ID NO: 206799 - DNA, 22 bp, Artificial Sequence
  Synthetic oligonucleotide; TTA chr2 60536800 60536821 60536817 60536822 +
acttctggtcagcagtgtgcag

SEQ ID NO: 206800 - DNA, 22 bp, Artificial Sequence
  Synthetic oligonucleotide; CTT chr2 60536804 60536825 60536821 60536826 +
ctggtcagcagtgtgcaggcag

SEQ ID NO: 206801 - DNA, 22 bp, Artificial Sequence
  Synthetic oligonucleotide; TTC chr2 60536805 60536826 60536822 60536827 +
tggtcagcagtgtgcaggcagc

SEQ ID NO: 206802 - DNA, 22 bp, Artificial Sequence
  Synthetic oligonucleotide; CTG chr2 60536807 60536828 60536824 60536829 +
gtcagcagtgtgcaggcagcag

SEQ ID NO: 206803 - DNA, 22 bp, Artificial Sequence
  Synthetic oligonucleotide; CTG chr2 60536833 60536854 60536850 60536855 +
ccccaagcagataggaggggag

SEQ ID NO: 206804 - DNA, 22 bp, Artificial Sequence
  Synthetic oligonucleotide; CTG chr2 60536870 60536891 60536887 60536892 +
ggacaagcacaaaagacaggtc

SEQ ID NO: 206805 - DNA, 22 bp, Artificial Sequence
  Synthetic oligonucleotide; CTG chr2 60536907 60536928 60536924 60536929 +
ctgtcagcagctgaattatttt

SEQ ID NO: 206806 - DNA, 22 bp, Artificial Sequence
  Synthetic oligonucleotide; CTG chr2 60536910 60536931 60536927 60536932 +
tcagcagctgaattatttttat

SEQ ID NO: 206807 - DNA, 22 bp, Artificial Sequence
  Synthetic oligonucleotide; CTG chr2 60536920 60536941 60536937 60536942 +
aattatttttatacaggaattt

SEQ ID NO: 206808 - DNA, 22 bp, Artificial Sequence
  Synthetic oligonucleotide; TTA chr2 60536925 60536946 60536942 60536947 +
tttttatacaggaatttttatc

SEQ ID NO: 206809 - DNA, 22 bp, Artificial Sequence
  Synthetic oligonucleotide; TTT chr2 60536928 60536949 60536945 60536950 +
ttatacaggaatttttatctct

SEQ ID NO: 206810 - DNA, 22 bp, Artificial Sequence
  Synthetic oligonucleotide; TTT chr2 60536929 60536950 60536946 60536951 +
tatacaggaatttttatctcta

SEQ ID NO: 206811 - DNA, 22 bp, Artificial Sequence
  Synthetic oligonucleotide; TTT chr2 60536930 60536951 60536947 60536952 +
atacaggaatttttatctctat

SEQ ID NO: 206812 - DNA, 22 bp, Artificial Sequence
  Synthetic oligonucleotide; TTA chr2 60536931 60536952 60536948 60536953 +
tacaggaatttttatctctatt

SEQ ID NO: 206813 - DNA, 22 bp, Artificial Sequence
  Synthetic oligonucleotide; TTT chr2 60536942 60536963 60536959 60536964 +
ttatctctattgtacaaacaag

SEQ ID NO: 206814 - DNA, 22 bp, Artificial Sequence
  Synthetic oligonucleotide; TTT chr2 60536943 60536964 60536960 60536965 +
tatctctattgtacaaacaagt

SEQ ID NO: 206815 - DNA, 22 bp, Artificial Sequence
  Synthetic oligonucleotide; TTT chr2 60536944 60536965 60536961 60536966 +
atctctattgtacaaacaagta

SEQ ID NO: 206816 - DNA, 22 bp, Artificial Sequence
  Synthetic oligonucleotide; TTA chr2 60536945 60536966 60536962 60536967 +
tctctattgtacaaacaagtac

SEQ ID NO: 206817 - DNA, 22 bp, Artificial Sequence
  Synthetic oligonucleotide; CTC chr2 60536949 60536970 60536966 60536971 +
tattgtacaaacaagtacgtgt

SEQ ID NO: 206818 - DNA, 22 bp, Artificial Sequence
  Synthetic oligonucleotide; CTA chr2 60536951 60536972 60536968 60536973 +
ttgtacaaacaagtacgtgtct

SEQ ID NO: 206819 - DNA, 22 bp, Artificial Sequence
  Synthetic oligonucleotide; TTG chr2 60536954 60536975 60536971 60536976 +
tacaaacaagtacgtgtctgtg

SEQ ID NO: 206820 - DNA, 22 bp, Artificial Sequence
  Synthetic oligonucleotide; CTG chr2 60536974 60536995 60536991 60536996 +
tgctgacttgttaagcaatcca

SEQ ID NO: 206821 - DNA, 22 bp, Artificial Sequence
  Synthetic oligonucleotide; CTG chr2 60536979 60537000 60536996 60537001 +
acttgttaagcaatccacttgt

SEQ ID NO: 206822 - DNA, 22 bp, Artificial Sequence
  Synthetic oligonucleotide; CTT chr2 60536983 60537004 60537000 60537005 +
gttaagcaatccacttgtatgt

SEQ ID NO: 206823 - DNA, 22 bp, Artificial Sequence
  Synthetic oligonucleotide; TTG chr2 60536984 60537005 60537001 60537006 +
ttaagcaatccacttgtatgta

SEQ ID NO: 206824 - DNA, 22 bp, Artificial Sequence
  Synthetic oligonucleotide; TTA chr2 60536987 60537008 60537004 60537009 +
agcaatccacttgtatgtagaa

SEQ ID NO: 206825 - DNA, 22 bp, Artificial Sequence
  Synthetic oligonucleotide; CTT chr2 60536999 60537020 60537016 60537021 +
gtatgtagaataagattttttt

SEQ ID NO: 206826 - DNA, 22 bp, Artificial Sequence
  Synthetic oligonucleotide; TTG chr2 60537000 60537021 60537017 60537022 +
tatgtagaataagatttttttt

SEQ ID NO: 206827 - DNA, 22 bp, Artificial Sequence
  Synthetic oligonucleotide; TTT chr2 60537017 60537038 60537034 60537039 +
tttttctttcttgctaccagtc

SEQ ID NO: 206828 - DNA, 22 bp, Artificial Sequence
  Synthetic oligonucleotide; TTT chr2 60537018 60537039 60537035 60537040 +
ttttctttcttgctaccagtca

SEQ ID NO: 206829 - DNA, 22 bp, Artificial Sequence
  Synthetic oligonucleotide; TTT chr2 60537019 60537040 60537036 60537041 +
tttctttcttgctaccagtcac

SEQ ID NO: 206830 - DNA, 22 bp, Artificial Sequence
  Synthetic oligonucleotide; TTT chr2 60537020 60537041 60537037 60537042 +
ttctttcttgctaccagtcaca

SEQ ID NO: 206831 - DNA, 22 bp, Artificial Sequence
  Synthetic oligonucleotide; TTT chr2 60537021 60537042 60537038 60537043 +
tctttcttgctaccagtcacac

SEQ ID NO: 206832 - DNA, 22 bp, Artificial Sequence
  Synthetic oligonucleotide; TTT chr2 60537022 60537043 60537039 60537044 +
ctttcttgctaccagtcacaca

SEQ ID NO: 206833 - DNA, 22 bp, Artificial Sequence
  Synthetic oligonucleotide; TTC chr2 60537023 60537044 60537040 60537045 +
tttcttgctaccagtcacacag

SEQ ID NO: 206834 - DNA, 22 bp, Artificial Sequence
  Synthetic oligonucleotide; CTT chr2 60537025 60537046 60537042 60537047 +
tcttgctaccagtcacacagct

SEQ ID NO: 206835 - DNA, 22 bp, Artificial Sequence
  Synthetic oligonucleotide; TTT chr2 60537026 60537047 60537043 60537048 +
cttgctaccagtcacacagctc

SEQ ID NO: 206836 - DNA, 22 bp, Artificial Sequence
  Synthetic oligonucleotide; TTC chr2 60537027 60537048 60537044 60537049 +
ttgctaccagtcacacagctcc

SEQ ID NO: 206837 - DNA, 22 bp, Artificial Sequence
  Synthetic oligonucleotide; CTT chr2 60537029 60537050 60537046 60537051 +
gctaccagtcacacagctccaa

SEQ ID NO: 206838 - DNA, 22 bp, Artificial Sequence
  Synthetic oligonucleotide; TTG chr2 60537030 60537051 60537047 60537052 +
ctaccagtcacacagctccaag

SEQ ID NO: 206839 - DNA, 22 bp, Artificial Sequence
  Synthetic oligonucleotide; CTA chr2 60537033 60537054 60537050 60537055 +
ccagtcacacagctccaagatc

SEQ ID NO: 206840 - DNA, 22 bp, Artificial Sequence
  Synthetic oligonucleotide; CTC chr2 60537048 60537069 60537065 60537070 +
caagatcagaagaaatacatag

SEQ ID NO: 206841 - DNA, 22 bp, Artificial Sequence
  Synthetic oligonucleotide; CTT chr2 60537074 60537095 60537091 60537096 +
tgaagctgctcaaatgttttag

SEQ ID NO: 206842 - DNA, 22 bp, Artificial Sequence
  Synthetic oligonucleotide; TTT chr2 60537075 60537096 60537092 60537097 +
gaagctgctcaaatgttttagt

SEQ ID NO: 206843 - DNA, 22 bp, Artificial Sequence
  Synthetic oligonucleotide; TTG chr2 60537076 60537097 60537093 60537098 +
aagctgctcaaatgttttagtt

SEQ ID NO: 206844 - DNA, 22 bp, Artificial Sequence
  Synthetic oligonucleotide; CTG chr2 60537082 60537103 60537099 60537104 +
ctcaaatgttttagttaaaagg

SEQ ID NO: 206845 - DNA, 22 bp, Artificial Sequence
  Synthetic oligonucleotide; CTC chr2 60537085 60537106 60537102 60537107 +
aaatgttttagttaaaaggaca

SEQ ID NO: 206846 - DNA, 22 bp, Artificial Sequence
  Synthetic oligonucleotide; TTT chr2 60537093 60537114 60537110 60537115 +
tagttaaaaggacagcagttgt

SEQ ID NO: 206847 - DNA, 22 bp, Artificial Sequence
  Synthetic oligonucleotide; TTT chr2 60537094 60537115 60537111 60537116 +
agttaaaaggacagcagttgtt

SEQ ID NO: 206848 - DNA, 22 bp, Artificial Sequence
  Synthetic oligonucleotide; TTA chr2 60537095 60537116 60537112 60537117 +
gttaaaaggacagcagttgttt

SEQ ID NO: 206849 - DNA, 22 bp, Artificial Sequence
  Synthetic oligonucleotide; TTA chr2 60537099 60537120 60537116 60537121 +
aaaggacagcagttgttttcaa

SEQ ID NO: 206850 - DNA, 22 bp, Artificial Sequence
  Synthetic oligonucleotide; TTG chr2 60537114 60537135 60537131 60537136 +
ttttcaaagatccaagagtatc

SEQ ID NO: 206851 - DNA, 22 bp, Artificial Sequence
  Synthetic oligonucleotide; TTT chr2 60537117 60537138 60537134 60537139 +
tcaaagatccaagagtatcttt

SEQ ID NO: 206852 - DNA, 22 bp, Artificial Sequence
  Synthetic oligonucleotide; TTT chr2 60537118 60537139 60537135 60537140 +
caaagatccaagagtatcttta

SEQ ID NO: 206853 - DNA, 22 bp, Artificial Sequence
  Synthetic oligonucleotide; TTC chr2 60537119 60537140 60537136 60537141 +
aaagatccaagagtatctttat

SEQ ID NO: 206854 - DNA, 22 bp, Artificial Sequence
  Synthetic oligonucleotide; CTT chr2 60537138 60537159 60537155 60537160 +
tatcagaattaaatttttcctt

SEQ ID NO: 206855 - DNA, 22 bp, Artificial Sequence
  Synthetic oligonucleotide; TTT chr2 60537139 60537160 60537156 60537161 +
atcagaattaaatttttcctta

SEQ ID NO: 206856 - DNA, 22 bp, Artificial Sequence
  Synthetic oligonucleotide; TTA chr2 60537140 60537161 60537157 60537162 +
tcagaattaaatttttccttat

SEQ ID NO: 206857 - DNA, 22 bp, Artificial Sequence
  Synthetic oligonucleotide; TTA chr2 60537149 60537170 60537166 60537171 +
aatttttccttattgatttttt

SEQ ID NO: 206858 - DNA, 22 bp, Artificial Sequence
  Synthetic oligonucleotide; TTT chr2 60537154 60537175 60537171 60537176 +
ttccttattgatttttttctcc

SEQ ID NO: 206859 - DNA, 22 bp, Artificial Sequence
  Synthetic oligonucleotide; TTT chr2 60537155 60537176 60537172 60537177 +
tccttattgatttttttctcct

SEQ ID NO: 206860 - DNA, 22 bp, Artificial Sequence
  Synthetic oligonucleotide; TTT chr2 60537156 60537177 60537173 60537178 +
ccttattgatttttttctcctt

SEQ ID NO: 206861 - DNA, 22 bp, Artificial Sequence
  Synthetic oligonucleotide; TTC chr2 60537157 60537178 60537174 60537179 +
cttattgatttttttctcctta

SEQ ID NO: 206862 - DNA, 22 bp, Artificial Sequence
  Synthetic oligonucleotide; CTT chr2 60537160 60537181 60537177 60537182 +
attgatttttttctccttaaca

SEQ ID NO: 206863 - DNA, 22 bp, Artificial Sequence
  Synthetic oligonucleotide; TTA chr2 60537161 60537182 60537178 60537183 +
ttgatttttttctccttaacat

SEQ ID NO: 206864 - DNA, 22 bp, Artificial Sequence
  Synthetic oligonucleotide; TTG chr2 60537164 60537185 60537181 60537186 +
atttttttctccttaacataac

SEQ ID NO: 206865 - DNA, 22 bp, Artificial Sequence
  Synthetic oligonucleotide; TTT chr2 60537168 60537189 60537185 60537190 +
ttttctccttaacataacaaaa

SEQ ID NO: 206866 - DNA, 22 bp, Artificial Sequence
  Synthetic oligonucleotide; TTT chr2 60537169 60537190 60537186 60537191 +
tttctccttaacataacaaaaa

SEQ ID NO: 206867 - DNA, 22 bp, Artificial Sequence
  Synthetic oligonucleotide; TTT chr2 60537170 60537191 60537187 60537192 +
ttctccttaacataacaaaaac

SEQ ID NO: 206868 - DNA, 22 bp, Artificial Sequence
  Synthetic oligonucleotide; TTT chr2 60537171 60537192 60537188 60537193 +
tctccttaacataacaaaaaca

SEQ ID NO: 206869 - DNA, 22 bp, Artificial Sequence
  Synthetic oligonucleotide; TTT chr2 60537172 60537193 60537189 60537194 +
ctccttaacataacaaaaacat

SEQ ID NO: 206870 - DNA, 22 bp, Artificial Sequence
  Synthetic oligonucleotide; TTC chr2 60537173 60537194 60537190 60537195 +
tccttaacataacaaaaacata

SEQ ID NO: 206871 - DNA, 22 bp, Artificial Sequence
  Synthetic oligonucleotide; CTC chr2 60537175 60537196 60537192 60537197 +
cttaacataacaaaaacataac

SEQ ID NO: 206872 - DNA, 22 bp, Artificial Sequence
  Synthetic oligonucleotide; CTT chr2 60537178 60537199 60537195 60537200 +
aacataacaaaaacataacatg

SEQ ID NO: 206873 - DNA, 22 bp, Artificial Sequence
  Synthetic oligonucleotide; TTA chr2 60537179 60537200 60537196 60537201 +
acataacaaaaacataacatga

SEQ ID NO: 206874 - DNA, 22 bp, Artificial Sequence
  Synthetic oligonucleotide; TTA chr2 60537209 60537230 60537226 60537231 +
cgatttattattaaaatttttt

SEQ ID NO: 206875 - DNA, 22 bp, Artificial Sequence
  Synthetic oligonucleotide; TTT chr2 60537215 60537236 60537232 60537237 +
attattaaaatttttttcagcc

SEQ ID NO: 206876 - DNA, 22 bp, Artificial Sequence
  Synthetic oligonucleotide; TTA chr2 60537216 60537237 60537233 60537238 +
ttattaaaatttttttcagcct

SEQ ID NO: 206877 - DNA, 22 bp, Artificial Sequence
  Synthetic oligonucleotide; TTA chr2 60537219 60537240 60537236 60537241 +
ttaaaatttttttcagccttta

SEQ ID NO: 206878 - DNA, 22 bp, Artificial Sequence
  Synthetic oligonucleotide; TTA chr2 60537222 60537243 60537239 60537244 +
aaatttttttcagcctttaaat

SEQ ID NO: 206879 - DNA, 22 bp, Artificial Sequence
  Synthetic oligonucleotide; TTT chr2 60537228 60537249 60537245 60537250 +
ttttcagcctttaaatcattct

SEQ ID NO: 206880 - DNA, 22 bp, Artificial Sequence
  Synthetic oligonucleotide; TTT chr2 60537229 60537250 60537246 60537251 +
tttcagcctttaaatcattctt

SEQ ID NO: 206881 - DNA, 22 bp, Artificial Sequence
  Synthetic oligonucleotide; TTT chr2 60537230 60537251 60537247 60537252 +
ttcagcctttaaatcattcttc

SEQ ID NO: 206882 - DNA, 22 bp, Artificial Sequence
  Synthetic oligonucleotide; TTT chr2 60537231 60537252 60537248 60537253 +
tcagcctttaaatcattcttca

SEQ ID NO: 206883 - DNA, 22 bp, Artificial Sequence
  Synthetic oligonucleotide; TTT chr2 60537232 60537253 60537249 60537254 +
cagcctttaaatcattcttcag

SEQ ID NO: 206884 - DNA, 22 bp, Artificial Sequence
  Synthetic oligonucleotide; TTC chr2 60537233 60537254 60537250 60537255 +
agcctttaaatcattcttcagt

SEQ ID NO: 206885 - DNA, 22 bp, Artificial Sequence
  Synthetic oligonucleotide; CTT chr2 60537239 60537260 60537256 60537261 +
taaatcattcttcagtagccaa

SEQ ID NO: 206886 - DNA, 22 bp, Artificial Sequence
  Synthetic oligonucleotide; TTT chr2 60537240 60537261 60537257 60537262 +
aaatcattcttcagtagccaat

SEQ ID NO: 206887 - DNA, 22 bp, Artificial Sequence
  Synthetic oligonucleotide; TTA chr2 60537241 60537262 60537258 60537263 +
aatcattcttcagtagccaatg

SEQ ID NO: 206888 - DNA, 22 bp, Artificial Sequence
  Synthetic oligonucleotide; TTC chr2 60537249 60537270 60537266 60537271 +
ttcagtagccaatgttcagttt

SEQ ID NO: 206889 - DNA, 22 bp, Artificial Sequence
  Synthetic oligonucleotide; CTT chr2 60537251 60537272 60537268 60537273 +
cagtagccaatgttcagtttta

SEQ ID NO: 206890 - DNA, 22 bp, Artificial Sequence
  Synthetic oligonucleotide; TTC chr2 60537252 60537273 60537269 60537274 +
agtagccaatgttcagttttaa

SEQ ID NO: 206891 - DNA, 22 bp, Artificial Sequence
  Synthetic oligonucleotide; TTC chr2 60537266 60537287 60537283 60537288 +
agttttaaatgtaaaggaataa

SEQ ID NO: 206892 - DNA, 22 bp, Artificial Sequence
  Synthetic oligonucleotide; TTT chr2 60537271 60537292 60537288 60537293 +
taaatgtaaaggaataattttt

SEQ ID NO: 206893 - DNA, 22 bp, Artificial Sequence
  Synthetic oligonucleotide; TTT chr2 60537272 60537293 60537289 60537294 +
aaatgtaaaggaataatttttt

SEQ ID NO: 206894 - DNA, 22 bp, Artificial Sequence
  Synthetic oligonucleotide; TTA chr2 60537273 60537294 60537290 60537295 +
aatgtaaaggaataattttttt

SEQ ID NO: 206895 - DNA, 22 bp, Artificial Sequence
  Synthetic oligonucleotide; TTT chr2 60537291 60537312 60537308 60537313 +
ttttaaaatattagggtgtgat

SEQ ID NO: 206896 - DNA, 22 bp, Artificial Sequence
  Synthetic oligonucleotide; TTT chr2 60537292 60537313 60537309 60537314 +
tttaaaatattagggtgtgatg

SEQ ID NO: 206897 - DNA, 22 bp, Artificial Sequence
  Synthetic oligonucleotide; TTT chr2 60537293 60537314 60537310 60537315 +
ttaaaatattagggtgtgatgg

SEQ ID NO: 206898 - DNA, 22 bp, Artificial Sequence
  Synthetic oligonucleotide; TTT chr2 60537294 60537315 60537311 60537316 +
taaaatattagggtgtgatgga

SEQ ID NO: 206899 - DNA, 22 bp, Artificial Sequence
  Synthetic oligonucleotide; TTT chr2 60537295 60537316 60537312 60537317 +
aaaatattagggtgtgatggag

SEQ ID NO: 206900 - DNA, 22 bp, Artificial Sequence
  Synthetic oligonucleotide; TTA chr2 60537296 60537317 60537313 60537318 +
aaatattagggtgtgatggaga

SEQ ID NO: 206901 - DNA, 22 bp, Artificial Sequence
  Synthetic oligonucleotide; TTA chr2 60537304 60537325 60537321 60537326 +
gggtgtgatggagagaaactca

SEQ ID NO: 206902 - DNA, 22 bp, Artificial Sequence
  Synthetic oligonucleotide; CTC chr2 60537325 60537346 60537342 60537347 +
acgagatttaagatttaacatt

SEQ ID NO: 206903 - DNA, 22 bp, Artificial Sequence
  Synthetic oligonucleotide; TTT chr2 60537334 60537355 60537351 60537356 +
aagatttaacattggttaatgc

SEQ ID NO: 206904 - DNA, 22 bp, Artificial Sequence
  Synthetic oligonucleotide; TTA chr2 60537335 60537356 60537352 60537357 +
agatttaacattggttaatgca

SEQ ID NO: 206905 - DNA, 22 bp, Artificial Sequence
  Synthetic oligonucleotide; TTT chr2 60537341 60537362 60537358 60537363 +
aacattggttaatgcattgttt

SEQ ID NO: 206906 - DNA, 22 bp, Artificial Sequence
  Synthetic oligonucleotide; TTA chr2 60537342 60537363 60537359 60537364 +
acattggttaatgcattgtttt

SEQ ID NO: 206907 - DNA, 22 bp, Artificial Sequence
  Synthetic oligonucleotide; TTG chr2 60537348 60537369 60537365 60537370 +
gttaatgcattgttttaactgg

SEQ ID NO: 206908 - DNA, 22 bp, Artificial Sequence
  Synthetic oligonucleotide; TTA chr2 60537352 60537373 60537369 60537374 +
atgcattgttttaactggaaac

SEQ ID NO: 206909 - DNA, 22 bp, Artificial Sequence
  Synthetic oligonucleotide; TTG chr2 60537360 60537381 60537377 60537382 +
ttttaactggaaactgaaagga

SEQ ID NO: 206910 - DNA, 22 bp, Artificial Sequence
  Synthetic oligonucleotide; TTT chr2 60537363 60537384 60537380 60537385 +
taactggaaactgaaaggatcg

SEQ ID NO: 206911 - DNA, 22 bp, Artificial Sequence
  Synthetic oligonucleotide; TTT chr2 60537364 60537385 60537381 60537386 +
aactggaaactgaaaggatcgg

SEQ ID NO: 206912 - DNA, 22 bp, Artificial Sequence
  Synthetic oligonucleotide; TTA chr2 60537365 60537386 60537382 60537387 +
actggaaactgaaaggatcggg

SEQ ID NO: 206913 - DNA, 22 bp, Artificial Sequence
  Synthetic oligonucleotide; CTG chr2 60537369 60537390 60537386 60537391 +
gaaactgaaaggatcggggcag

SEQ ID NO: 206914 - DNA, 22 bp, Artificial Sequence
  Synthetic oligonucleotide; CTG chr2 60537376 60537397 60537393 60537398 +
aaaggatcggggcaggggagtt

SEQ ID NO: 206915 - DNA, 22 bp, Artificial Sequence
  Synthetic oligonucleotide; TTA chr2 60537399 60537420 60537416 60537421 +
aaatggggagtaaatggttcac

SEQ ID NO: 206916 - DNA, 22 bp, Artificial Sequence
  Synthetic oligonucleotide; TTC chr2 60537419 60537440 60537436 60537441 +
actgaggggttcccccctaaat

SEQ ID NO: 206917 - DNA, 22 bp, Artificial Sequence
  Synthetic oligonucleotide; CTG chr2 60537423 60537444 60537440 60537445 +
aggggttcccccctaaatgtaa

SEQ ID NO: 206918 - DNA, 22 bp, Artificial Sequence
  Synthetic oligonucleotide; TTC chr2 60537431 60537452 60537448 60537453 +
ccccctaaatgtaaataaatca

SEQ ID NO: 206919 - DNA, 22 bp, Artificial Sequence
  Synthetic oligonucleotide; CTA chr2 60537438 60537459 60537455 60537460 +
aatgtaaataaatcataaaatc

SEQ ID NO: 206920 - DNA, 22 bp, Artificial Sequence
  Synthetic oligonucleotide; CTT chr2 60537472 60537493 60537489 60537494 +
gagttggtgaaggagaatactt

SEQ ID NO: 206921 - DNA, 22 bp, Artificial Sequence
  Synthetic oligonucleotide; TTG chr2 60537473 60537494 60537490 60537495 +
agttggtgaaggagaatacttc

SEQ ID NO: 206922 - DNA, 22 bp, Artificial Sequence
  Synthetic oligonucleotide; TTG chr2 60537478 60537499 60537495 60537500 +
gtgaaggagaatacttcaggtt

SEQ ID NO: 206923 - DNA, 22 bp, Artificial Sequence
  Synthetic oligonucleotide; CTT chr2 60537494 60537515 60537511 60537516 +
caggtttggttctcttagtttt

SEQ ID NO: 206924 - DNA, 22 bp, Artificial Sequence
  Synthetic oligonucleotide; TTC chr2 60537495 60537516 60537512 60537517 +
aggtttggttctcttagttttt

SEQ ID NO: 206925 - DNA, 22 bp, Artificial Sequence
  Synthetic oligonucleotide; TTT chr2 60537501 60537522 60537518 60537523 +
ggttctcttagttttttgaggt

SEQ ID NO: 206926 - DNA, 22 bp, Artificial Sequence
  Synthetic oligonucleotide; TTG chr2 60537502 60537523 60537519 60537524 +
gttctcttagttttttgaggtt

SEQ ID NO: 206927 - DNA, 22 bp, Artificial Sequence
  Synthetic oligonucleotide; TTC chr2 60537506 60537527 60537523 60537528 +
tcttagttttttgaggtttgtt

SEQ ID NO: 206928 - DNA, 22 bp, Artificial Sequence
  Synthetic oligonucleotide; CTC chr2 60537508 60537529 60537525 60537530 +
ttagttttttgaggtttgtttt

SEQ ID NO: 206929 - DNA, 22 bp, Artificial Sequence
  Synthetic oligonucleotide; CTT chr2 60537510 60537531 60537527 60537532 +
agttttttgaggtttgtttttg

SEQ ID NO: 206930 - DNA, 22 bp, Artificial Sequence
  Synthetic oligonucleotide; TTA chr2 60537511 60537532 60537528 60537533 +
gttttttgaggtttgtttttgt

SEQ ID NO: 206931 - DNA, 22 bp, Artificial Sequence
  Synthetic oligonucleotide; TTT chr2 60537515 60537536 60537532 60537537 +
tttgaggtttgtttttgtttga

SEQ ID NO: 206932 - DNA, 22 bp, Artificial Sequence
  Synthetic oligonucleotide; TTT chr2 60537516 60537537 60537533 60537538 +
ttgaggtttgtttttgtttgag

SEQ ID NO: 206933 - DNA, 22 bp, Artificial Sequence
  Synthetic oligonucleotide; TTT chr2 60537517 60537538 60537534 60537539 +
tgaggtttgtttttgtttgagg

SEQ ID NO: 206934 - DNA, 22 bp, Artificial Sequence
  Synthetic oligonucleotide; TTT chr2 60537518 60537539 60537535 60537540 +
gaggtttgtttttgtttgagga

SEQ ID NO: 206935 - DNA, 22 bp, Artificial Sequence
  Synthetic oligonucleotide; TTG chr2 60537519 60537540 60537536 60537541 +
aggtttgtttttgtttgaggag

SEQ ID NO: 206936 - DNA, 22 bp, Artificial Sequence
  Synthetic oligonucleotide; TTT chr2 60537525 60537546 60537542 60537547 +
gtttttgtttgaggaggtgcag

SEQ ID NO: 206937 - DNA, 22 bp, Artificial Sequence
  Synthetic oligonucleotide; TTG chr2 60537526 60537547 60537543 60537548 +
tttttgtttgaggaggtgcagg

SEQ ID NO: 206938 - DNA, 22 bp, Artificial Sequence
  Synthetic oligonucleotide; TTT chr2 60537529 60537550 60537546 60537551 +
ttgtttgaggaggtgcagggat

SEQ ID NO: 206939 - DNA, 22 bp, Artificial Sequence
  Synthetic oligonucleotide; TTT chr2 60537530 60537551 60537547 60537552 +
tgtttgaggaggtgcagggatt

SEQ ID NO: 206940 - DNA, 22 bp, Artificial Sequence
  Synthetic oligonucleotide; TTT chr2 60537531 60537552 60537548 60537553 +
gtttgaggaggtgcagggattg

SEQ ID NO: 206941 - DNA, 22 bp, Artificial Sequence
  Synthetic oligonucleotide; TTG chr2 60537532 60537553 60537549 60537554 +
tttgaggaggtgcagggattgg

SEQ ID NO: 206942 - DNA, 22 bp, Artificial Sequence
  Synthetic oligonucleotide; TTT chr2 60537535 60537556 60537552 60537557 +
gaggaggtgcagggattggcca

SEQ ID NO: 206943 - DNA, 22 bp, Artificial Sequence
  Synthetic oligonucleotide; TTG chr2 60537536 60537557 60537553 60537558 +
aggaggtgcagggattggccaa

SEQ ID NO: 206944 - DNA, 22 bp, Artificial Sequence
  Synthetic oligonucleotide; TTG chr2 60537553 60537574 60537570 60537575 +
gccaaatattaaaactctatat

SEQ ID NO: 206945 - DNA, 22 bp, Artificial Sequence
  Synthetic oligonucleotide; TTA chr2 60537564 60537585 60537581 60537586 +
aaactctatatttaaaatgtac

SEQ ID NO: 206946 - DNA, 22 bp, Artificial Sequence
  Synthetic oligonucleotide; CTC chr2 60537570 60537591 60537587 60537592 +
tatatttaaaatgtacaggaac

SEQ ID NO: 206947 - DNA, 22 bp, Artificial Sequence
  Synthetic oligonucleotide; CTA chr2 60537572 60537593 60537589 60537594 +
tatttaaaatgtacaggaacag

SEQ ID NO: 206948 - DNA, 22 bp, Artificial Sequence
  Synthetic oligonucleotide; TTT chr2 60537577 60537598 60537594 60537599 +
aaaatgtacaggaacagacttg

SEQ ID NO: 206949 - DNA, 22 bp, Artificial Sequence
  Synthetic oligonucleotide; TTA chr2 60537578 60537599 60537595 60537600 +
aaatgtacaggaacagacttgg

SEQ ID NO: 206950 - DNA, 22 bp, Artificial Sequence
  Synthetic oligonucleotide; CTT chr2 60537598 60537619 60537615 60537620 +
ggcacatagtgctttgtgctcc

SEQ ID NO: 206951 - DNA, 22 bp, Artificial Sequence
  Synthetic oligonucleotide; TTG chr2 60537599 60537620 60537616 60537621 +
gcacatagtgctttgtgctcca

SEQ ID NO: 206952 - DNA, 22 bp, Artificial Sequence
  Synthetic oligonucleotide; CTT chr2 60537612 60537633 60537629 60537634 +
tgtgctccaacataagaatcca

SEQ ID NO: 206953 - DNA, 22 bp, Artificial Sequence
  Synthetic oligonucleotide; TTT chr2 60537613 60537634 60537630 60537635 +
gtgctccaacataagaatccaa

SEQ ID NO: 206954 - DNA, 22 bp, Artificial Sequence
  Synthetic oligonucleotide; TTG chr2 60537614 60537635 60537631 60537636 +
tgctccaacataagaatccaag

SEQ ID NO: 206955 - DNA, 22 bp, Artificial Sequence
  Synthetic oligonucleotide; CTC chr2 60537619 60537640 60537636 60537641 +
caacataagaatccaagctaca

SEQ ID NO: 206956 - DNA, 22 bp, Artificial Sequence
  Synthetic oligonucleotide; CTA chr2 60537639 60537660 60537656 60537661 +
cactttatttccctaaaaatta

SEQ ID NO: 206957 - DNA, 22 bp, Artificial Sequence
  Synthetic oligonucleotide; CTT chr2 60537644 60537665 60537661 60537666 +
tatttccctaaaaattaacaga

SEQ ID NO: 206958 - DNA, 22 bp, Artificial Sequence
  Synthetic oligonucleotide; TTT chr2 60537645 60537666 60537662 60537667 +
atttccctaaaaattaacagat

SEQ ID NO: 206959 - DNA, 22 bp, Artificial Sequence
  Synthetic oligonucleotide; TTA chr2 60537646 60537667 60537663 60537668 +
tttccctaaaaattaacagatg

SEQ ID NO: 206960 - DNA, 22 bp, Artificial Sequence
  Synthetic oligonucleotide; TTT chr2 60537649 60537670 60537666 60537671 +
ccctaaaaattaacagatgtga

SEQ ID NO: 206961 - DNA, 22 bp, Artificial Sequence
  Synthetic oligonucleotide; TTC chr2 60537650 60537671 60537667 60537672 +
cctaaaaattaacagatgtgat

SEQ ID NO: 206962 - DNA, 22 bp, Artificial Sequence
  Synthetic oligonucleotide; CTA chr2 60537654 60537675 60537671 60537676 +
aaaattaacagatgtgatttcc

SEQ ID NO: 206963 - DNA, 22 bp, Artificial Sequence
  Synthetic oligonucleotide; TTA chr2 60537661 60537682 60537678 60537683 +
acagatgtgatttccttgcagc

SEQ ID NO: 206964 - DNA, 22 bp, Artificial Sequence
  Synthetic oligonucleotide; TTT chr2 60537674 60537695 60537691 60537696 +
ccttgcagcctttttatgcatc

SEQ ID NO: 206965 - DNA, 22 bp, Artificial Sequence
  Synthetic oligonucleotide; TTC chr2 60537675 60537696 60537692 60537697 +
cttgcagcctttttatgcatca

SEQ ID NO: 206966 - DNA, 22 bp, Artificial Sequence
  Synthetic oligonucleotide; CTT chr2 60537678 60537699 60537695 60537700 +
gcagcctttttatgcatcatta

SEQ ID NO: 206967 - DNA, 22 bp, Artificial Sequence
  Synthetic oligonucleotide; TTG chr2 60537679 60537700 60537696 60537701 +
cagcctttttatgcatcattac

SEQ ID NO: 206968 - DNA, 22 bp, Artificial Sequence
  Synthetic oligonucleotide; CTT chr2 60537686 60537707 60537703 60537708 +
tttatgcatcattacatattaa

SEQ ID NO: 206969 - DNA, 22 bp, Artificial Sequence
  Synthetic oligonucleotide; TTT chr2 60537687 60537708 60537704 60537709 +
ttatgcatcattacatattaag

SEQ ID NO: 206970 - DNA, 22 bp, Artificial Sequence
  Synthetic oligonucleotide; TTT chr2 60537688 60537709 60537705 60537710 +
tatgcatcattacatattaaga

SEQ ID NO: 206971 - DNA, 22 bp, Artificial Sequence
  Synthetic oligonucleotide; TTT chr2 60537689 60537710 60537706 60537711 +
atgcatcattacatattaagaa

SEQ ID NO: 206972 - DNA, 22 bp, Artificial Sequence
  Synthetic oligonucleotide; TTA chr2 60537690 60537711 60537707 60537712 +
tgcatcattacatattaagaaa

SEQ ID NO: 206973 - DNA, 22 bp, Artificial Sequence
  Synthetic oligonucleotide; TTA chr2 60537700 60537721 60537717 60537722 +
catattaagaaaatgaacaact

SEQ ID NO: 206974 - DNA, 22 bp, Artificial Sequence
  Synthetic oligonucleotide; TTA chr2 60537707 60537728 60537724 60537729 +
agaaaatgaacaactgatgaat

SEQ ID NO: 206975 - DNA, 22 bp, Artificial Sequence
  Synthetic oligonucleotide; CTG chr2 60537723 60537744 60537740 60537745 +
atgaatataaatttaaatgccc

SEQ ID NO: 206976 - DNA, 22 bp, Artificial Sequence
  Synthetic oligonucleotide; TTT chr2 60537737 60537758 60537754 60537759 +
aaatgccctgatgcttagcaaa

SEQ ID NO: 206977 - DNA, 22 bp, Artificial Sequence
  Synthetic oligonucleotide; TTA chr2 60537738 60537759 60537755 60537760 +
aatgccctgatgcttagcaaaa

SEQ ID NO: 206978 - DNA, 22 bp, Artificial Sequence
  Synthetic oligonucleotide; CTG chr2 60537747 60537768 60537764 60537769 +
atgcttagcaaaaagcttcctt

SEQ ID NO: 206979 - DNA, 22 bp, Artificial Sequence
  Synthetic oligonucleotide; CTT chr2 60537753 60537774 60537770 60537775 +
agcaaaaagcttccttgtgttt

SEQ ID NO: 206980 - DNA, 22 bp, Artificial Sequence
  Synthetic oligonucleotide; TTA chr2 60537754 60537775 60537771 60537776 +
gcaaaaagcttccttgtgtttt

SEQ ID NO: 206981 - DNA, 22 bp, Artificial Sequence
  Synthetic oligonucleotide; CTT chr2 60537765 60537786 60537782 60537787 +
ccttgtgttttttagaaagttc

SEQ ID NO: 206982 - DNA, 22 bp, Artificial Sequence
  Synthetic oligonucleotide; TTC chr2 60537766 60537787 60537783 60537788 +
cttgtgttttttagaaagttca

SEQ ID NO: 206983 - DNA, 22 bp, Artificial Sequence
  Synthetic oligonucleotide; CTT chr2 60537769 60537790 60537786 60537791 +
gtgttttttagaaagttcaaaa

SEQ ID NO: 206984 - DNA, 22 bp, Artificial Sequence
  Synthetic oligonucleotide; TTG chr2 60537770 60537791 60537787 60537792 +
tgttttttagaaagttcaaaaa

SEQ ID NO: 206985 - DNA, 22 bp, Artificial Sequence
  Synthetic oligonucleotide; TTT chr2 60537775 60537796 60537792 60537797 +
tttagaaagttcaaaaagcaaa

SEQ ID NO: 206986 - DNA, 22 bp, Artificial Sequence
  Synthetic oligonucleotide; TTT chr2 60537776 60537797 60537793 60537798 +
ttagaaagttcaaaaagcaaat

SEQ ID NO: 206987 - DNA, 22 bp, Artificial Sequence
  Synthetic oligonucleotide; TTT chr2 60537777 60537798 60537794 60537799 +
tagaaagttcaaaaagcaaata

SEQ ID NO: 206988 - DNA, 22 bp, Artificial Sequence
  Synthetic oligonucleotide; TTT chr2 60537778 60537799 60537795 60537800 +
agaaagttcaaaaagcaaatag

SEQ ID NO: 206989 - DNA, 22 bp, Artificial Sequence
  Synthetic oligonucleotide; TTA chr2 60537779 60537800 60537796 60537801 +
gaaagttcaaaaagcaaataga

SEQ ID NO: 206990 - DNA, 22 bp, Artificial Sequence
  Synthetic oligonucleotide; TTC chr2 60537787 60537808 60537804 60537809 +
aaaaagcaaatagaaaggcgag

SEQ ID NO: 206991 - DNA, 22 bp, Artificial Sequence
  Synthetic oligonucleotide; CTG chr2 60537829 60537850 60537846 60537851 +
gttttctttttgaaggcaccct

SEQ ID NO: 206992 - DNA, 22 bp, Artificial Sequence
  Synthetic oligonucleotide; TTT chr2 60537833 60537854 60537850 60537855 +
tctttttgaaggcacccttgca

SEQ ID NO: 206993 - DNA, 22 bp, Artificial Sequence
  Synthetic oligonucleotide; TTT chr2 60537834 60537855 60537851 60537856 +
ctttttgaaggcacccttgcag

SEQ ID NO: 206994 - DNA, 22 bp, Artificial Sequence
  Synthetic oligonucleotide; TTC chr2 60537835 60537856 60537852 60537857 +
tttttgaaggcacccttgcagg

SEQ ID NO: 206995 - DNA, 22 bp, Artificial Sequence
  Synthetic oligonucleotide; CTT chr2 60537837 60537858 60537854 60537859 +
tttgaaggcacccttgcaggtt

SEQ ID NO: 206996 - DNA, 22 bp, Artificial Sequence
  Synthetic oligonucleotide; TTT chr2 60537838 60537859 60537855 60537860 +
ttgaaggcacccttgcaggttt

SEQ ID NO: 206997 - DNA, 22 bp, Artificial Sequence
  Synthetic oligonucleotide; TTT chr2 60537839 60537860 60537856 60537861 +
tgaaggcacccttgcaggtttc

SEQ ID NO: 206998 - DNA, 22 bp, Artificial Sequence
  Synthetic oligonucleotide; TTT chr2 60537840 60537861 60537857 60537862 +
gaaggcacccttgcaggtttca

SEQ ID NO: 206999 - DNA, 22 bp, Artificial Sequence
  Synthetic oligonucleotide; TTG chr2 60537841 60537862 60537858 60537863 +
aaggcacccttgcaggtttcac

SEQ ID NO: 207000 - DNA, 22 bp, Artificial Sequence
  Synthetic oligonucleotide; CTT chr2 60537852 60537873 60537869 60537874 +
gcaggtttcacaataattccat

SEQ ID NO: 207001 - DNA, 22 bp, Artificial Sequence
  Synthetic oligonucleotide; TTG chr2 60537853 60537874 60537870 60537875 +
caggtttcacaataattccatt

SEQ ID NO: 207002 - DNA, 22 bp, Artificial Sequence
  Synthetic oligonucleotide; TTT chr2 60537860 60537881 60537877 60537882 +
cacaataattccattctttatt

SEQ ID NO: 207003 - DNA, 22 bp, Artificial Sequence
  Synthetic oligonucleotide; TTC chr2 60537861 60537882 60537878 60537883 +
acaataattccattctttattt

SEQ ID NO: 207004 - DNA, 22 bp, Artificial Sequence
  Synthetic oligonucleotide; TTC chr2 60537871 60537892 60537888 60537893 +
cattctttattttaatgggagt

SEQ ID NO: 207005 - DNA, 22 bp, Artificial Sequence
  Synthetic oligonucleotide; TTC chr2 60537876 60537897 60537893 60537898 +
tttattttaatgggagttttta

SEQ ID NO: 207006 - DNA, 22 bp, Artificial Sequence
  Synthetic oligonucleotide; CTT chr2 60537878 60537899 60537895 60537900 +
tattttaatgggagtttttaat

SEQ ID NO: 207007 - DNA, 22 bp, Artificial Sequence
  Synthetic oligonucleotide; TTT chr2 60537879 60537900 60537896 60537901 +
attttaatgggagtttttaatc

SEQ ID NO: 207008 - DNA, 22 bp, Artificial Sequence
  Synthetic oligonucleotide; TTA chr2 60537880 60537901 60537897 60537902 +
ttttaatgggagtttttaatca

SEQ ID NO: 207009 - DNA, 22 bp, Artificial Sequence
  Synthetic oligonucleotide; TTT chr2 60537883 60537904 60537900 60537905 +
taatgggagtttttaatcagtg

SEQ ID NO: 207010 - DNA, 22 bp, Artificial Sequence
  Synthetic oligonucleotide; TTT chr2 60537884 60537905 60537901 60537906 +
aatgggagtttttaatcagtgg

SEQ ID NO: 207011 - DNA, 22 bp, Artificial Sequence
  Synthetic oligonucleotide; TTA chr2 60537885 60537906 60537902 60537907 +
atgggagtttttaatcagtgga

SEQ ID NO: 207012 - DNA, 22 bp, Artificial Sequence
  Synthetic oligonucleotide; TTT chr2 60537895 60537916 60537912 60537917 +
ttaatcagtggattcgcctcta

SEQ ID NO: 207013 - DNA, 22 bp, Artificial Sequence
  Synthetic oligonucleotide; TTT chr2 60537896 60537917 60537913 60537918 +
taatcagtggattcgcctctat

SEQ ID NO: 207014 - DNA, 22 bp, Artificial Sequence
  Synthetic oligonucleotide; TTT chr2 60537897 60537918 60537914 60537919 +
aatcagtggattcgcctctatc

SEQ ID NO: 207015 - DNA, 22 bp, Artificial Sequence
  Synthetic oligonucleotide; TTA chr2 60537898 60537919 60537915 60537920 +
atcagtggattcgcctctatct

SEQ ID NO: 207016 - DNA, 22 bp, Artificial Sequence
  Synthetic oligonucleotide; TTC chr2 60537910 60537931 60537927 60537932 +
gcctctatctaaaactaaaatc

SEQ ID NO: 207017 - DNA, 22 bp, Artificial Sequence
  Synthetic oligonucleotide; CTC chr2 60537915 60537936 60537932 60537937 +
tatctaaaactaaaatcaaatt

SEQ ID NO: 207018 - DNA, 22 bp, Artificial Sequence
  Synthetic oligonucleotide; CTA chr2 60537917 60537938 60537934 60537939 +
tctaaaactaaaatcaaattgt

SEQ ID NO: 207019 - DNA, 22 bp, Artificial Sequence
  Synthetic oligonucleotide; CTA chr2 60537921 60537942 60537938 60537943 +
aaactaaaatcaaattgtaggt

SEQ ID NO: 207020 - DNA, 22 bp, Artificial Sequence
  Synthetic oligonucleotide; CTA chr2 60537927 60537948 60537944 60537949 +
aaatcaaattgtaggtgcaatt

SEQ ID NO: 207021 - DNA, 22 bp, Artificial Sequence
  Synthetic oligonucleotide; TTG chr2 60537938 60537959 60537955 60537960 +
taggtgcaattgttcattggca

SEQ ID NO: 207022 - DNA, 22 bp, Artificial Sequence
  Synthetic oligonucleotide; TTG chr2 60537950 60537971 60537967 60537972 +
ttcattggcaatgctaacaaca

SEQ ID NO: 207023 - DNA, 22 bp, Artificial Sequence
  Synthetic oligonucleotide; TTC chr2 60537953 60537974 60537970 60537975 +
attggcaatgctaacaacagtg

SEQ ID NO: 207024 - DNA, 22 bp, Artificial Sequence
  Synthetic oligonucleotide; TTG chr2 60537957 60537978 60537974 60537979 +
gcaatgctaacaacagtgagaa

SEQ ID NO: 207025 - DNA, 22 bp, Artificial Sequence
  Synthetic oligonucleotide; CTA chr2 60537966 60537987 60537983 60537988 +
acaacagtgagaatacaaacaa

SEQ ID NO: 207026 - DNA, 22 bp, Artificial Sequence
  Synthetic oligonucleotide; CTC chr2 60537994 60538015 60538011 60538016 +
attgtgagtgaccaaaggtccc

SEQ ID NO: 207027 - DNA, 22 bp, Artificial Sequence
  Synthetic oligonucleotide; TTG chr2 60537998 60538019 60538015 60538020 +
tgagtgaccaaaggtccccagg

SEQ ID NO: 207028 - DNA, 22 bp, Artificial Sequence
  Synthetic oligonucleotide; CTT chr2 60538029 60538050 60538046 60538051 +
catcaacatacctgctccaggt

SEQ ID NO: 207029 - DNA, 22 bp, Artificial Sequence
  Synthetic oligonucleotide; TTC chr2 60538030 60538051 60538047 60538052 +
atcaacatacctgctccaggtt

SEQ ID NO: 207030 - DNA, 22 bp, Artificial Sequence
  Synthetic oligonucleotide; CTG chr2 60538043 60538064 60538060 60538065 +
ctccaggttcccactgggaatt

SEQ ID NO: 207031 - DNA, 22 bp, Artificial Sequence
  Synthetic oligonucleotide; CTC chr2 60538046 60538067 60538063 60538068 +
caggttcccactgggaattctc

SEQ ID NO: 207032 - DNA, 22 bp, Artificial Sequence
  Synthetic oligonucleotide; TTC chr2 60538053 60538074 60538070 60538075 +
ccactgggaattctctggcaga

SEQ ID NO: 207033 - DNA, 22 bp, Artificial Sequence
  Synthetic oligonucleotide; CTG chr2 60538059 60538080 60538076 60538081 +
ggaattctctggcagagactga

SEQ ID NO: 207034 - DNA, 22 bp, Artificial Sequence
  Synthetic oligonucleotide; TTC chr2 60538066 60538087 60538083 60538088 +
tctggcagagactgattcagtt

SEQ ID NO: 207035 - DNA, 22 bp, Artificial Sequence
  Synthetic oligonucleotide; CTC chr2 60538068 60538089 60538085 60538090 +
tggcagagactgattcagttct

SEQ ID NO: 207036 - DNA, 22 bp, Artificial Sequence
  Synthetic oligonucleotide; CTG chr2 60538070 60538091 60538087 60538092 +
gcagagactgattcagttctga

SEQ ID NO: 207037 - DNA, 22 bp, Artificial Sequence
  Synthetic oligonucleotide; CTG chr2 60538080 60538101 60538097 60538102 +
attcagttctgaataacatgct

SEQ ID NO: 207038 - DNA, 22 bp, Artificial Sequence
  Synthetic oligonucleotide; TTC chr2 60538084 60538105 60538101 60538106 +
agttctgaataacatgctgcca

SEQ ID NO: 207039 - DNA, 22 bp, Artificial Sequence
  Synthetic oligonucleotide; TTC chr2 60538089 60538110 60538106 60538111 +
tgaataacatgctgccagccct

SEQ ID NO: 207040 - DNA, 22 bp, Artificial Sequence
  Synthetic oligonucleotide; CTG chr2 60538091 60538112 60538108 60538113 +
aataacatgctgccagccctat

SEQ ID NO: 207041 - DNA, 22 bp, Artificial Sequence
  Synthetic oligonucleotide; CTG chr2 60538103 60538124 60538120 60538125 +
ccagccctatctggaaaagggt

SEQ ID NO: 207042 - DNA, 22 bp, Artificial Sequence
  Synthetic oligonucleotide; CTA chr2 60538112 60538133 60538129 60538134 +
tctggaaaagggtgtgcaaggc

SEQ ID NO: 207043 - DNA, 22 bp, Artificial Sequence
  Synthetic oligonucleotide; CTG chr2 60538116 60538137 60538133 60538138 +
gaaaagggtgtgcaaggcgcct

SEQ ID NO: 207044 - DNA, 22 bp, Artificial Sequence
  Synthetic oligonucleotide; CTT chr2 60538139 60538160 60538156 60538161 +
ctcgcctcttttacaggaagtt

SEQ ID NO: 207045 - DNA, 22 bp, Artificial Sequence
  Synthetic oligonucleotide; TTC chr2 60538140 60538161 60538157 60538162 +
tcgcctcttttacaggaagttt

SEQ ID NO: 207046 - DNA, 22 bp, Artificial Sequence
  Synthetic oligonucleotide; CTC chr2 60538142 60538163 60538159 60538164 +
gcctcttttacaggaagtttaa

SEQ ID NO: 207047 - DNA, 22 bp, Artificial Sequence
  Synthetic oligonucleotide; CTC chr2 60538147 60538168 60538164 60538169 +
ttttacaggaagtttaaacctg

SEQ ID NO: 207048 - DNA, 22 bp, Artificial Sequence
  Synthetic oligonucleotide; CTT chr2 60538149 60538170 60538166 60538171 +
ttacaggaagtttaaacctgat

SEQ ID NO: 207049 - DNA, 22 bp, Artificial Sequence
  Synthetic oligonucleotide; TTT chr2 60538150 60538171 60538167 60538172 +
tacaggaagtttaaacctgatc

SEQ ID NO: 207050 - DNA, 22 bp, Artificial Sequence
  Synthetic oligonucleotide; TTT chr2 60538151 60538172 60538168 60538173 +
acaggaagtttaaacctgatca

SEQ ID NO: 207051 - DNA, 22 bp, Artificial Sequence
  Synthetic oligonucleotide; TTA chr2 60538152 60538173 60538169 60538174 +
caggaagtttaaacctgatcat

SEQ ID NO: 207052 - DNA, 22 bp, Artificial Sequence
  Synthetic oligonucleotide; TTT chr2 60538162 60538183 60538179 60538184 +
aaacctgatcatctcaccttta

SEQ ID NO: 207053 - DNA, 22 bp, Artificial Sequence
  Synthetic oligonucleotide; TTA chr2 60538163 60538184 60538180 60538185 +
aacctgatcatctcacctttag

SEQ ID NO: 207054 - DNA, 22 bp, Artificial Sequence
  Synthetic oligonucleotide; CTG chr2 60538169 60538190 60538186 60538191 +
atcatctcacctttaggtatat

SEQ ID NO: 207055 - DNA, 22 bp, Artificial Sequence
  Synthetic oligonucleotide; CTC chr2 60538177 60538198 60538194 60538199 +
acctttaggtatatataatttg

SEQ ID NO: 207056 - DNA, 22 bp, Artificial Sequence
  Synthetic oligonucleotide; CTT chr2 60538182 60538203 60538199 60538204 +
taggtatatataatttgttgtt

SEQ ID NO: 207057 - DNA, 22 bp, Artificial Sequence
  Synthetic oligonucleotide; TTT chr2 60538183 60538204 60538200 60538205 +
aggtatatataatttgttgttt

SEQ ID NO: 207058 - DNA, 22 bp, Artificial Sequence
  Synthetic oligonucleotide; TTA chr2 60538184 60538205 60538201 60538206 +
ggtatatataatttgttgttta

SEQ ID NO: 207059 - DNA, 22 bp, Artificial Sequence
  Synthetic oligonucleotide; TTT chr2 60538198 60538219 60538215 60538220 +
gttgtttagcactctgagaact

SEQ ID NO: 207060 - DNA, 22 bp, Artificial Sequence
  Synthetic oligonucleotide; TTG chr2 60538199 60538220 60538216 60538221 +
ttgtttagcactctgagaactt

SEQ ID NO: 207061 - DNA, 22 bp, Artificial Sequence
  Synthetic oligonucleotide; TTG chr2 60538202 60538223 60538219 60538224 +
tttagcactctgagaacttggt

SEQ ID NO: 207062 - DNA, 22 bp, Artificial Sequence
  Synthetic oligonucleotide; TTT chr2 60538205 60538226 60538222 60538227 +
agcactctgagaacttggtatt

SEQ ID NO: 207063 - DNA, 22 bp, Artificial Sequence
  Synthetic oligonucleotide; TTA chr2 60538206 60538227 60538223 60538228 +
gcactctgagaacttggtattt

SEQ ID NO: 207064 - DNA, 22 bp, Artificial Sequence
  Synthetic oligonucleotide; CTC chr2 60538212 60538233 60538229 60538234 +
tgagaacttggtattttatcta

SEQ ID NO: 207065 - DNA, 22 bp, Artificial Sequence
  Synthetic oligonucleotide; CTG chr2 60538214 60538235 60538231 60538236 +
agaacttggtattttatctatc

SEQ ID NO: 207066 - DNA, 22 bp, Artificial Sequence
  Synthetic oligonucleotide; CTT chr2 60538221 60538242 60538238 60538243 +
ggtattttatctatctaaagag

SEQ ID NO: 207067 - DNA, 22 bp, Artificial Sequence
  Synthetic oligonucleotide; TTG chr2 60538222 60538243 60538239 60538244 +
gtattttatctatctaaagaga

SEQ ID NO: 207068 - DNA, 22 bp, Artificial Sequence
  Synthetic oligonucleotide; TTT chr2 60538228 60538249 60538245 60538250 +
tatctatctaaagagatcaaaa

SEQ ID NO: 207069 - DNA, 22 bp, Artificial Sequence
  Synthetic oligonucleotide; TTT chr2 60538229 60538250 60538246 60538251 +
atctatctaaagagatcaaaaa

SEQ ID NO: 207070 - DNA, 22 bp, Artificial Sequence
  Synthetic oligonucleotide; TTA chr2 60538230 60538251 60538247 60538252 +
tctatctaaagagatcaaaaag

SEQ ID NO: 207071 - DNA, 22 bp, Artificial Sequence
  Synthetic oligonucleotide; CTA chr2 60538234 60538255 60538251 60538256 +
tctaaagagatcaaaaagggca

SEQ ID NO: 207072 - DNA, 22 bp, Artificial Sequence
  Synthetic oligonucleotide; CTA chr2 60538238 60538259 60538255 60538260 +
aagagatcaaaaagggcaaaag

SEQ ID NO: 207073 - DNA, 22 bp, Artificial Sequence
  Synthetic oligonucleotide; CTG chr2 60538273 60538294 60538290 60538295 +
aggcccagcctagctctggtgc

SEQ ID NO: 207074 - DNA, 22 bp, Artificial Sequence
  Synthetic oligonucleotide; CTA chr2 60538285 60538306 60538302 60538307 +
gctctggtgcatacgtcaatcg

SEQ ID NO: 207075 - DNA, 22 bp, Artificial Sequence
  Synthetic oligonucleotide; CTC chr2 60538289 60538310 60538306 60538311 +
tggtgcatacgtcaatcgtgca

SEQ ID NO: 207076 - DNA, 22 bp, Artificial Sequence
  Synthetic oligonucleotide; CTG chr2 60538291 60538312 60538308 60538313 +
gtgcatacgtcaatcgtgcact

SEQ ID NO: 207077 - DNA, 22 bp, Artificial Sequence
  Synthetic oligonucleotide; CTG chr2 60538314 60538335 60538331 60538336 +
cgcgttgccttagaggagcaac

SEQ ID NO: 207078 - DNA, 22 bp, Artificial Sequence
  Synthetic oligonucleotide; TTG chr2 60538321 60538342 60538338 60538343 +
ccttagaggagcaacctgtgca

SEQ ID NO: 207079 - DNA, 22 bp, Artificial Sequence
  Synthetic oligonucleotide; CTT chr2 60538325 60538346 60538342 60538347 +
agaggagcaacctgtgcaggta

SEQ ID NO: 207080 - DNA, 22 bp, Artificial Sequence
  Synthetic oligonucleotide; TTA chr2 60538326 60538347 60538343 60538348 +
gaggagcaacctgtgcaggtaa

SEQ ID NO: 207081 - DNA, 22 bp, Artificial Sequence
  Synthetic oligonucleotide; CTG chr2 60538339 60538360 60538356 60538361 +
tgcaggtaaatcttccagcagc

SEQ ID NO: 207082 - DNA, 22 bp, Artificial Sequence
  Synthetic oligonucleotide; CTT chr2 60538353 60538374 60538370 60538375 +
ccagcagcattgcatcagatcc

SEQ ID NO: 207083 - DNA, 22 bp, Artificial Sequence
  Synthetic oligonucleotide; TTC chr2 60538354 60538375 60538371 60538376 +
cagcagcattgcatcagatcca

SEQ ID NO: 207084 - DNA, 22 bp, Artificial Sequence
  Synthetic oligonucleotide; TTG chr2 60538365 60538386 60538382 60538387 +
catcagatccactcacatcagt

SEQ ID NO: 207085 - DNA, 22 bp, Artificial Sequence
  Synthetic oligonucleotide; CTC chr2 60538379 60538400 60538396 60538401 +
acatcagtctccagggtgaacc

SEQ ID NO: 207086 - DNA, 22 bp, Artificial Sequence
  Synthetic oligonucleotide; CTC chr2 60538390 60538411 60538407 60538412 +
cagggtgaaccaagagatgaca

SEQ ID NO: 207087 - DNA, 22 bp, Artificial Sequence
  Synthetic oligonucleotide; CTT chr2 60538415 60538436 60538432 60538437 +
cagttccctgtctgcaaacttc

SEQ ID NO: 207088 - DNA, 22 bp, Artificial Sequence
  Synthetic oligonucleotide; TTC chr2 60538416 60538437 60538433 60538438 +
agttccctgtctgcaaacttct

SEQ ID NO: 207089 - DNA, 22 bp, Artificial Sequence
  Synthetic oligonucleotide; TTC chr2 60538421 60538442 60538438 60538443 +
cctgtctgcaaacttctaattc

SEQ ID NO: 207090 - DNA, 22 bp, Artificial Sequence
  Synthetic oligonucleotide; CTG chr2 60538425 60538446 60538442 60538447 +
tctgcaaacttctaattcgcca

SEQ ID NO: 207091 - DNA, 22 bp, Artificial Sequence
  Synthetic oligonucleotide; CTG chr2 60538429 60538450 60538446 60538451 +
caaacttctaattcgccagttc

SEQ ID NO: 207092 - DNA, 22 bp, Artificial Sequence
  Synthetic oligonucleotide; CTT chr2 60538436 60538457 60538453 60538458 +
ctaattcgccagttcttagcag

SEQ ID NO: 207093 - DNA, 22 bp, Artificial Sequence
  Synthetic oligonucleotide; TTC chr2 60538437 60538458 60538454 60538459 +
taattcgccagttcttagcagc

SEQ ID NO: 207094 - DNA, 22 bp, Artificial Sequence
  Synthetic oligonucleotide; CTA chr2 60538439 60538460 60538456 60538461 +
attcgccagttcttagcagctt

SEQ ID NO: 207095 - DNA, 22 bp, Artificial Sequence
  Synthetic oligonucleotide; TTC chr2 60538443 60538464 60538460 60538465 +
gccagttcttagcagcttattt

SEQ ID NO: 207096 - DNA, 22 bp, Artificial Sequence
  Synthetic oligonucleotide; TTC chr2 60538451 60538472 60538468 60538473 +
ttagcagcttatttttccaagt

SEQ ID NO: 207097 - DNA, 22 bp, Artificial Sequence
  Synthetic oligonucleotide; CTT chr2 60538453 60538474 60538470 60538475 +
agcagcttatttttccaagtgt

SEQ ID NO: 207098 - DNA, 22 bp, Artificial Sequence
  Synthetic oligonucleotide; TTA chr2 60538454 60538475 60538471 60538476 +
gcagcttatttttccaagtgtt

SEQ ID NO: 207099 - DNA, 22 bp, Artificial Sequence
  Synthetic oligonucleotide; CTT chr2 60538461 60538482 60538478 60538483 +
atttttccaagtgttttgtttc

SEQ ID NO: 207100 - DNA, 22 bp, Artificial Sequence
  Synthetic oligonucleotide; TTA chr2 60538462 60538483 60538479 60538484 +
tttttccaagtgttttgtttca

SEQ ID NO: 207101 - DNA, 22 bp, Artificial Sequence
  Synthetic oligonucleotide; TTT chr2 60538465 60538486 60538482 60538487 +
ttccaagtgttttgtttcagga

SEQ ID NO: 207102 - DNA, 22 bp, Artificial Sequence
  Synthetic oligonucleotide; TTT chr2 60538466 60538487 60538483 60538488 +
tccaagtgttttgtttcaggaa

SEQ ID NO: 207103 - DNA, 22 bp, Artificial Sequence
  Synthetic oligonucleotide; TTT chr2 60538467 60538488 60538484 60538489 +
ccaagtgttttgtttcaggaaa

SEQ ID NO: 207104 - DNA, 22 bp, Artificial Sequence
  Synthetic oligonucleotide; TTC chr2 60538468 60538489 60538485 60538490 +
caagtgttttgtttcaggaaac

SEQ ID NO: 207105 - DNA, 22 bp, Artificial Sequence
  Synthetic oligonucleotide; TTT chr2 60538477 60538498 60538494 60538499 +
tgtttcaggaaacgtgtatttt

SEQ ID NO: 207106 - DNA, 22 bp, Artificial Sequence
  Synthetic oligonucleotide; TTT chr2 60538478 60538499 60538495 60538500 +
gtttcaggaaacgtgtattttt

SEQ ID NO: 207107 - DNA, 22 bp, Artificial Sequence
  Synthetic oligonucleotide; TTG chr2 60538479 60538500 60538496 60538501 +
tttcaggaaacgtgtatttttc

SEQ ID NO: 207108 - DNA, 22 bp, Artificial Sequence
  Synthetic oligonucleotide; TTT chr2 60538482 60538503 60538499 60538504 +
caggaaacgtgtatttttcttt

SEQ ID NO: 207109 - DNA, 22 bp, Artificial Sequence
  Synthetic oligonucleotide; TTC chr2 60538483 60538504 60538500 60538505 +
aggaaacgtgtatttttcttta

SEQ ID NO: 207110 - DNA, 22 bp, Artificial Sequence
  Synthetic oligonucleotide; TTT chr2 60538498 60538519 60538515 60538520 +
ttctttatacgttttgtggatc

SEQ ID NO: 207111 - DNA, 22 bp, Artificial Sequence
  Synthetic oligonucleotide; TTT chr2 60538499 60538520 60538516 60538521 +
tctttatacgttttgtggatct

SEQ ID NO: 207112 - DNA, 22 bp, Artificial Sequence
  Synthetic oligonucleotide; TTT chr2 60538500 60538521 60538517 60538522 +
ctttatacgttttgtggatcta

SEQ ID NO: 207113 - DNA, 22 bp, Artificial Sequence
  Synthetic oligonucleotide; TTC chr2 60538501 60538522 60538518 60538523 +
tttatacgttttgtggatctac

SEQ ID NO: 207114 - DNA, 22 bp, Artificial Sequence
  Synthetic oligonucleotide; CTT chr2 60538503 60538524 60538520 60538525 +
tatacgttttgtggatctacca

SEQ ID NO: 207115 - DNA, 22 bp, Artificial Sequence
  Synthetic oligonucleotide; TTT chr2 60538504 60538525 60538521 60538526 +
atacgttttgtggatctaccac

SEQ ID NO: 207116 - DNA, 22 bp, Artificial Sequence
  Synthetic oligonucleotide; TTA chr2 60538505 60538526 60538522 60538527 +
tacgttttgtggatctaccaca

SEQ ID NO: 207117 - DNA, 22 bp, Artificial Sequence
  Synthetic oligonucleotide; TTT chr2 60538512 60538533 60538529 60538534 +
tgtggatctaccacaactgctt

SEQ ID NO: 207118 - DNA, 22 bp, Artificial Sequence
  Synthetic oligonucleotide; TTT chr2 60538513 60538534 60538530 60538535 +
gtggatctaccacaactgcttc

SEQ ID NO: 207119 - DNA, 22 bp, Artificial Sequence
  Synthetic oligonucleotide; TTG chr2 60538514 60538535 60538531 60538536 +
tggatctaccacaactgcttct

SEQ ID NO: 207120 - DNA, 22 bp, Artificial Sequence
  Synthetic oligonucleotide; CTA chr2 60538522 60538543 60538539 60538544 +
ccacaactgcttctgacagctg

SEQ ID NO: 207121 - DNA, 22 bp, Artificial Sequence
  Synthetic oligonucleotide; CTG chr2 60538531 60538552 60538548 60538553 +
cttctgacagctgttgattctg

SEQ ID NO: 207122 - DNA, 22 bp, Artificial Sequence
  Synthetic oligonucleotide; CTT chr2 60538534 60538555 60538551 60538556 +
ctgacagctgttgattctgtta

SEQ ID NO: 207123 - DNA, 22 bp, Artificial Sequence
  Synthetic oligonucleotide; TTC chr2 60538535 60538556 60538552 60538557 +
tgacagctgttgattctgttaa

SEQ ID NO: 207124 - DNA, 22 bp, Artificial Sequence
  Synthetic oligonucleotide; CTG chr2 60538537 60538558 60538554 60538559 +
acagctgttgattctgttaaag

SEQ ID NO: 207125 - DNA, 22 bp, Artificial Sequence
  Synthetic oligonucleotide; CTG chr2 60538544 60538565 60538561 60538566 +
ttgattctgttaaaggaacaca

SEQ ID NO: 207126 - DNA, 22 bp, Artificial Sequence
  Synthetic oligonucleotide; TTG chr2 60538547 60538568 60538564 60538569 +
attctgttaaaggaacacatta

SEQ ID NO: 207127 - DNA, 22 bp, Artificial Sequence
  Synthetic oligonucleotide; TTC chr2 60538551 60538572 60538568 60538573 +
tgttaaaggaacacattataaa

SEQ ID NO: 207128 - DNA, 22 bp, Artificial Sequence
  Synthetic oligonucleotide; CTG chr2 60538553 60538574 60538570 60538575 +
ttaaaggaacacattataaaaa

SEQ ID NO: 207129 - DNA, 22 bp, Artificial Sequence
  Synthetic oligonucleotide; TTA chr2 60538556 60538577 60538573 60538578 +
aaggaacacattataaaaatct

SEQ ID NO: 207130 - DNA, 22 bp, Artificial Sequence
  Synthetic oligonucleotide; TTA chr2 60538569 60538590 60538586 60538591 +
taaaaatcttctttaaaacctc

SEQ ID NO: 207131 - DNA, 22 bp, Artificial Sequence
  Synthetic oligonucleotide; CTT chr2 60538579 60538600 60538596 60538601 +
ctttaaaacctcaagcaatgtg

SEQ ID NO: 207132 - DNA, 22 bp, Artificial Sequence
  Synthetic oligonucleotide; TTC chr2 60538580 60538601 60538597 60538602 +
tttaaaacctcaagcaatgtgg

SEQ ID NO: 207133 - DNA, 22 bp, Artificial Sequence
  Synthetic oligonucleotide; CTT chr2 60538582 60538603 60538599 60538604 +
taaaacctcaagcaatgtggac

SEQ ID NO: 207134 - DNA, 22 bp, Artificial Sequence
  Synthetic oligonucleotide; TTT chr2 60538583 60538604 60538600 60538605 +
aaaacctcaagcaatgtggact

SEQ ID NO: 207135 - DNA, 22 bp, Artificial Sequence
  Synthetic oligonucleotide; TTA chr2 60538584 60538605 60538601 60538606 +
aaacctcaagcaatgtggactc

SEQ ID NO: 207136 - DNA, 22 bp, Artificial Sequence
  Synthetic oligonucleotide; CTC chr2 60538591 60538612 60538608 60538613 +
aagcaatgtggactcaaaaata

SEQ ID NO: 207137 - DNA, 22 bp, Artificial Sequence
  Synthetic oligonucleotide; CTC chr2 60538606 60538627 60538623 60538628 +
aaaaatataatggtgaaatatt

SEQ ID NO: 207138 - DNA, 22 bp, Artificial Sequence
  Synthetic oligonucleotide; TTT chr2 60538629 60538650 60538646 60538651 +
taatggaattccagttgaaagt

SEQ ID NO: 207139 - DNA, 22 bp, Artificial Sequence
  Synthetic oligonucleotide; TTT chr2 60538630 60538651 60538647 60538652 +
aatggaattccagttgaaagtt

SEQ ID NO: 207140 - DNA, 22 bp, Artificial Sequence
  Synthetic oligonucleotide; TTA chr2 60538631 60538652 60538648 60538653 +
atggaattccagttgaaagttg

SEQ ID NO: 207141 - DNA, 22 bp, Artificial Sequence
  Synthetic oligonucleotide; TTC chr2 60538640 60538661 60538657 60538662 +
cagttgaaagttgttttttaaa

SEQ ID NO: 207142 - DNA, 22 bp, Artificial Sequence
  Synthetic oligonucleotide; TTG chr2 60538646 60538667 60538663 60538668 +
aaagttgttttttaaaaaaagt

SEQ ID NO: 207143 - DNA, 22 bp, Artificial Sequence
  Synthetic oligonucleotide; TTG chr2 60538653 60538674 60538670 60538675 +
ttttttaaaaaaagtacaaatg

SEQ ID NO: 207144 - DNA, 22 bp, Artificial Sequence
  Synthetic oligonucleotide; TTT chr2 60538656 60538677 60538673 60538678 +
tttaaaaaaagtacaaatgaag

SEQ ID NO: 207145 - DNA, 22 bp, Artificial Sequence
  Synthetic oligonucleotide; TTT chr2 60538657 60538678 60538674 60538679 +
ttaaaaaaagtacaaatgaagg

SEQ ID NO: 207146 - DNA, 22 bp, Artificial Sequence
  Synthetic oligonucleotide; TTT chr2 60538658 60538679 60538675 60538680 +
taaaaaaagtacaaatgaaggt

SEQ ID NO: 207147 - DNA, 22 bp, Artificial Sequence
  Synthetic oligonucleotide; TTT chr2 60538659 60538680 60538676 60538681 +
aaaaaaagtacaaatgaaggta

SEQ ID NO: 207148 - DNA, 22 bp, Artificial Sequence
  Synthetic oligonucleotide; TTA chr2 60538660 60538681 60538677 60538682 +
aaaaaagtacaaatgaaggtac

SEQ ID NO: 207149 - DNA, 22 bp, Artificial Sequence
  Synthetic oligonucleotide; CTT chr2 60538692 60538713 60538709 60538714 +
tagatcagtactagatttaaac

SEQ ID NO: 207150 - DNA, 22 bp, Artificial Sequence
  Synthetic oligonucleotide; TTT chr2 60538693 60538714 60538710 60538715 +
agatcagtactagatttaaact

SEQ ID NO: 207151 - DNA, 22 bp, Artificial Sequence
  Synthetic oligonucleotide; TTA chr2 60538694 60538715 60538711 60538716 +
gatcagtactagatttaaactg

SEQ ID NO: 207152 - DNA, 22 bp, Artificial Sequence
  Synthetic oligonucleotide; CTA chr2 60538705 60538726 60538722 60538727 +
gatttaaactgaatgtctctct

SEQ ID NO: 207153 - DNA, 22 bp, Artificial Sequence
  Synthetic oligonucleotide; TTT chr2 60538710 60538731 60538727 60538732 +
aaactgaatgtctctctctctc

SEQ ID NO: 207154 - DNA, 22 bp, Artificial Sequence
  Synthetic oligonucleotide; TTA chr2 60538711 60538732 60538728 60538733 +
aactgaatgtctctctctctct

SEQ ID NO: 207155 - DNA, 22 bp, Artificial Sequence
  Synthetic oligonucleotide; CTG chr2 60538716 60538737 60538733 60538738 +
aatgtctctctctctctctctc

SEQ ID NO: 207156 - DNA, 22 bp, Artificial Sequence
  Synthetic oligonucleotide; CTC chr2 60538724 60538745 60538741 60538746 +
tctctctctctctctctgtgtg

SEQ ID NO: 207157 - DNA, 22 bp, Artificial Sequence
  Synthetic oligonucleotide; CTC chr2 60538726 60538747 60538743 60538748 +
tctctctctctctctgtgtgtg

SEQ ID NO: 207158 - DNA, 22 bp, Artificial Sequence
  Synthetic oligonucleotide; CTC chr2 60538728 60538749 60538745 60538750 +
tctctctctctctgtgtgtgtg

SEQ ID NO: 207159 - DNA, 22 bp, Artificial Sequence
  Synthetic oligonucleotide; CTC chr2 60538730 60538751 60538747 60538752 +
tctctctctctgtgtgtgtgtg

SEQ ID NO: 207160 - DNA, 22 bp, Artificial Sequence
  Synthetic oligonucleotide; CTC chr2 60538732 60538753 60538749 60538754 +
tctctctctgtgtgtgtgtgtg

SEQ ID NO: 207161 - DNA, 22 bp, Artificial Sequence
  Synthetic oligonucleotide; CTC chr2 60538734 60538755 60538751 60538756 +
tctctctgtgtgtgtgtgtgtg

SEQ ID NO: 207162 - DNA, 22 bp, Artificial Sequence
  Synthetic oligonucleotide; CTC chr2 60538736 60538757 60538753 60538758 +
tctctgtgtgtgtgtgtgtgtg

SEQ ID NO: 207163 - DNA, 22 bp, Artificial Sequence
  Synthetic oligonucleotide; CTC chr2 60538738 60538759 60538755 60538760 +
tctgtgtgtgtgtgtgtgtgtg

SEQ ID NO: 207164 - DNA, 22 bp, Artificial Sequence
  Synthetic oligonucleotide; CTC chr2 60538740 60538761 60538757 60538762 +
tgtgtgtgtgtgtgtgtgtgtg

SEQ ID NO: 207165 - DNA, 22 bp, Artificial Sequence
  Synthetic oligonucleotide; CTG chr2 60538742 60538763 60538759 60538764 +
tgtgtgtgtgtgtgtgtgtgtg

SEQ ID NO: 207166 - DNA, 22 bp, Artificial Sequence
  Synthetic oligonucleotide; TTG chr2 60538806 60538827 60538823 60538828 +
caaatcaccacaaatatttaca

SEQ ID NO: 207167 - DNA, 22 bp, Artificial Sequence
  Synthetic oligonucleotide; TTT chr2 60538825 60538846 60538842 60538847 +
acactgtactccctttgttcaa

SEQ ID NO: 207168 - DNA, 22 bp, Artificial Sequence
  Synthetic oligonucleotide; TTA chr2 60538826 60538847 60538843 60538848 +
cactgtactccctttgttcaaa

SEQ ID NO: 207169 - DNA, 22 bp, Artificial Sequence
  Synthetic oligonucleotide; CTG chr2 60538831 60538852 60538848 60538853 +
tactccctttgttcaaatcaca

SEQ ID NO: 207170 - DNA, 22 bp, Artificial Sequence
  Synthetic oligonucleotide; CTC chr2 60538836 60538857 60538853 60538858 +
cctttgttcaaatcacatactt

SEQ ID NO: 207171 - DNA, 22 bp, Artificial Sequence
  Synthetic oligonucleotide; CTT chr2 60538840 60538861 60538857 60538862 +
tgttcaaatcacatacttttaa

SEQ ID NO: 207172 - DNA, 22 bp, Artificial Sequence
  Synthetic oligonucleotide; TTT chr2 60538841 60538862 60538858 60538863 +
gttcaaatcacatacttttaac

SEQ ID NO: 207173 - DNA, 22 bp, Artificial Sequence
  Synthetic oligonucleotide; TTG chr2 60538842 60538863 60538859 60538864 +
ttcaaatcacatacttttaacg

SEQ ID NO: 207174 - DNA, 22 bp, Artificial Sequence
  Synthetic oligonucleotide; TTC chr2 60538845 60538866 60538862 60538867 +
aaatcacatacttttaacggga

SEQ ID NO: 207175 - DNA, 22 bp, Artificial Sequence
  Synthetic oligonucleotide; CTT chr2 60538858 60538879 60538875 60538880 +
ttaacgggaaaagctggaactg

SEQ ID NO: 207176 - DNA, 22 bp, Artificial Sequence
  Synthetic oligonucleotide; TTT chr2 60538859 60538880 60538876 60538881 +
taacgggaaaagctggaactgt

SEQ ID NO: 207177 - DNA, 22 bp, Artificial Sequence
  Synthetic oligonucleotide; TTT chr2 60538860 60538881 60538877 60538882 +
aacgggaaaagctggaactgtg

SEQ ID NO: 207178 - DNA, 22 bp, Artificial Sequence
  Synthetic oligonucleotide; TTA chr2 60538861 60538882 60538878 60538883 +
acgggaaaagctggaactgtgg

SEQ ID NO: 207179 - DNA, 22 bp, Artificial Sequence
  Synthetic oligonucleotide; CTG chr2 60538874 60538895 60538891 60538896 +
gaactgtggctatttaaaattt

SEQ ID NO: 207180 - DNA, 22 bp, Artificial Sequence
  Synthetic oligonucleotide; CTG chr2 60538880 60538901 60538897 60538902 +
tggctatttaaaattttaaata

SEQ ID NO: 207181 - DNA, 22 bp, Artificial Sequence
  Synthetic oligonucleotide; CTA chr2 60538886 60538907 60538903 60538908 +
tttaaaattttaaatattcaaa

SEQ ID NO: 207182 - DNA, 22 bp, Artificial Sequence
  Synthetic oligonucleotide; TTT chr2 60538889 60538910 60538906 60538911 +
aaaattttaaatattcaaacgc

SEQ ID NO: 207183 - DNA, 22 bp, Artificial Sequence
  Synthetic oligonucleotide; TTA chr2 60538890 60538911 60538907 60538912 +
aaattttaaatattcaaacgcc

SEQ ID NO: 207184 - DNA, 22 bp, Artificial Sequence
  Synthetic oligonucleotide; TTT chr2 60538896 60538917 60538913 60538918 +
taaatattcaaacgcctgtaat

SEQ ID NO: 207185 - DNA, 22 bp, Artificial Sequence
  Synthetic oligonucleotide; TTT chr2 60538897 60538918 60538914 60538919 +
aaatattcaaacgcctgtaatt

SEQ ID NO: 207186 - DNA, 22 bp, Artificial Sequence
  Synthetic oligonucleotide; TTA chr2 60538898 60538919 60538915 60538920 +
aatattcaaacgcctgtaatta

SEQ ID NO: 207187 - DNA, 22 bp, Artificial Sequence
  Synthetic oligonucleotide; TTC chr2 60538905 60538926 60538922 60538927 +
aaacgcctgtaattaaccatat

SEQ ID NO: 207188 - DNA, 22 bp, Artificial Sequence
  Synthetic oligonucleotide; CTG chr2 60538914 60538935 60538931 60538936 +
taattaaccatatgaaacaaat

SEQ ID NO: 207189 - DNA, 22 bp, Artificial Sequence
  Synthetic oligonucleotide; TTA chr2 60538920 60538941 60538937 60538942 +
accatatgaaacaaattatgtt

SEQ ID NO: 207190 - DNA, 22 bp, Artificial Sequence
  Synthetic oligonucleotide; TTA chr2 60538938 60538959 60538955 60538960 +
tgttgcatttctccataccagc

SEQ ID NO: 207191 - DNA, 22 bp, Artificial Sequence
  Synthetic oligonucleotide; TTG chr2 60538943 60538964 60538960 60538965 +
catttctccataccagcacatg

SEQ ID NO: 207192 - DNA, 22 bp, Artificial Sequence
  Synthetic oligonucleotide; TTT chr2 60538948 60538969 60538965 60538970 +
ctccataccagcacatgcaaaa

SEQ ID NO: 207193 - DNA, 22 bp, Artificial Sequence
  Synthetic oligonucleotide; TTC chr2 60538949 60538970 60538966 60538971 +
tccataccagcacatgcaaaaa

SEQ ID NO: 207194 - DNA, 22 bp, Artificial Sequence
  Synthetic oligonucleotide; CTC chr2 60538951 60538972 60538968 60538973 +
cataccagcacatgcaaaaaaa

SEQ ID NO: 207195 - DNA, 22 bp, Artificial Sequence
  Synthetic oligonucleotide; TTC chr2 60538976 60538997 60538993 60538998 +
tggtggtgaattgggaggtggc

SEQ ID NO: 207196 - DNA, 22 bp, Artificial Sequence
  Synthetic oligonucleotide; CTG chr2 60538978 60538999 60538995 60539000 +
gtggtgaattgggaggtggcag

SEQ ID NO: 207197 - DNA, 22 bp, Artificial Sequence
  Synthetic oligonucleotide; TTG chr2 60538989 60539010 60539006 60539011 +
ggaggtggcagagttggggaga

SEQ ID NO: 207198 - DNA, 22 bp, Artificial Sequence
  Synthetic oligonucleotide; TTG chr2 60539005 60539026 60539022 60539027 +
gggagacaactccaagagaaga

SEQ ID NO: 207199 - DNA, 22 bp, Artificial Sequence
  Synthetic oligonucleotide; CTC chr2 60539017 60539038 60539034 60539039 +
caagagaagaaaaggatgatgt

SEQ ID NO: 207200 - DNA, 22 bp, Artificial Sequence
  Synthetic oligonucleotide; TTT chr2 60539041 60539062 60539058 60539063 +
tcatttcgctatagatcaaagg

SEQ ID NO: 207201 - DNA, 22 bp, Artificial Sequence
  Synthetic oligonucleotide; TTT chr2 60539042 60539063 60539059 60539064 +
catttcgctatagatcaaagga

SEQ ID NO: 207202 - DNA, 22 bp, Artificial Sequence
  Synthetic oligonucleotide; TTC chr2 60539043 60539064 60539060 60539065 +
atttcgctatagatcaaaggag

SEQ ID NO: 207203 - DNA, 22 bp, Artificial Sequence
  Synthetic oligonucleotide; TTT chr2 60539047 60539068 60539064 60539069 +
cgctatagatcaaaggagaaca

SEQ ID NO: 207204 - DNA, 22 bp, Artificial Sequence
  Synthetic oligonucleotide; TTC chr2 60539048 60539069 60539065 60539070 +
gctatagatcaaaggagaacaa

SEQ ID NO: 207205 - DNA, 22 bp, Artificial Sequence
  Synthetic oligonucleotide; CTA chr2 60539052 60539073 60539069 60539074 +
tagatcaaaggagaacaagaat

SEQ ID NO: 207206 - DNA, 22 bp, Artificial Sequence
  Synthetic oligonucleotide; CTG chr2 60539082 60539103 60539099 60539104 +
tggcatatcgagcatttttcca

SEQ ID NO: 207207 - DNA, 22 bp, Artificial Sequence
  Synthetic oligonucleotide; TTT chr2 60539099 60539120 60539116 60539121 +
ttccattgctgtctttcacact

SEQ ID NO: 207208 - DNA, 22 bp, Artificial Sequence
  Synthetic oligonucleotide; TTT chr2 60539100 60539121 60539117 60539122 +
tccattgctgtctttcacactg

SEQ ID NO: 207209 - DNA, 22 bp, Artificial Sequence
  Synthetic oligonucleotide; TTT chr2 60539101 60539122 60539118 60539123 +
ccattgctgtctttcacactgg

SEQ ID NO: 207210 - DNA, 22 bp, Artificial Sequence
  Synthetic oligonucleotide; TTC chr2 60539102 60539123 60539119 60539124 +
cattgctgtctttcacactggg

SEQ ID NO: 207211 - DNA, 22 bp, Artificial Sequence
  Synthetic oligonucleotide; TTG chr2 60539107 60539128 60539124 60539129 +
ctgtctttcacactgggctatc

SEQ ID NO: 207212 - DNA, 22 bp, Artificial Sequence
  Synthetic oligonucleotide; CTG chr2 60539110 60539131 60539127 60539132 +
tctttcacactgggctatctaa

SEQ ID NO: 207213 - DNA, 22 bp, Artificial Sequence
  Synthetic oligonucleotide; CTT chr2 60539114 60539135 60539131 60539136 +
tcacactgggctatctaagttt

SEQ ID NO: 207214 - DNA, 22 bp, Artificial Sequence
  Synthetic oligonucleotide; TTT chr2 60539115 60539136 60539132 60539137 +
cacactgggctatctaagttta

SEQ ID NO: 207215 - DNA, 22 bp, Artificial Sequence
  Synthetic oligonucleotide; TTC chr2 60539116 60539137 60539133 60539138 +
acactgggctatctaagtttat

SEQ ID NO: 207216 - DNA, 22 bp, Artificial Sequence
  Synthetic oligonucleotide; CTG chr2 60539122 60539143 60539139 60539144 +
ggctatctaagtttatacaatt

SEQ ID NO: 207217 - DNA, 22 bp, Artificial Sequence
  Synthetic oligonucleotide; CTA chr2 60539127 60539148 60539144 60539149 +
tctaagtttatacaattcccca

SEQ ID NO: 207218 - DNA, 22 bp, Artificial Sequence
  Synthetic oligonucleotide; CTA chr2 60539131 60539152 60539148 60539153 +
agtttatacaattccccagact

SEQ ID NO: 207219 - DNA, 22 bp, Artificial Sequence
  Synthetic oligonucleotide; TTT chr2 60539136 60539157 60539153 60539158 +
atacaattccccagactagctg

SEQ ID NO: 207220 - DNA, 22 bp, Artificial Sequence
  Synthetic oligonucleotide; TTA chr2 60539137 60539158 60539154 60539159 +
tacaattccccagactagctgc

SEQ ID NO: 207221 - DNA, 22 bp, Artificial Sequence
  Synthetic oligonucleotide; TTC chr2 60539145 60539166 60539162 60539167 +
cccagactagctgcatattaag

SEQ ID NO: 207222 - DNA, 22 bp, Artificial Sequence
  Synthetic oligonucleotide; CTA chr2 60539154 60539175 60539171 60539176 +
gctgcatattaagcttgctgtg

SEQ ID NO: 207223 - DNA, 22 bp, Artificial Sequence
  Synthetic oligonucleotide; CTG chr2 60539158 60539179 60539175 60539180 +
catattaagcttgctgtgtaca

SEQ ID NO: 207224 - DNA, 22 bp, Artificial Sequence
  Synthetic oligonucleotide; TTA chr2 60539165 60539186 60539182 60539187 +
agcttgctgtgtacagctttat

SEQ ID NO: 207225 - DNA, 22 bp, Artificial Sequence
  Synthetic oligonucleotide; CTT chr2 60539170 60539191 60539187 60539192 +
gctgtgtacagctttattatgg

SEQ ID NO: 207226 - DNA, 22 bp, Artificial Sequence
  Synthetic oligonucleotide; TTG chr2 60539171 60539192 60539188 60539193 +
ctgtgtacagctttattatggt

SEQ ID NO: 207227 - DNA, 22 bp, Artificial Sequence
  Synthetic oligonucleotide; CTG chr2 60539174 60539195 60539191 60539196 +
tgtacagctttattatggtgtg

SEQ ID NO: 207228 - DNA, 22 bp, Artificial Sequence
  Synthetic oligonucleotide; CTT chr2 60539184 60539205 60539201 60539206 +
tattatggtgtggtggtggaag

SEQ ID NO: 207229 - DNA, 22 bp, Artificial Sequence
  Synthetic oligonucleotide; TTT chr2 60539185 60539206 60539202 60539207 +
attatggtgtggtggtggaaga

SEQ ID NO: 207230 - DNA, 22 bp, Artificial Sequence
  Synthetic oligonucleotide; TTA chr2 60539186 60539207 60539203 60539208 +
ttatggtgtggtggtggaagaa

SEQ ID NO: 207231 - DNA, 22 bp, Artificial Sequence
  Synthetic oligonucleotide; TTA chr2 60539189 60539210 60539206 60539211 +
tggtgtggtggtggaagaagca

SEQ ID NO: 207232 - DNA, 22 bp, Artificial Sequence
  Synthetic oligonucleotide; TTA chr2 60539214 60539235 60539231 60539236 +
atattccagctccgcatctgac

SEQ ID NO: 207233 - DNA, 22 bp, Artificial Sequence
  Synthetic oligonucleotide; TTC chr2 60539220 60539241 60539237 60539242 +
cagctccgcatctgacagggca

SEQ ID NO: 207234 - DNA, 22 bp, Artificial Sequence
  Synthetic oligonucleotide; CTC chr2 60539226 60539247 60539243 60539248 +
cgcatctgacagggcatttaca

SEQ ID NO: 207235 - DNA, 22 bp, Artificial Sequence
  Synthetic oligonucleotide; CTG chr2 60539234 60539255 60539251 60539256 +
acagggcatttacatgcgccca

SEQ ID NO: 207236 - DNA, 22 bp, Artificial Sequence
  Synthetic oligonucleotide; TTT chr2 60539245 60539266 60539262 60539267 +
acatgcgcccatctgagcggca

SEQ ID NO: 207237 - DNA, 22 bp, Artificial Sequence
  Synthetic oligonucleotide; TTA chr2 60539246 60539267 60539263 60539268 +
catgcgcccatctgagcggcac

SEQ ID NO: 207238 - DNA, 22 bp, Artificial Sequence
  Synthetic oligonucleotide; CTG chr2 60539260 60539281 60539277 60539282 +
agcggcacctgagagctcctcc

SEQ ID NO: 207239 - DNA, 22 bp, Artificial Sequence
  Synthetic oligonucleotide; CTG chr2 60539271 60539292 60539288 60539293 +
agagctcctccaaggtgcagta

SEQ ID NO: 207240 - DNA, 22 bp, Artificial Sequence
  Synthetic oligonucleotide; CTC chr2 60539278 60539299 60539295 60539300 +
ctccaaggtgcagtaactgtgc

SEQ ID NO: 207241 - DNA, 22 bp, Artificial Sequence
  Synthetic oligonucleotide; CTC chr2 60539281 60539302 60539298 60539303 +
caaggtgcagtaactgtgcgcc

SEQ ID NO: 207242 - DNA, 22 bp, Artificial Sequence
  Synthetic oligonucleotide; CTG chr2 60539297 60539318 60539314 60539319 +
tgcgcctattgtaaaggcaaat

SEQ ID NO: 207243 - DNA, 22 bp, Artificial Sequence
  Synthetic oligonucleotide; CTA chr2 60539305 60539326 60539322 60539327 +
ttgtaaaggcaaatgaagctca

SEQ ID NO: 207244 - DNA, 22 bp, Artificial Sequence
  Synthetic oligonucleotide; TTG chr2 60539308 60539329 60539325 60539330 +
taaaggcaaatgaagctcacct

SEQ ID NO: 207245 - DNA, 22 bp, Artificial Sequence
  Synthetic oligonucleotide; CTC chr2 60539326 60539347 60539343 60539348 +
acctattccctgctgggatcag

SEQ ID NO: 207246 - DNA, 22 bp, Artificial Sequence
  Synthetic oligonucleotide; CTA chr2 60539331 60539352 60539348 60539353 +
ttccctgctgggatcagaagtg

SEQ ID NO: 207247 - DNA, 22 bp, Artificial Sequence
  Synthetic oligonucleotide; TTC chr2 60539334 60539355 60539351 60539356 +
cctgctgggatcagaagtgacc

SEQ ID NO: 207248 - DNA, 22 bp, Artificial Sequence
  Synthetic oligonucleotide; CTG chr2 60539338 60539359 60539355 60539360 +
ctgggatcagaagtgacctcac

SEQ ID NO: 207249 - DNA, 22 bp, Artificial Sequence
  Synthetic oligonucleotide; CTG chr2 60539341 60539362 60539358 60539363 +
ggatcagaagtgacctcaccac

SEQ ID NO: 207250 - DNA, 22 bp, Artificial Sequence
  Synthetic oligonucleotide; CTC chr2 60539358 60539379 60539375 60539380 +
accaccccccatgcctcaaatc

SEQ ID NO: 207251 - DNA, 22 bp, Artificial Sequence
  Synthetic oligonucleotide; CTC chr2 60539375 60539396 60539392 60539397 +
aaatccttcccttgccaaccta

SEQ ID NO: 207252 - DNA, 22 bp, Artificial Sequence
  Synthetic oligonucleotide; CTT chr2 60539383 60539404 60539400 60539405 +
cccttgccaacctaactcaatg

SEQ ID NO: 207253 - DNA, 22 bp, Artificial Sequence
  Synthetic oligonucleotide; TTC chr2 60539384 60539405 60539401 60539406 +
ccttgccaacctaactcaatgc

SEQ ID NO: 207254 - DNA, 22 bp, Artificial Sequence
  Synthetic oligonucleotide; CTT chr2 60539388 60539409 60539405 60539410 +
gccaacctaactcaatgccatt

SEQ ID NO: 207255 - DNA, 22 bp, Artificial Sequence
  Synthetic oligonucleotide; TTG chr2 60539389 60539410 60539406 60539411 +
ccaacctaactcaatgccattg

SEQ ID NO: 207256 - DNA, 22 bp, Artificial Sequence
  Synthetic oligonucleotide; CTA chr2 60539397 60539418 60539414 60539419 +
actcaatgccattgcagaatga

SEQ ID NO: 207257 - DNA, 22 bp, Artificial Sequence
  Synthetic oligonucleotide; CTC chr2 60539401 60539422 60539418 60539423 +
aatgccattgcagaatgacgaa

SEQ ID NO: 207258 - DNA, 22 bp, Artificial Sequence
  Synthetic oligonucleotide; TTG chr2 60539411 60539432 60539428 60539433 +
cagaatgacgaatgagctcaga

SEQ ID NO: 207259 - DNA, 22 bp, Artificial Sequence
  Synthetic oligonucleotide; CTC chr2 60539430 60539451 60539447 60539452 +
agaaatagaccccaagttacta

SEQ ID NO: 207260 - DNA, 22 bp, Artificial Sequence
  Synthetic oligonucleotide; TTA chr2 60539449 60539470 60539466 60539471 +
ctaaccctgctaagaacagcaa

SEQ ID NO: 207261 - DNA, 22 bp, Artificial Sequence
  Synthetic oligonucleotide; CTA chr2 60539452 60539473 60539469 60539474 +
accctgctaagaacagcaaaag

SEQ ID NO: 207262 - DNA, 22 bp, Artificial Sequence
  Synthetic oligonucleotide; CTG chr2 60539458 60539479 60539475 60539480 +
ctaagaacagcaaaagcctttg

SEQ ID NO: 207263 - DNA, 22 bp, Artificial Sequence
  Synthetic oligonucleotide; CTA chr2 60539461 60539482 60539478 60539483 +
agaacagcaaaagcctttgctg

SEQ ID NO: 207264 - DNA, 22 bp, Artificial Sequence
  Synthetic oligonucleotide; CTT chr2 60539478 60539499 60539495 60539500 +
tgctgaaatgttttaaaaatgc

SEQ ID NO: 207265 - DNA, 22 bp, Artificial Sequence
  Synthetic oligonucleotide; TTT chr2 60539479 60539500 60539496 60539501 +
gctgaaatgttttaaaaatgca

SEQ ID NO: 207266 - DNA, 22 bp, Artificial Sequence
  Synthetic oligonucleotide; TTG chr2 60539480 60539501 60539497 60539502 +
ctgaaatgttttaaaaatgcat

SEQ ID NO: 207267 - DNA, 22 bp, Artificial Sequence
  Synthetic oligonucleotide; CTG chr2 60539483 60539504 60539500 60539505 +
aaatgttttaaaaatgcatagg

SEQ ID NO: 207268 - DNA, 22 bp, Artificial Sequence
  Synthetic oligonucleotide; TTT chr2 60539491 60539512 60539508 60539513 +
taaaaatgcatagggagtgcag

SEQ ID NO: 207269 - DNA, 22 bp, Artificial Sequence
  Synthetic oligonucleotide; TTT chr2 60539492 60539513 60539509 60539514 +
aaaaatgcatagggagtgcagc

SEQ ID NO: 207270 - DNA, 22 bp, Artificial Sequence
  Synthetic oligonucleotide; TTA chr2 60539493 60539514 60539510 60539515 +
aaaatgcatagggagtgcagct

SEQ ID NO: 207271 - DNA, 22 bp, Artificial Sequence
  Synthetic oligonucleotide; CTG chr2 60539516 60539537 60539533 60539538 +
gccagtaaaaagcagggagaca

SEQ ID NO: 207272 - DNA, 22 bp, Artificial Sequence
  Synthetic oligonucleotide; TTC chr2 60539543 60539564 60539560 60539565 +
caatgaacccaatatggaataa

SEQ ID NO: 207273 - DNA, 22 bp, Artificial Sequence
  Synthetic oligonucleotide; TTA chr2 60539569 60539590 60539586 60539591 +
cattttaaaactgattagaaat

SEQ ID NO: 207274 - DNA, 22 bp, Artificial Sequence
  Synthetic oligonucleotide; TTT chr2 60539574 60539595 60539591 60539596 +
taaaactgattagaaatacagt

SEQ ID NO: 207275 - DNA, 22 bp, Artificial Sequence
  Synthetic oligonucleotide; TTT chr2 60539575 60539596 60539592 60539597 +
aaaactgattagaaatacagtc

SEQ ID NO: 207276 - DNA, 22 bp, Artificial Sequence
  Synthetic oligonucleotide; TTA chr2 60539576 60539597 60539593 60539598 +
aaactgattagaaatacagtct

SEQ ID NO: 207277 - DNA, 22 bp, Artificial Sequence
  Synthetic oligonucleotide; CTG chr2 60539582 60539603 60539599 60539604 +
attagaaatacagtctgatgtt

SEQ ID NO: 207278 - DNA, 22 bp, Artificial Sequence
  Synthetic oligonucleotide; TTA chr2 60539586 60539607 60539603 60539608 +
gaaatacagtctgatgtttact

SEQ ID NO: 207279 - DNA, 22 bp, Artificial Sequence
  Synthetic oligonucleotide; CTG chr2 60539599 60539620 60539616 60539621 +
atgtttactggcttcaaattga

SEQ ID NO: 207280 - DNA, 22 bp, Artificial Sequence
  Synthetic oligonucleotide; TTT chr2 60539605 60539626 60539622 60539627 +
actggcttcaaattgagtttgg

SEQ ID NO: 207281 - DNA, 22 bp, Artificial Sequence
  Synthetic oligonucleotide; TTA chr2 60539606 60539627 60539623 60539628 +
ctggcttcaaattgagtttggc

SEQ ID NO: 207282 - DNA, 22 bp, Artificial Sequence
  Synthetic oligonucleotide; CTG chr2 60539609 60539630 60539626 60539631 +
gcttcaaattgagtttggcatc

SEQ ID NO: 207283 - DNA, 22 bp, Artificial Sequence
  Synthetic oligonucleotide; CTT chr2 60539613 60539634 60539630 60539635 +
caaattgagtttggcatcaagt

SEQ ID NO: 207284 - DNA, 22 bp, Artificial Sequence
  Synthetic oligonucleotide; TTC chr2 60539614 60539635 60539631 60539636 +
aaattgagtttggcatcaagta

SEQ ID NO: 207285 - DNA, 22 bp, Artificial Sequence
  Synthetic oligonucleotide; TTG chr2 60539620 60539641 60539637 60539642 +
agtttggcatcaagtatactgg

SEQ ID NO: 207286 - DNA, 22 bp, Artificial Sequence
  Synthetic oligonucleotide; TTT chr2 60539625 60539646 60539642 60539647 +
ggcatcaagtatactggcttta

SEQ ID NO: 207287 - DNA, 22 bp, Artificial Sequence
  Synthetic oligonucleotide; TTG chr2 60539626 60539647 60539643 60539648 +
gcatcaagtatactggctttaa

SEQ ID NO: 207288 - DNA, 22 bp, Artificial Sequence
  Synthetic oligonucleotide; CTG chr2 60539641 60539662 60539658 60539663 +
gctttaataatgctggcacttt

SEQ ID NO: 207289 - DNA, 22 bp, Artificial Sequence
  Synthetic oligonucleotide; CTT chr2 60539645 60539666 60539662 60539667 +
taataatgctggcacttttaaa

SEQ ID NO: 207290 - DNA, 22 bp, Artificial Sequence
  Synthetic oligonucleotide; TTT chr2 60539646 60539667 60539663 60539668 +
aataatgctggcacttttaaaa

SEQ ID NO: 207291 - DNA, 22 bp, Artificial Sequence
  Synthetic oligonucleotide; TTA chr2 60539647 60539668 60539664 60539669 +
ataatgctggcacttttaaaat

SEQ ID NO: 207292 - DNA, 22 bp, Artificial Sequence
  Synthetic oligonucleotide; CTG chr2 60539656 60539677 60539673 60539678 +
gcacttttaaaattattattat

SEQ ID NO: 207293 - DNA, 22 bp, Artificial Sequence
  Synthetic oligonucleotide; CTT chr2 60539662 60539683 60539679 60539684 +
ttaaaattattattattttaaa

SEQ ID NO: 207294 - DNA, 22 bp, Artificial Sequence
  Synthetic oligonucleotide; TTT chr2 60539663 60539684 60539680 60539685 +
taaaattattattattttaaat

SEQ ID NO: 207295 - DNA, 22 bp, Artificial Sequence
  Synthetic oligonucleotide; TTT chr2 60539664 60539685 60539681 60539686 +
aaaattattattattttaaatc

SEQ ID NO: 207296 - DNA, 22 bp, Artificial Sequence
  Synthetic oligonucleotide; TTA chr2 60539665 60539686 60539682 60539687 +
aaattattattattttaaatct

SEQ ID NO: 207297 - DNA, 22 bp, Artificial Sequence
  Synthetic oligonucleotide; TTA chr2 60539671 60539692 60539688 60539693 +
ttattattttaaatctgccttt

SEQ ID NO: 207298 - DNA, 22 bp, Artificial Sequence
  Synthetic oligonucleotide; TTA chr2 60539674 60539695 60539691 60539696 +
ttattttaaatctgcctttggt

SEQ ID NO: 207299 - DNA, 22 bp, Artificial Sequence
  Synthetic oligonucleotide; TTA chr2 60539677 60539698 60539694 60539699 +
ttttaaatctgcctttggtctc

SEQ ID NO: 207300 - DNA, 22 bp, Artificial Sequence
  Synthetic oligonucleotide; TTT chr2 60539680 60539701 60539697 60539702 +
taaatctgcctttggtctctag

SEQ ID NO: 207301 - DNA, 22 bp, Artificial Sequence
  Synthetic oligonucleotide; TTT chr2 60539681 60539702 60539698 60539703 +
aaatctgcctttggtctctagg

SEQ ID NO: 207302 - DNA, 22 bp, Artificial Sequence
  Synthetic oligonucleotide; TTA chr2 60539682 60539703 60539699 60539704 +
aatctgcctttggtctctagga

SEQ ID NO: 207303 - DNA, 22 bp, Artificial Sequence
  Synthetic oligonucleotide; CTG chr2 60539688 60539709 60539705 60539710 +
cctttggtctctaggagcacat

SEQ ID NO: 207304 - DNA, 22 bp, Artificial Sequence
  Synthetic oligonucleotide; CTT chr2 60539692 60539713 60539709 60539714 +
tggtctctaggagcacatgtag

SEQ ID NO: 207305 - DNA, 22 bp, Artificial Sequence
  Synthetic oligonucleotide; TTT chr2 60539693 60539714 60539710 60539715 +
ggtctctaggagcacatgtaga

SEQ ID NO: 207306 - DNA, 22 bp, Artificial Sequence
  Synthetic oligonucleotide; TTG chr2 60539694 60539715 60539711 60539716 +
gtctctaggagcacatgtagag

SEQ ID NO: 207307 - DNA, 22 bp, Artificial Sequence
  Synthetic oligonucleotide; CTC chr2 60539699 60539720 60539716 60539721 +
taggagcacatgtagagagcta

SEQ ID NO: 207308 - DNA, 22 bp, Artificial Sequence
  Synthetic oligonucleotide; CTA chr2 60539701 60539722 60539718 60539723 +
ggagcacatgtagagagctaaa

SEQ ID NO: 207309 - DNA, 22 bp, Artificial Sequence
  Synthetic oligonucleotide; CTA chr2 60539721 60539742 60539738 60539743 +
aagaattcttatttgtcaggtt

SEQ ID NO: 207310 - DNA, 22 bp, Artificial Sequence
  Synthetic oligonucleotide; TTC chr2 60539729 60539750 60539746 60539751 +
ttatttgtcaggttacatttcc

SEQ ID NO: 207311 - DNA, 22 bp, Artificial Sequence
  Synthetic oligonucleotide; CTT chr2 60539731 60539752 60539748 60539753 +
atttgtcaggttacatttcctg

SEQ ID NO: 207312 - DNA, 22 bp, Artificial Sequence
  Synthetic oligonucleotide; TTA chr2 60539732 60539753 60539749 60539754 +
tttgtcaggttacatttcctgg

SEQ ID NO: 207313 - DNA, 22 bp, Artificial Sequence
  Synthetic oligonucleotide; TTT chr2 60539735 60539756 60539752 60539757 +
gtcaggttacatttcctggaaa

SEQ ID NO: 207314 - DNA, 22 bp, Artificial Sequence
  Synthetic oligonucleotide; TTG chr2 60539736 60539757 60539753 60539758 +
tcaggttacatttcctggaaat

SEQ ID NO: 207315 - DNA, 22 bp, Artificial Sequence
  Synthetic oligonucleotide; TTA chr2 60539744 60539765 60539761 60539766 +
catttcctggaaattaagtttg

SEQ ID NO: 207316 - DNA, 22 bp, Artificial Sequence
  Synthetic oligonucleotide; TTT chr2 60539749 60539770 60539766 60539771 +
cctggaaattaagtttgtgaca

SEQ ID NO: 207317 - DNA, 22 bp, Artificial Sequence
  Synthetic oligonucleotide; TTC chr2 60539750 60539771 60539767 60539772 +
ctggaaattaagtttgtgacag

SEQ ID NO: 207318 - DNA, 22 bp, Artificial Sequence
  Synthetic oligonucleotide; CTG chr2 60539753 60539774 60539770 60539775 +
gaaattaagtttgtgacagaaa

SEQ ID NO: 207319 - DNA, 22 bp, Artificial Sequence
  Synthetic oligonucleotide; TTA chr2 60539760 60539781 60539777 60539782 +
agtttgtgacagaaaatgactc

SEQ ID NO: 207320 - DNA, 22 bp, Artificial Sequence
  Synthetic oligonucleotide; TTT chr2 60539765 60539786 60539782 60539787 +
gtgacagaaaatgactccagta

SEQ ID NO: 207321 - DNA, 22 bp, Artificial Sequence
  Synthetic oligonucleotide; TTG chr2 60539766 60539787 60539783 60539788 +
tgacagaaaatgactccagtag

SEQ ID NO: 207322 - DNA, 22 bp, Artificial Sequence
  Synthetic oligonucleotide; CTC chr2 60539782 60539803 60539799 60539804 +
cagtagcaataatatggttcgt

SEQ ID NO: 207323 - DNA, 22 bp, Artificial Sequence
  Synthetic oligonucleotide; TTC chr2 60539802 60539823 60539819 60539824 +
gtgctcaaattaattaggtcat

SEQ ID NO: 207324 - DNA, 22 bp, Artificial Sequence
  Synthetic oligonucleotide; CTC chr2 60539808 60539829 60539825 60539830 +
aaattaattaggtcatgttgta

SEQ ID NO: 207325 - DNA, 22 bp, Artificial Sequence
  Synthetic oligonucleotide; TTA chr2 60539814 60539835 60539831 60539836 +
attaggtcatgttgtaaaaact

SEQ ID NO: 207326 - DNA, 22 bp, Artificial Sequence
  Synthetic oligonucleotide; TTA chr2 60539818 60539839 60539835 60539840 +
ggtcatgttgtaaaaactacgt

SEQ ID NO: 207327 - DNA, 22 bp, Artificial Sequence
  Synthetic oligonucleotide; TTG chr2 60539828 60539849 60539845 60539850 +
taaaaactacgtggcaaattac

SEQ ID NO: 207328 - DNA, 22 bp, Artificial Sequence
  Synthetic oligonucleotide; CTA chr2 60539837 60539858 60539854 60539859 +
cgtggcaaattacaaaggtaaa

SEQ ID NO: 207329 - DNA, 22 bp, Artificial Sequence
  Synthetic oligonucleotide; TTA chr2 60539849 60539870 60539866 60539871 +
caaaggtaaatttactgatatt

SEQ ID NO: 207330 - DNA, 22 bp, Artificial Sequence
  Synthetic oligonucleotide; TTT chr2 60539862 60539883 60539879 60539884 +
actgatattggccagtgctcta

SEQ ID NO: 207331 - DNA, 22 bp, Artificial Sequence
  Synthetic oligonucleotide; TTA chr2 60539863 60539884 60539880 60539885 +
ctgatattggccagtgctctat

SEQ ID NO: 207332 - DNA, 22 bp, Artificial Sequence
  Synthetic oligonucleotide; CTG chr2 60539866 60539887 60539883 60539888 +
atattggccagtgctctatacc

SEQ ID NO: 207333 - DNA, 22 bp, Artificial Sequence
  Synthetic oligonucleotide; TTG chr2 60539872 60539893 60539889 60539894 +
gccagtgctctataccctggtc

SEQ ID NO: 207334 - DNA, 22 bp, Artificial Sequence
  Synthetic oligonucleotide; CTC chr2 60539882 60539903 60539899 60539904 +
tataccctggtcgtaaagggga

SEQ ID NO: 207335 - DNA, 22 bp, Artificial Sequence
  Synthetic oligonucleotide; CTA chr2 60539884 60539905 60539901 60539906 +
taccctggtcgtaaaggggaga

SEQ ID NO: 207336 - DNA, 22 bp, Artificial Sequence
  Synthetic oligonucleotide; CTG chr2 60539891 60539912 60539908 60539913 +
gtcgtaaaggggagaagctgtt

SEQ ID NO: 207337 - DNA, 22 bp, Artificial Sequence
  Synthetic oligonucleotide; CTG chr2 60539911 60539932 60539928 60539933 +
tttaaggatgcccatttaccta

SEQ ID NO: 207338 - DNA, 22 bp, Artificial Sequence
  Synthetic oligonucleotide; TTT chr2 60539914 60539935 60539931 60539936 +
aaggatgcccatttacctaggt

SEQ ID NO: 207339 - DNA, 22 bp, Artificial Sequence
  Synthetic oligonucleotide; TTA chr2 60539915 60539936 60539932 60539937 +
aggatgcccatttacctaggta

SEQ ID NO: 207340 - DNA, 22 bp, Artificial Sequence
  Synthetic oligonucleotide; TTT chr2 60539928 60539949 60539945 60539950 +
acctaggtaggagaaaagaacc

SEQ ID NO: 207341 - DNA, 22 bp, Artificial Sequence
  Synthetic oligonucleotide; TTA chr2 60539929 60539950 60539946 60539951 +
cctaggtaggagaaaagaacca

SEQ ID NO: 207342 - DNA, 22 bp, Artificial Sequence
  Synthetic oligonucleotide; CTA chr2 60539933 60539954 60539950 60539955 +
ggtaggagaaaagaaccaagga

SEQ ID NO: 207343 - DNA, 22 bp, Artificial Sequence
  Synthetic oligonucleotide; TTT chr2 60539978 60539999 60539995 60540000 +
cctatttgtattacaaataaaa

SEQ ID NO: 207344 - DNA, 22 bp, Artificial Sequence
  Synthetic oligonucleotide; TTC chr2 60539979 60540000 60539996 60540001 +
ctatttgtattacaaataaaaa

SEQ ID NO: 207345 - DNA, 22 bp, Artificial Sequence
  Synthetic oligonucleotide; CTA chr2 60539982 60540003 60539999 60540004 +
tttgtattacaaataaaaatag

SEQ ID NO: 207346 - DNA, 22 bp, Artificial Sequence
  Synthetic oligonucleotide; TTT chr2 60539985 60540006 60540002 60540007 +
gtattacaaataaaaatagtag

SEQ ID NO: 207347 - DNA, 22 bp, Artificial Sequence
  Synthetic oligonucleotide; TTG chr2 60539986 60540007 60540003 60540008 +
tattacaaataaaaatagtagt

SEQ ID NO: 207348 - DNA, 22 bp, Artificial Sequence
  Synthetic oligonucleotide; TTA chr2 60539991 60540012 60540008 60540013 +
caaataaaaatagtagtcatta

SEQ ID NO: 207349 - DNA, 22 bp, Artificial Sequence
  Synthetic oligonucleotide; TTA chr2 60540013 60540034 60540030 60540035 +
tccattaaattatatagtctga

SEQ ID NO: 207350 - DNA, 22 bp, Artificial Sequence
  Synthetic oligonucleotide; TTA chr2 60540020 60540041 60540037 60540042 +
aattatatagtctgaacatatt

SEQ ID NO: 207351 - DNA, 22 bp, Artificial Sequence
  Synthetic oligonucleotide; TTA chr2 60540025 60540046 60540042 60540047 +
tatagtctgaacatattttatg

SEQ ID NO: 207352 - DNA, 22 bp, Artificial Sequence
  Synthetic oligonucleotide; CTG chr2 60540034 60540055 60540051 60540056 +
aacatattttatgaacttcatt

SEQ ID NO: 207353 - DNA, 22 bp, Artificial Sequence
  Synthetic oligonucleotide; TTT chr2 60540043 60540064 60540060 60540065 +
tatgaacttcattaatgtcatc

SEQ ID NO: 207354 - DNA, 22 bp, Artificial Sequence
  Synthetic oligonucleotide; TTT chr2 60540044 60540065 60540061 60540066 +
atgaacttcattaatgtcatcc

SEQ ID NO: 207355 - DNA, 22 bp, Artificial Sequence
  Synthetic oligonucleotide; TTA chr2 60540045 60540066 60540062 60540067 +
tgaacttcattaatgtcatcca

SEQ ID NO: 207356 - DNA, 22 bp, Artificial Sequence
  Synthetic oligonucleotide; CTT chr2 60540052 60540073 60540069 60540074 +
cattaatgtcatccaaattgat

SEQ ID NO: 207357 - DNA, 22 bp, Artificial Sequence
  Synthetic oligonucleotide; TTC chr2 60540053 60540074 60540070 60540075 +
attaatgtcatccaaattgata

SEQ ID NO: 207358 - DNA, 22 bp, Artificial Sequence
  Synthetic oligonucleotide; TTA chr2 60540057 60540078 60540074 60540079 +
atgtcatccaaattgatacata

SEQ ID NO: 207359 - DNA, 22 bp, Artificial Sequence
  Synthetic oligonucleotide; TTG chr2 60540072 60540093 60540089 60540094 +
atacataacataaaaacctgct

SEQ ID NO: 207360 - DNA, 22 bp, Artificial Sequence
  Synthetic oligonucleotide; CTG chr2 60540092 60540113 60540109 60540114 +
cttgatttgaaataatgttaaa

SEQ ID NO: 207361 - DNA, 22 bp, Artificial Sequence
  Synthetic oligonucleotide; CTT chr2 60540095 60540116 60540112 60540117 +
gatttgaaataatgttaaaagt

SEQ ID NO: 207362 - DNA, 22 bp, Artificial Sequence
  Synthetic oligonucleotide; TTG chr2 60540096 60540117 60540113 60540118 +
atttgaaataatgttaaaagtg

SEQ ID NO: 207363 - DNA, 22 bp, Artificial Sequence
  Synthetic oligonucleotide; TTT chr2 60540100 60540121 60540117 60540122 +
gaaataatgttaaaagtgggct

SEQ ID NO: 207364 - DNA, 22 bp, Artificial Sequence
  Synthetic oligonucleotide; TTG chr2 60540101 60540122 60540118 60540123 +
aaataatgttaaaagtgggctc

SEQ ID NO: 207365 - DNA, 22 bp, Artificial Sequence
  Synthetic oligonucleotide; TTA chr2 60540112 60540133 60540129 60540134 +
aaagtgggctctaagttagaat

SEQ ID NO: 207366 - DNA, 22 bp, Artificial Sequence
  Synthetic oligonucleotide; CTC chr2 60540123 60540144 60540140 60540145 +
taagttagaatcttttttttta

SEQ ID NO: 207367 - DNA, 22 bp, Artificial Sequence
  Synthetic oligonucleotide; CTA chr2 60540125 60540146 60540142 60540147 +
agttagaatctttttttttaat

SEQ ID NO: 207368 - DNA, 22 bp, Artificial Sequence
  Synthetic oligonucleotide; TTA chr2 60540130 60540151 60540147 60540152 +
gaatctttttttttaatccttg

SEQ ID NO: 207369 - DNA, 22 bp, Artificial Sequence
  Synthetic oligonucleotide; CTT chr2 60540137 60540158 60540154 60540159 +
tttttttaatccttgaaataac

SEQ ID NO: 207370 - DNA, 22 bp, Artificial Sequence
  Synthetic oligonucleotide; TTT chr2 60540138 60540159 60540155 60540160 +
ttttttaatccttgaaataaca

SEQ ID NO: 207371 - DNA, 22 bp, Artificial Sequence
  Synthetic oligonucleotide; TTT chr2 60540139 60540160 60540156 60540161 +
tttttaatccttgaaataacaa

SEQ ID NO: 207372 - DNA, 22 bp, Artificial Sequence
  Synthetic oligonucleotide; TTT chr2 60540140 60540161 60540157 60540162 +
ttttaatccttgaaataacaac

SEQ ID NO: 207373 - DNA, 22 bp, Artificial Sequence
  Synthetic oligonucleotide; TTT chr2 60540141 60540162 60540158 60540163 +
tttaatccttgaaataacaaca

SEQ ID NO: 207374 - DNA, 22 bp, Artificial Sequence
  Synthetic oligonucleotide; TTT chr2 60540142 60540163 60540159 60540164 +
ttaatccttgaaataacaacac

SEQ ID NO: 207375 - DNA, 22 bp, Artificial Sequence
  Synthetic oligonucleotide; TTT chr2 60540143 60540164 60540160 60540165 +
taatccttgaaataacaacact

SEQ ID NO: 207376 - DNA, 22 bp, Artificial Sequence
  Synthetic oligonucleotide; TTT chr2 60540144 60540165 60540161 60540166 +
aatccttgaaataacaacactg

SEQ ID NO: 207377 - DNA, 22 bp, Artificial Sequence
  Synthetic oligonucleotide; TTA chr2 60540145 60540166 60540162 60540167 +
atccttgaaataacaacactgc

SEQ ID NO: 207378 - DNA, 22 bp, Artificial Sequence
  Synthetic oligonucleotide; CTT chr2 60540151 60540172 60540168 60540173 +
gaaataacaacactgctgacat

SEQ ID NO: 207379 - DNA, 22 bp, Artificial Sequence
  Synthetic oligonucleotide; TTG chr2 60540152 60540173 60540169 60540174 +
aaataacaacactgctgacata

SEQ ID NO: 207380 - DNA, 22 bp, Artificial Sequence
  Synthetic oligonucleotide; CTG chr2 60540166 60540187 60540183 60540188 +
ctgacatagccatgacccaaat

SEQ ID NO: 207381 - DNA, 22 bp, Artificial Sequence
  Synthetic oligonucleotide; CTG chr2 60540169 60540190 60540186 60540191 +
acatagccatgacccaaatgaa

SEQ ID NO: 207382 - DNA, 22 bp, Artificial Sequence
  Synthetic oligonucleotide; CTG chr2 60540196 60540217 60540213 60540218 +
aacaagcagaaaggtactaaag

SEQ ID NO: 207383 - DNA, 22 bp, Artificial Sequence
  Synthetic oligonucleotide; CTA chr2 60540215 60540236 60540232 60540237 +
aagatgcttggtgattaaatct

SEQ ID NO: 207384 - DNA, 22 bp, Artificial Sequence
  Synthetic oligonucleotide; CTT chr2 60540224 60540245 60540241 60540246 +
ggtgattaaatctcatgctaaa

SEQ ID NO: 207385 - DNA, 22 bp, Artificial Sequence
  Synthetic oligonucleotide; TTG chr2 60540225 60540246 60540242 60540247 +
gtgattaaatctcatgctaaaa

SEQ ID NO: 207386 - DNA, 22 bp, Artificial Sequence
  Synthetic oligonucleotide; TTA chr2 60540232 60540253 60540249 60540254 +
aatctcatgctaaaaaagtggc

SEQ ID NO: 207387 - DNA, 22 bp, Artificial Sequence
  Synthetic oligonucleotide; CTC chr2 60540238 60540259 60540255 60540260 +
atgctaaaaaagtggcaaggtg

SEQ ID NO: 207388 - DNA, 22 bp, Artificial Sequence
  Synthetic oligonucleotide; CTA chr2 60540244 60540265 60540261 60540266 +
aaaaagtggcaaggtgccaggc

SEQ ID NO: 207389 - DNA, 22 bp, Artificial Sequence
  Synthetic oligonucleotide; CTG chr2 60540268 60540289 60540285 60540290 +
ggtccagcttgatgctaagtgc

SEQ ID NO: 207390 - DNA, 22 bp, Artificial Sequence
  Synthetic oligonucleotide; CTT chr2 60540278 60540299 60540295 60540300 +
gatgctaagtgctttttattgc

SEQ ID NO: 207391 - DNA, 22 bp, Artificial Sequence
  Synthetic oligonucleotide; TTG chr2 60540279 60540300 60540296 60540301 +
atgctaagtgctttttattgca

SEQ ID NO: 207392 - DNA, 22 bp, Artificial Sequence
  Synthetic oligonucleotide; CTA chr2 60540285 60540306 60540302 60540307 +
agtgctttttattgcacaaagc

SEQ ID NO: 207393 - DNA, 22 bp, Artificial Sequence
  Synthetic oligonucleotide; CTT chr2 60540292 60540313 60540309 60540314 +
tttattgcacaaagctggtact

SEQ ID NO: 207394 - DNA, 22 bp, Artificial Sequence
  Synthetic oligonucleotide; TTT chr2 60540293 60540314 60540310 60540315 +
ttattgcacaaagctggtacta

SEQ ID NO: 207395 - DNA, 22 bp, Artificial Sequence
  Synthetic oligonucleotide; TTT chr2 60540294 60540315 60540311 60540316 +
tattgcacaaagctggtactac

SEQ ID NO: 207396 - DNA, 22 bp, Artificial Sequence
  Synthetic oligonucleotide; TTT chr2 60540295 60540316 60540312 60540317 +
attgcacaaagctggtactact

SEQ ID NO: 207397 - DNA, 22 bp, Artificial Sequence
  Synthetic oligonucleotide; TTA chr2 60540296 60540317 60540313 60540318 +
ttgcacaaagctggtactactg

SEQ ID NO: 207398 - DNA, 22 bp, Artificial Sequence
  Synthetic oligonucleotide; TTG chr2 60540299 60540320 60540316 60540321 +
cacaaagctggtactactgtat

SEQ ID NO: 207399 - DNA, 22 bp, Artificial Sequence
  Synthetic oligonucleotide; CTG chr2 60540309 60540330 60540326 60540331 +
gtactactgtatgtaaaaacag

SEQ ID NO: 207400 - DNA, 22 bp, Artificial Sequence
  Synthetic oligonucleotide; CTA chr2 60540315 60540336 60540332 60540337 +
ctgtatgtaaaaacagacttgg

SEQ ID NO: 207401 - DNA, 22 bp, Artificial Sequence
  Synthetic oligonucleotide; CTG chr2 60540318 60540339 60540335 60540340 +
tatgtaaaaacagacttgggct

SEQ ID NO: 207402 - DNA, 22 bp, Artificial Sequence
  Synthetic oligonucleotide; CTT chr2 60540335 60540356 60540352 60540357 +
gggcttggggtaaattttgtca

SEQ ID NO: 207403 - DNA, 22 bp, Artificial Sequence
  Synthetic oligonucleotide; TTG chr2 60540336 60540357 60540353 60540358 +
ggcttggggtaaattttgtcaa

SEQ ID NO: 207404 - DNA, 22 bp, Artificial Sequence
  Synthetic oligonucleotide; CTT chr2 60540341 60540362 60540358 60540363 +
ggggtaaattttgtcaaatgac

SEQ ID NO: 207405 - DNA, 22 bp, Artificial Sequence
  Synthetic oligonucleotide; TTG chr2 60540342 60540363 60540359 60540364 +
gggtaaattttgtcaaatgact

SEQ ID NO: 207406 - DNA, 22 bp, Artificial Sequence
  Synthetic oligonucleotide; TTT chr2 60540352 60540373 60540369 60540374 +
tgtcaaatgacttctttgtgca

SEQ ID NO: 207407 - DNA, 22 bp, Artificial Sequence
  Synthetic oligonucleotide; TTT chr2 60540353 60540374 60540370 60540375 +
gtcaaatgacttctttgtgcaa

SEQ ID NO: 207408 - DNA, 22 bp, Artificial Sequence
  Synthetic oligonucleotide; TTG chr2 60540354 60540375 60540371 60540376 +
tcaaatgacttctttgtgcaat

SEQ ID NO: 207409 - DNA, 22 bp, Artificial Sequence
  Synthetic oligonucleotide; CTT chr2 60540365 60540386 60540382 60540387 +
ctttgtgcaataaagggtgtga

SEQ ID NO: 207410 - DNA, 22 bp, Artificial Sequence
  Synthetic oligonucleotide; TTC chr2 60540366 60540387 60540383 60540388 +
tttgtgcaataaagggtgtgaa

SEQ ID NO: 207411 - DNA, 22 bp, Artificial Sequence
  Synthetic oligonucleotide; CTT chr2 60540368 60540389 60540385 60540390 +
tgtgcaataaagggtgtgaaca

SEQ ID NO: 207412 - DNA, 22 bp, Artificial Sequence
  Synthetic oligonucleotide; TTT chr2 60540369 60540390 60540386 60540391 +
gtgcaataaagggtgtgaacag

SEQ ID NO: 207413 - DNA, 22 bp, Artificial Sequence
  Synthetic oligonucleotide; TTG chr2 60540370 60540391 60540387 60540392 +
tgcaataaagggtgtgaacaga

SEQ ID NO: 207414 - DNA, 22 bp, Artificial Sequence
  Synthetic oligonucleotide; TTA chr2 60540409 60540430 60540426 60540431 +
aattaacatccagtgacgcaat

SEQ ID NO: 207415 - DNA, 22 bp, Artificial Sequence
  Synthetic oligonucleotide; TTA chr2 60540414 60540435 60540431 60540436 +
acatccagtgacgcaatcttgg

SEQ ID NO: 207416 - DNA, 22 bp, Artificial Sequence
  Synthetic oligonucleotide; CTT chr2 60540434 60540455 60540451 60540456 +
ggtgcatctccctagctgtgct

SEQ ID NO: 207417 - DNA, 22 bp, Artificial Sequence
  Synthetic oligonucleotide; TTG chr2 60540435 60540456 60540452 60540457 +
gtgcatctccctagctgtgctt

SEQ ID NO: 207418 - DNA, 22 bp, Artificial Sequence
  Synthetic oligonucleotide; CTC chr2 60540444 60540465 60540461 60540466 +
cctagctgtgctttctacttcg

SEQ ID NO: 207419 - DNA, 22 bp, Artificial Sequence
  Synthetic oligonucleotide; CTA chr2 60540448 60540469 60540465 60540470 +
gctgtgctttctacttcggtta

SEQ ID NO: 207420 - DNA, 22 bp, Artificial Sequence
  Synthetic oligonucleotide; CTG chr2 60540452 60540473 60540469 60540474 +
tgctttctacttcggttaaatt

SEQ ID NO: 207421 - DNA, 22 bp, Artificial Sequence
  Synthetic oligonucleotide; CTT chr2 60540457 60540478 60540474 60540479 +
tctacttcggttaaatttaata

SEQ ID NO: 207422 - DNA, 22 bp, Artificial Sequence
  Synthetic oligonucleotide; TTT chr2 60540458 60540479 60540475 60540480 +
ctacttcggttaaatttaatat

SEQ ID NO: 207423 - DNA, 22 bp, Artificial Sequence
  Synthetic oligonucleotide; TTC chr2 60540459 60540480 60540476 60540481 +
tacttcggttaaatttaatatt

SEQ ID NO: 207424 - DNA, 22 bp, Artificial Sequence
  Synthetic oligonucleotide; CTA chr2 60540461 60540482 60540478 60540483 +
cttcggttaaatttaatatttc

SEQ ID NO: 207425 - DNA, 22 bp, Artificial Sequence
  Synthetic oligonucleotide; CTT chr2 60540464 60540485 60540481 60540486 +
cggttaaatttaatatttcccc

SEQ ID NO: 207426 - DNA, 22 bp, Artificial Sequence
  Synthetic oligonucleotide; TTC chr2 60540465 60540486 60540482 60540487 +
ggttaaatttaatatttccccc

SEQ ID NO: 207427 - DNA, 22 bp, Artificial Sequence
  Synthetic oligonucleotide; TTA chr2 60540470 60540491 60540487 60540492 +
aatttaatatttccccccaaag

SEQ ID NO: 207428 - DNA, 22 bp, Artificial Sequence
  Synthetic oligonucleotide; TTT chr2 60540475 60540496 60540492 60540497 +
aatatttccccccaaaggaaag

SEQ ID NO: 207429 - DNA, 22 bp, Artificial Sequence
  Synthetic oligonucleotide; TTA chr2 60540476 60540497 60540493 60540498 +
atatttccccccaaaggaaagc

SEQ ID NO: 207430 - DNA, 22 bp, Artificial Sequence
  Synthetic oligonucleotide; TTT chr2 60540482 60540503 60540499 60540504 +
ccccccaaaggaaagccaaaat

SEQ ID NO: 207431 - DNA, 22 bp, Artificial Sequence
  Synthetic oligonucleotide; TTC chr2 60540483 60540504 60540500 60540505 +
cccccaaaggaaagccaaaatt

SEQ ID NO: 207432 - DNA, 22 bp, Artificial Sequence
  Synthetic oligonucleotide; TTT chr2 60540506 60540527 60540523 60540528 +
gtttcctttcttactgaccagc

SEQ ID NO: 207433 - DNA, 22 bp, Artificial Sequence
  Synthetic oligonucleotide; TTG chr2 60540507 60540528 60540524 60540529 +
tttcctttcttactgaccagca

SEQ ID NO: 207434 - DNA, 22 bp, Artificial Sequence
  Synthetic oligonucleotide; TTT chr2 60540510 60540531 60540527 60540532 +
cctttcttactgaccagcacgc

SEQ ID NO: 207435 - DNA, 22 bp, Artificial Sequence
  Synthetic oligonucleotide; TTC chr2 60540511 60540532 60540528 60540533 +
ctttcttactgaccagcacgca

SEQ ID NO: 207436 - DNA, 22 bp, Artificial Sequence
  Synthetic oligonucleotide; CTT chr2 60540514 60540535 60540531 60540536 +
tcttactgaccagcacgcaaag

SEQ ID NO: 207437 - DNA, 22 bp, Artificial Sequence
  Synthetic oligonucleotide; TTT chr2 60540515 60540536 60540532 60540537 +
cttactgaccagcacgcaaagc

SEQ ID NO: 207438 - DNA, 22 bp, Artificial Sequence
  Synthetic oligonucleotide; TTC chr2 60540516 60540537 60540533 60540538 +
ttactgaccagcacgcaaagcc

SEQ ID NO: 207439 - DNA, 22 bp, Artificial Sequence
  Synthetic oligonucleotide; CTT chr2 60540518 60540539 60540535 60540540 +
actgaccagcacgcaaagccac

SEQ ID NO: 207440 - DNA, 22 bp, Artificial Sequence
  Synthetic oligonucleotide; TTA chr2 60540519 60540540 60540536 60540541 +
ctgaccagcacgcaaagccacc

SEQ ID NO: 207441 - DNA, 22 bp, Artificial Sequence
  Synthetic oligonucleotide; CTG chr2 60540522 60540543 60540539 60540544 +
accagcacgcaaagccaccatt

SEQ ID NO: 207442 - DNA, 22 bp, Artificial Sequence
  Synthetic oligonucleotide; TTC chr2 60540545 60540566 60540562 60540567 +
acctattctcctttattaaaca

SEQ ID NO: 207443 - DNA, 22 bp, Artificial Sequence
  Synthetic oligonucleotide; CTA chr2 60540550 60540571 60540567 60540572 +
ttctcctttattaaacattttc

SEQ ID NO: 207444 - DNA, 22 bp, Artificial Sequence
  Synthetic oligonucleotide; TTC chr2 60540553 60540574 60540570 60540575 +
tcctttattaaacattttcatt

SEQ ID NO: 207445 - DNA, 22 bp, Artificial Sequence
  Synthetic oligonucleotide; CTC chr2 60540555 60540576 60540572 60540577 +
ctttattaaacattttcattga

SEQ ID NO: 207446 - DNA, 22 bp, Artificial Sequence
  Synthetic oligonucleotide; CTT chr2 60540558 60540579 60540575 60540580 +
tattaaacattttcattgagaa

SEQ ID NO: 207447 - DNA, 22 bp, Artificial Sequence
  Synthetic oligonucleotide; TTT chr2 60540559 60540580 60540576 60540581 +
attaaacattttcattgagaaa

SEQ ID NO: 207448 - DNA, 22 bp, Artificial Sequence
  Synthetic oligonucleotide; TTA chr2 60540560 60540581 60540577 60540582 +
ttaaacattttcattgagaaat

SEQ ID NO: 207449 - DNA, 22 bp, Artificial Sequence
  Synthetic oligonucleotide; TTA chr2 60540563 60540584 60540580 60540585 +
aacattttcattgagaaatcac

SEQ ID NO: 207450 - DNA, 22 bp, Artificial Sequence
  Synthetic oligonucleotide; TTT chr2 60540570 60540591 60540587 60540592 +
tcattgagaaatcacaaaaatc

SEQ ID NO: 207451 - DNA, 22 bp, Artificial Sequence
  Synthetic oligonucleotide; TTT chr2 60540571 60540592 60540588 60540593 +
cattgagaaatcacaaaaatct

SEQ ID NO: 207452 - DNA, 22 bp, Artificial Sequence
  Synthetic oligonucleotide; TTC chr2 60540572 60540593 60540589 60540594 +
attgagaaatcacaaaaatcta

SEQ ID NO: 207453 - DNA, 22 bp, Artificial Sequence
  Synthetic oligonucleotide; TTG chr2 60540576 60540597 60540593 60540598 +
agaaatcacaaaaatctaaaaa

SEQ ID NO: 207454 - DNA, 22 bp, Artificial Sequence
  Synthetic oligonucleotide; CTA chr2 60540594 60540615 60540611 60540616 +
aaaaatgtttccctaggatttg

SEQ ID NO: 207455 - DNA, 22 bp, Artificial Sequence
  Synthetic oligonucleotide; TTT chr2 60540604 60540625 60540621 60540626 +
ccctaggatttgcatgtttttt

SEQ ID NO: 207456 - DNA, 22 bp, Artificial Sequence
  Synthetic oligonucleotide; TTC chr2 60540605 60540626 60540622 60540627 +
cctaggatttgcatgtttttta

SEQ ID NO: 207457 - DNA, 22 bp, Artificial Sequence
  Synthetic oligonucleotide; CTA chr2 60540609 60540630 60540626 60540631 +
ggatttgcatgttttttatgta

SEQ ID NO: 207458 - DNA, 22 bp, Artificial Sequence
  Synthetic oligonucleotide; TTT chr2 60540615 60540636 60540632 60540637 +
gcatgttttttatgtaccccaa

SEQ ID NO: 207459 - DNA, 22 bp, Artificial Sequence
  Synthetic oligonucleotide; TTG chr2 60540616 60540637 60540633 60540638 +
catgttttttatgtaccccaat

SEQ ID NO: 207460 - DNA, 22 bp, Artificial Sequence
  Synthetic oligonucleotide; TTT chr2 60540623 60540644 60540640 60540645 +
tttatgtaccccaatttagtac

SEQ ID NO: 207461 - DNA, 22 bp, Artificial Sequence
  Synthetic oligonucleotide; TTT chr2 60540624 60540645 60540641 60540646 +
ttatgtaccccaatttagtact

SEQ ID NO: 207462 - DNA, 22 bp, Artificial Sequence
  Synthetic oligonucleotide; TTT chr2 60540625 60540646 60540642 60540647 +
tatgtaccccaatttagtactc

SEQ ID NO: 207463 - DNA, 22 bp, Artificial Sequence
  Synthetic oligonucleotide; TTT chr2 60540626 60540647 60540643 60540648 +
atgtaccccaatttagtactcc

SEQ ID NO: 207464 - DNA, 22 bp, Artificial Sequence
  Synthetic oligonucleotide; TTA chr2 60540627 60540648 60540644 60540649 +
tgtaccccaatttagtactccc

SEQ ID NO: 207465 - DNA, 22 bp, Artificial Sequence
  Synthetic oligonucleotide; TTT chr2 60540640 60540661 60540657 60540662 +
agtactcccacattagccaaac

SEQ ID NO: 207466 - DNA, 22 bp, Artificial Sequence
  Synthetic oligonucleotide; TTA chr2 60540641 60540662 60540658 60540663 +
gtactcccacattagccaaact

SEQ ID NO: 207467 - DNA, 22 bp, Artificial Sequence
  Synthetic oligonucleotide; CTC chr2 60540647 60540668 60540664 60540669 +
ccacattagccaaactacatgg

SEQ ID NO: 207468 - DNA, 22 bp, Artificial Sequence
  Synthetic oligonucleotide; TTA chr2 60540655 60540676 60540672 60540677 +
gccaaactacatggaagctgca

SEQ ID NO: 207469 - DNA, 22 bp, Artificial Sequence
  Synthetic oligonucleotide; CTA chr2 60540664 60540685 60540681 60540686 +
catggaagctgcagtgtgaaat

SEQ ID NO: 207470 - DNA, 22 bp, Artificial Sequence
  Synthetic oligonucleotide; CTG chr2 60540675 60540696 60540692 60540697 +
cagtgtgaaattaatgattttc

SEQ ID NO: 207471 - DNA, 22 bp, Artificial Sequence
  Synthetic oligonucleotide; TTA chr2 60540688 60540709 60540705 60540710 +
atgattttccaggactctaaaa

SEQ ID NO: 207472 - DNA, 22 bp, Artificial Sequence
  Synthetic oligonucleotide; TTT chr2 60540695 60540716 60540712 60540717 +
tccaggactctaaaagatgcca

SEQ ID NO: 207473 - DNA, 22 bp, Artificial Sequence
  Synthetic oligonucleotide; TTT chr2 60540696 60540717 60540713 60540718 +
ccaggactctaaaagatgccat

SEQ ID NO: 207474 - DNA, 22 bp, Artificial Sequence
  Synthetic oligonucleotide; TTC chr2 60540697 60540718 60540714 60540719 +
caggactctaaaagatgccatt

SEQ ID NO: 207475 - DNA, 22 bp, Artificial Sequence
  Synthetic oligonucleotide; CTC chr2 60540705 60540726 60540722 60540727 +
taaaagatgccattaataagca

SEQ ID NO: 207476 - DNA, 22 bp, Artificial Sequence
  Synthetic oligonucleotide; CTA chr2 60540707 60540728 60540724 60540729 +
aaagatgccattaataagcatc

SEQ ID NO: 207477 - DNA, 22 bp, Artificial Sequence
  Synthetic oligonucleotide; TTA chr2 60540720 60540741 60540737 60540742 +
ataagcatccaactcgcctcct

SEQ ID NO: 207478 - DNA, 22 bp, Artificial Sequence
  Synthetic oligonucleotide; CTC chr2 60540735 60540756 60540752 60540757 +
gcctcctccctgagctgaaggt

SEQ ID NO: 207479 - DNA, 22 bp, Artificial Sequence
  Synthetic oligonucleotide; CTC chr2 60540740 60540761 60540757 60540762 +
ctccctgagctgaaggttgcct

SEQ ID NO: 207480 - DNA, 22 bp, Artificial Sequence
  Synthetic oligonucleotide; CTC chr2 60540743 60540764 60540760 60540765 +
cctgagctgaaggttgcctgtc

SEQ ID NO: 207481 - DNA, 22 bp, Artificial Sequence
  Synthetic oligonucleotide; CTG chr2 60540747 60540768 60540764 60540769 +
agctgaaggttgcctgtcctga

SEQ ID NO: 207482 - DNA, 22 bp, Artificial Sequence
  Synthetic oligonucleotide; CTG chr2 60540752 60540773 60540769 60540774 +
aaggttgcctgtcctgaccctg

SEQ ID NO: 207483 - DNA, 22 bp, Artificial Sequence
  Synthetic oligonucleotide; TTG chr2 60540759 60540780 60540776 60540781 +
cctgtcctgaccctgcctgcac

SEQ ID NO: 207484 - DNA, 22 bp, Artificial Sequence
  Synthetic oligonucleotide; CTG chr2 60540763 60540784 60540780 60540785 +
tcctgaccctgcctgcacgttt

SEQ ID NO: 207485 - DNA, 22 bp, Artificial Sequence
  Synthetic oligonucleotide; CTG chr2 60540768 60540789 60540785 60540790 +
accctgcctgcacgtttctaca

SEQ ID NO: 207486 - DNA, 22 bp, Artificial Sequence
  Synthetic oligonucleotide; CTG chr2 60540774 60540795 60540791 60540796 +
cctgcacgtttctacacccagt

SEQ ID NO: 207487 - DNA, 22 bp, Artificial Sequence
  Synthetic oligonucleotide; CTG chr2 60540778 60540799 60540795 60540800 +
cacgtttctacacccagttgca

SEQ ID NO: 207488 - DNA, 22 bp, Artificial Sequence
  Synthetic oligonucleotide; TTT chr2 60540785 60540806 60540802 60540807 +
ctacacccagttgcattttcca

SEQ ID NO: 207489 - DNA, 22 bp, Artificial Sequence
  Synthetic oligonucleotide; TTC chr2 60540786 60540807 60540803 60540808 +
tacacccagttgcattttccag

SEQ ID NO: 207490 - DNA, 22 bp, Artificial Sequence
  Synthetic oligonucleotide; CTA chr2 60540788 60540809 60540805 60540810 +
cacccagttgcattttccagcc

SEQ ID NO: 207491 - DNA, 22 bp, Artificial Sequence
  Synthetic oligonucleotide; TTG chr2 60540798 60540819 60540815 60540820 +
cattttccagcccatgtgcagc

SEQ ID NO: 207492 - DNA, 22 bp, Artificial Sequence
  Synthetic oligonucleotide; TTT chr2 60540803 60540824 60540820 60540825 +
tccagcccatgtgcagctccac

SEQ ID NO: 207493 - DNA, 22 bp, Artificial Sequence
  Synthetic oligonucleotide; TTT chr2 60540804 60540825 60540821 60540826 +
ccagcccatgtgcagctccaca

SEQ ID NO: 207494 - DNA, 22 bp, Artificial Sequence
  Synthetic oligonucleotide; TTC chr2 60540805 60540826 60540822 60540827 +
cagcccatgtgcagctccacaa

SEQ ID NO: 207495 - DNA, 22 bp, Artificial Sequence
  Synthetic oligonucleotide; CTC chr2 60540822 60540843 60540839 60540844 +
cacaattatatgccacattcac

SEQ ID NO: 207496 - DNA, 22 bp, Artificial Sequence
  Synthetic oligonucleotide; TTA chr2 60540830 60540851 60540847 60540852 +
tatgccacattcactaagagaa

SEQ ID NO: 207497 - DNA, 22 bp, Artificial Sequence
  Synthetic oligonucleotide; TTC chr2 60540842 60540863 60540859 60540864 +
actaagagaaaggtgtgcaaaa

SEQ ID NO: 207498 - DNA, 22 bp, Artificial Sequence
  Synthetic oligonucleotide; CTA chr2 60540846 60540867 60540863 60540868 +
agagaaaggtgtgcaaaacata

SEQ ID NO: 207499 - DNA, 22 bp, Artificial Sequence
  Synthetic oligonucleotide; TTT chr2 60540871 60540892 60540888 60540893 +
cagatcctttatagtaaaggca

SEQ ID NO: 207500 - DNA, 22 bp, Artificial Sequence
  Synthetic oligonucleotide; TTC chr2 60540872 60540893 60540889 60540894 +
agatcctttatagtaaaggcac

SEQ ID NO: 207501 - DNA, 22 bp, Artificial Sequence
  Synthetic oligonucleotide; CTT chr2 60540880 60540901 60540897 60540902 +
tatagtaaaggcacaacttgca

SEQ ID NO: 207502 - DNA, 22 bp, Artificial Sequence
  Synthetic oligonucleotide; TTT chr2 60540881 60540902 60540898 60540903 +
atagtaaaggcacaacttgcaa

SEQ ID NO: 207503 - DNA, 22 bp, Artificial Sequence
  Synthetic oligonucleotide; TTA chr2 60540882 60540903 60540899 60540904 +
tagtaaaggcacaacttgcaac

SEQ ID NO: 207504 - DNA, 22 bp, Artificial Sequence
  Synthetic oligonucleotide; CTT chr2 60540899 60540920 60540916 60540921 +
gcaacacaacaaggaatggggt

SEQ ID NO: 207505 - DNA, 22 bp, Artificial Sequence
  Synthetic oligonucleotide; TTG chr2 60540900 60540921 60540917 60540922 +
caacacaacaaggaatggggtg

SEQ ID NO: 207506 - DNA, 22 bp, Artificial Sequence
  Synthetic oligonucleotide; TTT chr2 60540926 60540947 60540943 60540948 +
aagaaattacagcactggtttt

SEQ ID NO: 207507 - DNA, 22 bp, Artificial Sequence
  Synthetic oligonucleotide; TTA chr2 60540927 60540948 60540944 60540949 +
agaaattacagcactggttttg

SEQ ID NO: 207508 - DNA, 22 bp, Artificial Sequence
  Synthetic oligonucleotide; TTA chr2 60540935 60540956 60540952 60540957 +
cagcactggttttgtgtgtgtg

SEQ ID NO: 207509 - DNA, 22 bp, Artificial Sequence
  Synthetic oligonucleotide; CTG chr2 60540943 60540964 60540960 60540965 +
gttttgtgtgtgtgtgtgtgtg

SEQ ID NO: 207510 - DNA, 22 bp, Artificial Sequence
  Synthetic oligonucleotide; TTT chr2 60540947 60540968 60540964 60540969 +
tgtgtgtgtgtgtgtgtgtgtg

SEQ ID NO: 207511 - DNA, 22 bp, Artificial Sequence
  Synthetic oligonucleotide; TTT chr2 60540948 60540969 60540965 60540970 +
gtgtgtgtgtgtgtgtgtgtgt

SEQ ID NO: 207512 - DNA, 22 bp, Artificial Sequence
  Synthetic oligonucleotide; TTG chr2 60540949 60540970 60540966 60540971 +
tgtgtgtgtgtgtgtgtgtgtg

SEQ ID NO: 207513 - DNA, 22 bp, Artificial Sequence
  Synthetic oligonucleotide; TTA chr2 60540997 60541018 60541014 60541019 +
ttttgtttttttgtttttttaa

SEQ ID NO: 207514 - DNA, 22 bp, Artificial Sequence
  Synthetic oligonucleotide; TTT chr2 60541000 60541021 60541017 60541022 +
tgtttttttgtttttttaagct

SEQ ID NO: 207515 - DNA, 22 bp, Artificial Sequence
  Synthetic oligonucleotide; TTT chr2 60541001 60541022 60541018 60541023 +
gtttttttgtttttttaagctt

SEQ ID NO: 207516 - DNA, 22 bp, Artificial Sequence
  Synthetic oligonucleotide; TTG chr2 60541002 60541023 60541019 60541024 +
tttttttgtttttttaagcttt

SEQ ID NO: 207517 - DNA, 22 bp, Artificial Sequence
  Synthetic oligonucleotide; TTT chr2 60541005 60541026 60541022 60541027 +
ttttgtttttttaagctttcac

SEQ ID NO: 207518 - DNA, 22 bp, Artificial Sequence
  Synthetic oligonucleotide; TTT chr2 60541006 60541027 60541023 60541028 +
tttgtttttttaagctttcaca

SEQ ID NO: 207519 - DNA, 22 bp, Artificial Sequence
  Synthetic oligonucleotide; TTT chr2 60541007 60541028 60541024 60541029 +
ttgtttttttaagctttcacag

SEQ ID NO: 207520 - DNA, 22 bp, Artificial Sequence
  Synthetic oligonucleotide; TTT chr2 60541008 60541029 60541025 60541030 +
tgtttttttaagctttcacaga

SEQ ID NO: 207521 - DNA, 22 bp, Artificial Sequence
  Synthetic oligonucleotide; TTT chr2 60541009 60541030 60541026 60541031 +
gtttttttaagctttcacagaa

SEQ ID NO: 207522 - DNA, 22 bp, Artificial Sequence
  Synthetic oligonucleotide; TTG chr2 60541010 60541031 60541027 60541032 +
tttttttaagctttcacagaat

SEQ ID NO: 207523 - DNA, 22 bp, Artificial Sequence
  Synthetic oligonucleotide; TTT chr2 60541013 60541034 60541030 60541035 +
ttttaagctttcacagaataaa

SEQ ID NO: 207524 - DNA, 22 bp, Artificial Sequence
  Synthetic oligonucleotide; TTT chr2 60541014 60541035 60541031 60541036 +
tttaagctttcacagaataaac

SEQ ID NO: 207525 - DNA, 22 bp, Artificial Sequence
  Synthetic oligonucleotide; TTT chr2 60541015 60541036 60541032 60541037 +
ttaagctttcacagaataaaca

SEQ ID NO: 207526 - DNA, 22 bp, Artificial Sequence
  Synthetic oligonucleotide; TTT chr2 60541016 60541037 60541033 60541038 +
taagctttcacagaataaacac

SEQ ID NO: 207527 - DNA, 22 bp, Artificial Sequence
  Synthetic oligonucleotide; TTT chr2 60541017 60541038 60541034 60541039 +
aagctttcacagaataaacaca

SEQ ID NO: 207528 - DNA, 22 bp, Artificial Sequence
  Synthetic oligonucleotide; TTA chr2 60541018 60541039 60541035 60541040 +
agctttcacagaataaacacag

SEQ ID NO: 207529 - DNA, 22 bp, Artificial Sequence
  Synthetic oligonucleotide; CTT chr2 60541023 60541044 60541040 60541045 +
tcacagaataaacacagagaac

SEQ ID NO: 207530 - DNA, 22 bp, Artificial Sequence
  Synthetic oligonucleotide; TTT chr2 60541024 60541045 60541041 60541046 +
cacagaataaacacagagaacg

SEQ ID NO: 207531 - DNA, 22 bp, Artificial Sequence
  Synthetic oligonucleotide; TTC chr2 60541025 60541046 60541042 60541047 +
acagaataaacacagagaacgg

SEQ ID NO: 207532 - DNA, 22 bp, Artificial Sequence
  Synthetic oligonucleotide; CTT chr2 60541058 60541079 60541075 60541080 +
tgtccccctctgctcctgttct

SEQ ID NO: 207533 - DNA, 22 bp, Artificial Sequence
  Synthetic oligonucleotide; TTT chr2 60541059 60541080 60541076 60541081 +
gtccccctctgctcctgttctt

SEQ ID NO: 207534 - DNA, 22 bp, Artificial Sequence
  Synthetic oligonucleotide; TTG chr2 60541060 60541081 60541077 60541082 +
tccccctctgctcctgttcttg

SEQ ID NO: 207535 - DNA, 22 bp, Artificial Sequence
  Synthetic oligonucleotide; CTC chr2 60541068 60541089 60541085 60541090 +
tgctcctgttcttgaagtgaat

SEQ ID NO: 207536 - DNA, 22 bp, Artificial Sequence
  Synthetic oligonucleotide; CTG chr2 60541070 60541091 60541087 60541092 +
ctcctgttcttgaagtgaatac

SEQ ID NO: 207537 - DNA, 22 bp, Artificial Sequence
  Synthetic oligonucleotide; CTC chr2 60541073 60541094 60541090 60541095 +
ctgttcttgaagtgaatacata

SEQ ID NO: 207538 - DNA, 22 bp, Artificial Sequence
  Synthetic oligonucleotide; CTG chr2 60541076 60541097 60541093 60541098 +
ttcttgaagtgaatacatattt

SEQ ID NO: 207539 - DNA, 22 bp, Artificial Sequence
  Synthetic oligonucleotide; TTC chr2 60541079 60541100 60541096 60541101 +
ttgaagtgaatacatatttgtg

SEQ ID NO: 207540 - DNA, 22 bp, Artificial Sequence
  Synthetic oligonucleotide; CTT chr2 60541081 60541102 60541098 60541103 +
gaagtgaatacatatttgtgtt

SEQ ID NO: 207541 - DNA, 22 bp, Artificial Sequence
  Synthetic oligonucleotide; TTG chr2 60541082 60541103 60541099 60541104 +
aagtgaatacatatttgtgttt

SEQ ID NO: 207542 - DNA, 22 bp, Artificial Sequence
  Synthetic oligonucleotide; TTT chr2 60541098 60541119 60541115 60541120 +
gtgtttccaataaaaggccatt

SEQ ID NO: 207543 - DNA, 22 bp, Artificial Sequence
  Synthetic oligonucleotide; TTG chr2 60541099 60541120 60541116 60541121 +
tgtttccaataaaaggccattt

SEQ ID NO: 207544 - DNA, 22 bp, Artificial Sequence
  Synthetic oligonucleotide; TTT chr2 60541104 60541125 60541121 60541126 +
ccaataaaaggccatttttaca

SEQ ID NO: 207545 - DNA, 22 bp, Artificial Sequence
  Synthetic oligonucleotide; TTC chr2 60541105 60541126 60541122 60541127 +
caataaaaggccatttttacat

SEQ ID NO: 207546 - DNA, 22 bp, Artificial Sequence
  Synthetic oligonucleotide; TTT chr2 60541121 60541142 60541138 60541143 +
ttacattaactgtctgtaacag

SEQ ID NO: 207547 - DNA, 22 bp, Artificial Sequence
  Synthetic oligonucleotide; TTT chr2 60541122 60541143 60541139 60541144 +
tacattaactgtctgtaacagc

SEQ ID NO: 207548 - DNA, 22 bp, Artificial Sequence
  Synthetic oligonucleotide; TTT chr2 60541123 60541144 60541140 60541145 +
acattaactgtctgtaacagca

SEQ ID NO: 207549 - DNA, 22 bp, Artificial Sequence
  Synthetic oligonucleotide; TTA chr2 60541124 60541145 60541141 60541146 +
cattaactgtctgtaacagcag

SEQ ID NO: 207550 - DNA, 22 bp, Artificial Sequence
  Synthetic oligonucleotide; TTA chr2 60541129 60541150 60541146 60541151 +
actgtctgtaacagcaggagac

SEQ ID NO: 207551 - DNA, 22 bp, Artificial Sequence
  Synthetic oligonucleotide; CTG chr2 60541133 60541154 60541150 60541155 +
tctgtaacagcaggagacagaa

SEQ ID NO: 207552 - DNA, 22 bp, Artificial Sequence
  Synthetic oligonucleotide; CTG chr2 60541137 60541158 60541154 60541159 +
taacagcaggagacagaaaaac

SEQ ID NO: 207553 - DNA, 22 bp, Artificial Sequence
  Synthetic oligonucleotide; CTA chr2 60541161 60541182 60541178 60541183 +
acacaatctccacatcacacac

SEQ ID NO: 207554 - DNA, 22 bp, Artificial Sequence
  Synthetic oligonucleotide; CTC chr2 60541171 60541192 60541188 60541193 +
cacatcacacacaggatgatct

SEQ ID NO: 207555 - DNA, 22 bp, Artificial Sequence
  Synthetic oligonucleotide; CTT chr2 60541194 60541215 60541211 60541216 +
catatcacgtggacctattctc

SEQ ID NO: 207556 - DNA, 22 bp, Artificial Sequence
  Synthetic oligonucleotide; TTC chr2 60541195 60541216 60541212 60541217 +
atatcacgtggacctattctca

SEQ ID NO: 207557 - DNA, 22 bp, Artificial Sequence
  Synthetic oligonucleotide; CTA chr2 60541211 60541232 60541228 60541233 +
ttctcaaaacattatttataaa

SEQ ID NO: 207558 - DNA, 22 bp, Artificial Sequence
  Synthetic oligonucleotide; TTC chr2 60541214 60541235 60541231 60541236 +
tcaaaacattatttataaaaga

SEQ ID NO: 207559 - DNA, 22 bp, Artificial Sequence
  Synthetic oligonucleotide; CTC chr2 60541216 60541237 60541233 60541238 +
aaaacattatttataaaagatg

SEQ ID NO: 207560 - DNA, 22 bp, Artificial Sequence
  Synthetic oligonucleotide; TTA chr2 60541225 60541246 60541242 60541247 +
tttataaaagatgactaggaaa

SEQ ID NO: 207561 - DNA, 22 bp, Artificial Sequence
  Synthetic oligonucleotide; TTT chr2 60541228 60541249 60541245 60541250 +
ataaaagatgactaggaaaatg

SEQ ID NO: 207562 - DNA, 22 bp, Artificial Sequence
  Synthetic oligonucleotide; TTA chr2 60541229 60541250 60541246 60541251 +
taaaagatgactaggaaaatgc

SEQ ID NO: 207563 - DNA, 22 bp, Artificial Sequence
  Synthetic oligonucleotide; CTA chr2 60541242 60541263 60541259 60541264 +
ggaaaatgcacaatgcatcttt

SEQ ID NO: 207564 - DNA, 22 bp, Artificial Sequence
  Synthetic oligonucleotide; CTT chr2 60541263 60541284 60541280 60541285 +
ttctgtgtcaccacaagggtaa

SEQ ID NO: 207565 - DNA, 22 bp, Artificial Sequence
  Synthetic oligonucleotide; TTT chr2 60541264 60541285 60541281 60541286 +
tctgtgtcaccacaagggtaat

SEQ ID NO: 207566 - DNA, 22 bp, Artificial Sequence
  Synthetic oligonucleotide; TTT chr2 60541265 60541286 60541282 60541287 +
ctgtgtcaccacaagggtaatg

SEQ ID NO: 207567 - DNA, 22 bp, Artificial Sequence
  Synthetic oligonucleotide; TTC chr2 60541266 60541287 60541283 60541288 +
tgtgtcaccacaagggtaatgt

SEQ ID NO: 207568 - DNA, 22 bp, Artificial Sequence
  Synthetic oligonucleotide; CTG chr2 60541268 60541289 60541285 60541290 +
tgtcaccacaagggtaatgtct

SEQ ID NO: 207569 - DNA, 22 bp, Artificial Sequence
  Synthetic oligonucleotide; CTG chr2 60541291 60541312 60541308 60541313 +
aagaagtttgggatctttagga

SEQ ID NO: 207570 - DNA, 22 bp, Artificial Sequence
  Synthetic oligonucleotide; TTT chr2 60541300 60541321 60541317 60541322 +
gggatctttaggatcttctaca

SEQ ID NO: 207571 - DNA, 22 bp, Artificial Sequence
  Synthetic oligonucleotide; TTG chr2 60541301 60541322 60541318 60541323 +
ggatctttaggatcttctacat

SEQ ID NO: 207572 - DNA, 22 bp, Artificial Sequence
  Synthetic oligonucleotide; CTT chr2 60541308 60541329 60541325 60541330 +
taggatcttctacattttagat

SEQ ID NO: 207573 - DNA, 22 bp, Artificial Sequence
  Synthetic oligonucleotide; TTT chr2 60541309 60541330 60541326 60541331 +
aggatcttctacattttagata

SEQ ID NO: 207574 - DNA, 22 bp, Artificial Sequence
  Synthetic oligonucleotide; TTA chr2 60541310 60541331 60541327 60541332 +
ggatcttctacattttagatat

SEQ ID NO: 207575 - DNA, 22 bp, Artificial Sequence
  Synthetic oligonucleotide; CTT chr2 60541317 60541338 60541334 60541339 +
ctacattttagatatatttttt

SEQ ID NO: 207576 - DNA, 22 bp, Artificial Sequence
  Synthetic oligonucleotide; TTC chr2 60541318 60541339 60541335 60541340 +
tacattttagatatattttttt

SEQ ID NO: 207577 - DNA, 22 bp, Artificial Sequence
  Synthetic oligonucleotide; CTA chr2 60541320 60541341 60541337 60541342 +
cattttagatatattttttttt

SEQ ID NO: 207578 - DNA, 22 bp, Artificial Sequence
  Synthetic oligonucleotide; TTT chr2 60541325 60541346 60541342 60541347 +
tagatatattttttttttcctt

SEQ ID NO: 207579 - DNA, 22 bp, Artificial Sequence
  Synthetic oligonucleotide; TTT chr2 60541326 60541347 60541343 60541348 +
agatatattttttttttccttt

SEQ ID NO: 207580 - DNA, 22 bp, Artificial Sequence
  Synthetic oligonucleotide; TTA chr2 60541327 60541348 60541344 60541349 +
gatatattttttttttcctttt

SEQ ID NO: 207581 - DNA, 22 bp, Artificial Sequence
  Synthetic oligonucleotide; TTT chr2 60541336 60541357 60541353 60541358 +
tttttttccttttggctttcct

SEQ ID NO: 207582 - DNA, 22 bp, Artificial Sequence
  Synthetic oligonucleotide; TTT chr2 60541337 60541358 60541354 60541359 +
ttttttccttttggctttcctt

SEQ ID NO: 207583 - DNA, 22 bp, Artificial Sequence
  Synthetic oligonucleotide; TTT chr2 60541338 60541359 60541355 60541360 +
tttttccttttggctttcctta

SEQ ID NO: 207584 - DNA, 22 bp, Artificial Sequence
  Synthetic oligonucleotide; TTT chr2 60541339 60541360 60541356 60541361 +
ttttccttttggctttccttag

SEQ ID NO: 207585 - DNA, 22 bp, Artificial Sequence
  Synthetic oligonucleotide; TTT chr2 60541340 60541361 60541357 60541362 +
tttccttttggctttccttagt

SEQ ID NO: 207586 - DNA, 22 bp, Artificial Sequence
  Synthetic oligonucleotide; TTT chr2 60541341 60541362 60541358 60541363 +
ttccttttggctttccttagta

SEQ ID NO: 207587 - DNA, 22 bp, Artificial Sequence
  Synthetic oligonucleotide; TTT chr2 60541342 60541363 60541359 60541364 +
tccttttggctttccttagtaa

SEQ ID NO: 207588 - DNA, 22 bp, Artificial Sequence
  Synthetic oligonucleotide; TTT chr2 60541343 60541364 60541360 60541365 +
ccttttggctttccttagtaag

SEQ ID NO: 207589 - DNA, 22 bp, Artificial Sequence
  Synthetic oligonucleotide; TTC chr2 60541344 60541365 60541361 60541366 +
cttttggctttccttagtaagt

SEQ ID NO: 207590 - DNA, 22 bp, Artificial Sequence
  Synthetic oligonucleotide; CTT chr2 60541347 60541368 60541364 60541369 +
ttggctttccttagtaagttta

SEQ ID NO: 207591 - DNA, 22 bp, Artificial Sequence
  Synthetic oligonucleotide; TTT chr2 60541348 60541369 60541365 60541370 +
tggctttccttagtaagtttag

SEQ ID NO: 207592 - DNA, 22 bp, Artificial Sequence
  Synthetic oligonucleotide; TTT chr2 60541349 60541370 60541366 60541371 +
ggctttccttagtaagtttagc

SEQ ID NO: 207593 - DNA, 22 bp, Artificial Sequence
  Synthetic oligonucleotide; TTG chr2 60541350 60541371 60541367 60541372 +
gctttccttagtaagtttagca

SEQ ID NO: 207594 - DNA, 22 bp, Artificial Sequence
  Synthetic oligonucleotide; CTT chr2 60541354 60541375 60541371 60541376 +
tccttagtaagtttagcagcca

SEQ ID NO: 207595 - DNA, 22 bp, Artificial Sequence
  Synthetic oligonucleotide; TTT chr2 60541355 60541376 60541372 60541377 +
ccttagtaagtttagcagccat

SEQ ID NO: 207596 - DNA, 22 bp, Artificial Sequence
  Synthetic oligonucleotide; TTC chr2 60541356 60541377 60541373 60541378 +
cttagtaagtttagcagccatg

SEQ ID NO: 207597 - DNA, 22 bp, Artificial Sequence
  Synthetic oligonucleotide; CTT chr2 60541359 60541380 60541376 60541381 +
agtaagtttagcagccatgcgg

SEQ ID NO: 207598 - DNA, 22 bp, Artificial Sequence
  Synthetic oligonucleotide; TTA chr2 60541360 60541381 60541377 60541382 +
gtaagtttagcagccatgcggg

SEQ ID NO: 207599 - DNA, 22 bp, Artificial Sequence
  Synthetic oligonucleotide; TTT chr2 60541368 60541389 60541385 60541390 +
agcagccatgcgggccactgtg

SEQ ID NO: 207600 - DNA, 22 bp, Artificial Sequence
  Synthetic oligonucleotide; TTA chr2 60541369 60541390 60541386 60541391 +
gcagccatgcgggccactgtgt

SEQ ID NO: 207601 - DNA, 22 bp, Artificial Sequence
  Synthetic oligonucleotide; CTG chr2 60541388 60541409 60541405 60541410 +
tgtttaattaagctttcaaaag

SEQ ID NO: 207602 - DNA, 22 bp, Artificial Sequence
  Synthetic oligonucleotide; TTT chr2 60541393 60541414 60541410 60541415 +
aattaagctttcaaaagtcctg

SEQ ID NO: 207603 - DNA, 22 bp, Artificial Sequence
  Synthetic oligonucleotide; TTA chr2 60541394 60541415 60541411 60541416 +
attaagctttcaaaagtcctga

SEQ ID NO: 207604 - DNA, 22 bp, Artificial Sequence
  Synthetic oligonucleotide; TTA chr2 60541398 60541419 60541415 60541420 +
agctttcaaaagtcctgacaat

SEQ ID NO: 207605 - DNA, 22 bp, Artificial Sequence
  Synthetic oligonucleotide; CTT chr2 60541403 60541424 60541420 60541425 +
tcaaaagtcctgacaatgccaa

SEQ ID NO: 207606 - DNA, 22 bp, Artificial Sequence
  Synthetic oligonucleotide; TTT chr2 60541404 60541425 60541421 60541426 +
caaaagtcctgacaatgccaac

SEQ ID NO: 207607 - DNA, 22 bp, Artificial Sequence
  Synthetic oligonucleotide; TTC chr2 60541405 60541426 60541422 60541427 +
aaaagtcctgacaatgccaaca

SEQ ID NO: 207608 - DNA, 22 bp, Artificial Sequence
  Synthetic oligonucleotide; CTG chr2 60541415 60541436 60541432 60541437 +
acaatgccaacaattgtaggac

SEQ ID NO: 207609 - DNA, 22 bp, Artificial Sequence
  Synthetic oligonucleotide; TTG chr2 60541431 60541452 60541448 60541453 +
taggacacttctgcggctcaat

SEQ ID NO: 207610 - DNA, 22 bp, Artificial Sequence
  Synthetic oligonucleotide; CTT chr2 60541441 60541462 60541458 60541463 +
ctgcggctcaatcatgcaatca

SEQ ID NO: 207611 - DNA, 22 bp, Artificial Sequence
  Synthetic oligonucleotide; TTC chr2 60541442 60541463 60541459 60541464 +
tgcggctcaatcatgcaatcac

SEQ ID NO: 207612 - DNA, 22 bp, Artificial Sequence
  Synthetic oligonucleotide; CTG chr2 60541444 60541465 60541461 60541466 +
cggctcaatcatgcaatcactg

SEQ ID NO: 207613 - DNA, 22 bp, Artificial Sequence
  Synthetic oligonucleotide; CTC chr2 60541450 60541471 60541467 60541472 +
aatcatgcaatcactgtgacag

SEQ ID NO: 207614 - DNA, 22 bp, Artificial Sequence
  Synthetic oligonucleotide; CTG chr2 60541466 60541487 60541483 60541488 +
tgacagttctatttacaatttg

SEQ ID NO: 207615 - DNA, 22 bp, Artificial Sequence
  Synthetic oligonucleotide; TTC chr2 60541475 60541496 60541492 60541497 +
tatttacaatttgtcttagaaa

SEQ ID NO: 207616 - DNA, 22 bp, Artificial Sequence
  Synthetic oligonucleotide; CTA chr2 60541477 60541498 60541494 60541499 +
tttacaatttgtcttagaaaga

SEQ ID NO: 207617 - DNA, 22 bp, Artificial Sequence
  Synthetic oligonucleotide; TTT chr2 60541480 60541501 60541497 60541502 +
acaatttgtcttagaaagagtt

SEQ ID NO: 207618 - DNA, 22 bp, Artificial Sequence
  Synthetic oligonucleotide; TTA chr2 60541481 60541502 60541498 60541503 +
caatttgtcttagaaagagttt

SEQ ID NO: 207619 - DNA, 22 bp, Artificial Sequence
  Synthetic oligonucleotide; TTT chr2 60541487 60541508 60541504 60541509 +
gtcttagaaagagtttctctga

SEQ ID NO: 207620 - DNA, 22 bp, Artificial Sequence
  Synthetic oligonucleotide; TTG chr2 60541488 60541509 60541505 60541510 +
tcttagaaagagtttctctgac

SEQ ID NO: 207621 - DNA, 22 bp, Artificial Sequence
  Synthetic oligonucleotide; CTT chr2 60541492 60541513 60541509 60541514 +
agaaagagtttctctgacattg

SEQ ID NO: 207622 - DNA, 22 bp, Artificial Sequence
  Synthetic oligonucleotide; TTA chr2 60541493 60541514 60541510 60541515 +
gaaagagtttctctgacattgt

SEQ ID NO: 207623 - DNA, 22 bp, Artificial Sequence
  Synthetic oligonucleotide; TTT chr2 60541503 60541524 60541520 60541525 +
ctctgacattgtactttgacaa

SEQ ID NO: 207624 - DNA, 22 bp, Artificial Sequence
  Synthetic oligonucleotide; TTC chr2 60541504 60541525 60541521 60541526 +
tctgacattgtactttgacaaa

SEQ ID NO: 207625 - DNA, 22 bp, Artificial Sequence
  Synthetic oligonucleotide; CTC chr2 60541506 60541527 60541523 60541528 +
tgacattgtactttgacaaaac

SEQ ID NO: 207626 - DNA, 22 bp, Artificial Sequence
  Synthetic oligonucleotide; CTG chr2 60541508 60541529 60541525 60541530 +
acattgtactttgacaaaacat

SEQ ID NO: 207627 - DNA, 22 bp, Artificial Sequence
  Synthetic oligonucleotide; TTG chr2 60541514 60541535 60541531 60541536 +
tactttgacaaaacatccaagc

SEQ ID NO: 207628 - DNA, 22 bp, Artificial Sequence
  Synthetic oligonucleotide; CTT chr2 60541519 60541540 60541536 60541541 +
tgacaaaacatccaagctgcca

SEQ ID NO: 207629 - DNA, 22 bp, Artificial Sequence
  Synthetic oligonucleotide; TTT chr2 60541520 60541541 60541537 60541542 +
gacaaaacatccaagctgccag

SEQ ID NO: 207630 - DNA, 22 bp, Artificial Sequence
  Synthetic oligonucleotide; TTG chr2 60541521 60541542 60541538 60541543 +
acaaaacatccaagctgccagt

SEQ ID NO: 207631 - DNA, 22 bp, Artificial Sequence
  Synthetic oligonucleotide; CTG chr2 60541538 60541559 60541555 60541560 +
ccagttcacaacctttctctgt

SEQ ID NO: 207632 - DNA, 22 bp, Artificial Sequence
  Synthetic oligonucleotide; TTC chr2 60541545 60541566 60541562 60541567 +
acaacctttctctgtcttattt

SEQ ID NO: 207633 - DNA, 22 bp, Artificial Sequence
  Synthetic oligonucleotide; CTT chr2 60541553 60541574 60541570 60541575 +
tctctgtcttatttacaaatac

SEQ ID NO: 207634 - DNA, 22 bp, Artificial Sequence
  Synthetic oligonucleotide; TTT chr2 60541554 60541575 60541571 60541576 +
ctctgtcttatttacaaataca

SEQ ID NO: 207635 - DNA, 22 bp, Artificial Sequence
  Synthetic oligonucleotide; TTC chr2 60541555 60541576 60541572 60541577 +
tctgtcttatttacaaatacag

SEQ ID NO: 207636 - DNA, 22 bp, Artificial Sequence
  Synthetic oligonucleotide; CTC chr2 60541557 60541578 60541574 60541579 +
tgtcttatttacaaatacagct

SEQ ID NO: 207637 - DNA, 22 bp, Artificial Sequence
  Synthetic oligonucleotide; CTG chr2 60541559 60541580 60541576 60541581 +
tcttatttacaaatacagcttg

SEQ ID NO: 207638 - DNA, 22 bp, Artificial Sequence
  Synthetic oligonucleotide; CTT chr2 60541563 60541584 60541580 60541585 +
atttacaaatacagcttgtata

SEQ ID NO: 207639 - DNA, 22 bp, Artificial Sequence
  Synthetic oligonucleotide; TTA chr2 60541564 60541585 60541581 60541586 +
tttacaaatacagcttgtatat

SEQ ID NO: 207640 - DNA, 22 bp, Artificial Sequence
  Synthetic oligonucleotide; TTT chr2 60541567 60541588 60541584 60541589 +
acaaatacagcttgtatatagg

SEQ ID NO: 207641 - DNA, 22 bp, Artificial Sequence
  Synthetic oligonucleotide; TTA chr2 60541568 60541589 60541585 60541590 +
caaatacagcttgtatatagga

SEQ ID NO: 207642 - DNA, 22 bp, Artificial Sequence
  Synthetic oligonucleotide; CTT chr2 60541580 60541601 60541597 60541602 +
gtatataggactcccagtttca

SEQ ID NO: 207643 - DNA, 22 bp, Artificial Sequence
  Synthetic oligonucleotide; TTG chr2 60541581 60541602 60541598 60541603 +
tatataggactcccagtttcat

SEQ ID NO: 207644 - DNA, 22 bp, Artificial Sequence
  Synthetic oligonucleotide; CTC chr2 60541593 60541614 60541610 60541615 +
ccagtttcatgaacattagtct

SEQ ID NO: 207645 - DNA, 22 bp, Artificial Sequence
  Synthetic oligonucleotide; TTT chr2 60541600 60541621 60541617 60541622 +
catgaacattagtctttggata

SEQ ID NO: 207646 - DNA, 22 bp, Artificial Sequence
  Synthetic oligonucleotide; TTC chr2 60541601 60541622 60541618 60541623 +
atgaacattagtctttggatag

SEQ ID NO: 207647 - DNA, 22 bp, Artificial Sequence
  Synthetic oligonucleotide; TTA chr2 60541611 60541632 60541628 60541633 +
gtctttggatagtggcctcaca

SEQ ID NO: 207648 - DNA, 22 bp, Artificial Sequence
  Synthetic oligonucleotide; CTT chr2 60541616 60541637 60541633 60541638 +
tggatagtggcctcacaaacat

SEQ ID NO: 207649 - DNA, 22 bp, Artificial Sequence
  Synthetic oligonucleotide; TTT chr2 60541617 60541638 60541634 60541639 +
ggatagtggcctcacaaacata

SEQ ID NO: 207650 - DNA, 22 bp, Artificial Sequence
  Synthetic oligonucleotide; TTG chr2 60541618 60541639 60541635 60541640 +
gatagtggcctcacaaacatag

SEQ ID NO: 207651 - DNA, 22 bp, Artificial Sequence
  Synthetic oligonucleotide; CTC chr2 60541630 60541651 60541647 60541652 +
acaaacataggctccctatgaa

SEQ ID NO: 207652 - DNA, 22 bp, Artificial Sequence
  Synthetic oligonucleotide; CTC chr2 60541644 60541665 60541661 60541666 +
cctatgaaaatcctaggtactt

SEQ ID NO: 207653 - DNA, 22 bp, Artificial Sequence
  Synthetic oligonucleotide; CTA chr2 60541648 60541669 60541665 60541670 +
tgaaaatcctaggtacttatta

SEQ ID NO: 207654 - DNA, 22 bp, Artificial Sequence
  Synthetic oligonucleotide; CTA chr2 60541659 60541680 60541676 60541681 +
ggtacttattagaaaacaatat

SEQ ID NO: 207655 - DNA, 22 bp, Artificial Sequence
  Synthetic oligonucleotide; CTT chr2 60541666 60541687 60541683 60541688 +
attagaaaacaatattctctac

SEQ ID NO: 207656 - DNA, 22 bp, Artificial Sequence
  Synthetic oligonucleotide; TTA chr2 60541667 60541688 60541684 60541689 +
ttagaaaacaatattctctact

SEQ ID NO: 207657 - DNA, 22 bp, Artificial Sequence
  Synthetic oligonucleotide; TTA chr2 60541670 60541691 60541687 60541692 +
gaaaacaatattctctactctc

SEQ ID NO: 207658 - DNA, 22 bp, Artificial Sequence
  Synthetic oligonucleotide; TTC chr2 60541683 60541704 60541700 60541705 +
tctactctctggattttgaagg

SEQ ID NO: 207659 - DNA, 22 bp, Artificial Sequence
  Synthetic oligonucleotide; CTC chr2 60541685 60541706 60541702 60541707 +
tactctctggattttgaaggta

SEQ ID NO: 207660 - DNA, 22 bp, Artificial Sequence
  Synthetic oligonucleotide; CTA chr2 60541687 60541708 60541704 60541709 +
ctctctggattttgaaggtaag

SEQ ID NO: 207661 - DNA, 22 bp, Artificial Sequence
  Synthetic oligonucleotide; CTC chr2 60541690 60541711 60541707 60541712 +
tctggattttgaaggtaagtaa

SEQ ID NO: 207662 - DNA, 22 bp, Artificial Sequence
  Synthetic oligonucleotide; CTC chr2 60541692 60541713 60541709 60541714 +
tggattttgaaggtaagtaaaa

SEQ ID NO: 207663 - DNA, 22 bp, Artificial Sequence
  Synthetic oligonucleotide; CTG chr2 60541694 60541715 60541711 60541716 +
gattttgaaggtaagtaaaatg

SEQ ID NO: 207664 - DNA, 22 bp, Artificial Sequence
  Synthetic oligonucleotide; TTT chr2 60541699 60541720 60541716 60541721 +
tgaaggtaagtaaaatgttcac

SEQ ID NO: 207665 - DNA, 22 bp, Artificial Sequence
  Synthetic oligonucleotide; TTT chr2 60541700 60541721 60541717 60541722 +
gaaggtaagtaaaatgttcacc

SEQ ID NO: 207666 - DNA, 22 bp, Artificial Sequence
  Synthetic oligonucleotide; TTG chr2 60541701 60541722 60541718 60541723 +
aaggtaagtaaaatgttcacca

SEQ ID NO: 207667 - DNA, 22 bp, Artificial Sequence
  Synthetic oligonucleotide; TTC chr2 60541719 60541740 60541736 60541741 +
accagtatattgttttttgtgg

SEQ ID NO: 207668 - DNA, 22 bp, Artificial Sequence
  Synthetic oligonucleotide; TTG chr2 60541731 60541752 60541748 60541753 +
ttttttgtggtagtggtgtttt

SEQ ID NO: 207669 - DNA, 22 bp, Artificial Sequence
  Synthetic oligonucleotide; TTT chr2 60541734 60541755 60541751 60541756 +
tttgtggtagtggtgttttttt

SEQ ID NO: 207670 - DNA, 22 bp, Artificial Sequence
  Synthetic oligonucleotide; TTT chr2 60541735 60541756 60541752 60541757 +
ttgtggtagtggtgtttttttg

SEQ ID NO: 207671 - DNA, 22 bp, Artificial Sequence
  Synthetic oligonucleotide; TTT chr2 60541736 60541757 60541753 60541758 +
tgtggtagtggtgtttttttgt

SEQ ID NO: 207672 - DNA, 22 bp, Artificial Sequence
  Synthetic oligonucleotide; TTT chr2 60541737 60541758 60541754 60541759 +
gtggtagtggtgtttttttgtt

SEQ ID NO: 207673 - DNA, 22 bp, Artificial Sequence
  Synthetic oligonucleotide; TTG chr2 60541738 60541759 60541755 60541760 +
tggtagtggtgtttttttgttt

SEQ ID NO: 207674 - DNA, 22 bp, Artificial Sequence
  Synthetic oligonucleotide; TTT chr2 60541752 60541773 60541769 60541774 +
ttttgttttaactgccatgctg

SEQ ID NO: 207675 - DNA, 22 bp, Artificial Sequence
  Synthetic oligonucleotide; TTT chr2 60541753 60541774 60541770 60541775 +
tttgttttaactgccatgctga

SEQ ID NO: 207676 - DNA, 22 bp, Artificial Sequence
  Synthetic oligonucleotide; TTT chr2 60541754 60541775 60541771 60541776 +
ttgttttaactgccatgctgaa

SEQ ID NO: 207677 - DNA, 22 bp, Artificial Sequence
  Synthetic oligonucleotide; TTT chr2 60541755 60541776 60541772 60541777 +
tgttttaactgccatgctgaaa

SEQ ID NO: 207678 - DNA, 22 bp, Artificial Sequence
  Synthetic oligonucleotide; TTT chr2 60541756 60541777 60541773 60541778 +
gttttaactgccatgctgaaaa

SEQ ID NO: 207679 - DNA, 22 bp, Artificial Sequence
  Synthetic oligonucleotide; TTG chr2 60541757 60541778 60541774 60541779 +
ttttaactgccatgctgaaaat

SEQ ID NO: 207680 - DNA, 22 bp, Artificial Sequence
  Synthetic oligonucleotide; TTT chr2 60541760 60541781 60541777 60541782 +
taactgccatgctgaaaattca

SEQ ID NO: 207681 - DNA, 22 bp, Artificial Sequence
  Synthetic oligonucleotide; TTT chr2 60541761 60541782 60541778 60541783 +
aactgccatgctgaaaattcac

SEQ ID NO: 207682 - DNA, 22 bp, Artificial Sequence
  Synthetic oligonucleotide; TTA chr2 60541762 60541783 60541779 60541784 +
actgccatgctgaaaattcact

SEQ ID NO: 207683 - DNA, 22 bp, Artificial Sequence
  Synthetic oligonucleotide; CTG chr2 60541766 60541787 60541783 60541788 +
ccatgctgaaaattcacttcag

SEQ ID NO: 207684 - DNA, 22 bp, Artificial Sequence
  Synthetic oligonucleotide; CTG chr2 60541774 60541795 60541791 60541796 +
aaaattcacttcagaagtcagt

SEQ ID NO: 207685 - DNA, 22 bp, Artificial Sequence
  Synthetic oligonucleotide; TTC chr2 60541781 60541802 60541798 60541803 +
acttcagaagtcagtcgttttt

SEQ ID NO: 207686 - DNA, 22 bp, Artificial Sequence
  Synthetic oligonucleotide; CTT chr2 60541785 60541806 60541802 60541807 +
cagaagtcagtcgtttttattc

SEQ ID NO: 207687 - DNA, 22 bp, Artificial Sequence
  Synthetic oligonucleotide; TTC chr2 60541786 60541807 60541803 60541808 +
agaagtcagtcgtttttattca

SEQ ID NO: 207688 - DNA, 22 bp, Artificial Sequence
  Synthetic oligonucleotide; TTT chr2 60541801 60541822 60541818 60541823 +
ttattcagaatcacataaataa

SEQ ID NO: 207689 - DNA, 22 bp, Artificial Sequence
  Synthetic oligonucleotide; TTT chr2 60541802 60541823 60541819 60541824 +
tattcagaatcacataaataaa

SEQ ID NO: 207690 - DNA, 22 bp, Artificial Sequence
  Synthetic oligonucleotide; TTT chr2 60541803 60541824 60541820 60541825 +
attcagaatcacataaataaag

SEQ ID NO: 207691 - DNA, 22 bp, Artificial Sequence
  Synthetic oligonucleotide; TTA chr2 60541804 60541825 60541821 60541826 +
ttcagaatcacataaataaaga

SEQ ID NO: 207692 - DNA, 22 bp, Artificial Sequence
  Synthetic oligonucleotide; TTC chr2 60541807 60541828 60541824 60541829 +
agaatcacataaataaagagaa

SEQ ID NO: 207693 - DNA, 22 bp, Artificial Sequence
  Synthetic oligonucleotide; CTA chr2 60541860 60541881 60541877 60541882 +
taatttatagtctcatttacaa

SEQ ID NO: 207694 - DNA, 22 bp, Artificial Sequence
  Synthetic oligonucleotide; TTT chr2 60541866 60541887 60541883 60541888 +
atagtctcatttacaattacac

SEQ ID NO: 207695 - DNA, 22 bp, Artificial Sequence
  Synthetic oligonucleotide; TTA chr2 60541867 60541888 60541884 60541889 +
tagtctcatttacaattacacc

SEQ ID NO: 207696 - DNA, 22 bp, Artificial Sequence
  Synthetic oligonucleotide; CTC chr2 60541874 60541895 60541891 60541896 +
atttacaattacaccataaggt

SEQ ID NO: 207697 - DNA, 22 bp, Artificial Sequence
  Synthetic oligonucleotide; TTT chr2 60541878 60541899 60541895 60541900 +
acaattacaccataaggtacac

SEQ ID NO: 207698 - DNA, 22 bp, Artificial Sequence
  Synthetic oligonucleotide; TTA chr2 60541879 60541900 60541896 60541901 +
caattacaccataaggtacaca

SEQ ID NO: 207699 - DNA, 22 bp, Artificial Sequence
  Synthetic oligonucleotide; TTA chr2 60541885 60541906 60541902 60541907 +
caccataaggtacacaaataca

SEQ ID NO: 207700 - DNA, 22 bp, Artificial Sequence
  Synthetic oligonucleotide; CTC chr2 60541912 60541933 60541929 60541934 +
cagttcagtctgagctaggaga

SEQ ID NO: 207701 - DNA, 22 bp, Artificial Sequence
  Synthetic oligonucleotide; TTC chr2 60541918 60541939 60541935 60541940 +
agtctgagctaggagagaatca

SEQ ID NO: 207702 - DNA, 22 bp, Artificial Sequence
  Synthetic oligonucleotide; CTG chr2 60541924 60541945 60541941 60541946 +
agctaggagagaatcagaatgg

SEQ ID NO: 207703 - DNA, 22 bp, Artificial Sequence
  Synthetic oligonucleotide; CTA chr2 60541929 60541950 60541946 60541951 +
ggagagaatcagaatggataca

SEQ ID NO: 207704 - DNA, 22 bp, Artificial Sequence
  Synthetic oligonucleotide; TTC chr2 60541969 60541990 60541986 60541991 +
attttctaaattctgaaaagca

SEQ ID NO: 207705 - DNA, 22 bp, Artificial Sequence
  Synthetic oligonucleotide; TTT chr2 60541973 60541994 60541990 60541995 +
tctaaattctgaaaagcatatt

SEQ ID NO: 207706 - DNA, 22 bp, Artificial Sequence
  Synthetic oligonucleotide; TTT chr2 60541974 60541995 60541991 60541996 +
ctaaattctgaaaagcatattg

SEQ ID NO: 207707 - DNA, 22 bp, Artificial Sequence
  Synthetic oligonucleotide; TTC chr2 60541975 60541996 60541992 60541997 +
taaattctgaaaagcatattgt

SEQ ID NO: 207708 - DNA, 22 bp, Artificial Sequence
  Synthetic oligonucleotide; CTA chr2 60541977 60541998 60541994 60541999 +
aattctgaaaagcatattgtat

SEQ ID NO: 207709 - DNA, 22 bp, Artificial Sequence
  Synthetic oligonucleotide; TTC chr2 60541982 60542003 60541999 60542004 +
tgaaaagcatattgtatttgat

SEQ ID NO: 207710 - DNA, 22 bp, Artificial Sequence
  Synthetic oligonucleotide; CTG chr2 60541984 60542005 60542001 60542006 +
aaaagcatattgtatttgattt

SEQ ID NO: 207711 - DNA, 22 bp, Artificial Sequence
  Synthetic oligonucleotide; TTG chr2 60541996 60542017 60542013 60542018 +
tatttgatttacttttaagagc

SEQ ID NO: 207712 - DNA, 22 bp, Artificial Sequence
  Synthetic oligonucleotide; TTT chr2 60542001 60542022 60542018 60542023 +
gatttacttttaagagcatgct

SEQ ID NO: 207713 - DNA, 22 bp, Artificial Sequence
  Synthetic oligonucleotide; TTG chr2 60542002 60542023 60542019 60542024 +
atttacttttaagagcatgcta

SEQ ID NO: 207714 - DNA, 22 bp, Artificial Sequence
  Synthetic oligonucleotide; TTT chr2 60542006 60542027 60542023 60542028 +
acttttaagagcatgctaatgt

SEQ ID NO: 207715 - DNA, 22 bp, Artificial Sequence
  Synthetic oligonucleotide; TTA chr2 60542007 60542028 60542024 60542029 +
cttttaagagcatgctaatgta

SEQ ID NO: 207716 - DNA, 22 bp, Artificial Sequence
  Synthetic oligonucleotide; CTT chr2 60542010 60542031 60542027 60542032 +
ttaagagcatgctaatgtattt

SEQ ID NO: 207717 - DNA, 22 bp, Artificial Sequence
  Synthetic oligonucleotide; TTT chr2 60542011 60542032 60542028 60542033 +
taagagcatgctaatgtatttc

SEQ ID NO: 207718 - DNA, 22 bp, Artificial Sequence
  Synthetic oligonucleotide; TTT chr2 60542012 60542033 60542029 60542034 +
aagagcatgctaatgtatttcc

SEQ ID NO: 207719 - DNA, 22 bp, Artificial Sequence
  Synthetic oligonucleotide; TTA chr2 60542013 60542034 60542030 60542035 +
agagcatgctaatgtatttcca

SEQ ID NO: 207720 - DNA, 22 bp, Artificial Sequence
  Synthetic oligonucleotide; CTA chr2 60542024 60542045 60542041 60542046 +
atgtatttccattttgaattac

SEQ ID NO: 207721 - DNA, 22 bp, Artificial Sequence
  Synthetic oligonucleotide; TTT chr2 60542032 60542053 60542049 60542054 +
ccattttgaattactatatctc

SEQ ID NO: 207722 - DNA, 22 bp, Artificial Sequence
  Synthetic oligonucleotide; TTC chr2 60542033 60542054 60542050 60542055 +
cattttgaattactatatctcc

SEQ ID NO: 207723 - DNA, 22 bp, Artificial Sequence
  Synthetic oligonucleotide; TTT chr2 60542038 60542059 60542055 60542060 +
tgaattactatatctcccttct

SEQ ID NO: 207724 - DNA, 22 bp, Artificial Sequence
  Synthetic oligonucleotide; TTT chr2 60542039 60542060 60542056 60542061 +
gaattactatatctcccttctt

SEQ ID NO: 207725 - DNA, 22 bp, Artificial Sequence
  Synthetic oligonucleotide; TTG chr2 60542040 60542061 60542057 60542062 +
aattactatatctcccttcttt

SEQ ID NO: 207726 - DNA, 22 bp, Artificial Sequence
  Synthetic oligonucleotide; TTA chr2 60542045 60542066 60542062 60542067 +
ctatatctcccttctttagagt

SEQ ID NO: 207727 - DNA, 22 bp, Artificial Sequence
  Synthetic oligonucleotide; CTA chr2 60542048 60542069 60542065 60542070 +
tatctcccttctttagagtatc

SEQ ID NO: 207728 - DNA, 22 bp, Artificial Sequence
  Synthetic oligonucleotide; CTC chr2 60542054 60542075 60542071 60542076 +
ccttctttagagtatctgtctg

SEQ ID NO: 207729 - DNA, 22 bp, Artificial Sequence
  Synthetic oligonucleotide; CTT chr2 60542058 60542079 60542075 60542080 +
ctttagagtatctgtctgatat

SEQ ID NO: 207730 - DNA, 22 bp, Artificial Sequence
  Synthetic oligonucleotide; TTC chr2 60542059 60542080 60542076 60542081 +
tttagagtatctgtctgatata

SEQ ID NO: 207731 - DNA, 22 bp, Artificial Sequence
  Synthetic oligonucleotide; CTT chr2 60542061 60542082 60542078 60542083 +
tagagtatctgtctgatatatc

SEQ ID NO: 207732 - DNA, 22 bp, Artificial Sequence
  Synthetic oligonucleotide; TTT chr2 60542062 60542083 60542079 60542084 +
agagtatctgtctgatatatca

SEQ ID NO: 207733 - DNA, 22 bp, Artificial Sequence
  Synthetic oligonucleotide; TTA chr2 60542063 60542084 60542080 60542085 +
gagtatctgtctgatatatcat

SEQ ID NO: 207734 - DNA, 22 bp, Artificial Sequence
  Synthetic oligonucleotide; CTG chr2 60542072 60542093 60542089 60542094 +
tctgatatatcattatctaaat

SEQ ID NO: 207735 - DNA, 22 bp, Artificial Sequence
  Synthetic oligonucleotide; CTG chr2 60542076 60542097 60542093 60542098 +
atatatcattatctaaatacca

SEQ ID NO: 207736 - DNA, 22 bp, Artificial Sequence
  Synthetic oligonucleotide; TTA chr2 60542087 60542108 60542104 60542109 +
tctaaataccagctatactgtc

SEQ ID NO: 207737 - DNA, 22 bp, Artificial Sequence
  Synthetic oligonucleotide; CTA chr2 60542091 60542112 60542108 60542113 +
aataccagctatactgtctagg

SEQ ID NO: 207738 - DNA, 22 bp, Artificial Sequence
  Synthetic oligonucleotide; CTA chr2 60542102 60542123 60542119 60542124 +
tactgtctaggcaaataatttt

SEQ ID NO: 207739 - DNA, 22 bp, Artificial Sequence
  Synthetic oligonucleotide; CTG chr2 60542107 60542128 60542124 60542129 +
tctaggcaaataattttaaata

SEQ ID NO: 207740 - DNA, 22 bp, Artificial Sequence
  Synthetic oligonucleotide; CTA chr2 60542111 60542132 60542128 60542133 +
ggcaaataattttaaataccct

SEQ ID NO: 207741 - DNA, 22 bp, Artificial Sequence
  Synthetic oligonucleotide; TTT chr2 60542123 60542144 60542140 60542145 +
taaataccctgatataaatgtc

SEQ ID NO: 207742 - DNA, 22 bp, Artificial Sequence
  Synthetic oligonucleotide; TTT chr2 60542124 60542145 60542141 60542146 +
aaataccctgatataaatgtct

SEQ ID NO: 207743 - DNA, 22 bp, Artificial Sequence
  Synthetic oligonucleotide; TTA chr2 60542125 60542146 60542142 60542147 +
aataccctgatataaatgtcta

SEQ ID NO: 207744 - DNA, 22 bp, Artificial Sequence
  Synthetic oligonucleotide; CTG chr2 60542134 60542155 60542151 60542156 +
atataaatgtctatgttcatga

SEQ ID NO: 207745 - DNA, 22 bp, Artificial Sequence
  Synthetic oligonucleotide; CTA chr2 60542147 60542168 60542164 60542169 +
tgttcatgattttaaagagaaa

SEQ ID NO: 207746 - DNA, 22 bp, Artificial Sequence
  Synthetic oligonucleotide; TTC chr2 60542152 60542173 60542169 60542174 +
atgattttaaagagaaaaaatg

SEQ ID NO: 207747 - DNA, 22 bp, Artificial Sequence
  Synthetic oligonucleotide; TTT chr2 60542159 60542180 60542176 60542181 +
taaagagaaaaaatgttatata

SEQ ID NO: 207748 - DNA, 22 bp, Artificial Sequence
  Synthetic oligonucleotide; TTT chr2 60542160 60542181 60542177 60542182 +
aaagagaaaaaatgttatatat

SEQ ID NO: 207749 - DNA, 22 bp, Artificial Sequence
  Synthetic oligonucleotide; TTA chr2 60542161 60542182 60542178 60542183 +
aagagaaaaaatgttatatatc

SEQ ID NO: 207750 - DNA, 22 bp, Artificial Sequence
  Synthetic oligonucleotide; TTA chr2 60542177 60542198 60542194 60542199 +
tatatcaacaggagcagacttt

SEQ ID NO: 207751 - DNA, 22 bp, Artificial Sequence
  Synthetic oligonucleotide; CTT chr2 60542198 60542219 60542215 60542220 +
tactacattttataggacttgt

SEQ ID NO: 207752 - DNA, 22 bp, Artificial Sequence
  Synthetic oligonucleotide; TTT chr2 60542199 60542220 60542216 60542221 +
actacattttataggacttgtc

SEQ ID NO: 207753 - DNA, 22 bp, Artificial Sequence
  Synthetic oligonucleotide; TTA chr2 60542200 60542221 60542217 60542222 +
ctacattttataggacttgtca

SEQ ID NO: 207754 - DNA, 22 bp, Artificial Sequence
  Synthetic oligonucleotide; CTA chr2 60542203 60542224 60542220 60542225 +
cattttataggacttgtcatat

SEQ ID NO: 207755 - DNA, 22 bp, Artificial Sequence
  Synthetic oligonucleotide; TTT chr2 60542208 60542229 60542225 60542230 +
tataggacttgtcatatttttt

SEQ ID NO: 207756 - DNA, 22 bp, Artificial Sequence
  Synthetic oligonucleotide; TTT chr2 60542209 60542230 60542226 60542231 +
ataggacttgtcatattttttc

SEQ ID NO: 207757 - DNA, 22 bp, Artificial Sequence
  Synthetic oligonucleotide; TTA chr2 60542210 60542231 60542227 60542232 +
taggacttgtcatattttttct

SEQ ID NO: 207758 - DNA, 22 bp, Artificial Sequence
  Synthetic oligonucleotide; CTT chr2 60542218 60542239 60542235 60542240 +
gtcatattttttctctagtctc

SEQ ID NO: 207759 - DNA, 22 bp, Artificial Sequence
  Synthetic oligonucleotide; TTG chr2 60542219 60542240 60542236 60542241 +
tcatattttttctctagtctct

SEQ ID NO: 207760 - DNA, 22 bp, Artificial Sequence
  Synthetic oligonucleotide; TTT chr2 60542227 60542248 60542244 60542249 +
tttctctagtctctcaaaaagc

SEQ ID NO: 207761 - DNA, 22 bp, Artificial Sequence
  Synthetic oligonucleotide; TTT chr2 60542228 60542249 60542245 60542250 +
ttctctagtctctcaaaaagct

SEQ ID NO: 207762 - DNA, 22 bp, Artificial Sequence
  Synthetic oligonucleotide; TTT chr2 60542229 60542250 60542246 60542251 +
tctctagtctctcaaaaagcta

SEQ ID NO: 207763 - DNA, 22 bp, Artificial Sequence
  Synthetic oligonucleotide; TTT chr2 60542230 60542251 60542247 60542252 +
ctctagtctctcaaaaagctaa

SEQ ID NO: 207764 - DNA, 22 bp, Artificial Sequence
  Synthetic oligonucleotide; TTC chr2 60542231 60542252 60542248 60542253 +
tctagtctctcaaaaagctaac

SEQ ID NO: 207765 - DNA, 22 bp, Artificial Sequence
  Synthetic oligonucleotide; CTC chr2 60542233 60542254 60542250 60542255 +
tagtctctcaaaaagctaactt

SEQ ID NO: 207766 - DNA, 22 bp, Artificial Sequence
  Synthetic oligonucleotide; CTA chr2 60542235 60542256 60542252 60542257 +
gtctctcaaaaagctaacttta

SEQ ID NO: 207767 - DNA, 22 bp, Artificial Sequence
  Synthetic oligonucleotide; CTC chr2 60542240 60542261 60542257 60542262 +
tcaaaaagctaactttatgaca

SEQ ID NO: 207768 - DNA, 22 bp, Artificial Sequence
  Synthetic oligonucleotide; CTC chr2 60542242 60542263 60542259 60542264 +
aaaaagctaactttatgacagc

SEQ ID NO: 207769 - DNA, 22 bp, Artificial Sequence
  Synthetic oligonucleotide; CTA chr2 60542251 60542272 60542268 60542273 +
actttatgacagcccaaaccta

SEQ ID NO: 207770 - DNA, 22 bp, Artificial Sequence
  Synthetic oligonucleotide; CTT chr2 60542255 60542276 60542272 60542277 +
tatgacagcccaaacctaattt

SEQ ID NO: 207771 - DNA, 22 bp, Artificial Sequence
  Synthetic oligonucleotide; TTT chr2 60542256 60542277 60542273 60542278 +
atgacagcccaaacctaattta

SEQ ID NO: 207772 - DNA, 22 bp, Artificial Sequence
  Synthetic oligonucleotide; TTA chr2 60542257 60542278 60542274 60542279 +
tgacagcccaaacctaatttaa

SEQ ID NO: 207773 - DNA, 22 bp, Artificial Sequence
  Synthetic oligonucleotide; CTA chr2 60542273 60542294 60542290 60542295 +
atttaaagattcctatgtgcaa

SEQ ID NO: 207774 - DNA, 22 bp, Artificial Sequence
  Synthetic oligonucleotide; TTT chr2 60542277 60542298 60542294 60542299 +
aaagattcctatgtgcaataag

SEQ ID NO: 207775 - DNA, 22 bp, Artificial Sequence
  Synthetic oligonucleotide; TTA chr2 60542278 60542299 60542295 60542300 +
aagattcctatgtgcaataagc

SEQ ID NO: 207776 - DNA, 22 bp, Artificial Sequence
  Synthetic oligonucleotide; TTC chr2 60542285 60542306 60542302 60542307 +
ctatgtgcaataagccaaaacc

SEQ ID NO: 207777 - DNA, 22 bp, Artificial Sequence
  Synthetic oligonucleotide; CTA chr2 60542288 60542309 60542305 60542310 +
tgtgcaataagccaaaacctca

SEQ ID NO: 207778 - DNA, 22 bp, Artificial Sequence
  Synthetic oligonucleotide; CTC chr2 60542309 60542330 60542326 60542331 +
aaatctgacatgatgggataat

SEQ ID NO: 207779 - DNA, 22 bp, Artificial Sequence
  Synthetic oligonucleotide; CTG chr2 60542316 60542337 60542333 60542338 +
acatgatgggataatgtttggg

SEQ ID NO: 207780 - DNA, 22 bp, Artificial Sequence
  Synthetic oligonucleotide; TTT chr2 60542335 60542356 60542352 60542357 +
gggtcttttctataagggaaca

SEQ ID NO: 207781 - DNA, 22 bp, Artificial Sequence
  Synthetic oligonucleotide; TTG chr2 60542336 60542357 60542353 60542358 +
ggtcttttctataagggaacag

SEQ ID NO: 207782 - DNA, 22 bp, Artificial Sequence
  Synthetic oligonucleotide; CTT chr2 60542342 60542363 60542359 60542364 +
ttctataagggaacagcagttt

SEQ ID NO: 207783 - DNA, 22 bp, Artificial Sequence
  Synthetic oligonucleotide; TTT chr2 60542343 60542364 60542360 60542365 +
tctataagggaacagcagtttc

SEQ ID NO: 207784 - DNA, 22 bp, Artificial Sequence
  Synthetic oligonucleotide; TTT chr2 60542344 60542365 60542361 60542366 +
ctataagggaacagcagtttca

SEQ ID NO: 207785 - DNA, 22 bp, Artificial Sequence
  Synthetic oligonucleotide; TTC chr2 60542345 60542366 60542362 60542367 +
tataagggaacagcagtttcac

SEQ ID NO: 207786 - DNA, 22 bp, Artificial Sequence
  Synthetic oligonucleotide; CTA chr2 60542347 60542368 60542364 60542369 +
taagggaacagcagtttcacat

SEQ ID NO: 207787 - DNA, 22 bp, Artificial Sequence
  Synthetic oligonucleotide; TTT chr2 60542364 60542385 60542381 60542386 +
cacattcagtaatcttccatga

SEQ ID NO: 207788 - DNA, 22 bp, Artificial Sequence
  Synthetic oligonucleotide; TTC chr2 60542365 60542386 60542382 60542387 +
acattcagtaatcttccatgaa

SEQ ID NO: 207789 - DNA, 22 bp, Artificial Sequence
  Synthetic oligonucleotide; TTC chr2 60542371 60542392 60542388 60542393 +
agtaatcttccatgaatatttc

SEQ ID NO: 207790 - DNA, 22 bp, Artificial Sequence
  Synthetic oligonucleotide; CTT chr2 60542380 60542401 60542397 60542402 +
ccatgaatatttccccccatca

SEQ ID NO: 207791 - DNA, 22 bp, Artificial Sequence
  Synthetic oligonucleotide; TTC chr2 60542381 60542402 60542398 60542403 +
catgaatatttccccccatcat

SEQ ID NO: 207792 - DNA, 22 bp, Artificial Sequence
  Synthetic oligonucleotide; TTT chr2 60542392 60542413 60542409 60542414 +
ccccccatcataaaatatgaga

SEQ ID NO: 207793 - DNA, 22 bp, Artificial Sequence
  Synthetic oligonucleotide; TTC chr2 60542393 60542414 60542410 60542415 +
cccccatcataaaatatgagac

SEQ ID NO: 207794 - DNA, 22 bp, Artificial Sequence
  Synthetic oligonucleotide; CTA chr2 60542417 60542438 60542434 60542439 +
aaaaaaaagaaaacaaaacaaa

SEQ ID NO: 207795 - DNA, 22 bp, Artificial Sequence
  Synthetic oligonucleotide; CTA chr2 60542451 60542472 60542468 60542473 +
ttgaaagctctgactgcaagtc

SEQ ID NO: 207796 - DNA, 22 bp, Artificial Sequence
  Synthetic oligonucleotide; TTG chr2 60542454 60542475 60542471 60542476 +
aaagctctgactgcaagtcaaa

SEQ ID NO: 207797 - DNA, 22 bp, Artificial Sequence
  Synthetic oligonucleotide; CTC chr2 60542461 60542482 60542478 60542483 +
tgactgcaagtcaaaggctgct

SEQ ID NO: 207798 - DNA, 22 bp, Artificial Sequence
  Synthetic oligonucleotide; CTG chr2 60542463 60542484 60542480 60542485 +
actgcaagtcaaaggctgctga

SEQ ID NO: 207799 - DNA, 22 bp, Artificial Sequence
  Synthetic oligonucleotide; CTG chr2 60542467 60542488 60542484 60542489 +
caagtcaaaggctgctgatatc

SEQ ID NO: 207800 - DNA, 22 bp, Artificial Sequence
  Synthetic oligonucleotide; CTG chr2 60542481 60542502 60542498 60542503 +
ctgatatctgagggtggatatt

SEQ ID NO: 207801 - DNA, 22 bp, Artificial Sequence
  Synthetic oligonucleotide; CTG chr2 60542484 60542505 60542501 60542506 +
atatctgagggtggatatttga

SEQ ID NO: 207802 - DNA, 22 bp, Artificial Sequence
  Synthetic oligonucleotide; CTG chr2 60542491 60542512 60542508 60542513 +
agggtggatatttgacacacat

SEQ ID NO: 207803 - DNA, 22 bp, Artificial Sequence
  Synthetic oligonucleotide; TTT chr2 60542504 60542525 60542521 60542526 +
gacacacatattgatgaactgg

SEQ ID NO: 207804 - DNA, 22 bp, Artificial Sequence
  Synthetic oligonucleotide; TTG chr2 60542505 60542526 60542522 60542527 +
acacacatattgatgaactggg

SEQ ID NO: 207805 - DNA, 22 bp, Artificial Sequence
  Synthetic oligonucleotide; TTG chr2 60542517 60542538 60542534 60542539 +
atgaactgggcccacacaacat

SEQ ID NO: 207806 - DNA, 22 bp, Artificial Sequence
  Synthetic oligonucleotide; CTG chr2 60542525 60542546 60542542 60542547 +
ggcccacacaacataagctgct

SEQ ID NO: 207807 - DNA, 22 bp, Artificial Sequence
  Synthetic oligonucleotide; CTG chr2 60542545 60542566 60542562 60542567 +
ctaattcccagctaaattaata

SEQ ID NO: 207808 - DNA, 22 bp, Artificial Sequence
  Synthetic oligonucleotide; CTA chr2 60542548 60542569 60542565 60542570 +
attcccagctaaattaatacta

SEQ ID NO: 207809 - DNA, 22 bp, Artificial Sequence
  Synthetic oligonucleotide; TTC chr2 60542552 60542573 60542569 60542574 +
ccagctaaattaatactacttc

SEQ ID NO: 207810 - DNA, 22 bp, Artificial Sequence
  Synthetic oligonucleotide; CTA chr2 60542559 60542580 60542576 60542581 +
aattaatactacttcaatgatc

SEQ ID NO: 207811 - DNA, 22 bp, Artificial Sequence
  Synthetic oligonucleotide; TTA chr2 60542564 60542585 60542581 60542586 +
atactacttcaatgatctcaat

SEQ ID NO: 207812 - DNA, 22 bp, Artificial Sequence
  Synthetic oligonucleotide; CTA chr2 60542570 60542591 60542587 60542592 +
cttcaatgatctcaatggatca

SEQ ID NO: 207813 - DNA, 22 bp, Artificial Sequence
  Synthetic oligonucleotide; CTT chr2 60542573 60542594 60542590 60542595 +
caatgatctcaatggatcacaa

SEQ ID NO: 207814 - DNA, 22 bp, Artificial Sequence
  Synthetic oligonucleotide; TTC chr2 60542574 60542595 60542591 60542596 +
aatgatctcaatggatcacaat

SEQ ID NO: 207815 - DNA, 22 bp, Artificial Sequence
  Synthetic oligonucleotide; CTC chr2 60542583 60542604 60542600 60542605 +
aatggatcacaatcacacaata

SEQ ID NO: 207816 - DNA, 22 bp, Artificial Sequence
  Synthetic oligonucleotide; TTT chr2 60542608 60542629 60542625 60542630 +
tgaatatttaaataaaatgaaa

SEQ ID NO: 207817 - DNA, 22 bp, Artificial Sequence
  Synthetic oligonucleotide; TTT chr2 60542609 60542630 60542626 60542631 +
gaatatttaaataaaatgaaaa

SEQ ID NO: 207818 - DNA, 22 bp, Artificial Sequence
  Synthetic oligonucleotide; TTG chr2 60542610 60542631 60542627 60542632 +
aatatttaaataaaatgaaaaa

SEQ ID NO: 207819 - DNA, 22 bp, Artificial Sequence
  Synthetic oligonucleotide; TTT chr2 60542617 60542638 60542634 60542639 +
aaataaaatgaaaaaagcaacc

SEQ ID NO: 207820 - DNA, 22 bp, Artificial Sequence
  Synthetic oligonucleotide; TTA chr2 60542618 60542639 60542635 60542640 +
aataaaatgaaaaaagcaacct

SEQ ID NO: 207821 - DNA, 22 bp, Artificial Sequence
  Synthetic oligonucleotide; CTG chr2 60542641 60542662 60542658 60542663 +
attaacatctatgtgtacagct

SEQ ID NO: 207822 - DNA, 22 bp, Artificial Sequence
  Synthetic oligonucleotide; TTA chr2 60542645 60542666 60542662 60542667 +
acatctatgtgtacagctcata

SEQ ID NO: 207823 - DNA, 22 bp, Artificial Sequence
  Synthetic oligonucleotide; CTA chr2 60542652 60542673 60542669 60542674 +
tgtgtacagctcatatgtgtac

SEQ ID NO: 207824 - DNA, 22 bp, Artificial Sequence
  Synthetic oligonucleotide; CTC chr2 60542664 60542685 60542681 60542686 +
atatgtgtacgtggatgaagtg

SEQ ID NO: 207825 - DNA, 22 bp, Artificial Sequence
  Synthetic oligonucleotide; CTA chr2 60542706 60542727 60542723 60542728 +
ttcaccaggtaaaaagaatcct

SEQ ID NO: 207826 - DNA, 22 bp, Artificial Sequence
  Synthetic oligonucleotide; TTC chr2 60542709 60542730 60542726 60542731 +
accaggtaaaaagaatcctcta

SEQ ID NO: 207827 - DNA, 22 bp, Artificial Sequence
  Synthetic oligonucleotide; CTC chr2 60542729 60542750 60542746 60542751 +
taaaaaatactcagtttgggcc

SEQ ID NO: 207828 - DNA, 22 bp, Artificial Sequence
  Synthetic oligonucleotide; CTA chr2 60542731 60542752 60542748 60542753 +
aaaaatactcagtttgggccag

SEQ ID NO: 207829 - DNA, 22 bp, Artificial Sequence
  Synthetic oligonucleotide; CTC chr2 60542741 60542762 60542758 60542763 +
agtttgggccaggtgcggtcgc

SEQ ID NO: 207830 - DNA, 22 bp, Artificial Sequence
  Synthetic oligonucleotide; TTT chr2 60542746 60542767 60542763 60542768 +
gggccaggtgcggtcgctcaag

SEQ ID NO: 207831 - DNA, 22 bp, Artificial Sequence
  Synthetic oligonucleotide; TTG chr2 60542747 60542768 60542764 60542769 +
ggccaggtgcggtcgctcaagc

SEQ ID NO: 207832 - DNA, 22 bp, Artificial Sequence
  Synthetic oligonucleotide; CTC chr2 60542765 60542786 60542782 60542787 +
aagcctgtaatcccagcacttt

SEQ ID NO: 207833 - DNA, 22 bp, Artificial Sequence
  Synthetic oligonucleotide; CTG chr2 60542772 60542793 60542789 60542794 +
taatcccagcactttgggaggc

SEQ ID NO: 207834 - DNA, 22 bp, Artificial Sequence
  Synthetic oligonucleotide; CTT chr2 60542786 60542807 60542803 60542808 +
tgggaggccaagccaggtggat

SEQ ID NO: 207835 - DNA, 22 bp, Artificial Sequence
  Synthetic oligonucleotide; TTT chr2 60542787 60542808 60542804 60542809 +
gggaggccaagccaggtggatc

SEQ ID NO: 207836 - DNA, 22 bp, Artificial Sequence
  Synthetic oligonucleotide; TTG chr2 60542788 60542809 60542805 60542810 +
ggaggccaagccaggtggatca

SEQ ID NO: 207837 - DNA, 22 bp, Artificial Sequence
  Synthetic oligonucleotide; CTG chr2 60542814 60542835 60542831 60542836 +
aggtcaggagttcaagaccagc

SEQ ID NO: 207838 - DNA, 22 bp, Artificial Sequence
  Synthetic oligonucleotide; TTC chr2 60542827 60542848 60542844 60542849 +
aagaccagcctggccaacatgg

SEQ ID NO: 207839 - DNA, 22 bp, Artificial Sequence
  Synthetic oligonucleotide; CTG chr2 60542839 60542860 60542856 60542861 +
gccaacatggtgaaaccctgcc

SEQ ID NO: 207840 - DNA, 22 bp, Artificial Sequence
  Synthetic oligonucleotide; CTG chr2 60542859 60542880 60542876 60542881 +
cctctactgaaaatacaaaaaa

SEQ ID NO: 207841 - DNA, 22 bp, Artificial Sequence
  Synthetic oligonucleotide; CTC chr2 60542863 60542884 60542880 60542885 +
tactgaaaatacaaaaaactag

SEQ ID NO: 207842 - DNA, 22 bp, Artificial Sequence
  Synthetic oligonucleotide; CTA chr2 60542865 60542886 60542882 60542887 +
ctgaaaatacaaaaaactagct

SEQ ID NO: 207843 - DNA, 22 bp, Artificial Sequence
  Synthetic oligonucleotide; CTG chr2 60542868 60542889 60542885 60542890 +
aaaatacaaaaaactagctggg

SEQ ID NO: 207844 - DNA, 22 bp, Artificial Sequence
  Synthetic oligonucleotide; CTA chr2 60542884 60542905 60542901 60542906 +
gctgggcgtagtggcacacgcc

SEQ ID NO: 207845 - DNA, 22 bp, Artificial Sequence
  Synthetic oligonucleotide; CTG chr2 60542888 60542909 60542905 60542910 +
ggcgtagtggcacacgcctgta

SEQ ID NO: 207846 - DNA, 22 bp, Artificial Sequence
  Synthetic oligonucleotide; CTG chr2 60542908 60542929 60542925 60542930 +
taatcccagctacttgggaggc

SEQ ID NO: 207847 - DNA, 22 bp, Artificial Sequence
  Synthetic oligonucleotide; CTA chr2 60542920 60542941 60542937 60542942 +
cttgggaggctgaggcaggaga

SEQ ID NO: 207848 - DNA, 22 bp, Artificial Sequence
  Synthetic oligonucleotide; CTT chr2 60542923 60542944 60542940 60542945 +
gggaggctgaggcaggagaatc

SEQ ID NO: 207849 - DNA, 22 bp, Artificial Sequence
  Synthetic oligonucleotide; TTG chr2 60542924 60542945 60542941 60542946 +
ggaggctgaggcaggagaatcg

SEQ ID NO: 207850 - DNA, 22 bp, Artificial Sequence
  Synthetic oligonucleotide; CTG chr2 60542932 60542953 60542949 60542954 +
aggcaggagaatcgcttgaacc

SEQ ID NO: 207851 - DNA, 22 bp, Artificial Sequence
  Synthetic oligonucleotide; CTT chr2 60542949 60542970 60542966 60542971 +
gaacctaggaggcagaggttgc

SEQ ID NO: 207852 - DNA, 22 bp, Artificial Sequence
  Synthetic oligonucleotide; TTG chr2 60542950 60542971 60542967 60542972 +
aacctaggaggcagaggttgca

SEQ ID NO: 207853 - DNA, 22 bp, Artificial Sequence
  Synthetic oligonucleotide; CTA chr2 60542956 60542977 60542973 60542978 +
ggaggcagaggttgcagtgagc

SEQ ID NO: 207854 - DNA, 22 bp, Artificial Sequence
  Synthetic oligonucleotide; TTG chr2 60542970 60542991 60542987 60542992 +
cagtgagccaaaatcatgccac

SEQ ID NO: 207855 - DNA, 22 bp, Artificial Sequence
  Synthetic oligonucleotide; CTG chr2 60542994 60543015 60543011 60543016 +
cactccagcctgggcaacaaga

SEQ ID NO: 207856 - DNA, 22 bp, Artificial Sequence
  Synthetic oligonucleotide; CTC chr2 60542999 60543020 60543016 60543021 +
cagcctgggcaacaagagcaaa

SEQ ID NO: 207857 - DNA, 22 bp, Artificial Sequence
  Synthetic oligonucleotide; CTG chr2 60543006 60543027 60543023 60543028 +
ggcaacaagagcaaaactctgt

SEQ ID NO: 207858 - DNA, 22 bp, Artificial Sequence
  Synthetic oligonucleotide; CTC chr2 60543025 60543046 60543042 60543047 +
tgtctaaaaaaaaaaaaaaaaa

SEQ ID NO: 207859 - DNA, 22 bp, Artificial Sequence
  Synthetic oligonucleotide; CTG chr2 60543027 60543048 60543044 60543049 +
tctaaaaaaaaaaaaaaaaaaa

SEQ ID NO: 207860 - DNA, 22 bp, Artificial Sequence
  Synthetic oligonucleotide; CTA chr2 60543031 60543052 60543048 60543053 +
aaaaaaaaaaaaaaaaaaaaaa

SEQ ID NO: 207861 - DNA, 22 bp, Artificial Sequence
  Synthetic oligonucleotide; CTC chr2 60543057 60543078 60543074 60543079 +
agcttggagaggcctgagtaca

SEQ ID NO: 207862 - DNA, 22 bp, Artificial Sequence
  Synthetic oligonucleotide; CTT chr2 60543062 60543083 60543079 60543084 +
ggagaggcctgagtacagtgaa

SEQ ID NO: 207863 - DNA, 22 bp, Artificial Sequence
  Synthetic oligonucleotide; TTG chr2 60543063 60543084 60543080 60543085 +
gagaggcctgagtacagtgaaa

SEQ ID NO: 207864 - DNA, 22 bp, Artificial Sequence
  Synthetic oligonucleotide; CTG chr2 60543073 60543094 60543090 60543095 +
agtacagtgaaaatgcatacca

SEQ ID NO: 207865 - DNA, 22 bp, Artificial Sequence
  Synthetic oligonucleotide; TTT chr2 60543098 60543119 60543115 60543120 +
tactcaagatttaaagaactct

SEQ ID NO: 207866 - DNA, 22 bp, Artificial Sequence
  Synthetic oligonucleotide; TTT chr2 60543099 60543120 60543116 60543121 +
actcaagatttaaagaactctg

SEQ ID NO: 207867 - DNA, 22 bp, Artificial Sequence
  Synthetic oligonucleotide; TTA chr2 60543100 60543121 60543117 60543122 +
ctcaagatttaaagaactctgc

SEQ ID NO: 207868 - DNA, 22 bp, Artificial Sequence
  Synthetic oligonucleotide; CTC chr2 60543103 60543124 60543120 60543125 +
aagatttaaagaactctgcctt

SEQ ID NO: 207869 - DNA, 22 bp, Artificial Sequence
  Synthetic oligonucleotide; TTT chr2 60543110 60543131 60543127 60543132 +
aaagaactctgccttattctcc

SEQ ID NO: 207870 - DNA, 22 bp, Artificial Sequence
  Synthetic oligonucleotide; TTA chr2 60543111 60543132 60543128 60543133 +
aagaactctgccttattctcct

SEQ ID NO: 207871 - DNA, 22 bp, Artificial Sequence
  Synthetic oligonucleotide; CTC chr2 60543119 60543140 60543136 60543141 +
tgccttattctcctatctgaaa

SEQ ID NO: 207872 - DNA, 22 bp, Artificial Sequence
  Synthetic oligonucleotide; CTG chr2 60543121 60543142 60543138 60543143 +
ccttattctcctatctgaaagt

SEQ ID NO: 207873 - DNA, 22 bp, Artificial Sequence
  Synthetic oligonucleotide; CTT chr2 60543125 60543146 60543142 60543147 +
attctcctatctgaaagtcccg

SEQ ID NO: 207874 - DNA, 22 bp, Artificial Sequence
  Synthetic oligonucleotide; TTA chr2 60543126 60543147 60543143 60543148 +
ttctcctatctgaaagtcccga

SEQ ID NO: 207875 - DNA, 22 bp, Artificial Sequence
  Synthetic oligonucleotide; TTC chr2 60543129 60543150 60543146 60543151 +
tcctatctgaaagtcccgaatt

SEQ ID NO: 207876 - DNA, 22 bp, Artificial Sequence
  Synthetic oligonucleotide; CTC chr2 60543131 60543152 60543148 60543153 +
ctatctgaaagtcccgaattct

SEQ ID NO: 207877 - DNA, 22 bp, Artificial Sequence
  Synthetic oligonucleotide; CTA chr2 60543134 60543155 60543151 60543156 +
tctgaaagtcccgaattctaag

SEQ ID NO: 207878 - DNA, 22 bp, Artificial Sequence
  Synthetic oligonucleotide; CTG chr2 60543138 60543159 60543155 60543160 +
aaagtcccgaattctaagcttt

SEQ ID NO: 207879 - DNA, 22 bp, Artificial Sequence
  Synthetic oligonucleotide; TTC chr2 60543152 60543173 60543169 60543174 +
taagctttatttatcttaggaa

SEQ ID NO: 207880 - DNA, 22 bp, Artificial Sequence
  Synthetic oligonucleotide; CTA chr2 60543154 60543175 60543171 60543176 +
agctttatttatcttaggaaga

SEQ ID NO: 207881 - DNA, 22 bp, Artificial Sequence
  Synthetic oligonucleotide; CTT chr2 60543159 60543180 60543176 60543181 +
tatttatcttaggaagaagatc

SEQ ID NO: 207882 - DNA, 22 bp, Artificial Sequence
  Synthetic oligonucleotide; TTT chr2 60543160 60543181 60543177 60543182 +
atttatcttaggaagaagatct

SEQ ID NO: 207883 - DNA, 22 bp, Artificial Sequence
  Synthetic oligonucleotide; TTA chr2 60543161 60543182 60543178 60543183 +
tttatcttaggaagaagatctg

SEQ ID NO: 207884 - DNA, 22 bp, Artificial Sequence
  Synthetic oligonucleotide; TTT chr2 60543164 60543185 60543181 60543186 +
atcttaggaagaagatctgtca

SEQ ID NO: 207885 - DNA, 22 bp, Artificial Sequence
  Synthetic oligonucleotide; TTA chr2 60543165 60543186 60543182 60543187 +
tcttaggaagaagatctgtcac

SEQ ID NO: 207886 - DNA, 22 bp, Artificial Sequence
  Synthetic oligonucleotide; CTT chr2 60543169 60543190 60543186 60543191 +
aggaagaagatctgtcactgtt

SEQ ID NO: 207887 - DNA, 22 bp, Artificial Sequence
  Synthetic oligonucleotide; TTA chr2 60543170 60543191 60543187 60543192 +
ggaagaagatctgtcactgttt

SEQ ID NO: 207888 - DNA, 22 bp, Artificial Sequence
  Synthetic oligonucleotide; CTG chr2 60543183 60543204 60543200 60543205 +
tcactgttttattcttgcttcc

SEQ ID NO: 207889 - DNA, 22 bp, Artificial Sequence
  Synthetic oligonucleotide; CTG chr2 60543189 60543210 60543206 60543211 +
ttttattcttgcttcctgccta

SEQ ID NO: 207890 - DNA, 22 bp, Artificial Sequence
  Synthetic oligonucleotide; TTT chr2 60543192 60543213 60543209 60543214 +
tattcttgcttcctgcctataa

SEQ ID NO: 207891 - DNA, 22 bp, Artificial Sequence
  Synthetic oligonucleotide; TTT chr2 60543193 60543214 60543210 60543215 +
attcttgcttcctgcctataaa

SEQ ID NO: 207892 - DNA, 22 bp, Artificial Sequence
  Synthetic oligonucleotide; TTA chr2 60543194 60543215 60543211 60543216 +
ttcttgcttcctgcctataaaa

SEQ ID NO: 207893 - DNA, 22 bp, Artificial Sequence
  Synthetic oligonucleotide; TTC chr2 60543197 60543218 60543214 60543219 +
ttgcttcctgcctataaaatag

SEQ ID NO: 207894 - DNA, 22 bp, Artificial Sequence
  Synthetic oligonucleotide; CTT chr2 60543199 60543220 60543216 60543221 +
gcttcctgcctataaaatagta

SEQ ID NO: 207895 - DNA, 22 bp, Artificial Sequence
  Synthetic oligonucleotide; TTG chr2 60543200 60543221 60543217 60543222 +
cttcctgcctataaaatagtac

SEQ ID NO: 207896 - DNA, 22 bp, Artificial Sequence
  Synthetic oligonucleotide; CTT chr2 60543203 60543224 60543220 60543225 +
cctgcctataaaatagtacagg

SEQ ID NO: 207897 - DNA, 22 bp, Artificial Sequence
  Synthetic oligonucleotide; TTC chr2 60543204 60543225 60543221 60543226 +
ctgcctataaaatagtacaggc

SEQ ID NO: 207898 - DNA, 22 bp, Artificial Sequence
  Synthetic oligonucleotide; CTG chr2 60543207 60543228 60543224 60543229 +
cctataaaatagtacaggctca

SEQ ID NO: 207899 - DNA, 22 bp, Artificial Sequence
  Synthetic oligonucleotide; CTA chr2 60543211 60543232 60543228 60543233 +
taaaatagtacaggctcacagt

SEQ ID NO: 207900 - DNA, 22 bp, Artificial Sequence
  Synthetic oligonucleotide; CTC chr2 60543228 60543249 60543245 60543250 +
acagtgaactcaaatccaactt

SEQ ID NO: 207901 - DNA, 22 bp, Artificial Sequence
  Synthetic oligonucleotide; CTC chr2 60543239 60543260 60543256 60543261 +
aaatccaacttacatcacttta

SEQ ID NO: 207902 - DNA, 22 bp, Artificial Sequence
  Synthetic oligonucleotide; CTT chr2 60543250 60543271 60543267 60543272 +
acatcactttaataaagccttt

SEQ ID NO: 207903 - DNA, 22 bp, Artificial Sequence
  Synthetic oligonucleotide; TTA chr2 60543251 60543272 60543268 60543273 +
catcactttaataaagcctttc

SEQ ID NO: 207904 - DNA, 22 bp, Artificial Sequence
  Synthetic oligonucleotide; CTT chr2 60543259 60543280 60543276 60543281 +
taataaagcctttcctacccag

SEQ ID NO: 207905 - DNA, 22 bp, Artificial Sequence
  Synthetic oligonucleotide; TTT chr2 60543260 60543281 60543277 60543282 +
aataaagcctttcctacccagc

SEQ ID NO: 207906 - DNA, 22 bp, Artificial Sequence
  Synthetic oligonucleotide; TTA chr2 60543261 60543282 60543278 60543283 +
ataaagcctttcctacccagca

SEQ ID NO: 207907 - DNA, 22 bp, Artificial Sequence
  Synthetic oligonucleotide; CTT chr2 60543271 60543292 60543288 60543293 +
tcctacccagcacgcttaaatg

SEQ ID NO: 207908 - DNA, 22 bp, Artificial Sequence
  Synthetic oligonucleotide; TTT chr2 60543272 60543293 60543289 60543294 +
cctacccagcacgcttaaatga

SEQ ID NO: 207909 - DNA, 22 bp, Artificial Sequence
  Synthetic oligonucleotide; TTC chr2 60543273 60543294 60543290 60543295 +
ctacccagcacgcttaaatgac

SEQ ID NO: 207910 - DNA, 22 bp, Artificial Sequence
  Synthetic oligonucleotide; CTA chr2 60543276 60543297 60543293 60543298 +
cccagcacgcttaaatgactac

SEQ ID NO: 207911 - DNA, 22 bp, Artificial Sequence
  Synthetic oligonucleotide; CTT chr2 60543288 60543309 60543305 60543310 +
aaatgactaccttttatgtggt

SEQ ID NO: 207912 - DNA, 22 bp, Artificial Sequence
  Synthetic oligonucleotide; TTA chr2 60543289 60543310 60543306 60543311 +
aatgactaccttttatgtggtt

SEQ ID NO: 207913 - DNA, 22 bp, Artificial Sequence
  Synthetic oligonucleotide; CTA chr2 60543297 60543318 60543314 60543319 +
ccttttatgtggttgccaaaca

SEQ ID NO: 207914 - DNA, 22 bp, Artificial Sequence
  Synthetic oligonucleotide; CTT chr2 60543301 60543322 60543318 60543323 +
ttatgtggttgccaaacacatt

SEQ ID NO: 207915 - DNA, 22 bp, Artificial Sequence
  Synthetic oligonucleotide; TTT chr2 60543302 60543323 60543319 60543324 +
tatgtggttgccaaacacattc

SEQ ID NO: 207916 - DNA, 22 bp, Artificial Sequence
  Synthetic oligonucleotide; TTT chr2 60543303 60543324 60543320 60543325 +
atgtggttgccaaacacattct

SEQ ID NO: 207917 - DNA, 22 bp, Artificial Sequence
  Synthetic oligonucleotide; TTA chr2 60543304 60543325 60543321 60543326 +
tgtggttgccaaacacattctt

SEQ ID NO: 207918 - DNA, 22 bp, Artificial Sequence
  Synthetic oligonucleotide; TTG chr2 60543312 60543333 60543329 60543334 +
ccaaacacattcttctagagat

SEQ ID NO: 207919 - DNA, 22 bp, Artificial Sequence
  Synthetic oligonucleotide; TTC chr2 60543324 60543345 60543341 60543346 +
ttctagagattcatcaatatat

SEQ ID NO: 207920 - DNA, 22 bp, Artificial Sequence
  Synthetic oligonucleotide; CTT chr2 60543326 60543347 60543343 60543348 +
ctagagattcatcaatatatct

SEQ ID NO: 207921 - DNA, 22 bp, Artificial Sequence
  Synthetic oligonucleotide; TTC chr2 60543327 60543348 60543344 60543349 +
tagagattcatcaatatatctc

SEQ ID NO: 207922 - DNA, 22 bp, Artificial Sequence
  Synthetic oligonucleotide; CTA chr2 60543329 60543350 60543346 60543351 +
gagattcatcaatatatctctt

SEQ ID NO: 207923 - DNA, 22 bp, Artificial Sequence
  Synthetic oligonucleotide; TTC chr2 60543336 60543357 60543353 60543358 +
atcaatatatctctttccttaa

SEQ ID NO: 207924 - DNA, 22 bp, Artificial Sequence
  Synthetic oligonucleotide; CTC chr2 60543349 60543370 60543366 60543371 +
tttccttaatacaaggcattgc

SEQ ID NO: 207925 - DNA, 22 bp, Artificial Sequence
  Synthetic oligonucleotide; CTT chr2 60543351 60543372 60543368 60543373 +
tccttaatacaaggcattgctt

SEQ ID NO: 207926 - DNA, 22 bp, Artificial Sequence
  Synthetic oligonucleotide; TTT chr2 60543352 60543373 60543369 60543374 +
ccttaatacaaggcattgcttc

SEQ ID NO: 207927 - DNA, 22 bp, Artificial Sequence
  Synthetic oligonucleotide; TTC chr2 60543353 60543374 60543370 60543375 +
cttaatacaaggcattgcttct

SEQ ID NO: 207928 - DNA, 22 bp, Artificial Sequence
  Synthetic oligonucleotide; CTT chr2 60543356 60543377 60543373 60543378 +
aatacaaggcattgcttctcct

SEQ ID NO: 207929 - DNA, 22 bp, Artificial Sequence
  Synthetic oligonucleotide; TTA chr2 60543357 60543378 60543374 60543379 +
atacaaggcattgcttctcctt

SEQ ID NO: 207930 - DNA, 22 bp, Artificial Sequence
  Synthetic oligonucleotide; TTG chr2 60543370 60543391 60543387 60543392 +
cttctcctttctttttgtgaca

SEQ ID NO: 207931 - DNA, 22 bp, Artificial Sequence
  Synthetic oligonucleotide; CTT chr2 60543373 60543394 60543390 60543395 +
ctcctttctttttgtgacacaa

SEQ ID NO: 207932 - DNA, 22 bp, Artificial Sequence
  Synthetic oligonucleotide; TTC chr2 60543374 60543395 60543391 60543396 +
tcctttctttttgtgacacaat

SEQ ID NO: 207933 - DNA, 22 bp, Artificial Sequence
  Synthetic oligonucleotide; CTC chr2 60543376 60543397 60543393 60543398 +
ctttctttttgtgacacaattc

SEQ ID NO: 207934 - DNA, 22 bp, Artificial Sequence
  Synthetic oligonucleotide; CTT chr2 60543379 60543400 60543396 60543401 +
tctttttgtgacacaattcaaa

SEQ ID NO: 207935 - DNA, 22 bp, Artificial Sequence
  Synthetic oligonucleotide; TTT chr2 60543380 60543401 60543397 60543402 +
ctttttgtgacacaattcaaat

SEQ ID NO: 207936 - DNA, 22 bp, Artificial Sequence
  Synthetic oligonucleotide; TTC chr2 60543381 60543402 60543398 60543403 +
tttttgtgacacaattcaaata

SEQ ID NO: 207937 - DNA, 22 bp, Artificial Sequence
  Synthetic oligonucleotide; CTT chr2 60543383 60543404 60543400 60543405 +
tttgtgacacaattcaaatatc

SEQ ID NO: 207938 - DNA, 22 bp, Artificial Sequence
  Synthetic oligonucleotide; TTT chr2 60543384 60543405 60543401 60543406 +
ttgtgacacaattcaaatatct

SEQ ID NO: 207939 - DNA, 22 bp, Artificial Sequence
  Synthetic oligonucleotide; TTT chr2 60543385 60543406 60543402 60543407 +
tgtgacacaattcaaatatcta

SEQ ID NO: 207940 - DNA, 22 bp, Artificial Sequence
  Synthetic oligonucleotide; TTT chr2 60543386 60543407 60543403 60543408 +
gtgacacaattcaaatatctac

SEQ ID NO: 207941 - DNA, 22 bp, Artificial Sequence
  Synthetic oligonucleotide; TTG chr2 60543387 60543408 60543404 60543409 +
tgacacaattcaaatatctact

SEQ ID NO: 207942 - DNA, 22 bp, Artificial Sequence
  Synthetic oligonucleotide; TTC chr2 60543398 60543419 60543415 60543420 +
aaatatctactgaatgattact

SEQ ID NO: 207943 - DNA, 22 bp, Artificial Sequence
  Synthetic oligonucleotide; CTA chr2 60543407 60543428 60543424 60543429 +
ctgaatgattactgttattgtt

SEQ ID NO: 207944 - DNA, 22 bp, Artificial Sequence
  Synthetic oligonucleotide; CTG chr2 60543410 60543431 60543427 60543432 +
aatgattactgttattgtttcc

SEQ ID NO: 207945 - DNA, 22 bp, Artificial Sequence
  Synthetic oligonucleotide; TTA chr2 60543418 60543439 60543435 60543440 +
ctgttattgtttccttcctcat

SEQ ID NO: 207946 - DNA, 22 bp, Artificial Sequence
  Synthetic oligonucleotide; CTG chr2 60543421 60543442 60543438 60543443 +
ttattgtttccttcctcatcat

SEQ ID NO: 207947 - DNA, 22 bp, Artificial Sequence
  Synthetic oligonucleotide; TTA chr2 60543424 60543445 60543441 60543446 +
ttgtttccttcctcatcataaa

SEQ ID NO: 207948 - DNA, 22 bp, Artificial Sequence
  Synthetic oligonucleotide; TTG chr2 60543427 60543448 60543444 60543449 +
tttccttcctcatcataaaaag

SEQ ID NO: 207949 - DNA, 22 bp, Artificial Sequence
  Synthetic oligonucleotide; TTT chr2 60543430 60543451 60543447 60543452 +
ccttcctcatcataaaaagaaa

SEQ ID NO: 207950 - DNA, 22 bp, Artificial Sequence
  Synthetic oligonucleotide; TTC chr2 60543431 60543452 60543448 60543453 +
cttcctcatcataaaaagaaaa

SEQ ID NO: 207951 - DNA, 22 bp, Artificial Sequence
  Synthetic oligonucleotide; CTT chr2 60543434 60543455 60543451 60543456 +
cctcatcataaaaagaaaagca

SEQ ID NO: 207952 - DNA, 22 bp, Artificial Sequence
  Synthetic oligonucleotide; TTC chr2 60543435 60543456 60543452 60543457 +
ctcatcataaaaagaaaagcag

SEQ ID NO: 207953 - DNA, 22 bp, Artificial Sequence
  Synthetic oligonucleotide; CTC chr2 60543438 60543459 60543455 60543460 +
atcataaaaagaaaagcagact

SEQ ID NO: 207954 - DNA, 22 bp, Artificial Sequence
  Synthetic oligonucleotide; CTT chr2 60543461 60543482 60543478 60543483 +
ggaattgtgcagacgtgcttta

SEQ ID NO: 207955 - DNA, 22 bp, Artificial Sequence
  Synthetic oligonucleotide; TTG chr2 60543462 60543483 60543479 60543484 +
gaattgtgcagacgtgctttag

SEQ ID NO: 207956 - DNA, 22 bp, Artificial Sequence
  Synthetic oligonucleotide; TTG chr2 60543468 60543489 60543485 60543490 +
tgcagacgtgctttagagaaat

SEQ ID NO: 207957 - DNA, 22 bp, Artificial Sequence
  Synthetic oligonucleotide; CTT chr2 60543481 60543502 60543498 60543503 +
tagagaaatgggctgggggtac

SEQ ID NO: 207958 - DNA, 22 bp, Artificial Sequence
  Synthetic oligonucleotide; TTT chr2 60543482 60543503 60543499 60543504 +
agagaaatgggctgggggtaca

SEQ ID NO: 207959 - DNA, 22 bp, Artificial Sequence
  Synthetic oligonucleotide; TTA chr2 60543483 60543504 60543500 60543505 +
gagaaatgggctgggggtacac

SEQ ID NO: 207960 - DNA, 22 bp, Artificial Sequence
  Synthetic oligonucleotide; CTG chr2 60543496 60543517 60543513 60543518 +
ggggtacacacacagccgtctt

SEQ ID NO: 207961 - DNA, 22 bp, Artificial Sequence
  Synthetic oligonucleotide; CTT chr2 60543518 60543539 60543535 60543540 +
ccagaacttcgcttcaggggca

SEQ ID NO: 207962 - DNA, 22 bp, Artificial Sequence
  Synthetic oligonucleotide; TTC chr2 60543519 60543540 60543536 60543541 +
cagaacttcgcttcaggggcac

SEQ ID NO: 207963 - DNA, 22 bp, Artificial Sequence
  Synthetic oligonucleotide; CTT chr2 60543527 60543548 60543544 60543549 +
cgcttcaggggcacctgagggc

SEQ ID NO: 207964 - DNA, 22 bp, Artificial Sequence
  Synthetic oligonucleotide; TTC chr2 60543528 60543549 60543545 60543550 +
gcttcaggggcacctgagggcc

SEQ ID NO: 207965 - DNA, 22 bp, Artificial Sequence
  Synthetic oligonucleotide; CTT chr2 60543532 60543553 60543549 60543554 +
caggggcacctgagggccagag

SEQ ID NO: 207966 - DNA, 22 bp, Artificial Sequence
  Synthetic oligonucleotide; TTC chr2 60543533 60543554 60543550 60543555 +
aggggcacctgagggccagagc

SEQ ID NO: 207967 - DNA, 22 bp, Artificial Sequence
  Synthetic oligonucleotide; CTG chr2 60543544 60543565 60543561 60543566 +
agggccagagcgtcggaattta

SEQ ID NO: 207968 - DNA, 22 bp, Artificial Sequence
  Synthetic oligonucleotide; TTT chr2 60543565 60543586 60543582 60543587 +
atgtgcaatggtagaatgttaa

SEQ ID NO: 207969 - DNA, 22 bp, Artificial Sequence
  Synthetic oligonucleotide; TTA chr2 60543566 60543587 60543583 60543588 +
tgtgcaatggtagaatgttaac

SEQ ID NO: 207970 - DNA, 22 bp, Artificial Sequence
  Synthetic oligonucleotide; TTA chr2 60543586 60543607 60543603 60543608 +
acttcaccataggaaactctta

SEQ ID NO: 207971 - DNA, 22 bp, Artificial Sequence
  Synthetic oligonucleotide; CTT chr2 60543590 60543611 60543607 60543612 +
caccataggaaactcttaattc

SEQ ID NO: 207972 - DNA, 22 bp, Artificial Sequence
  Synthetic oligonucleotide; TTC chr2 60543591 60543612 60543608 60543613 +
accataggaaactcttaattca

SEQ ID NO: 207973 - DNA, 22 bp, Artificial Sequence
  Synthetic oligonucleotide; CTC chr2 60543605 60543626 60543622 60543627 +
ttaattcattactgtgaattat

SEQ ID NO: 207974 - DNA, 22 bp, Artificial Sequence
  Synthetic oligonucleotide; CTT chr2 60543607 60543628 60543624 60543629 +
aattcattactgtgaattatga

SEQ ID NO: 207975 - DNA, 22 bp, Artificial Sequence
  Synthetic oligonucleotide; TTA chr2 60543608 60543629 60543625 60543630 +
attcattactgtgaattatgag

SEQ ID NO: 207976 - DNA, 22 bp, Artificial Sequence
  Synthetic oligonucleotide; TTC chr2 60543612 60543633 60543629 60543634 +
attactgtgaattatgagaagt

SEQ ID NO: 207977 - DNA, 22 bp, Artificial Sequence
  Synthetic oligonucleotide; TTA chr2 60543616 60543637 60543633 60543638 +
ctgtgaattatgagaagtcgtg

SEQ ID NO: 207978 - DNA, 22 bp, Artificial Sequence
  Synthetic oligonucleotide; CTG chr2 60543619 60543640 60543636 60543641 +
tgaattatgagaagtcgtgatt

SEQ ID NO: 207979 - DNA, 22 bp, Artificial Sequence
  Synthetic oligonucleotide; TTA chr2 60543626 60543647 60543643 60543648 +
tgagaagtcgtgattctagtta

SEQ ID NO: 207980 - DNA, 22 bp, Artificial Sequence
  Synthetic oligonucleotide; TTC chr2 60543642 60543663 60543659 60543664 +
tagttactgacatctcactttg

SEQ ID NO: 207981 - DNA, 22 bp, Artificial Sequence
  Synthetic oligonucleotide; CTA chr2 60543644 60543665 60543661 60543666 +
gttactgacatctcactttgag

SEQ ID NO: 207982 - DNA, 22 bp, Artificial Sequence
  Synthetic oligonucleotide; TTA chr2 60543648 60543669 60543665 60543670 +
ctgacatctcactttgagatgt

SEQ ID NO: 207983 - DNA, 22 bp, Artificial Sequence
  Synthetic oligonucleotide; CTG chr2 60543651 60543672 60543668 60543673 +
acatctcactttgagatgtgac

SEQ ID NO: 207984 - DNA, 22 bp, Artificial Sequence
  Synthetic oligonucleotide; CTC chr2 60543658 60543679 60543675 60543680 +
actttgagatgtgaccacacta

SEQ ID NO: 207985 - DNA, 22 bp, Artificial Sequence
  Synthetic oligonucleotide; CTT chr2 60543662 60543683 60543679 60543684 +
tgagatgtgaccacactattta

SEQ ID NO: 207986 - DNA, 22 bp, Artificial Sequence
  Synthetic oligonucleotide; TTT chr2 60543663 60543684 60543680 60543685 +
gagatgtgaccacactatttat

SEQ ID NO: 207987 - DNA, 22 bp, Artificial Sequence
  Synthetic oligonucleotide; TTG chr2 60543664 60543685 60543681 60543686 +
agatgtgaccacactatttatg

SEQ ID NO: 207988 - DNA, 22 bp, Artificial Sequence
  Synthetic oligonucleotide; CTA chr2 60543680 60543701 60543697 60543702 +
tttatgttcagccagttccagg

SEQ ID NO: 207989 - DNA, 22 bp, Artificial Sequence
  Synthetic oligonucleotide; TTT chr2 60543683 60543704 60543700 60543705 +
atgttcagccagttccagggtg

SEQ ID NO: 207990 - DNA, 22 bp, Artificial Sequence
  Synthetic oligonucleotide; TTA chr2 60543684 60543705 60543701 60543706 +
tgttcagccagttccagggtgg

SEQ ID NO: 207991 - DNA, 22 bp, Artificial Sequence
  Synthetic oligonucleotide; TTC chr2 60543689 60543710 60543706 60543711 +
agccagttccagggtgggaaca

SEQ ID NO: 207992 - DNA, 22 bp, Artificial Sequence
  Synthetic oligonucleotide; TTC chr2 60543698 60543719 60543715 60543720 +
cagggtgggaacaggtgattaa

SEQ ID NO: 207993 - DNA, 22 bp, Artificial Sequence
  Synthetic oligonucleotide; TTA chr2 60543719 60543740 60543736 60543741 +
aacacaatgaaagaaatcaaga

SEQ ID NO: 207994 - DNA, 22 bp, Artificial Sequence
  Synthetic oligonucleotide; CTT chr2 60543744 60543765 60543761 60543766 +
tgtaattattcatgcacgaaag

SEQ ID NO: 207995 - DNA, 22 bp, Artificial Sequence
  Synthetic oligonucleotide; TTT chr2 60543745 60543766 60543762 60543767 +
gtaattattcatgcacgaaagg

SEQ ID NO: 207996 - DNA, 22 bp, Artificial Sequence
  Synthetic oligonucleotide; TTG chr2 60543746 60543767 60543763 60543768 +
taattattcatgcacgaaaggt

SEQ ID NO: 207997 - DNA, 22 bp, Artificial Sequence
  Synthetic oligonucleotide; TTA chr2 60543752 60543773 60543769 60543774 +
ttcatgcacgaaaggtttacct

SEQ ID NO: 207998 - DNA, 22 bp, Artificial Sequence
  Synthetic oligonucleotide; TTC chr2 60543755 60543776 60543772 60543777 +
atgcacgaaaggtttacctcac

SEQ ID NO: 207999 - DNA, 22 bp, Artificial Sequence
  Synthetic oligonucleotide; TTT chr2 60543770 60543791 60543787 60543792 +
acctcacctgggtcacagcact

SEQ ID NO: 208000 - DNA, 22 bp, Artificial Sequence
  Synthetic oligonucleotide; TTA chr2 60543771 60543792 60543788 60543793 +
cctcacctgggtcacagcactt

SEQ ID NO: 208001 - DNA, 22 bp, Artificial Sequence
  Synthetic oligonucleotide; CTC chr2 60543775 60543796 60543792 60543797 +
acctgggtcacagcacttgttg

SEQ ID NO: 208002 - DNA, 22 bp, Artificial Sequence
  Synthetic oligonucleotide; CTG chr2 60543780 60543801 60543797 60543802 +
ggtcacagcacttgttgtgcgc

SEQ ID NO: 208003 - DNA, 22 bp, Artificial Sequence
  Synthetic oligonucleotide; CTT chr2 60543793 60543814 60543810 60543815 +
gttgtgcgcccattgaatatct

SEQ ID NO: 208004 - DNA, 22 bp, Artificial Sequence
  Synthetic oligonucleotide; TTG chr2 60543794 60543815 60543811 60543816 +
ttgtgcgcccattgaatatctt

SEQ ID NO: 208005 - DNA, 22 bp, Artificial Sequence
  Synthetic oligonucleotide; TTG chr2 60543797 60543818 60543814 60543819 +
tgcgcccattgaatatcttaga

SEQ ID NO: 208006 - DNA, 22 bp, Artificial Sequence
  Synthetic oligonucleotide; TTG chr2 60543808 60543829 60543825 60543830 +
aatatcttagacatcttagaga

SEQ ID NO: 208007 - DNA, 22 bp, Artificial Sequence
  Synthetic oligonucleotide; CTT chr2 60543816 60543837 60543833 60543838 +
agacatcttagagagcttttcg

SEQ ID NO: 208008 - DNA, 22 bp, Artificial Sequence
  Synthetic oligonucleotide; TTA chr2 60543817 60543838 60543834 60543839 +
gacatcttagagagcttttcgt

SEQ ID NO: 208009 - DNA, 22 bp, Artificial Sequence
  Synthetic oligonucleotide; CTT chr2 60543825 60543846 60543842 60543847 +
agagagcttttcgtctcagtta

SEQ ID NO: 208010 - DNA, 22 bp, Artificial Sequence
  Synthetic oligonucleotide; TTA chr2 60543826 60543847 60543843 60543848 +
gagagcttttcgtctcagttaa

SEQ ID NO: 208011 - DNA, 22 bp, Artificial Sequence
  Synthetic oligonucleotide; CTT chr2 60543834 60543855 60543851 60543856 +
ttcgtctcagttaaatgattga

SEQ ID NO: 208012 - DNA, 22 bp, Artificial Sequence
  Synthetic oligonucleotide; TTT chr2 60543835 60543856 60543852 60543857 +
tcgtctcagttaaatgattgat

SEQ ID NO: 208013 - DNA, 22 bp, Artificial Sequence
  Synthetic oligonucleotide; TTT chr2 60543836 60543857 60543853 60543858 +
cgtctcagttaaatgattgatt

SEQ ID NO: 208014 - DNA, 22 bp, Artificial Sequence
  Synthetic oligonucleotide; TTC chr2 60543837 60543858 60543854 60543859 +
gtctcagttaaatgattgatta

SEQ ID NO: 208015 - DNA, 22 bp, Artificial Sequence
  Synthetic oligonucleotide; CTC chr2 60543842 60543863 60543859 60543864 +
agttaaatgattgattattagc

SEQ ID NO: 208016 - DNA, 22 bp, Artificial Sequence
  Synthetic oligonucleotide; TTA chr2 60543847 60543868 60543864 60543869 +
aatgattgattattagcgctat

SEQ ID NO: 208017 - DNA, 22 bp, Artificial Sequence
  Synthetic oligonucleotide; TTG chr2 60543855 60543876 60543872 60543877 +
attattagcgctataaaatata

SEQ ID NO: 208018 - DNA, 22 bp, Artificial Sequence
  Synthetic oligonucleotide; TTA chr2 60543859 60543880 60543876 60543881 +
ttagcgctataaaatatatttt

SEQ ID NO: 208019 - DNA, 22 bp, Artificial Sequence
  Synthetic oligonucleotide; TTA chr2 60543862 60543883 60543879 60543884 +
gcgctataaaatatattttaaa

SEQ ID NO: 208020 - DNA, 22 bp, Artificial Sequence
  Synthetic oligonucleotide; CTA chr2 60543868 60543889 60543885 60543890 +
taaaatatattttaaatttgct

SEQ ID NO: 208021 - DNA, 22 bp, Artificial Sequence
  Synthetic oligonucleotide; TTT chr2 60543880 60543901 60543897 60543902 +
taaatttgcttttggttttggc

SEQ ID NO: 208022 - DNA, 22 bp, Artificial Sequence
  Synthetic oligonucleotide; TTT chr2 60543881 60543902 60543898 60543903 +
aaatttgcttttggttttggct

SEQ ID NO: 208023 - DNA, 22 bp, Artificial Sequence
  Synthetic oligonucleotide; TTA chr2 60543882 60543903 60543899 60543904 +
aatttgcttttggttttggctt

SEQ ID NO: 208024 - DNA, 22 bp, Artificial Sequence
  Synthetic oligonucleotide; TTT chr2 60543887 60543908 60543904 60543909 +
gcttttggttttggcttctcta

SEQ ID NO: 208025 - DNA, 22 bp, Artificial Sequence
  Synthetic oligonucleotide; TTG chr2 60543888 60543909 60543905 60543910 +
cttttggttttggcttctctag

SEQ ID NO: 208026 - DNA, 22 bp, Artificial Sequence
  Synthetic oligonucleotide; CTT chr2 60543891 60543912 60543908 60543913 +
ttggttttggcttctctaggct

SEQ ID NO: 208027 - DNA, 22 bp, Artificial Sequence
  Synthetic oligonucleotide; TTT chr2 60543892 60543913 60543909 60543914 +
tggttttggcttctctaggctc

SEQ ID NO: 208028 - DNA, 22 bp, Artificial Sequence
  Synthetic oligonucleotide; TTT chr2 60543893 60543914 60543910 60543915 +
ggttttggcttctctaggctct

SEQ ID NO: 208029 - DNA, 22 bp, Artificial Sequence
  Synthetic oligonucleotide; TTG chr2 60543894 60543915 60543911 60543916 +
gttttggcttctctaggctctg

SEQ ID NO: 208030 - DNA, 22 bp, Artificial Sequence
  Synthetic oligonucleotide; TTT chr2 60543898 60543919 60543915 60543920 +
tggcttctctaggctctgctat

SEQ ID NO: 208031 - DNA, 22 bp, Artificial Sequence
  Synthetic oligonucleotide; TTT chr2 60543899 60543920 60543916 60543921 +
ggcttctctaggctctgctatt

SEQ ID NO: 208032 - DNA, 22 bp, Artificial Sequence
  Synthetic oligonucleotide; TTG chr2 60543900 60543921 60543917 60543922 +
gcttctctaggctctgctatta

SEQ ID NO: 208033 - DNA, 22 bp, Artificial Sequence
  Synthetic oligonucleotide; CTT chr2 60543904 60543925 60543921 60543926 +
ctctaggctctgctattatact

SEQ ID NO: 208034 - DNA, 22 bp, Artificial Sequence
  Synthetic oligonucleotide; TTC chr2 60543905 60543926 60543922 60543927 +
tctaggctctgctattatactt

SEQ ID NO: 208035 - DNA, 22 bp, Artificial Sequence
  Synthetic oligonucleotide; CTC chr2 60543907 60543928 60543924 60543929 +
taggctctgctattatacttgt

SEQ ID NO: 208036 - DNA, 22 bp, Artificial Sequence
  Synthetic oligonucleotide; CTA chr2 60543909 60543930 60543926 60543931 +
ggctctgctattatacttgttc

SEQ ID NO: 208037 - DNA, 22 bp, Artificial Sequence
  Synthetic oligonucleotide; CTC chr2 60543914 60543935 60543931 60543936 +
tgctattatacttgttctttaa

SEQ ID NO: 208038 - DNA, 22 bp, Artificial Sequence
  Synthetic oligonucleotide; CTG chr2 60543916 60543937 60543933 60543938 +
ctattatacttgttctttaaaa

SEQ ID NO: 208039 - DNA, 22 bp, Artificial Sequence
  Synthetic oligonucleotide; CTA chr2 60543919 60543940 60543936 60543941 +
ttatacttgttctttaaaaaaa

SEQ ID NO: 208040 - DNA, 22 bp, Artificial Sequence
  Synthetic oligonucleotide; TTA chr2 60543922 60543943 60543939 60543944 +
tacttgttctttaaaaaaataa

SEQ ID NO: 208041 - DNA, 22 bp, Artificial Sequence
  Synthetic oligonucleotide; CTT chr2 60543927 60543948 60543944 60543949 +
gttctttaaaaaaataataaca

SEQ ID NO: 208042 - DNA, 22 bp, Artificial Sequence
  Synthetic oligonucleotide; TTG chr2 60543928 60543949 60543945 60543950 +
ttctttaaaaaaataataacag

SEQ ID NO: 208043 - DNA, 22 bp, Artificial Sequence
  Synthetic oligonucleotide; TTC chr2 60543931 60543952 60543948 60543953 +
tttaaaaaaataataacagaac

SEQ ID NO: 208044 - DNA, 22 bp, Artificial Sequence
  Synthetic oligonucleotide; CTT chr2 60543933 60543954 60543950 60543955 +
taaaaaaataataacagaacct

SEQ ID NO: 208045 - DNA, 22 bp, Artificial Sequence
  Synthetic oligonucleotide; TTT chr2 60543934 60543955 60543951 60543956 +
aaaaaaataataacagaacctt

SEQ ID NO: 208046 - DNA, 22 bp, Artificial Sequence
  Synthetic oligonucleotide; TTA chr2 60543935 60543956 60543952 60543957 +
aaaaaataataacagaaccttt

SEQ ID NO: 208047 - DNA, 22 bp, Artificial Sequence
  Synthetic oligonucleotide; CTT chr2 60543956 60543977 60543973 60543978 +
tagacaaccagggagttcaagc

SEQ ID NO: 208048 - DNA, 22 bp, Artificial Sequence
  Synthetic oligonucleotide; TTT chr2 60543957 60543978 60543974 60543979 +
agacaaccagggagttcaagca

SEQ ID NO: 208049 - DNA, 22 bp, Artificial Sequence
  Synthetic oligonucleotide; TTA chr2 60543958 60543979 60543975 60543980 +
gacaaccagggagttcaagcaa

SEQ ID NO: 208050 - DNA, 22 bp, Artificial Sequence
  Synthetic oligonucleotide; TTC chr2 60543974 60543995 60543991 60543996 +
aagcaaatatctcttatttccc

SEQ ID NO: 208051 - DNA, 22 bp, Artificial Sequence
  Synthetic oligonucleotide; CTC chr2 60543987 60544008 60544004 60544009 +
ttatttccctacatagattcac

SEQ ID NO: 208052 - DNA, 22 bp, Artificial Sequence
  Synthetic oligonucleotide; CTT chr2 60543989 60544010 60544006 60544011 +
atttccctacatagattcacaa

SEQ ID NO: 208053 - DNA, 22 bp, Artificial Sequence
  Synthetic oligonucleotide; TTA chr2 60543990 60544011 60544007 60544012 +
tttccctacatagattcacaac

SEQ ID NO: 208054 - DNA, 22 bp, Artificial Sequence
  Synthetic oligonucleotide; TTT chr2 60543993 60544014 60544010 60544015 +
ccctacatagattcacaactat

SEQ ID NO: 208055 - DNA, 22 bp, Artificial Sequence
  Synthetic oligonucleotide; TTC chr2 60543994 60544015 60544011 60544016 +
cctacatagattcacaactata

SEQ ID NO: 208056 - DNA, 22 bp, Artificial Sequence
  Synthetic oligonucleotide; CTA chr2 60543998 60544019 60544015 60544020 +
catagattcacaactatagcag

SEQ ID NO: 208057 - DNA, 22 bp, Artificial Sequence
  Synthetic oligonucleotide; TTC chr2 60544007 60544028 60544024 60544029 +
acaactatagcagtaaaagtct

SEQ ID NO: 208058 - DNA, 22 bp, Artificial Sequence
  Synthetic oligonucleotide; CTA chr2 60544014 60544035 60544031 60544036 +
tagcagtaaaagtcttaactat

SEQ ID NO: 208059 - DNA, 22 bp, Artificial Sequence
  Synthetic oligonucleotide; CTT chr2 60544030 60544051 60544047 60544052 +
aactatatgtaaggccttcccc

SEQ ID NO: 208060 - DNA, 22 bp, Artificial Sequence
  Synthetic oligonucleotide; TTA chr2 60544031 60544052 60544048 60544053 +
actatatgtaaggccttccccc

SEQ ID NO: 208061 - DNA, 22 bp, Artificial Sequence
  Synthetic oligonucleotide; CTA chr2 60544035 60544056 60544052 60544057 +
tatgtaaggccttccccccagc

SEQ ID NO: 208062 - DNA, 22 bp, Artificial Sequence
  Synthetic oligonucleotide; CTT chr2 60544048 60544069 60544065 60544070 +
ccccccagcatttagattcctc

SEQ ID NO: 208063 - DNA, 22 bp, Artificial Sequence
  Synthetic oligonucleotide; TTC chr2 60544049 60544070 60544066 60544071 +
cccccagcatttagattcctcc

SEQ ID NO: 208064 - DNA, 22 bp, Artificial Sequence
  Synthetic oligonucleotide; TTT chr2 60544061 60544082 60544078 60544083 +
agattcctcctctaaatacaga

SEQ ID NO: 208065 - DNA, 22 bp, Artificial Sequence
  Synthetic oligonucleotide; TTA chr2 60544062 60544083 60544079 60544084 +
gattcctcctctaaatacagag

SEQ ID NO: 208066 - DNA, 22 bp, Artificial Sequence
  Synthetic oligonucleotide; TTC chr2 60544067 60544088 60544084 60544089 +
ctcctctaaatacagaggcaca

SEQ ID NO: 208067 - DNA, 22 bp, Artificial Sequence
  Synthetic oligonucleotide; CTC chr2 60544070 60544091 60544087 60544092 +
ctctaaatacagaggcacagaa

SEQ ID NO: 208068 - DNA, 22 bp, Artificial Sequence
  Synthetic oligonucleotide; CTC chr2 60544073 60544094 60544090 60544095 +
taaatacagaggcacagaattt

SEQ ID NO: 208069 - DNA, 22 bp, Artificial Sequence
  Synthetic oligonucleotide; CTA chr2 60544075 60544096 60544092 60544097 +
aatacagaggcacagaattttt

SEQ ID NO: 208070 - DNA, 22 bp, Artificial Sequence
  Synthetic oligonucleotide; TTT chr2 60544095 60544116 60544112 60544117 +
ttgagctggttaatctaagact

SEQ ID NO: 208071 - DNA, 22 bp, Artificial Sequence
  Synthetic oligonucleotide; TTT chr2 60544096 60544117 60544113 60544118 +
tgagctggttaatctaagactg

SEQ ID NO: 208072 - DNA, 22 bp, Artificial Sequence
  Synthetic oligonucleotide; TTT chr2 60544097 60544118 60544114 60544119 +
gagctggttaatctaagactga

SEQ ID NO: 208073 - DNA, 22 bp, Artificial Sequence
  Synthetic oligonucleotide; TTG chr2 60544098 60544119 60544115 60544120 +
agctggttaatctaagactgaa

SEQ ID NO: 208074 - DNA, 22 bp, Artificial Sequence
  Synthetic oligonucleotide; CTG chr2 60544103 60544124 60544120 60544125 +
gttaatctaagactgaataacc

SEQ ID NO: 208075 - DNA, 22 bp, Artificial Sequence
  Synthetic oligonucleotide; TTA chr2 60544107 60544128 60544124 60544129 +
atctaagactgaataacctatt

SEQ ID NO: 208076 - DNA, 22 bp, Artificial Sequence
  Synthetic oligonucleotide; CTA chr2 60544112 60544133 60544129 60544134 +
agactgaataacctatttggga

SEQ ID NO: 208077 - DNA, 22 bp, Artificial Sequence
  Synthetic oligonucleotide; CTG chr2 60544118 60544139 60544135 60544140 +
aataacctatttgggacctcag

SEQ ID NO: 208078 - DNA, 22 bp, Artificial Sequence
  Synthetic oligonucleotide; CTA chr2 60544127 60544148 60544144 60544149 +
tttgggacctcagtaagaagtg

SEQ ID NO: 208079 - DNA, 22 bp, Artificial Sequence
  Synthetic oligonucleotide; TTT chr2 60544130 60544151 60544147 60544152 +
gggacctcagtaagaagtgtgg

SEQ ID NO: 208080 - DNA, 22 bp, Artificial Sequence
  Synthetic oligonucleotide; TTG chr2 60544131 60544152 60544148 60544153 +
ggacctcagtaagaagtgtggt

SEQ ID NO: 208081 - DNA, 22 bp, Artificial Sequence
  Synthetic oligonucleotide; CTC chr2 60544138 60544159 60544155 60544160 +
agtaagaagtgtggttttaatt

SEQ ID NO: 208082 - DNA, 22 bp, Artificial Sequence
  Synthetic oligonucleotide; TTT chr2 60544155 60544176 60544172 60544177 +
taattcttgcttgacagacact

SEQ ID NO: 208083 - DNA, 22 bp, Artificial Sequence
  Synthetic oligonucleotide; TTT chr2 60544156 60544177 60544173 60544178 +
aattcttgcttgacagacactg

SEQ ID NO: 208084 - DNA, 22 bp, Artificial Sequence
  Synthetic oligonucleotide; TTA chr2 60544157 60544178 60544174 60544179 +
attcttgcttgacagacactgt

SEQ ID NO: 208085 - DNA, 22 bp, Artificial Sequence
  Synthetic oligonucleotide; TTC chr2 60544161 60544182 60544178 60544183 +
ttgcttgacagacactgtgttt

SEQ ID NO: 208086 - DNA, 22 bp, Artificial Sequence
  Synthetic oligonucleotide; CTT chr2 60544163 60544184 60544180 60544185 +
gcttgacagacactgtgttttg

SEQ ID NO: 208087 - DNA, 22 bp, Artificial Sequence
  Synthetic oligonucleotide; TTG chr2 60544164 60544185 60544181 60544186 +
cttgacagacactgtgttttgt

SEQ ID NO: 208088 - DNA, 22 bp, Artificial Sequence
  Synthetic oligonucleotide; CTT chr2 60544167 60544188 60544184 60544189 +
gacagacactgtgttttgtctt

SEQ ID NO: 208089 - DNA, 22 bp, Artificial Sequence
  Synthetic oligonucleotide; TTG chr2 60544168 60544189 60544185 60544190 +
acagacactgtgttttgtcttt

SEQ ID NO: 208090 - DNA, 22 bp, Artificial Sequence
  Synthetic oligonucleotide; CTG chr2 60544178 60544199 60544195 60544200 +
tgttttgtcttttaaacgagca

SEQ ID NO: 208091 - DNA, 22 bp, Artificial Sequence
  Synthetic oligonucleotide; TTT chr2 60544183 60544204 60544200 60544205 +
tgtcttttaaacgagcagctcg

SEQ ID NO: 208092 - DNA, 22 bp, Artificial Sequence
  Synthetic oligonucleotide; TTT chr2 60544184 60544205 60544201 60544206 +
gtcttttaaacgagcagctcga

SEQ ID NO: 208093 - DNA, 22 bp, Artificial Sequence
  Synthetic oligonucleotide; TTG chr2 60544185 60544206 60544202 60544207 +
tcttttaaacgagcagctcgat

SEQ ID NO: 208094 - DNA, 22 bp, Artificial Sequence
  Synthetic oligonucleotide; CTT chr2 60544189 60544210 60544206 60544211 +
ttaaacgagcagctcgatatgt

SEQ ID NO: 208095 - DNA, 22 bp, Artificial Sequence
  Synthetic oligonucleotide; TTT chr2 60544190 60544211 60544207 60544212 +
taaacgagcagctcgatatgta

SEQ ID NO: 208096 - DNA, 22 bp, Artificial Sequence
  Synthetic oligonucleotide; TTT chr2 60544191 60544212 60544208 60544213 +
aaacgagcagctcgatatgtaa

SEQ ID NO: 208097 - DNA, 22 bp, Artificial Sequence
  Synthetic oligonucleotide; TTA chr2 60544192 60544213 60544209 60544214 +
aacgagcagctcgatatgtaaa

SEQ ID NO: 208098 - DNA, 22 bp, Artificial Sequence
  Synthetic oligonucleotide; CTC chr2 60544204 60544225 60544221 60544226 +
gatatgtaaatacgatgttaca

SEQ ID NO: 208099 - DNA, 22 bp, Artificial Sequence
  Synthetic oligonucleotide; TTA chr2 60544224 60544245 60544241 60544246 +
catcacgcaagtgttactccat

SEQ ID NO: 208100 - DNA, 22 bp, Artificial Sequence
  Synthetic oligonucleotide; TTA chr2 60544240 60544261 60544257 60544262 +
ctccatatttggtgatttagca

SEQ ID NO: 208101 - DNA, 22 bp, Artificial Sequence
  Synthetic oligonucleotide; CTC chr2 60544243 60544264 60544260 60544265 +
catatttggtgatttagcaagg

SEQ ID NO: 208102 - DNA, 22 bp, Artificial Sequence
  Synthetic oligonucleotide; TTT chr2 60544250 60544271 60544267 60544272 +
ggtgatttagcaaggctttgga

SEQ ID NO: 208103 - DNA, 22 bp, Artificial Sequence
  Synthetic oligonucleotide; TTG chr2 60544251 60544272 60544268 60544273 +
gtgatttagcaaggctttggat

SEQ ID NO: 208104 - DNA, 22 bp, Artificial Sequence
  Synthetic oligonucleotide; TTT chr2 60544258 60544279 60544275 60544280 +
agcaaggctttggatctccgaa

SEQ ID NO: 208105 - DNA, 22 bp, Artificial Sequence
  Synthetic oligonucleotide; TTA chr2 60544259 60544280 60544276 60544281 +
gcaaggctttggatctccgaag

SEQ ID NO: 208106 - DNA, 22 bp, Artificial Sequence
  Synthetic oligonucleotide; CTT chr2 60544268 60544289 60544285 60544290 +
tggatctccgaagacgacaaat

SEQ ID NO: 208107 - DNA, 22 bp, Artificial Sequence
  Synthetic oligonucleotide; TTT chr2 60544269 60544290 60544286 60544291 +
ggatctccgaagacgacaaatc

SEQ ID NO: 208108 - DNA, 22 bp, Artificial Sequence
  Synthetic oligonucleotide; TTG chr2 60544270 60544291 60544287 60544292 +
gatctccgaagacgacaaatcc

SEQ ID NO: 208109 - DNA, 22 bp, Artificial Sequence
  Synthetic oligonucleotide; CTC chr2 60544276 60544297 60544293 60544298 +
cgaagacgacaaatccccttcc

SEQ ID NO: 208110 - DNA, 22 bp, Artificial Sequence
  Synthetic oligonucleotide; CTT chr2 60544296 60544317 60544313 60544318 +
ccgcctgctcttgcttcattaa

SEQ ID NO: 208111 - DNA, 22 bp, Artificial Sequence
  Synthetic oligonucleotide; TTC chr2 60544297 60544318 60544314 60544319 +
cgcctgctcttgcttcattaat

SEQ ID NO: 208112 - DNA, 22 bp, Artificial Sequence
  Synthetic oligonucleotide; CTG chr2 60544303 60544324 60544320 60544325 +
ctcttgcttcattaatcatgcc

SEQ ID NO: 208113 - DNA, 22 bp, Artificial Sequence
  Synthetic oligonucleotide; CTC chr2 60544306 60544327 60544323 60544328 +
ttgcttcattaatcatgcctta

SEQ ID NO: 208114 - DNA, 22 bp, Artificial Sequence
  Synthetic oligonucleotide; CTT chr2 60544308 60544329 60544325 60544330 +
gcttcattaatcatgccttaca

SEQ ID NO: 208115 - DNA, 22 bp, Artificial Sequence
  Synthetic oligonucleotide; TTG chr2 60544309 60544330 60544326 60544331 +
cttcattaatcatgccttacac

SEQ ID NO: 208116 - DNA, 22 bp, Artificial Sequence
  Synthetic oligonucleotide; CTT chr2 60544312 60544333 60544329 60544334 +
cattaatcatgccttacacttc

SEQ ID NO: 208117 - DNA, 22 bp, Artificial Sequence
  Synthetic oligonucleotide; TTC chr2 60544313 60544334 60544330 60544335 +
attaatcatgccttacacttct

SEQ ID NO: 208118 - DNA, 22 bp, Artificial Sequence
  Synthetic oligonucleotide; TTA chr2 60544317 60544338 60544334 60544339 +
atcatgccttacacttctgttc

SEQ ID NO: 208119 - DNA, 22 bp, Artificial Sequence
  Synthetic oligonucleotide; CTT chr2 60544327 60544348 60544344 60544349 +
acacttctgttcattttccttc

SEQ ID NO: 208120 - DNA, 22 bp, Artificial Sequence
  Synthetic oligonucleotide; TTA chr2 60544328 60544349 60544345 60544350 +
cacttctgttcattttccttcc

SEQ ID NO: 208121 - DNA, 22 bp, Artificial Sequence
  Synthetic oligonucleotide; CTT chr2 60544333 60544354 60544350 60544355 +
ctgttcattttccttccagtca

SEQ ID NO: 208122 - DNA, 22 bp, Artificial Sequence
  Synthetic oligonucleotide; TTC chr2 60544334 60544355 60544351 60544356 +
tgttcattttccttccagtcac

SEQ ID NO: 208123 - DNA, 22 bp, Artificial Sequence
  Synthetic oligonucleotide; CTG chr2 60544336 60544357 60544353 60544358 +
ttcattttccttccagtcacaa

SEQ ID NO: 208124 - DNA, 22 bp, Artificial Sequence
  Synthetic oligonucleotide; TTC chr2 60544339 60544360 60544356 60544361 +
attttccttccagtcacaagac

SEQ ID NO: 208125 - DNA, 22 bp, Artificial Sequence
  Synthetic oligonucleotide; TTT chr2 60544343 60544364 60544360 60544365 +
tccttccagtcacaagacaaca

SEQ ID NO: 208126 - DNA, 22 bp, Artificial Sequence
  Synthetic oligonucleotide; TTT chr2 60544344 60544365 60544361 60544366 +
ccttccagtcacaagacaacac

SEQ ID NO: 208127 - DNA, 22 bp, Artificial Sequence
  Synthetic oligonucleotide; TTC chr2 60544345 60544366 60544362 60544367 +
cttccagtcacaagacaacaca

SEQ ID NO: 208128 - DNA, 22 bp, Artificial Sequence
  Synthetic oligonucleotide; CTT chr2 60544348 60544369 60544365 60544370 +
ccagtcacaagacaacacatgg

SEQ ID NO: 208129 - DNA, 22 bp, Artificial Sequence
  Synthetic oligonucleotide; TTC chr2 60544349 60544370 60544366 60544371 +
cagtcacaagacaacacatgga

SEQ ID NO: 208130 - DNA, 22 bp, Artificial Sequence
  Synthetic oligonucleotide; TTC chr2 60544382 60544403 60544399 60544404 +
ccacatcctgctggggggtagg

SEQ ID NO: 208131 - DNA, 22 bp, Artificial Sequence
  Synthetic oligonucleotide; CTG chr2 60544392 60544413 60544409 60544414 +
ctggggggtaggggagataaaa

SEQ ID NO: 208132 - DNA, 22 bp, Artificial Sequence
  Synthetic oligonucleotide; CTG chr2 60544395 60544416 60544412 60544417 +
gggggtaggggagataaaatct

SEQ ID NO: 208133 - DNA, 22 bp, Artificial Sequence
  Synthetic oligonucleotide; CTT chr2 60544418 60544439 60544435 60544440 +
cacctacatgtcacataaggta

SEQ ID NO: 208134 - DNA, 22 bp, Artificial Sequence
  Synthetic oligonucleotide; TTC chr2 60544419 60544440 60544436 60544441 +
acctacatgtcacataaggtaa

SEQ ID NO: 208135 - DNA, 22 bp, Artificial Sequence
  Synthetic oligonucleotide; CTA chr2 60544424 60544445 60544441 60544446 +
catgtcacataaggtaaatgtg

SEQ ID NO: 208136 - DNA, 22 bp, Artificial Sequence
  Synthetic oligonucleotide; TTC chr2 60544454 60544475 60544471 60544476 +
aagaaatacactccacaaatgc

SEQ ID NO: 208137 - DNA, 22 bp, Artificial Sequence
  Synthetic oligonucleotide; CTC chr2 60544467 60544488 60544484 60544489 +
cacaaatgcagcttccctagca

SEQ ID NO: 208138 - DNA, 22 bp, Artificial Sequence
  Synthetic oligonucleotide; CTT chr2 60544481 60544502 60544498 60544503 +
ccctagcagcagatttcccatt

SEQ ID NO: 208139 - DNA, 22 bp, Artificial Sequence
  Synthetic oligonucleotide; TTC chr2 60544482 60544503 60544499 60544504 +
cctagcagcagatttcccattt

SEQ ID NO: 208140 - DNA, 22 bp, Artificial Sequence
  Synthetic oligonucleotide; CTA chr2 60544486 60544507 60544503 60544508 +
gcagcagatttcccatttcact

SEQ ID NO: 208141 - DNA, 22 bp, Artificial Sequence
  Synthetic oligonucleotide; TTT chr2 60544497 60544518 60544514 60544519 +
cccatttcactaaagggaaagt

SEQ ID NO: 208142 - DNA, 22 bp, Artificial Sequence
  Synthetic oligonucleotide; TTC chr2 60544498 60544519 60544515 60544520 +
ccatttcactaaagggaaagta

SEQ ID NO: 208143 - DNA, 22 bp, Artificial Sequence
  Synthetic oligonucleotide; TTT chr2 60544504 60544525 60544521 60544526 +
cactaaagggaaagtatctgag

SEQ ID NO: 208144 - DNA, 22 bp, Artificial Sequence
  Synthetic oligonucleotide; TTC chr2 60544505 60544526 60544522 60544527 +
actaaagggaaagtatctgagt

SEQ ID NO: 208145 - DNA, 22 bp, Artificial Sequence
  Synthetic oligonucleotide; CTA chr2 60544509 60544530 60544526 60544531 +
aagggaaagtatctgagtgcta

SEQ ID NO: 208146 - DNA, 22 bp, Artificial Sequence
  Synthetic oligonucleotide; CTG chr2 60544524 60544545 60544541 60544546 +
agtgctatcacagaaagcacta

SEQ ID NO: 208147 - DNA, 22 bp, Artificial Sequence
  Synthetic oligonucleotide; CTA chr2 60544531 60544552 60544548 60544553 +
tcacagaaagcactaaaaaaag

SEQ ID NO: 208148 - DNA, 22 bp, Artificial Sequence
  Synthetic oligonucleotide; CTA chr2 60544546 60544567 60544563 60544568 +
aaaaaagaaagaaaatgccatg

SEQ ID NO: 208149 - DNA, 22 bp, Artificial Sequence
  Synthetic oligonucleotide; TTT chr2 60544571 60544592 60544588 60544593 +
ggttttaatgatcaaattctag

SEQ ID NO: 208150 - DNA, 22 bp, Artificial Sequence
  Synthetic oligonucleotide; TTG chr2 60544572 60544593 60544589 60544594 +
gttttaatgatcaaattctaga

SEQ ID NO: 208151 - DNA, 22 bp, Artificial Sequence
  Synthetic oligonucleotide; TTT chr2 60544576 60544597 60544593 60544598 +
taatgatcaaattctagagggg

SEQ ID NO: 208152 - DNA, 22 bp, Artificial Sequence
  Synthetic oligonucleotide; TTT chr2 60544577 60544598 60544594 60544599 +
aatgatcaaattctagaggggg

SEQ ID NO: 208153 - DNA, 22 bp, Artificial Sequence
  Synthetic oligonucleotide; TTA chr2 60544578 60544599 60544595 60544600 +
atgatcaaattctagaggggga

SEQ ID NO: 208154 - DNA, 22 bp, Artificial Sequence
  Synthetic oligonucleotide; TTC chr2 60544590 60544611 60544607 60544612 +
tagagggggagaggagaaataa

SEQ ID NO: 208155 - DNA, 22 bp, Artificial Sequence
  Synthetic oligonucleotide; CTA chr2 60544592 60544613 60544609 60544614 +
gagggggagaggagaaataata

SEQ ID NO: 208156 - DNA, 22 bp, Artificial Sequence
  Synthetic oligonucleotide; TTT chr2 60544622 60544643 60544639 60544644 +
aatcccctctagaccactgacc

SEQ ID NO: 208157 - DNA, 22 bp, Artificial Sequence
  Synthetic oligonucleotide; TTA chr2 60544623 60544644 60544640 60544645 +
atcccctctagaccactgacct

SEQ ID NO: 208158 - DNA, 22 bp, Artificial Sequence
  Synthetic oligonucleotide; CTC chr2 60544631 60544652 60544648 60544653 +
tagaccactgacctattatggt

SEQ ID NO: 208159 - DNA, 22 bp, Artificial Sequence
  Synthetic oligonucleotide; CTA chr2 60544633 60544654 60544650 60544655 +
gaccactgacctattatggttc

SEQ ID NO: 208160 - DNA, 22 bp, Artificial Sequence
  Synthetic oligonucleotide; CTG chr2 60544641 60544662 60544658 60544663 +
acctattatggttcaactttgt

SEQ ID NO: 208161 - DNA, 22 bp, Artificial Sequence
  Synthetic oligonucleotide; CTA chr2 60544646 60544667 60544663 60544668 +
ttatggttcaactttgtggtca

SEQ ID NO: 208162 - DNA, 22 bp, Artificial Sequence
  Synthetic oligonucleotide; TTA chr2 60544649 60544670 60544666 60544671 +
tggttcaactttgtggtcaaac

SEQ ID NO: 208163 - DNA, 22 bp, Artificial Sequence
  Synthetic oligonucleotide; TTC chr2 60544655 60544676 60544672 60544677 +
aactttgtggtcaaactaggtc

SEQ ID NO: 208164 - DNA, 22 bp, Artificial Sequence
  Synthetic oligonucleotide; CTT chr2 60544660 60544681 60544677 60544682 +
tgtggtcaaactaggtcggaga

SEQ ID NO: 208165 - DNA, 22 bp, Artificial Sequence
  Synthetic oligonucleotide; TTT chr2 60544661 60544682 60544678 60544683 +
gtggtcaaactaggtcggagag

SEQ ID NO: 208166 - DNA, 22 bp, Artificial Sequence
  Synthetic oligonucleotide; TTG chr2 60544662 60544683 60544679 60544684 +
tggtcaaactaggtcggagaga

SEQ ID NO: 208167 - DNA, 22 bp, Artificial Sequence
  Synthetic oligonucleotide; CTA chr2 60544673 60544694 60544690 60544695 +
ggtcggagagacaagttccagt

SEQ ID NO: 208168 - DNA, 22 bp, Artificial Sequence
  Synthetic oligonucleotide; TTC chr2 60544691 60544712 60544708 60544713 +
cagtgaatcaattcatgatatg

SEQ ID NO: 208169 - DNA, 22 bp, Artificial Sequence
  Synthetic oligonucleotide; TTC chr2 60544705 60544726 60544722 60544727 +
atgatatgcactacctttccta

SEQ ID NO: 208170 - DNA, 22 bp, Artificial Sequence
  Synthetic oligonucleotide; CTA chr2 60544718 60544739 60544735 60544740 +
cctttcctaaaactgaacaaac

SEQ ID NO: 208171 - DNA, 22 bp, Artificial Sequence
  Synthetic oligonucleotide; CTT chr2 60544722 60544743 60544739 60544744 +
tcctaaaactgaacaaacctct

SEQ ID NO: 208172 - DNA, 22 bp, Artificial Sequence
  Synthetic oligonucleotide; TTT chr2 60544723 60544744 60544740 60544745 +
cctaaaactgaacaaacctctt

SEQ ID NO: 208173 - DNA, 22 bp, Artificial Sequence
  Synthetic oligonucleotide; TTC chr2 60544724 60544745 60544741 60544746 +
ctaaaactgaacaaacctcttg

SEQ ID NO: 208174 - DNA, 22 bp, Artificial Sequence
  Synthetic oligonucleotide; CTA chr2 60544727 60544748 60544744 60544749 +
aaactgaacaaacctcttgcct

SEQ ID NO: 208175 - DNA, 22 bp, Artificial Sequence
  Synthetic oligonucleotide; CTG chr2 60544733 60544754 60544750 60544755 +
aacaaacctcttgcctttcggg

SEQ ID NO: 208176 - DNA, 22 bp, Artificial Sequence
  Synthetic oligonucleotide; CTC chr2 60544743 60544764 60544760 60544765 +
ttgcctttcgggagctgggtgg

SEQ ID NO: 208177 - DNA, 22 bp, Artificial Sequence
  Synthetic oligonucleotide; CTT chr2 60544745 60544766 60544762 60544767 +
gcctttcgggagctgggtggta

SEQ ID NO: 208178 - DNA, 22 bp, Artificial Sequence
  Synthetic oligonucleotide; TTG chr2 60544746 60544767 60544763 60544768 +
cctttcgggagctgggtggtag

SEQ ID NO: 208179 - DNA, 22 bp, Artificial Sequence
  Synthetic oligonucleotide; CTT chr2 60544750 60544771 60544767 60544772 +
tcgggagctgggtggtaggtag

SEQ ID NO: 208180 - DNA, 22 bp, Artificial Sequence
  Synthetic oligonucleotide; TTT chr2 60544751 60544772 60544768 60544773 +
cgggagctgggtggtaggtaga

SEQ ID NO: 208181 - DNA, 22 bp, Artificial Sequence
  Synthetic oligonucleotide; TTC chr2 60544752 60544773 60544769 60544774 +
gggagctgggtggtaggtagat

SEQ ID NO: 208182 - DNA, 22 bp, Artificial Sequence
  Synthetic oligonucleotide; CTG chr2 60544760 60544781 60544777 60544782 +
ggtggtaggtagatggaagaaa

SEQ ID NO: 208183 - DNA, 22 bp, Artificial Sequence
  Synthetic oligonucleotide; CTG chr2 60544811 60544832 60544828 60544833 +
tcatcacagaatctgcattgac

SEQ ID NO: 208184 - DNA, 22 bp, Artificial Sequence
  Synthetic oligonucleotide; CTG chr2 60544826 60544847 60544843 60544848 +
cattgacttttgtctaacatgc

SEQ ID NO: 208185 - DNA, 22 bp, Artificial Sequence
  Synthetic oligonucleotide; TTG chr2 60544831 60544852 60544848 60544853 +
acttttgtctaacatgctcaag

SEQ ID NO: 208186 - DNA, 22 bp, Artificial Sequence
  Synthetic oligonucleotide; CTT chr2 60544835 60544856 60544852 60544857 +
ttgtctaacatgctcaagcaaa

SEQ ID NO: 208187 - DNA, 22 bp, Artificial Sequence
  Synthetic oligonucleotide; TTT chr2 60544836 60544857 60544853 60544858 +
tgtctaacatgctcaagcaaaa

SEQ ID NO: 208188 - DNA, 22 bp, Artificial Sequence
  Synthetic oligonucleotide; TTT chr2 60544837 60544858 60544854 60544859 +
gtctaacatgctcaagcaaaaa

SEQ ID NO: 208189 - DNA, 22 bp, Artificial Sequence
  Synthetic oligonucleotide; TTG chr2 60544838 60544859 60544855 60544860 +
tctaacatgctcaagcaaaaaa

SEQ ID NO: 208190 - DNA, 22 bp, Artificial Sequence
  Synthetic oligonucleotide; CTA chr2 60544842 60544863 60544859 60544864 +
acatgctcaagcaaaaaatgtt

SEQ ID NO: 208191 - DNA, 22 bp, Artificial Sequence
  Synthetic oligonucleotide; CTC chr2 60544850 60544871 60544867 60544872 +
aagcaaaaaatgttttgagggt

SEQ ID NO: 208192 - DNA, 22 bp, Artificial Sequence
  Synthetic oligonucleotide; TTT chr2 60544865 60544886 60544882 60544887 +
tgagggtcactatatagtgtta

SEQ ID NO: 208193 - DNA, 22 bp, Artificial Sequence
  Synthetic oligonucleotide; TTT chr2 60544866 60544887 60544883 60544888 +
gagggtcactatatagtgttac

SEQ ID NO: 208194 - DNA, 22 bp, Artificial Sequence
  Synthetic oligonucleotide; TTG chr2 60544867 60544888 60544884 60544889 +
agggtcactatatagtgttact

SEQ ID NO: 208195 - DNA, 22 bp, Artificial Sequence
  Synthetic oligonucleotide; CTA chr2 60544877 60544898 60544894 60544899 +
tatagtgttactgtttatcact

SEQ ID NO: 208196 - DNA, 22 bp, Artificial Sequence
  Synthetic oligonucleotide; TTA chr2 60544887 60544908 60544904 60544909 +
ctgtttatcacttagagaaggg

SEQ ID NO: 208197 - DNA, 22 bp, Artificial Sequence
  Synthetic oligonucleotide; CTG chr2 60544890 60544911 60544907 60544912 +
tttatcacttagagaagggaat

SEQ ID NO: 208198 - DNA, 22 bp, Artificial Sequence
  Synthetic oligonucleotide; TTT chr2 60544893 60544914 60544910 60544915 +
atcacttagagaagggaattta

SEQ ID NO: 208199 - DNA, 22 bp, Artificial Sequence
  Synthetic oligonucleotide; TTA chr2 60544894 60544915 60544911 60544916 +
tcacttagagaagggaatttaa

SEQ ID NO: 208200 - DNA, 22 bp, Artificial Sequence
  Synthetic oligonucleotide; CTT chr2 60544900 60544921 60544917 60544922 +
agagaagggaatttaagtccca

SEQ ID NO: 208201 - DNA, 22 bp, Artificial Sequence
  Synthetic oligonucleotide; TTA chr2 60544901 60544922 60544918 60544923 +
gagaagggaatttaagtcccac

SEQ ID NO: 208202 - DNA, 22 bp, Artificial Sequence
  Synthetic oligonucleotide; TTT chr2 60544914 60544935 60544931 60544936 +
aagtcccactgctagcctttaa

SEQ ID NO: 208203 - DNA, 22 bp, Artificial Sequence
  Synthetic oligonucleotide; TTA chr2 60544915 60544936 60544932 60544937 +
agtcccactgctagcctttaat

SEQ ID NO: 208204 - DNA, 22 bp, Artificial Sequence
  Synthetic oligonucleotide; CTG chr2 60544925 60544946 60544942 60544947 +
ctagcctttaattccttttccc

SEQ ID NO: 208205 - DNA, 22 bp, Artificial Sequence
  Synthetic oligonucleotide; CTA chr2 60544928 60544949 60544945 60544950 +
gcctttaattccttttcccttg

SEQ ID NO: 208206 - DNA, 22 bp, Artificial Sequence
  Synthetic oligonucleotide; CTT chr2 60544933 60544954 60544950 60544955 +
taattccttttcccttgagctg

SEQ ID NO: 208207 - DNA, 22 bp, Artificial Sequence
  Synthetic oligonucleotide; TTT chr2 60544934 60544955 60544951 60544956 +
aattccttttcccttgagctgc

SEQ ID NO: 208208 - DNA, 22 bp, Artificial Sequence
  Synthetic oligonucleotide; TTA chr2 60544935 60544956 60544952 60544957 +
attccttttcccttgagctgcc

SEQ ID NO: 208209 - DNA, 22 bp, Artificial Sequence
  Synthetic oligonucleotide; TTC chr2 60544939 60544960 60544956 60544961 +
cttttcccttgagctgccgaga

SEQ ID NO: 208210 - DNA, 22 bp, Artificial Sequence
  Synthetic oligonucleotide; CTT chr2 60544942 60544963 60544959 60544964 +
ttcccttgagctgccgagaaac

SEQ ID NO: 208211 - DNA, 22 bp, Artificial Sequence
  Synthetic oligonucleotide; TTT chr2 60544943 60544964 60544960 60544965 +
tcccttgagctgccgagaaacc

SEQ ID NO: 208212 - DNA, 22 bp, Artificial Sequence
  Synthetic oligonucleotide; TTT chr2 60544944 60544965 60544961 60544966 +
cccttgagctgccgagaaaccc

SEQ ID NO: 208213 - DNA, 22 bp, Artificial Sequence
  Synthetic oligonucleotide; TTC chr2 60544945 60544966 60544962 60544967 +
ccttgagctgccgagaaaccca

SEQ ID NO: 208214 - DNA, 22 bp, Artificial Sequence
  Synthetic oligonucleotide; CTT chr2 60544949 60544970 60544966 60544971 +
gagctgccgagaaacccacaca

SEQ ID NO: 208215 - DNA, 22 bp, Artificial Sequence
  Synthetic oligonucleotide; TTG chr2 60544950 60544971 60544967 60544972 +
agctgccgagaaacccacacac

SEQ ID NO: 208216 - DNA, 22 bp, Artificial Sequence
  Synthetic oligonucleotide; CTG chr2 60544955 60544976 60544972 60544977 +
ccgagaaacccacacacctagc

SEQ ID NO: 208217 - DNA, 22 bp, Artificial Sequence
  Synthetic oligonucleotide; CTA chr2 60544975 60544996 60544992 60544997 +
gctgcctccctgctaaaattaa

SEQ ID NO: 208218 - DNA, 22 bp, Artificial Sequence
  Synthetic oligonucleotide; CTG chr2 60544979 60545000 60544996 60545001 +
cctccctgctaaaattaaccaa

SEQ ID NO: 208219 - DNA, 22 bp, Artificial Sequence
  Synthetic oligonucleotide; CTC chr2 60544983 60545004 60545000 60545005 +
cctgctaaaattaaccaaagga

SEQ ID NO: 208220 - DNA, 22 bp, Artificial Sequence
  Synthetic oligonucleotide; CTG chr2 60544987 60545008 60545004 60545009 +
ctaaaattaaccaaaggaggga

SEQ ID NO: 208221 - DNA, 22 bp, Artificial Sequence
  Synthetic oligonucleotide; CTA chr2 60544990 60545011 60545007 60545012 +
aaattaaccaaaggagggaggg

SEQ ID NO: 208222 - DNA, 22 bp, Artificial Sequence
  Synthetic oligonucleotide; TTA chr2 60544996 60545017 60545013 60545018 +
accaaaggagggagggctgttg

SEQ ID NO: 208223 - DNA, 22 bp, Artificial Sequence
  Synthetic oligonucleotide; CTG chr2 60545015 60545036 60545032 60545037 +
ttgaatacgtgtgtgtattttt

SEQ ID NO: 208224 - DNA, 22 bp, Artificial Sequence
  Synthetic oligonucleotide; TTG chr2 60545018 60545039 60545035 60545040 +
aatacgtgtgtgtatttttcca

SEQ ID NO: 208225 - DNA, 22 bp, Artificial Sequence
  Synthetic oligonucleotide; TTT chr2 60545035 60545056 60545052 60545057 +
ttccaagaaaatttttacattg

SEQ ID NO: 208226 - DNA, 22 bp, Artificial Sequence
  Synthetic oligonucleotide; TTT chr2 60545036 60545057 60545053 60545058 +
tccaagaaaatttttacattgt

SEQ ID NO: 208227 - DNA, 22 bp, Artificial Sequence
  Synthetic oligonucleotide; TTT chr2 60545037 60545058 60545054 60545059 +
ccaagaaaatttttacattgtg

SEQ ID NO: 208228 - DNA, 22 bp, Artificial Sequence
  Synthetic oligonucleotide; TTC chr2 60545038 60545059 60545055 60545060 +
caagaaaatttttacattgtgt

SEQ ID NO: 208229 - DNA, 22 bp, Artificial Sequence
  Synthetic oligonucleotide; TTT chr2 60545049 60545070 60545066 60545071 +
ttacattgtgttatagcagaaa

SEQ ID NO: 208230 - DNA, 22 bp, Artificial Sequence
  Synthetic oligonucleotide; TTT chr2 60545050 60545071 60545067 60545072 +
tacattgtgttatagcagaaac

SEQ ID NO: 208231 - DNA, 22 bp, Artificial Sequence
  Synthetic oligonucleotide; TTT chr2 60545051 60545072 60545068 60545073 +
acattgtgttatagcagaaaca

SEQ ID NO: 208232 - DNA, 22 bp, Artificial Sequence
  Synthetic oligonucleotide; TTA chr2 60545052 60545073 60545069 60545074 +
cattgtgttatagcagaaacag

SEQ ID NO: 208233 - DNA, 22 bp, Artificial Sequence
  Synthetic oligonucleotide; TTG chr2 60545057 60545078 60545074 60545079 +
tgttatagcagaaacagtggag

SEQ ID NO: 208234 - DNA, 22 bp, Artificial Sequence
  Synthetic oligonucleotide; TTA chr2 60545062 60545083 60545079 60545084 +
tagcagaaacagtggagtctgg

SEQ ID NO: 208235 - DNA, 22 bp, Artificial Sequence
  Synthetic oligonucleotide; CTG chr2 60545083 60545104 60545100 60545105 +
gactggacatttgtaagggtga

SEQ ID NO: 208236 - DNA, 22 bp, Artificial Sequence
  Synthetic oligonucleotide; CTG chr2 60545088 60545109 60545105 60545110 +
gacatttgtaagggtgacatgt

SEQ ID NO: 208237 - DNA, 22 bp, Artificial Sequence
  Synthetic oligonucleotide; TTT chr2 60545095 60545116 60545112 60545117 +
gtaagggtgacatgtggctgtg

SEQ ID NO: 208238 - DNA, 22 bp, Artificial Sequence
  Synthetic oligonucleotide; TTG chr2 60545096 60545117 60545113 60545118 +
taagggtgacatgtggctgtgt

SEQ ID NO: 208239 - DNA, 22 bp, Artificial Sequence
  Synthetic oligonucleotide; CTG chr2 60545115 60545136 60545132 60545137 +
tgtaaaccacaaacaaaatcaa

SEQ ID NO: 208240 - DNA, 22 bp, Artificial Sequence
  Synthetic oligonucleotide; CTG chr2 60545147 60545168 60545164 60545169 +
tcaaaaccacatcagagacaag

SEQ ID NO: 208241 - DNA, 22 bp, Artificial Sequence
  Synthetic oligonucleotide; TTT chr2 60545190 60545211 60545207 60545212 +
atcatttagctgaggaggcagg

SEQ ID NO: 208242 - DNA, 22 bp, Artificial Sequence
  Synthetic oligonucleotide; TTA chr2 60545191 60545212 60545208 60545213 +
tcatttagctgaggaggcaggc

SEQ ID NO: 208243 - DNA, 22 bp, Artificial Sequence
  Synthetic oligonucleotide; TTT chr2 60545197 60545218 60545214 60545219 +
agctgaggaggcaggctgcagg

SEQ ID NO: 208244 - DNA, 22 bp, Artificial Sequence
  Synthetic oligonucleotide; TTA chr2 60545198 60545219 60545215 60545220 +
gctgaggaggcaggctgcaggg

SEQ ID NO: 208245 - DNA, 22 bp, Artificial Sequence
  Synthetic oligonucleotide; CTG chr2 60545202 60545223 60545219 60545224 +
aggaggcaggctgcagggagca

SEQ ID NO: 208246 - DNA, 22 bp, Artificial Sequence
  Synthetic oligonucleotide; CTG chr2 60545215 60545236 60545232 60545237 +
cagggagcagccgttcctgtca

SEQ ID NO: 208247 - DNA, 22 bp, Artificial Sequence
  Synthetic oligonucleotide; TTC chr2 60545231 60545252 60545248 60545253 +
ctgtcaaaccaaccttttgaaa

SEQ ID NO: 208248 - DNA, 22 bp, Artificial Sequence
  Synthetic oligonucleotide; CTG chr2 60545234 60545255 60545251 60545256 +
tcaaaccaaccttttgaaattt

SEQ ID NO: 208249 - DNA, 22 bp, Artificial Sequence
  Synthetic oligonucleotide; CTT chr2 60545247 60545268 60545264 60545269 +
ttgaaatttccaacatgccctt

SEQ ID NO: 208250 - DNA, 22 bp, Artificial Sequence
  Synthetic oligonucleotide; TTT chr2 60545248 60545269 60545265 60545270 +
tgaaatttccaacatgccctta

SEQ ID NO: 208251 - DNA, 22 bp, Artificial Sequence
  Synthetic oligonucleotide; TTT chr2 60545249 60545270 60545266 60545271 +
gaaatttccaacatgcccttaa

SEQ ID NO: 208252 - DNA, 22 bp, Artificial Sequence
  Synthetic oligonucleotide; TTG chr2 60545250 60545271 60545267 60545272 +
aaatttccaacatgcccttaaa

SEQ ID NO: 208253 - DNA, 22 bp, Artificial Sequence
  Synthetic oligonucleotide; TTT chr2 60545256 60545277 60545273 60545278 +
ccaacatgcccttaaacttttc

SEQ ID NO: 208254 - DNA, 22 bp, Artificial Sequence
  Synthetic oligonucleotide; TTC chr2 60545257 60545278 60545274 60545279 +
caacatgcccttaaacttttcg

SEQ ID NO: 208255 - DNA, 22 bp, Artificial Sequence
  Synthetic oligonucleotide; CTT chr2 60545269 60545290 60545286 60545291 +
aaacttttcgagtaagcatgtc

SEQ ID NO: 208256 - DNA, 22 bp, Artificial Sequence
  Synthetic oligonucleotide; TTA chr2 60545270 60545291 60545287 60545292 +
aacttttcgagtaagcatgtct

SEQ ID NO: 208257 - DNA, 22 bp, Artificial Sequence
  Synthetic oligonucleotide; CTT chr2 60545275 60545296 60545292 60545297 +
ttcgagtaagcatgtctgtgcg

SEQ ID NO: 208258 - DNA, 22 bp, Artificial Sequence
  Synthetic oligonucleotide; TTT chr2 60545276 60545297 60545293 60545298 +
tcgagtaagcatgtctgtgcgc

SEQ ID NO: 208259 - DNA, 22 bp, Artificial Sequence
  Synthetic oligonucleotide; TTT chr2 60545277 60545298 60545294 60545299 +
cgagtaagcatgtctgtgcgct

SEQ ID NO: 208260 - DNA, 22 bp, Artificial Sequence
  Synthetic oligonucleotide; TTC chr2 60545278 60545299 60545295 60545300 +
gagtaagcatgtctgtgcgctt

SEQ ID NO: 208261 - DNA, 22 bp, Artificial Sequence
  Synthetic oligonucleotide; CTG chr2 60545293 60545314 60545310 60545315 +
tgcgcttcagcaactgccctct

SEQ ID NO: 208262 - DNA, 22 bp, Artificial Sequence
  Synthetic oligonucleotide; CTT chr2 60545300 60545321 60545317 60545322 +
cagcaactgccctctctactct

SEQ ID NO: 208263 - DNA, 22 bp, Artificial Sequence
  Synthetic oligonucleotide; TTC chr2 60545301 60545322 60545318 60545323 +
agcaactgccctctctactctg

SEQ ID NO: 208264 - DNA, 22 bp, Artificial Sequence
  Synthetic oligonucleotide; CTG chr2 60545309 60545330 60545326 60545331 +
ccctctctactctggcctggcc

SEQ ID NO: 208265 - DNA, 22 bp, Artificial Sequence
  Synthetic oligonucleotide; CTC chr2 60545314 60545335 60545331 60545336 +
tctactctggcctggccagtcg

SEQ ID NO: 208266 - DNA, 22 bp, Artificial Sequence
  Synthetic oligonucleotide; CTC chr2 60545316 60545337 60545333 60545338 +
tactctggcctggccagtcgaa

SEQ ID NO: 208267 - DNA, 22 bp, Artificial Sequence
  Synthetic oligonucleotide; CTA chr2 60545318 60545339 60545335 60545340 +
ctctggcctggccagtcgaaaa

SEQ ID NO: 208268 - DNA, 22 bp, Artificial Sequence
  Synthetic oligonucleotide; CTC chr2 60545321 60545342 60545338 60545343 +
tggcctggccagtcgaaaatgg

SEQ ID NO: 208269 - DNA, 22 bp, Artificial Sequence
  Synthetic oligonucleotide; CTG chr2 60545323 60545344 60545340 60545345 +
gcctggccagtcgaaaatggca

SEQ ID NO: 208270 - DNA, 22 bp, Artificial Sequence
  Synthetic oligonucleotide; CTG chr2 60545328 60545349 60545345 60545350 +
gccagtcgaaaatggcatctta

SEQ ID NO: 208271 - DNA, 22 bp, Artificial Sequence
  Synthetic oligonucleotide; CTT chr2 60545349 60545370 60545366 60545371 +
aaagtcaaggtcatggtgtcat

SEQ ID NO: 208272 - DNA, 22 bp, Artificial Sequence
  Synthetic oligonucleotide; TTA chr2 60545350 60545371 60545367 60545372 +
aagtcaaggtcatggtgtcatc

SEQ ID NO: 208273 - DNA, 22 bp, Artificial Sequence
  Synthetic oligonucleotide; CTG chr2 60545386 60545407 60545403 60545408 +
tgtttaattacagccccatccg

SEQ ID NO: 208274 - DNA, 22 bp, Artificial Sequence
  Synthetic oligonucleotide; TTT chr2 60545391 60545412 60545408 60545413 +
aattacagccccatccgggctg

SEQ ID NO: 208275 - DNA, 22 bp, Artificial Sequence
  Synthetic oligonucleotide; TTA chr2 60545392 60545413 60545409 60545414 +
attacagccccatccgggctga

SEQ ID NO: 208276 - DNA, 22 bp, Artificial Sequence
  Synthetic oligonucleotide; TTA chr2 60545396 60545417 60545413 60545418 +
cagccccatccgggctgacagc

SEQ ID NO: 208277 - DNA, 22 bp, Artificial Sequence
  Synthetic oligonucleotide; CTG chr2 60545413 60545434 60545430 60545435 +
acagccaatatggatccaaggc

SEQ ID NO: 208278 - DNA, 22 bp, Artificial Sequence
  Synthetic oligonucleotide; CTA chr2 60545437 60545458 60545454 60545459 +
gccctgaagctcagttaactct

SEQ ID NO: 208279 - DNA, 22 bp, Artificial Sequence
  Synthetic oligonucleotide; CTG chr2 60545443 60545464 60545460 60545465 +
aagctcagttaactctttccac

SEQ ID NO: 208280 - DNA, 22 bp, Artificial Sequence
  Synthetic oligonucleotide; CTC chr2 60545449 60545470 60545466 60545471 +
agttaactctttccaccacctc

SEQ ID NO: 208281 - DNA, 22 bp, Artificial Sequence
  Synthetic oligonucleotide; TTA chr2 60545454 60545475 60545471 60545476 +
actctttccaccacctccaact

SEQ ID NO: 208282 - DNA, 22 bp, Artificial Sequence
  Synthetic oligonucleotide; CTC chr2 60545458 60545479 60545475 60545480 +
tttccaccacctccaactaccc

SEQ ID NO: 208283 - DNA, 22 bp, Artificial Sequence
  Synthetic oligonucleotide; CTT chr2 60545460 60545481 60545477 60545482 +
tccaccacctccaactaccctg

SEQ ID NO: 208284 - DNA, 22 bp, Artificial Sequence
  Synthetic oligonucleotide; TTT chr2 60545461 60545482 60545478 60545483 +
ccaccacctccaactaccctgc

SEQ ID NO: 208285 - DNA, 22 bp, Artificial Sequence
  Synthetic oligonucleotide; TTC chr2 60545462 60545483 60545479 60545484 +
caccacctccaactaccctgcc

SEQ ID NO: 208286 - DNA, 22 bp, Artificial Sequence
  Synthetic oligonucleotide; CTC chr2 60545471 60545492 60545488 60545493 +
caactaccctgccagcccactc

SEQ ID NO: 208287 - DNA, 22 bp, Artificial Sequence
  Synthetic oligonucleotide; CTA chr2 60545477 60545498 60545494 60545499 +
ccctgccagcccactctacttc

SEQ ID NO: 208288 - DNA, 22 bp, Artificial Sequence
  Synthetic oligonucleotide; CTG chr2 60545482 60545503 60545499 60545504 +
ccagcccactctacttcaggga

SEQ ID NO: 208289 - DNA, 22 bp, Artificial Sequence
  Synthetic oligonucleotide; CTC chr2 60545493 60545514 60545510 60545515 +
tacttcagggaagccttgagaa

SEQ ID NO: 208290 - DNA, 22 bp, Artificial Sequence
  Synthetic oligonucleotide; CTA chr2 60545495 60545516 60545512 60545517 +
cttcagggaagccttgagaacg

SEQ ID NO: 208291 - DNA, 22 bp, Artificial Sequence
  Synthetic oligonucleotide; CTT chr2 60545498 60545519 60545515 60545520 +
cagggaagccttgagaacgagc

SEQ ID NO: 208292 - DNA, 22 bp, Artificial Sequence
  Synthetic oligonucleotide; TTC chr2 60545499 60545520 60545516 60545521 +
agggaagccttgagaacgagct

SEQ ID NO: 208293 - DNA, 22 bp, Artificial Sequence
  Synthetic oligonucleotide; CTT chr2 60545510 60545531 60545527 60545532 +
gagaacgagctgaacccctaag

SEQ ID NO: 208294 - DNA, 22 bp, Artificial Sequence
  Synthetic oligonucleotide; TTG chr2 60545511 60545532 60545528 60545533 +
agaacgagctgaacccctaagg

SEQ ID NO: 208295 - DNA, 22 bp, Artificial Sequence
  Synthetic oligonucleotide; CTG chr2 60545522 60545543 60545539 60545544 +
aacccctaaggaggcctggcca

SEQ ID NO: 208296 - DNA, 22 bp, Artificial Sequence
  Synthetic oligonucleotide; CTA chr2 60545530 60545551 60545547 60545552 +
aggaggcctggccagatgttct

SEQ ID NO: 208297 - DNA, 22 bp, Artificial Sequence
  Synthetic oligonucleotide; CTG chr2 60545540 60545561 60545557 60545562 +
gccagatgttctgagtcaaaca

SEQ ID NO: 208298 - DNA, 22 bp, Artificial Sequence
  Synthetic oligonucleotide; TTC chr2 60545551 60545572 60545568 60545573 +
tgagtcaaacaagtcattggct

SEQ ID NO: 208299 - DNA, 22 bp, Artificial Sequence
  Synthetic oligonucleotide; CTG chr2 60545553 60545574 60545570 60545575 +
agtcaaacaagtcattggctga

SEQ ID NO: 208300 - DNA, 22 bp, Artificial Sequence
  Synthetic oligonucleotide; TTG chr2 60545570 60545591 60545587 60545592 +
gctgaactgcaaatgcctatat

SEQ ID NO: 208301 - DNA, 22 bp, Artificial Sequence
  Synthetic oligonucleotide; CTG chr2 60545574 60545595 60545591 60545596 +
aactgcaaatgcctatatggcc

SEQ ID NO: 208302 - DNA, 22 bp, Artificial Sequence
  Synthetic oligonucleotide; CTG chr2 60545579 60545600 60545596 60545601 +
caaatgcctatatggccacttt

SEQ ID NO: 208303 - DNA, 22 bp, Artificial Sequence
  Synthetic oligonucleotide; CTA chr2 60545589 60545610 60545606 60545611 +
tatggccactttgcctctgaca

SEQ ID NO: 208304 - DNA, 22 bp, Artificial Sequence
  Synthetic oligonucleotide; CTT chr2 60545600 60545621 60545617 60545622 +
tgcctctgacacgtcaccaagg

SEQ ID NO: 208305 - DNA, 22 bp, Artificial Sequence
  Synthetic oligonucleotide; TTT chr2 60545601 60545622 60545618 60545623 +
gcctctgacacgtcaccaaggc

SEQ ID NO: 208306 - DNA, 22 bp, Artificial Sequence
  Synthetic oligonucleotide; TTG chr2 60545602 60545623 60545619 60545624 +
cctctgacacgtcaccaaggct

SEQ ID NO: 208307 - DNA, 22 bp, Artificial Sequence
  Synthetic oligonucleotide; CTC chr2 60545606 60545627 60545623 60545628 +
tgacacgtcaccaaggctggaa

SEQ ID NO: 208308 - DNA, 22 bp, Artificial Sequence
  Synthetic oligonucleotide; CTG chr2 60545608 60545629 60545625 60545630 +
acacgtcaccaaggctggaaat

SEQ ID NO: 208309 - DNA, 22 bp, Artificial Sequence
  Synthetic oligonucleotide; CTG chr2 60545625 60545646 60545642 60545647 +
gaaatggacaatggaagctgga

SEQ ID NO: 208310 - DNA, 22 bp, Artificial Sequence
  Synthetic oligonucleotide; CTG chr2 60545645 60545666 60545662 60545667 +
gactaggtgtagtaaagctcaa

SEQ ID NO: 208311 - DNA, 22 bp, Artificial Sequence
  Synthetic oligonucleotide; CTA chr2 60545650 60545671 60545667 60545672 +
ggtgtagtaaagctcaatactt

SEQ ID NO: 208312 - DNA, 22 bp, Artificial Sequence
  Synthetic oligonucleotide; CTC chr2 60545665 60545686 60545682 60545687 +
aatacttcaaaatgagaaggtg

SEQ ID NO: 208313 - DNA, 22 bp, Artificial Sequence
  Synthetic oligonucleotide; CTT chr2 60545672 60545693 60545689 60545694 +
caaaatgagaaggtggggatgg

SEQ ID NO: 208314 - DNA, 22 bp, Artificial Sequence
  Synthetic oligonucleotide; TTC chr2 60545673 60545694 60545690 60545695 +
aaaatgagaaggtggggatggg

SEQ ID NO: 208315 - DNA, 22 bp, Artificial Sequence
  Synthetic oligonucleotide; CTG chr2 60545741 60545762 60545758 60545763 +
atgtgtgtacctatcctgccta

SEQ ID NO: 208316 - DNA, 22 bp, Artificial Sequence
  Synthetic oligonucleotide; CTA chr2 60545754 60545775 60545771 60545776 +
tcctgcctacatctgattcagt

SEQ ID NO: 208317 - DNA, 22 bp, Artificial Sequence
  Synthetic oligonucleotide; CTG chr2 60545759 60545780 60545776 60545781 +
cctacatctgattcagtgaggt

SEQ ID NO: 208318 - DNA, 22 bp, Artificial Sequence
  Synthetic oligonucleotide; CTA chr2 60545763 60545784 60545780 60545785 +
catctgattcagtgaggtggaa

SEQ ID NO: 208319 - DNA, 22 bp, Artificial Sequence
  Synthetic oligonucleotide; CTG chr2 60545769 60545790 60545786 60545791 +
attcagtgaggtggaaaatatt

SEQ ID NO: 208320 - DNA, 22 bp, Artificial Sequence
  Synthetic oligonucleotide; TTC chr2 60545773 60545794 60545790 60545795 +
agtgaggtggaaaatatttatt

SEQ ID NO: 208321 - DNA, 22 bp, Artificial Sequence
  Synthetic oligonucleotide; TTT chr2 60545792 60545813 60545809 60545814 +
atttttctgtgttctggacgta

SEQ ID NO: 208322 - DNA, 22 bp, Artificial Sequence
  Synthetic oligonucleotide; TTA chr2 60545793 60545814 60545810 60545815 +
tttttctgtgttctggacgtaa

SEQ ID NO: 208323 - DNA, 22 bp, Artificial Sequence
  Synthetic oligonucleotide; TTT chr2 60545796 60545817 60545813 60545818 +
ttctgtgttctggacgtaagca

SEQ ID NO: 208324 - DNA, 22 bp, Artificial Sequence
  Synthetic oligonucleotide; TTT chr2 60545797 60545818 60545814 60545819 +
tctgtgttctggacgtaagcaa

SEQ ID NO: 208325 - DNA, 22 bp, Artificial Sequence
  Synthetic oligonucleotide; TTT chr2 60545798 60545819 60545815 60545820 +
ctgtgttctggacgtaagcaac

SEQ ID NO: 208326 - DNA, 22 bp, Artificial Sequence
  Synthetic oligonucleotide; TTC chr2 60545799 60545820 60545816 60545821 +
tgtgttctggacgtaagcaaca

SEQ ID NO: 208327 - DNA, 22 bp, Artificial Sequence
  Synthetic oligonucleotide; CTG chr2 60545801 60545822 60545818 60545823 +
tgttctggacgtaagcaacaga

SEQ ID NO: 208328 - DNA, 22 bp, Artificial Sequence
  Synthetic oligonucleotide; TTC chr2 60545806 60545827 60545823 60545828 +
tggacgtaagcaacagaaatga

SEQ ID NO: 208329 - DNA, 22 bp, Artificial Sequence
  Synthetic oligonucleotide; CTG chr2 60545808 60545829 60545825 60545830 +
gacgtaagcaacagaaatgatt

SEQ ID NO: 208330 - DNA, 22 bp, Artificial Sequence
  Synthetic oligonucleotide; TTA chr2 60545831 60545852 60545848 60545853 +
ttttaacattacagggctgtca

SEQ ID NO: 208331 - DNA, 22 bp, Artificial Sequence
  Synthetic oligonucleotide; TTT chr2 60545834 60545855 60545851 60545856 +
taacattacagggctgtcatgg

SEQ ID NO: 208332 - DNA, 22 bp, Artificial Sequence
  Synthetic oligonucleotide; TTT chr2 60545835 60545856 60545852 60545857 +
aacattacagggctgtcatgga

SEQ ID NO: 208333 - DNA, 22 bp, Artificial Sequence
  Synthetic oligonucleotide; TTA chr2 60545836 60545857 60545853 60545858 +
acattacagggctgtcatggac

SEQ ID NO: 208334 - DNA, 22 bp, Artificial Sequence
  Synthetic oligonucleotide; TTA chr2 60545842 60545863 60545859 60545864 +
cagggctgtcatggacagtcac

SEQ ID NO: 208335 - DNA, 22 bp, Artificial Sequence
  Synthetic oligonucleotide; CTG chr2 60545850 60545871 60545867 60545872 +
tcatggacagtcacatagagta

SEQ ID NO: 208336 - DNA, 22 bp, Artificial Sequence
  Synthetic oligonucleotide; CTT chr2 60545887 60545908 60545904 60545909 +
cacaactccttactgcttggct

SEQ ID NO: 208337 - DNA, 22 bp, Artificial Sequence
  Synthetic oligonucleotide; TTC chr2 60545888 60545909 60545905 60545910 +
acaactccttactgcttggcta

SEQ ID NO: 208338 - DNA, 22 bp, Artificial Sequence
  Synthetic oligonucleotide; CTC chr2 60545895 60545916 60545912 60545917 +
cttactgcttggctacagcacc

SEQ ID NO: 208339 - DNA, 22 bp, Artificial Sequence
  Synthetic oligonucleotide; CTT chr2 60545898 60545919 60545915 60545920 +
actgcttggctacagcacctct

SEQ ID NO: 208340 - DNA, 22 bp, Artificial Sequence
  Synthetic oligonucleotide; TTA chr2 60545899 60545920 60545916 60545921 +
ctgcttggctacagcacctctg

SEQ ID NO: 208341 - DNA, 22 bp, Artificial Sequence
  Synthetic oligonucleotide; CTG chr2 60545902 60545923 60545919 60545924 +
cttggctacagcacctctgaaa

SEQ ID NO: 208342 - DNA, 22 bp, Artificial Sequence
  Synthetic oligonucleotide; CTT chr2 60545905 60545926 60545922 60545927 +
ggctacagcacctctgaaaatg

SEQ ID NO: 208343 - DNA, 22 bp, Artificial Sequence
  Synthetic oligonucleotide; TTG chr2 60545906 60545927 60545923 60545928 +
gctacagcacctctgaaaatga

SEQ ID NO: 208344 - DNA, 22 bp, Artificial Sequence
  Synthetic oligonucleotide; CTA chr2 60545910 60545931 60545927 60545932 +
cagcacctctgaaaatgaaaag

SEQ ID NO: 208345 - DNA, 22 bp, Artificial Sequence
  Synthetic oligonucleotide; CTC chr2 60545919 60545940 60545936 60545941 +
tgaaaatgaaaagaaaacatgc

SEQ ID NO: 208346 - DNA, 22 bp, Artificial Sequence
  Synthetic oligonucleotide; CTG chr2 60545921 60545942 60545938 60545943 +
aaaatgaaaagaaaacatgcaa

SEQ ID NO: 208347 - DNA, 22 bp, Artificial Sequence
  Synthetic oligonucleotide; CTT chr2 60545950 60545971 60545967 60545972 +
ttctccttgcttctcatttacc

SEQ ID NO: 208348 - DNA, 22 bp, Artificial Sequence
  Synthetic oligonucleotide; TTT chr2 60545951 60545972 60545968 60545973 +
tctccttgcttctcatttacct

SEQ ID NO: 208349 - DNA, 22 bp, Artificial Sequence
  Synthetic oligonucleotide; TTT chr2 60545952 60545973 60545969 60545974 +
ctccttgcttctcatttacctg

SEQ ID NO: 208350 - DNA, 22 bp, Artificial Sequence
  Synthetic oligonucleotide; TTC chr2 60545953 60545974 60545970 60545975 +
tccttgcttctcatttacctgc

SEQ ID NO: 208351 - DNA, 22 bp, Artificial Sequence
  Synthetic oligonucleotide; CTC chr2 60545955 60545976 60545972 60545977 +
cttgcttctcatttacctgcta

SEQ ID NO: 208352 - DNA, 22 bp, Artificial Sequence
  Synthetic oligonucleotide; CTT chr2 60545958 60545979 60545975 60545980 +
gcttctcatttacctgctatgt

SEQ ID NO: 208353 - DNA, 22 bp, Artificial Sequence
  Synthetic oligonucleotide; TTG chr2 60545959 60545980 60545976 60545981 +
cttctcatttacctgctatgtg

SEQ ID NO: 208354 - DNA, 22 bp, Artificial Sequence
  Synthetic oligonucleotide; CTT chr2 60545962 60545983 60545979 60545984 +
ctcatttacctgctatgtgttc

SEQ ID NO: 208355 - DNA, 22 bp, Artificial Sequence
  Synthetic oligonucleotide; TTC chr2 60545963 60545984 60545980 60545985 +
tcatttacctgctatgtgttcc

SEQ ID NO: 208356 - DNA, 22 bp, Artificial Sequence
  Synthetic oligonucleotide; CTC chr2 60545965 60545986 60545982 60545987 +
atttacctgctatgtgttcctg

SEQ ID NO: 208357 - DNA, 22 bp, Artificial Sequence
  Synthetic oligonucleotide; TTT chr2 60545969 60545990 60545986 60545991 +
acctgctatgtgttcctgtttg

SEQ ID NO: 208358 - DNA, 22 bp, Artificial Sequence
  Synthetic oligonucleotide; TTA chr2 60545970 60545991 60545987 60545992 +
cctgctatgtgttcctgtttgg

SEQ ID NO: 208359 - DNA, 22 bp, Artificial Sequence
  Synthetic oligonucleotide; CTG chr2 60545974 60545995 60545991 60545996 +
ctatgtgttcctgtttggggca

SEQ ID NO: 208360 - DNA, 22 bp, Artificial Sequence
  Synthetic oligonucleotide; CTA chr2 60545977 60545998 60545994 60545999 +
tgtgttcctgtttggggcaaat

SEQ ID NO: 208361 - DNA, 22 bp, Artificial Sequence
  Synthetic oligonucleotide; TTC chr2 60545984 60546005 60546001 60546006 +
ctgtttggggcaaattcctcta

SEQ ID NO: 208362 - DNA, 22 bp, Artificial Sequence
  Synthetic oligonucleotide; CTG chr2 60545987 60546008 60546004 60546009 +
tttggggcaaattcctctagat

SEQ ID NO: 208363 - DNA, 22 bp, Artificial Sequence
  Synthetic oligonucleotide; TTT chr2 60545990 60546011 60546007 60546012 +
ggggcaaattcctctagatgac

SEQ ID NO: 208364 - DNA, 22 bp, Artificial Sequence
  Synthetic oligonucleotide; TTG chr2 60545991 60546012 60546008 60546013 +
gggcaaattcctctagatgacg

SEQ ID NO: 208365 - DNA, 22 bp, Artificial Sequence
  Synthetic oligonucleotide; TTC chr2 60546001 60546022 60546018 60546023 +
ctctagatgacgttgataaaca

SEQ ID NO: 208366 - DNA, 22 bp, Artificial Sequence
  Synthetic oligonucleotide; CTC chr2 60546004 60546025 60546021 60546026 +
tagatgacgttgataaacaatc

SEQ ID NO: 208367 - DNA, 22 bp, Artificial Sequence
  Synthetic oligonucleotide; CTA chr2 60546006 60546027 60546023 60546028 +
gatgacgttgataaacaatcgt

SEQ ID NO: 208368 - DNA, 22 bp, Artificial Sequence
  Synthetic oligonucleotide; TTG chr2 60546016 60546037 60546033 60546038 +
ataaacaatcgtcatcctctgg

SEQ ID NO: 208369 - DNA, 22 bp, Artificial Sequence
  Synthetic oligonucleotide; CTC chr2 60546035 60546056 60546052 60546057 +
tggcgtgacctggatgccaacc

SEQ ID NO: 208370 - DNA, 22 bp, Artificial Sequence
  Synthetic oligonucleotide; CTG chr2 60546037 60546058 60546054 60546059 +
gcgtgacctggatgccaacctc

SEQ ID NO: 208371 - DNA, 22 bp, Artificial Sequence
  Synthetic oligonucleotide; CTG chr2 60546047 60546068 60546064 60546069 +
gatgccaacctccacgggattg

SEQ ID NO: 208372 - DNA, 22 bp, Artificial Sequence
  Synthetic oligonucleotide; CTC chr2 60546059 60546080 60546076 60546081 +
cacgggattggatgcttttttc

SEQ ID NO: 208373 - DNA, 22 bp, Artificial Sequence
  Synthetic oligonucleotide; TTG chr2 60546069 60546090 60546086 60546091 +
gatgcttttttcatctcgattg

SEQ ID NO: 208374 - DNA, 22 bp, Artificial Sequence
  Synthetic oligonucleotide; CTT chr2 60546076 60546097 60546093 60546098 +
ttttcatctcgattggtgaagg

SEQ ID NO: 208375 - DNA, 22 bp, Artificial Sequence
  Synthetic oligonucleotide; TTT chr2 60546077 60546098 60546094 60546099 +
tttcatctcgattggtgaaggg

SEQ ID NO: 208376 - DNA, 22 bp, Artificial Sequence
  Synthetic oligonucleotide; TTT chr2 60546078 60546099 60546095 60546100 +
ttcatctcgattggtgaagggg

SEQ ID NO: 208377 - DNA, 22 bp, Artificial Sequence
  Synthetic oligonucleotide; TTT chr2 60546079 60546100 60546096 60546101 +
tcatctcgattggtgaagggga

SEQ ID NO: 208378 - DNA, 22 bp, Artificial Sequence
  Synthetic oligonucleotide; TTT chr2 60546080 60546101 60546097 60546102 +
catctcgattggtgaaggggaa

SEQ ID NO: 208379 - DNA, 22 bp, Artificial Sequence
  Synthetic oligonucleotide; TTC chr2 60546081 60546102 60546098 60546103 +
atctcgattggtgaaggggaag

SEQ ID NO: 208380 - DNA, 22 bp, Artificial Sequence
  Synthetic oligonucleotide; CTC chr2 60546086 60546107 60546103 60546108 +
gattggtgaaggggaaggtggc

SEQ ID NO: 208381 - DNA, 22 bp, Artificial Sequence
  Synthetic oligonucleotide; TTG chr2 60546091 60546112 60546108 60546113 +
gtgaaggggaaggtggcttatc

SEQ ID NO: 208382 - DNA, 22 bp, Artificial Sequence
  Synthetic oligonucleotide; CTT chr2 60546110 60546131 60546127 60546132 +
atccacagctttttctaagcag

SEQ ID NO: 208383 - DNA, 22 bp, Artificial Sequence
  Synthetic oligonucleotide; TTA chr2 60546111 60546132 60546128 60546133 +
tccacagctttttctaagcaga

SEQ ID NO: 208384 - DNA, 22 bp, Artificial Sequence
  Synthetic oligonucleotide; CTT chr2 60546121 60546142 60546138 60546143 +
tttctaagcagaggctgccatt

SEQ ID NO: 208385 - DNA, 22 bp, Artificial Sequence
  Synthetic oligonucleotide; TTT chr2 60546122 60546143 60546139 60546144 +
ttctaagcagaggctgccattg

SEQ ID NO: 208386 - DNA, 22 bp, Artificial Sequence
  Synthetic oligonucleotide; TTT chr2 60546123 60546144 60546140 60546145 +
tctaagcagaggctgccattgc

SEQ ID NO: 208387 - DNA, 22 bp, Artificial Sequence
  Synthetic oligonucleotide; TTT chr2 60546124 60546145 60546141 60546146 +
ctaagcagaggctgccattgca

SEQ ID NO: 208388 - DNA, 22 bp, Artificial Sequence
  Synthetic oligonucleotide; TTC chr2 60546125 60546146 60546142 60546147 +
taagcagaggctgccattgcat

SEQ ID NO: 208389 - DNA, 22 bp, Artificial Sequence
  Synthetic oligonucleotide; CTA chr2 60546127 60546148 60546144 60546149 +
agcagaggctgccattgcattg

SEQ ID NO: 208390 - DNA, 22 bp, Artificial Sequence
  Synthetic oligonucleotide; CTG chr2 60546138 60546159 60546155 60546160 +
ccattgcattgtttccgtttgt

SEQ ID NO: 208391 - DNA, 22 bp, Artificial Sequence
  Synthetic oligonucleotide; TTG chr2 60546144 60546165 60546161 60546166 +
cattgtttccgtttgtgctcga

SEQ ID NO: 208392 - DNA, 22 bp, Artificial Sequence
  Synthetic oligonucleotide; TTG chr2 60546149 60546170 60546166 60546171 +
tttccgtttgtgctcgataaaa

SEQ ID NO: 208393 - DNA, 22 bp, Artificial Sequence
  Synthetic oligonucleotide; TTT chr2 60546152 60546173 60546169 60546174 +
ccgtttgtgctcgataaaaata

SEQ ID NO: 208394 - DNA, 22 bp, Artificial Sequence
  Synthetic oligonucleotide; TTC chr2 60546153 60546174 60546170 60546175 +
cgtttgtgctcgataaaaataa

SEQ ID NO: 208395 - DNA, 22 bp, Artificial Sequence
  Synthetic oligonucleotide; TTT chr2 60546158 60546179 60546175 60546180 +
gtgctcgataaaaataagaatg

SEQ ID NO: 208396 - DNA, 22 bp, Artificial Sequence
  Synthetic oligonucleotide; TTG chr2 60546159 60546180 60546176 60546181 +
tgctcgataaaaataagaatgt

SEQ ID NO: 208397 - DNA, 22 bp, Artificial Sequence
  Synthetic oligonucleotide; CTC chr2 60546164 60546185 60546181 60546186 +
gataaaaataagaatgtccccc

SEQ ID NO: 208398 - DNA, 22 bp, Artificial Sequence
  Synthetic oligonucleotide; TTC chr2 60546198 60546219 60546215 60546220 +
atctggcactgcccacaggtga

SEQ ID NO: 208399 - DNA, 22 bp, Artificial Sequence
  Synthetic oligonucleotide; CTG chr2 60546203 60546224 60546220 60546225 +
gcactgcccacaggtgaggagg

SEQ ID NO: 208400 - DNA, 22 bp, Artificial Sequence
  Synthetic oligonucleotide; CTG chr2 60546209 60546230 60546226 60546231 +
cccacaggtgaggaggtcatga

SEQ ID NO: 208401 - DNA, 22 bp, Artificial Sequence
  Synthetic oligonucleotide; CTT chr2 60546238 60546259 60546255 60546260 +
ctggagctcccaacgggccgtg

SEQ ID NO: 208402 - DNA, 22 bp, Artificial Sequence
  Synthetic oligonucleotide; TTC chr2 60546239 60546260 60546256 60546261 +
tggagctcccaacgggccgtgg

SEQ ID NO: 208403 - DNA, 22 bp, Artificial Sequence
  Synthetic oligonucleotide; CTG chr2 60546241 60546262 60546258 60546263 +
gagctcccaacgggccgtggtc

SEQ ID NO: 208404 - DNA, 22 bp, Artificial Sequence
  Synthetic oligonucleotide; CTC chr2 60546247 60546268 60546264 60546269 +
ccaacgggccgtggtctggttc

SEQ ID NO: 208405 - DNA, 22 bp, Artificial Sequence
  Synthetic oligonucleotide; CTG chr2 60546265 60546286 60546282 60546287 +
gttcatcatctgtaagaatggc

SEQ ID NO: 208406 - DNA, 22 bp, Artificial Sequence
  Synthetic oligonucleotide; TTC chr2 60546269 60546290 60546286 60546291 +
atcatctgtaagaatggcttca

SEQ ID NO: 208407 - DNA, 22 bp, Artificial Sequence
  Synthetic oligonucleotide; CTG chr2 60546277 60546298 60546294 60546299 +
taagaatggcttcaagaggctc

SEQ ID NO: 208408 - DNA, 22 bp, Artificial Sequence
  Synthetic oligonucleotide; CTT chr2 60546289 60546310 60546306 60546311 +
caagaggctcggctgtggttgg

SEQ ID NO: 208409 - DNA, 22 bp, Artificial Sequence
  Synthetic oligonucleotide; TTC chr2 60546290 60546311 60546307 60546312 +
aagaggctcggctgtggttgga

SEQ ID NO: 208410 - DNA, 22 bp, Artificial Sequence
  Synthetic oligonucleotide; CTC chr2 60546299 60546320 60546316 60546321 +
ggctgtggttggagaaacaaaa

SEQ ID NO: 208411 - DNA, 22 bp, Artificial Sequence
  Synthetic oligonucleotide; CTG chr2 60546304 60546325 60546321 60546326 +
tggttggagaaacaaaagcaca

SEQ ID NO: 208412 - DNA, 22 bp, Artificial Sequence
  Synthetic oligonucleotide; TTG chr2 60546310 60546331 60546327 60546332 +
gagaaacaaaagcacaattatt

SEQ ID NO: 208413 - DNA, 22 bp, Artificial Sequence
  Synthetic oligonucleotide; TTA chr2 60546330 60546351 60546347 60546352 +
ttagagtgccagagaggacaga

SEQ ID NO: 208414 - DNA, 22 bp, Artificial Sequence
  Synthetic oligonucleotide; TTA chr2 60546333 60546354 60546350 60546355 +
gagtgccagagaggacagaaag

SEQ ID NO: 208415 - DNA, 22 bp, Artificial Sequence
  Synthetic oligonucleotide; CTC chr2 60546371 60546392 60546388 60546393 +
aaccccatgccatcccaccaca

SEQ ID NO: 208416 - DNA, 22 bp, Artificial Sequence
  Synthetic oligonucleotide; TTT chr2 60546408 60546429 60546425 60546430 +
ctaggcttctctatataatacc

SEQ ID NO: 208417 - DNA, 22 bp, Artificial Sequence
  Synthetic oligonucleotide; TTC chr2 60546409 60546430 60546426 60546431 +
taggcttctctatataataccc

SEQ ID NO: 208418 - DNA, 22 bp, Artificial Sequence
  Synthetic oligonucleotide; CTA chr2 60546411 60546432 60546428 60546433 +
ggcttctctatataatacccag

SEQ ID NO: 208419 - DNA, 22 bp, Artificial Sequence
  Synthetic oligonucleotide; CTT chr2 60546416 60546437 60546433 60546438 +
ctctatataatacccagaaaat

SEQ ID NO: 208420 - DNA, 22 bp, Artificial Sequence
  Synthetic oligonucleotide; TTC chr2 60546417 60546438 60546434 60546439 +
tctatataatacccagaaaatg

SEQ ID NO: 208421 - DNA, 22 bp, Artificial Sequence
  Synthetic oligonucleotide; CTC chr2 60546419 60546440 60546436 60546441 +
tatataatacccagaaaatgtg

SEQ ID NO: 208422 - DNA, 22 bp, Artificial Sequence
  Synthetic oligonucleotide; CTA chr2 60546421 60546442 60546438 60546443 +
tataatacccagaaaatgtgag

SEQ ID NO: 208423 - DNA, 22 bp, Artificial Sequence
  Synthetic oligonucleotide; TTA chr2 60546473 60546494 60546490 60546495 +
tcaaccagagagcaaatttgtc

SEQ ID NO: 208424 - DNA, 22 bp, Artificial Sequence
  Synthetic oligonucleotide; TTT chr2 60546492 60546513 60546509 60546514 +
gtcaatgaggcaaatcatcaca

SEQ ID NO: 208425 - DNA, 22 bp, Artificial Sequence
  Synthetic oligonucleotide; TTG chr2 60546493 60546514 60546510 60546515 +
tcaatgaggcaaatcatcacat

SEQ ID NO: 208426 - DNA, 22 bp, Artificial Sequence
  Synthetic oligonucleotide; CTT chr2 60546534 60546555 60546551 60546556 +
ccttgcataactccagagaaca

SEQ ID NO: 208427 - DNA, 22 bp, Artificial Sequence
  Synthetic oligonucleotide; TTC chr2 60546535 60546556 60546552 60546557 +
cttgcataactccagagaacac

SEQ ID NO: 208428 - DNA, 22 bp, Artificial Sequence
  Synthetic oligonucleotide; CTT chr2 60546538 60546559 60546555 60546560 +
gcataactccagagaacacaca

SEQ ID NO: 208429 - DNA, 22 bp, Artificial Sequence
  Synthetic oligonucleotide; TTG chr2 60546539 60546560 60546556 60546561 +
cataactccagagaacacacac

SEQ ID NO: 208430 - DNA, 22 bp, Artificial Sequence
  Synthetic oligonucleotide; CTC chr2 60546547 60546568 60546564 60546569 +
cagagaacacacacacacacat

SEQ ID NO: 208431 - DNA, 22 bp, Artificial Sequence
  Synthetic oligonucleotide; CTG chr2 60546606 60546627 60546623 60546628 +
gtttgtaagtttagaaagaatg

SEQ ID NO: 208432 - DNA, 22 bp, Artificial Sequence
  Synthetic oligonucleotide; TTT chr2 60546610 60546631 60546627 60546632 +
gtaagtttagaaagaatgctac

SEQ ID NO: 208433 - DNA, 22 bp, Artificial Sequence
  Synthetic oligonucleotide; TTG chr2 60546611 60546632 60546628 60546633 +
taagtttagaaagaatgctact

SEQ ID NO: 208434 - DNA, 22 bp, Artificial Sequence
  Synthetic oligonucleotide; TTT chr2 60546618 60546639 60546635 60546640 +
agaaagaatgctacttaaatag

SEQ ID NO: 208435 - DNA, 22 bp, Artificial Sequence
  Synthetic oligonucleotide; TTA chr2 60546619 60546640 60546636 60546641 +
gaaagaatgctacttaaatagt

SEQ ID NO: 208436 - DNA, 22 bp, Artificial Sequence
  Synthetic oligonucleotide; CTA chr2 60546631 60546652 60546648 60546653 +
cttaaatagttaacacagggaa

SEQ ID NO: 208437 - DNA, 22 bp, Artificial Sequence
  Synthetic oligonucleotide; CTT chr2 60546634 60546655 60546651 60546656 +
aaatagttaacacagggaacat

SEQ ID NO: 208438 - DNA, 22 bp, Artificial Sequence
  Synthetic oligonucleotide; TTA chr2 60546635 60546656 60546652 60546657 +
aatagttaacacagggaacata

SEQ ID NO: 208439 - DNA, 22 bp, Artificial Sequence
  Synthetic oligonucleotide; TTA chr2 60546643 60546664 60546660 60546665 +
acacagggaacataaagaaagc

SEQ ID NO: 208440 - DNA, 22 bp, Artificial Sequence
  Synthetic oligonucleotide; CTT chr2 60546667 60546688 60546684 60546689 +
aaataataactacaagaaaaac

SEQ ID NO: 208441 - DNA, 22 bp, Artificial Sequence
  Synthetic oligonucleotide; TTA chr2 60546668 60546689 60546685 60546690 +
aataataactacaagaaaaact

SEQ ID NO: 208442 - DNA, 22 bp, Artificial Sequence
  Synthetic oligonucleotide; CTA chr2 60546679 60546700 60546696 60546701 +
caagaaaaactggttaaaaaaa

SEQ ID NO: 208443 - DNA, 22 bp, Artificial Sequence
  Synthetic oligonucleotide; CTG chr2 60546691 60546712 60546708 60546713 +
gttaaaaaaaaaagtggataga

SEQ ID NO: 208444 - DNA, 22 bp, Artificial Sequence
  Synthetic oligonucleotide; TTA chr2 60546695 60546716 60546712 60546717 +
aaaaaaaaagtggatagaaacc

SEQ ID NO: 208445 - DNA, 22 bp, Artificial Sequence
  Synthetic oligonucleotide; TTT chr2 60546723 60546744 60546740 60546745 +
gtttcttttttcctatacacca

SEQ ID NO: 208446 - DNA, 22 bp, Artificial Sequence
  Synthetic oligonucleotide; TTG chr2 60546724 60546745 60546741 60546746 +
tttcttttttcctatacaccaa

SEQ ID NO: 208447 - DNA, 22 bp, Artificial Sequence
  Synthetic oligonucleotide; TTT chr2 60546727 60546748 60546744 60546749 +
cttttttcctatacaccaagtt

SEQ ID NO: 208448 - DNA, 22 bp, Artificial Sequence
  Synthetic oligonucleotide; TTC chr2 60546728 60546749 60546745 60546750 +
ttttttcctatacaccaagttg

SEQ ID NO: 208449 - DNA, 22 bp, Artificial Sequence
  Synthetic oligonucleotide; CTT chr2 60546730 60546751 60546747 60546752 +
ttttcctatacaccaagttgtc

SEQ ID NO: 208450 - DNA, 22 bp, Artificial Sequence
  Synthetic oligonucleotide; TTT chr2 60546731 60546752 60546748 60546753 +
tttcctatacaccaagttgtcc

SEQ ID NO: 208451 - DNA, 22 bp, Artificial Sequence
  Synthetic oligonucleotide; TTT chr2 60546732 60546753 60546749 60546754 +
ttcctatacaccaagttgtcca

SEQ ID NO: 208452 - DNA, 22 bp, Artificial Sequence
  Synthetic oligonucleotide; TTT chr2 60546733 60546754 60546750 60546755 +
tcctatacaccaagttgtccat

SEQ ID NO: 208453 - DNA, 22 bp, Artificial Sequence
  Synthetic oligonucleotide; TTT chr2 60546734 60546755 60546751 60546756 +
cctatacaccaagttgtccatt

SEQ ID NO: 208454 - DNA, 22 bp, Artificial Sequence
  Synthetic oligonucleotide; TTC chr2 60546735 60546756 60546752 60546757 +
ctatacaccaagttgtccattg

SEQ ID NO: 208455 - DNA, 22 bp, Artificial Sequence
  Synthetic oligonucleotide; CTA chr2 60546738 60546759 60546755 60546760 +
tacaccaagttgtccattgtgc

SEQ ID NO: 208456 - DNA, 22 bp, Artificial Sequence
  Synthetic oligonucleotide; TTG chr2 60546750 60546771 60546767 60546772 +
tccattgtgccaaagaatgaaa

SEQ ID NO: 208457 - DNA, 22 bp, Artificial Sequence
  Synthetic oligonucleotide; TTG chr2 60546757 60546778 60546774 60546779 +
tgccaaagaatgaaaggagagg

SEQ ID NO: 208458 - DNA, 22 bp, Artificial Sequence
  Synthetic oligonucleotide; CTT chr2 60546800 60546821 60546817 60546822 +
tgtgtgtgaatgtatatactcc

SEQ ID NO: 208459 - DNA, 22 bp, Artificial Sequence
  Synthetic oligonucleotide; TTT chr2 60546801 60546822 60546818 60546823 +
gtgtgtgaatgtatatactcct

SEQ ID NO: 208460 - DNA, 22 bp, Artificial Sequence
  Synthetic oligonucleotide; TTG chr2 60546802 60546823 60546819 60546824 +
tgtgtgaatgtatatactccta

SEQ ID NO: 208461 - DNA, 22 bp, Artificial Sequence
  Synthetic oligonucleotide; CTC chr2 60546821 60546842 60546838 60546843 +
ctaagtaaacagacatggcttc

SEQ ID NO: 208462 - DNA, 22 bp, Artificial Sequence
  Synthetic oligonucleotide; CTA chr2 60546824 60546845 60546841 60546846 +
agtaaacagacatggcttcata

SEQ ID NO: 208463 - DNA, 22 bp, Artificial Sequence
  Synthetic oligonucleotide; CTT chr2 60546842 60546863 60546859 60546864 +
cataaattagaaagctactatg

SEQ ID NO: 208464 - DNA, 22 bp, Artificial Sequence
  Synthetic oligonucleotide; TTC chr2 60546843 60546864 60546860 60546865 +
ataaattagaaagctactatgt

SEQ ID NO: 208465 - DNA, 22 bp, Artificial Sequence
  Synthetic oligonucleotide; TTA chr2 60546851 60546872 60546868 60546873 +
gaaagctactatgtcacatgaa

SEQ ID NO: 208466 - DNA, 22 bp, Artificial Sequence
  Synthetic oligonucleotide; CTA chr2 60546859 60546880 60546876 60546881 +
ctatgtcacatgaaaaatgtgc

SEQ ID NO: 208467 - DNA, 22 bp, Artificial Sequence
  Synthetic oligonucleotide; CTA chr2 60546862 60546883 60546879 60546884 +
tgtcacatgaaaaatgtgccac

SEQ ID NO: 208468 - DNA, 22 bp, Artificial Sequence
  Synthetic oligonucleotide; TTT chr2 60546888 60546909 60546905 60546910 +
acactgctgtaataagaaaacg

SEQ ID NO: 208469 - DNA, 22 bp, Artificial Sequence
  Synthetic oligonucleotide; TTA chr2 60546889 60546910 60546906 60546911 +
cactgctgtaataagaaaacga

SEQ ID NO: 208470 - DNA, 22 bp, Artificial Sequence
  Synthetic oligonucleotide; CTG chr2 60546894 60546915 60546911 60546916 +
ctgtaataagaaaacgactgca

SEQ ID NO: 208471 - DNA, 22 bp, Artificial Sequence
  Synthetic oligonucleotide; CTG chr2 60546897 60546918 60546914 60546919 +
taataagaaaacgactgcatgc

SEQ ID NO: 208472 - DNA, 22 bp, Artificial Sequence
  Synthetic oligonucleotide; CTG chr2 60546914 60546935 60546931 60546936 +
catgcacctatgaaacggatct

SEQ ID NO: 208473 - DNA, 22 bp, Artificial Sequence
  Synthetic oligonucleotide; CTA chr2 60546924 60546945 60546941 60546946 +
tgaaacggatctaaataataat

SEQ ID NO: 208474 - DNA, 22 bp, Artificial Sequence
  Synthetic oligonucleotide; CTA chr2 60546937 60546958 60546954 60546959 +
aataataatcatgtcgcagcat

SEQ ID NO: 208475 - DNA, 22 bp, Artificial Sequence
  Synthetic oligonucleotide; TTC chr2 60546964 60546985 60546981 60546986 +
acactgccaaaaacctttctgc

SEQ ID NO: 208476 - DNA, 22 bp, Artificial Sequence
  Synthetic oligonucleotide; CTG chr2 60546970 60546991 60546987 60546992 +
ccaaaaacctttctgctctcac

SEQ ID NO: 208477 - DNA, 22 bp, Artificial Sequence
  Synthetic oligonucleotide; CTT chr2 60546981 60547002 60546998 60547003 +
tctgctctcactctcagcagtg

SEQ ID NO: 208478 - DNA, 22 bp, Artificial Sequence
  Synthetic oligonucleotide; TTT chr2 60546982 60547003 60546999 60547004 +
ctgctctcactctcagcagtgc

SEQ ID NO: 208479 - DNA, 22 bp, Artificial Sequence
  Synthetic oligonucleotide; TTC chr2 60546983 60547004 60547000 60547005 +
tgctctcactctcagcagtgcc

SEQ ID NO: 208480 - DNA, 22 bp, Artificial Sequence
  Synthetic oligonucleotide; CTG chr2 60546985 60547006 60547002 60547007 +
ctctcactctcagcagtgccac

SEQ ID NO: 208481 - DNA, 22 bp, Artificial Sequence
  Synthetic oligonucleotide; CTC chr2 60546988 60547009 60547005 60547010 +
tcactctcagcagtgccacaaa

SEQ ID NO: 208482 - DNA, 22 bp, Artificial Sequence
  Synthetic oligonucleotide; CTC chr2 60546990 60547011 60547007 60547012 +
actctcagcagtgccacaaaat

SEQ ID NO: 208483 - DNA, 22 bp, Artificial Sequence
  Synthetic oligonucleotide; CTC chr2 60546994 60547015 60547011 60547016 +
tcagcagtgccacaaaatcaaa

SEQ ID NO: 208484 - DNA, 22 bp, Artificial Sequence
  Synthetic oligonucleotide; CTC chr2 60546996 60547017 60547013 60547018 +
agcagtgccacaaaatcaaaga

SEQ ID NO: 208485 - DNA, 22 bp, Artificial Sequence
  Synthetic oligonucleotide; TTT chr2 60547043 60547064 60547060 60547065 +
ctcagacacattagctaaatgg

SEQ ID NO: 208486 - DNA, 22 bp, Artificial Sequence
  Synthetic oligonucleotide; TTC chr2 60547044 60547065 60547061 60547066 +
tcagacacattagctaaatggg

SEQ ID NO: 208487 - DNA, 22 bp, Artificial Sequence
  Synthetic oligonucleotide; CTC chr2 60547046 60547067 60547063 60547068 +
agacacattagctaaatgggat

SEQ ID NO: 208488 - DNA, 22 bp, Artificial Sequence
  Synthetic oligonucleotide; TTA chr2 60547056 60547077 60547073 60547078 +
gctaaatgggatacttttgagt

SEQ ID NO: 208489 - DNA, 22 bp, Artificial Sequence
  Synthetic oligonucleotide; CTA chr2 60547060 60547081 60547077 60547082 +
aatgggatacttttgagtactt

SEQ ID NO: 208490 - DNA, 22 bp, Artificial Sequence
  Synthetic oligonucleotide; CTT chr2 60547072 60547093 60547089 60547094 +
ttgagtacttaagaaaataagc

SEQ ID NO: 208491 - DNA, 22 bp, Artificial Sequence
  Synthetic oligonucleotide; TTT chr2 60547073 60547094 60547090 60547095 +
tgagtacttaagaaaataagcc

SEQ ID NO: 208492 - DNA, 22 bp, Artificial Sequence
  Synthetic oligonucleotide; TTT chr2 60547074 60547095 60547091 60547096 +
gagtacttaagaaaataagcca

SEQ ID NO: 208493 - DNA, 22 bp, Artificial Sequence
  Synthetic oligonucleotide; TTG chr2 60547075 60547096 60547092 60547097 +
agtacttaagaaaataagccaa

SEQ ID NO: 208494 - DNA, 22 bp, Artificial Sequence
  Synthetic oligonucleotide; CTT chr2 60547082 60547103 60547099 60547104 +
aagaaaataagccaattagtca

SEQ ID NO: 208495 - DNA, 22 bp, Artificial Sequence
  Synthetic oligonucleotide; TTA chr2 60547083 60547104 60547100 60547105 +
agaaaataagccaattagtcat

SEQ ID NO: 208496 - DNA, 22 bp, Artificial Sequence
  Synthetic oligonucleotide; TTA chr2 60547100 60547121 60547117 60547122 +
gtcattttttttttattctgag

SEQ ID NO: 208497 - DNA, 22 bp, Artificial Sequence
  Synthetic oligonucleotide; TTT chr2 60547107 60547128 60547124 60547129 +
tttttttattctgagaaatgga

SEQ ID NO: 208498 - DNA, 22 bp, Artificial Sequence
  Synthetic oligonucleotide; TTT chr2 60547108 60547129 60547125 60547130 +
ttttttattctgagaaatggaa

SEQ ID NO: 208499 - DNA, 22 bp, Artificial Sequence
  Synthetic oligonucleotide; TTT chr2 60547109 60547130 60547126 60547131 +
tttttattctgagaaatggaat

SEQ ID NO: 208500 - DNA, 22 bp, Artificial Sequence
  Synthetic oligonucleotide; TTT chr2 60547110 60547131 60547127 60547132 +
ttttattctgagaaatggaatg

SEQ ID NO: 208501 - DNA, 22 bp, Artificial Sequence
  Synthetic oligonucleotide; TTT chr2 60547111 60547132 60547128 60547133 +
tttattctgagaaatggaatgc

SEQ ID NO: 208502 - DNA, 22 bp, Artificial Sequence
  Synthetic oligonucleotide; TTT chr2 60547112 60547133 60547129 60547134 +
ttattctgagaaatggaatgcc

SEQ ID NO: 208503 - DNA, 22 bp, Artificial Sequence
  Synthetic oligonucleotide; TTT chr2 60547113 60547134 60547130 60547135 +
tattctgagaaatggaatgcct

SEQ ID NO: 208504 - DNA, 22 bp, Artificial Sequence
  Synthetic oligonucleotide; TTT chr2 60547114 60547135 60547131 60547136 +
attctgagaaatggaatgccta

SEQ ID NO: 208505 - DNA, 22 bp, Artificial Sequence
  Synthetic oligonucleotide; TTA chr2 60547115 60547136 60547132 60547137 +
ttctgagaaatggaatgcctat

SEQ ID NO: 208506 - DNA, 22 bp, Artificial Sequence
  Synthetic oligonucleotide; TTC chr2 60547118 60547139 60547135 60547140 +
tgagaaatggaatgcctataat

SEQ ID NO: 208507 - DNA, 22 bp, Artificial Sequence
  Synthetic oligonucleotide; CTG chr2 60547120 60547141 60547137 60547142 +
agaaatggaatgcctataatat

SEQ ID NO: 208508 - DNA, 22 bp, Artificial Sequence
  Synthetic oligonucleotide; CTA chr2 60547136 60547157 60547153 60547158 +
taatattctaaacatgtttgca

SEQ ID NO: 208509 - DNA, 22 bp, Artificial Sequence
  Synthetic oligonucleotide; TTC chr2 60547144 60547165 60547161 60547166 +
taaacatgtttgcacttggtgg

SEQ ID NO: 208510 - DNA, 22 bp, Artificial Sequence
  Synthetic oligonucleotide; CTA chr2 60547146 60547167 60547163 60547168 +
aacatgtttgcacttggtggca

SEQ ID NO: 208511 - DNA, 22 bp, Artificial Sequence
  Synthetic oligonucleotide; TTT chr2 60547155 60547176 60547172 60547177 +
gcacttggtggcatctatgata

SEQ ID NO: 208512 - DNA, 22 bp, Artificial Sequence
  Synthetic oligonucleotide; TTG chr2 60547156 60547177 60547173 60547178 +
cacttggtggcatctatgatat

SEQ ID NO: 208513 - DNA, 22 bp, Artificial Sequence
  Synthetic oligonucleotide; CTT chr2 60547161 60547182 60547178 60547183 +
ggtggcatctatgatataaaaa

SEQ ID NO: 208514 - DNA, 22 bp, Artificial Sequence
  Synthetic oligonucleotide; TTG chr2 60547162 60547183 60547179 60547184 +
gtggcatctatgatataaaaat

SEQ ID NO: 208515 - DNA, 22 bp, Artificial Sequence
  Synthetic oligonucleotide; CTA chr2 60547172 60547193 60547189 60547194 +
tgatataaaaatcagaatggtc

SEQ ID NO: 208516 - DNA, 22 bp, Artificial Sequence
  Synthetic oligonucleotide; TTT chr2 60547211 60547232 60547228 60547233 +
cagagcaaggctgagaagtcct

SEQ ID NO: 208517 - DNA, 22 bp, Artificial Sequence
  Synthetic oligonucleotide; TTC chr2 60547212 60547233 60547229 60547234 +
agagcaaggctgagaagtcctt

SEQ ID NO: 208518 - DNA, 22 bp, Artificial Sequence
  Synthetic oligonucleotide; CTG chr2 60547224 60547245 60547241 60547246 +
agaagtcctttctttagacttg

SEQ ID NO: 208519 - DNA, 22 bp, Artificial Sequence
  Synthetic oligonucleotide; CTT chr2 60547234 60547255 60547251 60547256 +
tctttagacttgaaatacttcg

SEQ ID NO: 208520 - DNA, 22 bp, Artificial Sequence
  Synthetic oligonucleotide; TTT chr2 60547235 60547256 60547252 60547257 +
ctttagacttgaaatacttcgc

SEQ ID NO: 208521 - DNA, 22 bp, Artificial Sequence
  Synthetic oligonucleotide; TTC chr2 60547236 60547257 60547253 60547258 +
tttagacttgaaatacttcgcc

SEQ ID NO: 208522 - DNA, 22 bp, Artificial Sequence
  Synthetic oligonucleotide; CTT chr2 60547238 60547259 60547255 60547260 +
tagacttgaaatacttcgccta

SEQ ID NO: 208523 - DNA, 22 bp, Artificial Sequence
  Synthetic oligonucleotide; TTT chr2 60547239 60547260 60547256 60547261 +
agacttgaaatacttcgcctaa

SEQ ID NO: 208524 - DNA, 22 bp, Artificial Sequence
  Synthetic oligonucleotide; TTA chr2 60547240 60547261 60547257 60547262 +
gacttgaaatacttcgcctaat

SEQ ID NO: 208525 - DNA, 22 bp, Artificial Sequence
  Synthetic oligonucleotide; CTT chr2 60547245 60547266 60547262 60547267 +
gaaatacttcgcctaatgttgt

SEQ ID NO: 208526 - DNA, 22 bp, Artificial Sequence
  Synthetic oligonucleotide; TTG chr2 60547246 60547267 60547263 60547268 +
aaatacttcgcctaatgttgtc

SEQ ID NO: 208527 - DNA, 22 bp, Artificial Sequence
  Synthetic oligonucleotide; CTT chr2 60547254 60547275 60547271 60547276 +
cgcctaatgttgtcaaagtgga

SEQ ID NO: 208528 - DNA, 22 bp, Artificial Sequence
  Synthetic oligonucleotide; TTC chr2 60547255 60547276 60547272 60547277 +
gcctaatgttgtcaaagtggac

SEQ ID NO: 208529 - DNA, 22 bp, Artificial Sequence
  Synthetic oligonucleotide; CTA chr2 60547260 60547281 60547277 60547282 +
atgttgtcaaagtggactaatt

SEQ ID NO: 208530 - DNA, 22 bp, Artificial Sequence
  Synthetic oligonucleotide; TTG chr2 60547266 60547287 60547283 60547288 +
tcaaagtggactaattttctga

SEQ ID NO: 208531 - DNA, 22 bp, Artificial Sequence
  Synthetic oligonucleotide; CTA chr2 60547279 60547300 60547296 60547301 +
attttctgaatgagctccaaaa

SEQ ID NO: 208532 - DNA, 22 bp, Artificial Sequence
  Synthetic oligonucleotide; TTT chr2 60547283 60547304 60547300 60547305 +
tctgaatgagctccaaaatgct

SEQ ID NO: 208533 - DNA, 22 bp, Artificial Sequence
  Synthetic oligonucleotide; TTT chr2 60547284 60547305 60547301 60547306 +
ctgaatgagctccaaaatgctt

SEQ ID NO: 208534 - DNA, 22 bp, Artificial Sequence
  Synthetic oligonucleotide; TTC chr2 60547285 60547306 60547302 60547307 +
tgaatgagctccaaaatgcttc

SEQ ID NO: 208535 - DNA, 22 bp, Artificial Sequence
  Synthetic oligonucleotide; CTG chr2 60547287 60547308 60547304 60547309 +
aatgagctccaaaatgcttcat

SEQ ID NO: 208536 - DNA, 22 bp, Artificial Sequence
  Synthetic oligonucleotide; CTC chr2 60547296 60547317 60547313 60547318 +
caaaatgcttcattatgagact

SEQ ID NO: 208537 - DNA, 22 bp, Artificial Sequence
  Synthetic oligonucleotide; CTT chr2 60547306 60547327 60547323 60547328 +
cattatgagactatttctgcac

SEQ ID NO: 208538 - DNA, 22 bp, Artificial Sequence
  Synthetic oligonucleotide; TTC chr2 60547307 60547328 60547324 60547329 +
attatgagactatttctgcaca

SEQ ID NO: 208539 - DNA, 22 bp, Artificial Sequence
  Synthetic oligonucleotide; TTA chr2 60547311 60547332 60547328 60547333 +
tgagactatttctgcacacata

SEQ ID NO: 208540 - DNA, 22 bp, Artificial Sequence
  Synthetic oligonucleotide; CTA chr2 60547319 60547340 60547336 60547341 +
tttctgcacacataatcaccag

SEQ ID NO: 208541 - DNA, 22 bp, Artificial Sequence
  Synthetic oligonucleotide; TTT chr2 60547322 60547343 60547339 60547344 +
ctgcacacataatcaccagcgg

SEQ ID NO: 208542 - DNA, 22 bp, Artificial Sequence
  Synthetic oligonucleotide; TTC chr2 60547323 60547344 60547340 60547345 +
tgcacacataatcaccagcgga

SEQ ID NO: 208543 - DNA, 22 bp, Artificial Sequence
  Synthetic oligonucleotide; CTG chr2 60547325 60547346 60547342 60547347 +
cacacataatcaccagcggatg

SEQ ID NO: 208544 - DNA, 22 bp, Artificial Sequence
  Synthetic oligonucleotide; CTT chr2 60547370 60547391 60547387 60547392 +
tctttcctgtttgctttttttt

SEQ ID NO: 208545 - DNA, 22 bp, Artificial Sequence
  Synthetic oligonucleotide; TTT chr2 60547371 60547392 60547388 60547393 +
ctttcctgtttgcttttttttt

SEQ ID NO: 208546 - DNA, 22 bp, Artificial Sequence
  Synthetic oligonucleotide; TTC chr2 60547372 60547393 60547389 60547394 +
tttcctgtttgctttttttttt

SEQ ID NO: 208547 - DNA, 22 bp, Artificial Sequence
  Synthetic oligonucleotide; CTT chr2 60547374 60547395 60547391 60547396 +
tcctgtttgcttttttttttaa

SEQ ID NO: 208548 - DNA, 22 bp, Artificial Sequence
  Synthetic oligonucleotide; TTT chr2 60547375 60547396 60547392 60547397 +
cctgtttgcttttttttttaac

SEQ ID NO: 208549 - DNA, 22 bp, Artificial Sequence
  Synthetic oligonucleotide; TTC chr2 60547376 60547397 60547393 60547398 +
ctgtttgcttttttttttaact

SEQ ID NO: 208550 - DNA, 22 bp, Artificial Sequence
  Synthetic oligonucleotide; CTG chr2 60547379 60547400 60547396 60547401 +
tttgcttttttttttaactttg

SEQ ID NO: 208551 - DNA, 22 bp, Artificial Sequence
  Synthetic oligonucleotide; TTT chr2 60547382 60547403 60547399 60547404 +
gcttttttttttaactttgtac

SEQ ID NO: 208552 - DNA, 22 bp, Artificial Sequence
  Synthetic oligonucleotide; TTG chr2 60547383 60547404 60547400 60547405 +
cttttttttttaactttgtact

SEQ ID NO: 208553 - DNA, 22 bp, Artificial Sequence
  Synthetic oligonucleotide; CTT chr2 60547386 60547407 60547403 60547408 +
ttttttttaactttgtactaaa

SEQ ID NO: 208554 - DNA, 22 bp, Artificial Sequence
  Synthetic oligonucleotide; TTT chr2 60547387 60547408 60547404 60547409 +
tttttttaactttgtactaaaa

SEQ ID NO: 208555 - DNA, 22 bp, Artificial Sequence
  Synthetic oligonucleotide; TTT chr2 60547388 60547409 60547405 60547410 +
ttttttaactttgtactaaaat

SEQ ID NO: 208556 - DNA, 22 bp, Artificial Sequence
  Synthetic oligonucleotide; TTT chr2 60547389 60547410 60547406 60547411 +
tttttaactttgtactaaaata

SEQ ID NO: 208557 - DNA, 22 bp, Artificial Sequence
  Synthetic oligonucleotide; TTT chr2 60547390 60547411 60547407 60547412 +
ttttaactttgtactaaaatac

SEQ ID NO: 208558 - DNA, 22 bp, Artificial Sequence
  Synthetic oligonucleotide; TTT chr2 60547391 60547412 60547408 60547413 +
tttaactttgtactaaaatact

SEQ ID NO: 208559 - DNA, 22 bp, Artificial Sequence
  Synthetic oligonucleotide; TTT chr2 60547392 60547413 60547409 60547414 +
ttaactttgtactaaaatactc

SEQ ID NO: 208560 - DNA, 22 bp, Artificial Sequence
  Synthetic oligonucleotide; TTT chr2 60547393 60547414 60547410 60547415 +
taactttgtactaaaatactcc

SEQ ID NO: 208561 - DNA, 22 bp, Artificial Sequence
  Synthetic oligonucleotide; TTT chr2 60547394 60547415 60547411 60547416 +
aactttgtactaaaatactcca

SEQ ID NO: 208562 - DNA, 22 bp, Artificial Sequence
  Synthetic oligonucleotide; TTA chr2 60547395 60547416 60547412 60547417 +
actttgtactaaaatactccag

SEQ ID NO: 208563 - DNA, 22 bp, Artificial Sequence
  Synthetic oligonucleotide; CTT chr2 60547399 60547420 60547416 60547421 +
tgtactaaaatactccagcatc

SEQ ID NO: 208564 - DNA, 22 bp, Artificial Sequence
  Synthetic oligonucleotide; TTT chr2 60547400 60547421 60547417 60547422 +
gtactaaaatactccagcatct

SEQ ID NO: 208565 - DNA, 22 bp, Artificial Sequence
  Synthetic oligonucleotide; TTG chr2 60547401 60547422 60547418 60547423 +
tactaaaatactccagcatcta

SEQ ID NO: 208566 - DNA, 22 bp, Artificial Sequence
  Synthetic oligonucleotide; CTA chr2 60547406 60547427 60547423 60547428 +
aaatactccagcatctacttta

SEQ ID NO: 208567 - DNA, 22 bp, Artificial Sequence
  Synthetic oligonucleotide; CTC chr2 60547414 60547435 60547431 60547436 +
cagcatctactttaccagcttc

SEQ ID NO: 208568 - DNA, 22 bp, Artificial Sequence
  Synthetic oligonucleotide; CTA chr2 60547423 60547444 60547440 60547445 +
ctttaccagcttctatcatttt

SEQ ID NO: 208569 - DNA, 22 bp, Artificial Sequence
  Synthetic oligonucleotide; CTT chr2 60547426 60547447 60547443 60547448 +
taccagcttctatcatttttta

SEQ ID NO: 208570 - DNA, 22 bp, Artificial Sequence
  Synthetic oligonucleotide; TTT chr2 60547427 60547448 60547444 60547449 +
accagcttctatcattttttaa

SEQ ID NO: 208571 - DNA, 22 bp, Artificial Sequence
  Synthetic oligonucleotide; TTA chr2 60547428 60547449 60547445 60547450 +
ccagcttctatcattttttaag

SEQ ID NO: 208572 - DNA, 22 bp, Artificial Sequence
  Synthetic oligonucleotide; CTT chr2 60547435 60547456 60547452 60547457 +
ctatcattttttaagcttccaa

SEQ ID NO: 208573 - DNA, 22 bp, Artificial Sequence
  Synthetic oligonucleotide; TTC chr2 60547436 60547457 60547453 60547458 +
tatcattttttaagcttccaaa

SEQ ID NO: 208574 - DNA, 22 bp, Artificial Sequence
  Synthetic oligonucleotide; CTA chr2 60547438 60547459 60547455 60547460 +
tcattttttaagcttccaaagg

SEQ ID NO: 208575 - DNA, 22 bp, Artificial Sequence
  Synthetic oligonucleotide; TTT chr2 60547444 60547465 60547461 60547466 +
tttaagcttccaaaggggaaaa

SEQ ID NO: 208576 - DNA, 22 bp, Artificial Sequence
  Synthetic oligonucleotide; TTT chr2 60547445 60547466 60547462 60547467 +
ttaagcttccaaaggggaaaag

SEQ ID NO: 208577 - DNA, 22 bp, Artificial Sequence
  Synthetic oligonucleotide; TTT chr2 60547446 60547467 60547463 60547468 +
taagcttccaaaggggaaaaga

SEQ ID NO: 208578 - DNA, 22 bp, Artificial Sequence
  Synthetic oligonucleotide; TTT chr2 60547447 60547468 60547464 60547469 +
aagcttccaaaggggaaaagag

SEQ ID NO: 208579 - DNA, 22 bp, Artificial Sequence
  Synthetic oligonucleotide; TTA chr2 60547448 60547469 60547465 60547470 +
agcttccaaaggggaaaagaga

SEQ ID NO: 208580 - DNA, 22 bp, Artificial Sequence
  Synthetic oligonucleotide; CTT chr2 60547453 60547474 60547470 60547475 +
ccaaaggggaaaagagagttgg

SEQ ID NO: 208581 - DNA, 22 bp, Artificial Sequence
  Synthetic oligonucleotide; TTC chr2 60547454 60547475 60547471 60547476 +
caaaggggaaaagagagttggt

SEQ ID NO: 208582 - DNA, 22 bp, Artificial Sequence
  Synthetic oligonucleotide; TTG chr2 60547474 60547495 60547491 60547496 +
gtaagtctctgcttgtgaaatc

SEQ ID NO: 208583 - DNA, 22 bp, Artificial Sequence
  Synthetic oligonucleotide; CTC chr2 60547483 60547504 60547500 60547505 +
tgcttgtgaaatcttatgcttg

SEQ ID NO: 208584 - DNA, 22 bp, Artificial Sequence
  Synthetic oligonucleotide; CTG chr2 60547485 60547506 60547502 60547507 +
cttgtgaaatcttatgcttgct

SEQ ID NO: 208585 - DNA, 22 bp, Artificial Sequence
  Synthetic oligonucleotide; CTT chr2 60547488 60547509 60547505 60547510 +
gtgaaatcttatgcttgctcta

SEQ ID NO: 208586 - DNA, 22 bp, Artificial Sequence
  Synthetic oligonucleotide; TTG chr2 60547489 60547510 60547506 60547511 +
tgaaatcttatgcttgctctat

SEQ ID NO: 208587 - DNA, 22 bp, Artificial Sequence
  Synthetic oligonucleotide; CTT chr2 60547498 60547519 60547515 60547520 +
atgcttgctctatcaaaaaaaa

SEQ ID NO: 208588 - DNA, 22 bp, Artificial Sequence
  Synthetic oligonucleotide; TTA chr2 60547499 60547520 60547516 60547521 +
tgcttgctctatcaaaaaaaaa

SEQ ID NO: 208589 - DNA, 22 bp, Artificial Sequence
  Synthetic oligonucleotide; CTT chr2 60547504 60547525 60547521 60547526 +
gctctatcaaaaaaaaaaaaaa

SEQ ID NO: 208590 - DNA, 22 bp, Artificial Sequence
  Synthetic oligonucleotide; TTG chr2 60547505 60547526 60547522 60547527 +
ctctatcaaaaaaaaaaaaaaa

SEQ ID NO: 208591 - DNA, 22 bp, Artificial Sequence
  Synthetic oligonucleotide; CTC chr2 60547508 60547529 60547525 60547530 +
tatcaaaaaaaaaaaaaaaatc

SEQ ID NO: 208592 - DNA, 22 bp, Artificial Sequence
  Synthetic oligonucleotide; CTA chr2 60547510 60547531 60547527 60547532 +
tcaaaaaaaaaaaaaaaatcac

SEQ ID NO: 208593 - DNA, 22 bp, Artificial Sequence
  Synthetic oligonucleotide; CTG chr2 60547557 60547578 60547574 60547579 +
ccagttaataaaactgaagcag

SEQ ID NO: 208594 - DNA, 22 bp, Artificial Sequence
  Synthetic oligonucleotide; TTA chr2 60547564 60547585 60547581 60547586 +
ataaaactgaagcagaaaatgt

SEQ ID NO: 208595 - DNA, 22 bp, Artificial Sequence
  Synthetic oligonucleotide; CTG chr2 60547573 60547594 60547590 60547595 +
aagcagaaaatgtacaagtctt

SEQ ID NO: 208596 - DNA, 22 bp, Artificial Sequence
  Synthetic oligonucleotide; CTT chr2 60547595 60547616 60547612 60547617 +
aaacagttaatcagtctgacct

SEQ ID NO: 208597 - DNA, 22 bp, Artificial Sequence
  Synthetic oligonucleotide; TTA chr2 60547596 60547617 60547613 60547618 +
aacagttaatcagtctgacctt

SEQ ID NO: 208598 - DNA, 22 bp, Artificial Sequence
  Synthetic oligonucleotide; TTA chr2 60547604 60547625 60547621 60547626 +
atcagtctgaccttctttagca

SEQ ID NO: 208599 - DNA, 22 bp, Artificial Sequence
  Synthetic oligonucleotide; CTG chr2 60547613 60547634 60547630 60547635 +
accttctttagcaagctgccaa

SEQ ID NO: 208600 - DNA, 22 bp, Artificial Sequence
  Synthetic oligonucleotide; CTT chr2 60547618 60547639 60547635 60547640 +
ctttagcaagctgccaatttta

SEQ ID NO: 208601 - DNA, 22 bp, Artificial Sequence
  Synthetic oligonucleotide; TTC chr2 60547619 60547640 60547636 60547641 +
tttagcaagctgccaattttac

SEQ ID NO: 208602 - DNA, 22 bp, Artificial Sequence
  Synthetic oligonucleotide; CTT chr2 60547621 60547642 60547638 60547643 +
tagcaagctgccaattttacat

SEQ ID NO: 208603 - DNA, 22 bp, Artificial Sequence
  Synthetic oligonucleotide; TTT chr2 60547622 60547643 60547639 60547644 +
agcaagctgccaattttacatt

SEQ ID NO: 208604 - DNA, 22 bp, Artificial Sequence
  Synthetic oligonucleotide; TTA chr2 60547623 60547644 60547640 60547645 +
gcaagctgccaattttacattt

SEQ ID NO: 208605 - DNA, 22 bp, Artificial Sequence
  Synthetic oligonucleotide; CTG chr2 60547631 60547652 60547648 60547653 +
ccaattttacatttaatgaact

SEQ ID NO: 208606 - DNA, 22 bp, Artificial Sequence
  Synthetic oligonucleotide; TTT chr2 60547638 60547659 60547655 60547660 +
tacatttaatgaacttaaagcc

SEQ ID NO: 208607 - DNA, 22 bp, Artificial Sequence
  Synthetic oligonucleotide; TTT chr2 60547639 60547660 60547656 60547661 +
acatttaatgaacttaaagcca

SEQ ID NO: 208608 - DNA, 22 bp, Artificial Sequence
  Synthetic oligonucleotide; TTA chr2 60547640 60547661 60547657 60547662 +
catttaatgaacttaaagccac

SEQ ID NO: 208609 - DNA, 22 bp, Artificial Sequence
  Synthetic oligonucleotide; TTT chr2 60547645 60547666 60547662 60547667 +
aatgaacttaaagccacagaga

SEQ ID NO: 208610 - DNA, 22 bp, Artificial Sequence
  Synthetic oligonucleotide; TTA chr2 60547646 60547667 60547663 60547668 +
atgaacttaaagccacagagaa

SEQ ID NO: 208611 - DNA, 22 bp, Artificial Sequence
  Synthetic oligonucleotide; CTT chr2 60547654 60547675 60547671 60547676 +
aaagccacagagaatcaaaaaa

SEQ ID NO: 208612 - DNA, 22 bp, Artificial Sequence
  Synthetic oligonucleotide; TTA chr2 60547655 60547676 60547672 60547677 +
aagccacagagaatcaaaaaat

SEQ ID NO: 208613 - DNA, 22 bp, Artificial Sequence
  Synthetic oligonucleotide; TTT chr2 60547683 60547704 60547700 60547705 +
taatttgagtgtagaatattgg

SEQ ID NO: 208614 - DNA, 22 bp, Artificial Sequence
  Synthetic oligonucleotide; TTT chr2 60547684 60547705 60547701 60547706 +
aatttgagtgtagaatattgga

SEQ ID NO: 208615 - DNA, 22 bp, Artificial Sequence
  Synthetic oligonucleotide; TTA chr2 60547685 60547706 60547702 60547707 +
atttgagtgtagaatattggaa

SEQ ID NO: 208616 - DNA, 22 bp, Artificial Sequence
  Synthetic oligonucleotide; TTT chr2 60547689 60547710 60547706 60547711 +
gagtgtagaatattggaacaga

SEQ ID NO: 208617 - DNA, 22 bp, Artificial Sequence
  Synthetic oligonucleotide; TTG chr2 60547690 60547711 60547707 60547712 +
agtgtagaatattggaacagat

SEQ ID NO: 208618 - DNA, 22 bp, Artificial Sequence
  Synthetic oligonucleotide; TTG chr2 60547704 60547725 60547721 60547726 +
gaacagattttgataaagtgca

SEQ ID NO: 208619 - DNA, 22 bp, Artificial Sequence
  Synthetic oligonucleotide; TTT chr2 60547714 60547735 60547731 60547736 +
tgataaagtgcaaaaatccagt

SEQ ID NO: 208620 - DNA, 22 bp, Artificial Sequence
  Synthetic oligonucleotide; TTT chr2 60547715 60547736 60547732 60547737 +
gataaagtgcaaaaatccagtg

SEQ ID NO: 208621 - DNA, 22 bp, Artificial Sequence
  Synthetic oligonucleotide; TTG chr2 60547716 60547737 60547733 60547738 +
ataaagtgcaaaaatccagtga

SEQ ID NO: 208622 - DNA, 22 bp, Artificial Sequence
  Synthetic oligonucleotide; CTC chr2 60547742 60547763 60547759 60547764 +
aggttaaatttatttcaaccct

SEQ ID NO: 208623 - DNA, 22 bp, Artificial Sequence
  Synthetic oligonucleotide; TTA chr2 60547748 60547769 60547765 60547770 +
aatttatttcaaccctacccag

SEQ ID NO: 208624 - DNA, 22 bp, Artificial Sequence
  Synthetic oligonucleotide; TTT chr2 60547753 60547774 60547770 60547775 +
atttcaaccctacccaggctga

SEQ ID NO: 208625 - DNA, 22 bp, Artificial Sequence
  Synthetic oligonucleotide; TTA chr2 60547754 60547775 60547771 60547776 +
tttcaaccctacccaggctgaa

SEQ ID NO: 208626 - DNA, 22 bp, Artificial Sequence
  Synthetic oligonucleotide; TTT chr2 60547757 60547778 60547774 60547779 +
caaccctacccaggctgaatat

SEQ ID NO: 208627 - DNA, 22 bp, Artificial Sequence
  Synthetic oligonucleotide; TTC chr2 60547758 60547779 60547775 60547780 +
aaccctacccaggctgaatatt

SEQ ID NO: 208628 - DNA, 22 bp, Artificial Sequence
  Synthetic oligonucleotide; CTA chr2 60547765 60547786 60547782 60547787 +
cccaggctgaatattgaggggg

SEQ ID NO: 208629 - DNA, 22 bp, Artificial Sequence
  Synthetic oligonucleotide; CTG chr2 60547774 60547795 60547791 60547796 +
aatattgagggggaagatctgg

SEQ ID NO: 208630 - DNA, 22 bp, Artificial Sequence
  Synthetic oligonucleotide; TTG chr2 60547781 60547802 60547798 60547803 +
agggggaagatctggagtaact

SEQ ID NO: 208631 - DNA, 22 bp, Artificial Sequence
  Synthetic oligonucleotide; CTG chr2 60547795 60547816 60547812 60547817 +
gagtaactcccagatgtgctag

SEQ ID NO: 208632 - DNA, 22 bp, Artificial Sequence
  Synthetic oligonucleotide; CTC chr2 60547804 60547825 60547821 60547826 +
ccagatgtgctaggtgaaataa

SEQ ID NO: 208633 - DNA, 22 bp, Artificial Sequence
  Synthetic oligonucleotide; CTA chr2 60547816 60547837 60547833 60547838 +
ggtgaaataatattgagagagc

SEQ ID NO: 208634 - DNA, 22 bp, Artificial Sequence
  Synthetic oligonucleotide; TTG chr2 60547831 60547852 60547848 60547853 +
agagagccctgcctagctgcac

SEQ ID NO: 208635 - DNA, 22 bp, Artificial Sequence
  Synthetic oligonucleotide; CTG chr2 60547842 60547863 60547859 60547864 +
cctagctgcacctgtgctcaag

SEQ ID NO: 208636 - DNA, 22 bp, Artificial Sequence
  Synthetic oligonucleotide; CTA chr2 60547846 60547867 60547863 60547868 +
gctgcacctgtgctcaagtagg

SEQ ID NO: 208637 - DNA, 22 bp, Artificial Sequence
  Synthetic oligonucleotide; CTG chr2 60547850 60547871 60547867 60547872 +
cacctgtgctcaagtaggacat

SEQ ID NO: 208638 - DNA, 22 bp, Artificial Sequence
  Synthetic oligonucleotide; CTG chr2 60547856 60547877 60547873 60547878 +
tgctcaagtaggacatctcata

SEQ ID NO: 208639 - DNA, 22 bp, Artificial Sequence
  Synthetic oligonucleotide; CTC chr2 60547861 60547882 60547878 60547883 +
aagtaggacatctcataatttc

SEQ ID NO: 208640 - DNA, 22 bp, Artificial Sequence
  Synthetic oligonucleotide; CTC chr2 60547875 60547896 60547892 60547897 +
ataatttctagcctctggtact

SEQ ID NO: 208641 - DNA, 22 bp, Artificial Sequence
  Synthetic oligonucleotide; TTT chr2 60547882 60547903 60547899 60547904 +
ctagcctctggtactcctccta

SEQ ID NO: 208642 - DNA, 22 bp, Artificial Sequence
  Synthetic oligonucleotide; TTC chr2 60547883 60547904 60547900 60547905 +
tagcctctggtactcctcctaa

SEQ ID NO: 208643 - DNA, 22 bp, Artificial Sequence
  Synthetic oligonucleotide; CTA chr2 60547885 60547906 60547902 60547907 +
gcctctggtactcctcctaatt

SEQ ID NO: 208644 - DNA, 22 bp, Artificial Sequence
  Synthetic oligonucleotide; CTC chr2 60547890 60547911 60547907 60547912 +
tggtactcctcctaatttaaca

SEQ ID NO: 208645 - DNA, 22 bp, Artificial Sequence
  Synthetic oligonucleotide; CTG chr2 60547892 60547913 60547909 60547914 +
gtactcctcctaatttaacata

SEQ ID NO: 208646 - DNA, 22 bp, Artificial Sequence
  Synthetic oligonucleotide; CTC chr2 60547898 60547919 60547915 60547920 +
ctcctaatttaacataaggtca

SEQ ID NO: 208647 - DNA, 22 bp, Artificial Sequence
  Synthetic oligonucleotide; CTC chr2 60547901 60547922 60547918 60547923 +
ctaatttaacataaggtcacca

SEQ ID NO: 208648 - DNA, 22 bp, Artificial Sequence
  Synthetic oligonucleotide; CTA chr2 60547904 60547925 60547921 60547926 +
atttaacataaggtcaccacag

SEQ ID NO: 208649 - DNA, 22 bp, Artificial Sequence
  Synthetic oligonucleotide; TTT chr2 60547908 60547929 60547925 60547930 +
aacataaggtcaccacaggaat

SEQ ID NO: 208650 - DNA, 22 bp, Artificial Sequence
  Synthetic oligonucleotide; TTA chr2 60547909 60547930 60547926 60547931 +
acataaggtcaccacaggaata

SEQ ID NO: 208651 - DNA, 22 bp, Artificial Sequence
  Synthetic oligonucleotide; TTA chr2 60547940 60547961 60547957 60547962 +
tattcctactaataaagacagt

SEQ ID NO: 208652 - DNA, 22 bp, Artificial Sequence
  Synthetic oligonucleotide; TTC chr2 60547945 60547966 60547962 60547967 +
ctactaataaagacagtaaagt

SEQ ID NO: 208653 - DNA, 22 bp, Artificial Sequence
  Synthetic oligonucleotide; CTA chr2 60547948 60547969 60547965 60547970 +
ctaataaagacagtaaagtaag

SEQ ID NO: 208654 - DNA, 22 bp, Artificial Sequence
  Synthetic oligonucleotide; CTA chr2 60547951 60547972 60547968 60547973 +
ataaagacagtaaagtaagcac

SEQ ID NO: 208655 - DNA, 22 bp, Artificial Sequence
  Synthetic oligonucleotide; CTT chr2 60547975 60547996 60547992 60547997 +
atgtttctttgcccaacatact

SEQ ID NO: 208656 - DNA, 22 bp, Artificial Sequence
  Synthetic oligonucleotide; TTA chr2 60547976 60547997 60547993 60547998 +
tgtttctttgcccaacatactg

SEQ ID NO: 208657 - DNA, 22 bp, Artificial Sequence
  Synthetic oligonucleotide; TTT chr2 60547981 60548002 60547998 60548003 +
ctttgcccaacatactggccaa

SEQ ID NO: 208658 - DNA, 22 bp, Artificial Sequence
  Synthetic oligonucleotide; TTC chr2 60547982 60548003 60547999 60548004 +
tttgcccaacatactggccaaa

SEQ ID NO: 208659 - DNA, 22 bp, Artificial Sequence
  Synthetic oligonucleotide; CTT chr2 60547984 60548005 60548001 60548006 +
tgcccaacatactggccaaaag

SEQ ID NO: 208660 - DNA, 22 bp, Artificial Sequence
  Synthetic oligonucleotide; TTT chr2 60547985 60548006 60548002 60548007 +
gcccaacatactggccaaaaga

SEQ ID NO: 208661 - DNA, 22 bp, Artificial Sequence
  Synthetic oligonucleotide; TTG chr2 60547986 60548007 60548003 60548008 +
cccaacatactggccaaaagat

SEQ ID NO: 208662 - DNA, 22 bp, Artificial Sequence
  Synthetic oligonucleotide; CTG chr2 60547998 60548019 60548015 60548020 +
gccaaaagataaatacagaata

SEQ ID NO: 208663 - DNA, 22 bp, Artificial Sequence
  Synthetic oligonucleotide; CTT chr2 60548033 60548054 60548050 60548055 +
ttcaaataaaagaagacaaaca

SEQ ID NO: 208664 - DNA, 22 bp, Artificial Sequence
  Synthetic oligonucleotide; TTT chr2 60548034 60548055 60548051 60548056 +
tcaaataaaagaagacaaacag

SEQ ID NO: 208665 - DNA, 22 bp, Artificial Sequence
  Synthetic oligonucleotide; TTT chr2 60548035 60548056 60548052 60548057 +
caaataaaagaagacaaacaga

SEQ ID NO: 208666 - DNA, 22 bp, Artificial Sequence
  Synthetic oligonucleotide; TTC chr2 60548036 60548057 60548053 60548058 +
aaataaaagaagacaaacagaa

SEQ ID NO: 208667 - DNA, 22 bp, Artificial Sequence
  Synthetic oligonucleotide; CTC chr2 60548065 60548086 60548082 60548087 +
tgcattgtgccttaatgtcatt

SEQ ID NO: 208668 - DNA, 22 bp, Artificial Sequence
  Synthetic oligonucleotide; CTG chr2 60548067 60548088 60548084 60548089 +
cattgtgccttaatgtcattct

SEQ ID NO: 208669 - DNA, 22 bp, Artificial Sequence
  Synthetic oligonucleotide; TTG chr2 60548072 60548093 60548089 60548094 +
tgccttaatgtcattcttctct

SEQ ID NO: 208670 - DNA, 22 bp, Artificial Sequence
  Synthetic oligonucleotide; CTT chr2 60548078 60548099 60548095 60548100 +
aatgtcattcttctcttacatt

SEQ ID NO: 208671 - DNA, 22 bp, Artificial Sequence
  Synthetic oligonucleotide; TTA chr2 60548079 60548100 60548096 60548101 +
atgtcattcttctcttacattt

SEQ ID NO: 208672 - DNA, 22 bp, Artificial Sequence
  Synthetic oligonucleotide; TTC chr2 60548088 60548109 60548105 60548110 +
ttctcttacatttgcttccatt

SEQ ID NO: 208673 - DNA, 22 bp, Artificial Sequence
  Synthetic oligonucleotide; CTT chr2 60548090 60548111 60548107 60548112 +
ctcttacatttgcttccatttt

SEQ ID NO: 208674 - DNA, 22 bp, Artificial Sequence
  Synthetic oligonucleotide; TTC chr2 60548091 60548112 60548108 60548113 +
tcttacatttgcttccattttg

SEQ ID NO: 208675 - DNA, 22 bp, Artificial Sequence
  Synthetic oligonucleotide; CTC chr2 60548093 60548114 60548110 60548115 +
ttacatttgcttccattttgac

SEQ ID NO: 208676 - DNA, 22 bp, Artificial Sequence
  Synthetic oligonucleotide; CTT chr2 60548095 60548116 60548112 60548117 +
acatttgcttccattttgacca

SEQ ID NO: 208677 - DNA, 22 bp, Artificial Sequence
  Synthetic oligonucleotide; TTA chr2 60548096 60548117 60548113 60548118 +
catttgcttccattttgaccaa

SEQ ID NO: 208678 - DNA, 22 bp, Artificial Sequence
  Synthetic oligonucleotide; TTT chr2 60548101 60548122 60548118 60548123 +
gcttccattttgaccaagtgag

SEQ ID NO: 208679 - DNA, 22 bp, Artificial Sequence
  Synthetic oligonucleotide; TTG chr2 60548102 60548123 60548119 60548124 +
cttccattttgaccaagtgagg

SEQ ID NO: 208680 - DNA, 22 bp, Artificial Sequence
  Synthetic oligonucleotide; CTT chr2 60548105 60548126 60548122 60548127 +
ccattttgaccaagtgaggaat

SEQ ID NO: 208681 - DNA, 22 bp, Artificial Sequence
  Synthetic oligonucleotide; TTC chr2 60548106 60548127 60548123 60548128 +
cattttgaccaagtgaggaata

SEQ ID NO: 208682 - DNA, 22 bp, Artificial Sequence
  Synthetic oligonucleotide; TTT chr2 60548111 60548132 60548128 60548133 +
tgaccaagtgaggaatagggaa

SEQ ID NO: 208683 - DNA, 22 bp, Artificial Sequence
  Synthetic oligonucleotide; TTT chr2 60548112 60548133 60548129 60548134 +
gaccaagtgaggaatagggaac

SEQ ID NO: 208684 - DNA, 22 bp, Artificial Sequence
  Synthetic oligonucleotide; TTG chr2 60548113 60548134 60548130 60548135 +
accaagtgaggaatagggaact

SEQ ID NO: 208685 - DNA, 22 bp, Artificial Sequence
  Synthetic oligonucleotide; CTC chr2 60548136 60548157 60548153 60548158 +
attctcaaaatattcctgttgt

SEQ ID NO: 208686 - DNA, 22 bp, Artificial Sequence
  Synthetic oligonucleotide; TTC chr2 60548140 60548161 60548157 60548162 +
tcaaaatattcctgttgtctga

SEQ ID NO: 208687 - DNA, 22 bp, Artificial Sequence
  Synthetic oligonucleotide; CTC chr2 60548142 60548163 60548159 60548164 +
aaaatattcctgttgtctgaat

SEQ ID NO: 208688 - DNA, 22 bp, Artificial Sequence
  Synthetic oligonucleotide; TTC chr2 60548151 60548172 60548168 60548173 +
ctgttgtctgaattaaggattt

SEQ ID NO: 208689 - DNA, 22 bp, Artificial Sequence
  Synthetic oligonucleotide; CTG chr2 60548154 60548175 60548171 60548176 +
ttgtctgaattaaggattttaa

SEQ ID NO: 208690 - DNA, 22 bp, Artificial Sequence
  Synthetic oligonucleotide; TTG chr2 60548157 60548178 60548174 60548179 +
tctgaattaaggattttaagta

SEQ ID NO: 208691 - DNA, 22 bp, Artificial Sequence
  Synthetic oligonucleotide; CTG chr2 60548161 60548182 60548178 60548183 +
aattaaggattttaagtacaca

SEQ ID NO: 208692 - DNA, 22 bp, Artificial Sequence
  Synthetic oligonucleotide; TTA chr2 60548166 60548187 60548183 60548188 +
aggattttaagtacacattgat

SEQ ID NO: 208693 - DNA, 22 bp, Artificial Sequence
  Synthetic oligonucleotide; TTT chr2 60548173 60548194 60548190 60548195 +
taagtacacattgataaatgtg

SEQ ID NO: 208694 - DNA, 22 bp, Artificial Sequence
  Synthetic oligonucleotide; TTT chr2 60548174 60548195 60548191 60548196 +
aagtacacattgataaatgtgg

SEQ ID NO: 208695 - DNA, 22 bp, Artificial Sequence
  Synthetic oligonucleotide; TTA chr2 60548175 60548196 60548192 60548197 +
agtacacattgataaatgtggc

SEQ ID NO: 208696 - DNA, 22 bp, Artificial Sequence
  Synthetic oligonucleotide; TTG chr2 60548186 60548207 60548203 60548208 +
ataaatgtggcttttttgttta

SEQ ID NO: 208697 - DNA, 22 bp, Artificial Sequence
  Synthetic oligonucleotide; CTT chr2 60548199 60548220 60548216 60548221 +
ttttgtttagcattagctacaa

SEQ ID NO: 208698 - DNA, 22 bp, Artificial Sequence
  Synthetic oligonucleotide; TTT chr2 60548200 60548221 60548217 60548222 +
tttgtttagcattagctacaag

SEQ ID NO: 208699 - DNA, 22 bp, Artificial Sequence
  Synthetic oligonucleotide; TTT chr2 60548201 60548222 60548218 60548223 +
ttgtttagcattagctacaagt

SEQ ID NO: 208700 - DNA, 22 bp, Artificial Sequence
  Synthetic oligonucleotide; TTT chr2 60548202 60548223 60548219 60548224 +
tgtttagcattagctacaagtt

SEQ ID NO: 208701 - DNA, 22 bp, Artificial Sequence
  Synthetic oligonucleotide; TTT chr2 60548203 60548224 60548220 60548225 +
gtttagcattagctacaagttc

SEQ ID NO: 208702 - DNA, 22 bp, Artificial Sequence
  Synthetic oligonucleotide; TTG chr2 60548204 60548225 60548221 60548226 +
tttagcattagctacaagttct

SEQ ID NO: 208703 - DNA, 22 bp, Artificial Sequence
  Synthetic oligonucleotide; TTT chr2 60548207 60548228 60548224 60548229 +
agcattagctacaagttctgag

SEQ ID NO: 208704 - DNA, 22 bp, Artificial Sequence
  Synthetic oligonucleotide; TTA chr2 60548208 60548229 60548225 60548230 +
gcattagctacaagttctgagg

SEQ ID NO: 208705 - DNA, 22 bp, Artificial Sequence
  Synthetic oligonucleotide; TTA chr2 60548214 60548235 60548231 60548236 +
gctacaagttctgaggtttaca

SEQ ID NO: 208706 - DNA, 22 bp, Artificial Sequence
  Synthetic oligonucleotide; CTA chr2 60548218 60548239 60548235 60548240 +
caagttctgaggtttacagact

SEQ ID NO: 208707 - DNA, 22 bp, Artificial Sequence
  Synthetic oligonucleotide; TTC chr2 60548225 60548246 60548242 60548247 +
tgaggtttacagactgaaggaa

SEQ ID NO: 208708 - DNA, 22 bp, Artificial Sequence
  Synthetic oligonucleotide; CTG chr2 60548227 60548248 60548244 60548249 +
aggtttacagactgaaggaaga

SEQ ID NO: 208709 - DNA, 22 bp, Artificial Sequence
  Synthetic oligonucleotide; TTT chr2 60548233 60548254 60548250 60548255 +
acagactgaaggaagacttagg

SEQ ID NO: 208710 - DNA, 22 bp, Artificial Sequence
  Synthetic oligonucleotide; TTA chr2 60548234 60548255 60548251 60548256 +
cagactgaaggaagacttagga

SEQ ID NO: 208711 - DNA, 22 bp, Artificial Sequence
  Synthetic oligonucleotide; CTG chr2 60548241 60548262 60548258 60548263 +
aaggaagacttaggaaaatatt

SEQ ID NO: 208712 - DNA, 22 bp, Artificial Sequence
  Synthetic oligonucleotide; CTT chr2 60548252 60548273 60548269 60548274 +
aggaaaatattttatcaaactt

SEQ ID NO: 208713 - DNA, 22 bp, Artificial Sequence
  Synthetic oligonucleotide; TTA chr2 60548253 60548274 60548270 60548275 +
ggaaaatattttatcaaactta

SEQ ID NO: 208714 - DNA, 22 bp, Artificial Sequence
  Synthetic oligonucleotide; TTT chr2 60548264 60548285 60548281 60548286 +
tatcaaacttactagtacatag

SEQ ID NO: 208715 - DNA, 22 bp, Artificial Sequence
  Synthetic oligonucleotide; TTT chr2 60548265 60548286 60548282 60548287 +
atcaaacttactagtacataga

SEQ ID NO: 208716 - DNA, 22 bp, Artificial Sequence
  Synthetic oligonucleotide; TTA chr2 60548266 60548287 60548283 60548288 +
tcaaacttactagtacatagaa

SEQ ID NO: 208717 - DNA, 22 bp, Artificial Sequence
  Synthetic oligonucleotide; CTT chr2 60548274 60548295 60548291 60548296 +
actagtacatagaacctttgca

SEQ ID NO: 208718 - DNA, 22 bp, Artificial Sequence
  Synthetic oligonucleotide; TTA chr2 60548275 60548296 60548292 60548297 +
ctagtacatagaacctttgcaa

SEQ ID NO: 208719 - DNA, 22 bp, Artificial Sequence
  Synthetic oligonucleotide; CTA chr2 60548278 60548299 60548295 60548300 +
gtacatagaacctttgcaaaaa

SEQ ID NO: 208720 - DNA, 22 bp, Artificial Sequence
  Synthetic oligonucleotide; CTT chr2 60548292 60548313 60548309 60548314 +
tgcaaaaaaaaaaattttttat

SEQ ID NO: 208721 - DNA, 22 bp, Artificial Sequence
  Synthetic oligonucleotide; TTT chr2 60548293 60548314 60548310 60548315 +
gcaaaaaaaaaaattttttatt

SEQ ID NO: 208722 - DNA, 22 bp, Artificial Sequence
  Synthetic oligonucleotide; TTG chr2 60548294 60548315 60548311 60548316 +
caaaaaaaaaaattttttattt

SEQ ID NO: 208723 - DNA, 22 bp, Artificial Sequence
  Synthetic oligonucleotide; TTT chr2 60548309 60548330 60548326 60548331 +
tttatttccaccgttaagattc

SEQ ID NO: 208724 - DNA, 22 bp, Artificial Sequence
  Synthetic oligonucleotide; TTT chr2 60548310 60548331 60548327 60548332 +
ttatttccaccgttaagattct

SEQ ID NO: 208725 - DNA, 22 bp, Artificial Sequence
  Synthetic oligonucleotide; TTT chr2 60548311 60548332 60548328 60548333 +
tatttccaccgttaagattctt

SEQ ID NO: 208726 - DNA, 22 bp, Artificial Sequence
  Synthetic oligonucleotide; TTT chr2 60548312 60548333 60548329 60548334 +
atttccaccgttaagattcttt

SEQ ID NO: 208727 - DNA, 22 bp, Artificial Sequence
  Synthetic oligonucleotide; TTA chr2 60548313 60548334 60548330 60548335 +
tttccaccgttaagattctttt

SEQ ID NO: 208728 - DNA, 22 bp, Artificial Sequence
  Synthetic oligonucleotide; TTT chr2 60548316 60548337 60548333 60548338 +
ccaccgttaagattcttttttt

SEQ ID NO: 208729 - DNA, 22 bp, Artificial Sequence
  Synthetic oligonucleotide; TTC chr2 60548317 60548338 60548334 60548339 +
caccgttaagattctttttttt

SEQ ID NO: 208730 - DNA, 22 bp, Artificial Sequence
  Synthetic oligonucleotide; TTA chr2 60548325 60548346 60548342 60548347 +
agattctttttttttttttttt

SEQ ID NO: 208731 - DNA, 22 bp, Artificial Sequence
  Synthetic oligonucleotide; TTC chr2 60548331 60548352 60548348 60548353 +
ttttttttttttttttgttccc

SEQ ID NO: 208732 - DNA, 22 bp, Artificial Sequence
  Synthetic oligonucleotide; CTT chr2 60548333 60548354 60548350 60548355 +
ttttttttttttttgttcccaa

SEQ ID NO: 208733 - DNA, 22 bp, Artificial Sequence
  Synthetic oligonucleotide; TTT chr2 60548334 60548355 60548351 60548356 +
tttttttttttttgttcccaag

SEQ ID NO: 208734 - DNA, 22 bp, Artificial Sequence
  Synthetic oligonucleotide; TTT chr2 60548335 60548356 60548352 60548357 +
ttttttttttttgttcccaagg

SEQ ID NO: 208735 - DNA, 22 bp, Artificial Sequence
  Synthetic oligonucleotide; TTT chr2 60548336 60548357 60548353 60548358 +
tttttttttttgttcccaaggt

SEQ ID NO: 208736 - DNA, 22 bp, Artificial Sequence
  Synthetic oligonucleotide; TTT chr2 60548337 60548358 60548354 60548359 +
ttttttttttgttcccaaggtc

SEQ ID NO: 208737 - DNA, 22 bp, Artificial Sequence
  Synthetic oligonucleotide; TTT chr2 60548338 60548359 60548355 60548360 +
tttttttttgttcccaaggtct

SEQ ID NO: 208738 - DNA, 22 bp, Artificial Sequence
  Synthetic oligonucleotide; TTT chr2 60548339 60548360 60548356 60548361 +
ttttttttgttcccaaggtctg

SEQ ID NO: 208739 - DNA, 22 bp, Artificial Sequence
  Synthetic oligonucleotide; TTT chr2 60548340 60548361 60548357 60548362 +
tttttttgttcccaaggtctga

SEQ ID NO: 208740 - DNA, 22 bp, Artificial Sequence
  Synthetic oligonucleotide; TTT chr2 60548341 60548362 60548358 60548363 +
ttttttgttcccaaggtctgac

SEQ ID NO: 208741 - DNA, 22 bp, Artificial Sequence
  Synthetic oligonucleotide; TTT chr2 60548342 60548363 60548359 60548364 +
tttttgttcccaaggtctgaca

SEQ ID NO: 208742 - DNA, 22 bp, Artificial Sequence
  Synthetic oligonucleotide; TTT chr2 60548343 60548364 60548360 60548365 +
ttttgttcccaaggtctgacac

SEQ ID NO: 208743 - DNA, 22 bp, Artificial Sequence
  Synthetic oligonucleotide; TTT chr2 60548344 60548365 60548361 60548366 +
tttgttcccaaggtctgacaca

SEQ ID NO: 208744 - DNA, 22 bp, Artificial Sequence
  Synthetic oligonucleotide; TTT chr2 60548345 60548366 60548362 60548367 +
ttgttcccaaggtctgacacat

SEQ ID NO: 208745 - DNA, 22 bp, Artificial Sequence
  Synthetic oligonucleotide; TTT chr2 60548346 60548367 60548363 60548368 +
tgttcccaaggtctgacacatt

SEQ ID NO: 208746 - DNA, 22 bp, Artificial Sequence
  Synthetic oligonucleotide; TTT chr2 60548347 60548368 60548364 60548369 +
gttcccaaggtctgacacattt

SEQ ID NO: 208747 - DNA, 22 bp, Artificial Sequence
  Synthetic oligonucleotide; TTG chr2 60548348 60548369 60548365 60548370 +
ttcccaaggtctgacacatttc

SEQ ID NO: 208748 - DNA, 22 bp, Artificial Sequence
  Synthetic oligonucleotide; TTC chr2 60548351 60548372 60548368 60548373 +
ccaaggtctgacacatttctaa

SEQ ID NO: 208749 - DNA, 22 bp, Artificial Sequence
  Synthetic oligonucleotide; CTG chr2 60548361 60548382 60548378 60548383 +
acacatttctaaaagtgggaat

SEQ ID NO: 208750 - DNA, 22 bp, Artificial Sequence
  Synthetic oligonucleotide; TTT chr2 60548369 60548390 60548386 60548391 +
ctaaaagtgggaatattattta

SEQ ID NO: 208751 - DNA, 22 bp, Artificial Sequence
  Synthetic oligonucleotide; TTC chr2 60548370 60548391 60548387 60548392 +
taaaagtgggaatattatttag

SEQ ID NO: 208752 - DNA, 22 bp, Artificial Sequence
  Synthetic oligonucleotide; CTA chr2 60548372 60548393 60548389 60548394 +
aaagtgggaatattatttaggt

SEQ ID NO: 208753 - DNA, 22 bp, Artificial Sequence
  Synthetic oligonucleotide; TTA chr2 60548387 60548408 60548404 60548409 +
tttaggtgcaaaaggaaatatt

SEQ ID NO: 208754 - DNA, 22 bp, Artificial Sequence
  Synthetic oligonucleotide; TTT chr2 60548390 60548411 60548407 60548412 +
aggtgcaaaaggaaatattctc

SEQ ID NO: 208755 - DNA, 22 bp, Artificial Sequence
  Synthetic oligonucleotide; TTA chr2 60548391 60548412 60548408 60548413 +
ggtgcaaaaggaaatattctcc

SEQ ID NO: 208756 - DNA, 22 bp, Artificial Sequence
  Synthetic oligonucleotide; TTC chr2 60548410 60548431 60548427 60548432 +
tcctaggtatcaaatagttaaa

SEQ ID NO: 208757 - DNA, 22 bp, Artificial Sequence
  Synthetic oligonucleotide; CTC chr2 60548412 60548433 60548429 60548434 +
ctaggtatcaaatagttaaagg

SEQ ID NO: 208758 - DNA, 22 bp, Artificial Sequence
  Synthetic oligonucleotide; CTA chr2 60548415 60548436 60548432 60548437 +
ggtatcaaatagttaaaggtaa

SEQ ID NO: 208759 - DNA, 22 bp, Artificial Sequence
  Synthetic oligonucleotide; TTA chr2 60548430 60548451 60548447 60548452 +
aaggtaatgtggttcaaaacag

SEQ ID NO: 208760 - DNA, 22 bp, Artificial Sequence
  Synthetic oligonucleotide; TTC chr2 60548445 60548466 60548462 60548467 +
aaaacagacttggttaaagtct

SEQ ID NO: 208761 - DNA, 22 bp, Artificial Sequence
  Synthetic oligonucleotide; CTT chr2 60548456 60548477 60548473 60548478 +
ggttaaagtcttctaaatgtag

SEQ ID NO: 208762 - DNA, 22 bp, Artificial Sequence
  Synthetic oligonucleotide; TTG chr2 60548457 60548478 60548474 60548479 +
gttaaagtcttctaaatgtagt

SEQ ID NO: 208763 - DNA, 22 bp, Artificial Sequence
  Synthetic oligonucleotide; TTA chr2 60548461 60548482 60548478 60548483 +
aagtcttctaaatgtagtgact

SEQ ID NO: 208764 - DNA, 22 bp, Artificial Sequence
  Synthetic oligonucleotide; CTT chr2 60548468 60548489 60548485 60548490 +
ctaaatgtagtgactgaactga

SEQ ID NO: 208765 - DNA, 22 bp, Artificial Sequence
  Synthetic oligonucleotide; TTC chr2 60548469 60548490 60548486 60548491 +
taaatgtagtgactgaactgat

SEQ ID NO: 208766 - DNA, 22 bp, Artificial Sequence
  Synthetic oligonucleotide; CTA chr2 60548471 60548492 60548488 60548493 +
aatgtagtgactgaactgattt

SEQ ID NO: 208767 - DNA, 22 bp, Artificial Sequence
  Synthetic oligonucleotide; CTG chr2 60548484 60548505 60548501 60548506 +
aactgatttacaatcaaaaccg

SEQ ID NO: 208768 - DNA, 22 bp, Artificial Sequence
  Synthetic oligonucleotide; CTG chr2 60548489 60548510 60548506 60548511 +
atttacaatcaaaaccgggaaa

SEQ ID NO: 208769 - DNA, 22 bp, Artificial Sequence
  Synthetic oligonucleotide; TTT chr2 60548493 60548514 60548510 60548515 +
acaatcaaaaccgggaaatgaa

SEQ ID NO: 208770 - DNA, 22 bp, Artificial Sequence
  Synthetic oligonucleotide; TTA chr2 60548494 60548515 60548511 60548516 +
caatcaaaaccgggaaatgaag

SEQ ID NO: 208771 - DNA, 22 bp, Artificial Sequence
  Synthetic oligonucleotide; TTC chr2 60548525 60548546 60548542 60548547 +
agaggttgctgattacacctcc

SEQ ID NO: 208772 - DNA, 22 bp, Artificial Sequence
  Synthetic oligonucleotide; TTG chr2 60548533 60548554 60548550 60548555 +
ctgattacacctccacatttca

SEQ ID NO: 208773 - DNA, 22 bp, Artificial Sequence
  Synthetic oligonucleotide; CTG chr2 60548536 60548557 60548553 60548558 +
attacacctccacatttcacct

SEQ ID NO: 208774 - DNA, 22 bp, Artificial Sequence
  Synthetic oligonucleotide; TTA chr2 60548540 60548561 60548557 60548562 +
cacctccacatttcacctaatt

SEQ ID NO: 208775 - DNA, 22 bp, Artificial Sequence
  Synthetic oligonucleotide; CTC chr2 60548546 60548567 60548563 60548568 +
cacatttcacctaattaatttt

SEQ ID NO: 208776 - DNA, 22 bp, Artificial Sequence
  Synthetic oligonucleotide; TTT chr2 60548553 60548574 60548570 60548575 +
cacctaattaattttataggag

SEQ ID NO: 208777 - DNA, 22 bp, Artificial Sequence
  Synthetic oligonucleotide; TTC chr2 60548554 60548575 60548571 60548576 +
acctaattaattttataggagg

SEQ ID NO: 208778 - DNA, 22 bp, Artificial Sequence
  Synthetic oligonucleotide; CTA chr2 60548559 60548580 60548576 60548581 +
attaattttataggaggcaaag

SEQ ID NO: 208779 - DNA, 22 bp, Artificial Sequence
  Synthetic oligonucleotide; TTA chr2 60548563 60548584 60548580 60548585 +
attttataggaggcaaagttct

SEQ ID NO: 208780 - DNA, 22 bp, Artificial Sequence
  Synthetic oligonucleotide; TTT chr2 60548567 60548588 60548584 60548589 +
tataggaggcaaagttcttgaa

SEQ ID NO: 208781 - DNA, 22 bp, Artificial Sequence
  Synthetic oligonucleotide; TTT chr2 60548568 60548589 60548585 60548590 +
ataggaggcaaagttcttgaaa

SEQ ID NO: 208782 - DNA, 22 bp, Artificial Sequence
  Synthetic oligonucleotide; TTA chr2 60548569 60548590 60548586 60548591 +
taggaggcaaagttcttgaaaa

SEQ ID NO: 208783 - DNA, 22 bp, Artificial Sequence
  Synthetic oligonucleotide; TTC chr2 60548584 60548605 60548601 60548606 +
ttgaaaataacaagatgatcaa

SEQ ID NO: 208784 - DNA, 22 bp, Artificial Sequence
  Synthetic oligonucleotide; CTT chr2 60548586 60548607 60548603 60548608 +
gaaaataacaagatgatcaaat

SEQ ID NO: 208785 - DNA, 22 bp, Artificial Sequence
  Synthetic oligonucleotide; TTG chr2 60548587 60548608 60548604 60548609 +
aaaataacaagatgatcaaatg

SEQ ID NO: 208786 - DNA, 22 bp, Artificial Sequence
  Synthetic oligonucleotide; CTG chr2 60548626 60548647 60548643 60548648 +
taacctcaacattttctatgct

SEQ ID NO: 208787 - DNA, 22 bp, Artificial Sequence
  Synthetic oligonucleotide; CTC chr2 60548633 60548654 60548650 60548655 +
aacattttctatgctcttaacg

SEQ ID NO: 208788 - DNA, 22 bp, Artificial Sequence
  Synthetic oligonucleotide; TTT chr2 60548640 60548661 60548657 60548662 +
tctatgctcttaacgtaaatta

SEQ ID NO: 208789 - DNA, 22 bp, Artificial Sequence
  Synthetic oligonucleotide; TTT chr2 60548641 60548662 60548658 60548663 +
ctatgctcttaacgtaaattat

SEQ ID NO: 208790 - DNA, 22 bp, Artificial Sequence
  Synthetic oligonucleotide; TTC chr2 60548642 60548663 60548659 60548664 +
tatgctcttaacgtaaattatt

SEQ ID NO: 208791 - DNA, 22 bp, Artificial Sequence
  Synthetic oligonucleotide; CTA chr2 60548644 60548665 60548661 60548666 +
tgctcttaacgtaaattattgc

SEQ ID NO: 208792 - DNA, 22 bp, Artificial Sequence
  Synthetic oligonucleotide; CTC chr2 60548649 60548670 60548666 60548671 +
ttaacgtaaattattgctaatt

SEQ ID NO: 208793 - DNA, 22 bp, Artificial Sequence
  Synthetic oligonucleotide; CTT chr2 60548651 60548672 60548668 60548673 +
aacgtaaattattgctaattaa

SEQ ID NO: 208794 - DNA, 22 bp, Artificial Sequence
  Synthetic oligonucleotide; TTA chr2 60548652 60548673 60548669 60548674 +
acgtaaattattgctaattaac

SEQ ID NO: 208795 - DNA, 22 bp, Artificial Sequence
  Synthetic oligonucleotide; TTA chr2 60548662 60548683 60548679 60548684 +
ttgctaattaacaagaattata

SEQ ID NO: 208796 - DNA, 22 bp, Artificial Sequence
  Synthetic oligonucleotide; TTG chr2 60548665 60548686 60548682 60548687 +
ctaattaacaagaattatattc

SEQ ID NO: 208797 - DNA, 22 bp, Artificial Sequence
  Synthetic oligonucleotide; CTA chr2 60548668 60548689 60548685 60548690 +
attaacaagaattatattctaa

SEQ ID NO: 208798 - DNA, 22 bp, Artificial Sequence
  Synthetic oligonucleotide; TTA chr2 60548672 60548693 60548689 60548694 +
acaagaattatattctaatgta

SEQ ID NO: 208799 - DNA, 22 bp, Artificial Sequence
  Synthetic oligonucleotide; TTA chr2 60548682 60548703 60548699 60548704 +
tattctaatgtatgaaatacgt

SEQ ID NO: 208800 - DNA, 22 bp, Artificial Sequence
  Synthetic oligonucleotide; TTC chr2 60548687 60548708 60548704 60548709 +
taatgtatgaaatacgtttaac

SEQ ID NO: 208801 - DNA, 22 bp, Artificial Sequence
  Synthetic oligonucleotide; CTA chr2 60548689 60548710 60548706 60548711 +
atgtatgaaatacgtttaacat

SEQ ID NO: 208802 - DNA, 22 bp, Artificial Sequence
  Synthetic oligonucleotide; TTT chr2 60548706 60548727 60548723 60548728 +
aacatcggtctccttgcaaaac

SEQ ID NO: 208803 - DNA, 22 bp, Artificial Sequence
  Synthetic oligonucleotide; TTA chr2 60548707 60548728 60548724 60548729 +
acatcggtctccttgcaaaaca

SEQ ID NO: 208804 - DNA, 22 bp, Artificial Sequence
  Synthetic oligonucleotide; CTC chr2 60548718 60548739 60548735 60548740 +
cttgcaaaacatttggctagtg

SEQ ID NO: 208805 - DNA, 22 bp, Artificial Sequence
  Synthetic oligonucleotide; CTT chr2 60548721 60548742 60548738 60548743 +
gcaaaacatttggctagtggtg

SEQ ID NO: 208806 - DNA, 22 bp, Artificial Sequence
  Synthetic oligonucleotide; TTG chr2 60548722 60548743 60548739 60548744 +
caaaacatttggctagtggtgt

SEQ ID NO: 208807 - DNA, 22 bp, Artificial Sequence
  Synthetic oligonucleotide; TTT chr2 60548732 60548753 60548749 60548754 +
ggctagtggtgttcagagaaat

SEQ ID NO: 208808 - DNA, 22 bp, Artificial Sequence
  Synthetic oligonucleotide; TTG chr2 60548733 60548754 60548750 60548755 +
gctagtggtgttcagagaaata

SEQ ID NO: 208809 - DNA, 22 bp, Artificial Sequence
  Synthetic oligonucleotide; CTA chr2 60548737 60548758 60548754 60548759 +
gtggtgttcagagaaataccaa

SEQ ID NO: 208810 - DNA, 22 bp, Artificial Sequence
  Synthetic oligonucleotide; TTC chr2 60548746 60548767 60548763 60548768 +
agagaaataccaaaacgtgttt

SEQ ID NO: 208811 - DNA, 22 bp, Artificial Sequence
  Synthetic oligonucleotide; TTT chr2 60548768 60548789 60548785 60548790 +
ttatcattgctggtatattatt

SEQ ID NO: 208812 - DNA, 22 bp, Artificial Sequence
  Synthetic oligonucleotide; TTT chr2 60548769 60548790 60548786 60548791 +
tatcattgctggtatattatta

SEQ ID NO: 208813 - DNA, 22 bp, Artificial Sequence
  Synthetic oligonucleotide; TTT chr2 60548770 60548791 60548787 60548792 +
atcattgctggtatattattaa

SEQ ID NO: 208814 - DNA, 22 bp, Artificial Sequence
  Synthetic oligonucleotide; TTA chr2 60548771 60548792 60548788 60548793 +
tcattgctggtatattattaaa

SEQ ID NO: 208815 - DNA, 22 bp, Artificial Sequence
  Synthetic oligonucleotide; TTG chr2 60548777 60548798 60548794 60548799 +
ctggtatattattaaaaatcag

SEQ ID NO: 208816 - DNA, 22 bp, Artificial Sequence
  Synthetic oligonucleotide; CTG chr2 60548780 60548801 60548797 60548802 +
gtatattattaaaaatcagaca

SEQ ID NO: 208817 - DNA, 22 bp, Artificial Sequence
  Synthetic oligonucleotide; TTA chr2 60548788 60548809 60548805 60548810 +
ttaaaaatcagacaaagtggga

SEQ ID NO: 208818 - DNA, 22 bp, Artificial Sequence
  Synthetic oligonucleotide; TTA chr2 60548791 60548812 60548808 60548813 +
aaaatcagacaaagtgggacac

SEQ ID NO: 208819 - DNA, 22 bp, Artificial Sequence
  Synthetic oligonucleotide; TTC chr2 60548837 60548858 60548854 60548859 +
tcatggtgtagtctactgattt

SEQ ID NO: 208820 - DNA, 22 bp, Artificial Sequence
  Synthetic oligonucleotide; CTC chr2 60548839 60548860 60548856 60548861 +
atggtgtagtctactgatttgc

SEQ ID NO: 208821 - DNA, 22 bp, Artificial Sequence
  Synthetic oligonucleotide; CTA chr2 60548852 60548873 60548869 60548874 +
ctgatttgcattgacatctttt

SEQ ID NO: 208822 - DNA, 22 bp, Artificial Sequence
  Synthetic oligonucleotide; CTG chr2 60548855 60548876 60548872 60548877 +
atttgcattgacatcttttctc

SEQ ID NO: 208823 - DNA, 22 bp, Artificial Sequence
  Synthetic oligonucleotide; TTT chr2 60548859 60548880 60548876 60548881 +
gcattgacatcttttctcagtg

SEQ ID NO: 208824 - DNA, 22 bp, Artificial Sequence
  Synthetic oligonucleotide; TTG chr2 60548860 60548881 60548877 60548882 +
cattgacatcttttctcagtgg

SEQ ID NO: 208825 - DNA, 22 bp, Artificial Sequence
  Synthetic oligonucleotide; TTG chr2 60548865 60548886 60548882 60548887 +
acatcttttctcagtggcaatc

SEQ ID NO: 208826 - DNA, 22 bp, Artificial Sequence
  Synthetic oligonucleotide; CTT chr2 60548872 60548893 60548889 60548894 +
ttctcagtggcaatcaacattt

SEQ ID NO: 208827 - DNA, 22 bp, Artificial Sequence
  Synthetic oligonucleotide; TTT chr2 60548873 60548894 60548890 60548895 +
tctcagtggcaatcaacatttc

SEQ ID NO: 208828 - DNA, 22 bp, Artificial Sequence
  Synthetic oligonucleotide; TTT chr2 60548874 60548895 60548891 60548896 +
ctcagtggcaatcaacatttcc

SEQ ID NO: 208829 - DNA, 22 bp, Artificial Sequence
  Synthetic oligonucleotide; TTC chr2 60548875 60548896 60548892 60548897 +
tcagtggcaatcaacatttcct

SEQ ID NO: 208830 - DNA, 22 bp, Artificial Sequence
  Synthetic oligonucleotide; CTC chr2 60548877 60548898 60548894 60548899 +
agtggcaatcaacatttccttt

SEQ ID NO: 208831 - DNA, 22 bp, Artificial Sequence
  Synthetic oligonucleotide; TTT chr2 60548894 60548915 60548911 60548916 +
cctttctgggcatctgataatt

SEQ ID NO: 208832 - DNA, 22 bp, Artificial Sequence
  Synthetic oligonucleotide; TTC chr2 60548895 60548916 60548912 60548917 +
ctttctgggcatctgataattt

SEQ ID NO: 208833 - DNA, 22 bp, Artificial Sequence
  Synthetic oligonucleotide; CTT chr2 60548898 60548919 60548915 60548920 +
tctgggcatctgataatttctc

SEQ ID NO: 208834 - DNA, 22 bp, Artificial Sequence
  Synthetic oligonucleotide; TTT chr2 60548899 60548920 60548916 60548921 +
ctgggcatctgataatttctct

SEQ ID NO: 208835 - DNA, 22 bp, Artificial Sequence
  Synthetic oligonucleotide; TTC chr2 60548900 60548921 60548917 60548922 +
tgggcatctgataatttctctg

SEQ ID NO: 208836 - DNA, 22 bp, Artificial Sequence
  Synthetic oligonucleotide; CTG chr2 60548902 60548923 60548919 60548924 +
ggcatctgataatttctctgca

SEQ ID NO: 208837 - DNA, 22 bp, Artificial Sequence
  Synthetic oligonucleotide; CTG chr2 60548910 60548931 60548927 60548932 +
ataatttctctgcattttaatg

SEQ ID NO: 208838 - DNA, 22 bp, Artificial Sequence
  Synthetic oligonucleotide; TTT chr2 60548917 60548938 60548934 60548939 +
ctctgcattttaatgcaaattc

SEQ ID NO: 208839 - DNA, 22 bp, Artificial Sequence
  Synthetic oligonucleotide; TTC chr2 60548918 60548939 60548935 60548940 +
tctgcattttaatgcaaattcc

SEQ ID NO: 208840 - DNA, 22 bp, Artificial Sequence
  Synthetic oligonucleotide; CTC chr2 60548920 60548941 60548937 60548942 +
tgcattttaatgcaaattcccc

SEQ ID NO: 208841 - DNA, 22 bp, Artificial Sequence
  Synthetic oligonucleotide; CTG chr2 60548922 60548943 60548939 60548944 +
cattttaatgcaaattcccctt

SEQ ID NO: 208842 - DNA, 22 bp, Artificial Sequence
  Synthetic oligonucleotide; TTT chr2 60548927 60548948 60548944 60548949 +
taatgcaaattcccctttccct

SEQ ID NO: 208843 - DNA, 22 bp, Artificial Sequence
  Synthetic oligonucleotide; TTT chr2 60548928 60548949 60548945 60548950 +
aatgcaaattcccctttcccta

SEQ ID NO: 208844 - DNA, 22 bp, Artificial Sequence
  Synthetic oligonucleotide; TTA chr2 60548929 60548950 60548946 60548951 +
atgcaaattcccctttccctaa

SEQ ID NO: 208845 - DNA, 22 bp, Artificial Sequence
  Synthetic oligonucleotide; TTC chr2 60548939 60548960 60548956 60548961 +
ccctttccctaaaaaccttcct

SEQ ID NO: 208846 - DNA, 22 bp, Artificial Sequence
  Synthetic oligonucleotide; CTT chr2 60548944 60548965 60548961 60548966 +
tccctaaaaaccttcctaaccc

SEQ ID NO: 208847 - DNA, 22 bp, Artificial Sequence
  Synthetic oligonucleotide; TTT chr2 60548945 60548966 60548962 60548967 +
ccctaaaaaccttcctaaccct

SEQ ID NO: 208848 - DNA, 22 bp, Artificial Sequence
  Synthetic oligonucleotide; TTC chr2 60548946 60548967 60548963 60548968 +
cctaaaaaccttcctaaccctc

SEQ ID NO: 208849 - DNA, 22 bp, Artificial Sequence
  Synthetic oligonucleotide; CTA chr2 60548950 60548971 60548967 60548972 +
aaaaccttcctaaccctcagcc

SEQ ID NO: 208850 - DNA, 22 bp, Artificial Sequence
  Synthetic oligonucleotide; CTT chr2 60548958 60548979 60548975 60548980 +
cctaaccctcagccatttaccc

SEQ ID NO: 208851 - DNA, 22 bp, Artificial Sequence
  Synthetic oligonucleotide; TTC chr2 60548959 60548980 60548976 60548981 +
ctaaccctcagccatttacccc

SEQ ID NO: 208852 - DNA, 22 bp, Artificial Sequence
  Synthetic oligonucleotide; CTA chr2 60548962 60548983 60548979 60548984 +
accctcagccatttaccccctc

SEQ ID NO: 208853 - DNA, 22 bp, Artificial Sequence
  Synthetic oligonucleotide; CTC chr2 60548968 60548989 60548985 60548990 +
agccatttaccccctccctcaa

SEQ ID NO: 208854 - DNA, 22 bp, Artificial Sequence
  Synthetic oligonucleotide; TTT chr2 60548976 60548997 60548993 60548998 +
accccctccctcaattcaactc

SEQ ID NO: 208855 - DNA, 22 bp, Artificial Sequence
  Synthetic oligonucleotide; TTA chr2 60548977 60548998 60548994 60548999 +
ccccctccctcaattcaactcc

SEQ ID NO: 208856 - DNA, 22 bp, Artificial Sequence
  Synthetic oligonucleotide; CTC chr2 60548984 60549005 60549001 60549006 +
cctcaattcaactccatcctcc

SEQ ID NO: 208857 - DNA, 22 bp, Artificial Sequence
  Synthetic oligonucleotide; CTC chr2 60548988 60549009 60549005 60549010 +
aattcaactccatcctccttcg

SEQ ID NO: 208858 - DNA, 22 bp, Artificial Sequence
  Synthetic oligonucleotide; TTC chr2 60548993 60549014 60549010 60549015 +
aactccatcctccttcgcccca

SEQ ID NO: 208859 - DNA, 22 bp, Artificial Sequence
  Synthetic oligonucleotide; CTC chr2 60548998 60549019 60549015 60549020 +
catcctccttcgccccaacaat

SEQ ID NO: 208860 - DNA, 22 bp, Artificial Sequence
  Synthetic oligonucleotide; CTC chr2 60549005 60549026 60549022 60549027 +
cttcgccccaacaataccaaca

SEQ ID NO: 208861 - DNA, 22 bp, Artificial Sequence
  Synthetic oligonucleotide; CTT chr2 60549008 60549029 60549025 60549030 +
cgccccaacaataccaacattt

SEQ ID NO: 208862 - DNA, 22 bp, Artificial Sequence
  Synthetic oligonucleotide; TTC chr2 60549009 60549030 60549026 60549031 +
gccccaacaataccaacatttc

SEQ ID NO: 208863 - DNA, 22 bp, Artificial Sequence
  Synthetic oligonucleotide; TTT chr2 60549030 60549051 60549047 60549052 +
ctaagctccggcctaaactccg

SEQ ID NO: 208864 - DNA, 22 bp, Artificial Sequence
  Synthetic oligonucleotide; TTC chr2 60549031 60549052 60549048 60549053 +
taagctccggcctaaactccgg

SEQ ID NO: 208865 - DNA, 22 bp, Artificial Sequence
  Synthetic oligonucleotide; CTA chr2 60549033 60549054 60549050 60549055 +
agctccggcctaaactccggct

SEQ ID NO: 208866 - DNA, 22 bp, Artificial Sequence
  Synthetic oligonucleotide; CTC chr2 60549038 60549059 60549055 60549060 +
cggcctaaactccggctacaaa

SEQ ID NO: 208867 - DNA, 22 bp, Artificial Sequence
  Synthetic oligonucleotide; CTA chr2 60549045 60549066 60549062 60549067 +
aactccggctacaaagcaggga

SEQ ID NO: 208868 - DNA, 22 bp, Artificial Sequence
  Synthetic oligonucleotide; CTC chr2 60549050 60549071 60549067 60549072 +
cggctacaaagcagggagtcct

SEQ ID NO: 208869 - DNA, 22 bp, Artificial Sequence
  Synthetic oligonucleotide; CTA chr2 60549056 60549077 60549073 60549078 +
caaagcagggagtcctcgattg

SEQ ID NO: 208870 - DNA, 22 bp, Artificial Sequence
  Synthetic oligonucleotide; CTC chr2 60549073 60549094 60549090 60549095 +
gattgaagtggaagggagtggg

SEQ ID NO: 208871 - DNA, 22 bp, Artificial Sequence
  Synthetic oligonucleotide; TTG chr2 60549078 60549099 60549095 60549100 +
aagtggaagggagtgggcaaat

SEQ ID NO: 208872 - DNA, 22 bp, Artificial Sequence
  Synthetic oligonucleotide; TTA chr2 60549114 60549135 60549131 60549136 +
gccgcgaattctctctacgagg

SEQ ID NO: 208873 - DNA, 22 bp, Artificial Sequence
  Synthetic oligonucleotide; TTC chr2 60549125 60549146 60549142 60549147 +
tctctacgaggggaggaagaaa

SEQ ID NO: 208874 - DNA, 22 bp, Artificial Sequence
  Synthetic oligonucleotide; CTC chr2 60549127 60549148 60549144 60549149 +
tctacgaggggaggaagaaata

SEQ ID NO: 208875 - DNA, 22 bp, Artificial Sequence
  Synthetic oligonucleotide; CTC chr2 60549129 60549150 60549146 60549151 +
tacgaggggaggaagaaataga

SEQ ID NO: 208876 - DNA, 22 bp, Artificial Sequence
  Synthetic oligonucleotide; CTA chr2 60549131 60549152 60549148 60549153 +
cgaggggaggaagaaatagaaa

SEQ ID NO: 208877 - DNA, 22 bp, Artificial Sequence
  Synthetic oligonucleotide; CTT chr2 60549164 60549185 60549181 60549186 +
ctacgttcaaacagcaagacag

SEQ ID NO: 208878 - DNA, 22 bp, Artificial Sequence
  Synthetic oligonucleotide; TTC chr2 60549165 60549186 60549182 60549187 +
tacgttcaaacagcaagacagc

SEQ ID NO: 208879 - DNA, 22 bp, Artificial Sequence
  Synthetic oligonucleotide; CTA chr2 60549167 60549188 60549184 60549189 +
cgttcaaacagcaagacagcct

SEQ ID NO: 208880 - DNA, 22 bp, Artificial Sequence
  Synthetic oligonucleotide; TTC chr2 60549172 60549193 60549189 60549194 +
aaacagcaagacagcctggaac

SEQ ID NO: 208881 - DNA, 22 bp, Artificial Sequence
  Synthetic oligonucleotide; CTG chr2 60549190 60549211 60549207 60549212 +
gaacgtctcaatgtctcagtga

SEQ ID NO: 208882 - DNA, 22 bp, Artificial Sequence
  Synthetic oligonucleotide; CTC chr2 60549199 60549220 60549216 60549221 +
aatgtctcagtgacagactgag

SEQ ID NO: 208883 - DNA, 22 bp, Artificial Sequence
  Synthetic oligonucleotide; CTC chr2 60549207 60549228 60549224 60549229 +
agtgacagactgagatctcttt

SEQ ID NO: 208884 - DNA, 22 bp, Artificial Sequence
  Synthetic oligonucleotide; CTG chr2 60549219 60549240 60549236 60549241 +
agatctctttcctctctgtgta

SEQ ID NO: 208885 - DNA, 22 bp, Artificial Sequence
  Synthetic oligonucleotide; CTC chr2 60549226 60549247 60549243 60549248 +
tttcctctctgtgtagttgcaa

SEQ ID NO: 208886 - DNA, 22 bp, Artificial Sequence
  Synthetic oligonucleotide; CTT chr2 60549228 60549249 60549245 60549250 +
tcctctctgtgtagttgcaaaa

SEQ ID NO: 208887 - DNA, 22 bp, Artificial Sequence
  Synthetic oligonucleotide; TTT chr2 60549229 60549250 60549246 60549251 +
cctctctgtgtagttgcaaaag

SEQ ID NO: 208888 - DNA, 22 bp, Artificial Sequence
  Synthetic oligonucleotide; TTC chr2 60549230 60549251 60549247 60549252 +
ctctctgtgtagttgcaaaaga

SEQ ID NO: 208889 - DNA, 22 bp, Artificial Sequence
  Synthetic oligonucleotide; CTC chr2 60549233 60549254 60549250 60549255 +
tctgtgtagttgcaaaagaata

SEQ ID NO: 208890 - DNA, 22 bp, Artificial Sequence
  Synthetic oligonucleotide; CTC chr2 60549235 60549256 60549252 60549257 +
tgtgtagttgcaaaagaataaa

SEQ ID NO: 208891 - DNA, 22 bp, Artificial Sequence
  Synthetic oligonucleotide; CTG chr2 60549237 60549258 60549254 60549259 +
tgtagttgcaaaagaataaatt

SEQ ID NO: 208892 - DNA, 22 bp, Artificial Sequence
  Synthetic oligonucleotide; TTG chr2 60549245 60549266 60549262 60549267 +
caaaagaataaatttaagggaa

SEQ ID NO: 208893 - DNA, 22 bp, Artificial Sequence
  Synthetic oligonucleotide; TTT chr2 60549260 60549281 60549277 60549282 +
aagggaaaaaaataatccttat

SEQ ID NO: 208894 - DNA, 22 bp, Artificial Sequence
  Synthetic oligonucleotide; TTA chr2 60549261 60549282 60549278 60549283 +
agggaaaaaaataatccttata

SEQ ID NO: 208895 - DNA, 22 bp, Artificial Sequence
  Synthetic oligonucleotide; CTT chr2 60549280 60549301 60549297 60549302 +
ataggaaatgttggtaaggagc

SEQ ID NO: 208896 - DNA, 22 bp, Artificial Sequence
  Synthetic oligonucleotide; TTA chr2 60549281 60549302 60549298 60549303 +
taggaaatgttggtaaggagcg

SEQ ID NO: 208897 - DNA, 22 bp, Artificial Sequence
  Synthetic oligonucleotide; TTG chr2 60549293 60549314 60549310 60549315 +
gtaaggagcgagcaaaacgaga

SEQ ID NO: 208898 - DNA, 22 bp, Artificial Sequence
  Synthetic oligonucleotide; CTG chr2 60549319 60549340 60549336 60549341 +
ccggggagcggagggggagggg

SEQ ID NO: 208899 - DNA, 22 bp, Artificial Sequence
  Synthetic oligonucleotide; CTT chr2 60549359 60549380 60549376 60549381 +
caagtttgctttccaagtcctt

SEQ ID NO: 208900 - DNA, 22 bp, Artificial Sequence
  Synthetic oligonucleotide; TTC chr2 60549360 60549381 60549377 60549382 +
aagtttgctttccaagtccttc

SEQ ID NO: 208901 - DNA, 22 bp, Artificial Sequence
  Synthetic oligonucleotide; TTT chr2 60549366 60549387 60549383 60549388 +
gctttccaagtccttctccttg

SEQ ID NO: 208902 - DNA, 22 bp, Artificial Sequence
  Synthetic oligonucleotide; TTG chr2 60549367 60549388 60549384 60549389 +
ctttccaagtccttctccttga

SEQ ID NO: 208903 - DNA, 22 bp, Artificial Sequence
  Synthetic oligonucleotide; CTT chr2 60549370 60549391 60549387 60549392 +
tccaagtccttctccttgattg

SEQ ID NO: 208904 - DNA, 22 bp, Artificial Sequence
  Synthetic oligonucleotide; TTT chr2 60549371 60549392 60549388 60549393 +
ccaagtccttctccttgattgt

SEQ ID NO: 208905 - DNA, 22 bp, Artificial Sequence
  Synthetic oligonucleotide; TTC chr2 60549372 60549393 60549389 60549394 +
caagtccttctccttgattgtc

SEQ ID NO: 208906 - DNA, 22 bp, Artificial Sequence
  Synthetic oligonucleotide; CTT chr2 60549381 60549402 60549398 60549403 +
ctccttgattgtcttaacaggg

SEQ ID NO: 208907 - DNA, 22 bp, Artificial Sequence
  Synthetic oligonucleotide; TTC chr2 60549382 60549403 60549399 60549404 +
tccttgattgtcttaacagggt

SEQ ID NO: 208908 - DNA, 22 bp, Artificial Sequence
  Synthetic oligonucleotide; CTC chr2 60549384 60549405 60549401 60549406 +
cttgattgtcttaacagggtaa

SEQ ID NO: 208909 - DNA, 22 bp, Artificial Sequence
  Synthetic oligonucleotide; CTT chr2 60549387 60549408 60549404 60549409 +
gattgtcttaacagggtaaaga

SEQ ID NO: 208910 - DNA, 22 bp, Artificial Sequence
  Synthetic oligonucleotide; TTG chr2 60549388 60549409 60549405 60549410 +
attgtcttaacagggtaaagaa

SEQ ID NO: 208911 - DNA, 22 bp, Artificial Sequence
  Synthetic oligonucleotide; TTG chr2 60549392 60549413 60549409 60549414 +
tcttaacagggtaaagaagcaa

SEQ ID NO: 208912 - DNA, 22 bp, Artificial Sequence
  Synthetic oligonucleotide; CTT chr2 60549396 60549417 60549413 60549418 +
aacagggtaaagaagcaaacgg

SEQ ID NO: 208913 - DNA, 22 bp, Artificial Sequence
  Synthetic oligonucleotide; TTA chr2 60549397 60549418 60549414 60549419 +
acagggtaaagaagcaaacgga

SEQ ID NO: 208914 - DNA, 22 bp, Artificial Sequence
  Synthetic oligonucleotide; CTG chr2 60549424 60549445 60549441 60549446 +
aaattcagagaggaaaagcaaa

SEQ ID NO: 208915 - DNA, 22 bp, Artificial Sequence
  Synthetic oligonucleotide; TTC chr2 60549430 60549451 60549447 60549452 +
agagaggaaaagcaaagaaaca

SEQ ID NO: 208916 - DNA, 22 bp, Artificial Sequence
  Synthetic oligonucleotide; CTA chr2 60549471 60549492 60549488 60549493 +
caggcccggggcaggggccccg

SEQ ID NO: 208917 - DNA, 22 bp, Artificial Sequence
  Synthetic oligonucleotide; TTG chr2 60549524 60549545 60549541 60549546 +
ggcgcggggactctgaggcaca

SEQ ID NO: 208918 - DNA, 22 bp, Artificial Sequence
  Synthetic oligonucleotide; CTC chr2 60549537 60549558 60549554 60549559 +
tgaggcacaaagcgagcagcgt

SEQ ID NO: 208919 - DNA, 22 bp, Artificial Sequence
  Synthetic oligonucleotide; CTG chr2 60549539 60549560 60549556 60549561 +
aggcacaaagcgagcagcgtgc

SEQ ID NO: 208920 - DNA, 22 bp, Artificial Sequence
  Synthetic oligonucleotide; CTG chr2 60549563 60549584 60549580 60549585 +
gctgcaggctcccgccgcgctt

SEQ ID NO: 208921 - DNA, 22 bp, Artificial Sequence
  Synthetic oligonucleotide; CTG chr2 60549567 60549588 60549584 60549589 +
caggctcccgccgcgcttgctg

SEQ ID NO: 208922 - DNA, 22 bp, Artificial Sequence
  Synthetic oligonucleotide; CTC chr2 60549574 60549595 60549591 60549596 +
ccgccgcgcttgctgcgaacac

SEQ ID NO: 208923 - DNA, 22 bp, Artificial Sequence
  Synthetic oligonucleotide; CTT chr2 60549585 60549606 60549602 60549607 +
gctgcgaacacgtgcagcagcg

SEQ ID NO: 208924 - DNA, 22 bp, Artificial Sequence
  Synthetic oligonucleotide; TTG chr2 60549586 60549607 60549603 60549608 +
ctgcgaacacgtgcagcagcgg

SEQ ID NO: 208925 - DNA, 22 bp, Artificial Sequence
  Synthetic oligonucleotide; CTG chr2 60549589 60549610 60549606 60549611 +
cgaacacgtgcagcagcggccg

SEQ ID NO: 208926 - DNA, 22 bp, Artificial Sequence
  Synthetic oligonucleotide; CTT chr2 60549620 60549641 60549637 60549642 +
ggggcccgggggcccggagacg

SEQ ID NO: 208927 - DNA, 22 bp, Artificial Sequence
  Synthetic oligonucleotide; TTG chr2 60549621 60549642 60549638 60549643 +
gggcccgggggcccggagacgg

SEQ ID NO: 208928 - DNA, 22 bp, Artificial Sequence
  Synthetic oligonucleotide; CTG chr2 60549662 60549683 60549679 60549684 +
actgctgcctccatgcccgtcc

SEQ ID NO: 208929 - DNA, 22 bp, Artificial Sequence
  Synthetic oligonucleotide; CTG chr2 60549666 60549687 60549683 60549688 +
ctgcctccatgcccgtccagct

SEQ ID NO: 208930 - DNA, 22 bp, Artificial Sequence
  Synthetic oligonucleotide; CTG chr2 60549669 60549690 60549686 60549691 +
cctccatgcccgtccagctcgg

SEQ ID NO: 208931 - DNA, 22 bp, Artificial Sequence
  Synthetic oligonucleotide; CTC chr2 60549673 60549694 60549690 60549695 +
catgcccgtccagctcggccag

SEQ ID NO: 208932 - DNA, 22 bp, Artificial Sequence
  Synthetic oligonucleotide; CTC chr2 60549689 60549710 60549706 60549711 +
ggccagctcggccgcggggtga

SEQ ID NO: 208933 - DNA, 22 bp, Artificial Sequence
  Synthetic oligonucleotide; CTC chr2 60549698 60549719 60549715 60549720 +
ggccgcggggtgacggttccct

SEQ ID NO: 208934 - DNA, 22 bp, Artificial Sequence
  Synthetic oligonucleotide; TTC chr2 60549717 60549738 60549734 60549739 +
cctgggcctgccagttggtgaa

SEQ ID NO: 208935 - DNA, 22 bp, Artificial Sequence
  Synthetic oligonucleotide; CTG chr2 60549721 60549742 60549738 60549743 +
ggcctgccagttggtgaaaaag

SEQ ID NO: 208936 - DNA, 22 bp, Artificial Sequence
  Synthetic oligonucleotide; CTG chr2 60549727 60549748 60549744 60549749 +
ccagttggtgaaaaaggaagtg

SEQ ID NO: 208937 - DNA, 22 bp, Artificial Sequence
  Synthetic oligonucleotide; TTG chr2 60549734 60549755 60549751 60549756 +
gtgaaaaaggaagtgaggtttg

SEQ ID NO: 208938 - DNA, 22 bp, Artificial Sequence
  Synthetic oligonucleotide; TTT chr2 60549755 60549776 60549772 60549777 +
ggaaaacccggctggttaacct

SEQ ID NO: 208939 - DNA, 22 bp, Artificial Sequence
  Synthetic oligonucleotide; TTG chr2 60549756 60549777 60549773 60549778 +
gaaaacccggctggttaacctg

SEQ ID NO: 208940 - DNA, 22 bp, Artificial Sequence
  Synthetic oligonucleotide; CTG chr2 60549769 60549790 60549786 60549791 +
gttaacctggtgcagtctcagt

SEQ ID NO: 208941 - DNA, 22 bp, Artificial Sequence
  Synthetic oligonucleotide; TTA chr2 60549773 60549794 60549790 60549795 +
acctggtgcagtctcagtatct

SEQ ID NO: 208942 - DNA, 22 bp, Artificial Sequence
  Synthetic oligonucleotide; CTG chr2 60549778 60549799 60549795 60549800 +
gtgcagtctcagtatctccgca

SEQ ID NO: 208943 - DNA, 22 bp, Artificial Sequence
  Synthetic oligonucleotide; CTC chr2 60549788 60549809 60549805 60549810 +
agtatctccgcacacacctcaa

SEQ ID NO: 208944 - DNA, 22 bp, Artificial Sequence
  Synthetic oligonucleotide; CTC chr2 60549796 60549817 60549813 60549818 +
cgcacacacctcaagcgcgggt

SEQ ID NO: 208945 - DNA, 22 bp, Artificial Sequence
  Synthetic oligonucleotide; CTC chr2 60549808 60549829 60549825 60549830 +
aagcgcgggtcctgagattcat

SEQ ID NO: 208946 - DNA, 22 bp, Artificial Sequence
  Synthetic oligonucleotide; CTG chr2 60549822 60549843 60549839 60549844 +
agattcattctgtgtccacaag

SEQ ID NO: 208947 - DNA, 22 bp, Artificial Sequence
  Synthetic oligonucleotide; TTC chr2 60549828 60549849 60549845 60549850 +
attctgtgtccacaagcttaca

SEQ ID NO: 208948 - DNA, 22 bp, Artificial Sequence
  Synthetic oligonucleotide; TTC chr2 60549832 60549853 60549849 60549854 +
tgtgtccacaagcttacacttt

SEQ ID NO: 208949 - DNA, 22 bp, Artificial Sequence
  Synthetic oligonucleotide; CTG chr2 60549834 60549855 60549851 60549856 +
tgtccacaagcttacacttttt

SEQ ID NO: 208950 - DNA, 22 bp, Artificial Sequence
  Synthetic oligonucleotide; CTT chr2 60549847 60549868 60549864 60549869 +
acactttttactttgggggatc

SEQ ID NO: 208951 - DNA, 22 bp, Artificial Sequence
  Synthetic oligonucleotide; TTA chr2 60549848 60549869 60549865 60549870 +
cactttttactttgggggatct

SEQ ID NO: 208952 - DNA, 22 bp, Artificial Sequence
  Synthetic oligonucleotide; CTT chr2 60549853 60549874 60549870 60549875 +
tttactttgggggatctctgca

SEQ ID NO: 208953 - DNA, 22 bp, Artificial Sequence
  Synthetic oligonucleotide; TTT chr2 60549854 60549875 60549871 60549876 +
ttactttgggggatctctgcaa

SEQ ID NO: 208954 - DNA, 22 bp, Artificial Sequence
  Synthetic oligonucleotide; TTT chr2 60549855 60549876 60549872 60549877 +
tactttgggggatctctgcaaa

SEQ ID NO: 208955 - DNA, 22 bp, Artificial Sequence
  Synthetic oligonucleotide; TTT chr2 60549856 60549877 60549873 60549878 +
actttgggggatctctgcaaat

SEQ ID NO: 208956 - DNA, 22 bp, Artificial Sequence
  Synthetic oligonucleotide; TTA chr2 60549857 60549878 60549874 60549879 +
ctttgggggatctctgcaaatg

SEQ ID NO: 208957 - DNA, 22 bp, Artificial Sequence
  Synthetic oligonucleotide; CTT chr2 60549860 60549881 60549877 60549882 +
tgggggatctctgcaaatgcat

SEQ ID NO: 208958 - DNA, 22 bp, Artificial Sequence
  Synthetic oligonucleotide; TTT chr2 60549861 60549882 60549878 60549883 +
gggggatctctgcaaatgcatt

SEQ ID NO: 208959 - DNA, 22 bp, Artificial Sequence
  Synthetic oligonucleotide; TTG chr2 60549862 60549883 60549879 60549884 +
ggggatctctgcaaatgcattt

SEQ ID NO: 208960 - DNA, 22 bp, Artificial Sequence
  Synthetic oligonucleotide; CTC chr2 60549871 60549892 60549888 60549893 +
tgcaaatgcatttcccccgcaa

SEQ ID NO: 208961 - DNA, 22 bp, Artificial Sequence
  Synthetic oligonucleotide; CTG chr2 60549873 60549894 60549890 60549895 +
caaatgcatttcccccgcaatt

SEQ ID NO: 208962 - DNA, 22 bp, Artificial Sequence
  Synthetic oligonucleotide; TTT chr2 60549884 60549905 60549901 60549906 +
cccccgcaattctgggcactgg

SEQ ID NO: 208963 - DNA, 22 bp, Artificial Sequence
  Synthetic oligonucleotide; TTC chr2 60549885 60549906 60549902 60549907 +
ccccgcaattctgggcactggg

SEQ ID NO: 208964 - DNA, 22 bp, Artificial Sequence
  Synthetic oligonucleotide; TTC chr2 60549896 60549917 60549913 60549918 +
tgggcactgggtgtgcgcggcg

SEQ ID NO: 208965 - DNA, 22 bp, Artificial Sequence
  Synthetic oligonucleotide; CTG chr2 60549898 60549919 60549915 60549920 +
ggcactgggtgtgcgcggcggc

SEQ ID NO: 208966 - DNA, 22 bp, Artificial Sequence
  Synthetic oligonucleotide; CTG chr2 60549905 60549926 60549922 60549927 +
ggtgtgcgcggcggcggctgcg

SEQ ID NO: 208967 - DNA, 22 bp, Artificial Sequence
  Synthetic oligonucleotide; CTG chr2 60549925 60549946 60549942 60549947 +
cggttattcattattaatgacg

SEQ ID NO: 208968 - DNA, 22 bp, Artificial Sequence
  Synthetic oligonucleotide; TTA chr2 60549931 60549952 60549948 60549953 +
ttcattattaatgacgctgcct

SEQ ID NO: 208969 - DNA, 22 bp, Artificial Sequence
  Synthetic oligonucleotide; TTC chr2 60549934 60549955 60549951 60549956 +
attattaatgacgctgcctgcc

SEQ ID NO: 208970 - DNA, 22 bp, Artificial Sequence
  Synthetic oligonucleotide; TTA chr2 60549938 60549959 60549955 60549960 +
ttaatgacgctgcctgcccgca

SEQ ID NO: 208971 - DNA, 22 bp, Artificial Sequence
  Synthetic oligonucleotide; TTA chr2 60549941 60549962 60549958 60549963 +
atgacgctgcctgcccgcatca

SEQ ID NO: 208972 - DNA, 22 bp, Artificial Sequence
  Synthetic oligonucleotide; CTG chr2 60549950 60549971 60549967 60549972 +
cctgcccgcatcattatgatga

SEQ ID NO: 208973 - DNA, 22 bp, Artificial Sequence
  Synthetic oligonucleotide; CTG chr2 60549954 60549975 60549971 60549976 +
cccgcatcattatgatgataac

SEQ ID NO: 208974 - DNA, 22 bp, Artificial Sequence
  Synthetic oligonucleotide; TTA chr2 60549966 60549987 60549983 60549988 +
tgatgataactattactattgt

SEQ ID NO: 208975 - DNA, 22 bp, Artificial Sequence
  Synthetic oligonucleotide; CTA chr2 60549978 60549999 60549995 60550000 +
ttactattgttgtgattccgag

SEQ ID NO: 208976 - DNA, 22 bp, Artificial Sequence
  Synthetic oligonucleotide; TTA chr2 60549981 60550002 60549998 60550003 +
ctattgttgtgattccgagctc

SEQ ID NO: 208977 - DNA, 22 bp, Artificial Sequence
  Synthetic oligonucleotide; CTA chr2 60549984 60550005 60550001 60550006 +
ttgttgtgattccgagctccga

SEQ ID NO: 208978 - DNA, 22 bp, Artificial Sequence
  Synthetic oligonucleotide; TTG chr2 60549987 60550008 60550004 60550009 +
ttgtgattccgagctccgaggc

SEQ ID NO: 208979 - DNA, 22 bp, Artificial Sequence
  Synthetic oligonucleotide; TTG chr2 60549990 60550011 60550007 60550012 +
tgattccgagctccgaggcgag

SEQ ID NO: 208980 - DNA, 22 bp, Artificial Sequence
  Synthetic oligonucleotide; TTC chr2 60549996 60550017 60550013 60550018 +
cgagctccgaggcgagaggggg

SEQ ID NO: 208981 - DNA, 22 bp, Artificial Sequence
  Synthetic oligonucleotide; CTC chr2 60550003 60550024 60550020 60550025 +
cgaggcgagagggggggtgtcg

SEQ ID NO: 208982 - DNA, 22 bp, Artificial Sequence
  Synthetic oligonucleotide; CTG chr2 60550030 60550051 60550047 60550052 +
cagagccgcccagcaagccagc

SEQ ID NO: 208983 - DNA, 22 bp, Artificial Sequence
  Synthetic oligonucleotide; CTG chr2 60550070 60550091 60550087 60550092 +
tgctttgcatgggggtgagggg

SEQ ID NO: 208984 - DNA, 22 bp, Artificial Sequence
  Synthetic oligonucleotide; CTT chr2 60550075 60550096 60550092 60550097 +
tgcatgggggtgagggggtgga

SEQ ID NO: 208985 - DNA, 22 bp, Artificial Sequence
  Synthetic oligonucleotide; TTT chr2 60550076 60550097 60550093 60550098 +
gcatgggggtgagggggtggaa

SEQ ID NO: 208986 - DNA, 22 bp, Artificial Sequence
  Synthetic oligonucleotide; TTG chr2 60550077 60550098 60550094 60550099 +
catgggggtgagggggtggaag

SEQ ID NO: 208987 - DNA, 22 bp, Artificial Sequence
  Synthetic oligonucleotide; CTG chr2 60550110 60550131 60550127 60550132 +
gagaccaagtgcaaacttgcca

SEQ ID NO: 208988 - DNA, 22 bp, Artificial Sequence
  Synthetic oligonucleotide; CTT chr2 60550128 60550149 60550145 60550150 +
gccatatccccctcttcggcca

SEQ ID NO: 208989 - DNA, 22 bp, Artificial Sequence
  Synthetic oligonucleotide; TTG chr2 60550129 60550150 60550146 60550151 +
ccatatccccctcttcggccat

SEQ ID NO: 208990 - DNA, 22 bp, Artificial Sequence
  Synthetic oligonucleotide; CTC chr2 60550142 60550163 60550159 60550164 +
ttcggccatgccccgaagccct

SEQ ID NO: 208991 - DNA, 22 bp, Artificial Sequence
  Synthetic oligonucleotide; CTT chr2 60550144 60550165 60550161 60550166 +
cggccatgccccgaagccctag

SEQ ID NO: 208992 - DNA, 22 bp, Artificial Sequence
  Synthetic oligonucleotide; TTC chr2 60550145 60550166 60550162 60550167 +
ggccatgccccgaagccctaga

SEQ ID NO: 208993 - DNA, 22 bp, Artificial Sequence
  Synthetic oligonucleotide; CTA chr2 60550165 60550186 60550182 60550187 +
gagcgcgcactcccggttcctc

SEQ ID NO: 208994 - DNA, 22 bp, Artificial Sequence
  Synthetic oligonucleotide; CTC chr2 60550177 60550198 60550194 60550199 +
ccggttcctccctaccaaaaat

SEQ ID NO: 208995 - DNA, 22 bp, Artificial Sequence
  Synthetic oligonucleotide; TTC chr2 60550184 60550205 60550201 60550206 +
ctccctaccaaaaatgccggcc

SEQ ID NO: 208996 - DNA, 22 bp, Artificial Sequence
  Synthetic oligonucleotide; CTC chr2 60550187 60550208 60550204 60550209 +
cctaccaaaaatgccggccccg

SEQ ID NO: 208997 - DNA, 22 bp, Artificial Sequence
  Synthetic oligonucleotide; CTA chr2 60550191 60550212 60550208 60550213 +
ccaaaaatgccggccccgaaag

SEQ ID NO: 208998 - DNA, 22 bp, Artificial Sequence
  Synthetic oligonucleotide; CTG chr2 60550226 60550247 60550243 60550248 +
caccgtgctccgagcccggcgc

SEQ ID NO: 208999 - DNA, 22 bp, Artificial Sequence
  Synthetic oligonucleotide; CTC chr2 60550236 60550257 60550253 60550258 +
cgagcccggcgcgcgctggtct

SEQ ID NO: 209000 - DNA, 22 bp, Artificial Sequence
  Synthetic oligonucleotide; CTG chr2 60550254 60550275 60550271 60550276 +
gtctcagctcgcgcacgggggt

SEQ ID NO: 209001 - DNA, 22 bp, Artificial Sequence
  Synthetic oligonucleotide; CTC chr2 60550259 60550280 60550276 60550281 +
agctcgcgcacgggggtgtcgg

SEQ ID NO: 209002 - DNA, 22 bp, Artificial Sequence
  Synthetic oligonucleotide; CTC chr2 60550264 60550285 60550281 60550286 +
gcgcacgggggtgtcggccgcg

SEQ ID NO: 209003 - DNA, 22 bp, Artificial Sequence
  Synthetic oligonucleotide; CTT chr2 60550299 60550320 60550316 60550321 +
ctccgcggccccggccagaagc

SEQ ID NO: 209004 - DNA, 22 bp, Artificial Sequence
  Synthetic oligonucleotide; TTC chr2 60550300 60550321 60550317 60550322 +
tccgcggccccggccagaagca

SEQ ID NO: 209005 - DNA, 22 bp, Artificial Sequence
  Synthetic oligonucleotide; CTC chr2 60550302 60550323 60550319 60550324 +
cgcggccccggccagaagcatt

SEQ ID NO: 209006 - DNA, 22 bp, Artificial Sequence
  Synthetic oligonucleotide; TTT chr2 60550325 60550346 60550342 60550347 +
ttaaagtcaaaatgaagaacaa

SEQ ID NO: 209007 - DNA, 22 bp, Artificial Sequence
  Synthetic oligonucleotide; TTT chr2 60550326 60550347 60550343 60550348 +
taaagtcaaaatgaagaacaaa

SEQ ID NO: 209008 - DNA, 22 bp, Artificial Sequence
  Synthetic oligonucleotide; TTT chr2 60550327 60550348 60550344 60550349 +
aaagtcaaaatgaagaacaaag

SEQ ID NO: 209009 - DNA, 22 bp, Artificial Sequence
  Synthetic oligonucleotide; TTA chr2 60550328 60550349 60550345 60550350 +
aagtcaaaatgaagaacaaaga

SEQ ID NO: 209010 - DNA, 22 bp, Artificial Sequence
  Synthetic oligonucleotide; TTC chr2 60550383 60550404 60550400 60550405 +
tgcctaaccgttctttcccccc

SEQ ID NO: 209011 - DNA, 22 bp, Artificial Sequence
  Synthetic oligonucleotide; CTG chr2 60550385 60550406 60550402 60550407 +
cctaaccgttctttccccccac

SEQ ID NO: 209012 - DNA, 22 bp, Artificial Sequence
  Synthetic oligonucleotide; CTA chr2 60550389 60550410 60550406 60550411 +
accgttctttccccccaccccc

SEQ ID NO: 209013 - DNA, 22 bp, Artificial Sequence
  Synthetic oligonucleotide; TTC chr2 60550396 60550417 60550413 60550418 +
tttccccccacccccaccctcg

SEQ ID NO: 209014 - DNA, 22 bp, Artificial Sequence
  Synthetic oligonucleotide; CTT chr2 60550398 60550419 60550415 60550420 +
tccccccacccccaccctcgca

SEQ ID NO: 209015 - DNA, 22 bp, Artificial Sequence
  Synthetic oligonucleotide; TTT chr2 60550399 60550420 60550416 60550421 +
ccccccacccccaccctcgcaa

SEQ ID NO: 209016 - DNA, 22 bp, Artificial Sequence
  Synthetic oligonucleotide; TTC chr2 60550400 60550421 60550417 60550422 +
cccccacccccaccctcgcaaa

SEQ ID NO: 209017 - DNA, 22 bp, Artificial Sequence
  Synthetic oligonucleotide; CTC chr2 60550417 60550438 60550434 60550439 +
gcaaagctcgttcctccccgga

SEQ ID NO: 209018 - DNA, 22 bp, Artificial Sequence
  Synthetic oligonucleotide; CTC chr2 60550426 60550447 60550443 60550448 +
gttcctccccggacgagaatcg

SEQ ID NO: 209019 - DNA, 22 bp, Artificial Sequence
  Synthetic oligonucleotide; TTC chr2 60550430 60550451 60550447 60550452 +
ctccccggacgagaatcgccgg

SEQ ID NO: 209020 - DNA, 22 bp, Artificial Sequence
  Synthetic oligonucleotide; CTC chr2 60550433 60550454 60550450 60550455 +
cccggacgagaatcgccgggca

SEQ ID NO: 209021 - DNA, 22 bp, Artificial Sequence
  Synthetic oligonucleotide; CTC chr2 60550472 60550493 60550489 60550494 +
tggtacaggttcaagttcgctg

SEQ ID NO: 209022 - DNA, 22 bp, Artificial Sequence
  Synthetic oligonucleotide; CTG chr2 60550474 60550495 60550491 60550496 +
gtacaggttcaagttcgctgag

SEQ ID NO: 209023 - DNA, 22 bp, Artificial Sequence
  Synthetic oligonucleotide; TTC chr2 60550484 60550505 60550501 60550506 +
aagttcgctgagctttcttgat

SEQ ID NO: 209024 - DNA, 22 bp, Artificial Sequence
  Synthetic oligonucleotide; TTC chr2 60550490 60550511 60550507 60550512 +
gctgagctttcttgatcttgtt

SEQ ID NO: 209025 - DNA, 22 bp, Artificial Sequence
  Synthetic oligonucleotide; CTG chr2 60550494 60550515 60550511 60550516 +
agctttcttgatcttgttctgc

SEQ ID NO: 209026 - DNA, 22 bp, Artificial Sequence
  Synthetic oligonucleotide; CTT chr2 60550499 60550520 60550516 60550521 +
tcttgatcttgttctgcctcct

SEQ ID NO: 209027 - DNA, 22 bp, Artificial Sequence
  Synthetic oligonucleotide; TTT chr2 60550500 60550521 60550517 60550522 +
cttgatcttgttctgcctccta

SEQ ID NO: 209028 - DNA, 22 bp, Artificial Sequence
  Synthetic oligonucleotide; TTC chr2 60550501 60550522 60550518 60550523 +
ttgatcttgttctgcctcctag

SEQ ID NO: 209029 - DNA, 22 bp, Artificial Sequence
  Synthetic oligonucleotide; CTT chr2 60550503 60550524 60550520 60550525 +
gatcttgttctgcctcctagcg

SEQ ID NO: 209030 - DNA, 22 bp, Artificial Sequence
  Synthetic oligonucleotide; TTG chr2 60550504 60550525 60550521 60550526 +
atcttgttctgcctcctagcga

SEQ ID NO: 209031 - DNA, 22 bp, Artificial Sequence
  Synthetic oligonucleotide; CTT chr2 60550509 60550530 60550526 60550531 +
gttctgcctcctagcgaccgaa

SEQ ID NO: 209032 - DNA, 22 bp, Artificial Sequence
  Synthetic oligonucleotide; TTG chr2 60550510 60550531 60550527 60550532 +
ttctgcctcctagcgaccgaat

SEQ ID NO: 209033 - DNA, 22 bp, Artificial Sequence
  Synthetic oligonucleotide; TTC chr2 60550513 60550534 60550530 60550535 +
tgcctcctagcgaccgaatggc

SEQ ID NO: 209034 - DNA, 22 bp, Artificial Sequence
  Synthetic oligonucleotide; CTG chr2 60550515 60550536 60550532 60550537 +
cctcctagcgaccgaatggctc

SEQ ID NO: 209035 - DNA, 22 bp, Artificial Sequence
  Synthetic oligonucleotide; CTC chr2 60550519 60550540 60550536 60550541 +
ctagcgaccgaatggctcattc

SEQ ID NO: 209036 - DNA, 22 bp, Artificial Sequence
  Synthetic oligonucleotide; CTA chr2 60550522 60550543 60550539 60550544 +
gcgaccgaatggctcattcagc

SEQ ID NO: 209037 - DNA, 22 bp, Artificial Sequence
  Synthetic oligonucleotide; CTC chr2 60550537 60550558 60550554 60550559 +
attcagcccacatagcagaggc

SEQ ID NO: 209038 - DNA, 22 bp, Artificial Sequence
  Synthetic oligonucleotide; TTC chr2 60550541 60550562 60550558 60550563 +
agcccacatagcagaggcgggg

SEQ ID NO: 209039 - DNA, 22 bp, Artificial Sequence
  Synthetic oligonucleotide; CTG chr2 60550581 60550602 60550598 60550603 +
aggaccgggatggctcctgccc

SEQ ID NO: 209040 - DNA, 22 bp, Artificial Sequence
  Synthetic oligonucleotide; CTC chr2 60550597 60550618 60550614 60550619 +
ctgccccctctgagcacccaga

SEQ ID NO: 209041 - DNA, 22 bp, Artificial Sequence
  Synthetic oligonucleotide; CTG chr2 60550600 60550621 60550617 60550622 +
ccccctctgagcacccagaaaa

SEQ ID NO: 209042 - DNA, 22 bp, Artificial Sequence
  Synthetic oligonucleotide; CTC chr2 60550607 60550628 60550624 60550629 +
tgagcacccagaaaatgaggac

SEQ ID NO: 209043 - DNA, 22 bp, Artificial Sequence
  Synthetic oligonucleotide; CTG chr2 60550609 60550630 60550626 60550631 +
agcacccagaaaatgaggacag

SEQ ID NO: 209044 - DNA, 22 bp, Artificial Sequence
  Synthetic oligonucleotide; CTC chr2 60550648 60550669 60550665 60550670 +
accccctcccaaactggccctt

SEQ ID NO: 209045 - DNA, 22 bp, Artificial Sequence
  Synthetic oligonucleotide; CTC chr2 60550656 60550677 60550673 60550678 +
ccaaactggccctttaaccccg

SEQ ID NO: 209046 - DNA, 22 bp, Artificial Sequence
  Synthetic oligonucleotide; CTG chr2 60550664 60550685 60550681 60550686 +
gccctttaaccccgggacagga

SEQ ID NO: 209047 - DNA, 22 bp, Artificial Sequence
  Synthetic oligonucleotide; CTT chr2 60550670 60550691 60550687 60550692 +
taaccccgggacaggaggaggg

SEQ ID NO: 209048 - DNA, 22 bp, Artificial Sequence
  Synthetic oligonucleotide; TTT chr2 60550671 60550692 60550688 60550693 +
aaccccgggacaggaggagggg

SEQ ID NO: 209049 - DNA, 22 bp, Artificial Sequence
  Synthetic oligonucleotide; TTA chr2 60550672 60550693 60550689 60550694 +
accccgggacaggaggaggggg

SEQ ID NO: 209050 - DNA, 22 bp, Artificial Sequence
  Synthetic oligonucleotide; CTA chr2 60550699 60550720 60550716 60550721 +
accctcccagcctagagtgtcc

SEQ ID NO: 209051 - DNA, 22 bp, Artificial Sequence
  Synthetic oligonucleotide; CTC chr2 60550705 60550726 60550722 60550727 +
ccagcctagagtgtcccaagat

SEQ ID NO: 209052 - DNA, 22 bp, Artificial Sequence
  Synthetic oligonucleotide; CTA chr2 60550713 60550734 60550730 60550735 +
gagtgtcccaagatggacccag

SEQ ID NO: 209053 - DNA, 22 bp, Artificial Sequence
  Synthetic oligonucleotide; CTG chr2 60550764 60550785 60550781 60550786 +
gactgcgcgccccggtctgtcc

SEQ ID NO: 209054 - DNA, 22 bp, Artificial Sequence
  Synthetic oligonucleotide; CTG chr2 60550769 60550790 60550786 60550791 +
cgcgccccggtctgtcctttga

SEQ ID NO: 209055 - DNA, 22 bp, Artificial Sequence
  Synthetic oligonucleotide; CTG chr2 60550783 60550804 60550800 60550805 +
tcctttgagcccccactgcatc

SEQ ID NO: 209056 - DNA, 22 bp, Artificial Sequence
  Synthetic oligonucleotide; CTT chr2 60550788 60550809 60550805 60550810 +
tgagcccccactgcatccttcc

SEQ ID NO: 209057 - DNA, 22 bp, Artificial Sequence
  Synthetic oligonucleotide; TTT chr2 60550789 60550810 60550806 60550811 +
gagcccccactgcatccttccg

SEQ ID NO: 209058 - DNA, 22 bp, Artificial Sequence
  Synthetic oligonucleotide; TTG chr2 60550790 60550811 60550807 60550812 +
agcccccactgcatccttccga

SEQ ID NO: 209059 - DNA, 22 bp, Artificial Sequence
  Synthetic oligonucleotide; CTG chr2 60550801 60550822 60550818 60550823 +
catccttccgaagaagggcctg

SEQ ID NO: 209060 - DNA, 22 bp, Artificial Sequence
  Synthetic oligonucleotide; CTT chr2 60550808 60550829 60550825 60550830 +
ccgaagaagggcctgactttcc

SEQ ID NO: 209061 - DNA, 22 bp, Artificial Sequence
  Synthetic oligonucleotide; TTC chr2 60550809 60550830 60550826 60550831 +
cgaagaagggcctgactttccc

SEQ ID NO: 209062 - DNA, 22 bp, Artificial Sequence
  Synthetic oligonucleotide; CTG chr2 60550823 60550844 60550840 60550845 +
actttcccgagtcctgcgaaca

SEQ ID NO: 209063 - DNA, 22 bp, Artificial Sequence
  Synthetic oligonucleotide; CTT chr2 60550827 60550848 60550844 60550849 +
tcccgagtcctgcgaacactgc

SEQ ID NO: 209064 - DNA, 22 bp, Artificial Sequence
  Synthetic oligonucleotide; TTT chr2 60550828 60550849 60550845 60550850 +
cccgagtcctgcgaacactgcc

SEQ ID NO: 209065 - DNA, 22 bp, Artificial Sequence
  Synthetic oligonucleotide; TTC chr2 60550829 60550850 60550846 60550851 +
ccgagtcctgcgaacactgccc

SEQ ID NO: 209066 - DNA, 22 bp, Artificial Sequence
  Synthetic oligonucleotide; CTG chr2 60550839 60550860 60550856 60550861 +
cgaacactgcccttccttcccg

SEQ ID NO: 209067 - DNA, 22 bp, Artificial Sequence
  Synthetic oligonucleotide; CTG chr2 60550848 60550869 60550865 60550870 +
cccttccttcccgccggtacct

SEQ ID NO: 209068 - DNA, 22 bp, Artificial Sequence
  Synthetic oligonucleotide; CTT chr2 60550853 60550874 60550870 60550875 +
ccttcccgccggtacctggccg

SEQ ID NO: 209069 - DNA, 22 bp, Artificial Sequence
  Synthetic oligonucleotide; TTC chr2 60550854 60550875 60550871 60550876 +
cttcccgccggtacctggccgg

SEQ ID NO: 209070 - DNA, 22 bp, Artificial Sequence
  Synthetic oligonucleotide; CTT chr2 60550857 60550878 60550874 60550879 +
cccgccggtacctggccgggct

SEQ ID NO: 209071 - DNA, 22 bp, Artificial Sequence
  Synthetic oligonucleotide; TTC chr2 60550858 60550879 60550875 60550880 +
ccgccggtacctggccgggctg

SEQ ID NO: 209072 - DNA, 22 bp, Artificial Sequence
  Synthetic oligonucleotide; CTG chr2 60550871 60550892 60550888 60550893 +
gccgggctgtaacttcacaccg

SEQ ID NO: 209073 - DNA, 22 bp, Artificial Sequence
  Synthetic oligonucleotide; CTG chr2 60550880 60550901 60550897 60550902 +
taacttcacaccgccgcgcgcc

SEQ ID NO: 209074 - DNA, 22 bp, Artificial Sequence
  Synthetic oligonucleotide; CTT chr2 60550886 60550907 60550903 60550908 +
cacaccgccgcgcgccgcgtct

SEQ ID NO: 209075 - DNA, 22 bp, Artificial Sequence
  Synthetic oligonucleotide; TTC chr2 60550887 60550908 60550904 60550909 +
acaccgccgcgcgccgcgtctg

SEQ ID NO: 209076 - DNA, 22 bp, Artificial Sequence
  Synthetic oligonucleotide; CTG chr2 60550909 60550930 60550926 60550931 +
atccgcatccggcgcggccggg

SEQ ID NO: 209077 - DNA, 22 bp, Artificial Sequence
  Synthetic oligonucleotide; TTG chr2 60550938 60550959 60550955 60550960 +
ggggcgggggagagcggcgagg

SEQ ID NO: 209078 - DNA, 22 bp, Artificial Sequence
  Synthetic oligonucleotide; CTT chr2 60551020 60551041 60551037 60551042 +
ccgaagtgtgtgacaagttcca

SEQ ID NO: 209079 - DNA, 22 bp, Artificial Sequence
  Synthetic oligonucleotide; TTC chr2 60551021 60551042 60551038 60551043 +
cgaagtgtgtgacaagttccag

SEQ ID NO: 209080 - DNA, 22 bp, Artificial Sequence
  Synthetic oligonucleotide; TTC chr2 60551040 60551061 60551057 60551062 +
cagggcccagtgaaaaattaaa

SEQ ID NO: 209081 - DNA, 22 bp, Artificial Sequence
  Synthetic oligonucleotide; TTA chr2 60551060 60551081 60551077 60551082 +
aattccctgtgcgcacccccca

SEQ ID NO: 209082 - DNA, 22 bp, Artificial Sequence
  Synthetic oligonucleotide; TTC chr2 60551065 60551086 60551082 60551087 +
cctgtgcgcaccccccaccacc

SEQ ID NO: 209083 - DNA, 22 bp, Artificial Sequence
  Synthetic oligonucleotide; CTG chr2 60551069 60551090 60551086 60551091 +
tgcgcaccccccaccaccaccc

SEQ ID NO: 209084 - DNA, 22 bp, Artificial Sequence
  Synthetic oligonucleotide; CTT chr2 60551094 60551115 60551111 60551116 +
taaaaaaacacagaaccaagta

SEQ ID NO: 209085 - DNA, 22 bp, Artificial Sequence
  Synthetic oligonucleotide; TTT chr2 60551095 60551116 60551112 60551117 +
aaaaaaacacagaaccaagtat

SEQ ID NO: 209086 - DNA, 22 bp, Artificial Sequence
  Synthetic oligonucleotide; TTA chr2 60551096 60551117 60551113 60551118 +
aaaaaacacagaaccaagtata

SEQ ID NO: 209087 - DNA, 22 bp, Artificial Sequence
  Synthetic oligonucleotide; CTT chr2 60551128 60551149 60551145 60551150 +
taaaactgcatcaaaaatttaa

SEQ ID NO: 209088 - DNA, 22 bp, Artificial Sequence
  Synthetic oligonucleotide; TTT chr2 60551129 60551150 60551146 60551151 +
aaaactgcatcaaaaatttaaa

SEQ ID NO: 209089 - DNA, 22 bp, Artificial Sequence
  Synthetic oligonucleotide; TTA chr2 60551130 60551151 60551147 60551152 +
aaactgcatcaaaaatttaaag

SEQ ID NO: 209090 - DNA, 22 bp, Artificial Sequence
  Synthetic oligonucleotide; CTG chr2 60551136 60551157 60551153 60551158 +
catcaaaaatttaaagtaagaa

SEQ ID NO: 209091 - DNA, 22 bp, Artificial Sequence
  Synthetic oligonucleotide; TTT chr2 60551148 60551169 60551165 60551170 +
aaagtaagaatcataaattgag

SEQ ID NO: 209092 - DNA, 22 bp, Artificial Sequence
  Synthetic oligonucleotide; TTA chr2 60551149 60551170 60551166 60551171 +
aagtaagaatcataaattgagt

SEQ ID NO: 209093 - DNA, 22 bp, Artificial Sequence
  Synthetic oligonucleotide; TTG chr2 60551168 60551189 60551185 60551190 +
agtagggggggaatgtgggccc

SEQ ID NO: 209094 - DNA, 22 bp, Artificial Sequence
  Synthetic oligonucleotide; CTC chr2 60551192 60551213 60551209 60551214 +
acgcctttctttcccttgctgc

SEQ ID NO: 209095 - DNA, 22 bp, Artificial Sequence
  Synthetic oligonucleotide; CTT chr2 60551199 60551220 60551216 60551221 +
tctttcccttgctgccaaactt

SEQ ID NO: 209096 - DNA, 22 bp, Artificial Sequence
  Synthetic oligonucleotide; TTT chr2 60551200 60551221 60551217 60551222 +
ctttcccttgctgccaaacttt

SEQ ID NO: 209097 - DNA, 22 bp, Artificial Sequence
  Synthetic oligonucleotide; TTC chr2 60551201 60551222 60551218 60551223 +
tttcccttgctgccaaactttc

SEQ ID NO: 209098 - DNA, 22 bp, Artificial Sequence
  Synthetic oligonucleotide; CTT chr2 60551203 60551224 60551220 60551225 +
tcccttgctgccaaactttcct

SEQ ID NO: 209099 - DNA, 22 bp, Artificial Sequence
  Synthetic oligonucleotide; TTT chr2 60551204 60551225 60551221 60551226 +
cccttgctgccaaactttccta

SEQ ID NO: 209100 - DNA, 22 bp, Artificial Sequence
  Synthetic oligonucleotide; TTC chr2 60551205 60551226 60551222 60551227 +
ccttgctgccaaactttcctaa

SEQ ID NO: 209101 - DNA, 22 bp, Artificial Sequence
  Synthetic oligonucleotide; CTT chr2 60551209 60551230 60551226 60551231 +
gctgccaaactttcctaagtgc

SEQ ID NO: 209102 - DNA, 22 bp, Artificial Sequence
  Synthetic oligonucleotide; TTG chr2 60551210 60551231 60551227 60551232 +
ctgccaaactttcctaagtgcc

SEQ ID NO: 209103 - DNA, 22 bp, Artificial Sequence
  Synthetic oligonucleotide; CTG chr2 60551213 60551234 60551230 60551235 +
ccaaactttcctaagtgcccac

SEQ ID NO: 209104 - DNA, 22 bp, Artificial Sequence
  Synthetic oligonucleotide; CTT chr2 60551221 60551242 60551238 60551243 +
tcctaagtgcccaccgcccgcc

SEQ ID NO: 209105 - DNA, 22 bp, Artificial Sequence
  Synthetic oligonucleotide; TTT chr2 60551222 60551243 60551239 60551244 +
cctaagtgcccaccgcccgcct

SEQ ID NO: 209106 - DNA, 22 bp, Artificial Sequence
  Synthetic oligonucleotide; TTC chr2 60551223 60551244 60551240 60551245 +
ctaagtgcccaccgcccgcctt

SEQ ID NO: 209107 - DNA, 22 bp, Artificial Sequence
  Synthetic oligonucleotide; CTA chr2 60551226 60551247 60551243 60551248 +
agtgcccaccgcccgcctttcc

SEQ ID NO: 209108 - DNA, 22 bp, Artificial Sequence
  Synthetic oligonucleotide; CTT chr2 60551245 60551266 60551262 60551267 +
tccaggcgcagtcagcgggaga

SEQ ID NO: 209109 - DNA, 22 bp, Artificial Sequence
  Synthetic oligonucleotide; TTT chr2 60551246 60551267 60551263 60551268 +
ccaggcgcagtcagcgggagac

SEQ ID NO: 209110 - DNA, 22 bp, Artificial Sequence
  Synthetic oligonucleotide; TTC chr2 60551247 60551268 60551264 60551269 +
caggcgcagtcagcgggagaca

SEQ ID NO: 209111 - DNA, 22 bp, Artificial Sequence
  Synthetic oligonucleotide; CTC chr2 60551286 60551307 60551303 60551308 +
ttatacagactcacaagaacct

SEQ ID NO: 209112 - DNA, 22 bp, Artificial Sequence
  Synthetic oligonucleotide; CTT chr2 60551288 60551309 60551305 60551310 +
atacagactcacaagaacctca

SEQ ID NO: 209113 - DNA, 22 bp, Artificial Sequence
  Synthetic oligonucleotide; TTA chr2 60551289 60551310 60551306 60551311 +
tacagactcacaagaacctcag

SEQ ID NO: 209114 - DNA, 22 bp, Artificial Sequence
  Synthetic oligonucleotide; CTC chr2 60551298 60551319 60551315 60551320 +
acaagaacctcagaccaagcca

SEQ ID NO: 209115 - DNA, 22 bp, Artificial Sequence
  Synthetic oligonucleotide; CTC chr2 60551309 60551330 60551326 60551331 +
agaccaagccaggcctggggaa

SEQ ID NO: 209116 - DNA, 22 bp, Artificial Sequence
  Synthetic oligonucleotide; CTG chr2 60551326 60551347 60551343 60551348 +
gggaagagggcaagacccaaag

SEQ ID NO: 209117 - DNA, 22 bp, Artificial Sequence
  Synthetic oligonucleotide; CTC chr2 60551360 60551381 60551377 60551382 +
ggggtcccaggatccagcgccc

SEQ ID NO: 209118 - DNA, 22 bp, Artificial Sequence
  Synthetic oligonucleotide; CTT chr2 60551384 60551405 60551401 60551406 +
aaaatgcacactcaaacacact

SEQ ID NO: 209119 - DNA, 22 bp, Artificial Sequence
  Synthetic oligonucleotide; TTA chr2 60551385 60551406 60551402 60551407 +
aaatgcacactcaaacacactt

SEQ ID NO: 209120 - DNA, 22 bp, Artificial Sequence
  Synthetic oligonucleotide; CTC chr2 60551397 60551418 60551414 60551419 +
aaacacacttctcccctgccct

SEQ ID NO: 209121 - DNA, 22 bp, Artificial Sequence
  Synthetic oligonucleotide; CTT chr2 60551407 60551428 60551424 60551429 +
ctcccctgcccttccccggcaa

SEQ ID NO: 209122 - DNA, 22 bp, Artificial Sequence
  Synthetic oligonucleotide; TTC chr2 60551408 60551429 60551425 60551430 +
tcccctgcccttccccggcaac

SEQ ID NO: 209123 - DNA, 22 bp, Artificial Sequence
  Synthetic oligonucleotide; CTC chr2 60551410 60551431 60551427 60551432 +
ccctgcccttccccggcaaccc

SEQ ID NO: 209124 - DNA, 22 bp, Artificial Sequence
  Synthetic oligonucleotide; CTG chr2 60551415 60551436 60551432 60551437 +
cccttccccggcaaccccgcca

SEQ ID NO: 209125 - DNA, 22 bp, Artificial Sequence
  Synthetic oligonucleotide; CTT chr2 60551420 60551441 60551437 60551442 +
ccccggcaaccccgccacctgg

SEQ ID NO: 209126 - DNA, 22 bp, Artificial Sequence
  Synthetic oligonucleotide; TTC chr2 60551421 60551442 60551438 60551443 +
cccggcaaccccgccacctggc

SEQ ID NO: 209127 - DNA, 22 bp, Artificial Sequence
  Synthetic oligonucleotide; CTG chr2 60551441 60551462 60551458 60551463 +
gcctagtcgtgctcggggcgca

SEQ ID NO: 209128 - DNA, 22 bp, Artificial Sequence
  Synthetic oligonucleotide; CTA chr2 60551446 60551467 60551463 60551468 +
gtcgtgctcggggcgcaggggg

SEQ ID NO: 209129 - DNA, 22 bp, Artificial Sequence
  Synthetic oligonucleotide; CTC chr2 60551455 60551476 60551472 60551477 +
ggggcgcagggggactggtgac

SEQ ID NO: 209130 - DNA, 22 bp, Artificial Sequence
  Synthetic oligonucleotide; CTG chr2 60551472 60551493 60551489 60551494 +
gtgaccagaccgggcggggtgg

SEQ ID NO: 209131 - DNA, 22 bp, Artificial Sequence
  Synthetic oligonucleotide; CTC chr2 60551525 60551546 60551542 60551547 +
ctcgcggtcccgagctgtggac

SEQ ID NO: 209132 - DNA, 22 bp, Artificial Sequence
  Synthetic oligonucleotide; CTC chr2 60551528 60551549 60551545 60551550 +
gcggtcccgagctgtggacaag

SEQ ID NO: 209133 - DNA, 22 bp, Artificial Sequence
  Synthetic oligonucleotide; CTG chr2 60551542 60551563 60551559 60551564 +
tggacaagagacgtctgagaaa

SEQ ID NO: 209134 - DNA, 22 bp, Artificial Sequence
  Synthetic oligonucleotide; CTG chr2 60551559 60551580 60551576 60551581 +
agaaagtacccagggcggaggg

SEQ ID NO: 209135 - DNA, 22 bp, Artificial Sequence
  Synthetic oligonucleotide; CTT chr2 60551604 60551625 60551621 60551626 +
ttacagttgccctgcaaaataa

SEQ ID NO: 209136 - DNA, 22 bp, Artificial Sequence
  Synthetic oligonucleotide; TTT chr2 60551605 60551626 60551622 60551627 +
tacagttgccctgcaaaataaa

SEQ ID NO: 209137 - DNA, 22 bp, Artificial Sequence
  Synthetic oligonucleotide; TTT chr2 60551606 60551627 60551623 60551628 +
acagttgccctgcaaaataaaa

SEQ ID NO: 209138 - DNA, 22 bp, Artificial Sequence
  Synthetic oligonucleotide; TTA chr2 60551607 60551628 60551624 60551629 +
cagttgccctgcaaaataaaaa

SEQ ID NO: 209139 - DNA, 22 bp, Artificial Sequence
  Synthetic oligonucleotide; TTG chr2 60551613 60551634 60551630 60551635 +
ccctgcaaaataaaaatgcttt

SEQ ID NO: 209140 - DNA, 22 bp, Artificial Sequence
  Synthetic oligonucleotide; CTG chr2 60551618 60551639 60551635 60551640 +
caaaataaaaatgctttgcaaa

SEQ ID NO: 209141 - DNA, 22 bp, Artificial Sequence
  Synthetic oligonucleotide; CTT chr2 60551634 60551655 60551651 60551656 +
tgcaaagccgagtttcacccag

SEQ ID NO: 209142 - DNA, 22 bp, Artificial Sequence
  Synthetic oligonucleotide; TTT chr2 60551635 60551656 60551652 60551657 +
gcaaagccgagtttcacccagc

SEQ ID NO: 209143 - DNA, 22 bp, Artificial Sequence
  Synthetic oligonucleotide; TTG chr2 60551636 60551657 60551653 60551658 +
caaagccgagtttcacccagcc

SEQ ID NO: 209144 - DNA, 22 bp, Artificial Sequence
  Synthetic oligonucleotide; TTT chr2 60551649 60551670 60551666 60551671 +
cacccagccgatttcgcagtct

SEQ ID NO: 209145 - DNA, 22 bp, Artificial Sequence
  Synthetic oligonucleotide; TTC chr2 60551650 60551671 60551667 60551672 +
acccagccgatttcgcagtctg

SEQ ID NO: 209146 - DNA, 22 bp, Artificial Sequence
  Synthetic oligonucleotide; TTT chr2 60551663 60551684 60551680 60551685 +
cgcagtctgggaggtcgagaag

SEQ ID NO: 209147 - DNA, 22 bp, Artificial Sequence
  Synthetic oligonucleotide; TTC chr2 60551664 60551685 60551681 60551686 +
gcagtctgggaggtcgagaaga

SEQ ID NO: 209148 - DNA, 22 bp, Artificial Sequence
  Synthetic oligonucleotide; CTG chr2 60551672 60551693 60551689 60551694 +
ggaggtcgagaagaggtctcgg

SEQ ID NO: 209149 - DNA, 22 bp, Artificial Sequence
  Synthetic oligonucleotide; CTC chr2 60551692 60551713 60551709 60551714 +
ggcattgtgctgggggcggacc

SEQ ID NO: 209150 - DNA, 22 bp, Artificial Sequence
  Synthetic oligonucleotide; TTG chr2 60551699 60551720 60551716 60551721 +
tgctgggggcggaccaggacca

SEQ ID NO: 209151 - DNA, 22 bp, Artificial Sequence
  Synthetic oligonucleotide; CTG chr2 60551704 60551725 60551721 60551726 +
ggggcggaccaggaccacgggc

SEQ ID NO: 209152 - DNA, 22 bp, Artificial Sequence
  Synthetic oligonucleotide; CTG chr2 60551733 60551754 60551750 60551755 +
gcgcggagacactgcgtggcct

SEQ ID NO: 209153 - DNA, 22 bp, Artificial Sequence
  Synthetic oligonucleotide; CTG chr2 60551747 60551768 60551764 60551769 +
cgtggcctgccgccgtgcctgg

SEQ ID NO: 209154 - DNA, 22 bp, Artificial Sequence
  Synthetic oligonucleotide; CTG chr2 60551756 60551777 60551773 60551778 +
ccgccgtgcctggcgggtgggc

SEQ ID NO: 209155 - DNA, 22 bp, Artificial Sequence
  Synthetic oligonucleotide; CTG chr2 60551768 60551789 60551785 60551790 +
gcgggtgggcgccgggcgccgg

SEQ ID NO: 209156 - DNA, 22 bp, Artificial Sequence
  Synthetic oligonucleotide; CTG chr2 60551808 60551829 60551825 60551830 +
ggctggggcgcggcgaggtcgg

SEQ ID NO: 209157 - DNA, 22 bp, Artificial Sequence
  Synthetic oligonucleotide; CTG chr2 60551813 60551834 60551830 60551835 +
gggcgcggcgaggtcgggcaag

SEQ ID NO: 209158 - DNA, 22 bp, Artificial Sequence
  Synthetic oligonucleotide; CTG chr2 60551868 60551889 60551885 60551890 +
ctccggggctgccgcgccgcgc

SEQ ID NO: 209159 - DNA, 22 bp, Artificial Sequence
  Synthetic oligonucleotide; CTC chr2 60551871 60551892 60551888 60551893 +
cggggctgccgcgccgcgctcg

SEQ ID NO: 209160 - DNA, 22 bp, Artificial Sequence
  Synthetic oligonucleotide; CTG chr2 60551879 60551900 60551896 60551901 +
ccgcgccgcgctcggtcctctg

SEQ ID NO: 209161 - DNA, 22 bp, Artificial Sequence
  Synthetic oligonucleotide; CTC chr2 60551892 60551913 60551909 60551914 +
ggtcctctgtctgtttgttggc

SEQ ID NO: 209162 - DNA, 22 bp, Artificial Sequence
  Synthetic oligonucleotide; CTC chr2 60551899 60551920 60551916 60551921 +
tgtctgtttgttggcaggaggc

SEQ ID NO: 209163 - DNA, 22 bp, Artificial Sequence
  Synthetic oligonucleotide; CTG chr2 60551901 60551922 60551918 60551923 +
tctgtttgttggcaggaggctc

SEQ ID NO: 209164 - DNA, 22 bp, Artificial Sequence
  Synthetic oligonucleotide; CTG chr2 60551905 60551926 60551922 60551927 +
tttgttggcaggaggctcccgc

SEQ ID NO: 209165 - DNA, 22 bp, Artificial Sequence
  Synthetic oligonucleotide; TTT chr2 60551908 60551929 60551925 60551930 +
gttggcaggaggctcccgcaca

SEQ ID NO: 209166 - DNA, 22 bp, Artificial Sequence
  Synthetic oligonucleotide; TTG chr2 60551909 60551930 60551926 60551931 +
ttggcaggaggctcccgcacac

SEQ ID NO: 209167 - DNA, 22 bp, Artificial Sequence
  Synthetic oligonucleotide; TTG chr2 60551912 60551933 60551929 60551934 +
gcaggaggctcccgcacacgcg

SEQ ID NO: 209168 - DNA, 22 bp, Artificial Sequence
  Synthetic oligonucleotide; CTC chr2 60551923 60551944 60551940 60551945 +
ccgcacacgcggtgcttgtaaa

SEQ ID NO: 209169 - DNA, 22 bp, Artificial Sequence
  Synthetic oligonucleotide; CTT chr2 60551940 60551961 60551957 60551962 +
gtaaacattcagacacgagatt

SEQ ID NO: 209170 - DNA, 22 bp, Artificial Sequence
  Synthetic oligonucleotide; TTG chr2 60551941 60551962 60551958 60551963 +
taaacattcagacacgagattt

SEQ ID NO: 209171 - DNA, 22 bp, Artificial Sequence
  Synthetic oligonucleotide; TTC chr2 60551950 60551971 60551967 60551972 +
agacacgagatttttcccaatc

SEQ ID NO: 209172 - DNA, 22 bp, Artificial Sequence
  Synthetic oligonucleotide; TTT chr2 60551963 60551984 60551980 60551985 +
ttcccaatcaaaatccacttcc

SEQ ID NO: 209173 - DNA, 22 bp, Artificial Sequence
  Synthetic oligonucleotide; TTT chr2 60551964 60551985 60551981 60551986 +
tcccaatcaaaatccacttcca

SEQ ID NO: 209174 - DNA, 22 bp, Artificial Sequence
  Synthetic oligonucleotide; TTT chr2 60551965 60551986 60551982 60551987 +
cccaatcaaaatccacttccac

SEQ ID NO: 209175 - DNA, 22 bp, Artificial Sequence
  Synthetic oligonucleotide; TTC chr2 60551966 60551987 60551983 60551988 +
ccaatcaaaatccacttccact

SEQ ID NO: 209176 - DNA, 22 bp, Artificial Sequence
  Synthetic oligonucleotide; CTT chr2 60551983 60552004 60552000 60552005 +
ccactttttttgaaaatcttcc

SEQ ID NO: 209177 - DNA, 22 bp, Artificial Sequence
  Synthetic oligonucleotide; TTC chr2 60551984 60552005 60552001 60552006 +
cactttttttgaaaatcttcca

SEQ ID NO: 209178 - DNA, 22 bp, Artificial Sequence
  Synthetic oligonucleotide; CTT chr2 60551989 60552010 60552006 60552011 +
tttttgaaaatcttccaaaaaa

SEQ ID NO: 209179 - DNA, 22 bp, Artificial Sequence
  Synthetic oligonucleotide; TTT chr2 60551990 60552011 60552007 60552012 +
ttttgaaaatcttccaaaaaat

SEQ ID NO: 209180 - DNA, 22 bp, Artificial Sequence
  Synthetic oligonucleotide; TTT chr2 60551991 60552012 60552008 60552013 +
tttgaaaatcttccaaaaaata

SEQ ID NO: 209181 - DNA, 22 bp, Artificial Sequence
  Synthetic oligonucleotide; TTT chr2 60551992 60552013 60552009 60552014 +
ttgaaaatcttccaaaaaatag

SEQ ID NO: 209182 - DNA, 22 bp, Artificial Sequence
  Synthetic oligonucleotide; TTT chr2 60551993 60552014 60552010 60552015 +
tgaaaatcttccaaaaaatagt

SEQ ID NO: 209183 - DNA, 22 bp, Artificial Sequence
  Synthetic oligonucleotide; TTT chr2 60551994 60552015 60552011 60552016 +
gaaaatcttccaaaaaatagta

SEQ ID NO: 209184 - DNA, 22 bp, Artificial Sequence
  Synthetic oligonucleotide; TTG chr2 60551995 60552016 60552012 60552017 +
aaaatcttccaaaaaatagtaa

SEQ ID NO: 209185 - DNA, 22 bp, Artificial Sequence
  Synthetic oligonucleotide; CTT chr2 60552003 60552024 60552020 60552025 +
ccaaaaaatagtaagaggaggg

SEQ ID NO: 209186 - DNA, 22 bp, Artificial Sequence
  Synthetic oligonucleotide; TTC chr2 60552004 60552025 60552021 60552026 +
caaaaaatagtaagaggaggga

SEQ ID NO: 209187 - DNA, 22 bp, Artificial Sequence
  Synthetic oligonucleotide; TTC chr2 60552030 60552051 60552047 60552052 +
ctctctccctctccgtgccgtc

SEQ ID NO: 209188 - DNA, 22 bp, Artificial Sequence
  Synthetic oligonucleotide; CTC chr2 60552033 60552054 60552050 60552055 +
tctccctctccgtgccgtcggc

SEQ ID NO: 209189 - DNA, 22 bp, Artificial Sequence
  Synthetic oligonucleotide; CTC chr2 60552035 60552056 60552052 60552057 +
tccctctccgtgccgtcggcgc

SEQ ID NO: 209190 - DNA, 22 bp, Artificial Sequence
  Synthetic oligonucleotide; CTC chr2 60552037 60552058 60552054 60552059 +
cctctccgtgccgtcggcgccc

SEQ ID NO: 209191 - DNA, 22 bp, Artificial Sequence
  Synthetic oligonucleotide; CTC chr2 60552041 60552062 60552058 60552063 +
tccgtgccgtcggcgccctaag

SEQ ID NO: 209192 - DNA, 22 bp, Artificial Sequence
  Synthetic oligonucleotide; CTC chr2 60552043 60552064 60552060 60552065 +
cgtgccgtcggcgccctaagtt

SEQ ID NO: 209193 - DNA, 22 bp, Artificial Sequence
  Synthetic oligonucleotide; CTA chr2 60552061 60552082 60552078 60552083 +
agtttgcaactgaaggggtttg

SEQ ID NO: 209194 - DNA, 22 bp, Artificial Sequence
  Synthetic oligonucleotide; TTT chr2 60552066 60552087 60552083 60552088 +
gcaactgaaggggtttggggga

SEQ ID NO: 209195 - DNA, 22 bp, Artificial Sequence
  Synthetic oligonucleotide; TTG chr2 60552067 60552088 60552084 60552089 +
caactgaaggggtttgggggaa

SEQ ID NO: 209196 - DNA, 22 bp, Artificial Sequence
  Synthetic oligonucleotide; CTG chr2 60552073 60552094 60552090 60552095 +
aaggggtttgggggaagagggt

SEQ ID NO: 209197 - DNA, 22 bp, Artificial Sequence
  Synthetic oligonucleotide; TTT chr2 60552082 60552103 60552099 60552104 +
gggggaagagggtgattgtaaa

SEQ ID NO: 209198 - DNA, 22 bp, Artificial Sequence
  Synthetic oligonucleotide; TTG chr2 60552083 60552104 60552100 60552105 +
ggggaagagggtgattgtaaat

SEQ ID NO: 209199 - DNA, 22 bp, Artificial Sequence
  Synthetic oligonucleotide; TTG chr2 60552100 60552121 60552117 60552122 +
taaatttttttctagatgagag

SEQ ID NO: 209200 - DNA, 22 bp, Artificial Sequence
  Synthetic oligonucleotide; TTT chr2 60552107 60552128 60552124 60552129 +
ttttctagatgagagattgtga

SEQ ID NO: 209201 - DNA, 22 bp, Artificial Sequence
  Synthetic oligonucleotide; TTT chr2 60552108 60552129 60552125 60552130 +
tttctagatgagagattgtgag

SEQ ID NO: 209202 - DNA, 22 bp, Artificial Sequence
  Synthetic oligonucleotide; TTT chr2 60552109 60552130 60552126 60552131 +
ttctagatgagagattgtgaga

SEQ ID NO: 209203 - DNA, 22 bp, Artificial Sequence
  Synthetic oligonucleotide; TTT chr2 60552110 60552131 60552127 60552132 +
tctagatgagagattgtgagat

SEQ ID NO: 209204 - DNA, 22 bp, Artificial Sequence
  Synthetic oligonucleotide; TTT chr2 60552111 60552132 60552128 60552133 +
ctagatgagagattgtgagatt

SEQ ID NO: 209205 - DNA, 22 bp, Artificial Sequence
  Synthetic oligonucleotide; TTC chr2 60552112 60552133 60552129 60552134 +
tagatgagagattgtgagattt

SEQ ID NO: 209206 - DNA, 22 bp, Artificial Sequence
  Synthetic oligonucleotide; CTA chr2 60552114 60552135 60552131 60552136 +
gatgagagattgtgagattttt

SEQ ID NO: 209207 - DNA, 22 bp, Artificial Sequence
  Synthetic oligonucleotide; TTG chr2 60552126 60552147 60552143 60552148 +
tgagatttttgcaggggggctg

SEQ ID NO: 209208 - DNA, 22 bp, Artificial Sequence
  Synthetic oligonucleotide; TTT chr2 60552134 60552155 60552151 60552156 +
ttgcaggggggctggtggggga

SEQ ID NO: 209209 - DNA, 22 bp, Artificial Sequence
  Synthetic oligonucleotide; TTT chr2 60552135 60552156 60552152 60552157 +
tgcaggggggctggtgggggag

SEQ ID NO: 209210 - DNA, 22 bp, Artificial Sequence
  Synthetic oligonucleotide; TTT chr2 60552136 60552157 60552153 60552158 +
gcaggggggctggtgggggagt

SEQ ID NO: 209211 - DNA, 22 bp, Artificial Sequence
  Synthetic oligonucleotide; TTG chr2 60552137 60552158 60552154 60552159 +
caggggggctggtgggggagtc

SEQ ID NO: 209212 - DNA, 22 bp, Artificial Sequence
  Synthetic oligonucleotide; CTG chr2 60552148 60552169 60552165 60552170 +
gtgggggagtcaaagagaaggc

SEQ ID NO: 209213 - DNA, 22 bp, Artificial Sequence
  Synthetic oligonucleotide; TTG chr2 60552188 60552209 60552205 60552210 +
gcagagcgtttggcttcggttt

SEQ ID NO: 209214 - DNA, 22 bp, Artificial Sequence
  Synthetic oligonucleotide; TTT chr2 60552199 60552220 60552216 60552221 +
ggcttcggtttgggggcaagaa

SEQ ID NO: 209215 - DNA, 22 bp, Artificial Sequence
  Synthetic oligonucleotide; TTG chr2 60552200 60552221 60552217 60552222 +
gcttcggtttgggggcaagaaa

SEQ ID NO: 209216 - DNA, 22 bp, Artificial Sequence
  Synthetic oligonucleotide; CTT chr2 60552204 60552225 60552221 60552226 +
cggtttgggggcaagaaattgt

SEQ ID NO: 209217 - DNA, 22 bp, Artificial Sequence
  Synthetic oligonucleotide; TTC chr2 60552205 60552226 60552222 60552227 +
ggtttgggggcaagaaattgta

SEQ ID NO: 209218 - DNA, 22 bp, Artificial Sequence
  Synthetic oligonucleotide; TTT chr2 60552210 60552231 60552227 60552232 +
gggggcaagaaattgtacattc

SEQ ID NO: 209219 - DNA, 22 bp, Artificial Sequence
  Synthetic oligonucleotide; TTG chr2 60552211 60552232 60552228 60552233 +
ggggcaagaaattgtacattct

SEQ ID NO: 209220 - DNA, 22 bp, Artificial Sequence
  Synthetic oligonucleotide; TTG chr2 60552225 60552246 60552242 60552247 +
tacattctcttgccttgtttta

SEQ ID NO: 209221 - DNA, 22 bp, Artificial Sequence
  Synthetic oligonucleotide; TTC chr2 60552232 60552253 60552249 60552254 +
tcttgccttgttttatttattt

SEQ ID NO: 209222 - DNA, 22 bp, Artificial Sequence
  Synthetic oligonucleotide; CTC chr2 60552234 60552255 60552251 60552256 +
ttgccttgttttatttatttta

SEQ ID NO: 209223 - DNA, 22 bp, Artificial Sequence
  Synthetic oligonucleotide; CTT chr2 60552236 60552257 60552253 60552258 +
gccttgttttatttattttatt

SEQ ID NO: 209224 - DNA, 22 bp, Artificial Sequence
  Synthetic oligonucleotide; TTG chr2 60552237 60552258 60552254 60552259 +
ccttgttttatttattttattt

SEQ ID NO: 209225 - DNA, 22 bp, Artificial Sequence
  Synthetic oligonucleotide; CTT chr2 60552241 60552262 60552258 60552263 +
gttttatttattttatttttat

SEQ ID NO: 209226 - DNA, 22 bp, Artificial Sequence
  Synthetic oligonucleotide; TTG chr2 60552242 60552263 60552259 60552264 +
ttttatttattttatttttatg

SEQ ID NO: 209227 - DNA, 22 bp, Artificial Sequence
  Synthetic oligonucleotide; TTT chr2 60552245 60552266 60552262 60552267 +
tatttattttatttttatgtat

SEQ ID NO: 209228 - DNA, 22 bp, Artificial Sequence
  Synthetic oligonucleotide; TTT chr2 60552246 60552267 60552263 60552268 +
atttattttatttttatgtatt

SEQ ID NO: 209229 - DNA, 22 bp, Artificial Sequence
  Synthetic oligonucleotide; TTA chr2 60552247 60552268 60552264 60552269 +
tttattttatttttatgtattt

SEQ ID NO: 209230 - DNA, 22 bp, Artificial Sequence
  Synthetic oligonucleotide; TTT chr2 60552250 60552271 60552267 60552272 +
attttatttttatgtatttatt

SEQ ID NO: 209231 - DNA, 22 bp, Artificial Sequence
  Synthetic oligonucleotide; TTA chr2 60552251 60552272 60552268 60552273 +
ttttatttttatgtatttattt

SEQ ID NO: 209232 - DNA, 22 bp, Artificial Sequence
  Synthetic oligonucleotide; TTT chr2 60552254 60552275 60552271 60552276 +
tatttttatgtatttatttatt

SEQ ID NO: 209233 - DNA, 22 bp, Artificial Sequence
  Synthetic oligonucleotide; TTT chr2 60552255 60552276 60552272 60552277 +
atttttatgtatttatttattt

SEQ ID NO: 209234 - DNA, 22 bp, Artificial Sequence
  Synthetic oligonucleotide; TTA chr2 60552256 60552277 60552273 60552278 +
tttttatgtatttatttattta

SEQ ID NO: 209235 - DNA, 22 bp, Artificial Sequence
  Synthetic oligonucleotide; TTT chr2 60552259 60552280 60552276 60552281 +
ttatgtatttatttatttatgt

SEQ ID NO: 209236 - DNA, 22 bp, Artificial Sequence
  Synthetic oligonucleotide; TTT chr2 60552260 60552281 60552277 60552282 +
tatgtatttatttatttatgtg

SEQ ID NO: 209237 - DNA, 22 bp, Artificial Sequence
  Synthetic oligonucleotide; TTT chr2 60552261 60552282 60552278 60552283 +
atgtatttatttatttatgtgc

SEQ ID NO: 209238 - DNA, 22 bp, Artificial Sequence
  Synthetic oligonucleotide; TTA chr2 60552262 60552283 60552279 60552284 +
tgtatttatttatttatgtgcc

SEQ ID NO: 209239 - DNA, 22 bp, Artificial Sequence
  Synthetic oligonucleotide; TTT chr2 60552269 60552290 60552286 60552291 +
atttatttatgtgccagtcttc

SEQ ID NO: 209240 - DNA, 22 bp, Artificial Sequence
  Synthetic oligonucleotide; TTA chr2 60552270 60552291 60552287 60552292 +
tttatttatgtgccagtcttct

SEQ ID NO: 209241 - DNA, 22 bp, Artificial Sequence
  Synthetic oligonucleotide; TTT chr2 60552273 60552294 60552290 60552295 +
atttatgtgccagtcttctcct

SEQ ID NO: 209242 - DNA, 22 bp, Artificial Sequence
  Synthetic oligonucleotide; TTA chr2 60552274 60552295 60552291 60552296 +
tttatgtgccagtcttctcctt

SEQ ID NO: 209243 - DNA, 22 bp, Artificial Sequence
  Synthetic oligonucleotide; TTT chr2 60552277 60552298 60552294 60552299 +
atgtgccagtcttctccttgct

SEQ ID NO: 209244 - DNA, 22 bp, Artificial Sequence
  Synthetic oligonucleotide; TTA chr2 60552278 60552299 60552295 60552300 +
tgtgccagtcttctccttgctg

SEQ ID NO: 209245 - DNA, 22 bp, Artificial Sequence
  Synthetic oligonucleotide; CTT chr2 60552290 60552311 60552307 60552312 +
ctccttgctgcctctgaggttc

SEQ ID NO: 209246 - DNA, 22 bp, Artificial Sequence
  Synthetic oligonucleotide; TTC chr2 60552291 60552312 60552308 60552313 +
tccttgctgcctctgaggttcg

SEQ ID NO: 209247 - DNA, 22 bp, Artificial Sequence
  Synthetic oligonucleotide; CTC chr2 60552293 60552314 60552310 60552315 +
cttgctgcctctgaggttcggt

SEQ ID NO: 209248 - DNA, 22 bp, Artificial Sequence
  Synthetic oligonucleotide; CTT chr2 60552296 60552317 60552313 60552318 +
gctgcctctgaggttcggtcgg

SEQ ID NO: 209249 - DNA, 22 bp, Artificial Sequence
  Synthetic oligonucleotide; TTG chr2 60552297 60552318 60552314 60552319 +
ctgcctctgaggttcggtcggg

SEQ ID NO: 209250 - DNA, 22 bp, Artificial Sequence
  Synthetic oligonucleotide; CTG chr2 60552300 60552321 60552317 60552322 +
cctctgaggttcggtcgggagg

SEQ ID NO: 209251 - DNA, 22 bp, Artificial Sequence
  Synthetic oligonucleotide; CTC chr2 60552304 60552325 60552321 60552326 +
tgaggttcggtcgggaggggag

SEQ ID NO: 209252 - DNA, 22 bp, Artificial Sequence
  Synthetic oligonucleotide; CTG chr2 60552306 60552327 60552323 60552328 +
aggttcggtcgggaggggaggg

SEQ ID NO: 209253 - DNA, 22 bp, Artificial Sequence
  Synthetic oligonucleotide; TTC chr2 60552312 60552333 60552329 60552334 +
ggtcgggaggggagggcagcgg

SEQ ID NO: 209254 - DNA, 22 bp, Artificial Sequence
  Synthetic oligonucleotide; CTC chr2 60552361 60552382 60552378 60552383 +
cctccctccctctcccgcgtgc

SEQ ID NO: 209255 - DNA, 22 bp, Artificial Sequence
  Synthetic oligonucleotide; CTC chr2 60552365 60552386 60552382 60552387 +
cctccctctcccgcgtgccccc

SEQ ID NO: 209256 - DNA, 22 bp, Artificial Sequence
  Synthetic oligonucleotide; CTC chr2 60552369 60552390 60552386 60552391 +
cctctcccgcgtgcccccggcc

SEQ ID NO: 209257 - DNA, 22 bp, Artificial Sequence
  Synthetic oligonucleotide; CTC chr2 60552373 60552394 60552390 60552395 +
tcccgcgtgcccccggccgcct

SEQ ID NO: 209258 - DNA, 22 bp, Artificial Sequence
  Synthetic oligonucleotide; CTC chr2 60552375 60552396 60552392 60552397 +
ccgcgtgcccccggccgcctcc

SEQ ID NO: 209259 - DNA, 22 bp, Artificial Sequence
  Synthetic oligonucleotide; CTC chr2 60552396 60552417 60552413 60552418 +
ctcccccggccctagctcctgc

SEQ ID NO: 209260 - DNA, 22 bp, Artificial Sequence
  Synthetic oligonucleotide; CTC chr2 60552399 60552420 60552416 60552421 +
ccccggccctagctcctgccct

SEQ ID NO: 209261 - DNA, 22 bp, Artificial Sequence
  Synthetic oligonucleotide; CTA chr2 60552410 60552431 60552427 60552432 +
gctcctgcccttcggcggcggc

SEQ ID NO: 209262 - DNA, 22 bp, Artificial Sequence
  Synthetic oligonucleotide; CTC chr2 60552414 60552435 60552431 60552436 +
ctgcccttcggcggcggcggcg

SEQ ID NO: 209263 - DNA, 22 bp, Artificial Sequence
  Synthetic oligonucleotide; CTG chr2 60552417 60552438 60552434 60552439 +
cccttcggcggcggcggcggcg

SEQ ID NO: 209264 - DNA, 22 bp, Artificial Sequence
  Synthetic oligonucleotide; CTT chr2 60552422 60552443 60552439 60552444 +
cggcggcggcggcggcggcggc

SEQ ID NO: 209265 - DNA, 22 bp, Artificial Sequence
  Synthetic oligonucleotide; TTC chr2 60552423 60552444 60552440 60552445 +
ggcggcggcggcggcggcggcg

SEQ ID NO: 209266 - DNA, 22 bp, Artificial Sequence
  Synthetic oligonucleotide; CTC chr2 60552501 60552522 60552518 60552523 +
tggccggaacaaaaggcggcag

SEQ ID NO: 209267 - DNA, 22 bp, Artificial Sequence
  Synthetic oligonucleotide; CTG chr2 60552503 60552524 60552520 60552525 +
gccggaacaaaaggcggcagtg

SEQ ID NO: 209268 - DNA, 22 bp, Artificial Sequence
  Synthetic oligonucleotide; CTC chr2 60552538 60552559 60552555 60552560 +
ccgtccttcccggtcccacggc

SEQ ID NO: 209269 - DNA, 22 bp, Artificial Sequence
  Synthetic oligonucleotide; CTT chr2 60552546 60552567 60552563 60552568 +
cccggtcccacggctctccccg

SEQ ID NO: 209270 - DNA, 22 bp, Artificial Sequence
  Synthetic oligonucleotide; TTC chr2 60552547 60552568 60552564 60552569 +
ccggtcccacggctctccccgt

SEQ ID NO: 209271 - DNA, 22 bp, Artificial Sequence
  Synthetic oligonucleotide; CTC chr2 60552562 60552583 60552579 60552584 +
tccccgtcgccgcggcccctct

SEQ ID NO: 209272 - DNA, 22 bp, Artificial Sequence
  Synthetic oligonucleotide; CTC chr2 60552564 60552585 60552581 60552586 +
cccgtcgccgcggcccctctcc

SEQ ID NO: 209273 - DNA, 22 bp, Artificial Sequence
  Synthetic oligonucleotide; CTC chr2 60552583 60552604 60552600 60552605 +
tcccgactccgcggactcagga

SEQ ID NO: 209274 - DNA, 22 bp, Artificial Sequence
  Synthetic oligonucleotide; CTC chr2 60552585 60552606 60552602 60552607 +
ccgactccgcggactcaggagc

SEQ ID NO: 209275 - DNA, 22 bp, Artificial Sequence
  Synthetic oligonucleotide; CTC chr2 60552592 60552613 60552609 60552614 +
cgcggactcaggagcgccgggg

SEQ ID NO: 209276 - DNA, 22 bp, Artificial Sequence
  Synthetic oligonucleotide; CTC chr2 60552601 60552622 60552618 60552623 +
aggagcgccgggggcccctttc

SEQ ID NO: 209277 - DNA, 22 bp, Artificial Sequence
  Synthetic oligonucleotide; CTT chr2 60552621 60552642 60552638 60552643 +
tccacagtgccactttctcact

SEQ ID NO: 209278 - DNA, 22 bp, Artificial Sequence
  Synthetic oligonucleotide; TTT chr2 60552622 60552643 60552639 60552644 +
ccacagtgccactttctcacta

SEQ ID NO: 209279 - DNA, 22 bp, Artificial Sequence
  Synthetic oligonucleotide; TTC chr2 60552623 60552644 60552640 60552645 +
cacagtgccactttctcactat

SEQ ID NO: 209280 - DNA, 22 bp, Artificial Sequence
  Synthetic oligonucleotide; CTT chr2 60552636 60552657 60552653 60552658 +
tctcactattgtggggatgact

SEQ ID NO: 209281 - DNA, 22 bp, Artificial Sequence
  Synthetic oligonucleotide; TTT chr2 60552637 60552658 60552654 60552659 +
ctcactattgtggggatgacta

SEQ ID NO: 209282 - DNA, 22 bp, Artificial Sequence
  Synthetic oligonucleotide; TTC chr2 60552638 60552659 60552655 60552660 +
tcactattgtggggatgactac

SEQ ID NO: 209283 - DNA, 22 bp, Artificial Sequence
  Synthetic oligonucleotide; CTC chr2 60552640 60552661 60552657 60552662 +
actattgtggggatgactactt

SEQ ID NO: 209284 - DNA, 22 bp, Artificial Sequence
  Synthetic oligonucleotide; CTA chr2 60552644 60552665 60552661 60552666 +
ttgtggggatgactactttcct

SEQ ID NO: 209285 - DNA, 22 bp, Artificial Sequence
  Synthetic oligonucleotide; TTG chr2 60552647 60552668 60552664 60552669 +
tggggatgactactttcctccc

SEQ ID NO: 209286 - DNA, 22 bp, Artificial Sequence
  Synthetic oligonucleotide; CTA chr2 60552659 60552680 60552676 60552681 +
ctttcctcccgctgcacacttg

SEQ ID NO: 209287 - DNA, 22 bp, Artificial Sequence
  Synthetic oligonucleotide; CTT chr2 60552662 60552683 60552679 60552684 +
tcctcccgctgcacacttgacc

SEQ ID NO: 209288 - DNA, 22 bp, Artificial Sequence
  Synthetic oligonucleotide; TTT chr2 60552663 60552684 60552680 60552685 +
cctcccgctgcacacttgaccg

SEQ ID NO: 209289 - DNA, 22 bp, Artificial Sequence
  Synthetic oligonucleotide; TTC chr2 60552664 60552685 60552681 60552686 +
ctcccgctgcacacttgaccgt

SEQ ID NO: 209290 - DNA, 22 bp, Artificial Sequence
  Synthetic oligonucleotide; CTC chr2 60552667 60552688 60552684 60552689 +
ccgctgcacacttgaccgtgag

SEQ ID NO: 209291 - DNA, 22 bp, Artificial Sequence
  Synthetic oligonucleotide; CTG chr2 60552673 60552694 60552690 60552695 +
cacacttgaccgtgagcgcgct

SEQ ID NO: 209292 - DNA, 22 bp, Artificial Sequence
  Synthetic oligonucleotide; CTT chr2 60552680 60552701 60552697 60552702 +
gaccgtgagcgcgctggtgtcc

SEQ ID NO: 209293 - DNA, 22 bp, Artificial Sequence
  Synthetic oligonucleotide; TTG chr2 60552681 60552702 60552698 60552703 +
accgtgagcgcgctggtgtcca

SEQ ID NO: 209294 - DNA, 22 bp, Artificial Sequence
  Synthetic oligonucleotide; CTG chr2 60552696 60552717 60552713 60552718 +
gtgtccaaaagccagtctcacc

SEQ ID NO: 209295 - DNA, 22 bp, Artificial Sequence
  Synthetic oligonucleotide; CTC chr2 60552715 60552736 60552732 60552737 +
acctcttttctccccgggaatc

SEQ ID NO: 209296 - DNA, 22 bp, Artificial Sequence
  Synthetic oligonucleotide; CTC chr2 60552720 60552741 60552737 60552742 +
ttttctccccgggaatcgtttt

SEQ ID NO: 209297 - DNA, 22 bp, Artificial Sequence
  Synthetic oligonucleotide; CTT chr2 60552722 60552743 60552739 60552744 +
ttctccccgggaatcgtttttt

SEQ ID NO: 209298 - DNA, 22 bp, Artificial Sequence
  Synthetic oligonucleotide; TTT chr2 60552723 60552744 60552740 60552745 +
tctccccgggaatcgtttttta

SEQ ID NO: 209299 - DNA, 22 bp, Artificial Sequence
  Synthetic oligonucleotide; TTT chr2 60552724 60552745 60552741 60552746 +
ctccccgggaatcgttttttag

SEQ ID NO: 209300 - DNA, 22 bp, Artificial Sequence
  Synthetic oligonucleotide; TTC chr2 60552725 60552746 60552742 60552747 +
tccccgggaatcgttttttaga

SEQ ID NO: 209301 - DNA, 22 bp, Artificial Sequence
  Synthetic oligonucleotide; CTC chr2 60552727 60552748 60552744 60552749 +
cccgggaatcgttttttagact

SEQ ID NO: 209302 - DNA, 22 bp, Artificial Sequence
  Synthetic oligonucleotide; TTT chr2 60552741 60552762 60552758 60552763 +
tttagacttgtactcactccct

SEQ ID NO: 209303 - DNA, 22 bp, Artificial Sequence
  Synthetic oligonucleotide; TTT chr2 60552742 60552763 60552759 60552764 +
ttagacttgtactcactccctc

SEQ ID NO: 209304 - DNA, 22 bp, Artificial Sequence
  Synthetic oligonucleotide; TTT chr2 60552743 60552764 60552760 60552765 +
tagacttgtactcactccctcc

SEQ ID NO: 209305 - DNA, 22 bp, Artificial Sequence
  Synthetic oligonucleotide; TTT chr2 60552744 60552765 60552761 60552766 +
agacttgtactcactccctccc

SEQ ID NO: 209306 - DNA, 22 bp, Artificial Sequence
  Synthetic oligonucleotide; TTA chr2 60552745 60552766 60552762 60552767 +
gacttgtactcactccctccct

SEQ ID NO: 209307 - DNA, 22 bp, Artificial Sequence
  Synthetic oligonucleotide; CTT chr2 60552750 60552771 60552767 60552772 +
gtactcactccctccctacccc

SEQ ID NO: 209308 - DNA, 22 bp, Artificial Sequence
  Synthetic oligonucleotide; TTG chr2 60552751 60552772 60552768 60552773 +
tactcactccctccctaccccc

SEQ ID NO: 209309 - DNA, 22 bp, Artificial Sequence
  Synthetic oligonucleotide; CTC chr2 60552756 60552777 60552773 60552778 +
actccctccctacccccccatt

SEQ ID NO: 209310 - DNA, 22 bp, Artificial Sequence
  Synthetic oligonucleotide; CTC chr2 60552760 60552781 60552777 60552782 +
cctccctacccccccattttct

SEQ ID NO: 209311 - DNA, 22 bp, Artificial Sequence
  Synthetic oligonucleotide; CTC chr2 60552764 60552785 60552781 60552786 +
cctacccccccattttcttacg

SEQ ID NO: 209312 - DNA, 22 bp, Artificial Sequence
  Synthetic oligonucleotide; CTA chr2 60552768 60552789 60552785 60552790 +
cccccccattttcttacggtga

SEQ ID NO: 209313 - DNA, 22 bp, Artificial Sequence
  Synthetic oligonucleotide; TTT chr2 60552779 60552800 60552796 60552801 +
tcttacggtgagtgggaagcaa

SEQ ID NO: 209314 - DNA, 22 bp, Artificial Sequence
  Synthetic oligonucleotide; TTT chr2 60552780 60552801 60552797 60552802 +
cttacggtgagtgggaagcaac

SEQ ID NO: 209315 - DNA, 22 bp, Artificial Sequence
  Synthetic oligonucleotide; TTC chr2 60552781 60552802 60552798 60552803 +
ttacggtgagtgggaagcaacc

SEQ ID NO: 209316 - DNA, 22 bp, Artificial Sequence
  Synthetic oligonucleotide; CTT chr2 60552783 60552804 60552800 60552805 +
acggtgagtgggaagcaacctc

SEQ ID NO: 209317 - DNA, 22 bp, Artificial Sequence
  Synthetic oligonucleotide; TTA chr2 60552784 60552805 60552801 60552806 +
cggtgagtgggaagcaacctcc

SEQ ID NO: 209318 - DNA, 22 bp, Artificial Sequence
  Synthetic oligonucleotide; CTC chr2 60552805 60552826 60552822 60552827 +
cctttccccaccagctcccacc

SEQ ID NO: 209319 - DNA, 22 bp, Artificial Sequence
  Synthetic oligonucleotide; CTT chr2 60552809 60552830 60552826 60552831 +
tccccaccagctcccaccccca

SEQ ID NO: 209320 - DNA, 22 bp, Artificial Sequence
  Synthetic oligonucleotide; TTT chr2 60552810 60552831 60552827 60552832 +
ccccaccagctcccacccccag

SEQ ID NO: 209321 - DNA, 22 bp, Artificial Sequence
  Synthetic oligonucleotide; TTC chr2 60552811 60552832 60552828 60552833 +
cccaccagctcccacccccagg

SEQ ID NO: 209322 - DNA, 22 bp, Artificial Sequence
  Synthetic oligonucleotide; CTC chr2 60552822 60552843 60552839 60552844 +
ccacccccaggtttgcatgtga

SEQ ID NO: 209323 - DNA, 22 bp, Artificial Sequence
  Synthetic oligonucleotide; TTT chr2 60552836 60552857 60552853 60552858 +
gcatgtgagttgttcgcaacct

SEQ ID NO: 209324 - DNA, 22 bp, Artificial Sequence
  Synthetic oligonucleotide; TTG chr2 60552837 60552858 60552854 60552859 +
catgtgagttgttcgcaacctt

SEQ ID NO: 209325 - DNA, 22 bp, Artificial Sequence
  Synthetic oligonucleotide; TTG chr2 60552848 60552869 60552865 60552870 +
ttcgcaaccttagcattgttca

SEQ ID NO: 209326 - DNA, 22 bp, Artificial Sequence
  Synthetic oligonucleotide; TTC chr2 60552851 60552872 60552868 60552873 +
gcaaccttagcattgttcatta

SEQ ID NO: 209327 - DNA, 22 bp, Artificial Sequence
  Synthetic oligonucleotide; CTT chr2 60552859 60552880 60552876 60552881 +
agcattgttcattattttgcaa

SEQ ID NO: 209328 - DNA, 22 bp, Artificial Sequence
  Synthetic oligonucleotide; TTA chr2 60552860 60552881 60552877 60552882 +
gcattgttcattattttgcaaa

SEQ ID NO: 209329 - DNA, 22 bp, Artificial Sequence
  Synthetic oligonucleotide; TTG chr2 60552866 60552887 60552883 60552888 +
ttcattattttgcaaaactggc

SEQ ID NO: 209330 - DNA, 22 bp, Artificial Sequence
  Synthetic oligonucleotide; TTC chr2 60552869 60552890 60552886 60552891 +
attattttgcaaaactggcggg

SEQ ID NO: 209331 - DNA, 22 bp, Artificial Sequence
  Synthetic oligonucleotide; TTA chr2 60552873 60552894 60552890 60552895 +
ttttgcaaaactggcggggcgg

SEQ ID NO: 209332 - DNA, 22 bp, Artificial Sequence
  Synthetic oligonucleotide; TTT chr2 60552876 60552897 60552893 60552898 +
tgcaaaactggcggggcggggg

SEQ ID NO: 209333 - DNA, 22 bp, Artificial Sequence
  Synthetic oligonucleotide; TTT chr2 60552877 60552898 60552894 60552899 +
gcaaaactggcggggcgggggg

SEQ ID NO: 209334 - DNA, 22 bp, Artificial Sequence
  Synthetic oligonucleotide; TTG chr2 60552878 60552899 60552895 60552900 +
caaaactggcggggcggggggg

SEQ ID NO: 209335 - DNA, 22 bp, Artificial Sequence
  Synthetic oligonucleotide; CTG chr2 60552886 60552907 60552903 60552908 +
gcggggcggggggggagtggaa

SEQ ID NO: 209336 - DNA, 22 bp, Artificial Sequence
  Synthetic oligonucleotide; TTG chr2 60552914 60552935 60552931 60552936 +
cattccttttcgaaaagagaaa

SEQ ID NO: 209337 - DNA, 22 bp, Artificial Sequence
  Synthetic oligonucleotide; TTC chr2 60552919 60552940 60552936 60552941 +
cttttcgaaaagagaaataaag

SEQ ID NO: 209338 - DNA, 22 bp, Artificial Sequence
  Synthetic oligonucleotide; CTT chr2 60552922 60552943 60552939 60552944 +
ttcgaaaagagaaataaagcgg

SEQ ID NO: 209339 - DNA, 22 bp, Artificial Sequence
  Synthetic oligonucleotide; TTT chr2 60552923 60552944 60552940 60552945 +
tcgaaaagagaaataaagcggc

SEQ ID NO: 209340 - DNA, 22 bp, Artificial Sequence
  Synthetic oligonucleotide; TTT chr2 60552924 60552945 60552941 60552946 +
cgaaaagagaaataaagcggcg

SEQ ID NO: 209341 - DNA, 22 bp, Artificial Sequence
  Synthetic oligonucleotide; TTC chr2 60552925 60552946 60552942 60552947 +
gaaaagagaaataaagcggcgg

SEQ ID NO: 209342 - DNA, 22 bp, Artificial Sequence
  Synthetic oligonucleotide; TTT chr2 60552975 60552996 60552992 60552997 +
ttgtaaaattaaataaaattaa

SEQ ID NO: 209343 - DNA, 22 bp, Artificial Sequence
  Synthetic oligonucleotide; TTT chr2 60552976 60552997 60552993 60552998 +
tgtaaaattaaataaaattaaa

SEQ ID NO: 209344 - DNA, 22 bp, Artificial Sequence
  Synthetic oligonucleotide; TTT chr2 60552977 60552998 60552994 60552999 +
gtaaaattaaataaaattaaaa

SEQ ID NO: 209345 - DNA, 22 bp, Artificial Sequence
  Synthetic oligonucleotide; TTG chr2 60552978 60552999 60552995 60553000 +
taaaattaaataaaattaaaag

SEQ ID NO: 209346 - DNA, 22 bp, Artificial Sequence
  Synthetic oligonucleotide; TTA chr2 60552986 60553007 60553003 60553008 +
aataaaattaaaaggtgcgtgc

SEQ ID NO: 209347 - DNA, 22 bp, Artificial Sequence
  Synthetic oligonucleotide; TTA chr2 60552996 60553017 60553013 60553018 +
aaaggtgcgtgctgtctcaaaa

SEQ ID NO: 209348 - DNA, 22 bp, Artificial Sequence
  Synthetic oligonucleotide; CTG chr2 60553010 60553031 60553027 60553032 +
tctcaaaagtgcatacacggca

SEQ ID NO: 209349 - DNA, 22 bp, Artificial Sequence
  Synthetic oligonucleotide; CTC chr2 60553014 60553035 60553031 60553036 +
aaaagtgcatacacggcaatgg

SEQ ID NO: 209350 - DNA, 22 bp, Artificial Sequence
  Synthetic oligonucleotide; TTC chr2 60553039 60553060 60553056 60553061 +
cagatgggatgagggttttttc

SEQ ID NO: 209351 - DNA, 22 bp, Artificial Sequence
  Synthetic oligonucleotide; TTT chr2 60553057 60553078 60553074 60553079 +
tttccccctttatctcttttac

SEQ ID NO: 209352 - DNA, 22 bp, Artificial Sequence
  Synthetic oligonucleotide; TTT chr2 60553058 60553079 60553075 60553080 +
ttccccctttatctcttttacc

SEQ ID NO: 209353 - DNA, 22 bp, Artificial Sequence
  Synthetic oligonucleotide; TTT chr2 60553059 60553080 60553076 60553081 +
tccccctttatctcttttacct

SEQ ID NO: 209354 - DNA, 22 bp, Artificial Sequence
  Synthetic oligonucleotide; TTT chr2 60553060 60553081 60553077 60553082 +
ccccctttatctcttttacctc

SEQ ID NO: 209355 - DNA, 22 bp, Artificial Sequence
  Synthetic oligonucleotide; TTC chr2 60553061 60553082 60553078 60553083 +
cccctttatctcttttacctcg

SEQ ID NO: 209356 - DNA, 22 bp, Artificial Sequence
  Synthetic oligonucleotide; CTT chr2 60553067 60553088 60553084 60553089 +
tatctcttttacctcgactctc

SEQ ID NO: 209357 - DNA, 22 bp, Artificial Sequence
  Synthetic oligonucleotide; TTT chr2 60553068 60553089 60553085 60553090 +
atctcttttacctcgactctcg

SEQ ID NO: 209358 - DNA, 22 bp, Artificial Sequence
  Synthetic oligonucleotide; TTA chr2 60553069 60553090 60553086 60553091 +
tctcttttacctcgactctcgg

SEQ ID NO: 209359 - DNA, 22 bp, Artificial Sequence
  Synthetic oligonucleotide; CTC chr2 60553073 60553094 60553090 60553095 +
ttttacctcgactctcggaggt

SEQ ID NO: 209360 - DNA, 22 bp, Artificial Sequence
  Synthetic oligonucleotide; CTT chr2 60553075 60553096 60553092 60553097 +
ttacctcgactctcggaggttt

SEQ ID NO: 209361 - DNA, 22 bp, Artificial Sequence
  Synthetic oligonucleotide; TTT chr2 60553076 60553097 60553093 60553098 +
tacctcgactctcggaggtttt

SEQ ID NO: 209362 - DNA, 22 bp, Artificial Sequence
  Synthetic oligonucleotide; TTT chr2 60553077 60553098 60553094 60553099 +
acctcgactctcggaggttttt

SEQ ID NO: 209363 - DNA, 22 bp, Artificial Sequence
  Synthetic oligonucleotide; TTA chr2 60553078 60553099 60553095 60553100 +
cctcgactctcggaggtttttc

SEQ ID NO: 209364 - DNA, 22 bp, Artificial Sequence
  Synthetic oligonucleotide; CTC chr2 60553082 60553103 60553099 60553104 +
gactctcggaggtttttctcgt

SEQ ID NO: 209365 - DNA, 22 bp, Artificial Sequence
  Synthetic oligonucleotide; CTC chr2 60553087 60553108 60553104 60553109 +
tcggaggtttttctcgtgaaaa

SEQ ID NO: 209366 - DNA, 22 bp, Artificial Sequence
  Synthetic oligonucleotide; CTC chr2 60553089 60553110 60553106 60553111 +
ggaggtttttctcgtgaaaaat

SEQ ID NO: 209367 - DNA, 22 bp, Artificial Sequence
  Synthetic oligonucleotide; TTT chr2 60553097 60553118 60553114 60553119 +
ttctcgtgaaaaatttaaaaat

SEQ ID NO: 209368 - DNA, 22 bp, Artificial Sequence
  Synthetic oligonucleotide; TTT chr2 60553098 60553119 60553115 60553120 +
tctcgtgaaaaatttaaaaatg

SEQ ID NO: 209369 - DNA, 22 bp, Artificial Sequence
  Synthetic oligonucleotide; TTT chr2 60553099 60553120 60553116 60553121 +
ctcgtgaaaaatttaaaaatgc

SEQ ID NO: 209370 - DNA, 22 bp, Artificial Sequence
  Synthetic oligonucleotide; TTC chr2 60553100 60553121 60553117 60553122 +
tcgtgaaaaatttaaaaatgca

SEQ ID NO: 209371 - DNA, 22 bp, Artificial Sequence
  Synthetic oligonucleotide; CTC chr2 60553102 60553123 60553119 60553124 +
gtgaaaaatttaaaaatgcatg

SEQ ID NO: 209372 - DNA, 22 bp, Artificial Sequence
  Synthetic oligonucleotide; TTT chr2 60553113 60553134 60553130 60553135 +
aaaaatgcatgcacacacccct

SEQ ID NO: 209373 - DNA, 22 bp, Artificial Sequence
  Synthetic oligonucleotide; TTA chr2 60553114 60553135 60553131 60553136 +
aaaatgcatgcacacacccctc

SEQ ID NO: 209374 - DNA, 22 bp, Artificial Sequence
  Synthetic oligonucleotide; CTC chr2 60553136 60553157 60553153 60553158 +
tctccccctcgcttttgcttct

SEQ ID NO: 209375 - DNA, 22 bp, Artificial Sequence
  Synthetic oligonucleotide; CTC chr2 60553138 60553159 60553155 60553160 +
tccccctcgcttttgcttctag

SEQ ID NO: 209376 - DNA, 22 bp, Artificial Sequence
  Synthetic oligonucleotide; CTC chr2 60553140 60553161 60553157 60553162 +
cccctcgcttttgcttctagtc

SEQ ID NO: 209377 - DNA, 22 bp, Artificial Sequence
  Synthetic oligonucleotide; CTC chr2 60553146 60553167 60553163 60553168 +
gcttttgcttctagtcctgcgc

SEQ ID NO: 209378 - DNA, 22 bp, Artificial Sequence
  Synthetic oligonucleotide; CTT chr2 60553150 60553171 60553167 60553172 +
ttgcttctagtcctgcgcgctc

SEQ ID NO: 209379 - DNA, 22 bp, Artificial Sequence
  Synthetic oligonucleotide; TTT chr2 60553151 60553172 60553168 60553173 +
tgcttctagtcctgcgcgctct

SEQ ID NO: 209380 - DNA, 22 bp, Artificial Sequence
  Synthetic oligonucleotide; TTT chr2 60553152 60553173 60553169 60553174 +
gcttctagtcctgcgcgctctc

SEQ ID NO: 209381 - DNA, 22 bp, Artificial Sequence
  Synthetic oligonucleotide; TTG chr2 60553153 60553174 60553170 60553175 +
cttctagtcctgcgcgctctcg

SEQ ID NO: 209382 - DNA, 22 bp, Artificial Sequence
  Synthetic oligonucleotide; CTT chr2 60553156 60553177 60553173 60553178 +
ctagtcctgcgcgctctcgtga

SEQ ID NO: 209383 - DNA, 22 bp, Artificial Sequence
  Synthetic oligonucleotide; TTC chr2 60553157 60553178 60553174 60553179 +
tagtcctgcgcgctctcgtgat

SEQ ID NO: 209384 - DNA, 22 bp, Artificial Sequence
  Synthetic oligonucleotide; CTA chr2 60553159 60553180 60553176 60553181 +
gtcctgcgcgctctcgtgatta

SEQ ID NO: 209385 - DNA, 22 bp, Artificial Sequence
  Synthetic oligonucleotide; CTG chr2 60553165 60553186 60553182 60553187 +
cgcgctctcgtgattattaata

SEQ ID NO: 209386 - DNA, 22 bp, Artificial Sequence
  Synthetic oligonucleotide; CTC chr2 60553172 60553193 60553189 60553194 +
tcgtgattattaataattatta

SEQ ID NO: 209387 - DNA, 22 bp, Artificial Sequence
  Synthetic oligonucleotide; CTC chr2 60553174 60553195 60553191 60553196 +
gtgattattaataattattatt

SEQ ID NO: 209388 - DNA, 22 bp, Artificial Sequence
  Synthetic oligonucleotide; TTA chr2 60553181 60553202 60553198 60553203 +
ttaataattattattactatta

SEQ ID NO: 209389 - DNA, 22 bp, Artificial Sequence
  Synthetic oligonucleotide; TTA chr2 60553184 60553205 60553201 60553206 +
ataattattattactattattg

SEQ ID NO: 209390 - DNA, 22 bp, Artificial Sequence
  Synthetic oligonucleotide; TTA chr2 60553191 60553212 60553208 60553213 +
ttattactattattgggttact

SEQ ID NO: 209391 - DNA, 22 bp, Artificial Sequence
  Synthetic oligonucleotide; TTA chr2 60553194 60553215 60553211 60553216 +
ttactattattgggttacttac

SEQ ID NO: 209392 - DNA, 22 bp, Artificial Sequence
  Synthetic oligonucleotide; TTA chr2 60553197 60553218 60553214 60553219 +
ctattattgggttacttacgcg

SEQ ID NO: 209393 - DNA, 22 bp, Artificial Sequence
  Synthetic oligonucleotide; CTA chr2 60553200 60553221 60553217 60553222 +
ttattgggttacttacgcgaga

SEQ ID NO: 209394 - DNA, 22 bp, Artificial Sequence
  Synthetic oligonucleotide; TTA chr2 60553203 60553224 60553220 60553225 +
ttgggttacttacgcgagaatt

SEQ ID NO: 209395 - DNA, 22 bp, Artificial Sequence
  Synthetic oligonucleotide; TTG chr2 60553206 60553227 60553223 60553228 +
ggttacttacgcgagaattccc

SEQ ID NO: 209396 - DNA, 22 bp, Artificial Sequence
  Synthetic oligonucleotide; TTA chr2 60553211 60553232 60553228 60553233 +
cttacgcgagaattcccgtttg

SEQ ID NO: 209397 - DNA, 22 bp, Artificial Sequence
  Synthetic oligonucleotide; CTT chr2 60553214 60553235 60553231 60553236 +
acgcgagaattcccgtttgctt

SEQ ID NO: 209398 - DNA, 22 bp, Artificial Sequence
  Synthetic oligonucleotide; TTA chr2 60553215 60553236 60553232 60553237 +
cgcgagaattcccgtttgctta

SEQ ID NO: 209399 - DNA, 22 bp, Artificial Sequence
  Synthetic oligonucleotide; TTC chr2 60553226 60553247 60553243 60553248 +
ccgtttgcttaagtgctggggt

SEQ ID NO: 209400 - DNA, 22 bp, Artificial Sequence
  Synthetic oligonucleotide; TTT chr2 60553232 60553253 60553249 60553254 +
gcttaagtgctggggtttgcct

SEQ ID NO: 209401 - DNA, 22 bp, Artificial Sequence
  Synthetic oligonucleotide; TTG chr2 60553233 60553254 60553250 60553255 +
cttaagtgctggggtttgcctt

SEQ ID NO: 209402 - DNA, 22 bp, Artificial Sequence
  Synthetic oligonucleotide; CTT chr2 60553236 60553257 60553253 60553258 +
aagtgctggggtttgccttgct

SEQ ID NO: 209403 - DNA, 22 bp, Artificial Sequence
  Synthetic oligonucleotide; TTA chr2 60553237 60553258 60553254 60553259 +
agtgctggggtttgccttgctt

SEQ ID NO: 209404 - DNA, 22 bp, Artificial Sequence
  Synthetic oligonucleotide; CTG chr2 60553244 60553265 60553261 60553266 +
gggtttgccttgcttgcggcga

SEQ ID NO: 209405 - DNA, 22 bp, Artificial Sequence
  Synthetic oligonucleotide; TTT chr2 60553250 60553271 60553267 60553272 +
gccttgcttgcggcgagacatg

SEQ ID NO: 209406 - DNA, 22 bp, Artificial Sequence
  Synthetic oligonucleotide; TTG chr2 60553251 60553272 60553268 60553273 +
ccttgcttgcggcgagacatgg

SEQ ID NO: 209407 - DNA, 22 bp, Artificial Sequence
  Synthetic oligonucleotide; CTT chr2 60553255 60553276 60553272 60553277 +
gcttgcggcgagacatggtggg

SEQ ID NO: 209408 - DNA, 22 bp, Artificial Sequence
  Synthetic oligonucleotide; TTG chr2 60553256 60553277 60553273 60553278 +
cttgcggcgagacatggtgggc

SEQ ID NO: 209409 - DNA, 22 bp, Artificial Sequence
  Synthetic oligonucleotide; CTT chr2 60553259 60553280 60553276 60553281 +
gcggcgagacatggtgggctgc

SEQ ID NO: 209410 - DNA, 22 bp, Artificial Sequence
  Synthetic oligonucleotide; TTG chr2 60553260 60553281 60553277 60553282 +
cggcgagacatggtgggctgcg

SEQ ID NO: 209411 - DNA, 22 bp, Artificial Sequence
  Synthetic oligonucleotide; CTG chr2 60553280 60553301 60553297 60553302 +
cggggcgggcggcggcggcggc

SEQ ID NO: 209412 - DNA, 22 bp, Artificial Sequence
  Synthetic oligonucleotide; CTC chr2 60553330 60553351 60553347 60553352 +
ggttcacatcgggagagccggg

SEQ ID NO: 209413 - DNA, 22 bp, Artificial Sequence
  Synthetic oligonucleotide; TTC chr2 60553335 60553356 60553352 60553357 +
acatcgggagagccgggttaga

SEQ ID NO: 209414 - DNA, 22 bp, Artificial Sequence
  Synthetic oligonucleotide; TTA chr2 60553355 60553376 60553372 60553377 +
gaaagaaggagactccagagaa

SEQ ID NO: 209415 - DNA, 22 bp, Artificial Sequence
  Synthetic oligonucleotide; CTC chr2 60553370 60553391 60553387 60553392 +
cagagaaaatatcttcatcagt

SEQ ID NO: 209416 - DNA, 22 bp, Artificial Sequence
  Synthetic oligonucleotide; CTT chr2 60553385 60553406 60553402 60553407 +
catcagtgccttttgacatcca

SEQ ID NO: 209417 - DNA, 22 bp, Artificial Sequence
  Synthetic oligonucleotide; TTC chr2 60553386 60553407 60553403 60553408 +
atcagtgccttttgacatccaa

SEQ ID NO: 209418 - DNA, 22 bp, Artificial Sequence
  Synthetic oligonucleotide; CTT chr2 60553397 60553418 60553414 60553419 +
ttgacatccaaaataaattaga

SEQ ID NO: 209419 - DNA, 22 bp, Artificial Sequence
  Synthetic oligonucleotide; TTT chr2 60553398 60553419 60553415 60553420 +
tgacatccaaaataaattagaa

SEQ ID NO: 209420 - DNA, 22 bp, Artificial Sequence
  Synthetic oligonucleotide; TTT chr2 60553399 60553420 60553416 60553421 +
gacatccaaaataaattagaaa

SEQ ID NO: 209421 - DNA, 22 bp, Artificial Sequence
  Synthetic oligonucleotide; TTG chr2 60553400 60553421 60553417 60553422 +
acatccaaaataaattagaaat

SEQ ID NO: 209422 - DNA, 22 bp, Artificial Sequence
  Synthetic oligonucleotide; TTA chr2 60553417 60553438 60553434 60553439 +
gaaataatacaaagatggcgca

SEQ ID NO: 209423 - DNA, 22 bp, Artificial Sequence
  Synthetic oligonucleotide; TTG chr2 60553453 60553474 60553470 60553475 +
tgggagagccgtcatggctttt

SEQ ID NO: 209424 - DNA, 22 bp, Artificial Sequence
  Synthetic oligonucleotide; CTT chr2 60553473 60553494 60553490 60553495 +
ttttttaagcaaaaaaaaaaaa

SEQ ID NO: 209425 - DNA, 22 bp, Artificial Sequence
  Synthetic oligonucleotide; TTT chr2 60553474 60553495 60553491 60553496 +
tttttaagcaaaaaaaaaaaaa

SEQ ID NO: 209426 - DNA, 22 bp, Artificial Sequence
  Synthetic oligonucleotide; TTT chr2 60553475 60553496 60553492 60553497 +
ttttaagcaaaaaaaaaaaaaa

SEQ ID NO: 209427 - DNA, 22 bp, Artificial Sequence
  Synthetic oligonucleotide; TTT chr2 60553476 60553497 60553493 60553498 +
tttaagcaaaaaaaaaaaaaaa

SEQ ID NO: 209428 - DNA, 22 bp, Artificial Sequence
  Synthetic oligonucleotide; TTT chr2 60553477 60553498 60553494 60553499 +
ttaagcaaaaaaaaaaaaaaaa

SEQ ID NO: 209429 - DNA, 22 bp, Artificial Sequence
  Synthetic oligonucleotide; TTT chr2 60553478 60553499 60553495 60553500 +
taagcaaaaaaaaaaaaaaaaa

SEQ ID NO: 209430 - DNA, 22 bp, Artificial Sequence
  Synthetic oligonucleotide; TTT chr2 60553479 60553500 60553496 60553501 +
aagcaaaaaaaaaaaaaaaaaa

SEQ ID NO: 209431 - DNA, 22 bp, Artificial Sequence
  Synthetic oligonucleotide; TTA chr2 60553480 60553501 60553497 60553502 +
agcaaaaaaaaaaaaaaaaaaa

SEQ ID NO: 209432 - DNA, 22 bp, Artificial Sequence
  Synthetic oligonucleotide; CTG chr2 60553585 60553606 60553602 60553607 +
agctgcaagttcaagtgcggac

SEQ ID NO: 209433 - DNA, 22 bp, Artificial Sequence
  Synthetic oligonucleotide; CTG chr2 60553590 60553611 60553607 60553612 +
caagttcaagtgcggacgtgac

SEQ ID NO: 209434 - DNA, 22 bp, Artificial Sequence
  Synthetic oligonucleotide; TTC chr2 60553597 60553618 60553614 60553619 +
aagtgcggacgtgacgtccctg

SEQ ID NO: 209435 - DNA, 22 bp, Artificial Sequence
  Synthetic oligonucleotide; CTG chr2 60553619 60553640 60553636 60553641 +
cgaacttgaacgtcaggagtct

SEQ ID NO: 209436 - DNA, 22 bp, Artificial Sequence
  Synthetic oligonucleotide; CTT chr2 60553626 60553647 60553643 60553648 +
gaacgtcaggagtctggatgga

SEQ ID NO: 209437 - DNA, 22 bp, Artificial Sequence
  Synthetic oligonucleotide; TTG chr2 60553627 60553648 60553644 60553649 +
aacgtcaggagtctggatggac

SEQ ID NO: 209438 - DNA, 22 bp, Artificial Sequence
  Synthetic oligonucleotide; CTG chr2 60553642 60553663 60553659 60553664 +
gatggacagagacacacaaaac

SEQ ID NO: 209439 - DNA, 22 bp, Artificial Sequence
  Synthetic oligonucleotide; CTC chr2 60553711 60553732 60553728 60553733 +
acaccaatggacacacatcagg

SEQ ID NO: 209440 - DNA, 22 bp, Artificial Sequence
  Synthetic oligonucleotide; CTG chr2 60553738 60553759 60553755 60553760 +
gacatgaaaaagagaccaggac

SEQ ID NO: 209441 - DNA, 22 bp, Artificial Sequence
  Synthetic oligonucleotide; CTC chr2 60553807 60553828 60553824 60553829 +
cgcggacgccagacgcggcccc

SEQ ID NO: 209442 - DNA, 22 bp, Artificial Sequence
  Synthetic oligonucleotide; CTG chr2 60553863 60553884 60553880 60553885 +
gggccgcgggctcaccagtggc

SEQ ID NO: 209443 - DNA, 22 bp, Artificial Sequence
  Synthetic oligonucleotide; CTC chr2 60553876 60553897 60553893 60553898 +
accagtggccgcagcgagcgcc

SEQ ID NO: 209444 - DNA, 22 bp, Artificial Sequence
  Synthetic oligonucleotide; CTG chr2 60553980 60554001 60553997 60554002 +
ctcccccccacacacgcggact

SEQ ID NO: 209445 - DNA, 22 bp, Artificial Sequence
  Synthetic oligonucleotide; CTC chr2 60553983 60554004 60554000 60554005 +
ccccccacacacgcggactcta

SEQ ID NO: 209446 - DNA, 22 bp, Artificial Sequence
  Synthetic oligonucleotide; CTC chr2 60554003 60554024 60554020 60554025 +
taaaatgaaagattattcaaaa

SEQ ID NO: 209447 - DNA, 22 bp, Artificial Sequence
  Synthetic oligonucleotide; CTA chr2 60554005 60554026 60554022 60554027 +
aaatgaaagattattcaaaaaa

SEQ ID NO: 209448 - DNA, 22 bp, Artificial Sequence
  Synthetic oligonucleotide; TTA chr2 60554018 60554039 60554035 60554040 +
ttcaaaaaagaaaaaaatagag

SEQ ID NO: 209449 - DNA, 22 bp, Artificial Sequence
  Synthetic oligonucleotide; TTC chr2 60554021 60554042 60554038 60554043 +
aaaaaagaaaaaaatagagcga

SEQ ID NO: 209450 - DNA, 22 bp, Artificial Sequence
  Synthetic oligonucleotide; CTG chr2 60554061 60554082 60554078 60554083 +
cagccccgggctggggaagcgc

SEQ ID NO: 209451 - DNA, 22 bp, Artificial Sequence
  Synthetic oligonucleotide; CTG chr2 60554074 60554095 60554091 60554096 +
gggaagcgcgggcggagggaag

SEQ ID NO: 209452 - DNA, 22 bp, Artificial Sequence
  Synthetic oligonucleotide; TTG chr2 60554109 60554130 60554126 60554131 +
ctcccggacaccctcctccgta

SEQ ID NO: 209453 - DNA, 22 bp, Artificial Sequence
  Synthetic oligonucleotide; CTC chr2 60554112 60554133 60554129 60554134 +
ccggacaccctcctccgtacgc

SEQ ID NO: 209454 - DNA, 22 bp, Artificial Sequence
  Synthetic oligonucleotide; CTC chr2 60554124 60554145 60554141 60554146 +
ctccgtacgcacacccacttcc

SEQ ID NO: 209455 - DNA, 22 bp, Artificial Sequence
  Synthetic oligonucleotide; CTC chr2 60554127 60554148 60554144 60554149 +
cgtacgcacacccacttcccct

SEQ ID NO: 209456 - DNA, 22 bp, Artificial Sequence
  Synthetic oligonucleotide; CTT chr2 60554144 60554165 60554161 60554166 +
cccctccccgccgccgccgcgc

SEQ ID NO: 209457 - DNA, 22 bp, Artificial Sequence
  Synthetic oligonucleotide; TTC chr2 60554145 60554166 60554162 60554167 +
ccctccccgccgccgccgcgct

SEQ ID NO: 209458 - DNA, 22 bp, Artificial Sequence
  Synthetic oligonucleotide; CTC chr2 60554150 60554171 60554167 60554172 +
cccgccgccgccgcgctcgctc

SEQ ID NO: 209459 - DNA, 22 bp, Artificial Sequence
  Synthetic oligonucleotide; CTC chr2 60554168 60554189 60554185 60554190 +
gctccccgcgtgtggacgccag

SEQ ID NO: 209460 - DNA, 22 bp, Artificial Sequence
  Synthetic oligonucleotide; CTC chr2 60554172 60554193 60554189 60554194 +
cccgcgtgtggacgccaggggc

SEQ ID NO: 209461 - DNA, 22 bp, Artificial Sequence
  Synthetic oligonucleotide; CTG chr2 60554222 60554243 60554239 60554244 +
cgctcgggaaactttgcccgag

SEQ ID NO: 209462 - DNA, 22 bp, Artificial Sequence
  Synthetic oligonucleotide; CTC chr2 60554227 60554248 60554244 60554249 +
gggaaactttgcccgaggagag

SEQ ID NO: 209463 - DNA, 22 bp, Artificial Sequence
  Synthetic oligonucleotide; CTT chr2 60554236 60554257 60554253 60554258 +
tgcccgaggagaggacagcaaa

SEQ ID NO: 209464 - DNA, 22 bp, Artificial Sequence
  Synthetic oligonucleotide; TTT chr2 60554237 60554258 60554254 60554259 +
gcccgaggagaggacagcaaag

SEQ ID NO: 209465 - DNA, 22 bp, Artificial Sequence
  Synthetic oligonucleotide; TTG chr2 60554238 60554259 60554255 60554260 +
cccgaggagaggacagcaaaga

SEQ ID NO: 209466 - DNA, 22 bp, Artificial Sequence
  Synthetic oligonucleotide; TTG chr2 60554277 60554298 60554294 60554299 +
agagctgagcctccaagttaca

SEQ ID NO: 209467 - DNA, 22 bp, Artificial Sequence
  Synthetic oligonucleotide; CTG chr2 60554284 60554305 60554301 60554306 +
agcctccaagttacagctccgc

SEQ ID NO: 209468 - DNA, 22 bp, Artificial Sequence
  Synthetic oligonucleotide; CTC chr2 60554290 60554311 60554307 60554312 +
caagttacagctccgcagcggg

SEQ ID NO: 209469 - DNA, 22 bp, Artificial Sequence
  Synthetic oligonucleotide; TTA chr2 60554297 60554318 60554314 60554319 +
cagctccgcagcgggcgagggg

SEQ ID NO: 209470 - DNA, 22 bp, Artificial Sequence
  Synthetic oligonucleotide; CTC chr2 60554303 60554324 60554320 60554325 +
cgcagcgggcgaggggaggtgg

SEQ ID NO: 209471 - DNA, 22 bp, Artificial Sequence
  Synthetic oligonucleotide; CTA chr2 60554358 60554379 60554375 60554380 +
agtttggagggctgcgggtccg

SEQ ID NO: 209472 - DNA, 22 bp, Artificial Sequence
  Synthetic oligonucleotide; TTT chr2 60554363 60554384 60554380 60554385 +
ggagggctgcgggtccggaagg

SEQ ID NO: 209473 - DNA, 22 bp, Artificial Sequence
  Synthetic oligonucleotide; TTG chr2 60554364 60554385 60554381 60554386 +
gagggctgcgggtccggaaggg

SEQ ID NO: 209474 - DNA, 22 bp, Artificial Sequence
  Synthetic oligonucleotide; CTG chr2 60554372 60554393 60554389 60554394 +
cgggtccggaagggcagcgccc

SEQ ID NO: 209475 - DNA, 22 bp, Artificial Sequence
  Synthetic oligonucleotide; CTC chr2 60554401 60554422 60554418 60554423 +
caggagcccgcgcggcctggaa

SEQ ID NO: 209476 - DNA, 22 bp, Artificial Sequence
  Synthetic oligonucleotide; CTG chr2 60554420 60554441 60554437 60554442 +
gaaagaggggaccggggagagg

SEQ ID NO: 209477 - DNA, 22 bp, Artificial Sequence
  Synthetic oligonucleotide; CTG chr2 60554503 60554524 60554520 60554525 +
agcgccccgccaagcgactggg

SEQ ID NO: 209478 - DNA, 22 bp, Artificial Sequence
  Synthetic oligonucleotide; CTG chr2 60554523 60554544 60554540 60554545 +
ggtctgaatgcaactgaaagcg

SEQ ID NO: 209479 - DNA, 22 bp, Artificial Sequence
  Synthetic oligonucleotide; CTG chr2 60554529 60554550 60554546 60554551 +
aatgcaactgaaagcgccgagt

SEQ ID NO: 209480 - DNA, 22 bp, Artificial Sequence
  Synthetic oligonucleotide; CTG chr2 60554539 60554560 60554556 60554561 +
aaagcgccgagtccccggctcc

SEQ ID NO: 209481 - DNA, 22 bp, Artificial Sequence
  Synthetic oligonucleotide; CTC chr2 60554560 60554581 60554577 60554582 +
ctaagggtcgcagaaagagagc

SEQ ID NO: 209482 - DNA, 22 bp, Artificial Sequence
  Synthetic oligonucleotide; CTA chr2 60554563 60554584 60554580 60554585 +
agggtcgcagaaagagagcccg

SEQ ID NO: 209483 - DNA, 22 bp, Artificial Sequence
  Synthetic oligonucleotide; CTG chr2 60554614 60554635 60554631 60554636 +
gcccccggaggggagcgccggg

SEQ ID NO: 209484 - DNA, 22 bp, Artificial Sequence
  Synthetic oligonucleotide; CTG chr2 60554642 60554663 60554659 60554664 +
ggcaagagaggcaccgaggcgt

SEQ ID NO: 209485 - DNA, 22 bp, Artificial Sequence
  Synthetic oligonucleotide; CTC chr2 60554671 60554692 60554688 60554693 +
tctgagaggccgaggacaaagc

SEQ ID NO: 209486 - DNA, 22 bp, Artificial Sequence
  Synthetic oligonucleotide; CTC chr2 60554673 60554694 60554690 60554695 +
tgagaggccgaggacaaagcgc

SEQ ID NO: 209487 - DNA, 22 bp, Artificial Sequence
  Synthetic oligonucleotide; CTG chr2 60554675 60554696 60554692 60554697 +
agaggccgaggacaaagcgcgg

SEQ ID NO: 209488 - DNA, 22 bp, Artificial Sequence
  Synthetic oligonucleotide; CTG chr2 60554722 60554743 60554739 60554744 +
ggaatgtgctcacggcgccgcg

SEQ ID NO: 209489 - DNA, 22 bp, Artificial Sequence
  Synthetic oligonucleotide; CTC chr2 60554733 60554754 60554750 60554755 +
acggcgccgcgggaggtccccg

SEQ ID NO: 209490 - DNA, 22 bp, Artificial Sequence
  Synthetic oligonucleotide; CTG chr2 60554768 60554789 60554785 60554790 +
ggagggacacaccccctcccac

SEQ ID NO: 209491 - DNA, 22 bp, Artificial Sequence
  Synthetic oligonucleotide; CTC chr2 60554786 60554807 60554803 60554808 +
ccactccagagcaactgcaaaa

SEQ ID NO: 209492 - DNA, 22 bp, Artificial Sequence
  Synthetic oligonucleotide; CTC chr2 60554792 60554813 60554809 60554814 +
cagagcaactgcaaaagcacag

SEQ ID NO: 209493 - DNA, 22 bp, Artificial Sequence
  Synthetic oligonucleotide; CTG chr2 60554803 60554824 60554820 60554825 +
caaaagcacagagggatgggaa

SEQ ID NO: 209494 - DNA, 22 bp, Artificial Sequence
  Synthetic oligonucleotide; TTT chr2 60554835 60554856 60554852 60554857 +
cttacgggcagagcacaactgt

SEQ ID NO: 209495 - DNA, 22 bp, Artificial Sequence
  Synthetic oligonucleotide; TTC chr2 60554836 60554857 60554853 60554858 +
ttacgggcagagcacaactgtt

SEQ ID NO: 209496 - DNA, 22 bp, Artificial Sequence
  Synthetic oligonucleotide; CTT chr2 60554838 60554859 60554855 60554860 +
acgggcagagcacaactgttcc

SEQ ID NO: 209497 - DNA, 22 bp, Artificial Sequence
  Synthetic oligonucleotide; TTA chr2 60554839 60554860 60554856 60554861 +
cgggcagagcacaactgttcct

SEQ ID NO: 209498 - DNA, 22 bp, Artificial Sequence
  Synthetic oligonucleotide; CTG chr2 60554856 60554877 60554873 60554878 +
ttcctgtgctgttacccaggga

SEQ ID NO: 209499 - DNA, 22 bp, Artificial Sequence
  Synthetic oligonucleotide; TTC chr2 60554859 60554880 60554876 60554881 +
ctgtgctgttacccagggaaag

SEQ ID NO: 209500 - DNA, 22 bp, Artificial Sequence
  Synthetic oligonucleotide; CTG chr2 60554862 60554883 60554879 60554884 +
tgctgttacccagggaaagaga

SEQ ID NO: 209501 - DNA, 22 bp, Artificial Sequence
  Synthetic oligonucleotide; CTG chr2 60554867 60554888 60554884 60554889 +
ttacccagggaaagagaaaatg

SEQ ID NO: 209502 - DNA, 22 bp, Artificial Sequence
  Synthetic oligonucleotide; TTA chr2 60554870 60554891 60554887 60554892 +
cccagggaaagagaaaatggga

SEQ ID NO: 209503 - DNA, 22 bp, Artificial Sequence
  Synthetic oligonucleotide; CTC chr2 60554914 60554935 60554931 60554936 +
gcaggagcagcggggagaccac

SEQ ID NO: 209504 - DNA, 22 bp, Artificial Sequence
  Synthetic oligonucleotide; CTC chr2 60554956 60554977 60554973 60554978 +
gggtcaccgccgcgctccccag

SEQ ID NO: 209505 - DNA, 22 bp, Artificial Sequence
  Synthetic oligonucleotide; CTC chr2 60554973 60554994 60554990 60554995 +
cccaggcgccgccggccaaggc

SEQ ID NO: 209506 - DNA, 22 bp, Artificial Sequence
  Synthetic oligonucleotide; CTC chr2 60555022 60555043 60555039 60555044 +
tcgcctttctgcagacgttccc

SEQ ID NO: 209507 - DNA, 22 bp, Artificial Sequence
  Synthetic oligonucleotide; CTC chr2 60555024 60555045 60555041 60555046 +
gcctttctgcagacgttccctg

SEQ ID NO: 209508 - DNA, 22 bp, Artificial Sequence
  Synthetic oligonucleotide; CTT chr2 60555029 60555050 60555046 60555051 +
tctgcagacgttccctggaaat

SEQ ID NO: 209509 - DNA, 22 bp, Artificial Sequence
  Synthetic oligonucleotide; TTT chr2 60555030 60555051 60555047 60555052 +
ctgcagacgttccctggaaatt

SEQ ID NO: 209510 - DNA, 22 bp, Artificial Sequence
  Synthetic oligonucleotide; TTC chr2 60555031 60555052 60555048 60555053 +
tgcagacgttccctggaaatta

SEQ ID NO: 209511 - DNA, 22 bp, Artificial Sequence
  Synthetic oligonucleotide; CTG chr2 60555033 60555054 60555050 60555055 +
cagacgttccctggaaattagg

SEQ ID NO: 209512 - DNA, 22 bp, Artificial Sequence
  Synthetic oligonucleotide; TTC chr2 60555042 60555063 60555059 60555064 +
cctggaaattagggaagacctg

SEQ ID NO: 209513 - DNA, 22 bp, Artificial Sequence
  Synthetic oligonucleotide; CTG chr2 60555046 60555067 60555063 60555068 +
gaaattagggaagacctgttgg

SEQ ID NO: 209514 - DNA, 22 bp, Artificial Sequence
  Synthetic oligonucleotide; TTA chr2 60555053 60555074 60555070 60555075 +
gggaagacctgttggaaataaa

SEQ ID NO: 209515 - DNA, 22 bp, Artificial Sequence
  Synthetic oligonucleotide; CTG chr2 60555064 60555085 60555081 60555086 +
ttggaaataaaaccctgtctct

SEQ ID NO: 209516 - DNA, 22 bp, Artificial Sequence
  Synthetic oligonucleotide; TTG chr2 60555067 60555088 60555084 60555089 +
gaaataaaaccctgtctcttta

SEQ ID NO: 209517 - DNA, 22 bp, Artificial Sequence
  Synthetic oligonucleotide; CTG chr2 60555081 60555102 60555098 60555103 +
tctctttaatgcacacacgcac

SEQ ID NO: 209518 - DNA, 22 bp, Artificial Sequence
  Synthetic oligonucleotide; CTC chr2 60555085 60555106 60555102 60555107 +
tttaatgcacacacgcacacac

SEQ ID NO: 209519 - DNA, 22 bp, Artificial Sequence
  Synthetic oligonucleotide; CTT chr2 60555087 60555108 60555104 60555109 +
taatgcacacacgcacacacac

SEQ ID NO: 209520 - DNA, 22 bp, Artificial Sequence
  Synthetic oligonucleotide; TTT chr2 60555088 60555109 60555105 60555110 +
aatgcacacacgcacacacacg

SEQ ID NO: 209521 - DNA, 22 bp, Artificial Sequence
  Synthetic oligonucleotide; TTA chr2 60555089 60555110 60555106 60555111 +
atgcacacacgcacacacacgc

SEQ ID NO: 209522 - DNA, 22 bp, Artificial Sequence
  Synthetic oligonucleotide; CTG chr2 60555119 60555140 60555136 60555141 +
ccgctgtcaaaaagcgggcttc

SEQ ID NO: 209523 - DNA, 22 bp, Artificial Sequence
  Synthetic oligonucleotide; CTG chr2 60555125 60555146 60555142 60555147 +
tcaaaaagcgggcttcactctg

SEQ ID NO: 209524 - DNA, 22 bp, Artificial Sequence
  Synthetic oligonucleotide; CTT chr2 60555140 60555161 60555157 60555162 +
cactctggcgtgggatactttc

SEQ ID NO: 209525 - DNA, 22 bp, Artificial Sequence
  Synthetic oligonucleotide; TTC chr2 60555141 60555162 60555158 60555163 +
actctggcgtgggatactttca

SEQ ID NO: 209526 - DNA, 22 bp, Artificial Sequence
  Synthetic oligonucleotide; CTC chr2 60555145 60555166 60555162 60555167 +
tggcgtgggatactttcagttt

SEQ ID NO: 209527 - DNA, 22 bp, Artificial Sequence
  Synthetic oligonucleotide; CTG chr2 60555147 60555168 60555164 60555169 +
gcgtgggatactttcagtttta

SEQ ID NO: 209528 - DNA, 22 bp, Artificial Sequence
  Synthetic oligonucleotide; CTT chr2 60555160 60555181 60555177 60555182 +
tcagttttacgtaaaatgtaca

SEQ ID NO: 209529 - DNA, 22 bp, Artificial Sequence
  Synthetic oligonucleotide; TTT chr2 60555161 60555182 60555178 60555183 +
cagttttacgtaaaatgtacag

SEQ ID NO: 209530 - DNA, 22 bp, Artificial Sequence
  Synthetic oligonucleotide; TTC chr2 60555162 60555183 60555179 60555184 +
agttttacgtaaaatgtacagc

SEQ ID NO: 209531 - DNA, 22 bp, Artificial Sequence
  Synthetic oligonucleotide; TTT chr2 60555167 60555188 60555184 60555189 +
tacgtaaaatgtacagcaacag

SEQ ID NO: 209532 - DNA, 22 bp, Artificial Sequence
  Synthetic oligonucleotide; TTT chr2 60555168 60555189 60555185 60555190 +
acgtaaaatgtacagcaacagc

SEQ ID NO: 209533 - DNA, 22 bp, Artificial Sequence
  Synthetic oligonucleotide; TTA chr2 60555169 60555190 60555186 60555191 +
cgtaaaatgtacagcaacagca

SEQ ID NO: 209534 - DNA, 22 bp, Artificial Sequence
  Synthetic oligonucleotide; CTG chr2 60555198 60555219 60555215 60555220 +
cgattggaaagtttattcagaa

SEQ ID NO: 209535 - DNA, 22 bp, Artificial Sequence
  Synthetic oligonucleotide; TTG chr2 60555204 60555225 60555221 60555226 +
gaaagtttattcagaaacgtgc

SEQ ID NO: 209536 - DNA, 22 bp, Artificial Sequence
  Synthetic oligonucleotide; TTT chr2 60555212 60555233 60555229 60555234 +
attcagaaacgtgcctgtaaag

SEQ ID NO: 209537 - DNA, 22 bp, Artificial Sequence
  Synthetic oligonucleotide; TTA chr2 60555213 60555234 60555230 60555235 +
ttcagaaacgtgcctgtaaagt

SEQ ID NO: 209538 - DNA, 22 bp, Artificial Sequence
  Synthetic oligonucleotide; TTC chr2 60555216 60555237 60555233 60555238 +
agaaacgtgcctgtaaagtccc

SEQ ID NO: 209539 - DNA, 22 bp, Artificial Sequence
  Synthetic oligonucleotide; CTG chr2 60555229 60555250 60555246 60555251 +
taaagtcccctggcgcctcccg

SEQ ID NO: 209540 - DNA, 22 bp, Artificial Sequence
  Synthetic oligonucleotide; CTG chr2 60555241 60555262 60555258 60555263 +
gcgcctcccgcctcccagcctc

SEQ ID NO: 209541 - DNA, 22 bp, Artificial Sequence
  Synthetic oligonucleotide; CTC chr2 60555248 60555269 60555265 60555270 +
ccgcctcccagcctccctgcct

SEQ ID NO: 209542 - DNA, 22 bp, Artificial Sequence
  Synthetic oligonucleotide; CTC chr2 60555255 60555276 60555272 60555277 +
ccagcctccctgcctgccagca

SEQ ID NO: 209543 - DNA, 22 bp, Artificial Sequence
  Synthetic oligonucleotide; CTC chr2 60555263 60555284 60555280 60555285 +
cctgcctgccagcaccactctg

SEQ ID NO: 209544 - DNA, 22 bp, Artificial Sequence
  Synthetic oligonucleotide; CTG chr2 60555267 60555288 60555284 60555289 +
cctgccagcaccactctgcagc

SEQ ID NO: 209545 - DNA, 22 bp, Artificial Sequence
  Synthetic oligonucleotide; CTG chr2 60555271 60555292 60555288 60555293 +
ccagcaccactctgcagccgcc

SEQ ID NO: 209546 - DNA, 22 bp, Artificial Sequence
  Synthetic oligonucleotide; CTC chr2 60555283 60555304 60555300 60555305 +
tgcagccgccgccgccgccgcc

SEQ ID NO: 209547 - DNA, 22 bp, Artificial Sequence
  Synthetic oligonucleotide; CTG chr2 60555285 60555306 60555302 60555307 +
cagccgccgccgccgccgccgg

SEQ ID NO: 209548 - DNA, 22 bp, Artificial Sequence
  Synthetic oligonucleotide; TTC chr2 60555326 60555347 60555343 60555348 +
caaatctggaaggagttggggg

SEQ ID NO: 209549 - DNA, 22 bp, Artificial Sequence
  Synthetic oligonucleotide; CTG chr2 60555334 60555355 60555351 60555356 +
gaaggagttggggggagaggag

SEQ ID NO: 209550 - DNA, 22 bp, Artificial Sequence
  Synthetic oligonucleotide; TTG chr2 60555344 60555365 60555361 60555366 +
gggggagaggagaatggactca

SEQ ID NO: 209551 - DNA, 22 bp, Artificial Sequence
  Synthetic oligonucleotide; CTC chr2 60555365 60555386 60555382 60555387 +
aggtccaagggaggtgcggagg

SEQ ID NO: 209552 - DNA, 22 bp, Artificial Sequence
  Synthetic oligonucleotide; CTG chr2 60555428 60555449 60555445 60555450 +
agctgcaggtggatatgtgtga

SEQ ID NO: 209553 - DNA, 22 bp, Artificial Sequence
  Synthetic oligonucleotide; CTG chr2 60555433 60555454 60555450 60555455 +
caggtggatatgtgtgagtgtg

SEQ ID NO: 209554 - DNA, 22 bp, Artificial Sequence
  Synthetic oligonucleotide; CTG chr2 60555459 60555480 60555476 60555481 +
cagagcgaggagccctccttcc

SEQ ID NO: 209555 - DNA, 22 bp, Artificial Sequence
  Synthetic oligonucleotide; CTC chr2 60555476 60555497 60555493 60555498 +
cttccctctcctcggagcggtt

SEQ ID NO: 209556 - DNA, 22 bp, Artificial Sequence
  Synthetic oligonucleotide; CTT chr2 60555479 60555500 60555496 60555501 +
ccctctcctcggagcggttcca

SEQ ID NO: 209557 - DNA, 22 bp, Artificial Sequence
  Synthetic oligonucleotide; TTC chr2 60555480 60555501 60555497 60555502 +
cctctcctcggagcggttccac

SEQ ID NO: 209558 - DNA, 22 bp, Artificial Sequence
  Synthetic oligonucleotide; CTC chr2 60555484 60555505 60555501 60555506 +
tcctcggagcggttccacaacc

SEQ ID NO: 209559 - DNA, 22 bp, Artificial Sequence
  Synthetic oligonucleotide; CTC chr2 60555486 60555507 60555503 60555508 +
ctcggagcggttccacaacccc

SEQ ID NO: 209560 - DNA, 22 bp, Artificial Sequence
  Synthetic oligonucleotide; CTC chr2 60555489 60555510 60555506 60555511 +
ggagcggttccacaacccccgt

SEQ ID NO: 209561 - DNA, 22 bp, Artificial Sequence
  Synthetic oligonucleotide; TTC chr2 60555499 60555520 60555516 60555521 +
cacaacccccgtcttctcatcc

SEQ ID NO: 209562 - DNA, 22 bp, Artificial Sequence
  Synthetic oligonucleotide; CTT chr2 60555514 60555535 60555531 60555536 +
ctcatccccctcttcagtctaa

SEQ ID NO: 209563 - DNA, 22 bp, Artificial Sequence
  Synthetic oligonucleotide; TTC chr2 60555515 60555536 60555532 60555537 +
tcatccccctcttcagtctaaa

SEQ ID NO: 209564 - DNA, 22 bp, Artificial Sequence
  Synthetic oligonucleotide; CTC chr2 60555517 60555538 60555534 60555539 +
atccccctcttcagtctaaagg

SEQ ID NO: 209565 - DNA, 22 bp, Artificial Sequence
  Synthetic oligonucleotide; CTC chr2 60555526 60555547 60555543 60555548 +
ttcagtctaaagggtgtcgctt

SEQ ID NO: 209566 - DNA, 22 bp, Artificial Sequence
  Synthetic oligonucleotide; CTT chr2 60555528 60555549 60555545 60555550 +
cagtctaaagggtgtcgcttcc

SEQ ID NO: 209567 - DNA, 22 bp, Artificial Sequence
  Synthetic oligonucleotide; TTC chr2 60555529 60555550 60555546 60555551 +
agtctaaagggtgtcgcttccg

SEQ ID NO: 209568 - DNA, 22 bp, Artificial Sequence
  Synthetic oligonucleotide; CTA chr2 60555535 60555556 60555552 60555557 +
aagggtgtcgcttccgtaaact

SEQ ID NO: 209569 - DNA, 22 bp, Artificial Sequence
  Synthetic oligonucleotide; CTT chr2 60555548 60555569 60555565 60555570 +
ccgtaaactcacccacccggtg

SEQ ID NO: 209570 - DNA, 22 bp, Artificial Sequence
  Synthetic oligonucleotide; TTC chr2 60555549 60555570 60555566 60555571 +
cgtaaactcacccacccggtgg

SEQ ID NO: 209571 - DNA, 22 bp, Artificial Sequence
  Synthetic oligonucleotide; CTC chr2 60555558 60555579 60555575 60555580 +
acccacccggtgggggggcttt

SEQ ID NO: 209572 - DNA, 22 bp, Artificial Sequence
  Synthetic oligonucleotide; CTT chr2 60555579 60555600 60555596 60555601 +
tattgttttaagcgagggcccc

SEQ ID NO: 209573 - DNA, 22 bp, Artificial Sequence
  Synthetic oligonucleotide; TTT chr2 60555580 60555601 60555597 60555602 +
attgttttaagcgagggccccg

SEQ ID NO: 209574 - DNA, 22 bp, Artificial Sequence
  Synthetic oligonucleotide; TTA chr2 60555581 60555602 60555598 60555603 +
ttgttttaagcgagggccccgg

SEQ ID NO: 209575 - DNA, 22 bp, Artificial Sequence
  Synthetic oligonucleotide; TTG chr2 60555584 60555605 60555601 60555606 +
ttttaagcgagggccccgggct

SEQ ID NO: 209576 - DNA, 22 bp, Artificial Sequence
  Synthetic oligonucleotide; TTT chr2 60555587 60555608 60555604 60555609 +
taagcgagggccccgggcttgc

SEQ ID NO: 209577 - DNA, 22 bp, Artificial Sequence
  Synthetic oligonucleotide; TTT chr2 60555588 60555609 60555605 60555610 +
aagcgagggccccgggcttgca

SEQ ID NO: 209578 - DNA, 22 bp, Artificial Sequence
  Synthetic oligonucleotide; TTA chr2 60555589 60555610 60555606 60555611 +
agcgagggccccgggcttgcac

SEQ ID NO: 209579 - DNA, 22 bp, Artificial Sequence
  Synthetic oligonucleotide; CTT chr2 60555607 60555628 60555624 60555629 +
gcacgcgctcacccatcccgca

SEQ ID NO: 209580 - DNA, 22 bp, Artificial Sequence
  Synthetic oligonucleotide; TTG chr2 60555608 60555629 60555625 60555630 +
cacgcgctcacccatcccgcag

SEQ ID NO: 209581 - DNA, 22 bp, Artificial Sequence
  Synthetic oligonucleotide; CTC chr2 60555617 60555638 60555634 60555639 +
acccatcccgcagccctgccgg

SEQ ID NO: 209582 - DNA, 22 bp, Artificial Sequence
  Synthetic oligonucleotide; CTG chr2 60555635 60555656 60555652 60555657 +
ccggcaagcggctgtttattcc

SEQ ID NO: 209583 - DNA, 22 bp, Artificial Sequence
  Synthetic oligonucleotide; CTG chr2 60555649 60555670 60555666 60555671 +
tttattcctgtttcgtcttagt

SEQ ID NO: 209584 - DNA, 22 bp, Artificial Sequence
  Synthetic oligonucleotide; TTT chr2 60555652 60555673 60555669 60555674 +
attcctgtttcgtcttagtaaa

SEQ ID NO: 209585 - DNA, 22 bp, Artificial Sequence
  Synthetic oligonucleotide; TTA chr2 60555653 60555674 60555670 60555675 +
ttcctgtttcgtcttagtaaag

SEQ ID NO: 209586 - DNA, 22 bp, Artificial Sequence
  Synthetic oligonucleotide; TTC chr2 60555656 60555677 60555673 60555678 +
ctgtttcgtcttagtaaagttt

SEQ ID NO: 209587 - DNA, 22 bp, Artificial Sequence
  Synthetic oligonucleotide; CTG chr2 60555659 60555680 60555676 60555681 +
tttcgtcttagtaaagtttcaa

SEQ ID NO: 209588 - DNA, 22 bp, Artificial Sequence
  Synthetic oligonucleotide; TTT chr2 60555662 60555683 60555679 60555684 +
cgtcttagtaaagtttcaagtc

SEQ ID NO: 209589 - DNA, 22 bp, Artificial Sequence
  Synthetic oligonucleotide; TTC chr2 60555663 60555684 60555680 60555685 +
gtcttagtaaagtttcaagtct

SEQ ID NO: 209590 - DNA, 22 bp, Artificial Sequence
  Synthetic oligonucleotide; CTT chr2 60555668 60555689 60555685 60555690 +
agtaaagtttcaagtctactgt

SEQ ID NO: 209591 - DNA, 22 bp, Artificial Sequence
  Synthetic oligonucleotide; TTA chr2 60555669 60555690 60555686 60555691 +
gtaaagtttcaagtctactgtg

SEQ ID NO: 209592 - DNA, 22 bp, Artificial Sequence
  Synthetic oligonucleotide; TTT chr2 60555678 60555699 60555695 60555700 +
caagtctactgtgttagaaaat

SEQ ID NO: 209593 - DNA, 22 bp, Artificial Sequence
  Synthetic oligonucleotide; TTC chr2 60555679 60555700 60555696 60555701 +
aagtctactgtgttagaaaatg

SEQ ID NO: 209594 - DNA, 22 bp, Artificial Sequence
  Synthetic oligonucleotide; CTA chr2 60555686 60555707 60555703 60555708 +
ctgtgttagaaaatgactggct

SEQ ID NO: 209595 - DNA, 22 bp, Artificial Sequence
  Synthetic oligonucleotide; CTG chr2 60555689 60555710 60555706 60555711 +
tgttagaaaatgactggcttgc

SEQ ID NO: 209596 - DNA, 22 bp, Artificial Sequence
  Synthetic oligonucleotide; TTA chr2 60555694 60555715 60555711 60555716 +
gaaaatgactggcttgcctagc

SEQ ID NO: 209597 - DNA, 22 bp, Artificial Sequence
  Synthetic oligonucleotide; CTG chr2 60555705 60555726 60555722 60555727 +
gcttgcctagctcggcggagct

SEQ ID NO: 209598 - DNA, 22 bp, Artificial Sequence
  Synthetic oligonucleotide; CTT chr2 60555709 60555730 60555726 60555731 +
gcctagctcggcggagcttcgg

SEQ ID NO: 209599 - DNA, 22 bp, Artificial Sequence
  Synthetic oligonucleotide; TTG chr2 60555710 60555731 60555727 60555732 +
cctagctcggcggagcttcgga

SEQ ID NO: 209600 - DNA, 22 bp, Artificial Sequence
  Synthetic oligonucleotide; CTA chr2 60555714 60555735 60555731 60555736 +
gctcggcggagcttcggacccc

SEQ ID NO: 209601 - DNA, 22 bp, Artificial Sequence
  Synthetic oligonucleotide; CTC chr2 60555718 60555739 60555735 60555740 +
ggcggagcttcggacccctcta

SEQ ID NO: 209602 - DNA, 22 bp, Artificial Sequence
  Synthetic oligonucleotide; CTT chr2 60555728 60555749 60555745 60555750 +
cggacccctctaaggaagaaaa

SEQ ID NO: 209603 - DNA, 22 bp, Artificial Sequence
  Synthetic oligonucleotide; TTC chr2 60555729 60555750 60555746 60555751 +
ggacccctctaaggaagaaaag

SEQ ID NO: 209604 - DNA, 22 bp, Artificial Sequence
  Synthetic oligonucleotide; CTC chr2 60555738 60555759 60555755 60555760 +
taaggaagaaaaggaggttttg

SEQ ID NO: 209605 - DNA, 22 bp, Artificial Sequence
  Synthetic oligonucleotide; CTA chr2 60555740 60555761 60555757 60555762 +
aggaagaaaaggaggttttgat

SEQ ID NO: 209606 - DNA, 22 bp, Artificial Sequence
  Synthetic oligonucleotide; TTT chr2 60555758 60555779 60555775 60555780 +
tgatgctcaacattgagagaga

SEQ ID NO: 209607 - DNA, 22 bp, Artificial Sequence
  Synthetic oligonucleotide; TTT chr2 60555759 60555780 60555776 60555781 +
gatgctcaacattgagagagat

SEQ ID NO: 209608 - DNA, 22 bp, Artificial Sequence
  Synthetic oligonucleotide; TTG chr2 60555760 60555781 60555777 60555782 +
atgctcaacattgagagagatg

SEQ ID NO: 209609 - DNA, 22 bp, Artificial Sequence
  Synthetic oligonucleotide; CTC chr2 60555766 60555787 60555783 60555788 +
aacattgagagagatgtgggct

SEQ ID NO: 209610 - DNA, 22 bp, Artificial Sequence
  Synthetic oligonucleotide; TTG chr2 60555773 60555794 60555790 60555795 +
agagagatgtgggctgtactgg

SEQ ID NO: 209611 - DNA, 22 bp, Artificial Sequence
  Synthetic oligonucleotide; CTG chr2 60555789 60555810 60555806 60555811 +
tactgggattgtgtcaatgtgg

SEQ ID NO: 209612 - DNA, 22 bp, Artificial Sequence
  Synthetic oligonucleotide; CTG chr2 60555794 60555815 60555811 60555816 +
ggattgtgtcaatgtggtttgt

SEQ ID NO: 209613 - DNA, 22 bp, Artificial Sequence
  Synthetic oligonucleotide; TTG chr2 60555800 60555821 60555817 60555822 +
tgtcaatgtggtttgttgtttg

SEQ ID NO: 209614 - DNA, 22 bp, Artificial Sequence
  Synthetic oligonucleotide; TTT chr2 60555814 60555835 60555831 60555836 +
gttgtttgttgttgtttccctc

SEQ ID NO: 209615 - DNA, 22 bp, Artificial Sequence
  Synthetic oligonucleotide; TTG chr2 60555815 60555836 60555832 60555837 +
ttgtttgttgttgtttccctcc

SEQ ID NO: 209616 - DNA, 22 bp, Artificial Sequence
  Synthetic oligonucleotide; TTG chr2 60555818 60555839 60555835 60555840 +
tttgttgttgtttccctccagt

SEQ ID NO: 209617 - DNA, 22 bp, Artificial Sequence
  Synthetic oligonucleotide; TTT chr2 60555821 60555842 60555838 60555843 +
gttgttgtttccctccagtttg

SEQ ID NO: 209618 - DNA, 22 bp, Artificial Sequence
  Synthetic oligonucleotide; TTG chr2 60555822 60555843 60555839 60555844 +
ttgttgtttccctccagtttgt

SEQ ID NO: 209619 - DNA, 22 bp, Artificial Sequence
  Synthetic oligonucleotide; TTG chr2 60555825 60555846 60555842 60555847 +
ttgtttccctccagtttgtggg

SEQ ID NO: 209620 - DNA, 22 bp, Artificial Sequence
  Synthetic oligonucleotide; TTG chr2 60555828 60555849 60555845 60555850 +
tttccctccagtttgtgggagg

SEQ ID NO: 209621 - DNA, 22 bp, Artificial Sequence
  Synthetic oligonucleotide; TTT chr2 60555831 60555852 60555848 60555853 +
ccctccagtttgtgggagggag

SEQ ID NO: 209622 - DNA, 22 bp, Artificial Sequence
  Synthetic oligonucleotide; TTC chr2 60555832 60555853 60555849 60555854 +
cctccagtttgtgggagggaga

SEQ ID NO: 209623 - DNA, 22 bp, Artificial Sequence
  Synthetic oligonucleotide; CTC chr2 60555836 60555857 60555853 60555858 +
cagtttgtgggagggagacctc

SEQ ID NO: 209624 - DNA, 22 bp, Artificial Sequence
  Synthetic oligonucleotide; TTT chr2 60555842 60555863 60555859 60555864 +
gtgggagggagacctcaaattc

SEQ ID NO: 209625 - DNA, 22 bp, Artificial Sequence
  Synthetic oligonucleotide; TTG chr2 60555843 60555864 60555860 60555865 +
tgggagggagacctcaaattct

SEQ ID NO: 209626 - DNA, 22 bp, Artificial Sequence
  Synthetic oligonucleotide; CTC chr2 60555858 60555879 60555875 60555880 +
aaattctgtttaagaagcggga

SEQ ID NO: 209627 - DNA, 22 bp, Artificial Sequence
  Synthetic oligonucleotide; TTC chr2 60555864 60555885 60555881 60555886 +
tgtttaagaagcgggaggattc

SEQ ID NO: 209628 - DNA, 22 bp, Artificial Sequence
  Synthetic oligonucleotide; CTG chr2 60555866 60555887 60555883 60555888 +
tttaagaagcgggaggattcac

SEQ ID NO: 209629 - DNA, 22 bp, Artificial Sequence
  Synthetic oligonucleotide; TTT chr2 60555869 60555890 60555886 60555891 +
aagaagcgggaggattcactag

SEQ ID NO: 209630 - DNA, 22 bp, Artificial Sequence
  Synthetic oligonucleotide; TTA chr2 60555870 60555891 60555887 60555892 +
agaagcgggaggattcactaga

SEQ ID NO: 209631 - DNA, 22 bp, Artificial Sequence
  Synthetic oligonucleotide; TTC chr2 60555886 60555907 60555903 60555908 +
actagaagttaagctctgtagc

SEQ ID NO: 209632 - DNA, 22 bp, Artificial Sequence
  Synthetic oligonucleotide; CTA chr2 60555890 60555911 60555907 60555912 +
gaagttaagctctgtagcttgt

SEQ ID NO: 209633 - DNA, 22 bp, Artificial Sequence
  Synthetic oligonucleotide; TTA chr2 60555897 60555918 60555914 60555919 +
agctctgtagcttgtgtgtgac

SEQ ID NO: 209634 - DNA, 22 bp, Artificial Sequence
  Synthetic oligonucleotide; CTC chr2 60555902 60555923 60555919 60555924 +
tgtagcttgtgtgtgacaccat

SEQ ID NO: 209635 - DNA, 22 bp, Artificial Sequence
  Synthetic oligonucleotide; CTG chr2 60555904 60555925 60555921 60555926 +
tagcttgtgtgtgacaccattt

SEQ ID NO: 209636 - DNA, 22 bp, Artificial Sequence
  Synthetic oligonucleotide; CTT chr2 60555910 60555931 60555927 60555932 +
gtgtgtgacaccatttcccctt

SEQ ID NO: 209637 - DNA, 22 bp, Artificial Sequence
  Synthetic oligonucleotide; TTG chr2 60555911 60555932 60555928 60555933 +
tgtgtgacaccatttccccttt

SEQ ID NO: 209638 - DNA, 22 bp, Artificial Sequence
  Synthetic oligonucleotide; TTT chr2 60555926 60555947 60555943 60555948 +
ccccttttcactgagttcttca

SEQ ID NO: 209639 - DNA, 22 bp, Artificial Sequence
  Synthetic oligonucleotide; TTC chr2 60555927 60555948 60555944 60555949 +
cccttttcactgagttcttcag

SEQ ID NO: 209640 - DNA, 22 bp, Artificial Sequence
  Synthetic oligonucleotide; CTT chr2 60555932 60555953 60555949 60555954 +
ttcactgagttcttcagagcag

SEQ ID NO: 209641 - DNA, 22 bp, Artificial Sequence
  Synthetic oligonucleotide; TTT chr2 60555933 60555954 60555950 60555955 +
tcactgagttcttcagagcagg

SEQ ID NO: 209642 - DNA, 22 bp, Artificial Sequence
  Synthetic oligonucleotide; TTT chr2 60555934 60555955 60555951 60555956 +
cactgagttcttcagagcaggt

SEQ ID NO: 209643 - DNA, 22 bp, Artificial Sequence
  Synthetic oligonucleotide; TTC chr2 60555935 60555956 60555952 60555957 +
actgagttcttcagagcaggtc

SEQ ID NO: 209644 - DNA, 22 bp, Artificial Sequence
  Synthetic oligonucleotide; CTG chr2 60555939 60555960 60555956 60555961 +
agttcttcagagcaggtcagca

SEQ ID NO: 209645 - DNA, 22 bp, Artificial Sequence
  Synthetic oligonucleotide; TTC chr2 60555944 60555965 60555961 60555966 +
ttcagagcaggtcagcatctct

SEQ ID NO: 209646 - DNA, 22 bp, Artificial Sequence
  Synthetic oligonucleotide; CTT chr2 60555946 60555967 60555963 60555968 +
cagagcaggtcagcatctctat

SEQ ID NO: 209647 - DNA, 22 bp, Artificial Sequence
  Synthetic oligonucleotide; TTC chr2 60555947 60555968 60555964 60555969 +
agagcaggtcagcatctctatt

SEQ ID NO: 209648 - DNA, 22 bp, Artificial Sequence
  Synthetic oligonucleotide; CTC chr2 60555965 60555986 60555982 60555987 +
tattccaccacagtctgctttt

SEQ ID NO: 209649 - DNA, 22 bp, Artificial Sequence
  Synthetic oligonucleotide; CTA chr2 60555967 60555988 60555984 60555989 +
ttccaccacagtctgctttttg

SEQ ID NO: 209650 - DNA, 22 bp, Artificial Sequence
  Synthetic oligonucleotide; TTC chr2 60555970 60555991 60555987 60555992 +
caccacagtctgctttttgtct

SEQ ID NO: 209651 - DNA, 22 bp, Artificial Sequence
  Synthetic oligonucleotide; CTG chr2 60555982 60556003 60555999 60556004 +
ctttttgtcttgttaaaccagc

SEQ ID NO: 209652 - DNA, 22 bp, Artificial Sequence
  Synthetic oligonucleotide; CTT chr2 60555985 60556006 60556002 60556007 +
tttgtcttgttaaaccagcctt

SEQ ID NO: 209653 - DNA, 22 bp, Artificial Sequence
  Synthetic oligonucleotide; TTT chr2 60555986 60556007 60556003 60556008 +
ttgtcttgttaaaccagccttg

SEQ ID NO: 209654 - DNA, 22 bp, Artificial Sequence
  Synthetic oligonucleotide; TTT chr2 60555987 60556008 60556004 60556009 +
tgtcttgttaaaccagccttgg

SEQ ID NO: 209655 - DNA, 22 bp, Artificial Sequence
  Synthetic oligonucleotide; TTT chr2 60555988 60556009 60556005 60556010 +
gtcttgttaaaccagccttgga

SEQ ID NO: 209656 - DNA, 22 bp, Artificial Sequence
  Synthetic oligonucleotide; TTG chr2 60555989 60556010 60556006 60556011 +
tcttgttaaaccagccttggag

SEQ ID NO: 209657 - DNA, 22 bp, Artificial Sequence
  Synthetic oligonucleotide; CTT chr2 60555993 60556014 60556010 60556015 +
gttaaaccagccttggagtcac

SEQ ID NO: 209658 - DNA, 22 bp, Artificial Sequence
  Synthetic oligonucleotide; TTG chr2 60555994 60556015 60556011 60556016 +
ttaaaccagccttggagtcacc

SEQ ID NO: 209659 - DNA, 22 bp, Artificial Sequence
  Synthetic oligonucleotide; TTA chr2 60555997 60556018 60556014 60556019 +
aaccagccttggagtcaccaaa

SEQ ID NO: 209660 - DNA, 22 bp, Artificial Sequence
  Synthetic oligonucleotide; CTT chr2 60556007 60556028 60556024 60556029 +
ggagtcaccaaaagaatgtctt

SEQ ID NO: 209661 - DNA, 22 bp, Artificial Sequence
  Synthetic oligonucleotide; TTG chr2 60556008 60556029 60556025 60556030 +
gagtcaccaaaagaatgtcttc

SEQ ID NO: 209662 - DNA, 22 bp, Artificial Sequence
  Synthetic oligonucleotide; CTT chr2 60556029 60556050 60556046 60556051 +
cttggggggtggcgggggagga

SEQ ID NO: 209663 - DNA, 22 bp, Artificial Sequence
  Synthetic oligonucleotide; TTC chr2 60556030 60556051 60556047 60556052 +
ttggggggtggcgggggaggac

SEQ ID NO: 209664 - DNA, 22 bp, Artificial Sequence
  Synthetic oligonucleotide; CTT chr2 60556032 60556053 60556049 60556054 +
ggggggtggcgggggaggacga

SEQ ID NO: 209665 - DNA, 22 bp, Artificial Sequence
  Synthetic oligonucleotide; TTG chr2 60556033 60556054 60556050 60556055 +
gggggtggcgggggaggacgac

SEQ ID NO: 209666 - DNA, 22 bp, Artificial Sequence
  Synthetic oligonucleotide; TTG chr2 60556069 60556090 60556086 60556091 +
gagggaaggtgaagagagggaa

SEQ ID NO: 209667 - DNA, 22 bp, Artificial Sequence
  Synthetic oligonucleotide; CTG chr2 60556107 60556128 60556124 60556129 +
ggaggcctttgaaaaataaata

SEQ ID NO: 209668 - DNA, 22 bp, Artificial Sequence
  Synthetic oligonucleotide; CTT chr2 60556116 60556137 60556133 60556138 +
tgaaaaataaataaataaaaga

SEQ ID NO: 209669 - DNA, 22 bp, Artificial Sequence
  Synthetic oligonucleotide; TTT chr2 60556117 60556138 60556134 60556139 +
gaaaaataaataaataaaagaa

SEQ ID NO: 209670 - DNA, 22 bp, Artificial Sequence
  Synthetic oligonucleotide; TTG chr2 60556118 60556139 60556135 60556140 +
aaaaataaataaataaaagaaa

SEQ ID NO: 209671 - DNA, 22 bp, Artificial Sequence
  Synthetic oligonucleotide; CTT chr2 60556148 60556169 60556165 60556170 +
caggtaacaatagtgagccaga

SEQ ID NO: 209672 - DNA, 22 bp, Artificial Sequence
  Synthetic oligonucleotide; TTC chr2 60556149 60556170 60556166 60556171 +
aggtaacaatagtgagccagat

SEQ ID NO: 209673 - DNA, 22 bp, Artificial Sequence
  Synthetic oligonucleotide; TTC chr2 60556173 60556194 60556190 60556195 +
tttcagaaccaagcttttcaga

SEQ ID NO: 209674 - DNA, 22 bp, Artificial Sequence
  Synthetic oligonucleotide; CTT chr2 60556175 60556196 60556192 60556197 +
tcagaaccaagcttttcagatt

SEQ ID NO: 209675 - DNA, 22 bp, Artificial Sequence
  Synthetic oligonucleotide; TTT chr2 60556176 60556197 60556193 60556198 +
cagaaccaagcttttcagattt

SEQ ID NO: 209676 - DNA, 22 bp, Artificial Sequence
  Synthetic oligonucleotide; TTC chr2 60556177 60556198 60556194 60556199 +
agaaccaagcttttcagatttg

SEQ ID NO: 209677 - DNA, 22 bp, Artificial Sequence
  Synthetic oligonucleotide; CTT chr2 60556189 60556210 60556206 60556211 +
ttcagatttgaatattgttccc

SEQ ID NO: 209678 - DNA, 22 bp, Artificial Sequence
  Synthetic oligonucleotide; TTT chr2 60556190 60556211 60556207 60556212 +
tcagatttgaatattgttccca

SEQ ID NO: 209679 - DNA, 22 bp, Artificial Sequence
  Synthetic oligonucleotide; TTT chr2 60556191 60556212 60556208 60556213 +
cagatttgaatattgttcccac

SEQ ID NO: 209680 - DNA, 22 bp, Artificial Sequence
  Synthetic oligonucleotide; TTC chr2 60556192 60556213 60556209 60556214 +
agatttgaatattgttcccacc

SEQ ID NO: 209681 - DNA, 22 bp, Artificial Sequence
  Synthetic oligonucleotide; TTT chr2 60556198 60556219 60556215 60556220 +
gaatattgttcccacccgtcca

SEQ ID NO: 209682 - DNA, 22 bp, Artificial Sequence
  Synthetic oligonucleotide; TTG chr2 60556199 60556220 60556216 60556221 +
aatattgttcccacccgtccat

SEQ ID NO: 209683 - DNA, 22 bp, Artificial Sequence
  Synthetic oligonucleotide; TTG chr2 60556206 60556227 60556223 60556228 +
ttcccacccgtccataaaagtc

SEQ ID NO: 209684 - DNA, 22 bp, Artificial Sequence
  Synthetic oligonucleotide; TTC chr2 60556209 60556230 60556226 60556231 +
ccacccgtccataaaagtccat

SEQ ID NO: 209685 - DNA, 22 bp, Artificial Sequence
  Synthetic oligonucleotide; CTA chr2 60556234 60556255 60556251 60556256 +
tagagaagatatataaatgagc

SEQ ID NO: 209686 - DNA, 22 bp, Artificial Sequence
  Synthetic oligonucleotide; TTG chr2 60556268 60556289 60556285 60556290 +
tggaaatatatatatatgtatg

SEQ ID NO: 209687 - DNA, 22 bp, Artificial Sequence
  Synthetic oligonucleotide; TTT chr2 60556294 60556315 60556311 60556316 +
atatataatggtgtgtataaag

SEQ ID NO: 209688 - DNA, 22 bp, Artificial Sequence
  Synthetic oligonucleotide; TTA chr2 60556295 60556316 60556312 60556317 +
tatataatggtgtgtataaagc

SEQ ID NO: 209689 - DNA, 22 bp, Artificial Sequence
  Synthetic oligonucleotide; CTT chr2 60556319 60556340 60556336 60556341 +
ttcggggttggctgtagtgtaa

SEQ ID NO: 209690 - DNA, 22 bp, Artificial Sequence
  Synthetic oligonucleotide; TTT chr2 60556320 60556341 60556337 60556342 +
tcggggttggctgtagtgtaaa

SEQ ID NO: 209691 - DNA, 22 bp, Artificial Sequence
  Synthetic oligonucleotide; TTT chr2 60556321 60556342 60556338 60556343 +
cggggttggctgtagtgtaaaa

SEQ ID NO: 209692 - DNA, 22 bp, Artificial Sequence
  Synthetic oligonucleotide; TTC chr2 60556322 60556343 60556339 60556344 +
ggggttggctgtagtgtaaaaa

SEQ ID NO: 209693 - DNA, 22 bp, Artificial Sequence
  Synthetic oligonucleotide; TTG chr2 60556329 60556350 60556346 60556351 +
gctgtagtgtaaaaagtaatga

SEQ ID NO: 209694 - DNA, 22 bp, Artificial Sequence
  Synthetic oligonucleotide; CTG chr2 60556333 60556354 60556350 60556355 +
tagtgtaaaaagtaatgacttt

SEQ ID NO: 209695 - DNA, 22 bp, Artificial Sequence
  Synthetic oligonucleotide; CTT chr2 60556354 60556375 60556371 60556376 +
tattacctctgaaaggttctgt

SEQ ID NO: 209696 - DNA, 22 bp, Artificial Sequence
  Synthetic oligonucleotide; TTT chr2 60556355 60556376 60556372 60556377 +
attacctctgaaaggttctgtg

SEQ ID NO: 209697 - DNA, 22 bp, Artificial Sequence
  Synthetic oligonucleotide; TTA chr2 60556356 60556377 60556373 60556378 +
ttacctctgaaaggttctgtgg

SEQ ID NO: 209698 - DNA, 22 bp, Artificial Sequence
  Synthetic oligonucleotide; TTA chr2 60556359 60556380 60556376 60556381 +
cctctgaaaggttctgtggttc

SEQ ID NO: 209699 - DNA, 22 bp, Artificial Sequence
  Synthetic oligonucleotide; CTC chr2 60556363 60556384 60556380 60556385 +
tgaaaggttctgtggttcacat

SEQ ID NO: 209700 - DNA, 22 bp, Artificial Sequence
  Synthetic oligonucleotide; CTG chr2 60556365 60556386 60556382 60556387 +
aaaggttctgtggttcacattt

SEQ ID NO: 209701 - DNA, 22 bp, Artificial Sequence
  Synthetic oligonucleotide; TTC chr2 60556373 60556394 60556390 60556395 +
tgtggttcacatttaacagtct

SEQ ID NO: 209702 - DNA, 22 bp, Artificial Sequence
  Synthetic oligonucleotide; CTG chr2 60556375 60556396 60556392 60556397 +
tggttcacatttaacagtcttc

SEQ ID NO: 209703 - DNA, 22 bp, Artificial Sequence
  Synthetic oligonucleotide; TTC chr2 60556381 60556402 60556398 60556403 +
acatttaacagtcttctgaatt

SEQ ID NO: 209704 - DNA, 22 bp, Artificial Sequence
  Synthetic oligonucleotide; TTT chr2 60556387 60556408 60556404 60556409 +
aacagtcttctgaattacaatt

SEQ ID NO: 209705 - DNA, 22 bp, Artificial Sequence
  Synthetic oligonucleotide; TTA chr2 60556388 60556409 60556405 60556410 +
acagtcttctgaattacaattc

SEQ ID NO: 209706 - DNA, 22 bp, Artificial Sequence
  Synthetic oligonucleotide; CTT chr2 60556396 60556417 60556413 60556418 +
ctgaattacaattcattacaca

SEQ ID NO: 209707 - DNA, 22 bp, Artificial Sequence
  Synthetic oligonucleotide; TTC chr2 60556397 60556418 60556414 60556419 +
tgaattacaattcattacacaa

SEQ ID NO: 209708 - DNA, 22 bp, Artificial Sequence
  Synthetic oligonucleotide; CTG chr2 60556399 60556420 60556416 60556421 +
aattacaattcattacacaatt

SEQ ID NO: 209709 - DNA, 22 bp, Artificial Sequence
  Synthetic oligonucleotide; TTA chr2 60556404 60556425 60556421 60556426 +
caattcattacacaattgtgtg

SEQ ID NO: 209710 - DNA, 22 bp, Artificial Sequence
  Synthetic oligonucleotide; TTC chr2 60556410 60556431 60556427 60556432 +
attacacaattgtgtgcgctct

SEQ ID NO: 209711 - DNA, 22 bp, Artificial Sequence
  Synthetic oligonucleotide; TTA chr2 60556414 60556435 60556431 60556436 +
cacaattgtgtgcgctctgacg

SEQ ID NO: 209712 - DNA, 22 bp, Artificial Sequence
  Synthetic oligonucleotide; TTG chr2 60556422 60556443 60556439 60556444 +
tgtgcgctctgacgatggcacc

SEQ ID NO: 209713 - DNA, 22 bp, Artificial Sequence
  Synthetic oligonucleotide; CTC chr2 60556431 60556452 60556448 60556453 +
tgacgatggcaccctatcaggg

SEQ ID NO: 209714 - DNA, 22 bp, Artificial Sequence
  Synthetic oligonucleotide; CTG chr2 60556433 60556454 60556450 60556455 +
acgatggcaccctatcagggct

SEQ ID NO: 209715 - DNA, 22 bp, Artificial Sequence
  Synthetic oligonucleotide; CTA chr2 60556447 60556468 60556464 60556469 +
tcagggctgctatctgtggcta

SEQ ID NO: 209716 - DNA, 22 bp, Artificial Sequence
  Synthetic oligonucleotide; CTG chr2 60556456 60556477 60556473 60556478 +
ctatctgtggctatttccaata

SEQ ID NO: 209717 - DNA, 22 bp, Artificial Sequence
  Synthetic oligonucleotide; CTA chr2 60556459 60556480 60556476 60556481 +
tctgtggctatttccaataaat

SEQ ID NO: 209718 - DNA, 22 bp, Artificial Sequence
  Synthetic oligonucleotide; CTG chr2 60556463 60556484 60556480 60556485 +
tggctatttccaataaataact

SEQ ID NO: 209719 - DNA, 22 bp, Artificial Sequence
  Synthetic oligonucleotide; CTA chr2 60556469 60556490 60556486 60556491 +
tttccaataaataactggcaac

SEQ ID NO: 209720 - DNA, 22 bp, Artificial Sequence
  Synthetic oligonucleotide; TTT chr2 60556472 60556493 60556489 60556494 +
ccaataaataactggcaacatt

SEQ ID NO: 209721 - DNA, 22 bp, Artificial Sequence
  Synthetic oligonucleotide; TTC chr2 60556473 60556494 60556490 60556495 +
caataaataactggcaacattt

SEQ ID NO: 209722 - DNA, 22 bp, Artificial Sequence
  Synthetic oligonucleotide; CTG chr2 60556486 60556507 60556503 60556508 +
gcaacattttattgattttcct

SEQ ID NO: 209723 - DNA, 22 bp, Artificial Sequence
  Synthetic oligonucleotide; TTT chr2 60556495 60556516 60556512 60556517 +
tattgattttcctttttaaaaa

SEQ ID NO: 209724 - DNA, 22 bp, Artificial Sequence
  Synthetic oligonucleotide; TTT chr2 60556496 60556517 60556513 60556518 +
attgattttcctttttaaaaaa

SEQ ID NO: 209725 - DNA, 22 bp, Artificial Sequence
  Synthetic oligonucleotide; TTA chr2 60556497 60556518 60556514 60556519 +
ttgattttcctttttaaaaaaa

SEQ ID NO: 209726 - DNA, 22 bp, Artificial Sequence
  Synthetic oligonucleotide; TTG chr2 60556500 60556521 60556517 60556522 +
attttcctttttaaaaaaaaac

SEQ ID NO: 209727 - DNA, 22 bp, Artificial Sequence
  Synthetic oligonucleotide; TTT chr2 60556504 60556525 60556521 60556526 +
tcctttttaaaaaaaaacatag

SEQ ID NO: 209728 - DNA, 22 bp, Artificial Sequence
  Synthetic oligonucleotide; TTT chr2 60556505 60556526 60556522 60556527 +
cctttttaaaaaaaaacatagg

SEQ ID NO: 209729 - DNA, 22 bp, Artificial Sequence
  Synthetic oligonucleotide; TTC chr2 60556506 60556527 60556523 60556528 +
ctttttaaaaaaaaacatagga

SEQ ID NO: 209730 - DNA, 22 bp, Artificial Sequence
  Synthetic oligonucleotide; CTT chr2 60556509 60556530 60556526 60556531 +
tttaaaaaaaaacataggaaat

SEQ ID NO: 209731 - DNA, 22 bp, Artificial Sequence
  Synthetic oligonucleotide; TTT chr2 60556510 60556531 60556527 60556532 +
ttaaaaaaaaacataggaaatt

SEQ ID NO: 209732 - DNA, 22 bp, Artificial Sequence
  Synthetic oligonucleotide; TTT chr2 60556511 60556532 60556528 60556533 +
taaaaaaaaacataggaaatta

SEQ ID NO: 209733 - DNA, 22 bp, Artificial Sequence
  Synthetic oligonucleotide; TTT chr2 60556512 60556533 60556529 60556534 +
aaaaaaaaacataggaaattaa

SEQ ID NO: 209734 - DNA, 22 bp, Artificial Sequence
  Synthetic oligonucleotide; TTA chr2 60556513 60556534 60556530 60556535 +
aaaaaaaacataggaaattaag

SEQ ID NO: 209735 - DNA, 22 bp, Artificial Sequence
  Synthetic oligonucleotide; TTA chr2 60556533 60556554 60556550 60556555 +
agcacttagttacaagtaggtc

SEQ ID NO: 209736 - DNA, 22 bp, Artificial Sequence
  Synthetic oligonucleotide; CTT chr2 60556540 60556561 60556557 60556562 +
agttacaagtaggtctgctatg

SEQ ID NO: 209737 - DNA, 22 bp, Artificial Sequence
  Synthetic oligonucleotide; TTA chr2 60556541 60556562 60556558 60556563 +
gttacaagtaggtctgctatgt

SEQ ID NO: 209738 - DNA, 22 bp, Artificial Sequence
  Synthetic oligonucleotide; TTA chr2 60556545 60556566 60556562 60556567 +
caagtaggtctgctatgttatt

SEQ ID NO: 209739 - DNA, 22 bp, Artificial Sequence
  Synthetic oligonucleotide; CTA chr2 60556527 60556548 60556532 60556527 -
cttgtaactaagtgcttaattt

SEQ ID NO: 209740 - DNA, 22 bp, Artificial Sequence
  Synthetic oligonucleotide; CTT chr2 60556524 60556545 60556529 60556524 -
gtaactaagtgcttaatttcct

SEQ ID NO: 209741 - DNA, 22 bp, Artificial Sequence
  Synthetic oligonucleotide; TTG chr2 60556523 60556544 60556528 60556523 -
taactaagtgcttaatttccta

SEQ ID NO: 209742 - DNA, 22 bp, Artificial Sequence
  Synthetic oligonucleotide; CTA chr2 60556517 60556538 60556522 60556517 -
agtgcttaatttcctatgtttt

SEQ ID NO: 209743 - DNA, 22 bp, Artificial Sequence
  Synthetic oligonucleotide; CTT chr2 60556510 60556531 60556515 60556510 -
aatttcctatgtttttttttaa

SEQ ID NO: 209744 - DNA, 22 bp, Artificial Sequence
  Synthetic oligonucleotide; TTA chr2 60556509 60556530 60556514 60556509 -
atttcctatgtttttttttaaa

SEQ ID NO: 209745 - DNA, 22 bp, Artificial Sequence
  Synthetic oligonucleotide; TTT chr2 60556505 60556526 60556510 60556505 -
cctatgtttttttttaaaaagg

SEQ ID NO: 209746 - DNA, 22 bp, Artificial Sequence
  Synthetic oligonucleotide; TTC chr2 60556504 60556525 60556509 60556504 -
ctatgtttttttttaaaaagga

SEQ ID NO: 209747 - DNA, 22 bp, Artificial Sequence
  Synthetic oligonucleotide; CTA chr2 60556501 60556522 60556506 60556501 -
tgtttttttttaaaaaggaaaa

SEQ ID NO: 209748 - DNA, 22 bp, Artificial Sequence
  Synthetic oligonucleotide; TTT chr2 60556496 60556517 60556501 60556496 -
ttttttaaaaaggaaaatcaat

SEQ ID NO: 209749 - DNA, 22 bp, Artificial Sequence
  Synthetic oligonucleotide; TTT chr2 60556495 60556516 60556500 60556495 -
tttttaaaaaggaaaatcaata

SEQ ID NO: 209750 - DNA, 22 bp, Artificial Sequence
  Synthetic oligonucleotide; TTT chr2 60556494 60556515 60556499 60556494 -
ttttaaaaaggaaaatcaataa

SEQ ID NO: 209751 - DNA, 22 bp, Artificial Sequence
  Synthetic oligonucleotide; TTT chr2 60556493 60556514 60556498 60556493 -
tttaaaaaggaaaatcaataaa

SEQ ID NO: 209752 - DNA, 22 bp, Artificial Sequence
  Synthetic oligonucleotide; TTT chr2 60556492 60556513 60556497 60556492 -
ttaaaaaggaaaatcaataaaa

SEQ ID NO: 209753 - DNA, 22 bp, Artificial Sequence
  Synthetic oligonucleotide; TTT chr2 60556491 60556512 60556496 60556491 -
taaaaaggaaaatcaataaaat

SEQ ID NO: 209754 - DNA, 22 bp, Artificial Sequence
  Synthetic oligonucleotide; TTT chr2 60556490 60556511 60556495 60556490 -
aaaaaggaaaatcaataaaatg

SEQ ID NO: 209755 - DNA, 22 bp, Artificial Sequence
  Synthetic oligonucleotide; TTA chr2 60556489 60556510 60556494 60556489 -
aaaaggaaaatcaataaaatgt

SEQ ID NO: 209756 - DNA, 22 bp, Artificial Sequence
  Synthetic oligonucleotide; TTG chr2 60556465 60556486 60556470 60556465 -
ccagttatttattggaaatagc

SEQ ID NO: 209757 - DNA, 22 bp, Artificial Sequence
  Synthetic oligonucleotide; TTA chr2 60556458 60556479 60556463 60556458 -
tttattggaaatagccacagat

SEQ ID NO: 209758 - DNA, 22 bp, Artificial Sequence
  Synthetic oligonucleotide; TTT chr2 60556455 60556476 60556460 60556455 -
attggaaatagccacagatagc

SEQ ID NO: 209759 - DNA, 22 bp, Artificial Sequence
  Synthetic oligonucleotide; TTA chr2 60556454 60556475 60556459 60556454 -
ttggaaatagccacagatagca

SEQ ID NO: 209760 - DNA, 22 bp, Artificial Sequence
  Synthetic oligonucleotide; TTG chr2 60556451 60556472 60556456 60556451 -
gaaatagccacagatagcagcc

SEQ ID NO: 209761 - DNA, 22 bp, Artificial Sequence
  Synthetic oligonucleotide; CTG chr2 60556426 60556447 60556431 60556426 -
atagggtgccatcgtcagagcg

SEQ ID NO: 209762 - DNA, 22 bp, Artificial Sequence
  Synthetic oligonucleotide; TTG chr2 60556394 60556415 60556399 60556394 -
tgtaatgaattgtaattcagaa

SEQ ID NO: 209763 - DNA, 22 bp, Artificial Sequence
  Synthetic oligonucleotide; TTG chr2 60556382 60556403 60556387 60556382 -
taattcagaagactgttaaatg

SEQ ID NO: 209764 - DNA, 22 bp, Artificial Sequence
  Synthetic oligonucleotide; TTC chr2 60556376 60556397 60556381 60556376 -
agaagactgttaaatgtgaacc

SEQ ID NO: 209765 - DNA, 22 bp, Artificial Sequence
  Synthetic oligonucleotide; CTG chr2 60556367 60556388 60556372 60556367 -
ttaaatgtgaaccacagaacct

SEQ ID NO: 209766 - DNA, 22 bp, Artificial Sequence
  Synthetic oligonucleotide; TTA chr2 60556364 60556385 60556369 60556364 -
aatgtgaaccacagaacctttc

SEQ ID NO: 209767 - DNA, 22 bp, Artificial Sequence
  Synthetic oligonucleotide; CTT chr2 60556344 60556365 60556349 60556344 -
tcagaggtaataaagtcattac

SEQ ID NO: 209768 - DNA, 22 bp, Artificial Sequence
  Synthetic oligonucleotide; TTT chr2 60556343 60556364 60556348 60556343 -
cagaggtaataaagtcattact

SEQ ID NO: 209769 - DNA, 22 bp, Artificial Sequence
  Synthetic oligonucleotide; TTC chr2 60556342 60556363 60556347 60556342 -
agaggtaataaagtcattactt

SEQ ID NO: 209770 - DNA, 22 bp, Artificial Sequence
  Synthetic oligonucleotide; TTA chr2 60556323 60556344 60556328 60556323 -
ctttttacactacagccaaccc

SEQ ID NO: 209771 - DNA, 22 bp, Artificial Sequence
  Synthetic oligonucleotide; CTT chr2 60556320 60556341 60556325 60556320 -
tttacactacagccaaccccga

SEQ ID NO: 209772 - DNA, 22 bp, Artificial Sequence
  Synthetic oligonucleotide; TTT chr2 60556319 60556340 60556324 60556319 -
ttacactacagccaaccccgaa

SEQ ID NO: 209773 - DNA, 22 bp, Artificial Sequence
  Synthetic oligonucleotide; TTT chr2 60556318 60556339 60556323 60556318 -
tacactacagccaaccccgaaa

SEQ ID NO: 209774 - DNA, 22 bp, Artificial Sequence
  Synthetic oligonucleotide; TTT chr2 60556317 60556338 60556322 60556317 -
acactacagccaaccccgaaaa

SEQ ID NO: 209775 - DNA, 22 bp, Artificial Sequence
  Synthetic oligonucleotide; TTA chr2 60556316 60556337 60556321 60556316 -
cactacagccaaccccgaaaag

SEQ ID NO: 209776 - DNA, 22 bp, Artificial Sequence
  Synthetic oligonucleotide; CTA chr2 60556311 60556332 60556316 60556311 -
cagccaaccccgaaaagcttta

SEQ ID NO: 209777 - DNA, 22 bp, Artificial Sequence
  Synthetic oligonucleotide; CTT chr2 60556291 60556312 60556296 60556291 -
tatacacaccattatatataaa

SEQ ID NO: 209778 - DNA, 22 bp, Artificial Sequence
  Synthetic oligonucleotide; TTT chr2 60556290 60556311 60556295 60556290 -
atacacaccattatatataaat

SEQ ID NO: 209779 - DNA, 22 bp, Artificial Sequence
  Synthetic oligonucleotide; TTA chr2 60556289 60556310 60556294 60556289 -
tacacaccattatatataaatc

SEQ ID NO: 209780 - DNA, 22 bp, Artificial Sequence
  Synthetic oligonucleotide; TTA chr2 60556277 60556298 60556282 60556277 -
tatataaatcatacatatatat

SEQ ID NO: 209781 - DNA, 22 bp, Artificial Sequence
  Synthetic oligonucleotide; TTT chr2 60556249 60556270 60556254 60556249 -
ccacaacactcactcgctcatt

SEQ ID NO: 209782 - DNA, 22 bp, Artificial Sequence
  Synthetic oligonucleotide; TTC chr2 60556248 60556269 60556253 60556248 -
cacaacactcactcgctcattt

SEQ ID NO: 209783 - DNA, 22 bp, Artificial Sequence
  Synthetic oligonucleotide; CTC chr2 60556238 60556259 60556243 60556238 -
actcgctcatttatatatcttc

SEQ ID NO: 209784 - DNA, 22 bp, Artificial Sequence
  Synthetic oligonucleotide; CTC chr2 60556234 60556255 60556239 60556234 -
gctcatttatatatcttctcta

SEQ ID NO: 209785 - DNA, 22 bp, Artificial Sequence
  Synthetic oligonucleotide; CTC chr2 60556230 60556251 60556235 60556230 -
atttatatatcttctctataga

SEQ ID NO: 209786 - DNA, 22 bp, Artificial Sequence
  Synthetic oligonucleotide; TTT chr2 60556226 60556247 60556231 60556226 -
atatatcttctctatagatgga

SEQ ID NO: 209787 - DNA, 22 bp, Artificial Sequence
  Synthetic oligonucleotide; TTA chr2 60556225 60556246 60556230 60556225 -
tatatcttctctatagatggac

SEQ ID NO: 209788 - DNA, 22 bp, Artificial Sequence
  Synthetic oligonucleotide; CTT chr2 60556217 60556238 60556222 60556217 -
ctctatagatggacttttatgg

SEQ ID NO: 209789 - DNA, 22 bp, Artificial Sequence
  Synthetic oligonucleotide; TTC chr2 60556216 60556237 60556221 60556216 -
tctatagatggacttttatgga

SEQ ID NO: 209790 - DNA, 22 bp, Artificial Sequence
  Synthetic oligonucleotide; CTC chr2 60556214 60556235 60556219 60556214 -
tatagatggacttttatggacg

SEQ ID NO: 209791 - DNA, 22 bp, Artificial Sequence
  Synthetic oligonucleotide; CTA chr2 60556212 60556233 60556217 60556212 -
tagatggacttttatggacggg

SEQ ID NO: 209792 - DNA, 22 bp, Artificial Sequence
  Synthetic oligonucleotide; CTT chr2 60556201 60556222 60556206 60556201 -
ttatggacgggtgggaacaata

SEQ ID NO: 209793 - DNA, 22 bp, Artificial Sequence
  Synthetic oligonucleotide; TTT chr2 60556200 60556221 60556205 60556200 -
tatggacgggtgggaacaatat

SEQ ID NO: 209794 - DNA, 22 bp, Artificial Sequence
  Synthetic oligonucleotide; TTT chr2 60556199 60556220 60556204 60556199 -
atggacgggtgggaacaatatt

SEQ ID NO: 209795 - DNA, 22 bp, Artificial Sequence
  Synthetic oligonucleotide; TTA chr2 60556198 60556219 60556203 60556198 -
tggacgggtgggaacaatattc

SEQ ID NO: 209796 - DNA, 22 bp, Artificial Sequence
  Synthetic oligonucleotide; TTC chr2 60556176 60556197 60556181 60556176 -
aaatctgaaaagcttggttctg

SEQ ID NO: 209797 - DNA, 22 bp, Artificial Sequence
  Synthetic oligonucleotide; CTG chr2 60556169 60556190 60556174 60556169 -
aaaagcttggttctgaaagaat

SEQ ID NO: 209798 - DNA, 22 bp, Artificial Sequence
  Synthetic oligonucleotide; CTT chr2 60556161 60556182 60556166 60556161 -
ggttctgaaagaatctggctca

SEQ ID NO: 209799 - DNA, 22 bp, Artificial Sequence
  Synthetic oligonucleotide; TTG chr2 60556160 60556181 60556165 60556160 -
gttctgaaagaatctggctcac

SEQ ID NO: 209800 - DNA, 22 bp, Artificial Sequence
  Synthetic oligonucleotide; TTC chr2 60556156 60556177 60556161 60556156 -
tgaaagaatctggctcactatt

SEQ ID NO: 209801 - DNA, 22 bp, Artificial Sequence
  Synthetic oligonucleotide; CTG chr2 60556154 60556175 60556159 60556154 -
aaagaatctggctcactattgt

SEQ ID NO: 209802 - DNA, 22 bp, Artificial Sequence
  Synthetic oligonucleotide; CTG chr2 60556144 60556165 60556149 60556144 -
gctcactattgttacctgaagg

SEQ ID NO: 209803 - DNA, 22 bp, Artificial Sequence
  Synthetic oligonucleotide; CTC chr2 60556140 60556161 60556145 60556140 -
actattgttacctgaaggggct

SEQ ID NO: 209804 - DNA, 22 bp, Artificial Sequence
  Synthetic oligonucleotide; CTA chr2 60556136 60556157 60556141 60556136 -
ttgttacctgaaggggcttttc

SEQ ID NO: 209805 - DNA, 22 bp, Artificial Sequence
  Synthetic oligonucleotide; TTG chr2 60556133 60556154 60556138 60556133 -
ttacctgaaggggcttttcttt

SEQ ID NO: 209806 - DNA, 22 bp, Artificial Sequence
  Synthetic oligonucleotide; TTA chr2 60556130 60556151 60556135 60556130 -
cctgaaggggcttttcttttat

SEQ ID NO: 209807 - DNA, 22 bp, Artificial Sequence
  Synthetic oligonucleotide; CTG chr2 60556126 60556147 60556131 60556126 -
aaggggcttttcttttatttat

SEQ ID NO: 209808 - DNA, 22 bp, Artificial Sequence
  Synthetic oligonucleotide; CTT chr2 60556117 60556138 60556122 60556117 -
ttcttttatttatttatttttc

SEQ ID NO: 209809 - DNA, 22 bp, Artificial Sequence
  Synthetic oligonucleotide; TTT chr2 60556116 60556137 60556121 60556116 -
tcttttatttatttatttttca

SEQ ID NO: 209810 - DNA, 22 bp, Artificial Sequence
  Synthetic oligonucleotide; TTT chr2 60556115 60556136 60556120 60556115 -
cttttatttatttatttttcaa

SEQ ID NO: 209811 - DNA, 22 bp, Artificial Sequence
  Synthetic oligonucleotide; TTC chr2 60556114 60556135 60556119 60556114 -
ttttatttatttatttttcaaa

SEQ ID NO: 209812 - DNA, 22 bp, Artificial Sequence
  Synthetic oligonucleotide; CTT chr2 60556112 60556133 60556117 60556112 -
ttatttatttatttttcaaagg

SEQ ID NO: 209813 - DNA, 22 bp, Artificial Sequence
  Synthetic oligonucleotide; TTT chr2 60556111 60556132 60556116 60556111 -
tatttatttatttttcaaaggc

SEQ ID NO: 209814 - DNA, 22 bp, Artificial Sequence
  Synthetic oligonucleotide; TTT chr2 60556110 60556131 60556115 60556110 -
atttatttatttttcaaaggcc

SEQ ID NO: 209815 - DNA, 22 bp, Artificial Sequence
  Synthetic oligonucleotide; TTA chr2 60556109 60556130 60556114 60556109 -
tttatttatttttcaaaggcct

SEQ ID NO: 209816 - DNA, 22 bp, Artificial Sequence
  Synthetic oligonucleotide; TTT chr2 60556106 60556127 60556111 60556106 -
atttatttttcaaaggcctccc

SEQ ID NO: 209817 - DNA, 22 bp, Artificial Sequence
  Synthetic oligonucleotide; TTA chr2 60556105 60556126 60556110 60556105 -
tttatttttcaaaggcctccca

SEQ ID NO: 209818 - DNA, 22 bp, Artificial Sequence
  Synthetic oligonucleotide; TTT chr2 60556102 60556123 60556107 60556102 -
atttttcaaaggcctcccagtt

SEQ ID NO: 209819 - DNA, 22 bp, Artificial Sequence
  Synthetic oligonucleotide; TTA chr2 60556101 60556122 60556106 60556101 -
tttttcaaaggcctcccagttg

SEQ ID NO: 209820 - DNA, 22 bp, Artificial Sequence
  Synthetic oligonucleotide; TTT chr2 60556098 60556119 60556103 60556098 -
ttcaaaggcctcccagttgcac

SEQ ID NO: 209821 - DNA, 22 bp, Artificial Sequence
  Synthetic oligonucleotide; TTT chr2 60556097 60556118 60556102 60556097 -
tcaaaggcctcccagttgcact

SEQ ID NO: 209822 - DNA, 22 bp, Artificial Sequence
  Synthetic oligonucleotide; TTT chr2 60556096 60556117 60556101 60556096 -
caaaggcctcccagttgcactt

SEQ ID NO: 209823 - DNA, 22 bp, Artificial Sequence
  Synthetic oligonucleotide; TTC chr2 60556095 60556116 60556100 60556095 -
aaaggcctcccagttgcacttt

SEQ ID NO: 209824 - DNA, 22 bp, Artificial Sequence
  Synthetic oligonucleotide; CTC chr2 60556086 60556107 60556091 60556086 -
ccagttgcactttcttcttccc

SEQ ID NO: 209825 - DNA, 22 bp, Artificial Sequence
  Synthetic oligonucleotide; TTG chr2 60556079 60556100 60556084 60556079 -
cactttcttcttccctctcttc

SEQ ID NO: 209826 - DNA, 22 bp, Artificial Sequence
  Synthetic oligonucleotide; CTT chr2 60556074 60556095 60556079 60556074 -
tcttcttccctctcttcacctt

SEQ ID NO: 209827 - DNA, 22 bp, Artificial Sequence
  Synthetic oligonucleotide; TTT chr2 60556073 60556094 60556078 60556073 -
cttcttccctctcttcaccttc

SEQ ID NO: 209828 - DNA, 22 bp, Artificial Sequence
  Synthetic oligonucleotide; TTC chr2 60556072 60556093 60556077 60556072 -
ttcttccctctcttcaccttcc

SEQ ID NO: 209829 - DNA, 22 bp, Artificial Sequence
  Synthetic oligonucleotide; CTT chr2 60556070 60556091 60556075 60556070 -
cttccctctcttcaccttccct

SEQ ID NO: 209830 - DNA, 22 bp, Artificial Sequence
  Synthetic oligonucleotide; TTC chr2 60556069 60556090 60556074 60556069 -
ttccctctcttcaccttccctc

SEQ ID NO: 209831 - DNA, 22 bp, Artificial Sequence
  Synthetic oligonucleotide; CTT chr2 60556067 60556088 60556072 60556067 -
ccctctcttcaccttccctcca

SEQ ID NO: 209832 - DNA, 22 bp, Artificial Sequence
  Synthetic oligonucleotide; TTC chr2 60556066 60556087 60556071 60556066 -
cctctcttcaccttccctccaa

SEQ ID NO: 209833 - DNA, 22 bp, Artificial Sequence
  Synthetic oligonucleotide; CTC chr2 60556062 60556083 60556067 60556062 -
tcttcaccttccctccaaccgt

SEQ ID NO: 209834 - DNA, 22 bp, Artificial Sequence
  Synthetic oligonucleotide; CTC chr2 60556060 60556081 60556065 60556060 -
ttcaccttccctccaaccgtcc

SEQ ID NO: 209835 - DNA, 22 bp, Artificial Sequence
  Synthetic oligonucleotide; CTT chr2 60556058 60556079 60556063 60556058 -
caccttccctccaaccgtcccc

SEQ ID NO: 209836 - DNA, 22 bp, Artificial Sequence
  Synthetic oligonucleotide; TTC chr2 60556057 60556078 60556062 60556057 -
accttccctccaaccgtccccc

SEQ ID NO: 209837 - DNA, 22 bp, Artificial Sequence
  Synthetic oligonucleotide; CTT chr2 60556052 60556073 60556057 60556052 -
ccctccaaccgtcccccacgtc

SEQ ID NO: 209838 - DNA, 22 bp, Artificial Sequence
  Synthetic oligonucleotide; TTC chr2 60556051 60556072 60556056 60556051 -
cctccaaccgtcccccacgtcg

SEQ ID NO: 209839 - DNA, 22 bp, Artificial Sequence
  Synthetic oligonucleotide; CTC chr2 60556047 60556068 60556052 60556047 -
caaccgtcccccacgtcgtcct

SEQ ID NO: 209840 - DNA, 22 bp, Artificial Sequence
  Synthetic oligonucleotide; CTC chr2 60556024 60556045 60556029 60556024 -
ccccgccaccccccaagaagac

SEQ ID NO: 209841 - DNA, 22 bp, Artificial Sequence
  Synthetic oligonucleotide; TTC chr2 60555998 60556019 60556003 60555998 -
ttttggtgactccaaggctggt

SEQ ID NO: 209842 - DNA, 22 bp, Artificial Sequence
  Synthetic oligonucleotide; CTT chr2 60555996 60556017 60556001 60555996 -
ttggtgactccaaggctggttt

SEQ ID NO: 209843 - DNA, 22 bp, Artificial Sequence
  Synthetic oligonucleotide; TTT chr2 60555995 60556016 60556000 60555995 -
tggtgactccaaggctggttta

SEQ ID NO: 209844 - DNA, 22 bp, Artificial Sequence
  Synthetic oligonucleotide; TTT chr2 60555994 60556015 60555999 60555994 -
ggtgactccaaggctggtttaa

SEQ ID NO: 209845 - DNA, 22 bp, Artificial Sequence
  Synthetic oligonucleotide; TTG chr2 60555993 60556014 60555998 60555993 -
gtgactccaaggctggtttaac

SEQ ID NO: 209846 - DNA, 22 bp, Artificial Sequence
  Synthetic oligonucleotide; CTC chr2 60555986 60556007 60555991 60555986 -
caaggctggtttaacaagacaa

SEQ ID NO: 209847 - DNA, 22 bp, Artificial Sequence
  Synthetic oligonucleotide; CTG chr2 60555978 60555999 60555983 60555978 -
gtttaacaagacaaaaagcaga

SEQ ID NO: 209848 - DNA, 22 bp, Artificial Sequence
  Synthetic oligonucleotide; TTT chr2 60555974 60555995 60555979 60555974 -
aacaagacaaaaagcagactgt

SEQ ID NO: 209849 - DNA, 22 bp, Artificial Sequence
  Synthetic oligonucleotide; TTA chr2 60555973 60555994 60555978 60555973 -
acaagacaaaaagcagactgtg

SEQ ID NO: 209850 - DNA, 22 bp, Artificial Sequence
  Synthetic oligonucleotide; CTG chr2 60555953 60555974 60555958 60555953 -
tggtggaatagagatgctgacc

SEQ ID NO: 209851 - DNA, 22 bp, Artificial Sequence
  Synthetic oligonucleotide; CTG chr2 60555934 60555955 60555939 60555934 -
acctgctctgaagaactcagtg

SEQ ID NO: 209852 - DNA, 22 bp, Artificial Sequence
  Synthetic oligonucleotide; CTG chr2 60555929 60555950 60555934 60555929 -
ctctgaagaactcagtgaaaag

SEQ ID NO: 209853 - DNA, 22 bp, Artificial Sequence
  Synthetic oligonucleotide; CTC chr2 60555926 60555947 60555931 60555926 -
tgaagaactcagtgaaaagggg

SEQ ID NO: 209854 - DNA, 22 bp, Artificial Sequence
  Synthetic oligonucleotide; CTG chr2 60555924 60555945 60555929 60555924 -
aagaactcagtgaaaaggggaa

SEQ ID NO: 209855 - DNA, 22 bp, Artificial Sequence
  Synthetic oligonucleotide; CTC chr2 60555916 60555937 60555921 60555916 -
agtgaaaaggggaaatggtgtc

SEQ ID NO: 209856 - DNA, 22 bp, Artificial Sequence
  Synthetic oligonucleotide; CTA chr2 60555882 60555903 60555887 60555882 -
cagagcttaacttctagtgaat

SEQ ID NO: 209857 - DNA, 22 bp, Artificial Sequence
  Synthetic oligonucleotide; CTT chr2 60555874 60555895 60555879 60555874 -
aacttctagtgaatcctcccgc

SEQ ID NO: 209858 - DNA, 22 bp, Artificial Sequence
  Synthetic oligonucleotide; TTA chr2 60555873 60555894 60555878 60555873 -
acttctagtgaatcctcccgct

SEQ ID NO: 209859 - DNA, 22 bp, Artificial Sequence
  Synthetic oligonucleotide; CTT chr2 60555869 60555890 60555874 60555869 -
ctagtgaatcctcccgcttctt

SEQ ID NO: 209860 - DNA, 22 bp, Artificial Sequence
  Synthetic oligonucleotide; TTC chr2 60555868 60555889 60555873 60555868 -
tagtgaatcctcccgcttctta

SEQ ID NO: 209861 - DNA, 22 bp, Artificial Sequence
  Synthetic oligonucleotide; CTA chr2 60555866 60555887 60555871 60555866 -
gtgaatcctcccgcttcttaaa

SEQ ID NO: 209862 - DNA, 22 bp, Artificial Sequence
  Synthetic oligonucleotide; CTC chr2 60555856 60555877 60555861 60555856 -
ccgcttcttaaacagaatttga

SEQ ID NO: 209863 - DNA, 22 bp, Artificial Sequence
  Synthetic oligonucleotide; CTT chr2 60555850 60555871 60555855 60555850 -
cttaaacagaatttgaggtctc

SEQ ID NO: 209864 - DNA, 22 bp, Artificial Sequence
  Synthetic oligonucleotide; TTC chr2 60555849 60555870 60555854 60555849 -
ttaaacagaatttgaggtctcc

SEQ ID NO: 209865 - DNA, 22 bp, Artificial Sequence
  Synthetic oligonucleotide; CTT chr2 60555847 60555868 60555852 60555847 -
aaacagaatttgaggtctccct

SEQ ID NO: 209866 - DNA, 22 bp, Artificial Sequence
  Synthetic oligonucleotide; TTA chr2 60555846 60555867 60555851 60555846 -
aacagaatttgaggtctccctc

SEQ ID NO: 209867 - DNA, 22 bp, Artificial Sequence
  Synthetic oligonucleotide; TTT chr2 60555836 60555857 60555841 60555836 -
gaggtctccctcccacaaactg

SEQ ID NO: 209868 - DNA, 22 bp, Artificial Sequence
  Synthetic oligonucleotide; TTG chr2 60555835 60555856 60555840 60555835 -
aggtctccctcccacaaactgg

SEQ ID NO: 209869 - DNA, 22 bp, Artificial Sequence
  Synthetic oligonucleotide; CTC chr2 60555828 60555849 60555833 60555828 -
cctcccacaaactggagggaaa

SEQ ID NO: 209870 - DNA, 22 bp, Artificial Sequence
  Synthetic oligonucleotide; CTC chr2 60555824 60555845 60555829 60555824 -
ccacaaactggagggaaacaac

SEQ ID NO: 209871 - DNA, 22 bp, Artificial Sequence
  Synthetic oligonucleotide; CTG chr2 60555814 60555835 60555819 60555814 -
gagggaaacaacaacaaacaac

SEQ ID NO: 209872 - DNA, 22 bp, Artificial Sequence
  Synthetic oligonucleotide; TTG chr2 60555781 60555802 60555786 60555781 -
acacaatcccagtacagcccac

SEQ ID NO: 209873 - DNA, 22 bp, Artificial Sequence
  Synthetic oligonucleotide; CTC chr2 60555754 60555775 60555759 60555754 -
tctcaatgttgagcatcaaaac

SEQ ID NO: 209874 - DNA, 22 bp, Artificial Sequence
  Synthetic oligonucleotide; CTC chr2 60555752 60555773 60555757 60555752 -
tcaatgttgagcatcaaaacct

SEQ ID NO: 209875 - DNA, 22 bp, Artificial Sequence
  Synthetic oligonucleotide; CTC chr2 60555750 60555771 60555755 60555750 -
aatgttgagcatcaaaacctcc

SEQ ID NO: 209876 - DNA, 22 bp, Artificial Sequence
  Synthetic oligonucleotide; TTG chr2 60555743 60555764 60555748 60555743 -
agcatcaaaacctccttttctt

SEQ ID NO: 209877 - DNA, 22 bp, Artificial Sequence
  Synthetic oligonucleotide; CTC chr2 60555729 60555750 60555734 60555729 -
cttttcttccttagaggggtcc

SEQ ID NO: 209878 - DNA, 22 bp, Artificial Sequence
  Synthetic oligonucleotide; CTT chr2 60555726 60555747 60555731 60555726 -
ttcttccttagaggggtccgaa

SEQ ID NO: 209879 - DNA, 22 bp, Artificial Sequence
  Synthetic oligonucleotide; TTT chr2 60555725 60555746 60555730 60555725 -
tcttccttagaggggtccgaag

SEQ ID NO: 209880 - DNA, 22 bp, Artificial Sequence
  Synthetic oligonucleotide; TTT chr2 60555724 60555745 60555729 60555724 -
cttccttagaggggtccgaagc

SEQ ID NO: 209881 - DNA, 22 bp, Artificial Sequence
  Synthetic oligonucleotide; TTC chr2 60555723 60555744 60555728 60555723 -
ttccttagaggggtccgaagct

SEQ ID NO: 209882 - DNA, 22 bp, Artificial Sequence
  Synthetic oligonucleotide; CTT chr2 60555721 60555742 60555726 60555721 -
ccttagaggggtccgaagctcc

SEQ ID NO: 209883 - DNA, 22 bp, Artificial Sequence
  Synthetic oligonucleotide; TTC chr2 60555720 60555741 60555725 60555720 -
cttagaggggtccgaagctccg

SEQ ID NO: 209884 - DNA, 22 bp, Artificial Sequence
  Synthetic oligonucleotide; CTT chr2 60555717 60555738 60555722 60555717 -
agaggggtccgaagctccgccg

SEQ ID NO: 209885 - DNA, 22 bp, Artificial Sequence
  Synthetic oligonucleotide; TTA chr2 60555716 60555737 60555721 60555716 -
gaggggtccgaagctccgccga

SEQ ID NO: 209886 - DNA, 22 bp, Artificial Sequence
  Synthetic oligonucleotide; CTC chr2 60555700 60555721 60555705 60555700 -
cgccgagctaggcaagccagtc

SEQ ID NO: 209887 - DNA, 22 bp, Artificial Sequence
  Synthetic oligonucleotide; CTA chr2 60555690 60555711 60555695 60555690 -
ggcaagccagtcattttctaac

SEQ ID NO: 209888 - DNA, 22 bp, Artificial Sequence
  Synthetic oligonucleotide; TTT chr2 60555674 60555695 60555679 60555674 -
tctaacacagtagacttgaaac

SEQ ID NO: 209889 - DNA, 22 bp, Artificial Sequence
  Synthetic oligonucleotide; TTT chr2 60555673 60555694 60555678 60555673 -
ctaacacagtagacttgaaact

SEQ ID NO: 209890 - DNA, 22 bp, Artificial Sequence
  Synthetic oligonucleotide; TTC chr2 60555672 60555693 60555677 60555672 -
taacacagtagacttgaaactt

SEQ ID NO: 209891 - DNA, 22 bp, Artificial Sequence
  Synthetic oligonucleotide; CTA chr2 60555670 60555691 60555675 60555670 -
acacagtagacttgaaacttta

SEQ ID NO: 209892 - DNA, 22 bp, Artificial Sequence
  Synthetic oligonucleotide; CTT chr2 60555657 60555678 60555662 60555657 -
gaaactttactaagacgaaaca

SEQ ID NO: 209893 - DNA, 22 bp, Artificial Sequence
  Synthetic oligonucleotide; TTG chr2 60555656 60555677 60555661 60555656 -
aaactttactaagacgaaacag

SEQ ID NO: 209894 - DNA, 22 bp, Artificial Sequence
  Synthetic oligonucleotide; CTT chr2 60555650 60555671 60555655 60555650 -
tactaagacgaaacaggaataa

SEQ ID NO: 209895 - DNA, 22 bp, Artificial Sequence
  Synthetic oligonucleotide; TTT chr2 60555649 60555670 60555654 60555649 -
actaagacgaaacaggaataaa

SEQ ID NO: 209896 - DNA, 22 bp, Artificial Sequence
  Synthetic oligonucleotide; TTA chr2 60555648 60555669 60555653 60555648 -
ctaagacgaaacaggaataaac

SEQ ID NO: 209897 - DNA, 22 bp, Artificial Sequence
  Synthetic oligonucleotide; CTA chr2 60555645 60555666 60555650 60555645 -
agacgaaacaggaataaacagc

SEQ ID NO: 209898 - DNA, 22 bp, Artificial Sequence
  Synthetic oligonucleotide; CTT chr2 60555618 60555639 60555623 60555618 -
gccggcagggctgcgggatggg

SEQ ID NO: 209899 - DNA, 22 bp, Artificial Sequence
  Synthetic oligonucleotide; TTG chr2 60555617 60555638 60555622 60555617 -
ccggcagggctgcgggatgggt

SEQ ID NO: 209900 - DNA, 22 bp, Artificial Sequence
  Synthetic oligonucleotide; CTG chr2 60555605 60555626 60555610 60555605 -
cgggatgggtgagcgcgtgcaa

SEQ ID NO: 209901 - DNA, 22 bp, Artificial Sequence
  Synthetic oligonucleotide; CTC chr2 60555570 60555591 60555575 60555570 -
gcttaaaacaataaagcccccc

SEQ ID NO: 209902 - DNA, 22 bp, Artificial Sequence
  Synthetic oligonucleotide; CTT chr2 60555566 60555587 60555571 60555566 -
aaaacaataaagcccccccacc

SEQ ID NO: 209903 - DNA, 22 bp, Artificial Sequence
  Synthetic oligonucleotide; TTA chr2 60555565 60555586 60555570 60555565 -
aaacaataaagcccccccaccg

SEQ ID NO: 209904 - DNA, 22 bp, Artificial Sequence
  Synthetic oligonucleotide; TTT chr2 60555530 60555551 60555535 60555530 -
acggaagcgacaccctttagac

SEQ ID NO: 209905 - DNA, 22 bp, Artificial Sequence
  Synthetic oligonucleotide; TTA chr2 60555529 60555550 60555534 60555529 -
cggaagcgacaccctttagact

SEQ ID NO: 209906 - DNA, 22 bp, Artificial Sequence
  Synthetic oligonucleotide; CTT chr2 60555513 60555534 60555518 60555513 -
tagactgaagagggggatgaga

SEQ ID NO: 209907 - DNA, 22 bp, Artificial Sequence
  Synthetic oligonucleotide; TTT chr2 60555512 60555533 60555517 60555512 -
agactgaagagggggatgagaa

SEQ ID NO: 209908 - DNA, 22 bp, Artificial Sequence
  Synthetic oligonucleotide; TTA chr2 60555511 60555532 60555516 60555511 -
gactgaagagggggatgagaag

SEQ ID NO: 209909 - DNA, 22 bp, Artificial Sequence
  Synthetic oligonucleotide; CTG chr2 60555506 60555527 60555511 60555506 -
aagagggggatgagaagacggg

SEQ ID NO: 209910 - DNA, 22 bp, Artificial Sequence
  Synthetic oligonucleotide; TTG chr2 60555479 60555500 60555484 60555479 -
tggaaccgctccgaggagaggg

SEQ ID NO: 209911 - DNA, 22 bp, Artificial Sequence
  Synthetic oligonucleotide; CTC chr2 60555468 60555489 60555473 60555468 -
cgaggagagggaaggagggctc

SEQ ID NO: 209912 - DNA, 22 bp, Artificial Sequence
  Synthetic oligonucleotide; CTC chr2 60555446 60555467 60555451 60555446 -
ctcgctctgcagacacactcac

SEQ ID NO: 209913 - DNA, 22 bp, Artificial Sequence
  Synthetic oligonucleotide; CTC chr2 60555443 60555464 60555448 60555443 -
gctctgcagacacactcacaca

SEQ ID NO: 209914 - DNA, 22 bp, Artificial Sequence
  Synthetic oligonucleotide; CTC chr2 60555439 60555460 60555444 60555439 -
tgcagacacactcacacatatc

SEQ ID NO: 209915 - DNA, 22 bp, Artificial Sequence
  Synthetic oligonucleotide; CTG chr2 60555437 60555458 60555442 60555437 -
cagacacactcacacatatcca

SEQ ID NO: 209916 - DNA, 22 bp, Artificial Sequence
  Synthetic oligonucleotide; CTC chr2 60555426 60555447 60555431 60555426 -
acacatatccacctgcagctca

SEQ ID NO: 209917 - DNA, 22 bp, Artificial Sequence
  Synthetic oligonucleotide; CTG chr2 60555411 60555432 60555416 60555411 -
cagctcagggtctcgcgggcca

SEQ ID NO: 209918 - DNA, 22 bp, Artificial Sequence
  Synthetic oligonucleotide; CTC chr2 60555405 60555426 60555410 60555405 -
agggtctcgcgggccatggcga

SEQ ID NO: 209919 - DNA, 22 bp, Artificial Sequence
  Synthetic oligonucleotide; CTC chr2 60555397 60555418 60555402 60555397 -
gcgggccatggcgacccgtctc

SEQ ID NO: 209920 - DNA, 22 bp, Artificial Sequence
  Synthetic oligonucleotide; CTC chr2 60555375 60555396 60555380 60555375 -
caccctgcaccctccgcacctc

SEQ ID NO: 209921 - DNA, 22 bp, Artificial Sequence
  Synthetic oligonucleotide; CTG chr2 60555368 60555389 60555373 60555368 -
caccctccgcacctcccttgga

SEQ ID NO: 209922 - DNA, 22 bp, Artificial Sequence
  Synthetic oligonucleotide; CTC chr2 60555361 60555382 60555366 60555361 -
cgcacctcccttggacctgagt

SEQ ID NO: 209923 - DNA, 22 bp, Artificial Sequence
  Synthetic oligonucleotide; CTC chr2 60555353 60555374 60555358 60555353 -
ccttggacctgagtccattctc

SEQ ID NO: 209924 - DNA, 22 bp, Artificial Sequence
  Synthetic oligonucleotide; CTT chr2 60555349 60555370 60555354 60555349 -
ggacctgagtccattctcctct

SEQ ID NO: 209925 - DNA, 22 bp, Artificial Sequence
  Synthetic oligonucleotide; TTG chr2 60555348 60555369 60555353 60555348 -
gacctgagtccattctcctctc

SEQ ID NO: 209926 - DNA, 22 bp, Artificial Sequence
  Synthetic oligonucleotide; CTG chr2 60555342 60555363 60555347 60555342 -
agtccattctcctctcccccca

SEQ ID NO: 209927 - DNA, 22 bp, Artificial Sequence
  Synthetic oligonucleotide; TTC chr2 60555333 60555354 60555338 60555333 -
tcctctccccccaactccttcc

SEQ ID NO: 209928 - DNA, 22 bp, Artificial Sequence
  Synthetic oligonucleotide; CTC chr2 60555331 60555352 60555336 60555331 -
ctctccccccaactccttccag

SEQ ID NO: 209929 - DNA, 22 bp, Artificial Sequence
  Synthetic oligonucleotide; CTC chr2 60555328 60555349 60555333 60555328 -
tccccccaactccttccagatt

SEQ ID NO: 209930 - DNA, 22 bp, Artificial Sequence
  Synthetic oligonucleotide; CTC chr2 60555326 60555347 60555331 60555326 -
cccccaactccttccagatttg

SEQ ID NO: 209931 - DNA, 22 bp, Artificial Sequence
  Synthetic oligonucleotide; CTC chr2 60555316 60555337 60555321 60555316 -
cttccagatttggaatcggact

SEQ ID NO: 209932 - DNA, 22 bp, Artificial Sequence
  Synthetic oligonucleotide; CTT chr2 60555313 60555334 60555318 60555313 -
ccagatttggaatcggactgcg

SEQ ID NO: 209933 - DNA, 22 bp, Artificial Sequence
  Synthetic oligonucleotide; TTC chr2 60555312 60555333 60555317 60555312 -
cagatttggaatcggactgcga

SEQ ID NO: 209934 - DNA, 22 bp, Artificial Sequence
  Synthetic oligonucleotide; TTT chr2 60555305 60555326 60555310 60555305 -
ggaatcggactgcgatctcccc

SEQ ID NO: 209935 - DNA, 22 bp, Artificial Sequence
  Synthetic oligonucleotide; TTG chr2 60555304 60555325 60555309 60555304 -
gaatcggactgcgatctccccg

SEQ ID NO: 209936 - DNA, 22 bp, Artificial Sequence
  Synthetic oligonucleotide; CTG chr2 60555293 60555314 60555298 60555293 -
cgatctccccggcggcggcggc

SEQ ID NO: 209937 - DNA, 22 bp, Artificial Sequence
  Synthetic oligonucleotide; CTC chr2 60555286 60555307 60555291 60555286 -
cccggcggcggcggcggcggct

SEQ ID NO: 209938 - DNA, 22 bp, Artificial Sequence
  Synthetic oligonucleotide; CTG chr2 60555263 60555284 60555268 60555263 -
cagagtggtgctggcaggcagg

SEQ ID NO: 209939 - DNA, 22 bp, Artificial Sequence
  Synthetic oligonucleotide; CTG chr2 60555250 60555271 60555255 60555250 -
gcaggcagggaggctgggaggc

SEQ ID NO: 209940 - DNA, 22 bp, Artificial Sequence
  Synthetic oligonucleotide; CTG chr2 60555234 60555255 60555239 60555234 -
ggaggcgggaggcgccagggga

SEQ ID NO: 209941 - DNA, 22 bp, Artificial Sequence
  Synthetic oligonucleotide; CTT chr2 60555209 60555230 60555214 60555209 -
tacaggcacgtttctgaataaa

SEQ ID NO: 209942 - DNA, 22 bp, Artificial Sequence
  Synthetic oligonucleotide; TTT chr2 60555208 60555229 60555213 60555208 -
acaggcacgtttctgaataaac

SEQ ID NO: 209943 - DNA, 22 bp, Artificial Sequence
  Synthetic oligonucleotide; TTA chr2 60555207 60555228 60555212 60555207 -
caggcacgtttctgaataaact

SEQ ID NO: 209944 - DNA, 22 bp, Artificial Sequence
  Synthetic oligonucleotide; TTT chr2 60555196 60555217 60555201 60555196 -
ctgaataaactttccaatcgca

SEQ ID NO: 209945 - DNA, 22 bp, Artificial Sequence
  Synthetic oligonucleotide; TTC chr2 60555195 60555216 60555200 60555195 -
tgaataaactttccaatcgcag

SEQ ID NO: 209946 - DNA, 22 bp, Artificial Sequence
  Synthetic oligonucleotide; CTG chr2 60555193 60555214 60555198 60555193 -
aataaactttccaatcgcaggg

SEQ ID NO: 209947 - DNA, 22 bp, Artificial Sequence
  Synthetic oligonucleotide; CTT chr2 60555184 60555205 60555189 60555184 -
tccaatcgcagggggtgctgtt

SEQ ID NO: 209948 - DNA, 22 bp, Artificial Sequence
  Synthetic oligonucleotide; TTT chr2 60555183 60555204 60555188 60555183 -
ccaatcgcagggggtgctgttg

SEQ ID NO: 209949 - DNA, 22 bp, Artificial Sequence
  Synthetic oligonucleotide; TTC chr2 60555182 60555203 60555187 60555182 -
caatcgcagggggtgctgttgc

SEQ ID NO: 209950 - DNA, 22 bp, Artificial Sequence
  Synthetic oligonucleotide; CTG chr2 60555164 60555185 60555169 60555164 -
ttgctgtacattttacgtaaaa

SEQ ID NO: 209951 - DNA, 22 bp, Artificial Sequence
  Synthetic oligonucleotide; TTG chr2 60555161 60555182 60555166 60555161 -
ctgtacattttacgtaaaactg

SEQ ID NO: 209952 - DNA, 22 bp, Artificial Sequence
  Synthetic oligonucleotide; CTG chr2 60555158 60555179 60555163 60555158 -
tacattttacgtaaaactgaaa

SEQ ID NO: 209953 - DNA, 22 bp, Artificial Sequence
  Synthetic oligonucleotide; TTT chr2 60555151 60555172 60555156 60555151 -
tacgtaaaactgaaagtatccc

SEQ ID NO: 209954 - DNA, 22 bp, Artificial Sequence
  Synthetic oligonucleotide; TTT chr2 60555150 60555171 60555155 60555150 -
acgtaaaactgaaagtatccca

SEQ ID NO: 209955 - DNA, 22 bp, Artificial Sequence
  Synthetic oligonucleotide; TTA chr2 60555149 60555170 60555154 60555149 -
cgtaaaactgaaagtatcccac

SEQ ID NO: 209956 - DNA, 22 bp, Artificial Sequence
  Synthetic oligonucleotide; CTG chr2 60555139 60555160 60555144 60555139 -
aaagtatcccacgccagagtga

SEQ ID NO: 209957 - DNA, 22 bp, Artificial Sequence
  Synthetic oligonucleotide; CTT chr2 60555108 60555129 60555113 60555108 -
tttgacagcggcagcacgcgcg

SEQ ID NO: 209958 - DNA, 22 bp, Artificial Sequence
  Synthetic oligonucleotide; TTT chr2 60555107 60555128 60555112 60555107 -
ttgacagcggcagcacgcgcgt

SEQ ID NO: 209959 - DNA, 22 bp, Artificial Sequence
  Synthetic oligonucleotide; TTT chr2 60555106 60555127 60555111 60555106 -
tgacagcggcagcacgcgcgtg

SEQ ID NO: 209960 - DNA, 22 bp, Artificial Sequence
  Synthetic oligonucleotide; TTT chr2 60555105 60555126 60555110 60555105 -
gacagcggcagcacgcgcgtgt

SEQ ID NO: 209961 - DNA, 22 bp, Artificial Sequence
  Synthetic oligonucleotide; TTG chr2 60555104 60555125 60555109 60555104 -
acagcggcagcacgcgcgtgtg

SEQ ID NO: 209962 - DNA, 22 bp, Artificial Sequence
  Synthetic oligonucleotide; TTA chr2 60555065 60555086 60555070 60555065 -
aagagacagggttttatttcca

SEQ ID NO: 209963 - DNA, 22 bp, Artificial Sequence
  Synthetic oligonucleotide; TTT chr2 60555051 60555072 60555056 60555051 -
tatttccaacaggtcttcccta

SEQ ID NO: 209964 - DNA, 22 bp, Artificial Sequence
  Synthetic oligonucleotide; TTT chr2 60555050 60555071 60555055 60555050 -
atttccaacaggtcttccctaa

SEQ ID NO: 209965 - DNA, 22 bp, Artificial Sequence
  Synthetic oligonucleotide; TTA chr2 60555049 60555070 60555054 60555049 -
tttccaacaggtcttccctaat

SEQ ID NO: 209966 - DNA, 22 bp, Artificial Sequence
  Synthetic oligonucleotide; TTT chr2 60555046 60555067 60555051 60555046 -
ccaacaggtcttccctaatttc

SEQ ID NO: 209967 - DNA, 22 bp, Artificial Sequence
  Synthetic oligonucleotide; TTC chr2 60555045 60555066 60555050 60555045 -
caacaggtcttccctaatttcc

SEQ ID NO: 209968 - DNA, 22 bp, Artificial Sequence
  Synthetic oligonucleotide; CTT chr2 60555034 60555055 60555039 60555034 -
ccctaatttccagggaacgtct

SEQ ID NO: 209969 - DNA, 22 bp, Artificial Sequence
  Synthetic oligonucleotide; TTC chr2 60555033 60555054 60555038 60555033 -
cctaatttccagggaacgtctg

SEQ ID NO: 209970 - DNA, 22 bp, Artificial Sequence
  Synthetic oligonucleotide; CTA chr2 60555029 60555050 60555034 60555029 -
atttccagggaacgtctgcaga

SEQ ID NO: 209971 - DNA, 22 bp, Artificial Sequence
  Synthetic oligonucleotide; TTT chr2 60555025 60555046 60555030 60555025 -
ccagggaacgtctgcagaaagg

SEQ ID NO: 209972 - DNA, 22 bp, Artificial Sequence
  Synthetic oligonucleotide; TTC chr2 60555024 60555045 60555029 60555024 -
cagggaacgtctgcagaaaggc

SEQ ID NO: 209973 - DNA, 22 bp, Artificial Sequence
  Synthetic oligonucleotide; CTG chr2 60555011 60555032 60555016 60555011 -
cagaaaggcgagagggggctgc

SEQ ID NO: 209974 - DNA, 22 bp, Artificial Sequence
  Synthetic oligonucleotide; CTG chr2 60554990 60555011 60554995 60554990 -
ctggctcctgggtgtgcgcctt

SEQ ID NO: 209975 - DNA, 22 bp, Artificial Sequence
  Synthetic oligonucleotide; CTG chr2 60554987 60555008 60554992 60554987 -
gctcctgggtgtgcgccttggc

SEQ ID NO: 209976 - DNA, 22 bp, Artificial Sequence
  Synthetic oligonucleotide; CTC chr2 60554983 60555004 60554988 60554983 -
ctgggtgtgcgccttggccggc

SEQ ID NO: 209977 - DNA, 22 bp, Artificial Sequence
  Synthetic oligonucleotide; CTG chr2 60554980 60555001 60554985 60554980 -
ggtgtgcgccttggccggcggc

SEQ ID NO: 209978 - DNA, 22 bp, Artificial Sequence
  Synthetic oligonucleotide; CTT chr2 60554968 60554989 60554973 60554968 -
ggccggcggcgcctggggagcg

SEQ ID NO: 209979 - DNA, 22 bp, Artificial Sequence
  Synthetic oligonucleotide; TTG chr2 60554967 60554988 60554972 60554967 -
gccggcggcgcctggggagcgc

SEQ ID NO: 209980 - DNA, 22 bp, Artificial Sequence
  Synthetic oligonucleotide; CTG chr2 60554953 60554974 60554958 60554953 -
gggagcgcggcggtgacccgag

SEQ ID NO: 209981 - DNA, 22 bp, Artificial Sequence
  Synthetic oligonucleotide; CTC chr2 60554920 60554941 60554925 60554920 -
accaccgtggtctccccgctgc

SEQ ID NO: 209982 - DNA, 22 bp, Artificial Sequence
  Synthetic oligonucleotide; CTC chr2 60554906 60554927 60554911 60554906 -
cccgctgctcctgcgagcctgt

SEQ ID NO: 209983 - DNA, 22 bp, Artificial Sequence
  Synthetic oligonucleotide; CTG chr2 60554899 60554920 60554904 60554899 -
ctcctgcgagcctgtcgctctc

SEQ ID NO: 209984 - DNA, 22 bp, Artificial Sequence
  Synthetic oligonucleotide; CTC chr2 60554896 60554917 60554901 60554896 -
ctgcgagcctgtcgctctctct

SEQ ID NO: 209985 - DNA, 22 bp, Artificial Sequence
  Synthetic oligonucleotide; CTG chr2 60554893 60554914 60554898 60554893 -
cgagcctgtcgctctctctcca

SEQ ID NO: 209986 - DNA, 22 bp, Artificial Sequence
  Synthetic oligonucleotide; CTG chr2 60554885 60554906 60554890 60554885 -
tcgctctctctccattcccatt

SEQ ID NO: 209987 - DNA, 22 bp, Artificial Sequence
  Synthetic oligonucleotide; CTC chr2 60554879 60554900 60554884 60554879 -
tctctccattcccattttctct

SEQ ID NO: 209988 - DNA, 22 bp, Artificial Sequence
  Synthetic oligonucleotide; CTC chr2 60554877 60554898 60554882 60554877 -
tctccattcccattttctcttt

SEQ ID NO: 209989 - DNA, 22 bp, Artificial Sequence
  Synthetic oligonucleotide; CTC chr2 60554875 60554896 60554880 60554875 -
tccattcccattttctctttcc

SEQ ID NO: 209990 - DNA, 22 bp, Artificial Sequence
  Synthetic oligonucleotide; CTC chr2 60554873 60554894 60554878 60554873 -
cattcccattttctctttccct

SEQ ID NO: 209991 - DNA, 22 bp, Artificial Sequence
  Synthetic oligonucleotide; TTC chr2 60554868 60554889 60554873 60554868 -
ccattttctctttccctgggta

SEQ ID NO: 209992 - DNA, 22 bp, Artificial Sequence
  Synthetic oligonucleotide; TTT chr2 60554862 60554883 60554867 60554862 -
tctctttccctgggtaacagca

SEQ ID NO: 209993 - DNA, 22 bp, Artificial Sequence
  Synthetic oligonucleotide; TTT chr2 60554861 60554882 60554866 60554861 -
ctctttccctgggtaacagcac

SEQ ID NO: 209994 - DNA, 22 bp, Artificial Sequence
  Synthetic oligonucleotide; TTC chr2 60554860 60554881 60554865 60554860 -
tctttccctgggtaacagcaca

SEQ ID NO: 209995 - DNA, 22 bp, Artificial Sequence
  Synthetic oligonucleotide; CTC chr2 60554858 60554879 60554863 60554858 -
tttccctgggtaacagcacagg

SEQ ID NO: 209996 - DNA, 22 bp, Artificial Sequence
  Synthetic oligonucleotide; CTT chr2 60554856 60554877 60554861 60554856 -
tccctgggtaacagcacaggaa

SEQ ID NO: 209997 - DNA, 22 bp, Artificial Sequence
  Synthetic oligonucleotide; TTT chr2 60554855 60554876 60554860 60554855 -
ccctgggtaacagcacaggaac

SEQ ID NO: 209998 - DNA, 22 bp, Artificial Sequence
  Synthetic oligonucleotide; TTC chr2 60554854 60554875 60554859 60554854 -
cctgggtaacagcacaggaaca

SEQ ID NO: 209999 - DNA, 22 bp, Artificial Sequence
  Synthetic oligonucleotide; CTG chr2 60554850 60554871 60554855 60554850 -
ggtaacagcacaggaacagttg

SEQ ID NO: 210000 - DNA, 22 bp, Artificial Sequence
  Synthetic oligonucleotide; TTG chr2 60554828 60554849 60554833 60554828 -
tgctctgcccgtaagaaacatt

SEQ ID NO: 210001 - DNA, 22 bp, Artificial Sequence
  Synthetic oligonucleotide; CTC chr2 60554823 60554844 60554828 60554823 -
tgcccgtaagaaacattttctt

SEQ ID NO: 210002 - DNA, 22 bp, Artificial Sequence
  Synthetic oligonucleotide; CTG chr2 60554821 60554842 60554826 60554821 -
cccgtaagaaacattttcttcc

SEQ ID NO: 210003 - DNA, 22 bp, Artificial Sequence
  Synthetic oligonucleotide; TTT chr2 60554805 60554826 60554810 60554805 -
tcttcccatccctctgtgcttt

SEQ ID NO: 210004 - DNA, 22 bp, Artificial Sequence
  Synthetic oligonucleotide; TTT chr2 60554804 60554825 60554809 60554804 -
cttcccatccctctgtgctttt

SEQ ID NO: 210005 - DNA, 22 bp, Artificial Sequence
  Synthetic oligonucleotide; TTC chr2 60554803 60554824 60554808 60554803 -
ttcccatccctctgtgcttttg

SEQ ID NO: 210006 - DNA, 22 bp, Artificial Sequence
  Synthetic oligonucleotide; CTT chr2 60554801 60554822 60554806 60554801 -
cccatccctctgtgcttttgca

SEQ ID NO: 210007 - DNA, 22 bp, Artificial Sequence
  Synthetic oligonucleotide; TTC chr2 60554800 60554821 60554805 60554800 -
ccatccctctgtgcttttgcag

SEQ ID NO: 210008 - DNA, 22 bp, Artificial Sequence
  Synthetic oligonucleotide; CTC chr2 60554791 60554812 60554796 60554791 -
tgtgcttttgcagttgctctgg

SEQ ID NO: 210009 - DNA, 22 bp, Artificial Sequence
  Synthetic oligonucleotide; CTG chr2 60554789 60554810 60554794 60554789 -
tgcttttgcagttgctctggag

SEQ ID NO: 210010 - DNA, 22 bp, Artificial Sequence
  Synthetic oligonucleotide; CTT chr2 60554784 60554805 60554789 60554784 -
ttgcagttgctctggagtggga

SEQ ID NO: 210011 - DNA, 22 bp, Artificial Sequence
  Synthetic oligonucleotide; TTT chr2 60554783 60554804 60554788 60554783 -
tgcagttgctctggagtgggag

SEQ ID NO: 210012 - DNA, 22 bp, Artificial Sequence
  Synthetic oligonucleotide; TTT chr2 60554782 60554803 60554787 60554782 -
gcagttgctctggagtgggagg

SEQ ID NO: 210013 - DNA, 22 bp, Artificial Sequence
  Synthetic oligonucleotide; TTG chr2 60554781 60554802 60554786 60554781 -
cagttgctctggagtgggaggg

SEQ ID NO: 210014 - DNA, 22 bp, Artificial Sequence
  Synthetic oligonucleotide; TTG chr2 60554775 60554796 60554780 60554775 -
ctctggagtgggagggggtgtg

SEQ ID NO: 210015 - DNA, 22 bp, Artificial Sequence
  Synthetic oligonucleotide; CTC chr2 60554772 60554793 60554777 60554772 -
tggagtgggagggggtgtgtcc

SEQ ID NO: 210016 - DNA, 22 bp, Artificial Sequence
  Synthetic oligonucleotide; CTG chr2 60554770 60554791 60554775 60554770 -
gagtgggagggggtgtgtccct

SEQ ID NO: 210017 - DNA, 22 bp, Artificial Sequence
  Synthetic oligonucleotide; CTC chr2 60554747 60554768 60554752 60554747 -
ccagggacccggctcggggacc

SEQ ID NO: 210018 - DNA, 22 bp, Artificial Sequence
  Synthetic oligonucleotide; CTC chr2 60554732 60554753 60554737 60554732 -
ggggacctcccgcggcgccgtg

SEQ ID NO: 210019 - DNA, 22 bp, Artificial Sequence
  Synthetic oligonucleotide; CTC chr2 60554723 60554744 60554728 60554723 -
ccgcggcgccgtgagcacattc

SEQ ID NO: 210020 - DNA, 22 bp, Artificial Sequence
  Synthetic oligonucleotide; TTC chr2 60554701 60554722 60554706 60554701 -
ccagggactgggactcccggga

SEQ ID NO: 210021 - DNA, 22 bp, Artificial Sequence
  Synthetic oligonucleotide; CTG chr2 60554691 60554712 60554696 60554691 -
ggactcccgggactgcccgcgc

SEQ ID NO: 210022 - DNA, 22 bp, Artificial Sequence
  Synthetic oligonucleotide; CTC chr2 60554685 60554706 60554690 60554685 -
ccgggactgcccgcgctttgtc

SEQ ID NO: 210023 - DNA, 22 bp, Artificial Sequence
  Synthetic oligonucleotide; CTG chr2 60554676 60554697 60554681 60554676 -
cccgcgctttgtcctcggcctc

SEQ ID NO: 210024 - DNA, 22 bp, Artificial Sequence
  Synthetic oligonucleotide; CTT chr2 60554667 60554688 60554672 60554667 -
tgtcctcggcctctcagagagg

SEQ ID NO: 210025 - DNA, 22 bp, Artificial Sequence
  Synthetic oligonucleotide; TTT chr2 60554666 60554687 60554671 60554666 -
gtcctcggcctctcagagaggt

SEQ ID NO: 210026 - DNA, 22 bp, Artificial Sequence
  Synthetic oligonucleotide; TTG chr2 60554665 60554686 60554670 60554665 -
tcctcggcctctcagagaggtg

SEQ ID NO: 210027 - DNA, 22 bp, Artificial Sequence
  Synthetic oligonucleotide; CTC chr2 60554660 60554681 60554665 60554660 -
ggcctctcagagaggtggacgc

SEQ ID NO: 210028 - DNA, 22 bp, Artificial Sequence
  Synthetic oligonucleotide; CTC chr2 60554654 60554675 60554659 60554654 -
tcagagaggtggacgcctcggt

SEQ ID NO: 210029 - DNA, 22 bp, Artificial Sequence
  Synthetic oligonucleotide; CTC chr2 60554652 60554673 60554657 60554652 -
agagaggtggacgcctcggtgc

SEQ ID NO: 210030 - DNA, 22 bp, Artificial Sequence
  Synthetic oligonucleotide; CTC chr2 60554635 60554656 60554640 60554635 -
ggtgcctctcttgcccaggccc

SEQ ID NO: 210031 - DNA, 22 bp, Artificial Sequence
  Synthetic oligonucleotide; CTC chr2 60554627 60554648 60554632 60554627 -
tcttgcccaggcccccggcgct

SEQ ID NO: 210032 - DNA, 22 bp, Artificial Sequence
  Synthetic oligonucleotide; CTC chr2 60554625 60554646 60554630 60554625 -
ttgcccaggcccccggcgctcc

SEQ ID NO: 210033 - DNA, 22 bp, Artificial Sequence
  Synthetic oligonucleotide; CTT chr2 60554623 60554644 60554628 60554623 -
gcccaggcccccggcgctcccc

SEQ ID NO: 210034 - DNA, 22 bp, Artificial Sequence
  Synthetic oligonucleotide; TTG chr2 60554622 60554643 60554627 60554622 -
cccaggcccccggcgctcccct

SEQ ID NO: 210035 - DNA, 22 bp, Artificial Sequence
  Synthetic oligonucleotide; CTC chr2 60554604 60554625 60554609 60554604 -
ccctccgggggccagactctgg

SEQ ID NO: 210036 - DNA, 22 bp, Artificial Sequence
  Synthetic oligonucleotide; CTC chr2 60554599 60554620 60554604 60554599 -
cgggggccagactctggctcct

SEQ ID NO: 210037 - DNA, 22 bp, Artificial Sequence
  Synthetic oligonucleotide; CTC chr2 60554585 60554606 60554590 60554585 -
tggctcctcgttctttattcct

SEQ ID NO: 210038 - DNA, 22 bp, Artificial Sequence
  Synthetic oligonucleotide; CTG chr2 60554583 60554604 60554588 60554583 -
gctcctcgttctttattcctcg

SEQ ID NO: 210039 - DNA, 22 bp, Artificial Sequence
  Synthetic oligonucleotide; CTC chr2 60554579 60554600 60554584 60554579 -
ctcgttctttattcctcgggct

SEQ ID NO: 210040 - DNA, 22 bp, Artificial Sequence
  Synthetic oligonucleotide; CTC chr2 60554576 60554597 60554581 60554576 -
gttctttattcctcgggctctc

SEQ ID NO: 210041 - DNA, 22 bp, Artificial Sequence
  Synthetic oligonucleotide; TTC chr2 60554572 60554593 60554577 60554572 -
tttattcctcgggctctctttc

SEQ ID NO: 210042 - DNA, 22 bp, Artificial Sequence
  Synthetic oligonucleotide; CTT chr2 60554570 60554591 60554575 60554570 -
tattcctcgggctctctttctg

SEQ ID NO: 210043 - DNA, 22 bp, Artificial Sequence
  Synthetic oligonucleotide; TTT chr2 60554569 60554590 60554574 60554569 -
attcctcgggctctctttctgc

SEQ ID NO: 210044 - DNA, 22 bp, Artificial Sequence
  Synthetic oligonucleotide; TTA chr2 60554568 60554589 60554573 60554568 -
ttcctcgggctctctttctgcg

SEQ ID NO: 210045 - DNA, 22 bp, Artificial Sequence
  Synthetic oligonucleotide; TTC chr2 60554565 60554586 60554570 60554565 -
ctcgggctctctttctgcgacc

SEQ ID NO: 210046 - DNA, 22 bp, Artificial Sequence
  Synthetic oligonucleotide; CTC chr2 60554562 60554583 60554567 60554562 -
gggctctctttctgcgaccctt

SEQ ID NO: 210047 - DNA, 22 bp, Artificial Sequence
  Synthetic oligonucleotide; CTC chr2 60554556 60554577 60554561 60554556 -
tctttctgcgacccttaggagc

SEQ ID NO: 210048 - DNA, 22 bp, Artificial Sequence
  Synthetic oligonucleotide; CTC chr2 60554554 60554575 60554559 60554554 -
tttctgcgacccttaggagccg

SEQ ID NO: 210049 - DNA, 22 bp, Artificial Sequence
  Synthetic oligonucleotide; CTT chr2 60554552 60554573 60554557 60554552 -
tctgcgacccttaggagccggg

SEQ ID NO: 210050 - DNA, 22 bp, Artificial Sequence
  Synthetic oligonucleotide; TTT chr2 60554551 60554572 60554556 60554551 -
ctgcgacccttaggagccgggg

SEQ ID NO: 210051 - DNA, 22 bp, Artificial Sequence
  Synthetic oligonucleotide; TTC chr2 60554550 60554571 60554555 60554550 -
tgcgacccttaggagccgggga

SEQ ID NO: 210052 - DNA, 22 bp, Artificial Sequence
  Synthetic oligonucleotide; CTG chr2 60554548 60554569 60554553 60554548 -
cgacccttaggagccggggact

SEQ ID NO: 210053 - DNA, 22 bp, Artificial Sequence
  Synthetic oligonucleotide; CTT chr2 60554540 60554561 60554545 60554540 -
aggagccggggactcggcgctt

SEQ ID NO: 210054 - DNA, 22 bp, Artificial Sequence
  Synthetic oligonucleotide; TTA chr2 60554539 60554560 60554544 60554539 -
ggagccggggactcggcgcttt

SEQ ID NO: 210055 - DNA, 22 bp, Artificial Sequence
  Synthetic oligonucleotide; CTC chr2 60554525 60554546 60554530 60554525 -
ggcgctttcagttgcattcaga

SEQ ID NO: 210056 - DNA, 22 bp, Artificial Sequence
  Synthetic oligonucleotide; CTT chr2 60554518 60554539 60554523 60554518 -
tcagttgcattcagacccagtc

SEQ ID NO: 210057 - DNA, 22 bp, Artificial Sequence
  Synthetic oligonucleotide; TTT chr2 60554517 60554538 60554522 60554517 -
cagttgcattcagacccagtcg

SEQ ID NO: 210058 - DNA, 22 bp, Artificial Sequence
  Synthetic oligonucleotide; TTC chr2 60554516 60554537 60554521 60554516 -
agttgcattcagacccagtcgc

SEQ ID NO: 210059 - DNA, 22 bp, Artificial Sequence
  Synthetic oligonucleotide; TTG chr2 60554511 60554532 60554516 60554511 -
cattcagacccagtcgcttggc

SEQ ID NO: 210060 - DNA, 22 bp, Artificial Sequence
  Synthetic oligonucleotide; TTC chr2 60554506 60554527 60554511 60554506 -
agacccagtcgcttggcggggc

SEQ ID NO: 210061 - DNA, 22 bp, Artificial Sequence
  Synthetic oligonucleotide; CTT chr2 60554492 60554513 60554497 60554492 -
ggcggggcgctcagattcccgg

SEQ ID NO: 210062 - DNA, 22 bp, Artificial Sequence
  Synthetic oligonucleotide; TTG chr2 60554491 60554512 60554496 60554491 -
gcggggcgctcagattcccggt

SEQ ID NO: 210063 - DNA, 22 bp, Artificial Sequence
  Synthetic oligonucleotide; CTC chr2 60554480 60554501 60554485 60554480 -
agattcccggtccctggctcgg

SEQ ID NO: 210064 - DNA, 22 bp, Artificial Sequence
  Synthetic oligonucleotide; TTC chr2 60554474 60554495 60554479 60554474 -
ccggtccctggctcggccttgg

SEQ ID NO: 210065 - DNA, 22 bp, Artificial Sequence
  Synthetic oligonucleotide; CTG chr2 60554464 60554485 60554469 60554464 -
gctcggccttgggggcgccctc

SEQ ID NO: 210066 - DNA, 22 bp, Artificial Sequence
  Synthetic oligonucleotide; CTC chr2 60554460 60554481 60554465 60554460 -
ggccttgggggcgccctcgggc

SEQ ID NO: 210067 - DNA, 22 bp, Artificial Sequence
  Synthetic oligonucleotide; CTT chr2 60554454 60554475 60554459 60554454 -
gggggcgccctcgggccccggc

SEQ ID NO: 210068 - DNA, 22 bp, Artificial Sequence
  Synthetic oligonucleotide; TTG chr2 60554453 60554474 60554458 60554453 -
ggggcgccctcgggccccggcc

SEQ ID NO: 210069 - DNA, 22 bp, Artificial Sequence
  Synthetic oligonucleotide; CTC chr2 60554442 60554463 60554447 60554442 -
gggccccggcctgcgccgcctg

SEQ ID NO: 210070 - DNA, 22 bp, Artificial Sequence
  Synthetic oligonucleotide; CTG chr2 60554429 60554450 60554434 60554429 -
cgccgcctgcctctccccggtc

SEQ ID NO: 210071 - DNA, 22 bp, Artificial Sequence
  Synthetic oligonucleotide; CTG chr2 60554420 60554441 60554425 60554420 -
cctctccccggtcccctctttc

SEQ ID NO: 210072 - DNA, 22 bp, Artificial Sequence
  Synthetic oligonucleotide; CTC chr2 60554416 60554437 60554421 60554416 -
tccccggtcccctctttccagg

SEQ ID NO: 210073 - DNA, 22 bp, Artificial Sequence
  Synthetic oligonucleotide; CTC chr2 60554414 60554435 60554419 60554414 -
cccggtcccctctttccaggcc

SEQ ID NO: 210074 - DNA, 22 bp, Artificial Sequence
  Synthetic oligonucleotide; CTC chr2 60554402 60554423 60554407 60554402 -
tttccaggccgcgcgggctcct

SEQ ID NO: 210075 - DNA, 22 bp, Artificial Sequence
  Synthetic oligonucleotide; CTT chr2 60554400 60554421 60554405 60554400 -
tccaggccgcgcgggctcctgg

SEQ ID NO: 210076 - DNA, 22 bp, Artificial Sequence
  Synthetic oligonucleotide; TTT chr2 60554399 60554420 60554404 60554399 -
ccaggccgcgcgggctcctgga

SEQ ID NO: 210077 - DNA, 22 bp, Artificial Sequence
  Synthetic oligonucleotide; TTC chr2 60554398 60554419 60554403 60554398 -
caggccgcgcgggctcctggag

SEQ ID NO: 210078 - DNA, 22 bp, Artificial Sequence
  Synthetic oligonucleotide; CTC chr2 60554382 60554403 60554387 60554382 -
ctggagacttgggcgctgccct

SEQ ID NO: 210079 - DNA, 22 bp, Artificial Sequence
  Synthetic oligonucleotide; CTG chr2 60554379 60554400 60554384 60554379 -
gagacttgggcgctgcccttcc

SEQ ID NO: 210080 - DNA, 22 bp, Artificial Sequence
  Synthetic oligonucleotide; CTT chr2 60554372 60554393 60554377 60554372 -
gggcgctgcccttccggacccg

SEQ ID NO: 210081 - DNA, 22 bp, Artificial Sequence
  Synthetic oligonucleotide; TTG chr2 60554371 60554392 60554376 60554371 -
ggcgctgcccttccggacccgc

SEQ ID NO: 210082 - DNA, 22 bp, Artificial Sequence
  Synthetic oligonucleotide; CTG chr2 60554364 60554385 60554369 60554364 -
cccttccggacccgcagccctc

SEQ ID NO: 210083 - DNA, 22 bp, Artificial Sequence
  Synthetic oligonucleotide; CTT chr2 60554359 60554380 60554364 60554359 -
ccggacccgcagccctccaaac

SEQ ID NO: 210084 - DNA, 22 bp, Artificial Sequence
  Synthetic oligonucleotide; TTC chr2 60554358 60554379 60554363 60554358 -
cggacccgcagccctccaaact

SEQ ID NO: 210085 - DNA, 22 bp, Artificial Sequence
  Synthetic oligonucleotide; CTC chr2 60554342 60554363 60554347 60554342 -
caaacttaggctggattccgcg

SEQ ID NO: 210086 - DNA, 22 bp, Artificial Sequence
  Synthetic oligonucleotide; CTT chr2 60554335 60554356 60554340 60554335 -
aggctggattccgcgttgccgt

SEQ ID NO: 210087 - DNA, 22 bp, Artificial Sequence
  Synthetic oligonucleotide; TTA chr2 60554334 60554355 60554339 60554334 -
ggctggattccgcgttgccgtg

SEQ ID NO: 210088 - DNA, 22 bp, Artificial Sequence
  Synthetic oligonucleotide; CTG chr2 60554329 60554350 60554334 60554329 -
gattccgcgttgccgtgcgctc

SEQ ID NO: 210089 - DNA, 22 bp, Artificial Sequence
  Synthetic oligonucleotide; TTC chr2 60554324 60554345 60554329 60554324 -
cgcgttgccgtgcgctccctcc

SEQ ID NO: 210090 - DNA, 22 bp, Artificial Sequence
  Synthetic oligonucleotide; TTG chr2 60554317 60554338 60554322 60554317 -
ccgtgcgctccctcccacctcc

SEQ ID NO: 210091 - DNA, 22 bp, Artificial Sequence
  Synthetic oligonucleotide; CTC chr2 60554307 60554328 60554312 60554307 -
cctcccacctcccctcgcccgc

SEQ ID NO: 210092 - DNA, 22 bp, Artificial Sequence
  Synthetic oligonucleotide; CTC chr2 60554303 60554324 60554308 60554303 -
ccacctcccctcgcccgctgcg

SEQ ID NO: 210093 - DNA, 22 bp, Artificial Sequence
  Synthetic oligonucleotide; CTC chr2 60554296 60554317 60554301 60554296 -
ccctcgcccgctgcggagctgt

SEQ ID NO: 210094 - DNA, 22 bp, Artificial Sequence
  Synthetic oligonucleotide; CTC chr2 60554291 60554312 60554296 60554291 -
gcccgctgcggagctgtaactt

SEQ ID NO: 210095 - DNA, 22 bp, Artificial Sequence
  Synthetic oligonucleotide; CTG chr2 60554283 60554304 60554288 60554283 -
cggagctgtaacttggaggctc

SEQ ID NO: 210096 - DNA, 22 bp, Artificial Sequence
  Synthetic oligonucleotide; CTG chr2 60554275 60554296 60554280 60554275 -
taacttggaggctcagctctca

SEQ ID NO: 210097 - DNA, 22 bp, Artificial Sequence
  Synthetic oligonucleotide; CTT chr2 60554269 60554290 60554274 60554269 -
ggaggctcagctctcaacttcg

SEQ ID NO: 210098 - DNA, 22 bp, Artificial Sequence
  Synthetic oligonucleotide; TTG chr2 60554268 60554289 60554273 60554268 -
gaggctcagctctcaacttcgg

SEQ ID NO: 210099 - DNA, 22 bp, Artificial Sequence
  Synthetic oligonucleotide; CTC chr2 60554261 60554282 60554266 60554261 -
agctctcaacttcgggtgattt

SEQ ID NO: 210100 - DNA, 22 bp, Artificial Sequence
  Synthetic oligonucleotide; CTC chr2 60554256 60554277 60554261 60554256 -
tcaacttcgggtgatttttctt

SEQ ID NO: 210101 - DNA, 22 bp, Artificial Sequence
  Synthetic oligonucleotide; CTC chr2 60554254 60554275 60554259 60554254 -
aacttcgggtgatttttctttg

SEQ ID NO: 210102 - DNA, 22 bp, Artificial Sequence
  Synthetic oligonucleotide; CTT chr2 60554249 60554270 60554254 60554249 -
cgggtgatttttctttgctgtc

SEQ ID NO: 210103 - DNA, 22 bp, Artificial Sequence
  Synthetic oligonucleotide; TTC chr2 60554248 60554269 60554253 60554248 -
gggtgatttttctttgctgtcc

SEQ ID NO: 210104 - DNA, 22 bp, Artificial Sequence
  Synthetic oligonucleotide; TTT chr2 60554239 60554260 60554244 60554239 -
ttctttgctgtcctctcctcgg

SEQ ID NO: 210105 - DNA, 22 bp, Artificial Sequence
  Synthetic oligonucleotide; TTT chr2 60554238 60554259 60554243 60554238 -
tctttgctgtcctctcctcggg

SEQ ID NO: 210106 - DNA, 22 bp, Artificial Sequence
  Synthetic oligonucleotide; TTT chr2 60554237 60554258 60554242 60554237 -
ctttgctgtcctctcctcgggc

SEQ ID NO: 210107 - DNA, 22 bp, Artificial Sequence
  Synthetic oligonucleotide; TTC chr2 60554236 60554257 60554241 60554236 -
tttgctgtcctctcctcgggca

SEQ ID NO: 210108 - DNA, 22 bp, Artificial Sequence
  Synthetic oligonucleotide; CTT chr2 60554234 60554255 60554239 60554234 -
tgctgtcctctcctcgggcaaa

SEQ ID NO: 210109 - DNA, 22 bp, Artificial Sequence
  Synthetic oligonucleotide; TTT chr2 60554233 60554254 60554238 60554233 -
gctgtcctctcctcgggcaaag

SEQ ID NO: 210110 - DNA, 22 bp, Artificial Sequence
  Synthetic oligonucleotide; TTG chr2 60554232 60554253 60554237 60554232 -
ctgtcctctcctcgggcaaagt

SEQ ID NO: 210111 - DNA, 22 bp, Artificial Sequence
  Synthetic oligonucleotide; CTG chr2 60554229 60554250 60554234 60554229 -
tcctctcctcgggcaaagtttc

SEQ ID NO: 210112 - DNA, 22 bp, Artificial Sequence
  Synthetic oligonucleotide; CTC chr2 60554224 60554245 60554229 60554224 -
tcctcgggcaaagtttcccgag

SEQ ID NO: 210113 - DNA, 22 bp, Artificial Sequence
  Synthetic oligonucleotide; CTC chr2 60554222 60554243 60554227 60554222 -
ctcgggcaaagtttcccgagcg

SEQ ID NO: 210114 - DNA, 22 bp, Artificial Sequence
  Synthetic oligonucleotide; CTC chr2 60554219 60554240 60554224 60554219 -
gggcaaagtttcccgagcgcag

SEQ ID NO: 210115 - DNA, 22 bp, Artificial Sequence
  Synthetic oligonucleotide; TTT chr2 60554208 60554229 60554213 60554208 -
cccgagcgcagccgcgggctcg

SEQ ID NO: 210116 - DNA, 22 bp, Artificial Sequence
  Synthetic oligonucleotide; TTC chr2 60554207 60554228 60554212 60554207 -
ccgagcgcagccgcgggctcgg

SEQ ID NO: 210117 - DNA, 22 bp, Artificial Sequence
  Synthetic oligonucleotide; CTC chr2 60554187 60554208 60554192 60554187 -
ggggcttttacttcggcccctg

SEQ ID NO: 210118 - DNA, 22 bp, Artificial Sequence
  Synthetic oligonucleotide; CTT chr2 60554180 60554201 60554185 60554180 -
ttacttcggcccctggcgtcca

SEQ ID NO: 210119 - DNA, 22 bp, Artificial Sequence
  Synthetic oligonucleotide; TTT chr2 60554179 60554200 60554184 60554179 -
tacttcggcccctggcgtccac

SEQ ID NO: 210120 - DNA, 22 bp, Artificial Sequence
  Synthetic oligonucleotide; TTT chr2 60554178 60554199 60554183 60554178 -
acttcggcccctggcgtccaca

SEQ ID NO: 210121 - DNA, 22 bp, Artificial Sequence
  Synthetic oligonucleotide; TTA chr2 60554177 60554198 60554182 60554177 -
cttcggcccctggcgtccacac

SEQ ID NO: 210122 - DNA, 22 bp, Artificial Sequence
  Synthetic oligonucleotide; CTT chr2 60554174 60554195 60554179 60554174 -
cggcccctggcgtccacacgcg

SEQ ID NO: 210123 - DNA, 22 bp, Artificial Sequence
  Synthetic oligonucleotide; TTC chr2 60554173 60554194 60554178 60554173 -
ggcccctggcgtccacacgcgg

SEQ ID NO: 210124 - DNA, 22 bp, Artificial Sequence
  Synthetic oligonucleotide; CTG chr2 60554165 60554186 60554170 60554165 -
gcgtccacacgcggggagcgag

SEQ ID NO: 210125 - DNA, 22 bp, Artificial Sequence
  Synthetic oligonucleotide; CTC chr2 60554081 60554102 60554086 60554081 -
tacctggcttccctccgcccgc

SEQ ID NO: 210126 - DNA, 22 bp, Artificial Sequence
  Synthetic oligonucleotide; CTA chr2 60554079 60554100 60554084 60554079 -
cctggcttccctccgcccgcgc

SEQ ID NO: 210127 - DNA, 22 bp, Artificial Sequence
  Synthetic oligonucleotide; CTG chr2 60554075 60554096 60554080 60554075 -
gcttccctccgcccgcgcttcc

SEQ ID NO: 210128 - DNA, 22 bp, Artificial Sequence
  Synthetic oligonucleotide; CTT chr2 60554071 60554092 60554076 60554071 -
ccctccgcccgcgcttccccag

SEQ ID NO: 210129 - DNA, 22 bp, Artificial Sequence
  Synthetic oligonucleotide; TTC chr2 60554070 60554091 60554075 60554070 -
cctccgcccgcgcttccccagc

SEQ ID NO: 210130 - DNA, 22 bp, Artificial Sequence
  Synthetic oligonucleotide; CTC chr2 60554066 60554087 60554071 60554066 -
cgcccgcgcttccccagcccgg

SEQ ID NO: 210131 - DNA, 22 bp, Artificial Sequence
  Synthetic oligonucleotide; CTT chr2 60554055 60554076 60554060 60554055 -
ccccagcccggggctgcagcct

SEQ ID NO: 210132 - DNA, 22 bp, Artificial Sequence
  Synthetic oligonucleotide; TTC chr2 60554054 60554075 60554059 60554054 -
cccagcccggggctgcagcctc

SEQ ID NO: 210133 - DNA, 22 bp, Artificial Sequence
  Synthetic oligonucleotide; CTG chr2 60554039 60554060 60554044 60554039 -
cagcctcccggtgcactctcgc

SEQ ID NO: 210134 - DNA, 22 bp, Artificial Sequence
  Synthetic oligonucleotide; CTC chr2 60554032 60554053 60554037 60554032 -
ccggtgcactctcgctctattt

SEQ ID NO: 210135 - DNA, 22 bp, Artificial Sequence
  Synthetic oligonucleotide; CTC chr2 60554021 60554042 60554026 60554021 -
tcgctctatttttttctttttt

SEQ ID NO: 210136 - DNA, 22 bp, Artificial Sequence
  Synthetic oligonucleotide; CTC chr2 60554019 60554040 60554024 60554019 -
gctctatttttttcttttttga

SEQ ID NO: 210137 - DNA, 22 bp, Artificial Sequence
  Synthetic oligonucleotide; CTC chr2 60554015 60554036 60554020 60554015 -
tatttttttcttttttgaataa

SEQ ID NO: 210138 - DNA, 22 bp, Artificial Sequence
  Synthetic oligonucleotide; CTA chr2 60554013 60554034 60554018 60554013 -
tttttttcttttttgaataatc

SEQ ID NO: 210139 - DNA, 22 bp, Artificial Sequence
  Synthetic oligonucleotide; TTT chr2 60554010 60554031 60554015 60554010 -
ttttcttttttgaataatcttt

SEQ ID NO: 210140 - DNA, 22 bp, Artificial Sequence
  Synthetic oligonucleotide; TTT chr2 60554009 60554030 60554014 60554009 -
tttcttttttgaataatctttc

SEQ ID NO: 210141 - DNA, 22 bp, Artificial Sequence
  Synthetic oligonucleotide; TTT chr2 60554008 60554029 60554013 60554008 -
ttcttttttgaataatctttca

SEQ ID NO: 210142 - DNA, 22 bp, Artificial Sequence
  Synthetic oligonucleotide; TTT chr2 60554007 60554028 60554012 60554007 -
tcttttttgaataatctttcat

SEQ ID NO: 210143 - DNA, 22 bp, Artificial Sequence
  Synthetic oligonucleotide; TTT chr2 60554006 60554027 60554011 60554006 -
cttttttgaataatctttcatt

SEQ ID NO: 210144 - DNA, 22 bp, Artificial Sequence
  Synthetic oligonucleotide; TTC chr2 60554005 60554026 60554010 60554005 -
ttttttgaataatctttcattt

SEQ ID NO: 210145 - DNA, 22 bp, Artificial Sequence
  Synthetic oligonucleotide; CTT chr2 60554003 60554024 60554008 60554003 -
ttttgaataatctttcatttta

SEQ ID NO: 210146 - DNA, 22 bp, Artificial Sequence
  Synthetic oligonucleotide; TTT chr2 60554002 60554023 60554007 60554002 -
tttgaataatctttcattttag

SEQ ID NO: 210147 - DNA, 22 bp, Artificial Sequence
  Synthetic oligonucleotide; TTT chr2 60554001 60554022 60554006 60554001 -
ttgaataatctttcattttaga

SEQ ID NO: 210148 - DNA, 22 bp, Artificial Sequence
  Synthetic oligonucleotide; TTT chr2 60554000 60554021 60554005 60554000 -
tgaataatctttcattttagag

SEQ ID NO: 210149 - DNA, 22 bp, Artificial Sequence
  Synthetic oligonucleotide; TTT chr2 60553999 60554020 60554004 60553999 -
gaataatctttcattttagagt

SEQ ID NO: 210150 - DNA, 22 bp, Artificial Sequence
  Synthetic oligonucleotide; TTG chr2 60553998 60554019 60554003 60553998 -
aataatctttcattttagagtc

SEQ ID NO: 210151 - DNA, 22 bp, Artificial Sequence
  Synthetic oligonucleotide; CTT chr2 60553989 60554010 60553994 60553989 -
tcattttagagtccgcgtgtgt

SEQ ID NO: 210152 - DNA, 22 bp, Artificial Sequence
  Synthetic oligonucleotide; TTT chr2 60553988 60554009 60553993 60553988 -
cattttagagtccgcgtgtgtg

SEQ ID NO: 210153 - DNA, 22 bp, Artificial Sequence
  Synthetic oligonucleotide; TTC chr2 60553987 60554008 60553992 60553987 -
attttagagtccgcgtgtgtgg

SEQ ID NO: 210154 - DNA, 22 bp, Artificial Sequence
  Synthetic oligonucleotide; TTT chr2 60553983 60554004 60553988 60553983 -
tagagtccgcgtgtgtgggggg

SEQ ID NO: 210155 - DNA, 22 bp, Artificial Sequence
  Synthetic oligonucleotide; TTT chr2 60553982 60554003 60553987 60553982 -
agagtccgcgtgtgtggggggg

SEQ ID NO: 210156 - DNA, 22 bp, Artificial Sequence
  Synthetic oligonucleotide; TTA chr2 60553981 60554002 60553986 60553981 -
gagtccgcgtgtgtggggggga

SEQ ID NO: 210157 - DNA, 22 bp, Artificial Sequence
  Synthetic oligonucleotide; CTT chr2 60553943 60553964 60553948 60553943 -
gctcccccccaccctttcctcc

SEQ ID NO: 210158 - DNA, 22 bp, Artificial Sequence
  Synthetic oligonucleotide; TTG chr2 60553942 60553963 60553947 60553942 -
ctcccccccaccctttcctccc

SEQ ID NO: 210159 - DNA, 22 bp, Artificial Sequence
  Synthetic oligonucleotide; CTC chr2 60553939 60553960 60553944 60553939 -
ccccccaccctttcctcccacc

SEQ ID NO: 210160 - DNA, 22 bp, Artificial Sequence
  Synthetic oligonucleotide; CTT chr2 60553927 60553948 60553932 60553927 -
tcctcccacccctgccacccct

SEQ ID NO: 210161 - DNA, 22 bp, Artificial Sequence
  Synthetic oligonucleotide; TTT chr2 60553926 60553947 60553931 60553926 -
cctcccacccctgccacccctt

SEQ ID NO: 210162 - DNA, 22 bp, Artificial Sequence
  Synthetic oligonucleotide; TTC chr2 60553925 60553946 60553930 60553925 -
ctcccacccctgccaccccttt

SEQ ID NO: 210163 - DNA, 22 bp, Artificial Sequence
  Synthetic oligonucleotide; CTC chr2 60553922 60553943 60553927 60553922 -
ccacccctgccacccctttctt

SEQ ID NO: 210164 - DNA, 22 bp, Artificial Sequence
  Synthetic oligonucleotide; CTG chr2 60553913 60553934 60553918 60553913 -
ccacccctttcttctctcccgg

SEQ ID NO: 210165 - DNA, 22 bp, Artificial Sequence
  Synthetic oligonucleotide; CTT chr2 60553904 60553925 60553909 60553904 -
tcttctctcccggccacgccac

SEQ ID NO: 210166 - DNA, 22 bp, Artificial Sequence
  Synthetic oligonucleotide; TTT chr2 60553903 60553924 60553908 60553903 -
cttctctcccggccacgccacc

SEQ ID NO: 210167 - DNA, 22 bp, Artificial Sequence
  Synthetic oligonucleotide; TTC chr2 60553902 60553923 60553907 60553902 -
ttctctcccggccacgccaccg

SEQ ID NO: 210168 - DNA, 22 bp, Artificial Sequence
  Synthetic oligonucleotide; CTT chr2 60553900 60553921 60553905 60553900 -
ctctcccggccacgccaccgcc

SEQ ID NO: 210169 - DNA, 22 bp, Artificial Sequence
  Synthetic oligonucleotide; TTC chr2 60553899 60553920 60553904 60553899 -
tctcccggccacgccaccgccg

SEQ ID NO: 210170 - DNA, 22 bp, Artificial Sequence
  Synthetic oligonucleotide; CTC chr2 60553897 60553918 60553902 60553897 -
tcccggccacgccaccgccgcg

SEQ ID NO: 210171 - DNA, 22 bp, Artificial Sequence
  Synthetic oligonucleotide; CTC chr2 60553895 60553916 60553900 60553895 -
ccggccacgccaccgccgcggc

SEQ ID NO: 210172 - DNA, 22 bp, Artificial Sequence
  Synthetic oligonucleotide; CTC chr2 60553869 60553890 60553874 60553869 -
gctgcggccactggtgagcccg

SEQ ID NO: 210173 - DNA, 22 bp, Artificial Sequence
  Synthetic oligonucleotide; CTG chr2 60553865 60553886 60553870 60553865 -
cggccactggtgagcccgcggc

SEQ ID NO: 210174 - DNA, 22 bp, Artificial Sequence
  Synthetic oligonucleotide; CTG chr2 60553856 60553877 60553861 60553856 -
gtgagcccgcggccccagcgcc

SEQ ID NO: 210175 - DNA, 22 bp, Artificial Sequence
  Synthetic oligonucleotide; CTC chr2 60553829 60553850 60553834 60553829 -
ccctcggcccgcccctcccccg

SEQ ID NO: 210176 - DNA, 22 bp, Artificial Sequence
  Synthetic oligonucleotide; CTC chr2 60553824 60553845 60553829 60553824 -
ggcccgcccctcccccgggggc

SEQ ID NO: 210177 - DNA, 22 bp, Artificial Sequence
  Synthetic oligonucleotide; CTC chr2 60553812 60553833 60553817 60553812 -
ccccgggggccgcgtctggcgt

SEQ ID NO: 210178 - DNA, 22 bp, Artificial Sequence
  Synthetic oligonucleotide; CTG chr2 60553794 60553815 60553799 60553794 -
gcgtccgcggagccccccgccc

SEQ ID NO: 210179 - DNA, 22 bp, Artificial Sequence
  Synthetic oligonucleotide; CTC chr2 60553764 60553785 60553769 60553764 -
cccctccccgcactggccattg

SEQ ID NO: 210180 - DNA, 22 bp, Artificial Sequence
  Synthetic oligonucleotide; CTC chr2 60553758 60553779 60553763 60553758 -
cccgcactggccattggcttgt

SEQ ID NO: 210181 - DNA, 22 bp, Artificial Sequence
  Synthetic oligonucleotide; CTG chr2 60553749 60553770 60553754 60553749 -
gccattggcttgtcctggtctc

SEQ ID NO: 210182 - DNA, 22 bp, Artificial Sequence
  Synthetic oligonucleotide; TTG chr2 60553742 60553763 60553747 60553742 -
gcttgtcctggtctctttttca

SEQ ID NO: 210183 - DNA, 22 bp, Artificial Sequence
  Synthetic oligonucleotide; CTT chr2 60553738 60553759 60553743 60553738 -
gtcctggtctctttttcatgtc

SEQ ID NO: 210184 - DNA, 22 bp, Artificial Sequence
  Synthetic oligonucleotide; TTG chr2 60553737 60553758 60553742 60553737 -
tcctggtctctttttcatgtcc

SEQ ID NO: 210185 - DNA, 22 bp, Artificial Sequence
  Synthetic oligonucleotide; CTG chr2 60553732 60553753 60553737 60553732 -
gtctctttttcatgtccagccc

SEQ ID NO: 210186 - DNA, 22 bp, Artificial Sequence
  Synthetic oligonucleotide; CTC chr2 60553727 60553748 60553732 60553727 -
tttttcatgtccagcccctgat

SEQ ID NO: 210187 - DNA, 22 bp, Artificial Sequence
  Synthetic oligonucleotide; CTT chr2 60553725 60553746 60553730 60553725 -
tttcatgtccagcccctgatgt

SEQ ID NO: 210188 - DNA, 22 bp, Artificial Sequence
  Synthetic oligonucleotide; TTT chr2 60553724 60553745 60553729 60553724 -
ttcatgtccagcccctgatgtg

SEQ ID NO: 210189 - DNA, 22 bp, Artificial Sequence
  Synthetic oligonucleotide; TTT chr2 60553723 60553744 60553728 60553723 -
tcatgtccagcccctgatgtgt

SEQ ID NO: 210190 - DNA, 22 bp, Artificial Sequence
  Synthetic oligonucleotide; TTT chr2 60553722 60553743 60553727 60553722 -
catgtccagcccctgatgtgtg

SEQ ID NO: 210191 - DNA, 22 bp, Artificial Sequence
  Synthetic oligonucleotide; TTC chr2 60553721 60553742 60553726 60553721 -
atgtccagcccctgatgtgtgt

SEQ ID NO: 210192 - DNA, 22 bp, Artificial Sequence
  Synthetic oligonucleotide; CTG chr2 60553707 60553728 60553712 60553707 -
atgtgtgtccattggtgtgagc

SEQ ID NO: 210193 - DNA, 22 bp, Artificial Sequence
  Synthetic oligonucleotide; TTG chr2 60553693 60553714 60553698 60553693 -
gtgtgagcttccccttccctcc

SEQ ID NO: 210194 - DNA, 22 bp, Artificial Sequence
  Synthetic oligonucleotide; CTT chr2 60553683 60553704 60553688 60553683 -
ccccttccctcctccccttctc

SEQ ID NO: 210195 - DNA, 22 bp, Artificial Sequence
  Synthetic oligonucleotide; TTC chr2 60553682 60553703 60553687 60553682 -
cccttccctcctccccttctct

SEQ ID NO: 210196 - DNA, 22 bp, Artificial Sequence
  Synthetic oligonucleotide; CTT chr2 60553677 60553698 60553682 60553677 -
ccctcctccccttctctcctgc

SEQ ID NO: 210197 - DNA, 22 bp, Artificial Sequence
  Synthetic oligonucleotide; TTC chr2 60553676 60553697 60553681 60553676 -
cctcctccccttctctcctgct

SEQ ID NO: 210198 - DNA, 22 bp, Artificial Sequence
  Synthetic oligonucleotide; CTC chr2 60553672 60553693 60553677 60553672 -
ctccccttctctcctgctcgcc

SEQ ID NO: 210199 - DNA, 22 bp, Artificial Sequence
  Synthetic oligonucleotide; CTC chr2 60553669 60553690 60553674 60553669 -
cccttctctcctgctcgccctg

SEQ ID NO: 210200 - DNA, 22 bp, Artificial Sequence
  Synthetic oligonucleotide; CTT chr2 60553664 60553685 60553669 60553664 -
ctctcctgctcgccctgcccat

SEQ ID NO: 210201 - DNA, 22 bp, Artificial Sequence
  Synthetic oligonucleotide; TTC chr2 60553663 60553684 60553668 60553663 -
tctcctgctcgccctgcccatg

SEQ ID NO: 210202 - DNA, 22 bp, Artificial Sequence
  Synthetic oligonucleotide; CTC chr2 60553661 60553682 60553666 60553661 -
tcctgctcgccctgcccatgtt

SEQ ID NO: 210203 - DNA, 22 bp, Artificial Sequence
  Synthetic oligonucleotide; CTC chr2 60553659 60553680 60553664 60553659 -
ctgctcgccctgcccatgtttt

SEQ ID NO: 210204 - DNA, 22 bp, Artificial Sequence
  Synthetic oligonucleotide; CTG chr2 60553656 60553677 60553661 60553656 -
ctcgccctgcccatgttttgtg

SEQ ID NO: 210205 - DNA, 22 bp, Artificial Sequence
  Synthetic oligonucleotide; CTC chr2 60553653 60553674 60553658 60553653 -
gccctgcccatgttttgtgtgt

SEQ ID NO: 210206 - DNA, 22 bp, Artificial Sequence
  Synthetic oligonucleotide; CTG chr2 60553647 60553668 60553652 60553647 -
cccatgttttgtgtgtctctgt

SEQ ID NO: 210207 - DNA, 22 bp, Artificial Sequence
  Synthetic oligonucleotide; TTT chr2 60553638 60553659 60553643 60553638 -
tgtgtgtctctgtccatccaga

SEQ ID NO: 210208 - DNA, 22 bp, Artificial Sequence
  Synthetic oligonucleotide; TTT chr2 60553637 60553658 60553642 60553637 -
gtgtgtctctgtccatccagac

SEQ ID NO: 210209 - DNA, 22 bp, Artificial Sequence
  Synthetic oligonucleotide; TTG chr2 60553636 60553657 60553641 60553636 -
tgtgtctctgtccatccagact

SEQ ID NO: 210210 - DNA, 22 bp, Artificial Sequence
  Synthetic oligonucleotide; CTC chr2 60553628 60553649 60553633 60553628 -
tgtccatccagactcctgacgt

SEQ ID NO: 210211 - DNA, 22 bp, Artificial Sequence
  Synthetic oligonucleotide; CTG chr2 60553626 60553647 60553631 60553626 -
tccatccagactcctgacgttc

SEQ ID NO: 210212 - DNA, 22 bp, Artificial Sequence
  Synthetic oligonucleotide; CTC chr2 60553613 60553634 60553618 60553613 -
ctgacgttcaagttcgcaggga

SEQ ID NO: 210213 - DNA, 22 bp, Artificial Sequence
  Synthetic oligonucleotide; CTG chr2 60553610 60553631 60553615 60553610 -
acgttcaagttcgcagggacgt

SEQ ID NO: 210214 - DNA, 22 bp, Artificial Sequence
  Synthetic oligonucleotide; TTC chr2 60553604 60553625 60553609 60553604 -
aagttcgcagggacgtcacgtc

SEQ ID NO: 210215 - DNA, 22 bp, Artificial Sequence
  Synthetic oligonucleotide; TTC chr2 60553598 60553619 60553603 60553598 -
gcagggacgtcacgtccgcact

SEQ ID NO: 210216 - DNA, 22 bp, Artificial Sequence
  Synthetic oligonucleotide; CTT chr2 60553575 60553596 60553580 60553575 -
gaacttgcagctcaggggggct

SEQ ID NO: 210217 - DNA, 22 bp, Artificial Sequence
  Synthetic oligonucleotide; TTG chr2 60553574 60553595 60553579 60553574 -
aacttgcagctcaggggggctt

SEQ ID NO: 210218 - DNA, 22 bp, Artificial Sequence
  Synthetic oligonucleotide; CTT chr2 60553569 60553590 60553574 60553569 -
gcagctcaggggggcttttgcc

SEQ ID NO: 210219 - DNA, 22 bp, Artificial Sequence
  Synthetic oligonucleotide; TTG chr2 60553568 60553589 60553573 60553568 -
cagctcaggggggcttttgcca

SEQ ID NO: 210220 - DNA, 22 bp, Artificial Sequence
  Synthetic oligonucleotide; CTC chr2 60553562 60553583 60553567 60553562 -
aggggggcttttgccatttttt

SEQ ID NO: 210221 - DNA, 22 bp, Artificial Sequence
  Synthetic oligonucleotide; CTT chr2 60553552 60553573 60553557 60553552 -
ttgccatttttttcatctctct

SEQ ID NO: 210222 - DNA, 22 bp, Artificial Sequence
  Synthetic oligonucleotide; TTT chr2 60553551 60553572 60553556 60553551 -
tgccatttttttcatctctctc

SEQ ID NO: 210223 - DNA, 22 bp, Artificial Sequence
  Synthetic oligonucleotide; TTT chr2 60553550 60553571 60553555 60553550 -
gccatttttttcatctctctct

SEQ ID NO: 210224 - DNA, 22 bp, Artificial Sequence
  Synthetic oligonucleotide; TTG chr2 60553549 60553570 60553554 60553549 -
ccatttttttcatctctctctc

SEQ ID NO: 210225 - DNA, 22 bp, Artificial Sequence
  Synthetic oligonucleotide; TTT chr2 60553543 60553564 60553548 60553543 -
ttttcatctctctctctctctc

SEQ ID NO: 210226 - DNA, 22 bp, Artificial Sequence
  Synthetic oligonucleotide; TTT chr2 60553542 60553563 60553547 60553542 -
tttcatctctctctctctctct

SEQ ID NO: 210227 - DNA, 22 bp, Artificial Sequence
  Synthetic oligonucleotide; TTT chr2 60553541 60553562 60553546 60553541 -
ttcatctctctctctctctctc

SEQ ID NO: 210228 - DNA, 22 bp, Artificial Sequence
  Synthetic oligonucleotide; TTT chr2 60553540 60553561 60553545 60553540 -
tcatctctctctctctctctcc

SEQ ID NO: 210229 - DNA, 22 bp, Artificial Sequence
  Synthetic oligonucleotide; TTT chr2 60553539 60553560 60553544 60553539 -
catctctctctctctctctccc

SEQ ID NO: 210230 - DNA, 22 bp, Artificial Sequence
  Synthetic oligonucleotide; TTC chr2 60553538 60553559 60553543 60553538 -
atctctctctctctctctccct

SEQ ID NO: 210231 - DNA, 22 bp, Artificial Sequence
  Synthetic oligonucleotide; CTC chr2 60553533 60553554 60553538 60553533 -
tctctctctctctccctctatc

SEQ ID NO: 210232 - DNA, 22 bp, Artificial Sequence
  Synthetic oligonucleotide; CTC chr2 60553531 60553552 60553536 60553531 -
tctctctctctccctctatctc

SEQ ID NO: 210233 - DNA, 22 bp, Artificial Sequence
  Synthetic oligonucleotide; CTC chr2 60553529 60553550 60553534 60553529 -
tctctctctccctctatctctc

SEQ ID NO: 210234 - DNA, 22 bp, Artificial Sequence
  Synthetic oligonucleotide; CTC chr2 60553527 60553548 60553532 60553527 -
tctctctccctctatctctctt

SEQ ID NO: 210235 - DNA, 22 bp, Artificial Sequence
  Synthetic oligonucleotide; CTC chr2 60553525 60553546 60553530 60553525 -
tctctccctctatctctcttct

SEQ ID NO: 210236 - DNA, 22 bp, Artificial Sequence
  Synthetic oligonucleotide; CTC chr2 60553523 60553544 60553528 60553523 -
tctccctctatctctcttctct

SEQ ID NO: 210237 - DNA, 22 bp, Artificial Sequence
  Synthetic oligonucleotide; CTC chr2 60553521 60553542 60553526 60553521 -
tccctctatctctcttctctct

SEQ ID NO: 210238 - DNA, 22 bp, Artificial Sequence
  Synthetic oligonucleotide; CTC chr2 60553519 60553540 60553524 60553519 -
cctctatctctcttctctctct

SEQ ID NO: 210239 - DNA, 22 bp, Artificial Sequence
  Synthetic oligonucleotide; CTC chr2 60553515 60553536 60553520 60553515 -
tatctctcttctctctctctcc

SEQ ID NO: 210240 - DNA, 22 bp, Artificial Sequence
  Synthetic oligonucleotide; CTA chr2 60553513 60553534 60553518 60553513 -
tctctcttctctctctctccct

SEQ ID NO: 210241 - DNA, 22 bp, Artificial Sequence
  Synthetic oligonucleotide; CTC chr2 60553509 60553530 60553514 60553509 -
tcttctctctctctccctcttt

SEQ ID NO: 210242 - DNA, 22 bp, Artificial Sequence
  Synthetic oligonucleotide; CTC chr2 60553507 60553528 60553512 60553507 -
ttctctctctctccctcttttt

SEQ ID NO: 210243 - DNA, 22 bp, Artificial Sequence
  Synthetic oligonucleotide; CTT chr2 60553505 60553526 60553510 60553505 -
ctctctctctccctcttttttt

SEQ ID NO: 210244 - DNA, 22 bp, Artificial Sequence
  Synthetic oligonucleotide; TTC chr2 60553504 60553525 60553509 60553504 -
tctctctctccctctttttttt

SEQ ID NO: 210245 - DNA, 22 bp, Artificial Sequence
  Synthetic oligonucleotide; CTC chr2 60553502 60553523 60553507 60553502 -
tctctctccctctttttttttt

SEQ ID NO: 210246 - DNA, 22 bp, Artificial Sequence
  Synthetic oligonucleotide; CTC chr2 60553500 60553521 60553505 60553500 -
tctctccctctttttttttttt

SEQ ID NO: 210247 - DNA, 22 bp, Artificial Sequence
  Synthetic oligonucleotide; CTC chr2 60553498 60553519 60553503 60553498 -
tctccctctttttttttttttt

SEQ ID NO: 210248 - DNA, 22 bp, Artificial Sequence
  Synthetic oligonucleotide; CTC chr2 60553496 60553517 60553501 60553496 -
tccctctttttttttttttttt

SEQ ID NO: 210249 - DNA, 22 bp, Artificial Sequence
  Synthetic oligonucleotide; CTC chr2 60553494 60553515 60553499 60553494 -
cctctttttttttttttttttt

SEQ ID NO: 210250 - DNA, 22 bp, Artificial Sequence
  Synthetic oligonucleotide; CTC chr2 60553490 60553511 60553495 60553490 -
tttttttttttttttttttttt

SEQ ID NO: 210251 - DNA, 22 bp, Artificial Sequence
  Synthetic oligonucleotide; CTT chr2 60553488 60553509 60553493 60553488 -
tttttttttttttttttttttt

SEQ ID NO: 210252 - DNA, 22 bp, Artificial Sequence
  Synthetic oligonucleotide; TTT chr2 60553487 60553508 60553492 60553487 -
tttttttttttttttttttttt

SEQ ID NO: 210253 - DNA, 22 bp, Artificial Sequence
  Synthetic oligonucleotide; TTT chr2 60553486 60553507 60553491 60553486 -
tttttttttttttttttttttt

SEQ ID NO: 210254 - DNA, 22 bp, Artificial Sequence
  Synthetic oligonucleotide; TTT chr2 60553485 60553506 60553490 60553485 -
tttttttttttttttttttttt

SEQ ID NO: 210255 - DNA, 22 bp, Artificial Sequence
  Synthetic oligonucleotide; TTT chr2 60553484 60553505 60553489 60553484 -
tttttttttttttttttttttt

SEQ ID NO: 210256 - DNA, 22 bp, Artificial Sequence
  Synthetic oligonucleotide; TTT chr2 60553483 60553504 60553488 60553483 -
tttttttttttttttttttttt

SEQ ID NO: 210257 - DNA, 22 bp, Artificial Sequence
  Synthetic oligonucleotide; TTT chr2 60553482 60553503 60553487 60553482 -
tttttttttttttttttttttg

SEQ ID NO: 210258 - DNA, 22 bp, Artificial Sequence
  Synthetic oligonucleotide; TTT chr2 60553481 60553502 60553486 60553481 -
ttttttttttttttttttttgc

SEQ ID NO: 210259 - DNA, 22 bp, Artificial Sequence
  Synthetic oligonucleotide; TTT chr2 60553480 60553501 60553485 60553480 -
tttttttttttttttttttgct

SEQ ID NO: 210260 - DNA, 22 bp, Artificial Sequence
  Synthetic oligonucleotide; TTT chr2 60553479 60553500 60553484 60553479 -
ttttttttttttttttttgctt

SEQ ID NO: 210261 - DNA, 22 bp, Artificial Sequence
  Synthetic oligonucleotide; TTT chr2 60553478 60553499 60553483 60553478 -
tttttttttttttttttgctta

SEQ ID NO: 210262 - DNA, 22 bp, Artificial Sequence
  Synthetic oligonucleotide; TTT chr2 60553477 60553498 60553482 60553477 -
ttttttttttttttttgcttaa

SEQ ID NO: 210263 - DNA, 22 bp, Artificial Sequence
  Synthetic oligonucleotide; TTT chr2 60553476 60553497 60553481 60553476 -
tttttttttttttttgcttaaa

SEQ ID NO: 210264 - DNA, 22 bp, Artificial Sequence
  Synthetic oligonucleotide; TTT chr2 60553475 60553496 60553480 60553475 -
ttttttttttttttgcttaaaa

SEQ ID NO: 210265 - DNA, 22 bp, Artificial Sequence
  Synthetic oligonucleotide; TTT chr2 60553474 60553495 60553479 60553474 -
tttttttttttttgcttaaaaa

SEQ ID NO: 210266 - DNA, 22 bp, Artificial Sequence
  Synthetic oligonucleotide; TTT chr2 60553473 60553494 60553478 60553473 -
ttttttttttttgcttaaaaaa

SEQ ID NO: 210267 - DNA, 22 bp, Artificial Sequence
  Synthetic oligonucleotide; TTT chr2 60553472 60553493 60553477 60553472 -
tttttttttttgcttaaaaaaa

SEQ ID NO: 210268 - DNA, 22 bp, Artificial Sequence
  Synthetic oligonucleotide; TTT chr2 60553471 60553492 60553476 60553471 -
ttttttttttgcttaaaaaaaa

SEQ ID NO: 210269 - DNA, 22 bp, Artificial Sequence
  Synthetic oligonucleotide; TTT chr2 60553470 60553491 60553475 60553470 -
tttttttttgcttaaaaaaaag

SEQ ID NO: 210270 - DNA, 22 bp, Artificial Sequence
  Synthetic oligonucleotide; TTT chr2 60553469 60553490 60553474 60553469 -
ttttttttgcttaaaaaaaagc

SEQ ID NO: 210271 - DNA, 22 bp, Artificial Sequence
  Synthetic oligonucleotide; TTT chr2 60553468 60553489 60553473 60553468 -
tttttttgcttaaaaaaaagcc

SEQ ID NO: 210272 - DNA, 22 bp, Artificial Sequence
  Synthetic oligonucleotide; TTT chr2 60553467 60553488 60553472 60553467 -
ttttttgcttaaaaaaaagcca

SEQ ID NO: 210273 - DNA, 22 bp, Artificial Sequence
  Synthetic oligonucleotide; TTT chr2 60553466 60553487 60553471 60553466 -
tttttgcttaaaaaaaagccat

SEQ ID NO: 210274 - DNA, 22 bp, Artificial Sequence
  Synthetic oligonucleotide; TTT chr2 60553465 60553486 60553470 60553465 -
ttttgcttaaaaaaaagccatg

SEQ ID NO: 210275 - DNA, 22 bp, Artificial Sequence
  Synthetic oligonucleotide; TTT chr2 60553464 60553485 60553469 60553464 -
tttgcttaaaaaaaagccatga

SEQ ID NO: 210276 - DNA, 22 bp, Artificial Sequence
  Synthetic oligonucleotide; TTT chr2 60553463 60553484 60553468 60553463 -
ttgcttaaaaaaaagccatgac

SEQ ID NO: 210277 - DNA, 22 bp, Artificial Sequence
  Synthetic oligonucleotide; TTT chr2 60553462 60553483 60553467 60553462 -
tgcttaaaaaaaagccatgacg

SEQ ID NO: 210278 - DNA, 22 bp, Artificial Sequence
  Synthetic oligonucleotide; TTT chr2 60553461 60553482 60553466 60553461 -
gcttaaaaaaaagccatgacgg

SEQ ID NO: 210279 - DNA, 22 bp, Artificial Sequence
  Synthetic oligonucleotide; TTG chr2 60553460 60553481 60553465 60553460 -
cttaaaaaaaagccatgacggc

SEQ ID NO: 210280 - DNA, 22 bp, Artificial Sequence
  Synthetic oligonucleotide; CTT chr2 60553457 60553478 60553462 60553457 -
aaaaaaaagccatgacggctct

SEQ ID NO: 210281 - DNA, 22 bp, Artificial Sequence
  Synthetic oligonucleotide; TTA chr2 60553456 60553477 60553461 60553456 -
aaaaaaagccatgacggctctc

SEQ ID NO: 210282 - DNA, 22 bp, Artificial Sequence
  Synthetic oligonucleotide; CTC chr2 60553436 60553457 60553441 60553436 -
tcccacaattcatcttccctgc

SEQ ID NO: 210283 - DNA, 22 bp, Artificial Sequence
  Synthetic oligonucleotide; CTC chr2 60553434 60553455 60553439 60553434 -
ccacaattcatcttccctgcgc

SEQ ID NO: 210284 - DNA, 22 bp, Artificial Sequence
  Synthetic oligonucleotide; TTC chr2 60553425 60553446 60553430 60553425 -
atcttccctgcgccatctttgt

SEQ ID NO: 210285 - DNA, 22 bp, Artificial Sequence
  Synthetic oligonucleotide; CTT chr2 60553420 60553441 60553425 60553420 -
ccctgcgccatctttgtattat

SEQ ID NO: 210286 - DNA, 22 bp, Artificial Sequence
  Synthetic oligonucleotide; TTC chr2 60553419 60553440 60553424 60553419 -
cctgcgccatctttgtattatt

SEQ ID NO: 210287 - DNA, 22 bp, Artificial Sequence
  Synthetic oligonucleotide; CTG chr2 60553415 60553436 60553420 60553415 -
cgccatctttgtattatttcta

SEQ ID NO: 210288 - DNA, 22 bp, Artificial Sequence
  Synthetic oligonucleotide; CTT chr2 60553406 60553427 60553411 60553406 -
tgtattatttctaatttatttt

SEQ ID NO: 210289 - DNA, 22 bp, Artificial Sequence
  Synthetic oligonucleotide; TTT chr2 60553405 60553426 60553410 60553405 -
gtattatttctaatttattttg

SEQ ID NO: 210290 - DNA, 22 bp, Artificial Sequence
  Synthetic oligonucleotide; TTG chr2 60553404 60553425 60553409 60553404 -
tattatttctaatttattttgg

SEQ ID NO: 210291 - DNA, 22 bp, Artificial Sequence
  Synthetic oligonucleotide; TTA chr2 60553399 60553420 60553404 60553399 -
tttctaatttattttggatgtc

SEQ ID NO: 210292 - DNA, 22 bp, Artificial Sequence
  Synthetic oligonucleotide; TTT chr2 60553396 60553417 60553401 60553396 -
ctaatttattttggatgtcaaa

SEQ ID NO: 210293 - DNA, 22 bp, Artificial Sequence
  Synthetic oligonucleotide; TTC chr2 60553395 60553416 60553400 60553395 -
taatttattttggatgtcaaaa

SEQ ID NO: 210294 - DNA, 22 bp, Artificial Sequence
  Synthetic oligonucleotide; CTA chr2 60553393 60553414 60553398 60553393 -
atttattttggatgtcaaaagg

SEQ ID NO: 210295 - DNA, 22 bp, Artificial Sequence
  Synthetic oligonucleotide; TTT chr2 60553389 60553410 60553394 60553389 -
attttggatgtcaaaaggcact

SEQ ID NO: 210296 - DNA, 22 bp, Artificial Sequence
  Synthetic oligonucleotide; TTA chr2 60553388 60553409 60553393 60553388 -
ttttggatgtcaaaaggcactg

SEQ ID NO: 210297 - DNA, 22 bp, Artificial Sequence
  Synthetic oligonucleotide; TTT chr2 60553385 60553406 60553390 60553385 -
tggatgtcaaaaggcactgatg

SEQ ID NO: 210298 - DNA, 22 bp, Artificial Sequence
  Synthetic oligonucleotide; TTT chr2 60553384 60553405 60553389 60553384 -
ggatgtcaaaaggcactgatga

SEQ ID NO: 210299 - DNA, 22 bp, Artificial Sequence
  Synthetic oligonucleotide; TTG chr2 60553383 60553404 60553388 60553383 -
gatgtcaaaaggcactgatgaa

SEQ ID NO: 210300 - DNA, 22 bp, Artificial Sequence
  Synthetic oligonucleotide; CTG chr2 60553366 60553387 60553371 60553366 -
atgaagatattttctctggagt

SEQ ID NO: 210301 - DNA, 22 bp, Artificial Sequence
  Synthetic oligonucleotide; TTT chr2 60553354 60553375 60553359 60553354 -
tctctggagtctccttctttct

SEQ ID NO: 210302 - DNA, 22 bp, Artificial Sequence
  Synthetic oligonucleotide; TTT chr2 60553353 60553374 60553358 60553353 -
ctctggagtctccttctttcta

SEQ ID NO: 210303 - DNA, 22 bp, Artificial Sequence
  Synthetic oligonucleotide; TTC chr2 60553352 60553373 60553357 60553352 -
tctggagtctccttctttctaa

SEQ ID NO: 210304 - DNA, 22 bp, Artificial Sequence
  Synthetic oligonucleotide; CTC chr2 60553350 60553371 60553355 60553350 -
tggagtctccttctttctaacc

SEQ ID NO: 210305 - DNA, 22 bp, Artificial Sequence
  Synthetic oligonucleotide; CTG chr2 60553348 60553369 60553353 60553348 -
gagtctccttctttctaacccg

SEQ ID NO: 210306 - DNA, 22 bp, Artificial Sequence
  Synthetic oligonucleotide; CTC chr2 60553341 60553362 60553346 60553341 -
cttctttctaacccggctctcc

SEQ ID NO: 210307 - DNA, 22 bp, Artificial Sequence
  Synthetic oligonucleotide; CTT chr2 60553338 60553359 60553343 60553338 -
ctttctaacccggctctcccga

SEQ ID NO: 210308 - DNA, 22 bp, Artificial Sequence
  Synthetic oligonucleotide; TTC chr2 60553337 60553358 60553342 60553337 -
tttctaacccggctctcccgat

SEQ ID NO: 210309 - DNA, 22 bp, Artificial Sequence
  Synthetic oligonucleotide; CTT chr2 60553335 60553356 60553340 60553335 -
tctaacccggctctcccgatgt

SEQ ID NO: 210310 - DNA, 22 bp, Artificial Sequence
  Synthetic oligonucleotide; TTT chr2 60553334 60553355 60553339 60553334 -
ctaacccggctctcccgatgtg

SEQ ID NO: 210311 - DNA, 22 bp, Artificial Sequence
  Synthetic oligonucleotide; TTC chr2 60553333 60553354 60553338 60553333 -
taacccggctctcccgatgtga

SEQ ID NO: 210312 - DNA, 22 bp, Artificial Sequence
  Synthetic oligonucleotide; CTA chr2 60553331 60553352 60553336 60553331 -
acccggctctcccgatgtgaac

SEQ ID NO: 210313 - DNA, 22 bp, Artificial Sequence
  Synthetic oligonucleotide; CTC chr2 60553322 60553343 60553327 60553322 -
tcccgatgtgaaccgagccgtc

SEQ ID NO: 210314 - DNA, 22 bp, Artificial Sequence
  Synthetic oligonucleotide; CTC chr2 60553320 60553341 60553325 60553320 -
ccgatgtgaaccgagccgtcgt

SEQ ID NO: 210315 - DNA, 22 bp, Artificial Sequence
  Synthetic oligonucleotide; CTC chr2 60553242 60553263 60553247 60553242 -
gccgcaagcaaggcaaacccca

SEQ ID NO: 210316 - DNA, 22 bp, Artificial Sequence
  Synthetic oligonucleotide; CTT chr2 60553214 60553235 60553219 60553214 -
aagcaaacgggaattctcgcgt

SEQ ID NO: 210317 - DNA, 22 bp, Artificial Sequence
  Synthetic oligonucleotide; TTA chr2 60553213 60553234 60553218 60553213 -
agcaaacgggaattctcgcgta

SEQ ID NO: 210318 - DNA, 22 bp, Artificial Sequence
  Synthetic oligonucleotide; TTC chr2 60553198 60553219 60553203 60553198 -
tcgcgtaagtaacccaataata

SEQ ID NO: 210319 - DNA, 22 bp, Artificial Sequence
  Synthetic oligonucleotide; CTC chr2 60553196 60553217 60553201 60553196 -
gcgtaagtaacccaataatagt

SEQ ID NO: 210320 - DNA, 22 bp, Artificial Sequence
  Synthetic oligonucleotide; TTA chr2 60553163 60553184 60553168 60553163 -
ttaataatcacgagagcgcgca

SEQ ID NO: 210321 - DNA, 22 bp, Artificial Sequence
  Synthetic oligonucleotide; TTA chr2 60553160 60553181 60553165 60553160 -
ataatcacgagagcgcgcagga

SEQ ID NO: 210322 - DNA, 22 bp, Artificial Sequence
  Synthetic oligonucleotide; CTA chr2 60553135 60553156 60553140 60553135 -
gaagcaaaagcgagggggagag

SEQ ID NO: 210323 - DNA, 22 bp, Artificial Sequence
  Synthetic oligonucleotide; TTT chr2 60553093 60553114 60553098 60553093 -
ttaaatttttcacgagaaaaac

SEQ ID NO: 210324 - DNA, 22 bp, Artificial Sequence
  Synthetic oligonucleotide; TTT chr2 60553092 60553113 60553097 60553092 -
taaatttttcacgagaaaaacc

SEQ ID NO: 210325 - DNA, 22 bp, Artificial Sequence
  Synthetic oligonucleotide; TTT chr2 60553091 60553112 60553096 60553091 -
aaatttttcacgagaaaaacct

SEQ ID NO: 210326 - DNA, 22 bp, Artificial Sequence
  Synthetic oligonucleotide; TTA chr2 60553090 60553111 60553095 60553090 -
aatttttcacgagaaaaacctc

SEQ ID NO: 210327 - DNA, 22 bp, Artificial Sequence
  Synthetic oligonucleotide; TTT chr2 60553085 60553106 60553090 60553085 -
ttcacgagaaaaacctccgaga

SEQ ID NO: 210328 - DNA, 22 bp, Artificial Sequence
  Synthetic oligonucleotide; TTT chr2 60553084 60553105 60553089 60553084 -
tcacgagaaaaacctccgagag

SEQ ID NO: 210329 - DNA, 22 bp, Artificial Sequence
  Synthetic oligonucleotide; TTT chr2 60553083 60553104 60553088 60553083 -
cacgagaaaaacctccgagagt

SEQ ID NO: 210330 - DNA, 22 bp, Artificial Sequence
  Synthetic oligonucleotide; TTC chr2 60553082 60553103 60553087 60553082 -
acgagaaaaacctccgagagtc

SEQ ID NO: 210331 - DNA, 22 bp, Artificial Sequence
  Synthetic oligonucleotide; CTC chr2 60553068 60553089 60553073 60553068 -
cgagagtcgaggtaaaagagat

SEQ ID NO: 210332 - DNA, 22 bp, Artificial Sequence
  Synthetic oligonucleotide; CTC chr2 60553027 60553048 60553032 60553027 -
atcccatctggaaccattgccg

SEQ ID NO: 210333 - DNA, 22 bp, Artificial Sequence
  Synthetic oligonucleotide; CTG chr2 60553017 60553038 60553022 60553017 -
gaaccattgccgtgtatgcact

SEQ ID NO: 210334 - DNA, 22 bp, Artificial Sequence
  Synthetic oligonucleotide; TTG chr2 60553008 60553029 60553013 60553008 -
ccgtgtatgcacttttgagaca

SEQ ID NO: 210335 - DNA, 22 bp, Artificial Sequence
  Synthetic oligonucleotide; CTT chr2 60552994 60553015 60552999 60552994 -
ttgagacagcacgcacctttta

SEQ ID NO: 210336 - DNA, 22 bp, Artificial Sequence
  Synthetic oligonucleotide; TTT chr2 60552993 60553014 60552998 60552993 -
tgagacagcacgcaccttttaa

SEQ ID NO: 210337 - DNA, 22 bp, Artificial Sequence
  Synthetic oligonucleotide; TTT chr2 60552992 60553013 60552997 60552992 -
gagacagcacgcaccttttaat

SEQ ID NO: 210338 - DNA, 22 bp, Artificial Sequence
  Synthetic oligonucleotide; TTG chr2 60552991 60553012 60552996 60552991 -
agacagcacgcaccttttaatt

SEQ ID NO: 210339 - DNA, 22 bp, Artificial Sequence
  Synthetic oligonucleotide; CTT chr2 60552975 60552996 60552980 60552975 -
ttaattttatttaattttacaa

SEQ ID NO: 210340 - DNA, 22 bp, Artificial Sequence
  Synthetic oligonucleotide; TTT chr2 60552974 60552995 60552979 60552974 -
taattttatttaattttacaaa

SEQ ID NO: 210341 - DNA, 22 bp, Artificial Sequence
  Synthetic oligonucleotide; TTT chr2 60552973 60552994 60552978 60552973 -
aattttatttaattttacaaaa

SEQ ID NO: 210342 - DNA, 22 bp, Artificial Sequence
  Synthetic oligonucleotide; TTA chr2 60552972 60552993 60552977 60552972 -
attttatttaattttacaaaaa

SEQ ID NO: 210343 - DNA, 22 bp, Artificial Sequence
  Synthetic oligonucleotide; TTT chr2 60552968 60552989 60552973 60552968 -
tatttaattttacaaaaatttg

SEQ ID NO: 210344 - DNA, 22 bp, Artificial Sequence
  Synthetic oligonucleotide; TTT chr2 60552967 60552988 60552972 60552967 -
atttaattttacaaaaatttga

SEQ ID NO: 210345 - DNA, 22 bp, Artificial Sequence
  Synthetic oligonucleotide; TTA chr2 60552966 60552987 60552971 60552966 -
tttaattttacaaaaatttgac

SEQ ID NO: 210346 - DNA, 22 bp, Artificial Sequence
  Synthetic oligonucleotide; TTT chr2 60552963 60552984 60552968 60552963 -
aattttacaaaaatttgactcc

SEQ ID NO: 210347 - DNA, 22 bp, Artificial Sequence
  Synthetic oligonucleotide; TTA chr2 60552962 60552983 60552967 60552962 -
attttacaaaaatttgactcct

SEQ ID NO: 210348 - DNA, 22 bp, Artificial Sequence
  Synthetic oligonucleotide; TTT chr2 60552958 60552979 60552963 60552958 -
tacaaaaatttgactcctcctc

SEQ ID NO: 210349 - DNA, 22 bp, Artificial Sequence
  Synthetic oligonucleotide; TTT chr2 60552957 60552978 60552962 60552957 -
acaaaaatttgactcctcctct

SEQ ID NO: 210350 - DNA, 22 bp, Artificial Sequence
  Synthetic oligonucleotide; TTA chr2 60552956 60552977 60552961 60552956 -
caaaaatttgactcctcctctt

SEQ ID NO: 210351 - DNA, 22 bp, Artificial Sequence
  Synthetic oligonucleotide; TTT chr2 60552947 60552968 60552952 60552947 -
gactcctcctctttcctccttt

SEQ ID NO: 210352 - DNA, 22 bp, Artificial Sequence
  Synthetic oligonucleotide; TTG chr2 60552946 60552967 60552951 60552946 -
actcctcctctttcctcctttc

SEQ ID NO: 210353 - DNA, 22 bp, Artificial Sequence
  Synthetic oligonucleotide; CTC chr2 60552942 60552963 60552947 60552942 -
ctcctctttcctcctttccgcc

SEQ ID NO: 210354 - DNA, 22 bp, Artificial Sequence
  Synthetic oligonucleotide; CTC chr2 60552939 60552960 60552944 60552939 -
ctctttcctcctttccgccgct

SEQ ID NO: 210355 - DNA, 22 bp, Artificial Sequence
  Synthetic oligonucleotide; CTC chr2 60552936 60552957 60552941 60552936 -
tttcctcctttccgccgcttta

SEQ ID NO: 210356 - DNA, 22 bp, Artificial Sequence
  Synthetic oligonucleotide; CTT chr2 60552934 60552955 60552939 60552934 -
tcctcctttccgccgctttatt

SEQ ID NO: 210357 - DNA, 22 bp, Artificial Sequence
  Synthetic oligonucleotide; TTT chr2 60552933 60552954 60552938 60552933 -
cctcctttccgccgctttattt

SEQ ID NO: 210358 - DNA, 22 bp, Artificial Sequence
  Synthetic oligonucleotide; TTC chr2 60552932 60552953 60552937 60552932 -
ctcctttccgccgctttatttc

SEQ ID NO: 210359 - DNA, 22 bp, Artificial Sequence
  Synthetic oligonucleotide; CTC chr2 60552929 60552950 60552934 60552929 -
ctttccgccgctttatttctct

SEQ ID NO: 210360 - DNA, 22 bp, Artificial Sequence
  Synthetic oligonucleotide; CTT chr2 60552926 60552947 60552931 60552926 -
tccgccgctttatttctctttt

SEQ ID NO: 210361 - DNA, 22 bp, Artificial Sequence
  Synthetic oligonucleotide; TTT chr2 60552925 60552946 60552930 60552925 -
ccgccgctttatttctcttttc

SEQ ID NO: 210362 - DNA, 22 bp, Artificial Sequence
  Synthetic oligonucleotide; TTC chr2 60552924 60552945 60552929 60552924 -
cgccgctttatttctcttttcg

SEQ ID NO: 210363 - DNA, 22 bp, Artificial Sequence
  Synthetic oligonucleotide; CTT chr2 60552916 60552937 60552921 60552916 -
tatttctcttttcgaaaaggaa

SEQ ID NO: 210364 - DNA, 22 bp, Artificial Sequence
  Synthetic oligonucleotide; TTT chr2 60552915 60552936 60552920 60552915 -
atttctcttttcgaaaaggaat

SEQ ID NO: 210365 - DNA, 22 bp, Artificial Sequence
  Synthetic oligonucleotide; TTA chr2 60552914 60552935 60552919 60552914 -
tttctcttttcgaaaaggaatg

SEQ ID NO: 210366 - DNA, 22 bp, Artificial Sequence
  Synthetic oligonucleotide; TTT chr2 60552911 60552932 60552916 60552911 -
ctcttttcgaaaaggaatgcaa

SEQ ID NO: 210367 - DNA, 22 bp, Artificial Sequence
  Synthetic oligonucleotide; TTC chr2 60552910 60552931 60552915 60552910 -
tcttttcgaaaaggaatgcaat

SEQ ID NO: 210368 - DNA, 22 bp, Artificial Sequence
  Synthetic oligonucleotide; CTC chr2 60552908 60552929 60552913 60552908 -
ttttcgaaaaggaatgcaatga

SEQ ID NO: 210369 - DNA, 22 bp, Artificial Sequence
  Synthetic oligonucleotide; CTT chr2 60552906 60552927 60552911 60552906 -
ttcgaaaaggaatgcaatgatt

SEQ ID NO: 210370 - DNA, 22 bp, Artificial Sequence
  Synthetic oligonucleotide; TTT chr2 60552905 60552926 60552910 60552905 -
tcgaaaaggaatgcaatgattc

SEQ ID NO: 210371 - DNA, 22 bp, Artificial Sequence
  Synthetic oligonucleotide; TTT chr2 60552904 60552925 60552909 60552904 -
cgaaaaggaatgcaatgattcc

SEQ ID NO: 210372 - DNA, 22 bp, Artificial Sequence
  Synthetic oligonucleotide; TTC chr2 60552903 60552924 60552908 60552903 -
gaaaaggaatgcaatgattcca

SEQ ID NO: 210373 - DNA, 22 bp, Artificial Sequence
  Synthetic oligonucleotide; TTC chr2 60552883 60552904 60552888 60552883 -
cactccccccccgccccgccag

SEQ ID NO: 210374 - DNA, 22 bp, Artificial Sequence
  Synthetic oligonucleotide; CTC chr2 60552878 60552899 60552883 60552878 -
cccccccgccccgccagttttg

SEQ ID NO: 210375 - DNA, 22 bp, Artificial Sequence
  Synthetic oligonucleotide; TTT chr2 60552858 60552879 60552863 60552858 -
tgcaaaataatgaacaatgcta

SEQ ID NO: 210376 - DNA, 22 bp, Artificial Sequence
  Synthetic oligonucleotide; TTT chr2 60552857 60552878 60552862 60552857 -
gcaaaataatgaacaatgctaa

SEQ ID NO: 210377 - DNA, 22 bp, Artificial Sequence
  Synthetic oligonucleotide; TTG chr2 60552856 60552877 60552861 60552856 -
caaaataatgaacaatgctaag

SEQ ID NO: 210378 - DNA, 22 bp, Artificial Sequence
  Synthetic oligonucleotide; CTA chr2 60552836 60552857 60552841 60552836 -
aggttgcgaacaactcacatgc

SEQ ID NO: 210379 - DNA, 22 bp, Artificial Sequence
  Synthetic oligonucleotide; TTG chr2 60552830 60552851 60552835 60552830 -
cgaacaactcacatgcaaacct

SEQ ID NO: 210380 - DNA, 22 bp, Artificial Sequence
  Synthetic oligonucleotide; CTC chr2 60552820 60552841 60552825 60552820 -
acatgcaaacctgggggtggga

SEQ ID NO: 210381 - DNA, 22 bp, Artificial Sequence
  Synthetic oligonucleotide; CTG chr2 60552807 60552828 60552812 60552807 -
ggggtgggagctggtggggaaa

SEQ ID NO: 210382 - DNA, 22 bp, Artificial Sequence
  Synthetic oligonucleotide; CTG chr2 60552794 60552815 60552799 60552794 -
gtggggaaagggaggttgcttc

SEQ ID NO: 210383 - DNA, 22 bp, Artificial Sequence
  Synthetic oligonucleotide; TTG chr2 60552776 60552797 60552781 60552776 -
cttcccactcaccgtaagaaaa

SEQ ID NO: 210384 - DNA, 22 bp, Artificial Sequence
  Synthetic oligonucleotide; CTT chr2 60552773 60552794 60552778 60552773 -
cccactcaccgtaagaaaatgg

SEQ ID NO: 210385 - DNA, 22 bp, Artificial Sequence
  Synthetic oligonucleotide; TTC chr2 60552772 60552793 60552777 60552772 -
ccactcaccgtaagaaaatggg

SEQ ID NO: 210386 - DNA, 22 bp, Artificial Sequence
  Synthetic oligonucleotide; CTC chr2 60552766 60552787 60552771 60552766 -
accgtaagaaaatgggggggta

SEQ ID NO: 210387 - DNA, 22 bp, Artificial Sequence
  Synthetic oligonucleotide; CTA chr2 60552721 60552742 60552726 60552721 -
aaaaacgattcccggggagaaa

SEQ ID NO: 210388 - DNA, 22 bp, Artificial Sequence
  Synthetic oligonucleotide; TTC chr2 60552710 60552731 60552715 60552710 -
ccggggagaaaagaggtgagac

SEQ ID NO: 210389 - DNA, 22 bp, Artificial Sequence
  Synthetic oligonucleotide; CTG chr2 60552686 60552707 60552691 60552686 -
gcttttggacaccagcgcgctc

SEQ ID NO: 210390 - DNA, 22 bp, Artificial Sequence
  Synthetic oligonucleotide; CTT chr2 60552682 60552703 60552687 60552682 -
ttggacaccagcgcgctcacgg

SEQ ID NO: 210391 - DNA, 22 bp, Artificial Sequence
  Synthetic oligonucleotide; TTT chr2 60552681 60552702 60552686 60552681 -
tggacaccagcgcgctcacggt

SEQ ID NO: 210392 - DNA, 22 bp, Artificial Sequence
  Synthetic oligonucleotide; TTT chr2 60552680 60552701 60552685 60552680 -
ggacaccagcgcgctcacggtc

SEQ ID NO: 210393 - DNA, 22 bp, Artificial Sequence
  Synthetic oligonucleotide; TTG chr2 60552679 60552700 60552684 60552679 -
gacaccagcgcgctcacggtca

SEQ ID NO: 210394 - DNA, 22 bp, Artificial Sequence
  Synthetic oligonucleotide; CTC chr2 60552664 60552685 60552669 60552664 -
acggtcaagtgtgcagcgggag

SEQ ID NO: 210395 - DNA, 22 bp, Artificial Sequence
  Synthetic oligonucleotide; CTG chr2 60552603 60552624 60552608 60552603 -
tggaaaggggcccccggcgctc

SEQ ID NO: 210396 - DNA, 22 bp, Artificial Sequence
  Synthetic oligonucleotide; CTC chr2 60552581 60552602 60552586 60552581 -
ctgagtccgcggagtcgggaga

SEQ ID NO: 210397 - DNA, 22 bp, Artificial Sequence
  Synthetic oligonucleotide; CTG chr2 60552578 60552599 60552583 60552578 -
agtccgcggagtcgggagaggg

SEQ ID NO: 210398 - DNA, 22 bp, Artificial Sequence
  Synthetic oligonucleotide; CTG chr2 60552498 60552519 60552503 60552498 -
ccgccttttgttccggccagag

SEQ ID NO: 210399 - DNA, 22 bp, Artificial Sequence
  Synthetic oligonucleotide; CTT chr2 60552491 60552512 60552496 60552491 -
ttgttccggccagaggtgggtg

SEQ ID NO: 210400 - DNA, 22 bp, Artificial Sequence
  Synthetic oligonucleotide; TTT chr2 60552490 60552511 60552495 60552490 -
tgttccggccagaggtgggtgt

SEQ ID NO: 210401 - DNA, 22 bp, Artificial Sequence
  Synthetic oligonucleotide; TTT chr2 60552489 60552510 60552494 60552489 -
gttccggccagaggtgggtgtt

SEQ ID NO: 210402 - DNA, 22 bp, Artificial Sequence
  Synthetic oligonucleotide; TTG chr2 60552488 60552509 60552493 60552488 -
ttccggccagaggtgggtgttt

SEQ ID NO: 210403 - DNA, 22 bp, Artificial Sequence
  Synthetic oligonucleotide; TTC chr2 60552485 60552506 60552490 60552485 -
cggccagaggtgggtgtttgtc

SEQ ID NO: 210404 - DNA, 22 bp, Artificial Sequence
  Synthetic oligonucleotide; TTT chr2 60552466 60552487 60552471 60552466 -
gtcccgctgccttttgtgccgg

SEQ ID NO: 210405 - DNA, 22 bp, Artificial Sequence
  Synthetic oligonucleotide; TTG chr2 60552465 60552486 60552470 60552465 -
tcccgctgccttttgtgccggc

SEQ ID NO: 210406 - DNA, 22 bp, Artificial Sequence
  Synthetic oligonucleotide; CTG chr2 60552457 60552478 60552462 60552457 -
ccttttgtgccggctcctcgcg

SEQ ID NO: 210407 - DNA, 22 bp, Artificial Sequence
  Synthetic oligonucleotide; CTT chr2 60552453 60552474 60552458 60552453 -
ttgtgccggctcctcgcgcttg

SEQ ID NO: 210408 - DNA, 22 bp, Artificial Sequence
  Synthetic oligonucleotide; TTT chr2 60552452 60552473 60552457 60552452 -
tgtgccggctcctcgcgcttgc

SEQ ID NO: 210409 - DNA, 22 bp, Artificial Sequence
  Synthetic oligonucleotide; TTT chr2 60552451 60552472 60552456 60552451 -
gtgccggctcctcgcgcttgcc

SEQ ID NO: 210410 - DNA, 22 bp, Artificial Sequence
  Synthetic oligonucleotide; TTG chr2 60552450 60552471 60552455 60552450 -
tgccggctcctcgcgcttgccc

SEQ ID NO: 210411 - DNA, 22 bp, Artificial Sequence
  Synthetic oligonucleotide; CTC chr2 60552441 60552462 60552446 60552441 -
ctcgcgcttgccctcccgcgcc

SEQ ID NO: 210412 - DNA, 22 bp, Artificial Sequence
  Synthetic oligonucleotide; CTC chr2 60552438 60552459 60552443 60552438 -
gcgcttgccctcccgcgccgcc

SEQ ID NO: 210413 - DNA, 22 bp, Artificial Sequence
  Synthetic oligonucleotide; CTT chr2 60552432 60552453 60552437 60552432 -
gccctcccgcgccgccgccgcc

SEQ ID NO: 210414 - DNA, 22 bp, Artificial Sequence
  Synthetic oligonucleotide; TTG chr2 60552431 60552452 60552436 60552431 -
ccctcccgcgccgccgccgccg

SEQ ID NO: 210415 - DNA, 22 bp, Artificial Sequence
  Synthetic oligonucleotide; CTC chr2 60552426 60552447 60552431 60552426 -
ccgcgccgccgccgccgccgcc

SEQ ID NO: 210416 - DNA, 22 bp, Artificial Sequence
  Synthetic oligonucleotide; CTA chr2 60552386 60552407 60552391 60552386 -
gggccgggggaggaggcggccg

SEQ ID NO: 210417 - DNA, 22 bp, Artificial Sequence
  Synthetic oligonucleotide; CTG chr2 60552327 60552348 60552332 60552327 -
ctgcctcctgggttgccgctgc

SEQ ID NO: 210418 - DNA, 22 bp, Artificial Sequence
  Synthetic oligonucleotide; CTG chr2 60552324 60552345 60552329 60552324 -
cctcctgggttgccgctgccct

SEQ ID NO: 210419 - DNA, 22 bp, Artificial Sequence
  Synthetic oligonucleotide; CTC chr2 60552320 60552341 60552325 60552320 -
ctgggttgccgctgccctcccc

SEQ ID NO: 210420 - DNA, 22 bp, Artificial Sequence
  Synthetic oligonucleotide; CTG chr2 60552317 60552338 60552322 60552317 -
ggttgccgctgccctcccctcc

SEQ ID NO: 210421 - DNA, 22 bp, Artificial Sequence
  Synthetic oligonucleotide; TTG chr2 60552312 60552333 60552317 60552312 -
ccgctgccctcccctcccgacc

SEQ ID NO: 210422 - DNA, 22 bp, Artificial Sequence
  Synthetic oligonucleotide; CTG chr2 60552306 60552327 60552311 60552306 -
ccctcccctcccgaccgaacct

SEQ ID NO: 210423 - DNA, 22 bp, Artificial Sequence
  Synthetic oligonucleotide; CTC chr2 60552301 60552322 60552306 60552301 -
ccctcccgaccgaacctcagag

SEQ ID NO: 210424 - DNA, 22 bp, Artificial Sequence
  Synthetic oligonucleotide; CTC chr2 60552296 60552317 60552301 60552296 -
ccgaccgaacctcagaggcagc

SEQ ID NO: 210425 - DNA, 22 bp, Artificial Sequence
  Synthetic oligonucleotide; CTC chr2 60552283 60552304 60552288 60552283 -
agaggcagcaaggagaagactg

SEQ ID NO: 210426 - DNA, 22 bp, Artificial Sequence
  Synthetic oligonucleotide; CTG chr2 60552261 60552282 60552266 60552261 -
gcacataaataaataaatacat

SEQ ID NO: 210427 - DNA, 22 bp, Artificial Sequence
  Synthetic oligonucleotide; TTT chr2 60552197 60552218 60552202 60552197 -
cttgcccccaaaccgaagccaa

SEQ ID NO: 210428 - DNA, 22 bp, Artificial Sequence
  Synthetic oligonucleotide; TTC chr2 60552196 60552217 60552201 60552196 -
ttgcccccaaaccgaagccaaa

SEQ ID NO: 210429 - DNA, 22 bp, Artificial Sequence
  Synthetic oligonucleotide; CTT chr2 60552194 60552215 60552199 60552194 -
gcccccaaaccgaagccaaacg

SEQ ID NO: 210430 - DNA, 22 bp, Artificial Sequence
  Synthetic oligonucleotide; TTG chr2 60552193 60552214 60552198 60552193 -
cccccaaaccgaagccaaacgc

SEQ ID NO: 210431 - DNA, 22 bp, Artificial Sequence
  Synthetic oligonucleotide; CTC chr2 60552169 60552190 60552174 60552169 -
tgccaacccttttctgtgacgg

SEQ ID NO: 210432 - DNA, 22 bp, Artificial Sequence
  Synthetic oligonucleotide; CTG chr2 60552167 60552188 60552172 60552167 -
ccaacccttttctgtgacggcc

SEQ ID NO: 210433 - DNA, 22 bp, Artificial Sequence
  Synthetic oligonucleotide; CTT chr2 60552158 60552179 60552163 60552158 -
ttctgtgacggccttctctttg

SEQ ID NO: 210434 - DNA, 22 bp, Artificial Sequence
  Synthetic oligonucleotide; TTT chr2 60552157 60552178 60552162 60552157 -
tctgtgacggccttctctttga

SEQ ID NO: 210435 - DNA, 22 bp, Artificial Sequence
  Synthetic oligonucleotide; TTT chr2 60552156 60552177 60552161 60552156 -
ctgtgacggccttctctttgac

SEQ ID NO: 210436 - DNA, 22 bp, Artificial Sequence
  Synthetic oligonucleotide; TTC chr2 60552155 60552176 60552160 60552155 -
tgtgacggccttctctttgact

SEQ ID NO: 210437 - DNA, 22 bp, Artificial Sequence
  Synthetic oligonucleotide; CTG chr2 60552153 60552174 60552158 60552153 -
tgacggccttctctttgactcc

SEQ ID NO: 210438 - DNA, 22 bp, Artificial Sequence
  Synthetic oligonucleotide; CTT chr2 60552143 60552164 60552148 60552143 -
ctctttgactcccccaccagcc

SEQ ID NO: 210439 - DNA, 22 bp, Artificial Sequence
  Synthetic oligonucleotide; TTC chr2 60552142 60552163 60552147 60552142 -
tctttgactcccccaccagccc

SEQ ID NO: 210440 - DNA, 22 bp, Artificial Sequence
  Synthetic oligonucleotide; CTC chr2 60552140 60552161 60552145 60552140 -
tttgactcccccaccagccccc

SEQ ID NO: 210441 - DNA, 22 bp, Artificial Sequence
  Synthetic oligonucleotide; CTT chr2 60552138 60552159 60552143 60552138 -
tgactcccccaccagcccccct

SEQ ID NO: 210442 - DNA, 22 bp, Artificial Sequence
  Synthetic oligonucleotide; TTT chr2 60552137 60552158 60552142 60552137 -
gactcccccaccagcccccctg

SEQ ID NO: 210443 - DNA, 22 bp, Artificial Sequence
  Synthetic oligonucleotide; TTG chr2 60552136 60552157 60552141 60552136 -
actcccccaccagcccccctgc

SEQ ID NO: 210444 - DNA, 22 bp, Artificial Sequence
  Synthetic oligonucleotide; CTC chr2 60552132 60552153 60552137 60552132 -
ccccaccagcccccctgcaaaa

SEQ ID NO: 210445 - DNA, 22 bp, Artificial Sequence
  Synthetic oligonucleotide; CTG chr2 60552115 60552136 60552120 60552115 -
caaaaatctcacaatctctcat

SEQ ID NO: 210446 - DNA, 22 bp, Artificial Sequence
  Synthetic oligonucleotide; CTC chr2 60552105 60552126 60552110 60552105 -
acaatctctcatctagaaaaaa

SEQ ID NO: 210447 - DNA, 22 bp, Artificial Sequence
  Synthetic oligonucleotide; CTC chr2 60552097 60552118 60552102 60552097 -
tcatctagaaaaaaatttacaa

SEQ ID NO: 210448 - DNA, 22 bp, Artificial Sequence
  Synthetic oligonucleotide; CTC chr2 60552095 60552116 60552100 60552095 -
atctagaaaaaaatttacaatc

SEQ ID NO: 210449 - DNA, 22 bp, Artificial Sequence
  Synthetic oligonucleotide; CTA chr2 60552090 60552111 60552095 60552090 -
gaaaaaaatttacaatcaccct

SEQ ID NO: 210450 - DNA, 22 bp, Artificial Sequence
  Synthetic oligonucleotide; TTT chr2 60552079 60552100 60552084 60552079 -
acaatcaccctcttcccccaaa

SEQ ID NO: 210451 - DNA, 22 bp, Artificial Sequence
  Synthetic oligonucleotide; TTA chr2 60552078 60552099 60552083 60552078 -
caatcaccctcttcccccaaac

SEQ ID NO: 210452 - DNA, 22 bp, Artificial Sequence
  Synthetic oligonucleotide; CTC chr2 60552067 60552088 60552072 60552067 -
ttcccccaaaccccttcagttg

SEQ ID NO: 210453 - DNA, 22 bp, Artificial Sequence
  Synthetic oligonucleotide; CTT chr2 60552065 60552086 60552070 60552065 -
cccccaaaccccttcagttgca

SEQ ID NO: 210454 - DNA, 22 bp, Artificial Sequence
  Synthetic oligonucleotide; TTC chr2 60552064 60552085 60552069 60552064 -
ccccaaaccccttcagttgcaa

SEQ ID NO: 210455 - DNA, 22 bp, Artificial Sequence
  Synthetic oligonucleotide; CTT chr2 60552051 60552072 60552056 60552051 -
cagttgcaaacttagggcgccg

SEQ ID NO: 210456 - DNA, 22 bp, Artificial Sequence
  Synthetic oligonucleotide; TTC chr2 60552050 60552071 60552055 60552050 -
agttgcaaacttagggcgccga

SEQ ID NO: 210457 - DNA, 22 bp, Artificial Sequence
  Synthetic oligonucleotide; TTG chr2 60552045 60552066 60552050 60552045 -
caaacttagggcgccgacggca

SEQ ID NO: 210458 - DNA, 22 bp, Artificial Sequence
  Synthetic oligonucleotide; CTT chr2 60552038 60552059 60552043 60552038 -
agggcgccgacggcacggagag

SEQ ID NO: 210459 - DNA, 22 bp, Artificial Sequence
  Synthetic oligonucleotide; TTA chr2 60552037 60552058 60552042 60552037 -
gggcgccgacggcacggagagg

SEQ ID NO: 210460 - DNA, 22 bp, Artificial Sequence
  Synthetic oligonucleotide; CTC chr2 60552002 60552023 60552007 60552002 -
cctcctcttactattttttgga

SEQ ID NO: 210461 - DNA, 22 bp, Artificial Sequence
  Synthetic oligonucleotide; CTC chr2 60551998 60552019 60552003 60551998 -
ctcttactattttttggaagat

SEQ ID NO: 210462 - DNA, 22 bp, Artificial Sequence
  Synthetic oligonucleotide; CTC chr2 60551995 60552016 60552000 60551995 -
ttactattttttggaagatttt

SEQ ID NO: 210463 - DNA, 22 bp, Artificial Sequence
  Synthetic oligonucleotide; CTT chr2 60551993 60552014 60551998 60551993 -
actattttttggaagattttca

SEQ ID NO: 210464 - DNA, 22 bp, Artificial Sequence
  Synthetic oligonucleotide; TTA chr2 60551992 60552013 60551997 60551992 -
ctattttttggaagattttcaa

SEQ ID NO: 210465 - DNA, 22 bp, Artificial Sequence
  Synthetic oligonucleotide; CTA chr2 60551989 60552010 60551994 60551989 -
ttttttggaagattttcaaaaa

SEQ ID NO: 210466 - DNA, 22 bp, Artificial Sequence
  Synthetic oligonucleotide; TTT chr2 60551986 60552007 60551991 60551986 -
tttggaagattttcaaaaaaag

SEQ ID NO: 210467 - DNA, 22 bp, Artificial Sequence
  Synthetic oligonucleotide; TTT chr2 60551985 60552006 60551990 60551985 -
ttggaagattttcaaaaaaagt

SEQ ID NO: 210468 - DNA, 22 bp, Artificial Sequence
  Synthetic oligonucleotide; TTT chr2 60551984 60552005 60551989 60551984 -
tggaagattttcaaaaaaagtg

SEQ ID NO: 210469 - DNA, 22 bp, Artificial Sequence
  Synthetic oligonucleotide; TTT chr2 60551983 60552004 60551988 60551983 -
ggaagattttcaaaaaaagtgg

SEQ ID NO: 210470 - DNA, 22 bp, Artificial Sequence
  Synthetic oligonucleotide; TTG chr2 60551982 60552003 60551987 60551982 -
gaagattttcaaaaaaagtgga

SEQ ID NO: 210471 - DNA, 22 bp, Artificial Sequence
  Synthetic oligonucleotide; TTT chr2 60551974 60551995 60551979 60551974 -
tcaaaaaaagtggaagtggatt

SEQ ID NO: 210472 - DNA, 22 bp, Artificial Sequence
  Synthetic oligonucleotide; TTT chr2 60551973 60551994 60551978 60551973 -
caaaaaaagtggaagtggattt

SEQ ID NO: 210473 - DNA, 22 bp, Artificial Sequence
  Synthetic oligonucleotide; TTC chr2 60551972 60551993 60551977 60551972 -
aaaaaaagtggaagtggatttt

SEQ ID NO: 210474 - DNA, 22 bp, Artificial Sequence
  Synthetic oligonucleotide; TTT chr2 60551951 60551972 60551956 60551951 -
tgattgggaaaaatctcgtgtc

SEQ ID NO: 210475 - DNA, 22 bp, Artificial Sequence
  Synthetic oligonucleotide; TTT chr2 60551950 60551971 60551955 60551950 -
gattgggaaaaatctcgtgtct

SEQ ID NO: 210476 - DNA, 22 bp, Artificial Sequence
  Synthetic oligonucleotide; TTG chr2 60551949 60551970 60551954 60551949 -
attgggaaaaatctcgtgtctg

SEQ ID NO: 210477 - DNA, 22 bp, Artificial Sequence
  Synthetic oligonucleotide; TTG chr2 60551945 60551966 60551950 60551945 -
ggaaaaatctcgtgtctgaatg

SEQ ID NO: 210478 - DNA, 22 bp, Artificial Sequence
  Synthetic oligonucleotide; CTC chr2 60551934 60551955 60551939 60551934 -
gtgtctgaatgtttacaagcac

SEQ ID NO: 210479 - DNA, 22 bp, Artificial Sequence
  Synthetic oligonucleotide; CTG chr2 60551927 60551948 60551932 60551927 -
aatgtttacaagcaccgcgtgt

SEQ ID NO: 210480 - DNA, 22 bp, Artificial Sequence
  Synthetic oligonucleotide; TTT chr2 60551920 60551941 60551925 60551920 -
acaagcaccgcgtgtgcgggag

SEQ ID NO: 210481 - DNA, 22 bp, Artificial Sequence
  Synthetic oligonucleotide; TTA chr2 60551919 60551940 60551924 60551919 -
caagcaccgcgtgtgcgggagc

SEQ ID NO: 210482 - DNA, 22 bp, Artificial Sequence
  Synthetic oligonucleotide; CTC chr2 60551894 60551915 60551899 60551894 -
ctgccaacaaacagacagagga

SEQ ID NO: 210483 - DNA, 22 bp, Artificial Sequence
  Synthetic oligonucleotide; CTG chr2 60551891 60551912 60551896 60551891 -
ccaacaaacagacagaggaccg

SEQ ID NO: 210484 - DNA, 22 bp, Artificial Sequence
  Synthetic oligonucleotide; CTG chr2 60551826 60551847 60551831 60551826 -
gcctcgcccgggccttgcccga

SEQ ID NO: 210485 - DNA, 22 bp, Artificial Sequence
  Synthetic oligonucleotide; CTC chr2 60551821 60551842 60551826 60551821 -
gcccgggccttgcccgacctcg

SEQ ID NO: 210486 - DNA, 22 bp, Artificial Sequence
  Synthetic oligonucleotide; CTT chr2 60551810 60551831 60551815 60551810 -
gcccgacctcgccgcgccccag

SEQ ID NO: 210487 - DNA, 22 bp, Artificial Sequence
  Synthetic oligonucleotide; TTG chr2 60551809 60551830 60551814 60551809 -
cccgacctcgccgcgccccagc

SEQ ID NO: 210488 - DNA, 22 bp, Artificial Sequence
  Synthetic oligonucleotide; CTC chr2 60551800 60551821 60551805 60551800 -
gccgcgccccagcccagccccg

SEQ ID NO: 210489 - DNA, 22 bp, Artificial Sequence
  Synthetic oligonucleotide; CTC chr2 60551716 60551737 60551721 60551716 -
cgcgccagcctggcccgtggtc

SEQ ID NO: 210490 - DNA, 22 bp, Artificial Sequence
  Synthetic oligonucleotide; CTG chr2 60551704 60551725 60551709 60551704 -
gcccgtggtcctggtccgcccc

SEQ ID NO: 210491 - DNA, 22 bp, Artificial Sequence
  Synthetic oligonucleotide; CTG chr2 60551691 60551712 60551696 60551691 -
gtccgcccccagcacaatgccg

SEQ ID NO: 210492 - DNA, 22 bp, Artificial Sequence
  Synthetic oligonucleotide; CTC chr2 60551662 60551683 60551667 60551662 -
ttctcgacctcccagactgcga

SEQ ID NO: 210493 - DNA, 22 bp, Artificial Sequence
  Synthetic oligonucleotide; CTT chr2 60551660 60551681 60551665 60551660 -
ctcgacctcccagactgcgaaa

SEQ ID NO: 210494 - DNA, 22 bp, Artificial Sequence
  Synthetic oligonucleotide; TTC chr2 60551659 60551680 60551664 60551659 -
tcgacctcccagactgcgaaat

SEQ ID NO: 210495 - DNA, 22 bp, Artificial Sequence
  Synthetic oligonucleotide; CTC chr2 60551657 60551678 60551662 60551657 -
gacctcccagactgcgaaatcg

SEQ ID NO: 210496 - DNA, 22 bp, Artificial Sequence
  Synthetic oligonucleotide; CTC chr2 60551651 60551672 60551656 60551651 -
ccagactgcgaaatcggctggg

SEQ ID NO: 210497 - DNA, 22 bp, Artificial Sequence
  Synthetic oligonucleotide; CTG chr2 60551643 60551664 60551648 60551643 -
cgaaatcggctgggtgaaactc

SEQ ID NO: 210498 - DNA, 22 bp, Artificial Sequence
  Synthetic oligonucleotide; CTG chr2 60551631 60551652 60551636 60551631 -
ggtgaaactcggctttgcaaag

SEQ ID NO: 210499 - DNA, 22 bp, Artificial Sequence
  Synthetic oligonucleotide; CTC chr2 60551621 60551642 60551626 60551621 -
ggctttgcaaagcatttttatt

SEQ ID NO: 210500 - DNA, 22 bp, Artificial Sequence
  Synthetic oligonucleotide; CTT chr2 60551616 60551637 60551621 60551616 -
tgcaaagcatttttattttgca

SEQ ID NO: 210501 - DNA, 22 bp, Artificial Sequence
  Synthetic oligonucleotide; TTT chr2 60551615 60551636 60551620 60551615 -
gcaaagcatttttattttgcag

SEQ ID NO: 210502 - DNA, 22 bp, Artificial Sequence
  Synthetic oligonucleotide; TTG chr2 60551614 60551635 60551619 60551614 -
caaagcatttttattttgcagg

SEQ ID NO: 210503 - DNA, 22 bp, Artificial Sequence
  Synthetic oligonucleotide; TTT chr2 60551604 60551625 60551609 60551604 -
ttattttgcagggcaactgtaa

SEQ ID NO: 210504 - DNA, 22 bp, Artificial Sequence
  Synthetic oligonucleotide; TTT chr2 60551603 60551624 60551608 60551603 -
tattttgcagggcaactgtaaa

SEQ ID NO: 210505 - DNA, 22 bp, Artificial Sequence
  Synthetic oligonucleotide; TTT chr2 60551602 60551623 60551607 60551602 -
attttgcagggcaactgtaaaa

SEQ ID NO: 210506 - DNA, 22 bp, Artificial Sequence
  Synthetic oligonucleotide; TTA chr2 60551601 60551622 60551606 60551601 -
ttttgcagggcaactgtaaaag

SEQ ID NO: 210507 - DNA, 22 bp, Artificial Sequence
  Synthetic oligonucleotide; TTT chr2 60551598 60551619 60551603 60551598 -
tgcagggcaactgtaaaagcgc

SEQ ID NO: 210508 - DNA, 22 bp, Artificial Sequence
  Synthetic oligonucleotide; TTT chr2 60551597 60551618 60551602 60551597 -
gcagggcaactgtaaaagcgcg

SEQ ID NO: 210509 - DNA, 22 bp, Artificial Sequence
  Synthetic oligonucleotide; TTG chr2 60551596 60551617 60551601 60551596 -
cagggcaactgtaaaagcgcgt

SEQ ID NO: 210510 - DNA, 22 bp, Artificial Sequence
  Synthetic oligonucleotide; CTG chr2 60551585 60551606 60551590 60551585 -
taaaagcgcgttctgcgcctcc

SEQ ID NO: 210511 - DNA, 22 bp, Artificial Sequence
  Synthetic oligonucleotide; TTC chr2 60551572 60551593 60551577 60551572 -
tgcgcctcccctcccctccgcc

SEQ ID NO: 210512 - DNA, 22 bp, Artificial Sequence
  Synthetic oligonucleotide; CTG chr2 60551570 60551591 60551575 60551570 -
cgcctcccctcccctccgccct

SEQ ID NO: 210513 - DNA, 22 bp, Artificial Sequence
  Synthetic oligonucleotide; CTC chr2 60551564 60551585 60551569 60551564 -
ccctcccctccgccctgggtac

SEQ ID NO: 210514 - DNA, 22 bp, Artificial Sequence
  Synthetic oligonucleotide; CTC chr2 60551559 60551580 60551564 60551559 -
ccctccgccctgggtactttct

SEQ ID NO: 210515 - DNA, 22 bp, Artificial Sequence
  Synthetic oligonucleotide; CTC chr2 60551554 60551575 60551559 60551554 -
cgccctgggtactttctcagac

SEQ ID NO: 210516 - DNA, 22 bp, Artificial Sequence
  Synthetic oligonucleotide; CTG chr2 60551547 60551568 60551552 60551547 -
ggtactttctcagacgtctctt

SEQ ID NO: 210517 - DNA, 22 bp, Artificial Sequence
  Synthetic oligonucleotide; CTT chr2 60551540 60551561 60551545 60551540 -
tctcagacgtctcttgtccaca

SEQ ID NO: 210518 - DNA, 22 bp, Artificial Sequence
  Synthetic oligonucleotide; TTT chr2 60551539 60551560 60551544 60551539 -
ctcagacgtctcttgtccacag

SEQ ID NO: 210519 - DNA, 22 bp, Artificial Sequence
  Synthetic oligonucleotide; TTC chr2 60551538 60551559 60551543 60551538 -
tcagacgtctcttgtccacagc

SEQ ID NO: 210520 - DNA, 22 bp, Artificial Sequence
  Synthetic oligonucleotide; CTC chr2 60551536 60551557 60551541 60551536 -
agacgtctcttgtccacagctc

SEQ ID NO: 210521 - DNA, 22 bp, Artificial Sequence
  Synthetic oligonucleotide; CTC chr2 60551527 60551548 60551532 60551527 -
ttgtccacagctcgggaccgcg

SEQ ID NO: 210522 - DNA, 22 bp, Artificial Sequence
  Synthetic oligonucleotide; CTT chr2 60551525 60551546 60551530 60551525 -
gtccacagctcgggaccgcgag

SEQ ID NO: 210523 - DNA, 22 bp, Artificial Sequence
  Synthetic oligonucleotide; TTG chr2 60551524 60551545 60551529 60551524 -
tccacagctcgggaccgcgagg

SEQ ID NO: 210524 - DNA, 22 bp, Artificial Sequence
  Synthetic oligonucleotide; CTC chr2 60551514 60551535 60551519 60551514 -
gggaccgcgaggaggtcaccac

SEQ ID NO: 210525 - DNA, 22 bp, Artificial Sequence
  Synthetic oligonucleotide; CTT chr2 60551486 60551507 60551491 60551486 -
tccctgcccaccccccaccccg

SEQ ID NO: 210526 - DNA, 22 bp, Artificial Sequence
  Synthetic oligonucleotide; TTT chr2 60551485 60551506 60551490 60551485 -
ccctgcccaccccccaccccgc

SEQ ID NO: 210527 - DNA, 22 bp, Artificial Sequence
  Synthetic oligonucleotide; TTC chr2 60551484 60551505 60551489 60551484 -
cctgcccaccccccaccccgcc

SEQ ID NO: 210528 - DNA, 22 bp, Artificial Sequence
  Synthetic oligonucleotide; CTG chr2 60551480 60551501 60551485 60551480 -
cccaccccccaccccgcccggt

SEQ ID NO: 210529 - DNA, 22 bp, Artificial Sequence
  Synthetic oligonucleotide; CTG chr2 60551455 60551476 60551460 60551455 -
gtcaccagtccccctgcgcccc

SEQ ID NO: 210530 - DNA, 22 bp, Artificial Sequence
  Synthetic oligonucleotide; CTG chr2 60551439 60551460 60551444 60551439 -
cgccccgagcacgactaggcca

SEQ ID NO: 210531 - DNA, 22 bp, Artificial Sequence
  Synthetic oligonucleotide; CTA chr2 60551422 60551443 60551427 60551422 -
ggccaggtggcggggttgccgg

SEQ ID NO: 210532 - DNA, 22 bp, Artificial Sequence
  Synthetic oligonucleotide; TTG chr2 60551404 60551425 60551409 60551404 -
ccggggaagggcaggggagaag

SEQ ID NO: 210533 - DNA, 22 bp, Artificial Sequence
  Synthetic oligonucleotide; TTT chr2 60551375 60551396 60551380 60551375 -
gagtgtgcattttaagggcgct

SEQ ID NO: 210534 - DNA, 22 bp, Artificial Sequence
  Synthetic oligonucleotide; TTG chr2 60551374 60551395 60551379 60551374 -
agtgtgcattttaagggcgctg

SEQ ID NO: 210535 - DNA, 22 bp, Artificial Sequence
  Synthetic oligonucleotide; TTT chr2 60551363 60551384 60551368 60551363 -
taagggcgctggatcctgggac

SEQ ID NO: 210536 - DNA, 22 bp, Artificial Sequence
  Synthetic oligonucleotide; TTT chr2 60551362 60551383 60551367 60551362 -
aagggcgctggatcctgggacc

SEQ ID NO: 210537 - DNA, 22 bp, Artificial Sequence
  Synthetic oligonucleotide; TTA chr2 60551361 60551382 60551366 60551361 -
agggcgctggatcctgggaccc

SEQ ID NO: 210538 - DNA, 22 bp, Artificial Sequence
  Synthetic oligonucleotide; CTG chr2 60551352 60551373 60551357 60551352 -
gatcctgggaccccgagcactt

SEQ ID NO: 210539 - DNA, 22 bp, Artificial Sequence
  Synthetic oligonucleotide; CTG chr2 60551345 60551366 60551350 60551345 -
ggaccccgagcacttcaccctt

SEQ ID NO: 210540 - DNA, 22 bp, Artificial Sequence
  Synthetic oligonucleotide; CTT chr2 60551330 60551351 60551335 60551330 -
caccctttgggtcttgccctct

SEQ ID NO: 210541 - DNA, 22 bp, Artificial Sequence
  Synthetic oligonucleotide; TTC chr2 60551329 60551350 60551334 60551329 -
accctttgggtcttgccctctt

SEQ ID NO: 210542 - DNA, 22 bp, Artificial Sequence
  Synthetic oligonucleotide; CTT chr2 60551323 60551344 60551328 60551323 -
tgggtcttgccctcttccccag

SEQ ID NO: 210543 - DNA, 22 bp, Artificial Sequence
  Synthetic oligonucleotide; TTT chr2 60551322 60551343 60551327 60551322 -
gggtcttgccctcttccccagg

SEQ ID NO: 210544 - DNA, 22 bp, Artificial Sequence
  Synthetic oligonucleotide; TTG chr2 60551321 60551342 60551326 60551321 -
ggtcttgccctcttccccaggc

SEQ ID NO: 210545 - DNA, 22 bp, Artificial Sequence
  Synthetic oligonucleotide; CTT chr2 60551315 60551336 60551320 60551315 -
gccctcttccccaggcctggct

SEQ ID NO: 210546 - DNA, 22 bp, Artificial Sequence
  Synthetic oligonucleotide; TTG chr2 60551314 60551335 60551319 60551314 -
ccctcttccccaggcctggctt

SEQ ID NO: 210547 - DNA, 22 bp, Artificial Sequence
  Synthetic oligonucleotide; CTC chr2 60551309 60551330 60551314 60551309 -
ttccccaggcctggcttggtct

SEQ ID NO: 210548 - DNA, 22 bp, Artificial Sequence
  Synthetic oligonucleotide; CTT chr2 60551307 60551328 60551312 60551307 -
ccccaggcctggcttggtctga

SEQ ID NO: 210549 - DNA, 22 bp, Artificial Sequence
  Synthetic oligonucleotide; TTC chr2 60551306 60551327 60551311 60551306 -
cccaggcctggcttggtctgag

SEQ ID NO: 210550 - DNA, 22 bp, Artificial Sequence
  Synthetic oligonucleotide; CTG chr2 60551296 60551317 60551301 60551296 -
gcttggtctgaggttcttgtga

SEQ ID NO: 210551 - DNA, 22 bp, Artificial Sequence
  Synthetic oligonucleotide; CTT chr2 60551292 60551313 60551297 60551292 -
ggtctgaggttcttgtgagtct

SEQ ID NO: 210552 - DNA, 22 bp, Artificial Sequence
  Synthetic oligonucleotide; TTG chr2 60551291 60551312 60551296 60551291 -
gtctgaggttcttgtgagtctg

SEQ ID NO: 210553 - DNA, 22 bp, Artificial Sequence
  Synthetic oligonucleotide; CTG chr2 60551286 60551307 60551291 60551286 -
aggttcttgtgagtctgtataa

SEQ ID NO: 210554 - DNA, 22 bp, Artificial Sequence
  Synthetic oligonucleotide; TTC chr2 60551280 60551301 60551285 60551280 -
ttgtgagtctgtataagagctg

SEQ ID NO: 210555 - DNA, 22 bp, Artificial Sequence
  Synthetic oligonucleotide; CTT chr2 60551278 60551299 60551283 60551278 -
gtgagtctgtataagagctggt

SEQ ID NO: 210556 - DNA, 22 bp, Artificial Sequence
  Synthetic oligonucleotide; TTG chr2 60551277 60551298 60551282 60551277 -
tgagtctgtataagagctggtg

SEQ ID NO: 210557 - DNA, 22 bp, Artificial Sequence
  Synthetic oligonucleotide; CTG chr2 60551269 60551290 60551274 60551269 -
tataagagctggtggtggtggc

SEQ ID NO: 210558 - DNA, 22 bp, Artificial Sequence
  Synthetic oligonucleotide; CTG chr2 60551258 60551279 60551263 60551258 -
gtggtggtggctgtctcccgct

SEQ ID NO: 210559 - DNA, 22 bp, Artificial Sequence
  Synthetic oligonucleotide; CTG chr2 60551245 60551266 60551250 60551245 -
tctcccgctgactgcgcctgga

SEQ ID NO: 210560 - DNA, 22 bp, Artificial Sequence
  Synthetic oligonucleotide; CTC chr2 60551241 60551262 60551246 60551241 -
ccgctgactgcgcctggaaagg

SEQ ID NO: 210561 - DNA, 22 bp, Artificial Sequence
  Synthetic oligonucleotide; CTG chr2 60551235 60551256 60551240 60551235 -
actgcgcctggaaaggcgggcg

SEQ ID NO: 210562 - DNA, 22 bp, Artificial Sequence
  Synthetic oligonucleotide; CTG chr2 60551231 60551252 60551236 60551231 -
cgcctggaaaggcgggcggtgg

SEQ ID NO: 210563 - DNA, 22 bp, Artificial Sequence
  Synthetic oligonucleotide; CTG chr2 60551225 60551246 60551230 60551225 -
gaaaggcgggcggtgggcactt

SEQ ID NO: 210564 - DNA, 22 bp, Artificial Sequence
  Synthetic oligonucleotide; CTT chr2 60551203 60551224 60551208 60551203 -
aggaaagtttggcagcaaggga

SEQ ID NO: 210565 - DNA, 22 bp, Artificial Sequence
  Synthetic oligonucleotide; TTA chr2 60551202 60551223 60551207 60551202 -
ggaaagtttggcagcaagggaa

SEQ ID NO: 210566 - DNA, 22 bp, Artificial Sequence
  Synthetic oligonucleotide; TTT chr2 60551193 60551214 60551198 60551193 -
ggcagcaagggaaagaaaggcg

SEQ ID NO: 210567 - DNA, 22 bp, Artificial Sequence
  Synthetic oligonucleotide; TTG chr2 60551192 60551213 60551197 60551192 -
gcagcaagggaaagaaaggcgt

SEQ ID NO: 210568 - DNA, 22 bp, Artificial Sequence
  Synthetic oligonucleotide; TTC chr2 60551156 60551177 60551161 60551156 -
cccccctactcaatttatgatt

SEQ ID NO: 210569 - DNA, 22 bp, Artificial Sequence
  Synthetic oligonucleotide; CTA chr2 60551148 60551169 60551153 60551148 -
ctcaatttatgattcttacttt

SEQ ID NO: 210570 - DNA, 22 bp, Artificial Sequence
  Synthetic oligonucleotide; CTC chr2 60551145 60551166 60551150 60551145 -
aatttatgattcttactttaaa

SEQ ID NO: 210571 - DNA, 22 bp, Artificial Sequence
  Synthetic oligonucleotide; TTT chr2 60551140 60551161 60551145 60551140 -
atgattcttactttaaattttt

SEQ ID NO: 210572 - DNA, 22 bp, Artificial Sequence
  Synthetic oligonucleotide; TTA chr2 60551139 60551160 60551144 60551139 -
tgattcttactttaaatttttg

SEQ ID NO: 210573 - DNA, 22 bp, Artificial Sequence
  Synthetic oligonucleotide; TTC chr2 60551133 60551154 60551138 60551133 -
ttactttaaatttttgatgcag

SEQ ID NO: 210574 - DNA, 22 bp, Artificial Sequence
  Synthetic oligonucleotide; CTT chr2 60551131 60551152 60551136 60551131 -
actttaaatttttgatgcagtt

SEQ ID NO: 210575 - DNA, 22 bp, Artificial Sequence
  Synthetic oligonucleotide; TTA chr2 60551130 60551151 60551135 60551130 -
ctttaaatttttgatgcagttt

SEQ ID NO: 210576 - DNA, 22 bp, Artificial Sequence
  Synthetic oligonucleotide; CTT chr2 60551127 60551148 60551132 60551127 -
taaatttttgatgcagttttaa

SEQ ID NO: 210577 - DNA, 22 bp, Artificial Sequence
  Synthetic oligonucleotide; TTT chr2 60551126 60551147 60551131 60551126 -
aaatttttgatgcagttttaaa

SEQ ID NO: 210578 - DNA, 22 bp, Artificial Sequence
  Synthetic oligonucleotide; TTA chr2 60551125 60551146 60551130 60551125 -
aatttttgatgcagttttaaag

SEQ ID NO: 210579 - DNA, 22 bp, Artificial Sequence
  Synthetic oligonucleotide; TTT chr2 60551120 60551141 60551125 60551120 -
ttgatgcagttttaaaggacca

SEQ ID NO: 210580 - DNA, 22 bp, Artificial Sequence
  Synthetic oligonucleotide; TTT chr2 60551119 60551140 60551124 60551119 -
tgatgcagttttaaaggaccac

SEQ ID NO: 210581 - DNA, 22 bp, Artificial Sequence
  Synthetic oligonucleotide; TTT chr2 60551118 60551139 60551123 60551118 -
gatgcagttttaaaggaccacc

SEQ ID NO: 210582 - DNA, 22 bp, Artificial Sequence
  Synthetic oligonucleotide; TTG chr2 60551117 60551138 60551122 60551117 -
atgcagttttaaaggaccacct

SEQ ID NO: 210583 - DNA, 22 bp, Artificial Sequence
  Synthetic oligonucleotide; TTT chr2 60551108 60551129 60551113 60551108 -
taaaggaccacctatacttggt

SEQ ID NO: 210584 - DNA, 22 bp, Artificial Sequence
  Synthetic oligonucleotide; TTT chr2 60551107 60551128 60551112 60551107 -
aaaggaccacctatacttggtt

SEQ ID NO: 210585 - DNA, 22 bp, Artificial Sequence
  Synthetic oligonucleotide; TTA chr2 60551106 60551127 60551111 60551106 -
aaggaccacctatacttggttc

SEQ ID NO: 210586 - DNA, 22 bp, Artificial Sequence
  Synthetic oligonucleotide; CTA chr2 60551094 60551115 60551099 60551094 -
tacttggttctgtgttttttta

SEQ ID NO: 210587 - DNA, 22 bp, Artificial Sequence
  Synthetic oligonucleotide; CTT chr2 60551089 60551110 60551094 60551089 -
ggttctgtgtttttttaaaggg

SEQ ID NO: 210588 - DNA, 22 bp, Artificial Sequence
  Synthetic oligonucleotide; TTG chr2 60551088 60551109 60551093 60551088 -
gttctgtgtttttttaaagggg

SEQ ID NO: 210589 - DNA, 22 bp, Artificial Sequence
  Synthetic oligonucleotide; TTC chr2 60551084 60551105 60551089 60551084 -
tgtgtttttttaaaggggtggt

SEQ ID NO: 210590 - DNA, 22 bp, Artificial Sequence
  Synthetic oligonucleotide; CTG chr2 60551082 60551103 60551087 60551082 -
tgtttttttaaaggggtggtgg

SEQ ID NO: 210591 - DNA, 22 bp, Artificial Sequence
  Synthetic oligonucleotide; TTT chr2 60551077 60551098 60551082 60551077 -
ttttaaaggggtggtggtgggg

SEQ ID NO: 210592 - DNA, 22 bp, Artificial Sequence
  Synthetic oligonucleotide; TTT chr2 60551076 60551097 60551081 60551076 -
tttaaaggggtggtggtggggg

SEQ ID NO: 210593 - DNA, 22 bp, Artificial Sequence
  Synthetic oligonucleotide; TTT chr2 60551075 60551096 60551080 60551075 -
ttaaaggggtggtggtgggggg

SEQ ID NO: 210594 - DNA, 22 bp, Artificial Sequence
  Synthetic oligonucleotide; TTT chr2 60551074 60551095 60551079 60551074 -
taaaggggtggtggtggggggt

SEQ ID NO: 210595 - DNA, 22 bp, Artificial Sequence
  Synthetic oligonucleotide; TTT chr2 60551073 60551094 60551078 60551073 -
aaaggggtggtggtggggggtg

SEQ ID NO: 210596 - DNA, 22 bp, Artificial Sequence
  Synthetic oligonucleotide; TTA chr2 60551072 60551093 60551077 60551072 -
aaggggtggtggtggggggtgc

SEQ ID NO: 210597 - DNA, 22 bp, Artificial Sequence
  Synthetic oligonucleotide; TTT chr2 60551037 60551058 60551042 60551037 -
aatttttcactgggccctggaa

SEQ ID NO: 210598 - DNA, 22 bp, Artificial Sequence
  Synthetic oligonucleotide; TTA chr2 60551036 60551057 60551041 60551036 -
atttttcactgggccctggaac

SEQ ID NO: 210599 - DNA, 22 bp, Artificial Sequence
  Synthetic oligonucleotide; TTT chr2 60551032 60551053 60551037 60551032 -
ttcactgggccctggaacttgt

SEQ ID NO: 210600 - DNA, 22 bp, Artificial Sequence
  Synthetic oligonucleotide; TTT chr2 60551031 60551052 60551036 60551031 -
tcactgggccctggaacttgtc

SEQ ID NO: 210601 - DNA, 22 bp, Artificial Sequence
  Synthetic oligonucleotide; TTT chr2 60551030 60551051 60551035 60551030 -
cactgggccctggaacttgtca

SEQ ID NO: 210602 - DNA, 22 bp, Artificial Sequence
  Synthetic oligonucleotide; TTC chr2 60551029 60551050 60551034 60551029 -
actgggccctggaacttgtcac

SEQ ID NO: 210603 - DNA, 22 bp, Artificial Sequence
  Synthetic oligonucleotide; CTG chr2 60551025 60551046 60551030 60551025 -
ggccctggaacttgtcacacac

SEQ ID NO: 210604 - DNA, 22 bp, Artificial Sequence
  Synthetic oligonucleotide; CTG chr2 60551018 60551039 60551023 60551018 -
gaacttgtcacacacttcggaa

SEQ ID NO: 210605 - DNA, 22 bp, Artificial Sequence
  Synthetic oligonucleotide; CTT chr2 60551012 60551033 60551017 60551012 -
gtcacacacttcggaagctccc

SEQ ID NO: 210606 - DNA, 22 bp, Artificial Sequence
  Synthetic oligonucleotide; TTG chr2 60551011 60551032 60551016 60551011 -
tcacacacttcggaagctcccc

SEQ ID NO: 210607 - DNA, 22 bp, Artificial Sequence
  Synthetic oligonucleotide; CTT chr2 60551001 60551022 60551006 60551001 -
cggaagctcccccaccccggca

SEQ ID NO: 210608 - DNA, 22 bp, Artificial Sequence
  Synthetic oligonucleotide; TTC chr2 60551000 60551021 60551005 60551000 -
ggaagctcccccaccccggcac

SEQ ID NO: 210609 - DNA, 22 bp, Artificial Sequence
  Synthetic oligonucleotide; CTC chr2 60550992 60551013 60550997 60550992 -
ccccaccccggcacgttgcgcg

SEQ ID NO: 210610 - DNA, 22 bp, Artificial Sequence
  Synthetic oligonucleotide; TTG chr2 60550974 60550995 60550979 60550974 -
cgcggccctccctctccccacc

SEQ ID NO: 210611 - DNA, 22 bp, Artificial Sequence
  Synthetic oligonucleotide; CTC chr2 60550964 60550985 60550969 60550964 -
cctctccccaccccctcgcatc

SEQ ID NO: 210612 - DNA, 22 bp, Artificial Sequence
  Synthetic oligonucleotide; CTC chr2 60550960 60550981 60550965 60550960 -
tccccaccccctcgcatccctc

SEQ ID NO: 210613 - DNA, 22 bp, Artificial Sequence
  Synthetic oligonucleotide; CTC chr2 60550958 60550979 60550963 60550958 -
cccaccccctcgcatccctccc

SEQ ID NO: 210614 - DNA, 22 bp, Artificial Sequence
  Synthetic oligonucleotide; CTC chr2 60550947 60550968 60550952 60550947 -
gcatccctccctcgccgctctc

SEQ ID NO: 210615 - DNA, 22 bp, Artificial Sequence
  Synthetic oligonucleotide; CTC chr2 60550938 60550959 60550943 60550938 -
cctcgccgctctcccccgcccc

SEQ ID NO: 210616 - DNA, 22 bp, Artificial Sequence
  Synthetic oligonucleotide; CTC chr2 60550934 60550955 60550939 60550934 -
gccgctctcccccgcccccaac

SEQ ID NO: 210617 - DNA, 22 bp, Artificial Sequence
  Synthetic oligonucleotide; CTC chr2 60550927 60550948 60550932 60550927 -
tcccccgcccccaactcccccg

SEQ ID NO: 210618 - DNA, 22 bp, Artificial Sequence
  Synthetic oligonucleotide; CTC chr2 60550925 60550946 60550930 60550925 -
ccccgcccccaactcccccggc

SEQ ID NO: 210619 - DNA, 22 bp, Artificial Sequence
  Synthetic oligonucleotide; CTC chr2 60550910 60550931 60550915 60550910 -
ccccggccgcgccggatgcgga

SEQ ID NO: 210620 - DNA, 22 bp, Artificial Sequence
  Synthetic oligonucleotide; TTA chr2 60550858 60550879 60550863 60550858 -
cagcccggccaggtaccggcgg

SEQ ID NO: 210621 - DNA, 22 bp, Artificial Sequence
  Synthetic oligonucleotide; TTC chr2 60550818 60550839 60550823 60550818 -
gcaggactcgggaaagtcaggc

SEQ ID NO: 210622 - DNA, 22 bp, Artificial Sequence
  Synthetic oligonucleotide; CTC chr2 60550809 60550830 60550814 60550809 -
gggaaagtcaggcccttcttcg

SEQ ID NO: 210623 - DNA, 22 bp, Artificial Sequence
  Synthetic oligonucleotide; CTT chr2 60550792 60550813 60550797 60550792 -
cttcggaaggatgcagtggggg

SEQ ID NO: 210624 - DNA, 22 bp, Artificial Sequence
  Synthetic oligonucleotide; TTC chr2 60550791 60550812 60550796 60550791 -
ttcggaaggatgcagtgggggc

SEQ ID NO: 210625 - DNA, 22 bp, Artificial Sequence
  Synthetic oligonucleotide; CTT chr2 60550789 60550810 60550794 60550789 -
cggaaggatgcagtgggggctc

SEQ ID NO: 210626 - DNA, 22 bp, Artificial Sequence
  Synthetic oligonucleotide; TTC chr2 60550788 60550809 60550793 60550788 -
ggaaggatgcagtgggggctca

SEQ ID NO: 210627 - DNA, 22 bp, Artificial Sequence
  Synthetic oligonucleotide; CTC chr2 60550767 60550788 60550772 60550767 -
aaaggacagaccggggcgcgca

SEQ ID NO: 210628 - DNA, 22 bp, Artificial Sequence
  Synthetic oligonucleotide; CTG chr2 60550735 60550756 60550740 60550735 -
ctccctcgtacccctctccctc

SEQ ID NO: 210629 - DNA, 22 bp, Artificial Sequence
  Synthetic oligonucleotide; CTC chr2 60550732 60550753 60550737 60550732 -
cctcgtacccctctccctcctg

SEQ ID NO: 210630 - DNA, 22 bp, Artificial Sequence
  Synthetic oligonucleotide; CTC chr2 60550728 60550749 60550733 60550728 -
gtacccctctccctcctgggtc

SEQ ID NO: 210631 - DNA, 22 bp, Artificial Sequence
  Synthetic oligonucleotide; CTC chr2 60550719 60550740 60550724 60550719 -
tccctcctgggtccatcttggg

SEQ ID NO: 210632 - DNA, 22 bp, Artificial Sequence
  Synthetic oligonucleotide; CTC chr2 60550717 60550738 60550722 60550717 -
cctcctgggtccatcttgggac

SEQ ID NO: 210633 - DNA, 22 bp, Artificial Sequence
  Synthetic oligonucleotide; CTC chr2 60550713 60550734 60550718 60550713 -
ctgggtccatcttgggacactc

SEQ ID NO: 210634 - DNA, 22 bp, Artificial Sequence
  Synthetic oligonucleotide; CTG chr2 60550710 60550731 60550715 60550710 -
ggtccatcttgggacactctag

SEQ ID NO: 210635 - DNA, 22 bp, Artificial Sequence
  Synthetic oligonucleotide; CTT chr2 60550700 60550721 60550705 60550700 -
gggacactctaggctgggaggg

SEQ ID NO: 210636 - DNA, 22 bp, Artificial Sequence
  Synthetic oligonucleotide; TTG chr2 60550699 60550720 60550704 60550699 -
ggacactctaggctgggagggt

SEQ ID NO: 210637 - DNA, 22 bp, Artificial Sequence
  Synthetic oligonucleotide; CTC chr2 60550691 60550712 60550696 60550691 -
taggctgggagggttagtaccc

SEQ ID NO: 210638 - DNA, 22 bp, Artificial Sequence
  Synthetic oligonucleotide; CTA chr2 60550689 60550710 60550694 60550689 -
ggctgggagggttagtaccccc

SEQ ID NO: 210639 - DNA, 22 bp, Artificial Sequence
  Synthetic oligonucleotide; CTG chr2 60550684 60550705 60550689 60550684 -
ggagggttagtaccccctcctc

SEQ ID NO: 210640 - DNA, 22 bp, Artificial Sequence
  Synthetic oligonucleotide; TTA chr2 60550675 60550696 60550680 60550675 -
gtaccccctcctcctgtcccgg

SEQ ID NO: 210641 - DNA, 22 bp, Artificial Sequence
  Synthetic oligonucleotide; CTC chr2 60550665 60550686 60550670 60550665 -
ctcctgtcccggggttaaaggg

SEQ ID NO: 210642 - DNA, 22 bp, Artificial Sequence
  Synthetic oligonucleotide; CTC chr2 60550662 60550683 60550667 60550662 -
ctgtcccggggttaaagggcca

SEQ ID NO: 210643 - DNA, 22 bp, Artificial Sequence
  Synthetic oligonucleotide; CTG chr2 60550659 60550680 60550664 60550659 -
tcccggggttaaagggccagtt

SEQ ID NO: 210644 - DNA, 22 bp, Artificial Sequence
  Synthetic oligonucleotide; TTA chr2 60550648 60550669 60550653 60550648 -
aagggccagtttgggagggggt

SEQ ID NO: 210645 - DNA, 22 bp, Artificial Sequence
  Synthetic oligonucleotide; TTT chr2 60550636 60550657 60550641 60550636 -
gggagggggtgagggggccact

SEQ ID NO: 210646 - DNA, 22 bp, Artificial Sequence
  Synthetic oligonucleotide; TTG chr2 60550635 60550656 60550640 60550635 -
ggagggggtgagggggccactt

SEQ ID NO: 210647 - DNA, 22 bp, Artificial Sequence
  Synthetic oligonucleotide; CTT chr2 60550613 60550634 60550618 60550613 -
ctttctgtcctcattttctggg

SEQ ID NO: 210648 - DNA, 22 bp, Artificial Sequence
  Synthetic oligonucleotide; TTC chr2 60550612 60550633 60550617 60550612 -
tttctgtcctcattttctgggt

SEQ ID NO: 210649 - DNA, 22 bp, Artificial Sequence
  Synthetic oligonucleotide; CTT chr2 60550610 60550631 60550615 60550610 -
tctgtcctcattttctgggtgc

SEQ ID NO: 210650 - DNA, 22 bp, Artificial Sequence
  Synthetic oligonucleotide; TTT chr2 60550609 60550630 60550614 60550609 -
ctgtcctcattttctgggtgct

SEQ ID NO: 210651 - DNA, 22 bp, Artificial Sequence
  Synthetic oligonucleotide; TTC chr2 60550608 60550629 60550613 60550608 -
tgtcctcattttctgggtgctc

SEQ ID NO: 210652 - DNA, 22 bp, Artificial Sequence
  Synthetic oligonucleotide; CTG chr2 60550606 60550627 60550611 60550606 -
tcctcattttctgggtgctcag

SEQ ID NO: 210653 - DNA, 22 bp, Artificial Sequence
  Synthetic oligonucleotide; CTC chr2 60550601 60550622 60550606 60550601 -
attttctgggtgctcagagggg

SEQ ID NO: 210654 - DNA, 22 bp, Artificial Sequence
  Synthetic oligonucleotide; TTT chr2 60550597 60550618 60550602 60550597 -
tctgggtgctcagagggggcag

SEQ ID NO: 210655 - DNA, 22 bp, Artificial Sequence
  Synthetic oligonucleotide; TTT chr2 60550596 60550617 60550601 60550596 -
ctgggtgctcagagggggcagg

SEQ ID NO: 210656 - DNA, 22 bp, Artificial Sequence
  Synthetic oligonucleotide; TTC chr2 60550595 60550616 60550600 60550595 -
tgggtgctcagagggggcagga

SEQ ID NO: 210657 - DNA, 22 bp, Artificial Sequence
  Synthetic oligonucleotide; CTG chr2 60550593 60550614 60550598 60550593 -
ggtgctcagagggggcaggagc

SEQ ID NO: 210658 - DNA, 22 bp, Artificial Sequence
  Synthetic oligonucleotide; CTC chr2 60550586 60550607 60550591 60550586 -
agagggggcaggagccatcccg

SEQ ID NO: 210659 - DNA, 22 bp, Artificial Sequence
  Synthetic oligonucleotide; CTC chr2 60550558 60550579 60550563 60550558 -
agtaccacccccccgccccccg

SEQ ID NO: 210660 - DNA, 22 bp, Artificial Sequence
  Synthetic oligonucleotide; CTC chr2 60550532 60550553 60550537 60550532 -
tgctatgtgggctgaatgagcc

SEQ ID NO: 210661 - DNA, 22 bp, Artificial Sequence
  Synthetic oligonucleotide; CTG chr2 60550530 60550551 60550535 60550530 -
ctatgtgggctgaatgagccat

SEQ ID NO: 210662 - DNA, 22 bp, Artificial Sequence
  Synthetic oligonucleotide; CTA chr2 60550527 60550548 60550532 60550527 -
tgtgggctgaatgagccattcg

SEQ ID NO: 210663 - DNA, 22 bp, Artificial Sequence
  Synthetic oligonucleotide; CTG chr2 60550518 60550539 60550523 60550518 -
aatgagccattcggtcgctagg

SEQ ID NO: 210664 - DNA, 22 bp, Artificial Sequence
  Synthetic oligonucleotide; TTC chr2 60550506 60550527 60550511 60550506 -
ggtcgctaggaggcagaacaag

SEQ ID NO: 210665 - DNA, 22 bp, Artificial Sequence
  Synthetic oligonucleotide; CTA chr2 60550498 60550519 60550503 60550498 -
ggaggcagaacaagatcaagaa

SEQ ID NO: 210666 - DNA, 22 bp, Artificial Sequence
  Synthetic oligonucleotide; CTC chr2 60550471 60550492 60550476 60550471 -
agcgaacttgaacctgtaccag

SEQ ID NO: 210667 - DNA, 22 bp, Artificial Sequence
  Synthetic oligonucleotide; CTT chr2 60550462 60550483 60550467 60550462 -
gaacctgtaccagagcctcccc

SEQ ID NO: 210668 - DNA, 22 bp, Artificial Sequence
  Synthetic oligonucleotide; TTG chr2 60550461 60550482 60550466 60550461 -
aacctgtaccagagcctccccc

SEQ ID NO: 210669 - DNA, 22 bp, Artificial Sequence
  Synthetic oligonucleotide; CTG chr2 60550455 60550476 60550460 60550455 -
taccagagcctcccccacctcc

SEQ ID NO: 210670 - DNA, 22 bp, Artificial Sequence
  Synthetic oligonucleotide; CTC chr2 60550443 60550464 60550448 60550443 -
ccccacctcctgcccggcgatt

SEQ ID NO: 210671 - DNA, 22 bp, Artificial Sequence
  Synthetic oligonucleotide; CTC chr2 60550434 60550455 60550439 60550434 -
ctgcccggcgattctcgtccgg

SEQ ID NO: 210672 - DNA, 22 bp, Artificial Sequence
  Synthetic oligonucleotide; CTG chr2 60550431 60550452 60550436 60550431 -
cccggcgattctcgtccgggga

SEQ ID NO: 210673 - DNA, 22 bp, Artificial Sequence
  Synthetic oligonucleotide; TTC chr2 60550420 60550441 60550425 60550420 -
tcgtccggggaggaacgagctt

SEQ ID NO: 210674 - DNA, 22 bp, Artificial Sequence
  Synthetic oligonucleotide; CTC chr2 60550418 60550439 60550423 60550418 -
gtccggggaggaacgagctttg

SEQ ID NO: 210675 - DNA, 22 bp, Artificial Sequence
  Synthetic oligonucleotide; CTT chr2 60550398 60550419 60550403 60550398 -
tgcgagggtgggggtgggggga

SEQ ID NO: 210676 - DNA, 22 bp, Artificial Sequence
  Synthetic oligonucleotide; TTT chr2 60550397 60550418 60550402 60550397 -
gcgagggtgggggtggggggaa

SEQ ID NO: 210677 - DNA, 22 bp, Artificial Sequence
  Synthetic oligonucleotide; TTG chr2 60550396 60550417 60550401 60550396 -
cgagggtgggggtggggggaaa

SEQ ID NO: 210678 - DNA, 22 bp, Artificial Sequence
  Synthetic oligonucleotide; TTA chr2 60550365 60550386 60550370 60550365 -
ggcagaattccctttctctccc

SEQ ID NO: 210679 - DNA, 22 bp, Artificial Sequence
  Synthetic oligonucleotide; TTC chr2 60550355 60550376 60550360 60550355 -
cctttctctcccccatcacccc

SEQ ID NO: 210680 - DNA, 22 bp, Artificial Sequence
  Synthetic oligonucleotide; CTT chr2 60550351 60550372 60550356 60550351 -
tctctcccccatcaccccgtat

SEQ ID NO: 210681 - DNA, 22 bp, Artificial Sequence
  Synthetic oligonucleotide; TTT chr2 60550350 60550371 60550355 60550350 -
ctctcccccatcaccccgtatg

SEQ ID NO: 210682 - DNA, 22 bp, Artificial Sequence
  Synthetic oligonucleotide; TTC chr2 60550349 60550370 60550354 60550349 -
tctcccccatcaccccgtatgt

SEQ ID NO: 210683 - DNA, 22 bp, Artificial Sequence
  Synthetic oligonucleotide; CTC chr2 60550347 60550368 60550352 60550347 -
tcccccatcaccccgtatgtct

SEQ ID NO: 210684 - DNA, 22 bp, Artificial Sequence
  Synthetic oligonucleotide; CTC chr2 60550345 60550366 60550350 60550345 -
ccccatcaccccgtatgtcttt

SEQ ID NO: 210685 - DNA, 22 bp, Artificial Sequence
  Synthetic oligonucleotide; CTT chr2 60550324 60550345 60550329 60550324 -
tgttcttcattttgactttaaa

SEQ ID NO: 210686 - DNA, 22 bp, Artificial Sequence
  Synthetic oligonucleotide; TTT chr2 60550323 60550344 60550328 60550323 -
gttcttcattttgactttaaaa

SEQ ID NO: 210687 - DNA, 22 bp, Artificial Sequence
  Synthetic oligonucleotide; TTG chr2 60550322 60550343 60550327 60550322 -
ttcttcattttgactttaaaaa

SEQ ID NO: 210688 - DNA, 22 bp, Artificial Sequence
  Synthetic oligonucleotide; TTC chr2 60550319 60550340 60550324 60550319 -
ttcattttgactttaaaaatgc

SEQ ID NO: 210689 - DNA, 22 bp, Artificial Sequence
  Synthetic oligonucleotide; CTT chr2 60550317 60550338 60550322 60550317 -
cattttgactttaaaaatgctt

SEQ ID NO: 210690 - DNA, 22 bp, Artificial Sequence
  Synthetic oligonucleotide; TTC chr2 60550316 60550337 60550321 60550316 -
attttgactttaaaaatgcttc

SEQ ID NO: 210691 - DNA, 22 bp, Artificial Sequence
  Synthetic oligonucleotide; TTT chr2 60550312 60550333 60550317 60550312 -
tgactttaaaaatgcttctggc

SEQ ID NO: 210692 - DNA, 22 bp, Artificial Sequence
  Synthetic oligonucleotide; TTT chr2 60550311 60550332 60550316 60550311 -
gactttaaaaatgcttctggcc

SEQ ID NO: 210693 - DNA, 22 bp, Artificial Sequence
  Synthetic oligonucleotide; TTG chr2 60550310 60550331 60550315 60550310 -
actttaaaaatgcttctggccg

SEQ ID NO: 210694 - DNA, 22 bp, Artificial Sequence
  Synthetic oligonucleotide; CTT chr2 60550306 60550327 60550311 60550306 -
taaaaatgcttctggccggggc

SEQ ID NO: 210695 - DNA, 22 bp, Artificial Sequence
  Synthetic oligonucleotide; TTT chr2 60550305 60550326 60550310 60550305 -
aaaaatgcttctggccggggcc

SEQ ID NO: 210696 - DNA, 22 bp, Artificial Sequence
  Synthetic oligonucleotide; TTA chr2 60550304 60550325 60550309 60550304 -
aaaatgcttctggccggggccg

SEQ ID NO: 210697 - DNA, 22 bp, Artificial Sequence
  Synthetic oligonucleotide; CTT chr2 60550295 60550316 60550300 60550295 -
ctggccggggccgcggagaagc

SEQ ID NO: 210698 - DNA, 22 bp, Artificial Sequence
  Synthetic oligonucleotide; TTC chr2 60550294 60550315 60550299 60550294 -
tggccggggccgcggagaagcg

SEQ ID NO: 210699 - DNA, 22 bp, Artificial Sequence
  Synthetic oligonucleotide; CTG chr2 60550292 60550313 60550297 60550292 -
gccggggccgcggagaagcgac

SEQ ID NO: 210700 - DNA, 22 bp, Artificial Sequence
  Synthetic oligonucleotide; CTG chr2 60550236 60550257 60550241 60550236 -
agaccagcgcgcgccgggctcg

SEQ ID NO: 210701 - DNA, 22 bp, Artificial Sequence
  Synthetic oligonucleotide; CTC chr2 60550215 60550236 60550220 60550215 -
ggagcacggtgcagttttcgct

SEQ ID NO: 210702 - DNA, 22 bp, Artificial Sequence
  Synthetic oligonucleotide; TTT chr2 60550198 60550219 60550203 60550198 -
tcgctttctttcggggccggca

SEQ ID NO: 210703 - DNA, 22 bp, Artificial Sequence
  Synthetic oligonucleotide; TTT chr2 60550197 60550218 60550202 60550197 -
cgctttctttcggggccggcat

SEQ ID NO: 210704 - DNA, 22 bp, Artificial Sequence
  Synthetic oligonucleotide; TTC chr2 60550196 60550217 60550201 60550196 -
gctttctttcggggccggcatt

SEQ ID NO: 210705 - DNA, 22 bp, Artificial Sequence
  Synthetic oligonucleotide; CTT chr2 60550192 60550213 60550197 60550192 -
tctttcggggccggcatttttg

SEQ ID NO: 210706 - DNA, 22 bp, Artificial Sequence
  Synthetic oligonucleotide; TTT chr2 60550191 60550212 60550196 60550191 -
ctttcggggccggcatttttgg

SEQ ID NO: 210707 - DNA, 22 bp, Artificial Sequence
  Synthetic oligonucleotide; TTC chr2 60550190 60550211 60550195 60550190 -
tttcggggccggcatttttggt

SEQ ID NO: 210708 - DNA, 22 bp, Artificial Sequence
  Synthetic oligonucleotide; CTT chr2 60550188 60550209 60550193 60550188 -
tcggggccggcatttttggtag

SEQ ID NO: 210709 - DNA, 22 bp, Artificial Sequence
  Synthetic oligonucleotide; TTT chr2 60550187 60550208 60550192 60550187 -
cggggccggcatttttggtagg

SEQ ID NO: 210710 - DNA, 22 bp, Artificial Sequence
  Synthetic oligonucleotide; TTC chr2 60550186 60550207 60550191 60550186 -
ggggccggcatttttggtaggg

SEQ ID NO: 210711 - DNA, 22 bp, Artificial Sequence
  Synthetic oligonucleotide; TTT chr2 60550173 60550194 60550178 60550173 -
ttggtagggaggaaccgggagt

SEQ ID NO: 210712 - DNA, 22 bp, Artificial Sequence
  Synthetic oligonucleotide; TTT chr2 60550172 60550193 60550177 60550172 -
tggtagggaggaaccgggagtg

SEQ ID NO: 210713 - DNA, 22 bp, Artificial Sequence
  Synthetic oligonucleotide; TTT chr2 60550171 60550192 60550176 60550171 -
ggtagggaggaaccgggagtgc

SEQ ID NO: 210714 - DNA, 22 bp, Artificial Sequence
  Synthetic oligonucleotide; TTG chr2 60550170 60550191 60550175 60550170 -
gtagggaggaaccgggagtgcg

SEQ ID NO: 210715 - DNA, 22 bp, Artificial Sequence
  Synthetic oligonucleotide; CTC chr2 60550143 60550164 60550148 60550143 -
tagggcttcggggcatggccga

SEQ ID NO: 210716 - DNA, 22 bp, Artificial Sequence
  Synthetic oligonucleotide; CTA chr2 60550141 60550162 60550146 60550141 -
gggcttcggggcatggccgaag

SEQ ID NO: 210717 - DNA, 22 bp, Artificial Sequence
  Synthetic oligonucleotide; CTT chr2 60550135 60550156 60550140 60550135 -
cggggcatggccgaagaggggg

SEQ ID NO: 210718 - DNA, 22 bp, Artificial Sequence
  Synthetic oligonucleotide; TTC chr2 60550134 60550155 60550139 60550134 -
ggggcatggccgaagaggggga

SEQ ID NO: 210719 - DNA, 22 bp, Artificial Sequence
  Synthetic oligonucleotide; TTT chr2 60550100 60550121 60550105 60550100 -
gcacttggtctccagcctcact

SEQ ID NO: 210720 - DNA, 22 bp, Artificial Sequence
  Synthetic oligonucleotide; TTG chr2 60550099 60550120 60550104 60550099 -
cacttggtctccagcctcactt

SEQ ID NO: 210721 - DNA, 22 bp, Artificial Sequence
  Synthetic oligonucleotide; CTT chr2 60550094 60550115 60550099 60550094 -
ggtctccagcctcacttcttcc

SEQ ID NO: 210722 - DNA, 22 bp, Artificial Sequence
  Synthetic oligonucleotide; TTG chr2 60550093 60550114 60550098 60550093 -
gtctccagcctcacttcttcca

SEQ ID NO: 210723 - DNA, 22 bp, Artificial Sequence
  Synthetic oligonucleotide; CTC chr2 60550088 60550109 60550093 60550088 -
cagcctcacttcttccaccccc

SEQ ID NO: 210724 - DNA, 22 bp, Artificial Sequence
  Synthetic oligonucleotide; CTC chr2 60550081 60550102 60550086 60550081 -
acttcttccaccccctcacccc

SEQ ID NO: 210725 - DNA, 22 bp, Artificial Sequence
  Synthetic oligonucleotide; CTT chr2 60550077 60550098 60550082 60550077 -
cttccaccccctcacccccatg

SEQ ID NO: 210726 - DNA, 22 bp, Artificial Sequence
  Synthetic oligonucleotide; TTC chr2 60550076 60550097 60550081 60550076 -
ttccaccccctcacccccatgc

SEQ ID NO: 210727 - DNA, 22 bp, Artificial Sequence
  Synthetic oligonucleotide; CTT chr2 60550074 60550095 60550079 60550074 -
ccaccccctcacccccatgcaa

SEQ ID NO: 210728 - DNA, 22 bp, Artificial Sequence
  Synthetic oligonucleotide; TTC chr2 60550073 60550094 60550078 60550073 -
caccccctcacccccatgcaaa

SEQ ID NO: 210729 - DNA, 22 bp, Artificial Sequence
  Synthetic oligonucleotide; CTC chr2 60550064 60550085 60550069 60550064 -
acccccatgcaaagcacagacc

SEQ ID NO: 210730 - DNA, 22 bp, Artificial Sequence
  Synthetic oligonucleotide; CTC chr2 60550040 60550061 60550045 60550040 -
ggtggcctcggctggcttgctg

SEQ ID NO: 210731 - DNA, 22 bp, Artificial Sequence
  Synthetic oligonucleotide; CTC chr2 60550031 60550052 60550036 60550031 -
ggctggcttgctgggcggctct

SEQ ID NO: 210732 - DNA, 22 bp, Artificial Sequence
  Synthetic oligonucleotide; CTG chr2 60550026 60550047 60550031 60550026 -
gcttgctgggcggctctgcagc

SEQ ID NO: 210733 - DNA, 22 bp, Artificial Sequence
  Synthetic oligonucleotide; CTT chr2 60550022 60550043 60550027 60550022 -
gctgggcggctctgcagcccga

SEQ ID NO: 210734 - DNA, 22 bp, Artificial Sequence
  Synthetic oligonucleotide; TTG chr2 60550021 60550042 60550026 60550021 -
ctgggcggctctgcagcccgac

SEQ ID NO: 210735 - DNA, 22 bp, Artificial Sequence
  Synthetic oligonucleotide; CTG chr2 60550018 60550039 60550023 60550018 -
ggcggctctgcagcccgacacc

SEQ ID NO: 210736 - DNA, 22 bp, Artificial Sequence
  Synthetic oligonucleotide; CTC chr2 60550010 60550031 60550015 60550010 -
tgcagcccgacaccccccctct

SEQ ID NO: 210737 - DNA, 22 bp, Artificial Sequence
  Synthetic oligonucleotide; CTG chr2 60550008 60550029 60550013 60550008 -
cagcccgacaccccccctctcg

SEQ ID NO: 210738 - DNA, 22 bp, Artificial Sequence
  Synthetic oligonucleotide; CTC chr2 60549989 60550010 60549994 60549989 -
tcgcctcggagctcggaatcac

SEQ ID NO: 210739 - DNA, 22 bp, Artificial Sequence
  Synthetic oligonucleotide; CTC chr2 60549987 60550008 60549992 60549987 -
gcctcggagctcggaatcacaa

SEQ ID NO: 210740 - DNA, 22 bp, Artificial Sequence
  Synthetic oligonucleotide; CTC chr2 60549982 60550003 60549987 60549982 -
ggagctcggaatcacaacaata

SEQ ID NO: 210741 - DNA, 22 bp, Artificial Sequence
  Synthetic oligonucleotide; CTC chr2 60549975 60549996 60549980 60549975 -
ggaatcacaacaatagtaatag

SEQ ID NO: 210742 - DNA, 22 bp, Artificial Sequence
  Synthetic oligonucleotide; TTA chr2 60549950 60549971 60549955 60549950 -
tcatcataatgatgcgggcagg

SEQ ID NO: 210743 - DNA, 22 bp, Artificial Sequence
  Synthetic oligonucleotide; TTA chr2 60549917 60549938 60549922 60549917 -
ataatgaataaccgcagccgcc

SEQ ID NO: 210744 - DNA, 22 bp, Artificial Sequence
  Synthetic oligonucleotide; TTG chr2 60549868 60549889 60549873 60549868 -
cgggggaaatgcatttgcagag

SEQ ID NO: 210745 - DNA, 22 bp, Artificial Sequence
  Synthetic oligonucleotide; TTT chr2 60549852 60549873 60549857 60549852 -
gcagagatcccccaaagtaaaa

SEQ ID NO: 210746 - DNA, 22 bp, Artificial Sequence
  Synthetic oligonucleotide; TTG chr2 60549851 60549872 60549856 60549851 -
cagagatcccccaaagtaaaaa

SEQ ID NO: 210747 - DNA, 22 bp, Artificial Sequence
  Synthetic oligonucleotide; CTT chr2 60549819 60549840 60549824 60549819 -
gtggacacagaatgaatctcag

SEQ ID NO: 210748 - DNA, 22 bp, Artificial Sequence
  Synthetic oligonucleotide; TTG chr2 60549818 60549839 60549823 60549818 -
tggacacagaatgaatctcagg

SEQ ID NO: 210749 - DNA, 22 bp, Artificial Sequence
  Synthetic oligonucleotide; CTC chr2 60549799 60549820 60549804 60549799 -
aggacccgcgcttgaggtgtgt

SEQ ID NO: 210750 - DNA, 22 bp, Artificial Sequence
  Synthetic oligonucleotide; CTT chr2 60549786 60549807 60549791 60549786 -
gaggtgtgtgcggagatactga

SEQ ID NO: 210751 - DNA, 22 bp, Artificial Sequence
  Synthetic oligonucleotide; TTG chr2 60549785 60549806 60549790 60549785 -
aggtgtgtgcggagatactgag

SEQ ID NO: 210752 - DNA, 22 bp, Artificial Sequence
  Synthetic oligonucleotide; CTG chr2 60549765 60549786 60549770 60549765 -
agactgcaccaggttaaccagc

SEQ ID NO: 210753 - DNA, 22 bp, Artificial Sequence
  Synthetic oligonucleotide; CTG chr2 60549759 60549780 60549764 60549759 -
caccaggttaaccagccgggtt

SEQ ID NO: 210754 - DNA, 22 bp, Artificial Sequence
  Synthetic oligonucleotide; TTA chr2 60549749 60549770 60549754 60549749 -
accagccgggttttccaaacct

SEQ ID NO: 210755 - DNA, 22 bp, Artificial Sequence
  Synthetic oligonucleotide; TTT chr2 60549736 60549757 60549741 60549736 -
tccaaacctcacttcctttttc

SEQ ID NO: 210756 - DNA, 22 bp, Artificial Sequence
  Synthetic oligonucleotide; TTT chr2 60549735 60549756 60549740 60549735 -
ccaaacctcacttcctttttca

SEQ ID NO: 210757 - DNA, 22 bp, Artificial Sequence
  Synthetic oligonucleotide; TTC chr2 60549734 60549755 60549739 60549734 -
caaacctcacttcctttttcac

SEQ ID NO: 210758 - DNA, 22 bp, Artificial Sequence
  Synthetic oligonucleotide; CTC chr2 60549726 60549747 60549731 60549726 -
acttcctttttcaccaactggc

SEQ ID NO: 210759 - DNA, 22 bp, Artificial Sequence
  Synthetic oligonucleotide; CTT chr2 60549722 60549743 60549727 60549722 -
cctttttcaccaactggcaggc

SEQ ID NO: 210760 - DNA, 22 bp, Artificial Sequence
  Synthetic oligonucleotide; TTC chr2 60549721 60549742 60549726 60549721 -
ctttttcaccaactggcaggcc

SEQ ID NO: 210761 - DNA, 22 bp, Artificial Sequence
  Synthetic oligonucleotide; CTT chr2 60549718 60549739 60549723 60549718 -
tttcaccaactggcaggcccag

SEQ ID NO: 210762 - DNA, 22 bp, Artificial Sequence
  Synthetic oligonucleotide; TTT chr2 60549717 60549738 60549722 60549717 -
ttcaccaactggcaggcccagg

SEQ ID NO: 210763 - DNA, 22 bp, Artificial Sequence
  Synthetic oligonucleotide; TTT chr2 60549716 60549737 60549721 60549716 -
tcaccaactggcaggcccaggg

SEQ ID NO: 210764 - DNA, 22 bp, Artificial Sequence
  Synthetic oligonucleotide; TTT chr2 60549715 60549736 60549720 60549715 -
caccaactggcaggcccaggga

SEQ ID NO: 210765 - DNA, 22 bp, Artificial Sequence
  Synthetic oligonucleotide; TTC chr2 60549714 60549735 60549719 60549714 -
accaactggcaggcccagggaa

SEQ ID NO: 210766 - DNA, 22 bp, Artificial Sequence
  Synthetic oligonucleotide; CTG chr2 60549706 60549727 60549711 60549706 -
gcaggcccagggaaccgtcacc

SEQ ID NO: 210767 - DNA, 22 bp, Artificial Sequence
  Synthetic oligonucleotide; CTG chr2 60549670 60549691 60549675 60549670 -
gccgagctggacgggcatggag

SEQ ID NO: 210768 - DNA, 22 bp, Artificial Sequence
  Synthetic oligonucleotide; CTG chr2 60549661 60549682 60549666 60549661 -
gacgggcatggaggcagcagtc

SEQ ID NO: 210769 - DNA, 22 bp, Artificial Sequence
  Synthetic oligonucleotide; CTG chr2 60549629 60549650 60549634 60549629 -
gctgccctccgtctccgggccc

SEQ ID NO: 210770 - DNA, 22 bp, Artificial Sequence
  Synthetic oligonucleotide; CTG chr2 60549625 60549646 60549630 60549625 -
ccctccgtctccgggcccccgg

SEQ ID NO: 210771 - DNA, 22 bp, Artificial Sequence
  Synthetic oligonucleotide; CTC chr2 60549620 60549641 60549625 60549620 -
cgtctccgggcccccgggcccc

SEQ ID NO: 210772 - DNA, 22 bp, Artificial Sequence
  Synthetic oligonucleotide; CTC chr2 60549614 60549635 60549619 60549614 -
cgggcccccgggccccaaggcc

SEQ ID NO: 210773 - DNA, 22 bp, Artificial Sequence
  Synthetic oligonucleotide; CTG chr2 60549580 60549601 60549585 60549580 -
ctgcacgtgttcgcagcaagcg

SEQ ID NO: 210774 - DNA, 22 bp, Artificial Sequence
  Synthetic oligonucleotide; CTG chr2 60549577 60549598 60549582 60549577 -
cacgtgttcgcagcaagcgcgg

SEQ ID NO: 210775 - DNA, 22 bp, Artificial Sequence
  Synthetic oligonucleotide; TTC chr2 60549568 60549589 60549573 60549568 -
gcagcaagcgcggcgggagcct

SEQ ID NO: 210776 - DNA, 22 bp, Artificial Sequence
  Synthetic oligonucleotide; CTG chr2 60549545 60549566 60549550 60549545 -
cagccagcacgctgctcgcttt

SEQ ID NO: 210777 - DNA, 22 bp, Artificial Sequence
  Synthetic oligonucleotide; CTG chr2 60549531 60549552 60549536 60549531 -
ctcgctttgtgcctcagagtcc

SEQ ID NO: 210778 - DNA, 22 bp, Artificial Sequence
  Synthetic oligonucleotide; CTC chr2 60549528 60549549 60549533 60549528 -
gctttgtgcctcagagtccccg

SEQ ID NO: 210779 - DNA, 22 bp, Artificial Sequence
  Synthetic oligonucleotide; CTT chr2 60549524 60549545 60549529 60549524 -
tgtgcctcagagtccccgcgcc

SEQ ID NO: 210780 - DNA, 22 bp, Artificial Sequence
  Synthetic oligonucleotide; TTT chr2 60549523 60549544 60549528 60549523 -
gtgcctcagagtccccgcgccc

SEQ ID NO: 210781 - DNA, 22 bp, Artificial Sequence
  Synthetic oligonucleotide; TTG chr2 60549522 60549543 60549527 60549522 -
tgcctcagagtccccgcgccca

SEQ ID NO: 210782 - DNA, 22 bp, Artificial Sequence
  Synthetic oligonucleotide; CTC chr2 60549516 60549537 60549521 60549516 -
agagtccccgcgcccaacttca

SEQ ID NO: 210783 - DNA, 22 bp, Artificial Sequence
  Synthetic oligonucleotide; CTT chr2 60549496 60549517 60549501 60549496 -
cactttctgcacggtccaccct

SEQ ID NO: 210784 - DNA, 22 bp, Artificial Sequence
  Synthetic oligonucleotide; TTC chr2 60549495 60549516 60549500 60549495 -
actttctgcacggtccaccctt

SEQ ID NO: 210785 - DNA, 22 bp, Artificial Sequence
  Synthetic oligonucleotide; CTT chr2 60549491 60549512 60549496 60549491 -
tctgcacggtccacccttgccg

SEQ ID NO: 210786 - DNA, 22 bp, Artificial Sequence
  Synthetic oligonucleotide; TTT chr2 60549490 60549511 60549495 60549490 -
ctgcacggtccacccttgccgg

SEQ ID NO: 210787 - DNA, 22 bp, Artificial Sequence
  Synthetic oligonucleotide; TTC chr2 60549489 60549510 60549494 60549489 -
tgcacggtccacccttgccggg

SEQ ID NO: 210788 - DNA, 22 bp, Artificial Sequence
  Synthetic oligonucleotide; CTG chr2 60549487 60549508 60549492 60549487 -
cacggtccacccttgccggggc

SEQ ID NO: 210789 - DNA, 22 bp, Artificial Sequence
  Synthetic oligonucleotide; CTT chr2 60549473 60549494 60549478 60549473 -
gccggggcccctgccccgggcc

SEQ ID NO: 210790 - DNA, 22 bp, Artificial Sequence
  Synthetic oligonucleotide; TTG chr2 60549472 60549493 60549477 60549472 -
ccggggcccctgccccgggcct

SEQ ID NO: 210791 - DNA, 22 bp, Artificial Sequence
  Synthetic oligonucleotide; CTG chr2 60549460 60549481 60549465 60549460 -
ccccgggcctgtagcccccggc

SEQ ID NO: 210792 - DNA, 22 bp, Artificial Sequence
  Synthetic oligonucleotide; CTG chr2 60549449 60549470 60549454 60549449 -
tagcccccggctttgcttttgt

SEQ ID NO: 210793 - DNA, 22 bp, Artificial Sequence
  Synthetic oligonucleotide; CTT chr2 60549436 60549457 60549441 60549436 -
tgcttttgtttctttgcttttc

SEQ ID NO: 210794 - DNA, 22 bp, Artificial Sequence
  Synthetic oligonucleotide; TTT chr2 60549435 60549456 60549440 60549435 -
gcttttgtttctttgcttttcc

SEQ ID NO: 210795 - DNA, 22 bp, Artificial Sequence
  Synthetic oligonucleotide; TTG chr2 60549434 60549455 60549439 60549434 -
cttttgtttctttgcttttcct

SEQ ID NO: 210796 - DNA, 22 bp, Artificial Sequence
  Synthetic oligonucleotide; CTT chr2 60549431 60549452 60549436 60549431 -
ttgtttctttgcttttcctctc

SEQ ID NO: 210797 - DNA, 22 bp, Artificial Sequence
  Synthetic oligonucleotide; TTT chr2 60549430 60549451 60549435 60549430 -
tgtttctttgcttttcctctct

SEQ ID NO: 210798 - DNA, 22 bp, Artificial Sequence
  Synthetic oligonucleotide; TTT chr2 60549429 60549450 60549434 60549429 -
gtttctttgcttttcctctctg

SEQ ID NO: 210799 - DNA, 22 bp, Artificial Sequence
  Synthetic oligonucleotide; TTG chr2 60549428 60549449 60549433 60549428 -
tttctttgcttttcctctctga

SEQ ID NO: 210800 - DNA, 22 bp, Artificial Sequence
  Synthetic oligonucleotide; TTT chr2 60549425 60549446 60549430 60549425 -
ctttgcttttcctctctgaatt

SEQ ID NO: 210801 - DNA, 22 bp, Artificial Sequence
  Synthetic oligonucleotide; TTC chr2 60549424 60549445 60549429 60549424 -
tttgcttttcctctctgaattt

SEQ ID NO: 210802 - DNA, 22 bp, Artificial Sequence
  Synthetic oligonucleotide; CTT chr2 60549422 60549443 60549427 60549422 -
tgcttttcctctctgaatttca

SEQ ID NO: 210803 - DNA, 22 bp, Artificial Sequence
  Synthetic oligonucleotide; TTT chr2 60549421 60549442 60549426 60549421 -
gcttttcctctctgaatttcag

SEQ ID NO: 210804 - DNA, 22 bp, Artificial Sequence
  Synthetic oligonucleotide; TTG chr2 60549420 60549441 60549425 60549420 -
cttttcctctctgaatttcagc

SEQ ID NO: 210805 - DNA, 22 bp, Artificial Sequence
  Synthetic oligonucleotide; CTT chr2 60549417 60549438 60549422 60549417 -
ttcctctctgaatttcagcctc

SEQ ID NO: 210806 - DNA, 22 bp, Artificial Sequence
  Synthetic oligonucleotide; TTT chr2 60549416 60549437 60549421 60549416 -
tcctctctgaatttcagcctcc

SEQ ID NO: 210807 - DNA, 22 bp, Artificial Sequence
  Synthetic oligonucleotide; TTT chr2 60549415 60549436 60549420 60549415 -
cctctctgaatttcagcctccg

SEQ ID NO: 210808 - DNA, 22 bp, Artificial Sequence
  Synthetic oligonucleotide; TTC chr2 60549414 60549435 60549419 60549414 -
ctctctgaatttcagcctccgt

SEQ ID NO: 210809 - DNA, 22 bp, Artificial Sequence
  Synthetic oligonucleotide; CTC chr2 60549411 60549432 60549416 60549411 -
tctgaatttcagcctccgtttg

SEQ ID NO: 210810 - DNA, 22 bp, Artificial Sequence
  Synthetic oligonucleotide; CTC chr2 60549409 60549430 60549414 60549409 -
tgaatttcagcctccgtttgct

SEQ ID NO: 210811 - DNA, 22 bp, Artificial Sequence
  Synthetic oligonucleotide; CTG chr2 60549407 60549428 60549412 60549407 -
aatttcagcctccgtttgcttc

SEQ ID NO: 210812 - DNA, 22 bp, Artificial Sequence
  Synthetic oligonucleotide; TTT chr2 60549402 60549423 60549407 60549402 -
cagcctccgtttgcttctttac

SEQ ID NO: 210813 - DNA, 22 bp, Artificial Sequence
  Synthetic oligonucleotide; TTC chr2 60549401 60549422 60549406 60549401 -
agcctccgtttgcttctttacc

SEQ ID NO: 210814 - DNA, 22 bp, Artificial Sequence
  Synthetic oligonucleotide; CTC chr2 60549395 60549416 60549400 60549395 -
cgtttgcttctttaccctgtta

SEQ ID NO: 210815 - DNA, 22 bp, Artificial Sequence
  Synthetic oligonucleotide; TTT chr2 60549390 60549411 60549395 60549390 -
gcttctttaccctgttaagaca

SEQ ID NO: 210816 - DNA, 22 bp, Artificial Sequence
  Synthetic oligonucleotide; TTG chr2 60549389 60549410 60549394 60549389 -
cttctttaccctgttaagacaa

SEQ ID NO: 210817 - DNA, 22 bp, Artificial Sequence
  Synthetic oligonucleotide; CTT chr2 60549386 60549407 60549391 60549386 -
ctttaccctgttaagacaatca

SEQ ID NO: 210818 - DNA, 22 bp, Artificial Sequence
  Synthetic oligonucleotide; TTC chr2 60549385 60549406 60549390 60549385 -
tttaccctgttaagacaatcaa

SEQ ID NO: 210819 - DNA, 22 bp, Artificial Sequence
  Synthetic oligonucleotide; CTT chr2 60549383 60549404 60549388 60549383 -
taccctgttaagacaatcaagg

SEQ ID NO: 210820 - DNA, 22 bp, Artificial Sequence
  Synthetic oligonucleotide; TTT chr2 60549382 60549403 60549387 60549382 -
accctgttaagacaatcaagga

SEQ ID NO: 210821 - DNA, 22 bp, Artificial Sequence
  Synthetic oligonucleotide; TTA chr2 60549381 60549402 60549386 60549381 -
ccctgttaagacaatcaaggag

SEQ ID NO: 210822 - DNA, 22 bp, Artificial Sequence
  Synthetic oligonucleotide; CTG chr2 60549376 60549397 60549381 60549376 -
ttaagacaatcaaggagaagga

SEQ ID NO: 210823 - DNA, 22 bp, Artificial Sequence
  Synthetic oligonucleotide; TTA chr2 60549373 60549394 60549378 60549373 -
agacaatcaaggagaaggactt

SEQ ID NO: 210824 - DNA, 22 bp, Artificial Sequence
  Synthetic oligonucleotide; CTT chr2 60549351 60549372 60549356 60549351 -
ggaaagcaaacttgaagacaca

SEQ ID NO: 210825 - DNA, 22 bp, Artificial Sequence
  Synthetic oligonucleotide; TTG chr2 60549350 60549371 60549355 60549350 -
gaaagcaaacttgaagacacat

SEQ ID NO: 210826 - DNA, 22 bp, Artificial Sequence
  Synthetic oligonucleotide; CTT chr2 60549338 60549359 60549343 60549338 -
gaagacacatctccctttcccc

SEQ ID NO: 210827 - DNA, 22 bp, Artificial Sequence
  Synthetic oligonucleotide; TTG chr2 60549337 60549358 60549342 60549337 -
aagacacatctccctttccccc

SEQ ID NO: 210828 - DNA, 22 bp, Artificial Sequence
  Synthetic oligonucleotide; CTC chr2 60549325 60549346 60549330 60549325 -
cctttccccctccccctccgct

SEQ ID NO: 210829 - DNA, 22 bp, Artificial Sequence
  Synthetic oligonucleotide; CTT chr2 60549321 60549342 60549326 60549321 -
tccccctccccctccgctcccc

SEQ ID NO: 210830 - DNA, 22 bp, Artificial Sequence
  Synthetic oligonucleotide; TTT chr2 60549320 60549341 60549325 60549320 -
ccccctccccctccgctccccg

SEQ ID NO: 210831 - DNA, 22 bp, Artificial Sequence
  Synthetic oligonucleotide; TTC chr2 60549319 60549340 60549324 60549319 -
cccctccccctccgctccccgg

SEQ ID NO: 210832 - DNA, 22 bp, Artificial Sequence
  Synthetic oligonucleotide; CTC chr2 60549313 60549334 60549318 60549313 -
cccctccgctccccggcagctc

SEQ ID NO: 210833 - DNA, 22 bp, Artificial Sequence
  Synthetic oligonucleotide; CTC chr2 60549307 60549328 60549312 60549307 -
cgctccccggcagctctcgttt

SEQ ID NO: 210834 - DNA, 22 bp, Artificial Sequence
  Synthetic oligonucleotide; CTC chr2 60549302 60549323 60549307 60549302 -
cccggcagctctcgttttgctc

SEQ ID NO: 210835 - DNA, 22 bp, Artificial Sequence
  Synthetic oligonucleotide; CTC chr2 60549291 60549312 60549296 60549291 -
tcgttttgctcgctccttacca

SEQ ID NO: 210836 - DNA, 22 bp, Artificial Sequence
  Synthetic oligonucleotide; CTC chr2 60549289 60549310 60549294 60549289 -
gttttgctcgctccttaccaac

SEQ ID NO: 210837 - DNA, 22 bp, Artificial Sequence
  Synthetic oligonucleotide; TTT chr2 60549285 60549306 60549290 60549285 -
tgctcgctccttaccaacattt

SEQ ID NO: 210838 - DNA, 22 bp, Artificial Sequence
  Synthetic oligonucleotide; TTT chr2 60549284 60549305 60549289 60549284 -
gctcgctccttaccaacatttc

SEQ ID NO: 210839 - DNA, 22 bp, Artificial Sequence
  Synthetic oligonucleotide; TTG chr2 60549283 60549304 60549288 60549283 -
ctcgctccttaccaacatttcc

SEQ ID NO: 210840 - DNA, 22 bp, Artificial Sequence
  Synthetic oligonucleotide; CTC chr2 60549280 60549301 60549285 60549280 -
gctccttaccaacatttcctat

SEQ ID NO: 210841 - DNA, 22 bp, Artificial Sequence
  Synthetic oligonucleotide; CTC chr2 60549276 60549297 60549281 60549276 -
cttaccaacatttcctataagg

SEQ ID NO: 210842 - DNA, 22 bp, Artificial Sequence
  Synthetic oligonucleotide; CTT chr2 60549273 60549294 60549278 60549273 -
accaacatttcctataaggatt

SEQ ID NO: 210843 - DNA, 22 bp, Artificial Sequence
  Synthetic oligonucleotide; TTA chr2 60549272 60549293 60549277 60549272 -
ccaacatttcctataaggatta

SEQ ID NO: 210844 - DNA, 22 bp, Artificial Sequence
  Synthetic oligonucleotide; TTT chr2 60549263 60549284 60549268 60549263 -
cctataaggattatttttttcc

SEQ ID NO: 210845 - DNA, 22 bp, Artificial Sequence
  Synthetic oligonucleotide; TTC chr2 60549262 60549283 60549267 60549262 -
ctataaggattatttttttccc

SEQ ID NO: 210846 - DNA, 22 bp, Artificial Sequence
  Synthetic oligonucleotide; CTA chr2 60549259 60549280 60549264 60549259 -
taaggattatttttttccctta

SEQ ID NO: 210847 - DNA, 22 bp, Artificial Sequence
  Synthetic oligonucleotide; TTA chr2 60549250 60549271 60549255 60549250 -
tttttttcccttaaatttattc

SEQ ID NO: 210848 - DNA, 22 bp, Artificial Sequence
  Synthetic oligonucleotide; TTT chr2 60549247 60549268 60549252 60549247 -
ttttcccttaaatttattcttt

SEQ ID NO: 210849 - DNA, 22 bp, Artificial Sequence
  Synthetic oligonucleotide; TTT chr2 60549246 60549267 60549251 60549246 -
tttcccttaaatttattctttt

SEQ ID NO: 210850 - DNA, 22 bp, Artificial Sequence
  Synthetic oligonucleotide; TTT chr2 60549245 60549266 60549250 60549245 -
ttcccttaaatttattcttttg

SEQ ID NO: 210851 - DNA, 22 bp, Artificial Sequence
  Synthetic oligonucleotide; TTT chr2 60549244 60549265 60549249 60549244 -
tcccttaaatttattcttttgc

SEQ ID NO: 210852 - DNA, 22 bp, Artificial Sequence
  Synthetic oligonucleotide; TTT chr2 60549243 60549264 60549248 60549243 -
cccttaaatttattcttttgca

SEQ ID NO: 210853 - DNA, 22 bp, Artificial Sequence
  Synthetic oligonucleotide; TTC chr2 60549242 60549263 60549247 60549242 -
ccttaaatttattcttttgcaa

SEQ ID NO: 210854 - DNA, 22 bp, Artificial Sequence
  Synthetic oligonucleotide; CTT chr2 60549238 60549259 60549243 60549238 -
aaatttattcttttgcaactac

SEQ ID NO: 210855 - DNA, 22 bp, Artificial Sequence
  Synthetic oligonucleotide; TTA chr2 60549237 60549258 60549242 60549237 -
aatttattcttttgcaactaca

SEQ ID NO: 210856 - DNA, 22 bp, Artificial Sequence
  Synthetic oligonucleotide; TTT chr2 60549232 60549253 60549237 60549232 -
attcttttgcaactacacagag

SEQ ID NO: 210857 - DNA, 22 bp, Artificial Sequence
  Synthetic oligonucleotide; TTA chr2 60549231 60549252 60549236 60549231 -
ttcttttgcaactacacagaga

SEQ ID NO: 210858 - DNA, 22 bp, Artificial Sequence
  Synthetic oligonucleotide; TTC chr2 60549228 60549249 60549233 60549228 -
ttttgcaactacacagagagga

SEQ ID NO: 210859 - DNA, 22 bp, Artificial Sequence
  Synthetic oligonucleotide; CTT chr2 60549226 60549247 60549231 60549226 -
ttgcaactacacagagaggaaa

SEQ ID NO: 210860 - DNA, 22 bp, Artificial Sequence
  Synthetic oligonucleotide; TTT chr2 60549225 60549246 60549230 60549225 -
tgcaactacacagagaggaaag

SEQ ID NO: 210861 - DNA, 22 bp, Artificial Sequence
  Synthetic oligonucleotide; TTT chr2 60549224 60549245 60549229 60549224 -
gcaactacacagagaggaaaga

SEQ ID NO: 210862 - DNA, 22 bp, Artificial Sequence
  Synthetic oligonucleotide; TTG chr2 60549223 60549244 60549228 60549223 -
caactacacagagaggaaagag

SEQ ID NO: 210863 - DNA, 22 bp, Artificial Sequence
  Synthetic oligonucleotide; CTA chr2 60549217 60549238 60549222 60549217 -
cacagagaggaaagagatctca

SEQ ID NO: 210864 - DNA, 22 bp, Artificial Sequence
  Synthetic oligonucleotide; CTC chr2 60549196 60549217 60549201 60549196 -
agtctgtcactgagacattgag

SEQ ID NO: 210865 - DNA, 22 bp, Artificial Sequence
  Synthetic oligonucleotide; CTG chr2 60549190 60549211 60549195 60549190 -
tcactgagacattgagacgttc

SEQ ID NO: 210866 - DNA, 22 bp, Artificial Sequence
  Synthetic oligonucleotide; CTG chr2 60549184 60549205 60549189 60549184 -
agacattgagacgttccaggct

SEQ ID NO: 210867 - DNA, 22 bp, Artificial Sequence
  Synthetic oligonucleotide; TTG chr2 60549176 60549197 60549181 60549176 -
agacgttccaggctgtcttgct

SEQ ID NO: 210868 - DNA, 22 bp, Artificial Sequence
  Synthetic oligonucleotide; TTC chr2 60549168 60549189 60549173 60549168 -
caggctgtcttgctgtttgaac

SEQ ID NO: 210869 - DNA, 22 bp, Artificial Sequence
  Synthetic oligonucleotide; CTG chr2 60549161 60549182 60549166 60549161 -
tcttgctgtttgaacgtagaag

SEQ ID NO: 210870 - DNA, 22 bp, Artificial Sequence
  Synthetic oligonucleotide; CTT chr2 60549157 60549178 60549162 60549157 -
gctgtttgaacgtagaagcatt

SEQ ID NO: 210871 - DNA, 22 bp, Artificial Sequence
  Synthetic oligonucleotide; TTG chr2 60549156 60549177 60549161 60549156 -
ctgtttgaacgtagaagcattt

SEQ ID NO: 210872 - DNA, 22 bp, Artificial Sequence
  Synthetic oligonucleotide; CTG chr2 60549153 60549174 60549158 60549153 -
tttgaacgtagaagcattttat

SEQ ID NO: 210873 - DNA, 22 bp, Artificial Sequence
  Synthetic oligonucleotide; TTT chr2 60549150 60549171 60549155 60549150 -
gaacgtagaagcattttatttt

SEQ ID NO: 210874 - DNA, 22 bp, Artificial Sequence
  Synthetic oligonucleotide; TTG chr2 60549149 60549170 60549154 60549149 -
aacgtagaagcattttattttc

SEQ ID NO: 210875 - DNA, 22 bp, Artificial Sequence
  Synthetic oligonucleotide; TTT chr2 60549134 60549155 60549139 60549134 -
tattttctatttcttcctcccc

SEQ ID NO: 210876 - DNA, 22 bp, Artificial Sequence
  Synthetic oligonucleotide; TTT chr2 60549133 60549154 60549138 60549133 -
attttctatttcttcctcccct

SEQ ID NO: 210877 - DNA, 22 bp, Artificial Sequence
  Synthetic oligonucleotide; TTA chr2 60549132 60549153 60549137 60549132 -
ttttctatttcttcctcccctc

SEQ ID NO: 210878 - DNA, 22 bp, Artificial Sequence
  Synthetic oligonucleotide; TTT chr2 60549129 60549150 60549134 60549129 -
tctatttcttcctcccctcgta

SEQ ID NO: 210879 - DNA, 22 bp, Artificial Sequence
  Synthetic oligonucleotide; TTT chr2 60549128 60549149 60549133 60549128 -
ctatttcttcctcccctcgtag

SEQ ID NO: 210880 - DNA, 22 bp, Artificial Sequence
  Synthetic oligonucleotide; TTC chr2 60549127 60549148 60549132 60549127 -
tatttcttcctcccctcgtaga

SEQ ID NO: 210881 - DNA, 22 bp, Artificial Sequence
  Synthetic oligonucleotide; CTA chr2 60549125 60549146 60549130 60549125 -
tttcttcctcccctcgtagaga

SEQ ID NO: 210882 - DNA, 22 bp, Artificial Sequence
  Synthetic oligonucleotide; TTT chr2 60549122 60549143 60549127 60549122 -
cttcctcccctcgtagagagaa

SEQ ID NO: 210883 - DNA, 22 bp, Artificial Sequence
  Synthetic oligonucleotide; TTC chr2 60549121 60549142 60549126 60549121 -
ttcctcccctcgtagagagaat

SEQ ID NO: 210884 - DNA, 22 bp, Artificial Sequence
  Synthetic oligonucleotide; CTT chr2 60549119 60549140 60549124 60549119 -
cctcccctcgtagagagaattc

SEQ ID NO: 210885 - DNA, 22 bp, Artificial Sequence
  Synthetic oligonucleotide; TTC chr2 60549118 60549139 60549123 60549118 -
ctcccctcgtagagagaattcg

SEQ ID NO: 210886 - DNA, 22 bp, Artificial Sequence
  Synthetic oligonucleotide; CTC chr2 60549115 60549136 60549120 60549115 -
ccctcgtagagagaattcgcgg

SEQ ID NO: 210887 - DNA, 22 bp, Artificial Sequence
  Synthetic oligonucleotide; CTC chr2 60549110 60549131 60549115 60549110 -
gtagagagaattcgcggctaat

SEQ ID NO: 210888 - DNA, 22 bp, Artificial Sequence
  Synthetic oligonucleotide; TTC chr2 60549097 60549118 60549102 60549097 -
gcggctaattattatgattatt

SEQ ID NO: 210889 - DNA, 22 bp, Artificial Sequence
  Synthetic oligonucleotide; CTA chr2 60549090 60549111 60549095 60549090 -
attattatgattatttgcccac

SEQ ID NO: 210890 - DNA, 22 bp, Artificial Sequence
  Synthetic oligonucleotide; TTA chr2 60549086 60549107 60549091 60549086 -
ttatgattatttgcccactccc

SEQ ID NO: 210891 - DNA, 22 bp, Artificial Sequence
  Synthetic oligonucleotide; TTA chr2 60549083 60549104 60549088 60549083 -
tgattatttgcccactcccttc

SEQ ID NO: 210892 - DNA, 22 bp, Artificial Sequence
  Synthetic oligonucleotide; TTA chr2 60549077 60549098 60549082 60549077 -
tttgcccactcccttccacttc

SEQ ID NO: 210893 - DNA, 22 bp, Artificial Sequence
  Synthetic oligonucleotide; TTT chr2 60549074 60549095 60549079 60549074 -
gcccactcccttccacttcaat

SEQ ID NO: 210894 - DNA, 22 bp, Artificial Sequence
  Synthetic oligonucleotide; TTG chr2 60549073 60549094 60549078 60549073 -
cccactcccttccacttcaatc

SEQ ID NO: 210895 - DNA, 22 bp, Artificial Sequence
  Synthetic oligonucleotide; CTC chr2 60549066 60549087 60549071 60549066 -
ccttccacttcaatcgaggact

SEQ ID NO: 210896 - DNA, 22 bp, Artificial Sequence
  Synthetic oligonucleotide; CTT chr2 60549062 60549083 60549067 60549062 -
ccacttcaatcgaggactccct

SEQ ID NO: 210897 - DNA, 22 bp, Artificial Sequence
  Synthetic oligonucleotide; TTC chr2 60549061 60549082 60549066 60549061 -
cacttcaatcgaggactccctg

SEQ ID NO: 210898 - DNA, 22 bp, Artificial Sequence
  Synthetic oligonucleotide; CTT chr2 60549056 60549077 60549061 60549056 -
caatcgaggactccctgctttg

SEQ ID NO: 210899 - DNA, 22 bp, Artificial Sequence
  Synthetic oligonucleotide; TTC chr2 60549055 60549076 60549060 60549055 -
aatcgaggactccctgctttgt

SEQ ID NO: 210900 - DNA, 22 bp, Artificial Sequence
  Synthetic oligonucleotide; CTC chr2 60549043 60549064 60549048 60549043 -
cctgctttgtagccggagttta

SEQ ID NO: 210901 - DNA, 22 bp, Artificial Sequence
  Synthetic oligonucleotide; CTG chr2 60549039 60549060 60549044 60549039 -
ctttgtagccggagtttaggcc

SEQ ID NO: 210902 - DNA, 22 bp, Artificial Sequence
  Synthetic oligonucleotide; CTT chr2 60549036 60549057 60549041 60549036 -
tgtagccggagtttaggccgga

SEQ ID NO: 210903 - DNA, 22 bp, Artificial Sequence
  Synthetic oligonucleotide; TTT chr2 60549035 60549056 60549040 60549035 -
gtagccggagtttaggccggag

SEQ ID NO: 210904 - DNA, 22 bp, Artificial Sequence
  Synthetic oligonucleotide; TTG chr2 60549034 60549055 60549039 60549034 -
tagccggagtttaggccggagc

SEQ ID NO: 210905 - DNA, 22 bp, Artificial Sequence
  Synthetic oligonucleotide; TTT chr2 60549022 60549043 60549027 60549022 -
aggccggagcttagaaatgttg

SEQ ID NO: 210906 - DNA, 22 bp, Artificial Sequence
  Synthetic oligonucleotide; TTA chr2 60549021 60549042 60549026 60549021 -
ggccggagcttagaaatgttgg

SEQ ID NO: 210907 - DNA, 22 bp, Artificial Sequence
  Synthetic oligonucleotide; CTT chr2 60549010 60549031 60549015 60549010 -
agaaatgttggtattgttgggg

SEQ ID NO: 210908 - DNA, 22 bp, Artificial Sequence
  Synthetic oligonucleotide; TTA chr2 60549009 60549030 60549014 60549009 -
gaaatgttggtattgttggggc

SEQ ID NO: 210909 - DNA, 22 bp, Artificial Sequence
  Synthetic oligonucleotide; TTG chr2 60549000 60549021 60549005 60549000 -
gtattgttggggcgaaggagga

SEQ ID NO: 210910 - DNA, 22 bp, Artificial Sequence
  Synthetic oligonucleotide; TTG chr2 60548994 60549015 60548999 60548994 -
ttggggcgaaggaggatggagt

SEQ ID NO: 210911 - DNA, 22 bp, Artificial Sequence
  Synthetic oligonucleotide; TTG chr2 60548991 60549012 60548996 60548991 -
gggcgaaggaggatggagttga

SEQ ID NO: 210912 - DNA, 22 bp, Artificial Sequence
  Synthetic oligonucleotide; TTG chr2 60548970 60548991 60548975 60548970 -
aattgagggagggggtaaatgg

SEQ ID NO: 210913 - DNA, 22 bp, Artificial Sequence
  Synthetic oligonucleotide; TTG chr2 60548965 60548986 60548970 60548965 -
agggagggggtaaatggctgag

SEQ ID NO: 210914 - DNA, 22 bp, Artificial Sequence
  Synthetic oligonucleotide; CTG chr2 60548945 60548966 60548950 60548945 -
agggttaggaaggtttttaggg

SEQ ID NO: 210915 - DNA, 22 bp, Artificial Sequence
  Synthetic oligonucleotide; TTA chr2 60548938 60548959 60548943 60548938 -
ggaaggtttttagggaaagggg

SEQ ID NO: 210916 - DNA, 22 bp, Artificial Sequence
  Synthetic oligonucleotide; TTT chr2 60548929 60548950 60548934 60548929 -
ttagggaaaggggaatttgcat

SEQ ID NO: 210917 - DNA, 22 bp, Artificial Sequence
  Synthetic oligonucleotide; TTT chr2 60548928 60548949 60548933 60548928 -
tagggaaaggggaatttgcatt

SEQ ID NO: 210918 - DNA, 22 bp, Artificial Sequence
  Synthetic oligonucleotide; TTT chr2 60548927 60548948 60548932 60548927 -
agggaaaggggaatttgcatta

SEQ ID NO: 210919 - DNA, 22 bp, Artificial Sequence
  Synthetic oligonucleotide; TTA chr2 60548926 60548947 60548931 60548926 -
gggaaaggggaatttgcattaa

SEQ ID NO: 210920 - DNA, 22 bp, Artificial Sequence
  Synthetic oligonucleotide; TTT chr2 60548911 60548932 60548916 60548911 -
gcattaaaatgcagagaaatta

SEQ ID NO: 210921 - DNA, 22 bp, Artificial Sequence
  Synthetic oligonucleotide; TTG chr2 60548910 60548931 60548915 60548910 -
cattaaaatgcagagaaattat

SEQ ID NO: 210922 - DNA, 22 bp, Artificial Sequence
  Synthetic oligonucleotide; TTA chr2 60548905 60548926 60548910 60548905 -
aaatgcagagaaattatcagat

SEQ ID NO: 210923 - DNA, 22 bp, Artificial Sequence
  Synthetic oligonucleotide; TTA chr2 60548889 60548910 60548894 60548889 -
tcagatgcccagaaaggaaatg

SEQ ID NO: 210924 - DNA, 22 bp, Artificial Sequence
  Synthetic oligonucleotide; TTG chr2 60548864 60548885 60548869 60548864 -
attgccactgagaaaagatgtc

SEQ ID NO: 210925 - DNA, 22 bp, Artificial Sequence
  Synthetic oligonucleotide; TTG chr2 60548860 60548881 60548865 60548860 -
ccactgagaaaagatgtcaatg

SEQ ID NO: 210926 - DNA, 22 bp, Artificial Sequence
  Synthetic oligonucleotide; CTG chr2 60548854 60548875 60548859 60548854 -
agaaaagatgtcaatgcaaatc

SEQ ID NO: 210927 - DNA, 22 bp, Artificial Sequence
  Synthetic oligonucleotide; CTA chr2 60548823 60548844 60548828 60548823 -
caccatgagaattgtattttca

SEQ ID NO: 210928 - DNA, 22 bp, Artificial Sequence
  Synthetic oligonucleotide; TTG chr2 60548809 60548830 60548814 60548809 -
tattttcatattttctttgtgt

SEQ ID NO: 210929 - DNA, 22 bp, Artificial Sequence
  Synthetic oligonucleotide; TTT chr2 60548804 60548825 60548809 60548804 -
tcatattttctttgtgtcccac

SEQ ID NO: 210930 - DNA, 22 bp, Artificial Sequence
  Synthetic oligonucleotide; TTT chr2 60548803 60548824 60548808 60548803 -
catattttctttgtgtcccact

SEQ ID NO: 210931 - DNA, 22 bp, Artificial Sequence
  Synthetic oligonucleotide; TTC chr2 60548802 60548823 60548807 60548802 -
atattttctttgtgtcccactt

SEQ ID NO: 210932 - DNA, 22 bp, Artificial Sequence
  Synthetic oligonucleotide; TTT chr2 60548796 60548817 60548801 60548796 -
tctttgtgtcccactttgtctg

SEQ ID NO: 210933 - DNA, 22 bp, Artificial Sequence
  Synthetic oligonucleotide; TTT chr2 60548795 60548816 60548800 60548795 -
ctttgtgtcccactttgtctga

SEQ ID NO: 210934 - DNA, 22 bp, Artificial Sequence
  Synthetic oligonucleotide; TTC chr2 60548794 60548815 60548799 60548794 -
tttgtgtcccactttgtctgat

SEQ ID NO: 210935 - DNA, 22 bp, Artificial Sequence
  Synthetic oligonucleotide; CTT chr2 60548792 60548813 60548797 60548792 -
tgtgtcccactttgtctgattt

SEQ ID NO: 210936 - DNA, 22 bp, Artificial Sequence
  Synthetic oligonucleotide; TTT chr2 60548791 60548812 60548796 60548791 -
gtgtcccactttgtctgatttt

SEQ ID NO: 210937 - DNA, 22 bp, Artificial Sequence
  Synthetic oligonucleotide; TTG chr2 60548790 60548811 60548795 60548790 -
tgtcccactttgtctgattttt

SEQ ID NO: 210938 - DNA, 22 bp, Artificial Sequence
  Synthetic oligonucleotide; CTT chr2 60548780 60548801 60548785 60548780 -
tgtctgatttttaataatatac

SEQ ID NO: 210939 - DNA, 22 bp, Artificial Sequence
  Synthetic oligonucleotide; TTT chr2 60548779 60548800 60548784 60548779 -
gtctgatttttaataatatacc

SEQ ID NO: 210940 - DNA, 22 bp, Artificial Sequence
  Synthetic oligonucleotide; TTG chr2 60548778 60548799 60548783 60548778 -
tctgatttttaataatatacca

SEQ ID NO: 210941 - DNA, 22 bp, Artificial Sequence
  Synthetic oligonucleotide; CTG chr2 60548774 60548795 60548779 60548774 -
atttttaataatataccagcaa

SEQ ID NO: 210942 - DNA, 22 bp, Artificial Sequence
  Synthetic oligonucleotide; TTT chr2 60548770 60548791 60548775 60548770 -
ttaataatataccagcaatgat

SEQ ID NO: 210943 - DNA, 22 bp, Artificial Sequence
  Synthetic oligonucleotide; TTT chr2 60548769 60548790 60548774 60548769 -
taataatataccagcaatgata

SEQ ID NO: 210944 - DNA, 22 bp, Artificial Sequence
  Synthetic oligonucleotide; TTT chr2 60548768 60548789 60548773 60548768 -
aataatataccagcaatgataa

SEQ ID NO: 210945 - DNA, 22 bp, Artificial Sequence
  Synthetic oligonucleotide; TTA chr2 60548767 60548788 60548772 60548767 -
ataatataccagcaatgataaa

SEQ ID NO: 210946 - DNA, 22 bp, Artificial Sequence
  Synthetic oligonucleotide; TTT chr2 60548736 60548757 60548741 60548736 -
tggtatttctctgaacaccact

SEQ ID NO: 210947 - DNA, 22 bp, Artificial Sequence
  Synthetic oligonucleotide; TTT chr2 60548735 60548756 60548740 60548735 -
ggtatttctctgaacaccacta

SEQ ID NO: 210948 - DNA, 22 bp, Artificial Sequence
  Synthetic oligonucleotide; TTG chr2 60548734 60548755 60548739 60548734 -
gtatttctctgaacaccactag

SEQ ID NO: 210949 - DNA, 22 bp, Artificial Sequence
  Synthetic oligonucleotide; TTT chr2 60548728 60548749 60548733 60548728 -
ctctgaacaccactagccaaat

SEQ ID NO: 210950 - DNA, 22 bp, Artificial Sequence
  Synthetic oligonucleotide; TTC chr2 60548727 60548748 60548732 60548727 -
tctgaacaccactagccaaatg

SEQ ID NO: 210951 - DNA, 22 bp, Artificial Sequence
  Synthetic oligonucleotide; CTC chr2 60548725 60548746 60548730 60548725 -
tgaacaccactagccaaatgtt

SEQ ID NO: 210952 - DNA, 22 bp, Artificial Sequence
  Synthetic oligonucleotide; CTG chr2 60548723 60548744 60548728 60548723 -
aacaccactagccaaatgtttt

SEQ ID NO: 210953 - DNA, 22 bp, Artificial Sequence
  Synthetic oligonucleotide; CTA chr2 60548713 60548734 60548718 60548713 -
gccaaatgttttgcaaggagac

SEQ ID NO: 210954 - DNA, 22 bp, Artificial Sequence
  Synthetic oligonucleotide; TTT chr2 60548702 60548723 60548707 60548702 -
tgcaaggagaccgatgttaaac

SEQ ID NO: 210955 - DNA, 22 bp, Artificial Sequence
  Synthetic oligonucleotide; TTT chr2 60548701 60548722 60548706 60548701 -
gcaaggagaccgatgttaaacg

SEQ ID NO: 210956 - DNA, 22 bp, Artificial Sequence
  Synthetic oligonucleotide; TTG chr2 60548700 60548721 60548705 60548700 -
caaggagaccgatgttaaacgt

SEQ ID NO: 210957 - DNA, 22 bp, Artificial Sequence
  Synthetic oligonucleotide; TTA chr2 60548683 60548704 60548688 60548683 -
aacgtatttcatacattagaat

SEQ ID NO: 210958 - DNA, 22 bp, Artificial Sequence
  Synthetic oligonucleotide; TTT chr2 60548674 60548695 60548679 60548674 -
catacattagaatataattctt

SEQ ID NO: 210959 - DNA, 22 bp, Artificial Sequence
  Synthetic oligonucleotide; TTC chr2 60548673 60548694 60548678 60548673 -
atacattagaatataattcttg

SEQ ID NO: 210960 - DNA, 22 bp, Artificial Sequence
  Synthetic oligonucleotide; TTA chr2 60548665 60548686 60548670 60548665 -
gaatataattcttgttaattag

SEQ ID NO: 210961 - DNA, 22 bp, Artificial Sequence
  Synthetic oligonucleotide; TTC chr2 60548654 60548675 60548659 60548654 -
ttgttaattagcaataatttac

SEQ ID NO: 210962 - DNA, 22 bp, Artificial Sequence
  Synthetic oligonucleotide; CTT chr2 60548652 60548673 60548657 60548652 -
gttaattagcaataatttacgt

SEQ ID NO: 210963 - DNA, 22 bp, Artificial Sequence
  Synthetic oligonucleotide; TTG chr2 60548651 60548672 60548656 60548651 -
ttaattagcaataatttacgtt

SEQ ID NO: 210964 - DNA, 22 bp, Artificial Sequence
  Synthetic oligonucleotide; TTA chr2 60548648 60548669 60548653 60548648 -
attagcaataatttacgttaag

SEQ ID NO: 210965 - DNA, 22 bp, Artificial Sequence
  Synthetic oligonucleotide; TTA chr2 60548644 60548665 60548649 60548644 -
gcaataatttacgttaagagca

SEQ ID NO: 210966 - DNA, 22 bp, Artificial Sequence
  Synthetic oligonucleotide; TTT chr2 60548634 60548655 60548639 60548634 -
acgttaagagcatagaaaatgt

SEQ ID NO: 210967 - DNA, 22 bp, Artificial Sequence
  Synthetic oligonucleotide; TTA chr2 60548633 60548654 60548638 60548633 -
cgttaagagcatagaaaatgtt

SEQ ID NO: 210968 - DNA, 22 bp, Artificial Sequence
  Synthetic oligonucleotide; TTA chr2 60548628 60548649 60548633 60548628 -
agagcatagaaaatgttgaggt

SEQ ID NO: 210969 - DNA, 22 bp, Artificial Sequence
  Synthetic oligonucleotide; TTG chr2 60548610 60548631 60548615 60548610 -
aggttacaggttttatatctgt

SEQ ID NO: 210970 - DNA, 22 bp, Artificial Sequence
  Synthetic oligonucleotide; TTA chr2 60548604 60548625 60548609 60548604 -
caggttttatatctgtacattt

SEQ ID NO: 210971 - DNA, 22 bp, Artificial Sequence
  Synthetic oligonucleotide; TTT chr2 60548597 60548618 60548602 60548597 -
tatatctgtacatttgatcatc

SEQ ID NO: 210972 - DNA, 22 bp, Artificial Sequence
  Synthetic oligonucleotide; TTT chr2 60548596 60548617 60548601 60548596 -
atatctgtacatttgatcatct

SEQ ID NO: 210973 - DNA, 22 bp, Artificial Sequence
  Synthetic oligonucleotide; TTA chr2 60548595 60548616 60548600 60548595 -
tatctgtacatttgatcatctt

SEQ ID NO: 210974 - DNA, 22 bp, Artificial Sequence
  Synthetic oligonucleotide; CTG chr2 60548589 60548610 60548594 60548589 -
tacatttgatcatcttgttatt

SEQ ID NO: 210975 - DNA, 22 bp, Artificial Sequence
  Synthetic oligonucleotide; TTT chr2 60548582 60548603 60548587 60548582 -
gatcatcttgttattttcaaga

SEQ ID NO: 210976 - DNA, 22 bp, Artificial Sequence
  Synthetic oligonucleotide; TTG chr2 60548581 60548602 60548586 60548581 -
atcatcttgttattttcaagaa

SEQ ID NO: 210977 - DNA, 22 bp, Artificial Sequence
  Synthetic oligonucleotide; CTT chr2 60548573 60548594 60548578 60548573 -
gttattttcaagaactttgcct

SEQ ID NO: 210978 - DNA, 22 bp, Artificial Sequence
  Synthetic oligonucleotide; TTG chr2 60548572 60548593 60548577 60548572 -
ttattttcaagaactttgcctc

SEQ ID NO: 210979 - DNA, 22 bp, Artificial Sequence
  Synthetic oligonucleotide; TTA chr2 60548569 60548590 60548574 60548569 -
ttttcaagaactttgcctccta

SEQ ID NO: 210980 - DNA, 22 bp, Artificial Sequence
  Synthetic oligonucleotide; TTT chr2 60548566 60548587 60548571 60548566 -
tcaagaactttgcctcctataa

SEQ ID NO: 210981 - DNA, 22 bp, Artificial Sequence
  Synthetic oligonucleotide; TTT chr2 60548565 60548586 60548570 60548565 -
caagaactttgcctcctataaa

SEQ ID NO: 210982 - DNA, 22 bp, Artificial Sequence
  Synthetic oligonucleotide; TTC chr2 60548564 60548585 60548569 60548564 -
aagaactttgcctcctataaaa

SEQ ID NO: 210983 - DNA, 22 bp, Artificial Sequence
  Synthetic oligonucleotide; CTT chr2 60548556 60548577 60548561 60548556 -
tgcctcctataaaattaattag

SEQ ID NO: 210984 - DNA, 22 bp, Artificial Sequence
  Synthetic oligonucleotide; TTT chr2 60548555 60548576 60548560 60548555 -
gcctcctataaaattaattagg

SEQ ID NO: 210985 - DNA, 22 bp, Artificial Sequence
  Synthetic oligonucleotide; TTG chr2 60548554 60548575 60548559 60548554 -
cctcctataaaattaattaggt

SEQ ID NO: 210986 - DNA, 22 bp, Artificial Sequence
  Synthetic oligonucleotide; CTC chr2 60548550 60548571 60548555 60548550 -
ctataaaattaattaggtgaaa

SEQ ID NO: 210987 - DNA, 22 bp, Artificial Sequence
  Synthetic oligonucleotide; CTA chr2 60548547 60548568 60548552 60548547 -
taaaattaattaggtgaaatgt

SEQ ID NO: 210988 - DNA, 22 bp, Artificial Sequence
  Synthetic oligonucleotide; TTA chr2 60548539 60548560 60548544 60548539 -
attaggtgaaatgtggaggtgt

SEQ ID NO: 210989 - DNA, 22 bp, Artificial Sequence
  Synthetic oligonucleotide; TTA chr2 60548535 60548556 60548540 60548535 -
ggtgaaatgtggaggtgtaatc

SEQ ID NO: 210990 - DNA, 22 bp, Artificial Sequence
  Synthetic oligonucleotide; CTC chr2 60548504 60548525 60548509 60548504 -
tgaattaccacttcatttcccg

SEQ ID NO: 210991 - DNA, 22 bp, Artificial Sequence
  Synthetic oligonucleotide; CTG chr2 60548502 60548523 60548507 60548502 -
aattaccacttcatttcccggt

SEQ ID NO: 210992 - DNA, 22 bp, Artificial Sequence
  Synthetic oligonucleotide; TTA chr2 60548497 60548518 60548502 60548497 -
ccacttcatttcccggttttga

SEQ ID NO: 210993 - DNA, 22 bp, Artificial Sequence
  Synthetic oligonucleotide; CTT chr2 60548491 60548512 60548496 60548491 -
catttcccggttttgattgtaa

SEQ ID NO: 210994 - DNA, 22 bp, Artificial Sequence
  Synthetic oligonucleotide; TTC chr2 60548490 60548511 60548495 60548490 -
atttcccggttttgattgtaaa

SEQ ID NO: 210995 - DNA, 22 bp, Artificial Sequence
  Synthetic oligonucleotide; TTT chr2 60548486 60548507 60548491 60548486 -
cccggttttgattgtaaatcag

SEQ ID NO: 210996 - DNA, 22 bp, Artificial Sequence
  Synthetic oligonucleotide; TTC chr2 60548485 60548506 60548490 60548485 -
ccggttttgattgtaaatcagt

SEQ ID NO: 210997 - DNA, 22 bp, Artificial Sequence
  Synthetic oligonucleotide; TTT chr2 60548478 60548499 60548483 60548478 -
tgattgtaaatcagttcagtca

SEQ ID NO: 210998 - DNA, 22 bp, Artificial Sequence
  Synthetic oligonucleotide; TTT chr2 60548477 60548498 60548482 60548477 -
gattgtaaatcagttcagtcac

SEQ ID NO: 210999 - DNA, 22 bp, Artificial Sequence
  Synthetic oligonucleotide; TTG chr2 60548476 60548497 60548481 60548476 -
attgtaaatcagttcagtcact

SEQ ID NO: 211000 - DNA, 22 bp, Artificial Sequence
  Synthetic oligonucleotide; TTG chr2 60548472 60548493 60548477 60548472 -
taaatcagttcagtcactacat

SEQ ID NO: 211001 - DNA, 22 bp, Artificial Sequence
  Synthetic oligonucleotide; TTC chr2 60548461 60548482 60548466 60548461 -
agtcactacatttagaagactt

SEQ ID NO: 211002 - DNA, 22 bp, Artificial Sequence
  Synthetic oligonucleotide; CTA chr2 60548453 60548474 60548458 60548453 -
catttagaagactttaaccaag

SEQ ID NO: 211003 - DNA, 22 bp, Artificial Sequence
  Synthetic oligonucleotide; TTT chr2 60548448 60548469 60548453 60548448 -
agaagactttaaccaagtctgt

SEQ ID NO: 211004 - DNA, 22 bp, Artificial Sequence
  Synthetic oligonucleotide; TTA chr2 60548447 60548468 60548452 60548447 -
gaagactttaaccaagtctgtt

SEQ ID NO: 211005 - DNA, 22 bp, Artificial Sequence
  Synthetic oligonucleotide; CTT chr2 60548439 60548460 60548444 60548439 -
taaccaagtctgttttgaacca

SEQ ID NO: 211006 - DNA, 22 bp, Artificial Sequence
  Synthetic oligonucleotide; TTT chr2 60548438 60548459 60548443 60548438 -
aaccaagtctgttttgaaccac

SEQ ID NO: 211007 - DNA, 22 bp, Artificial Sequence
  Synthetic oligonucleotide; TTA chr2 60548437 60548458 60548442 60548437 -
accaagtctgttttgaaccaca

SEQ ID NO: 211008 - DNA, 22 bp, Artificial Sequence
  Synthetic oligonucleotide; CTG chr2 60548427 60548448 60548432 60548427 -
ttttgaaccacattacctttaa

SEQ ID NO: 211009 - DNA, 22 bp, Artificial Sequence
  Synthetic oligonucleotide; TTT chr2 60548424 60548445 60548429 60548424 -
tgaaccacattacctttaacta

SEQ ID NO: 211010 - DNA, 22 bp, Artificial Sequence
  Synthetic oligonucleotide; TTT chr2 60548423 60548444 60548428 60548423 -
gaaccacattacctttaactat

SEQ ID NO: 211011 - DNA, 22 bp, Artificial Sequence
  Synthetic oligonucleotide; TTG chr2 60548422 60548443 60548427 60548422 -
aaccacattacctttaactatt

SEQ ID NO: 211012 - DNA, 22 bp, Artificial Sequence
  Synthetic oligonucleotide; TTA chr2 60548412 60548433 60548417 60548412 -
cctttaactatttgatacctag

SEQ ID NO: 211013 - DNA, 22 bp, Artificial Sequence
  Synthetic oligonucleotide; CTT chr2 60548408 60548429 60548413 60548408 -
taactatttgatacctaggaga

SEQ ID NO: 211014 - DNA, 22 bp, Artificial Sequence
  Synthetic oligonucleotide; TTT chr2 60548407 60548428 60548412 60548407 -
aactatttgatacctaggagaa

SEQ ID NO: 211015 - DNA, 22 bp, Artificial Sequence
  Synthetic oligonucleotide; TTA chr2 60548406 60548427 60548411 60548406 -
actatttgatacctaggagaat

SEQ ID NO: 211016 - DNA, 22 bp, Artificial Sequence
  Synthetic oligonucleotide; CTA chr2 60548402 60548423 60548407 60548402 -
tttgatacctaggagaatattt

SEQ ID NO: 211017 - DNA, 22 bp, Artificial Sequence
  Synthetic oligonucleotide; TTT chr2 60548399 60548420 60548404 60548399 -
gatacctaggagaatatttcct

SEQ ID NO: 211018 - DNA, 22 bp, Artificial Sequence
  Synthetic oligonucleotide; TTG chr2 60548398 60548419 60548403 60548398 -
atacctaggagaatatttcctt

SEQ ID NO: 211019 - DNA, 22 bp, Artificial Sequence
  Synthetic oligonucleotide; CTA chr2 60548391 60548412 60548396 60548391 -
ggagaatatttccttttgcacc

SEQ ID NO: 211020 - DNA, 22 bp, Artificial Sequence
  Synthetic oligonucleotide; TTT chr2 60548380 60548401 60548385 60548380 -
ccttttgcacctaaataatatt

SEQ ID NO: 211021 - DNA, 22 bp, Artificial Sequence
  Synthetic oligonucleotide; TTC chr2 60548379 60548400 60548384 60548379 -
cttttgcacctaaataatattc

SEQ ID NO: 211022 - DNA, 22 bp, Artificial Sequence
  Synthetic oligonucleotide; CTT chr2 60548376 60548397 60548381 60548376 -
ttgcacctaaataatattccca

SEQ ID NO: 211023 - DNA, 22 bp, Artificial Sequence
  Synthetic oligonucleotide; TTT chr2 60548375 60548396 60548380 60548375 -
tgcacctaaataatattcccac

SEQ ID NO: 211024 - DNA, 22 bp, Artificial Sequence
  Synthetic oligonucleotide; TTT chr2 60548374 60548395 60548379 60548374 -
gcacctaaataatattcccact

SEQ ID NO: 211025 - DNA, 22 bp, Artificial Sequence
  Synthetic oligonucleotide; TTG chr2 60548373 60548394 60548378 60548373 -
cacctaaataatattcccactt

SEQ ID NO: 211026 - DNA, 22 bp, Artificial Sequence
  Synthetic oligonucleotide; CTA chr2 60548367 60548388 60548372 60548367 -
aataatattcccacttttagaa

SEQ ID NO: 211027 - DNA, 22 bp, Artificial Sequence
  Synthetic oligonucleotide; TTC chr2 60548357 60548378 60548362 60548357 -
ccacttttagaaatgtgtcaga

SEQ ID NO: 211028 - DNA, 22 bp, Artificial Sequence
  Synthetic oligonucleotide; CTT chr2 60548351 60548372 60548356 60548351 -
ttagaaatgtgtcagaccttgg

SEQ ID NO: 211029 - DNA, 22 bp, Artificial Sequence
  Synthetic oligonucleotide; TTT chr2 60548350 60548371 60548355 60548350 -
tagaaatgtgtcagaccttggg

SEQ ID NO: 211030 - DNA, 22 bp, Artificial Sequence
  Synthetic oligonucleotide; TTT chr2 60548349 60548370 60548354 60548349 -
agaaatgtgtcagaccttggga

SEQ ID NO: 211031 - DNA, 22 bp, Artificial Sequence
  Synthetic oligonucleotide; TTA chr2 60548348 60548369 60548353 60548348 -
gaaatgtgtcagaccttgggaa

SEQ ID NO: 211032 - DNA, 22 bp, Artificial Sequence
  Synthetic oligonucleotide; CTT chr2 60548331 60548352 60548336 60548331 -
gggaacaaaaaaaaaaaaaaaa

SEQ ID NO: 211033 - DNA, 22 bp, Artificial Sequence
  Synthetic oligonucleotide; TTG chr2 60548330 60548351 60548335 60548330 -
ggaacaaaaaaaaaaaaaaaag

SEQ ID NO: 211034 - DNA, 22 bp, Artificial Sequence
  Synthetic oligonucleotide; CTT chr2 60548302 60548323 60548307 60548302 -
aacggtggaaataaaaaatttt

SEQ ID NO: 211035 - DNA, 22 bp, Artificial Sequence
  Synthetic oligonucleotide; TTA chr2 60548301 60548322 60548306 60548301 -
acggtggaaataaaaaattttt

SEQ ID NO: 211036 - DNA, 22 bp, Artificial Sequence
  Synthetic oligonucleotide; TTT chr2 60548281 60548302 60548286 60548281 -
ttttttttgcaaaggttctatg

SEQ ID NO: 211037 - DNA, 22 bp, Artificial Sequence
  Synthetic oligonucleotide; TTT chr2 60548280 60548301 60548285 60548280 -
tttttttgcaaaggttctatgt

SEQ ID NO: 211038 - DNA, 22 bp, Artificial Sequence
  Synthetic oligonucleotide; TTT chr2 60548279 60548300 60548284 60548279 -
ttttttgcaaaggttctatgta

SEQ ID NO: 211039 - DNA, 22 bp, Artificial Sequence
  Synthetic oligonucleotide; TTT chr2 60548278 60548299 60548283 60548278 -
tttttgcaaaggttctatgtac

SEQ ID NO: 211040 - DNA, 22 bp, Artificial Sequence
  Synthetic oligonucleotide; TTT chr2 60548277 60548298 60548282 60548277 -
ttttgcaaaggttctatgtact

SEQ ID NO: 211041 - DNA, 22 bp, Artificial Sequence
  Synthetic oligonucleotide; TTT chr2 60548276 60548297 60548281 60548276 -
tttgcaaaggttctatgtacta

SEQ ID NO: 211042 - DNA, 22 bp, Artificial Sequence
  Synthetic oligonucleotide; TTT chr2 60548275 60548296 60548280 60548275 -
ttgcaaaggttctatgtactag

SEQ ID NO: 211043 - DNA, 22 bp, Artificial Sequence
  Synthetic oligonucleotide; TTT chr2 60548274 60548295 60548279 60548274 -
tgcaaaggttctatgtactagt

SEQ ID NO: 211044 - DNA, 22 bp, Artificial Sequence
  Synthetic oligonucleotide; TTT chr2 60548273 60548294 60548278 60548273 -
gcaaaggttctatgtactagta

SEQ ID NO: 211045 - DNA, 22 bp, Artificial Sequence
  Synthetic oligonucleotide; TTG chr2 60548272 60548293 60548277 60548272 -
caaaggttctatgtactagtaa

SEQ ID NO: 211046 - DNA, 22 bp, Artificial Sequence
  Synthetic oligonucleotide; TTC chr2 60548263 60548284 60548268 60548263 -
tatgtactagtaagtttgataa

SEQ ID NO: 211047 - DNA, 22 bp, Artificial Sequence
  Synthetic oligonucleotide; CTA chr2 60548261 60548282 60548266 60548261 -
tgtactagtaagtttgataaaa

SEQ ID NO: 211048 - DNA, 22 bp, Artificial Sequence
  Synthetic oligonucleotide; CTA chr2 60548254 60548275 60548259 60548254 -
gtaagtttgataaaatattttc

SEQ ID NO: 211049 - DNA, 22 bp, Artificial Sequence
  Synthetic oligonucleotide; TTT chr2 60548246 60548267 60548251 60548246 -
gataaaatattttcctaagtct

SEQ ID NO: 211050 - DNA, 22 bp, Artificial Sequence
  Synthetic oligonucleotide; TTG chr2 60548245 60548266 60548250 60548245 -
ataaaatattttcctaagtctt

SEQ ID NO: 211051 - DNA, 22 bp, Artificial Sequence
  Synthetic oligonucleotide; TTT chr2 60548234 60548255 60548239 60548234 -
tcctaagtcttccttcagtctg

SEQ ID NO: 211052 - DNA, 22 bp, Artificial Sequence
  Synthetic oligonucleotide; TTT chr2 60548233 60548254 60548238 60548233 -
cctaagtcttccttcagtctgt

SEQ ID NO: 211053 - DNA, 22 bp, Artificial Sequence
  Synthetic oligonucleotide; TTC chr2 60548232 60548253 60548237 60548232 -
ctaagtcttccttcagtctgta

SEQ ID NO: 211054 - DNA, 22 bp, Artificial Sequence
  Synthetic oligonucleotide; CTA chr2 60548229 60548250 60548234 60548229 -
agtcttccttcagtctgtaaac

SEQ ID NO: 211055 - DNA, 22 bp, Artificial Sequence
  Synthetic oligonucleotide; CTT chr2 60548223 60548244 60548228 60548223 -
ccttcagtctgtaaacctcaga

SEQ ID NO: 211056 - DNA, 22 bp, Artificial Sequence
  Synthetic oligonucleotide; TTC chr2 60548222 60548243 60548227 60548222 -
cttcagtctgtaaacctcagaa

SEQ ID NO: 211057 - DNA, 22 bp, Artificial Sequence
  Synthetic oligonucleotide; CTT chr2 60548219 60548240 60548224 60548219 -
cagtctgtaaacctcagaactt

SEQ ID NO: 211058 - DNA, 22 bp, Artificial Sequence
  Synthetic oligonucleotide; TTC chr2 60548218 60548239 60548223 60548218 -
agtctgtaaacctcagaacttg

SEQ ID NO: 211059 - DNA, 22 bp, Artificial Sequence
  Synthetic oligonucleotide; CTG chr2 60548212 60548233 60548217 60548212 -
taaacctcagaacttgtagcta

SEQ ID NO: 211060 - DNA, 22 bp, Artificial Sequence
  Synthetic oligonucleotide; CTC chr2 60548204 60548225 60548209 60548204 -
agaacttgtagctaatgctaaa

SEQ ID NO: 211061 - DNA, 22 bp, Artificial Sequence
  Synthetic oligonucleotide; CTT chr2 60548197 60548218 60548202 60548197 -
gtagctaatgctaaacaaaaaa

SEQ ID NO: 211062 - DNA, 22 bp, Artificial Sequence
  Synthetic oligonucleotide; TTG chr2 60548196 60548217 60548201 60548196 -
tagctaatgctaaacaaaaaag

SEQ ID NO: 211063 - DNA, 22 bp, Artificial Sequence
  Synthetic oligonucleotide; CTA chr2 60548190 60548211 60548195 60548190 -
atgctaaacaaaaaagccacat

SEQ ID NO: 211064 - DNA, 22 bp, Artificial Sequence
  Synthetic oligonucleotide; CTA chr2 60548184 60548205 60548189 60548184 -
aacaaaaaagccacatttatca

SEQ ID NO: 211065 - DNA, 22 bp, Artificial Sequence
  Synthetic oligonucleotide; TTT chr2 60548166 60548187 60548171 60548166 -
atcaatgtgtacttaaaatcct

SEQ ID NO: 211066 - DNA, 22 bp, Artificial Sequence
  Synthetic oligonucleotide; TTA chr2 60548165 60548186 60548170 60548165 -
tcaatgtgtacttaaaatcctt

SEQ ID NO: 211067 - DNA, 22 bp, Artificial Sequence
  Synthetic oligonucleotide; CTT chr2 60548152 60548173 60548157 60548152 -
aaaatccttaattcagacaaca

SEQ ID NO: 211068 - DNA, 22 bp, Artificial Sequence
  Synthetic oligonucleotide; TTA chr2 60548151 60548172 60548156 60548151 -
aaatccttaattcagacaacag

SEQ ID NO: 211069 - DNA, 22 bp, Artificial Sequence
  Synthetic oligonucleotide; CTT chr2 60548143 60548164 60548148 60548143 -
aattcagacaacaggaatattt

SEQ ID NO: 211070 - DNA, 22 bp, Artificial Sequence
  Synthetic oligonucleotide; TTA chr2 60548142 60548163 60548147 60548142 -
attcagacaacaggaatatttt

SEQ ID NO: 211071 - DNA, 22 bp, Artificial Sequence
  Synthetic oligonucleotide; TTC chr2 60548138 60548159 60548143 60548138 -
agacaacaggaatattttgaga

SEQ ID NO: 211072 - DNA, 22 bp, Artificial Sequence
  Synthetic oligonucleotide; TTT chr2 60548121 60548142 60548126 60548121 -
tgagaatgagttccctattcct

SEQ ID NO: 211073 - DNA, 22 bp, Artificial Sequence
  Synthetic oligonucleotide; TTT chr2 60548120 60548141 60548125 60548120 -
gagaatgagttccctattcctc

SEQ ID NO: 211074 - DNA, 22 bp, Artificial Sequence
  Synthetic oligonucleotide; TTG chr2 60548119 60548140 60548124 60548119 -
agaatgagttccctattcctca

SEQ ID NO: 211075 - DNA, 22 bp, Artificial Sequence
  Synthetic oligonucleotide; TTC chr2 60548108 60548129 60548113 60548108 -
cctattcctcacttggtcaaaa

SEQ ID NO: 211076 - DNA, 22 bp, Artificial Sequence
  Synthetic oligonucleotide; CTA chr2 60548104 60548125 60548109 60548104 -
ttcctcacttggtcaaaatgga

SEQ ID NO: 211077 - DNA, 22 bp, Artificial Sequence
  Synthetic oligonucleotide; TTC chr2 60548101 60548122 60548106 60548101 -
ctcacttggtcaaaatggaagc

SEQ ID NO: 211078 - DNA, 22 bp, Artificial Sequence
  Synthetic oligonucleotide; CTC chr2 60548098 60548119 60548103 60548098 -
acttggtcaaaatggaagcaaa

SEQ ID NO: 211079 - DNA, 22 bp, Artificial Sequence
  Synthetic oligonucleotide; CTT chr2 60548094 60548115 60548099 60548094 -
ggtcaaaatggaagcaaatgta

SEQ ID NO: 211080 - DNA, 22 bp, Artificial Sequence
  Synthetic oligonucleotide; TTG chr2 60548093 60548114 60548098 60548093 -
gtcaaaatggaagcaaatgtaa

SEQ ID NO: 211081 - DNA, 22 bp, Artificial Sequence
  Synthetic oligonucleotide; TTA chr2 60548055 60548076 60548060 60548055 -
aggcacaatgcagaggcacttc

SEQ ID NO: 211082 - DNA, 22 bp, Artificial Sequence
  Synthetic oligonucleotide; CTT chr2 60548034 60548055 60548039 60548034 -
ctgtttgtcttcttttatttga

SEQ ID NO: 211083 - DNA, 22 bp, Artificial Sequence
  Synthetic oligonucleotide; TTC chr2 60548033 60548054 60548038 60548033 -
tgtttgtcttcttttatttgaa

SEQ ID NO: 211084 - DNA, 22 bp, Artificial Sequence
  Synthetic oligonucleotide; CTG chr2 60548031 60548052 60548036 60548031 -
tttgtcttcttttatttgaaaa

SEQ ID NO: 211085 - DNA, 22 bp, Artificial Sequence
  Synthetic oligonucleotide; TTT chr2 60548028 60548049 60548033 60548028 -
gtcttcttttatttgaaaagta

SEQ ID NO: 211086 - DNA, 22 bp, Artificial Sequence
  Synthetic oligonucleotide; TTG chr2 60548027 60548048 60548032 60548027 -
tcttcttttatttgaaaagtat

SEQ ID NO: 211087 - DNA, 22 bp, Artificial Sequence
  Synthetic oligonucleotide; CTT chr2 60548023 60548044 60548028 60548023 -
cttttatttgaaaagtatgcat

SEQ ID NO: 211088 - DNA, 22 bp, Artificial Sequence
  Synthetic oligonucleotide; TTC chr2 60548022 60548043 60548027 60548022 -
ttttatttgaaaagtatgcata

SEQ ID NO: 211089 - DNA, 22 bp, Artificial Sequence
  Synthetic oligonucleotide; CTT chr2 60548020 60548041 60548025 60548020 -
ttatttgaaaagtatgcatatg

SEQ ID NO: 211090 - DNA, 22 bp, Artificial Sequence
  Synthetic oligonucleotide; TTT chr2 60548019 60548040 60548024 60548019 -
tatttgaaaagtatgcatatgt

SEQ ID NO: 211091 - DNA, 22 bp, Artificial Sequence
  Synthetic oligonucleotide; TTT chr2 60548018 60548039 60548023 60548018 -
atttgaaaagtatgcatatgta

SEQ ID NO: 211092 - DNA, 22 bp, Artificial Sequence
  Synthetic oligonucleotide; TTA chr2 60548017 60548038 60548022 60548017 -
tttgaaaagtatgcatatgtat

SEQ ID NO: 211093 - DNA, 22 bp, Artificial Sequence
  Synthetic oligonucleotide; TTT chr2 60548014 60548035 60548019 60548014 -
gaaaagtatgcatatgtattct

SEQ ID NO: 211094 - DNA, 22 bp, Artificial Sequence
  Synthetic oligonucleotide; TTG chr2 60548013 60548034 60548018 60548013 -
aaaagtatgcatatgtattctg

SEQ ID NO: 211095 - DNA, 22 bp, Artificial Sequence
  Synthetic oligonucleotide; TTC chr2 60547993 60548014 60547998 60547993 -
tgtatttatcttttggccagta

SEQ ID NO: 211096 - DNA, 22 bp, Artificial Sequence
  Synthetic oligonucleotide; CTG chr2 60547991 60548012 60547996 60547991 -
tatttatcttttggccagtatg

SEQ ID NO: 211097 - DNA, 22 bp, Artificial Sequence
  Synthetic oligonucleotide; TTT chr2 60547986 60548007 60547991 60547986 -
atcttttggccagtatgttggg

SEQ ID NO: 211098 - DNA, 22 bp, Artificial Sequence
  Synthetic oligonucleotide; TTA chr2 60547985 60548006 60547990 60547985 -
tcttttggccagtatgttgggc

SEQ ID NO: 211099 - DNA, 22 bp, Artificial Sequence
  Synthetic oligonucleotide; CTT chr2 60547981 60548002 60547986 60547981 -
ttggccagtatgttgggcaaag

SEQ ID NO: 211100 - DNA, 22 bp, Artificial Sequence
  Synthetic oligonucleotide; TTT chr2 60547980 60548001 60547985 60547980 -
tggccagtatgttgggcaaaga

SEQ ID NO: 211101 - DNA, 22 bp, Artificial Sequence
  Synthetic oligonucleotide; TTT chr2 60547979 60548000 60547984 60547979 -
ggccagtatgttgggcaaagaa

SEQ ID NO: 211102 - DNA, 22 bp, Artificial Sequence
  Synthetic oligonucleotide; TTG chr2 60547978 60547999 60547983 60547978 -
gccagtatgttgggcaaagaaa

SEQ ID NO: 211103 - DNA, 22 bp, Artificial Sequence
  Synthetic oligonucleotide; TTG chr2 60547966 60547987 60547971 60547966 -
ggcaaagaaacataagtgctta

SEQ ID NO: 211104 - DNA, 22 bp, Artificial Sequence
  Synthetic oligonucleotide; CTT chr2 60547945 60547966 60547950 60547945 -
actttactgtctttattagtag

SEQ ID NO: 211105 - DNA, 22 bp, Artificial Sequence
  Synthetic oligonucleotide; TTA chr2 60547944 60547965 60547949 60547944 -
ctttactgtctttattagtagg

SEQ ID NO: 211106 - DNA, 22 bp, Artificial Sequence
  Synthetic oligonucleotide; CTT chr2 60547941 60547962 60547946 60547941 -
tactgtctttattagtaggaat

SEQ ID NO: 211107 - DNA, 22 bp, Artificial Sequence
  Synthetic oligonucleotide; TTT chr2 60547940 60547961 60547945 60547940 -
actgtctttattagtaggaata

SEQ ID NO: 211108 - DNA, 22 bp, Artificial Sequence
  Synthetic oligonucleotide; TTA chr2 60547939 60547960 60547944 60547939 -
ctgtctttattagtaggaatat

SEQ ID NO: 211109 - DNA, 22 bp, Artificial Sequence
  Synthetic oligonucleotide; CTG chr2 60547936 60547957 60547941 60547936 -
tctttattagtaggaatataac

SEQ ID NO: 211110 - DNA, 22 bp, Artificial Sequence
  Synthetic oligonucleotide; CTT chr2 60547932 60547953 60547937 60547932 -
tattagtaggaatataaccttc

SEQ ID NO: 211111 - DNA, 22 bp, Artificial Sequence
  Synthetic oligonucleotide; TTT chr2 60547931 60547952 60547936 60547931 -
attagtaggaatataaccttca

SEQ ID NO: 211112 - DNA, 22 bp, Artificial Sequence
  Synthetic oligonucleotide; TTA chr2 60547930 60547951 60547935 60547930 -
ttagtaggaatataaccttcat

SEQ ID NO: 211113 - DNA, 22 bp, Artificial Sequence
  Synthetic oligonucleotide; TTA chr2 60547927 60547948 60547932 60547927 -
gtaggaatataaccttcatatt

SEQ ID NO: 211114 - DNA, 22 bp, Artificial Sequence
  Synthetic oligonucleotide; CTT chr2 60547911 60547932 60547916 60547911 -
catattcctgtggtgaccttat

SEQ ID NO: 211115 - DNA, 22 bp, Artificial Sequence
  Synthetic oligonucleotide; TTC chr2 60547910 60547931 60547915 60547910 -
atattcctgtggtgaccttatg

SEQ ID NO: 211116 - DNA, 22 bp, Artificial Sequence
  Synthetic oligonucleotide; TTC chr2 60547904 60547925 60547909 60547904 -
ctgtggtgaccttatgttaaat

SEQ ID NO: 211117 - DNA, 22 bp, Artificial Sequence
  Synthetic oligonucleotide; CTG chr2 60547901 60547922 60547906 60547901 -
tggtgaccttatgttaaattag

SEQ ID NO: 211118 - DNA, 22 bp, Artificial Sequence
  Synthetic oligonucleotide; CTT chr2 60547891 60547912 60547896 60547891 -
atgttaaattaggaggagtacc

SEQ ID NO: 211119 - DNA, 22 bp, Artificial Sequence
  Synthetic oligonucleotide; TTA chr2 60547890 60547911 60547895 60547890 -
tgttaaattaggaggagtacca

SEQ ID NO: 211120 - DNA, 22 bp, Artificial Sequence
  Synthetic oligonucleotide; TTA chr2 60547885 60547906 60547890 60547885 -
aattaggaggagtaccagaggc

SEQ ID NO: 211121 - DNA, 22 bp, Artificial Sequence
  Synthetic oligonucleotide; TTA chr2 60547880 60547901 60547885 60547880 -
ggaggagtaccagaggctagaa

SEQ ID NO: 211122 - DNA, 22 bp, Artificial Sequence
  Synthetic oligonucleotide; CTA chr2 60547861 60547882 60547866 60547861 -
gaaattatgagatgtcctactt

SEQ ID NO: 211123 - DNA, 22 bp, Artificial Sequence
  Synthetic oligonucleotide; TTA chr2 60547854 60547875 60547859 60547854 -
tgagatgtcctacttgagcaca

SEQ ID NO: 211124 - DNA, 22 bp, Artificial Sequence
  Synthetic oligonucleotide; CTA chr2 60547842 60547863 60547847 60547842 -
cttgagcacaggtgcagctagg

SEQ ID NO: 211125 - DNA, 22 bp, Artificial Sequence
  Synthetic oligonucleotide; CTT chr2 60547839 60547860 60547844 60547839 -
gagcacaggtgcagctaggcag

SEQ ID NO: 211126 - DNA, 22 bp, Artificial Sequence
  Synthetic oligonucleotide; TTG chr2 60547838 60547859 60547843 60547838 -
agcacaggtgcagctaggcagg

SEQ ID NO: 211127 - DNA, 22 bp, Artificial Sequence
  Synthetic oligonucleotide; CTA chr2 60547822 60547843 60547827 60547822 -
ggcagggctctctcaatattat

SEQ ID NO: 211128 - DNA, 22 bp, Artificial Sequence
  Synthetic oligonucleotide; CTC chr2 60547812 60547833 60547817 60547812 -
tctcaatattatttcacctagc

SEQ ID NO: 211129 - DNA, 22 bp, Artificial Sequence
  Synthetic oligonucleotide; CTC chr2 60547810 60547831 60547815 60547810 -
tcaatattatttcacctagcac

SEQ ID NO: 211130 - DNA, 22 bp, Artificial Sequence
  Synthetic oligonucleotide; CTC chr2 60547808 60547829 60547813 60547808 -
aatattatttcacctagcacat

SEQ ID NO: 211131 - DNA, 22 bp, Artificial Sequence
  Synthetic oligonucleotide; TTA chr2 60547801 60547822 60547806 60547801 -
tttcacctagcacatctgggag

SEQ ID NO: 211132 - DNA, 22 bp, Artificial Sequence
  Synthetic oligonucleotide; TTT chr2 60547798 60547819 60547803 60547798 -
cacctagcacatctgggagtta

SEQ ID NO: 211133 - DNA, 22 bp, Artificial Sequence
  Synthetic oligonucleotide; TTC chr2 60547797 60547818 60547802 60547797 -
acctagcacatctgggagttac

SEQ ID NO: 211134 - DNA, 22 bp, Artificial Sequence
  Synthetic oligonucleotide; CTA chr2 60547792 60547813 60547797 60547792 -
gcacatctgggagttactccag

SEQ ID NO: 211135 - DNA, 22 bp, Artificial Sequence
  Synthetic oligonucleotide; CTG chr2 60547783 60547804 60547788 60547783 -
ggagttactccagatcttcccc

SEQ ID NO: 211136 - DNA, 22 bp, Artificial Sequence
  Synthetic oligonucleotide; TTA chr2 60547776 60547797 60547781 60547776 -
ctccagatcttccccctcaata

SEQ ID NO: 211137 - DNA, 22 bp, Artificial Sequence
  Synthetic oligonucleotide; CTC chr2 60547773 60547794 60547778 60547773 -
cagatcttccccctcaatattc

SEQ ID NO: 211138 - DNA, 22 bp, Artificial Sequence
  Synthetic oligonucleotide; CTT chr2 60547765 60547786 60547770 60547765 -
ccccctcaatattcagcctggg

SEQ ID NO: 211139 - DNA, 22 bp, Artificial Sequence
  Synthetic oligonucleotide; TTC chr2 60547764 60547785 60547769 60547764 -
cccctcaatattcagcctgggt

SEQ ID NO: 211140 - DNA, 22 bp, Artificial Sequence
  Synthetic oligonucleotide; CTC chr2 60547758 60547779 60547763 60547758 -
aatattcagcctgggtagggtt

SEQ ID NO: 211141 - DNA, 22 bp, Artificial Sequence
  Synthetic oligonucleotide; TTC chr2 60547751 60547772 60547756 60547751 -
agcctgggtagggttgaaataa

SEQ ID NO: 211142 - DNA, 22 bp, Artificial Sequence
  Synthetic oligonucleotide; CTG chr2 60547745 60547766 60547750 60547745 -
ggtagggttgaaataaatttaa

SEQ ID NO: 211143 - DNA, 22 bp, Artificial Sequence
  Synthetic oligonucleotide; TTG chr2 60547735 60547756 60547740 60547735 -
aaataaatttaacctgagttca

SEQ ID NO: 211144 - DNA, 22 bp, Artificial Sequence
  Synthetic oligonucleotide; TTT chr2 60547725 60547746 60547730 60547725 -
aacctgagttcactggattttt

SEQ ID NO: 211145 - DNA, 22 bp, Artificial Sequence
  Synthetic oligonucleotide; TTA chr2 60547724 60547745 60547729 60547724 -
acctgagttcactggatttttg

SEQ ID NO: 211146 - DNA, 22 bp, Artificial Sequence
  Synthetic oligonucleotide; CTG chr2 60547719 60547740 60547724 60547719 -
agttcactggatttttgcactt

SEQ ID NO: 211147 - DNA, 22 bp, Artificial Sequence
  Synthetic oligonucleotide; TTC chr2 60547714 60547735 60547719 60547714 -
actggatttttgcactttatca

SEQ ID NO: 211148 - DNA, 22 bp, Artificial Sequence
  Synthetic oligonucleotide; CTG chr2 60547710 60547731 60547715 60547710 -
gatttttgcactttatcaaaat

SEQ ID NO: 211149 - DNA, 22 bp, Artificial Sequence
  Synthetic oligonucleotide; TTT chr2 60547705 60547726 60547710 60547705 -
ttgcactttatcaaaatctgtt

SEQ ID NO: 211150 - DNA, 22 bp, Artificial Sequence
  Synthetic oligonucleotide; TTT chr2 60547704 60547725 60547709 60547704 -
tgcactttatcaaaatctgttc

SEQ ID NO: 211151 - DNA, 22 bp, Artificial Sequence
  Synthetic oligonucleotide; TTT chr2 60547703 60547724 60547708 60547703 -
gcactttatcaaaatctgttcc

SEQ ID NO: 211152 - DNA, 22 bp, Artificial Sequence
  Synthetic oligonucleotide; TTG chr2 60547702 60547723 60547707 60547702 -
cactttatcaaaatctgttcca

SEQ ID NO: 211153 - DNA, 22 bp, Artificial Sequence
  Synthetic oligonucleotide; CTT chr2 60547697 60547718 60547702 60547697 -
tatcaaaatctgttccaatatt

SEQ ID NO: 211154 - DNA, 22 bp, Artificial Sequence
  Synthetic oligonucleotide; TTT chr2 60547696 60547717 60547701 60547696 -
atcaaaatctgttccaatattc

SEQ ID NO: 211155 - DNA, 22 bp, Artificial Sequence
  Synthetic oligonucleotide; TTA chr2 60547695 60547716 60547700 60547695 -
tcaaaatctgttccaatattct

SEQ ID NO: 211156 - DNA, 22 bp, Artificial Sequence
  Synthetic oligonucleotide; CTG chr2 60547685 60547706 60547690 60547685 -
ttccaatattctacactcaaat

SEQ ID NO: 211157 - DNA, 22 bp, Artificial Sequence
  Synthetic oligonucleotide; TTC chr2 60547682 60547703 60547687 60547682 -
caatattctacactcaaattaa

SEQ ID NO: 211158 - DNA, 22 bp, Artificial Sequence
  Synthetic oligonucleotide; TTC chr2 60547674 60547695 60547679 60547674 -
tacactcaaattaaaatctatt

SEQ ID NO: 211159 - DNA, 22 bp, Artificial Sequence
  Synthetic oligonucleotide; CTA chr2 60547672 60547693 60547677 60547672 -
cactcaaattaaaatctatttt

SEQ ID NO: 211160 - DNA, 22 bp, Artificial Sequence
  Synthetic oligonucleotide; CTC chr2 60547667 60547688 60547672 60547667 -
aaattaaaatctattttttgat

SEQ ID NO: 211161 - DNA, 22 bp, Artificial Sequence
  Synthetic oligonucleotide; TTA chr2 60547661 60547682 60547666 60547661 -
aaatctattttttgattctctg

SEQ ID NO: 211162 - DNA, 22 bp, Artificial Sequence
  Synthetic oligonucleotide; CTA chr2 60547654 60547675 60547659 60547654 -
ttttttgattctctgtggcttt

SEQ ID NO: 211163 - DNA, 22 bp, Artificial Sequence
  Synthetic oligonucleotide; TTT chr2 60547651 60547672 60547656 60547651 -
tttgattctctgtggctttaag

SEQ ID NO: 211164 - DNA, 22 bp, Artificial Sequence
  Synthetic oligonucleotide; TTT chr2 60547650 60547671 60547655 60547650 -
ttgattctctgtggctttaagt

SEQ ID NO: 211165 - DNA, 22 bp, Artificial Sequence
  Synthetic oligonucleotide; TTT chr2 60547649 60547670 60547654 60547649 -
tgattctctgtggctttaagtt

SEQ ID NO: 211166 - DNA, 22 bp, Artificial Sequence
  Synthetic oligonucleotide; TTT chr2 60547648 60547669 60547653 60547648 -
gattctctgtggctttaagttc

SEQ ID NO: 211167 - DNA, 22 bp, Artificial Sequence
  Synthetic oligonucleotide; TTG chr2 60547647 60547668 60547652 60547647 -
attctctgtggctttaagttca

SEQ ID NO: 211168 - DNA, 22 bp, Artificial Sequence
  Synthetic oligonucleotide; TTC chr2 60547643 60547664 60547648 60547643 -
tctgtggctttaagttcattaa

SEQ ID NO: 211169 - DNA, 22 bp, Artificial Sequence
  Synthetic oligonucleotide; CTC chr2 60547641 60547662 60547646 60547641 -
tgtggctttaagttcattaaat

SEQ ID NO: 211170 - DNA, 22 bp, Artificial Sequence
  Synthetic oligonucleotide; CTG chr2 60547639 60547660 60547644 60547639 -
tggctttaagttcattaaatgt

SEQ ID NO: 211171 - DNA, 22 bp, Artificial Sequence
  Synthetic oligonucleotide; CTT chr2 60547633 60547654 60547638 60547633 -
taagttcattaaatgtaaaatt

SEQ ID NO: 211172 - DNA, 22 bp, Artificial Sequence
  Synthetic oligonucleotide; TTT chr2 60547632 60547653 60547637 60547632 -
aagttcattaaatgtaaaattg

SEQ ID NO: 211173 - DNA, 22 bp, Artificial Sequence
  Synthetic oligonucleotide; TTA chr2 60547631 60547652 60547636 60547631 -
agttcattaaatgtaaaattgg

SEQ ID NO: 211174 - DNA, 22 bp, Artificial Sequence
  Synthetic oligonucleotide; TTC chr2 60547626 60547647 60547631 60547626 -
attaaatgtaaaattggcagct

SEQ ID NO: 211175 - DNA, 22 bp, Artificial Sequence
  Synthetic oligonucleotide; TTA chr2 60547622 60547643 60547627 60547622 -
aatgtaaaattggcagcttgct

SEQ ID NO: 211176 - DNA, 22 bp, Artificial Sequence
  Synthetic oligonucleotide; TTG chr2 60547610 60547631 60547615 60547610 -
gcagcttgctaaagaaggtcag

SEQ ID NO: 211177 - DNA, 22 bp, Artificial Sequence
  Synthetic oligonucleotide; CTT chr2 60547603 60547624 60547608 60547603 -
gctaaagaaggtcagactgatt

SEQ ID NO: 211178 - DNA, 22 bp, Artificial Sequence
  Synthetic oligonucleotide; TTG chr2 60547602 60547623 60547607 60547602 -
ctaaagaaggtcagactgatta

SEQ ID NO: 211179 - DNA, 22 bp, Artificial Sequence
  Synthetic oligonucleotide; CTA chr2 60547599 60547620 60547604 60547599 -
aagaaggtcagactgattaact

SEQ ID NO: 211180 - DNA, 22 bp, Artificial Sequence
  Synthetic oligonucleotide; CTG chr2 60547584 60547605 60547589 60547584 -
attaactgtttaagacttgtac

SEQ ID NO: 211181 - DNA, 22 bp, Artificial Sequence
  Synthetic oligonucleotide; TTA chr2 60547580 60547601 60547585 60547580 -
actgtttaagacttgtacattt

SEQ ID NO: 211182 - DNA, 22 bp, Artificial Sequence
  Synthetic oligonucleotide; CTG chr2 60547576 60547597 60547581 60547576 -
tttaagacttgtacattttctg

SEQ ID NO: 211183 - DNA, 22 bp, Artificial Sequence
  Synthetic oligonucleotide; TTT chr2 60547573 60547594 60547578 60547573 -
aagacttgtacattttctgctt

SEQ ID NO: 211184 - DNA, 22 bp, Artificial Sequence
  Synthetic oligonucleotide; TTA chr2 60547572 60547593 60547577 60547572 -
agacttgtacattttctgcttc

SEQ ID NO: 211185 - DNA, 22 bp, Artificial Sequence
  Synthetic oligonucleotide; CTT chr2 60547566 60547587 60547571 60547566 -
gtacattttctgcttcagtttt

SEQ ID NO: 211186 - DNA, 22 bp, Artificial Sequence
  Synthetic oligonucleotide; TTG chr2 60547565 60547586 60547570 60547565 -
tacattttctgcttcagtttta

SEQ ID NO: 211187 - DNA, 22 bp, Artificial Sequence
  Synthetic oligonucleotide; TTT chr2 60547558 60547579 60547563 60547558 -
tctgcttcagttttattaactg

SEQ ID NO: 211188 - DNA, 22 bp, Artificial Sequence
  Synthetic oligonucleotide; TTT chr2 60547557 60547578 60547562 60547557 -
ctgcttcagttttattaactgg

SEQ ID NO: 211189 - DNA, 22 bp, Artificial Sequence
  Synthetic oligonucleotide; TTC chr2 60547556 60547577 60547561 60547556 -
tgcttcagttttattaactggc

SEQ ID NO: 211190 - DNA, 22 bp, Artificial Sequence
  Synthetic oligonucleotide; CTG chr2 60547554 60547575 60547559 60547554 -
cttcagttttattaactggcag

SEQ ID NO: 211191 - DNA, 22 bp, Artificial Sequence
  Synthetic oligonucleotide; CTT chr2 60547551 60547572 60547556 60547551 -
cagttttattaactggcagcat

SEQ ID NO: 211192 - DNA, 22 bp, Artificial Sequence
  Synthetic oligonucleotide; TTC chr2 60547550 60547571 60547555 60547550 -
agttttattaactggcagcatc

SEQ ID NO: 211193 - DNA, 22 bp, Artificial Sequence
  Synthetic oligonucleotide; TTT chr2 60547545 60547566 60547550 60547545 -
tattaactggcagcatcctgga

SEQ ID NO: 211194 - DNA, 22 bp, Artificial Sequence
  Synthetic oligonucleotide; TTT chr2 60547544 60547565 60547549 60547544 -
attaactggcagcatcctggat

SEQ ID NO: 211195 - DNA, 22 bp, Artificial Sequence
  Synthetic oligonucleotide; TTA chr2 60547543 60547564 60547548 60547543 -
ttaactggcagcatcctggatg

SEQ ID NO: 211196 - DNA, 22 bp, Artificial Sequence
  Synthetic oligonucleotide; TTA chr2 60547540 60547561 60547545 60547540 -
actggcagcatcctggatgttt

SEQ ID NO: 211197 - DNA, 22 bp, Artificial Sequence
  Synthetic oligonucleotide; CTG chr2 60547536 60547557 60547541 60547536 -
gcagcatcctggatgttttgta

SEQ ID NO: 211198 - DNA, 22 bp, Artificial Sequence
  Synthetic oligonucleotide; CTG chr2 60547525 60547546 60547530 60547525 -
gatgttttgtattttgtgattt

SEQ ID NO: 211199 - DNA, 22 bp, Artificial Sequence
  Synthetic oligonucleotide; TTT chr2 60547518 60547539 60547523 60547518 -
tgtattttgtgatttttttttt

SEQ ID NO: 211200 - DNA, 22 bp, Artificial Sequence
  Synthetic oligonucleotide; TTT chr2 60547517 60547538 60547522 60547517 -
gtattttgtgattttttttttt

SEQ ID NO: 211201 - DNA, 22 bp, Artificial Sequence
  Synthetic oligonucleotide; TTG chr2 60547516 60547537 60547521 60547516 -
tattttgtgatttttttttttt

SEQ ID NO: 211202 - DNA, 22 bp, Artificial Sequence
  Synthetic oligonucleotide; TTT chr2 60547511 60547532 60547516 60547511 -
tgtgattttttttttttttttg

SEQ ID NO: 211203 - DNA, 22 bp, Artificial Sequence
  Synthetic oligonucleotide; TTT chr2 60547510 60547531 60547515 60547510 -
gtgattttttttttttttttga

SEQ ID NO: 211204 - DNA, 22 bp, Artificial Sequence
  Synthetic oligonucleotide; TTG chr2 60547509 60547530 60547514 60547509 -
tgattttttttttttttttgat

SEQ ID NO: 211205 - DNA, 22 bp, Artificial Sequence
  Synthetic oligonucleotide; TTT chr2 60547503 60547524 60547508 60547503 -
tttttttttttttgatagagca

SEQ ID NO: 211206 - DNA, 22 bp, Artificial Sequence
  Synthetic oligonucleotide; TTT chr2 60547502 60547523 60547507 60547502 -
ttttttttttttgatagagcaa

SEQ ID NO: 211207 - DNA, 22 bp, Artificial Sequence
  Synthetic oligonucleotide; TTT chr2 60547501 60547522 60547506 60547501 -
tttttttttttgatagagcaag

SEQ ID NO: 211208 - DNA, 22 bp, Artificial Sequence
  Synthetic oligonucleotide; TTT chr2 60547500 60547521 60547505 60547500 -
ttttttttttgatagagcaagc

SEQ ID NO: 211209 - DNA, 22 bp, Artificial Sequence
  Synthetic oligonucleotide; TTT chr2 60547499 60547520 60547504 60547499 -
tttttttttgatagagcaagca

SEQ ID NO: 211210 - DNA, 22 bp, Artificial Sequence
  Synthetic oligonucleotide; TTT chr2 60547498 60547519 60547503 60547498 -
ttttttttgatagagcaagcat

SEQ ID NO: 211211 - DNA, 22 bp, Artificial Sequence
  Synthetic oligonucleotide; TTT chr2 60547497 60547518 60547502 60547497 -
tttttttgatagagcaagcata

SEQ ID NO: 211212 - DNA, 22 bp, Artificial Sequence
  Synthetic oligonucleotide; TTT chr2 60547496 60547517 60547501 60547496 -
ttttttgatagagcaagcataa

SEQ ID NO: 211213 - DNA, 22 bp, Artificial Sequence
  Synthetic oligonucleotide; TTT chr2 60547495 60547516 60547500 60547495 -
tttttgatagagcaagcataag

SEQ ID NO: 211214 - DNA, 22 bp, Artificial Sequence
  Synthetic oligonucleotide; TTT chr2 60547494 60547515 60547499 60547494 -
ttttgatagagcaagcataaga

SEQ ID NO: 211215 - DNA, 22 bp, Artificial Sequence
  Synthetic oligonucleotide; TTT chr2 60547493 60547514 60547498 60547493 -
tttgatagagcaagcataagat

SEQ ID NO: 211216 - DNA, 22 bp, Artificial Sequence
  Synthetic oligonucleotide; TTT chr2 60547492 60547513 60547497 60547492 -
ttgatagagcaagcataagatt

SEQ ID NO: 211217 - DNA, 22 bp, Artificial Sequence
  Synthetic oligonucleotide; TTT chr2 60547491 60547512 60547496 60547491 -
tgatagagcaagcataagattt

SEQ ID NO: 211218 - DNA, 22 bp, Artificial Sequence
  Synthetic oligonucleotide; TTT chr2 60547490 60547511 60547495 60547490 -
gatagagcaagcataagatttc

SEQ ID NO: 211219 - DNA, 22 bp, Artificial Sequence
  Synthetic oligonucleotide; TTG chr2 60547489 60547510 60547494 60547489 -
atagagcaagcataagatttca

SEQ ID NO: 211220 - DNA, 22 bp, Artificial Sequence
  Synthetic oligonucleotide; TTT chr2 60547469 60547490 60547474 60547469 -
cacaagcagagacttaccaact

SEQ ID NO: 211221 - DNA, 22 bp, Artificial Sequence
  Synthetic oligonucleotide; TTC chr2 60547468 60547489 60547473 60547468 -
acaagcagagacttaccaactc

SEQ ID NO: 211222 - DNA, 22 bp, Artificial Sequence
  Synthetic oligonucleotide; CTT chr2 60547454 60547475 60547459 60547454 -
accaactctcttttcccctttg

SEQ ID NO: 211223 - DNA, 22 bp, Artificial Sequence
  Synthetic oligonucleotide; TTA chr2 60547453 60547474 60547458 60547453 -
ccaactctcttttcccctttgg

SEQ ID NO: 211224 - DNA, 22 bp, Artificial Sequence
  Synthetic oligonucleotide; CTC chr2 60547446 60547467 60547451 60547446 -
tcttttcccctttggaagctta

SEQ ID NO: 211225 - DNA, 22 bp, Artificial Sequence
  Synthetic oligonucleotide; CTC chr2 60547444 60547465 60547449 60547444 -
ttttcccctttggaagcttaaa

SEQ ID NO: 211226 - DNA, 22 bp, Artificial Sequence
  Synthetic oligonucleotide; CTT chr2 60547442 60547463 60547447 60547442 -
ttcccctttggaagcttaaaaa

SEQ ID NO: 211227 - DNA, 22 bp, Artificial Sequence
  Synthetic oligonucleotide; TTT chr2 60547441 60547462 60547446 60547441 -
tcccctttggaagcttaaaaaa

SEQ ID NO: 211228 - DNA, 22 bp, Artificial Sequence
  Synthetic oligonucleotide; TTT chr2 60547440 60547461 60547445 60547440 -
cccctttggaagcttaaaaaat

SEQ ID NO: 211229 - DNA, 22 bp, Artificial Sequence
  Synthetic oligonucleotide; TTC chr2 60547439 60547460 60547444 60547439 -
ccctttggaagcttaaaaaatg

SEQ ID NO: 211230 - DNA, 22 bp, Artificial Sequence
  Synthetic oligonucleotide; CTT chr2 60547434 60547455 60547439 60547434 -
tggaagcttaaaaaatgataga

SEQ ID NO: 211231 - DNA, 22 bp, Artificial Sequence
  Synthetic oligonucleotide; TTT chr2 60547433 60547454 60547438 60547433 -
ggaagcttaaaaaatgatagaa

SEQ ID NO: 211232 - DNA, 22 bp, Artificial Sequence
  Synthetic oligonucleotide; TTG chr2 60547432 60547453 60547437 60547432 -
gaagcttaaaaaatgatagaag

SEQ ID NO: 211233 - DNA, 22 bp, Artificial Sequence
  Synthetic oligonucleotide; CTT chr2 60547425 60547446 60547430 60547425 -
aaaaaatgatagaagctggtaa

SEQ ID NO: 211234 - DNA, 22 bp, Artificial Sequence
  Synthetic oligonucleotide; TTA chr2 60547424 60547445 60547429 60547424 -
aaaaatgatagaagctggtaaa

SEQ ID NO: 211235 - DNA, 22 bp, Artificial Sequence
  Synthetic oligonucleotide; CTG chr2 60547407 60547428 60547412 60547407 -
gtaaagtagatgctggagtatt

SEQ ID NO: 211236 - DNA, 22 bp, Artificial Sequence
  Synthetic oligonucleotide; CTG chr2 60547392 60547413 60547397 60547392 -
gagtattttagtacaaagttaa

SEQ ID NO: 211237 - DNA, 22 bp, Artificial Sequence
  Synthetic oligonucleotide; TTT chr2 60547384 60547405 60547389 60547384 -
tagtacaaagttaaaaaaaaaa

SEQ ID NO: 211238 - DNA, 22 bp, Artificial Sequence
  Synthetic oligonucleotide; TTT chr2 60547383 60547404 60547388 60547383 -
agtacaaagttaaaaaaaaaag

SEQ ID NO: 211239 - DNA, 22 bp, Artificial Sequence
  Synthetic oligonucleotide; TTA chr2 60547382 60547403 60547387 60547382 -
gtacaaagttaaaaaaaaaagc

SEQ ID NO: 211240 - DNA, 22 bp, Artificial Sequence
  Synthetic oligonucleotide; TTA chr2 60547371 60547392 60547376 60547371 -
aaaaaaaaagcaaacaggaaag

SEQ ID NO: 211241 - DNA, 22 bp, Artificial Sequence
  Synthetic oligonucleotide; CTA chr2 60547336 60547357 60547341 60547336 -
ccttgttataccatccgctggt

SEQ ID NO: 211242 - DNA, 22 bp, Artificial Sequence
  Synthetic oligonucleotide; CTT chr2 60547332 60547353 60547337 60547332 -
gttataccatccgctggtgatt

SEQ ID NO: 211243 - DNA, 22 bp, Artificial Sequence
  Synthetic oligonucleotide; TTG chr2 60547331 60547352 60547336 60547331 -
ttataccatccgctggtgatta

SEQ ID NO: 211244 - DNA, 22 bp, Artificial Sequence
  Synthetic oligonucleotide; TTA chr2 60547328 60547349 60547333 60547328 -
taccatccgctggtgattatgt

SEQ ID NO: 211245 - DNA, 22 bp, Artificial Sequence
  Synthetic oligonucleotide; CTG chr2 60547316 60547337 60547321 60547316 -
gtgattatgtgtgcagaaatag

SEQ ID NO: 211246 - DNA, 22 bp, Artificial Sequence
  Synthetic oligonucleotide; TTA chr2 60547309 60547330 60547314 60547309 -
tgtgtgcagaaatagtctcata

SEQ ID NO: 211247 - DNA, 22 bp, Artificial Sequence
  Synthetic oligonucleotide; CTC chr2 60547290 60547311 60547295 60547290 -
ataatgaagcattttggagctc

SEQ ID NO: 211248 - DNA, 22 bp, Artificial Sequence
  Synthetic oligonucleotide; TTT chr2 60547276 60547297 60547281 60547276 -
tggagctcattcagaaaattag

SEQ ID NO: 211249 - DNA, 22 bp, Artificial Sequence
  Synthetic oligonucleotide; TTT chr2 60547275 60547296 60547280 60547275 -
ggagctcattcagaaaattagt

SEQ ID NO: 211250 - DNA, 22 bp, Artificial Sequence
  Synthetic oligonucleotide; TTG chr2 60547274 60547295 60547279 60547274 -
gagctcattcagaaaattagtc

SEQ ID NO: 211251 - DNA, 22 bp, Artificial Sequence
  Synthetic oligonucleotide; CTC chr2 60547268 60547289 60547273 60547268 -
attcagaaaattagtccacttt

SEQ ID NO: 211252 - DNA, 22 bp, Artificial Sequence
  Synthetic oligonucleotide; TTC chr2 60547264 60547285 60547269 60547264 -
agaaaattagtccactttgaca

SEQ ID NO: 211253 - DNA, 22 bp, Artificial Sequence
  Synthetic oligonucleotide; TTA chr2 60547255 60547276 60547260 60547255 -
gtccactttgacaacattaggc

SEQ ID NO: 211254 - DNA, 22 bp, Artificial Sequence
  Synthetic oligonucleotide; CTT chr2 60547247 60547268 60547252 60547247 -
tgacaacattaggcgaagtatt

SEQ ID NO: 211255 - DNA, 22 bp, Artificial Sequence
  Synthetic oligonucleotide; TTT chr2 60547246 60547267 60547251 60547246 -
gacaacattaggcgaagtattt

SEQ ID NO: 211256 - DNA, 22 bp, Artificial Sequence
  Synthetic oligonucleotide; TTG chr2 60547245 60547266 60547250 60547245 -
acaacattaggcgaagtatttc

SEQ ID NO: 211257 - DNA, 22 bp, Artificial Sequence
  Synthetic oligonucleotide; TTA chr2 60547236 60547257 60547241 60547236 -
ggcgaagtatttcaagtctaaa

SEQ ID NO: 211258 - DNA, 22 bp, Artificial Sequence
  Synthetic oligonucleotide; TTT chr2 60547224 60547245 60547229 60547224 -
caagtctaaagaaaggacttct

SEQ ID NO: 211259 - DNA, 22 bp, Artificial Sequence
  Synthetic oligonucleotide; TTC chr2 60547223 60547244 60547228 60547223 -
aagtctaaagaaaggacttctc

SEQ ID NO: 211260 - DNA, 22 bp, Artificial Sequence
  Synthetic oligonucleotide; CTA chr2 60547216 60547237 60547221 60547216 -
aagaaaggacttctcagccttg

SEQ ID NO: 211261 - DNA, 22 bp, Artificial Sequence
  Synthetic oligonucleotide; CTT chr2 60547204 60547225 60547209 60547204 -
ctcagccttgctctgaaatgtg

SEQ ID NO: 211262 - DNA, 22 bp, Artificial Sequence
  Synthetic oligonucleotide; TTC chr2 60547203 60547224 60547208 60547203 -
tcagccttgctctgaaatgtgg

SEQ ID NO: 211263 - DNA, 22 bp, Artificial Sequence
  Synthetic oligonucleotide; CTC chr2 60547201 60547222 60547206 60547201 -
agccttgctctgaaatgtggtg

SEQ ID NO: 211264 - DNA, 22 bp, Artificial Sequence
  Synthetic oligonucleotide; CTT chr2 60547195 60547216 60547200 60547195 -
gctctgaaatgtggtgtttgct

SEQ ID NO: 211265 - DNA, 22 bp, Artificial Sequence
  Synthetic oligonucleotide; TTG chr2 60547194 60547215 60547199 60547194 -
ctctgaaatgtggtgtttgctt

SEQ ID NO: 211266 - DNA, 22 bp, Artificial Sequence
  Synthetic oligonucleotide; CTC chr2 60547191 60547212 60547196 60547191 -
tgaaatgtggtgtttgcttgac

SEQ ID NO: 211267 - DNA, 22 bp, Artificial Sequence
  Synthetic oligonucleotide; CTG chr2 60547189 60547210 60547194 60547189 -
aaatgtggtgtttgcttgacca

SEQ ID NO: 211268 - DNA, 22 bp, Artificial Sequence
  Synthetic oligonucleotide; TTT chr2 60547176 60547197 60547181 60547176 -
gcttgaccattctgatttttat

SEQ ID NO: 211269 - DNA, 22 bp, Artificial Sequence
  Synthetic oligonucleotide; TTG chr2 60547175 60547196 60547180 60547175 -
cttgaccattctgatttttata

SEQ ID NO: 211270 - DNA, 22 bp, Artificial Sequence
  Synthetic oligonucleotide; CTT chr2 60547172 60547193 60547177 60547172 -
gaccattctgatttttatatca

SEQ ID NO: 211271 - DNA, 22 bp, Artificial Sequence
  Synthetic oligonucleotide; TTG chr2 60547171 60547192 60547176 60547171 -
accattctgatttttatatcat

SEQ ID NO: 211272 - DNA, 22 bp, Artificial Sequence
  Synthetic oligonucleotide; TTC chr2 60547164 60547185 60547169 60547164 -
tgatttttatatcatagatgcc

SEQ ID NO: 211273 - DNA, 22 bp, Artificial Sequence
  Synthetic oligonucleotide; CTG chr2 60547162 60547183 60547167 60547162 -
atttttatatcatagatgccac

SEQ ID NO: 211274 - DNA, 22 bp, Artificial Sequence
  Synthetic oligonucleotide; TTT chr2 60547158 60547179 60547163 60547158 -
ttatatcatagatgccaccaag

SEQ ID NO: 211275 - DNA, 22 bp, Artificial Sequence
  Synthetic oligonucleotide; TTT chr2 60547157 60547178 60547162 60547157 -
tatatcatagatgccaccaagt

SEQ ID NO: 211276 - DNA, 22 bp, Artificial Sequence
  Synthetic oligonucleotide; TTT chr2 60547156 60547177 60547161 60547156 -
atatcatagatgccaccaagtg

SEQ ID NO: 211277 - DNA, 22 bp, Artificial Sequence
  Synthetic oligonucleotide; TTA chr2 60547155 60547176 60547160 60547155 -
tatcatagatgccaccaagtgc

SEQ ID NO: 211278 - DNA, 22 bp, Artificial Sequence
  Synthetic oligonucleotide; TTT chr2 60547123 60547144 60547128 60547123 -
agaatattataggcattccatt

SEQ ID NO: 211279 - DNA, 22 bp, Artificial Sequence
  Synthetic oligonucleotide; TTA chr2 60547122 60547143 60547127 60547122 -
gaatattataggcattccattt

SEQ ID NO: 211280 - DNA, 22 bp, Artificial Sequence
  Synthetic oligonucleotide; TTA chr2 60547114 60547135 60547119 60547114 -
taggcattccatttctcagaat

SEQ ID NO: 211281 - DNA, 22 bp, Artificial Sequence
  Synthetic oligonucleotide; TTC chr2 60547105 60547126 60547110 60547105 -
catttctcagaataaaaaaaaa

SEQ ID NO: 211282 - DNA, 22 bp, Artificial Sequence
  Synthetic oligonucleotide; TTT chr2 60547100 60547121 60547105 60547100 -
ctcagaataaaaaaaaaatgac

SEQ ID NO: 211283 - DNA, 22 bp, Artificial Sequence
  Synthetic oligonucleotide; TTC chr2 60547099 60547120 60547104 60547099 -
tcagaataaaaaaaaaatgact

SEQ ID NO: 211284 - DNA, 22 bp, Artificial Sequence
  Synthetic oligonucleotide; CTC chr2 60547097 60547118 60547102 60547097 -
agaataaaaaaaaaatgactaa

SEQ ID NO: 211285 - DNA, 22 bp, Artificial Sequence
  Synthetic oligonucleotide; CTA chr2 60547076 60547097 60547081 60547076 -
attggcttattttcttaagtac

SEQ ID NO: 211286 - DNA, 22 bp, Artificial Sequence
  Synthetic oligonucleotide; TTG chr2 60547072 60547093 60547077 60547072 -
gcttattttcttaagtactcaa

SEQ ID NO: 211287 - DNA, 22 bp, Artificial Sequence
  Synthetic oligonucleotide; CTT chr2 60547068 60547089 60547073 60547068 -
attttcttaagtactcaaaagt

SEQ ID NO: 211288 - DNA, 22 bp, Artificial Sequence
  Synthetic oligonucleotide; TTA chr2 60547067 60547088 60547072 60547067 -
ttttcttaagtactcaaaagta

SEQ ID NO: 211289 - DNA, 22 bp, Artificial Sequence
  Synthetic oligonucleotide; TTT chr2 60547064 60547085 60547069 60547064 -
tcttaagtactcaaaagtatcc

SEQ ID NO: 211290 - DNA, 22 bp, Artificial Sequence
  Synthetic oligonucleotide; TTT chr2 60547063 60547084 60547068 60547063 -
cttaagtactcaaaagtatccc

SEQ ID NO: 211291 - DNA, 22 bp, Artificial Sequence
  Synthetic oligonucleotide; TTC chr2 60547062 60547083 60547067 60547062 -
ttaagtactcaaaagtatccca

SEQ ID NO: 211292 - DNA, 22 bp, Artificial Sequence
  Synthetic oligonucleotide; CTT chr2 60547060 60547081 60547065 60547060 -
aagtactcaaaagtatcccatt

SEQ ID NO: 211293 - DNA, 22 bp, Artificial Sequence
  Synthetic oligonucleotide; TTA chr2 60547059 60547080 60547064 60547059 -
agtactcaaaagtatcccattt

SEQ ID NO: 211294 - DNA, 22 bp, Artificial Sequence
  Synthetic oligonucleotide; CTC chr2 60547052 60547073 60547057 60547052 -
aaaagtatcccatttagctaat

SEQ ID NO: 211295 - DNA, 22 bp, Artificial Sequence
  Synthetic oligonucleotide; TTT chr2 60547037 60547058 60547042 60547037 -
agctaatgtgtctgagaaatac

SEQ ID NO: 211296 - DNA, 22 bp, Artificial Sequence
  Synthetic oligonucleotide; TTA chr2 60547036 60547057 60547041 60547036 -
gctaatgtgtctgagaaatact

SEQ ID NO: 211297 - DNA, 22 bp, Artificial Sequence
  Synthetic oligonucleotide; CTA chr2 60547032 60547053 60547037 60547032 -
atgtgtctgagaaatactgccc

SEQ ID NO: 211298 - DNA, 22 bp, Artificial Sequence
  Synthetic oligonucleotide; CTG chr2 60547023 60547044 60547028 60547023 -
agaaatactgcccgtgcatttg

SEQ ID NO: 211299 - DNA, 22 bp, Artificial Sequence
  Synthetic oligonucleotide; CTG chr2 60547013 60547034 60547018 60547013 -
cccgtgcatttggtatttcttt

SEQ ID NO: 211300 - DNA, 22 bp, Artificial Sequence
  Synthetic oligonucleotide; TTT chr2 60547002 60547023 60547007 60547002 -
ggtatttctttgattttgtggc

SEQ ID NO: 211301 - DNA, 22 bp, Artificial Sequence
  Synthetic oligonucleotide; TTG chr2 60547001 60547022 60547006 60547001 -
gtatttctttgattttgtggca

SEQ ID NO: 211302 - DNA, 22 bp, Artificial Sequence
  Synthetic oligonucleotide; TTT chr2 60546995 60547016 60547000 60546995 -
ctttgattttgtggcactgctg

SEQ ID NO: 211303 - DNA, 22 bp, Artificial Sequence
  Synthetic oligonucleotide; TTC chr2 60546994 60547015 60546999 60546994 -
tttgattttgtggcactgctga

SEQ ID NO: 211304 - DNA, 22 bp, Artificial Sequence
  Synthetic oligonucleotide; CTT chr2 60546992 60547013 60546997 60546992 -
tgattttgtggcactgctgaga

SEQ ID NO: 211305 - DNA, 22 bp, Artificial Sequence
  Synthetic oligonucleotide; TTT chr2 60546991 60547012 60546996 60546991 -
gattttgtggcactgctgagag

SEQ ID NO: 211306 - DNA, 22 bp, Artificial Sequence
  Synthetic oligonucleotide; TTG chr2 60546990 60547011 60546995 60546990 -
attttgtggcactgctgagagt

SEQ ID NO: 211307 - DNA, 22 bp, Artificial Sequence
  Synthetic oligonucleotide; TTT chr2 60546986 60547007 60546991 60546986 -
tgtggcactgctgagagtgaga

SEQ ID NO: 211308 - DNA, 22 bp, Artificial Sequence
  Synthetic oligonucleotide; TTT chr2 60546985 60547006 60546990 60546985 -
gtggcactgctgagagtgagag

SEQ ID NO: 211309 - DNA, 22 bp, Artificial Sequence
  Synthetic oligonucleotide; TTG chr2 60546984 60547005 60546989 60546984 -
tggcactgctgagagtgagagc

SEQ ID NO: 211310 - DNA, 22 bp, Artificial Sequence
  Synthetic oligonucleotide; CTG chr2 60546976 60546997 60546981 60546976 -
ctgagagtgagagcagaaaggt

SEQ ID NO: 211311 - DNA, 22 bp, Artificial Sequence
  Synthetic oligonucleotide; CTG chr2 60546973 60546994 60546978 60546973 -
agagtgagagcagaaaggtttt

SEQ ID NO: 211312 - DNA, 22 bp, Artificial Sequence
  Synthetic oligonucleotide; TTT chr2 60546952 60546973 60546957 60546952 -
ttggcagtgtgaattatgctgc

SEQ ID NO: 211313 - DNA, 22 bp, Artificial Sequence
  Synthetic oligonucleotide; TTT chr2 60546951 60546972 60546956 60546951 -
tggcagtgtgaattatgctgcg

SEQ ID NO: 211314 - DNA, 22 bp, Artificial Sequence
  Synthetic oligonucleotide; TTT chr2 60546950 60546971 60546955 60546950 -
ggcagtgtgaattatgctgcga

SEQ ID NO: 211315 - DNA, 22 bp, Artificial Sequence
  Synthetic oligonucleotide; TTG chr2 60546949 60546970 60546954 60546949 -
gcagtgtgaattatgctgcgac

SEQ ID NO: 211316 - DNA, 22 bp, Artificial Sequence
  Synthetic oligonucleotide; TTA chr2 60546936 60546957 60546941 60546936 -
tgctgcgacatgattattattt

SEQ ID NO: 211317 - DNA, 22 bp, Artificial Sequence
  Synthetic oligonucleotide; CTG chr2 60546931 60546952 60546936 60546931 -
cgacatgattattatttagatc

SEQ ID NO: 211318 - DNA, 22 bp, Artificial Sequence
  Synthetic oligonucleotide; TTA chr2 60546920 60546941 60546925 60546920 -
ttatttagatccgtttcatagg

SEQ ID NO: 211319 - DNA, 22 bp, Artificial Sequence
  Synthetic oligonucleotide; TTA chr2 60546917 60546938 60546922 60546917 -
tttagatccgtttcataggtgc

SEQ ID NO: 211320 - DNA, 22 bp, Artificial Sequence
  Synthetic oligonucleotide; TTT chr2 60546914 60546935 60546919 60546914 -
agatccgtttcataggtgcatg

SEQ ID NO: 211321 - DNA, 22 bp, Artificial Sequence
  Synthetic oligonucleotide; TTA chr2 60546913 60546934 60546918 60546913 -
gatccgtttcataggtgcatgc

SEQ ID NO: 211322 - DNA, 22 bp, Artificial Sequence
  Synthetic oligonucleotide; TTT chr2 60546904 60546925 60546909 60546904 -
cataggtgcatgcagtcgtttt

SEQ ID NO: 211323 - DNA, 22 bp, Artificial Sequence
  Synthetic oligonucleotide; TTC chr2 60546903 60546924 60546908 60546903 -
ataggtgcatgcagtcgttttc

SEQ ID NO: 211324 - DNA, 22 bp, Artificial Sequence
  Synthetic oligonucleotide; TTT chr2 60546883 60546904 60546888 60546883 -
tcttattacagcagtgtaaatg

SEQ ID NO: 211325 - DNA, 22 bp, Artificial Sequence
  Synthetic oligonucleotide; TTT chr2 60546882 60546903 60546887 60546882 -
cttattacagcagtgtaaatgt

SEQ ID NO: 211326 - DNA, 22 bp, Artificial Sequence
  Synthetic oligonucleotide; TTC chr2 60546881 60546902 60546886 60546881 -
ttattacagcagtgtaaatgtg

SEQ ID NO: 211327 - DNA, 22 bp, Artificial Sequence
  Synthetic oligonucleotide; CTT chr2 60546879 60546900 60546884 60546879 -
attacagcagtgtaaatgtggc

SEQ ID NO: 211328 - DNA, 22 bp, Artificial Sequence
  Synthetic oligonucleotide; TTA chr2 60546878 60546899 60546883 60546878 -
ttacagcagtgtaaatgtggca

SEQ ID NO: 211329 - DNA, 22 bp, Artificial Sequence
  Synthetic oligonucleotide; TTA chr2 60546875 60546896 60546880 60546875 -
cagcagtgtaaatgtggcacat

SEQ ID NO: 211330 - DNA, 22 bp, Artificial Sequence
  Synthetic oligonucleotide; TTT chr2 60546851 60546872 60546856 60546851 -
ttcatgtgacatagtagctttc

SEQ ID NO: 211331 - DNA, 22 bp, Artificial Sequence
  Synthetic oligonucleotide; TTT chr2 60546850 60546871 60546855 60546850 -
tcatgtgacatagtagctttct

SEQ ID NO: 211332 - DNA, 22 bp, Artificial Sequence
  Synthetic oligonucleotide; TTT chr2 60546849 60546870 60546854 60546849 -
catgtgacatagtagctttcta

SEQ ID NO: 211333 - DNA, 22 bp, Artificial Sequence
  Synthetic oligonucleotide; TTC chr2 60546848 60546869 60546853 60546848 -
atgtgacatagtagctttctaa

SEQ ID NO: 211334 - DNA, 22 bp, Artificial Sequence
  Synthetic oligonucleotide; CTT chr2 60546831 60546852 60546836 60546831 -
tctaatttatgaagccatgtct

SEQ ID NO: 211335 - DNA, 22 bp, Artificial Sequence
  Synthetic oligonucleotide; TTT chr2 60546830 60546851 60546835 60546830 -
ctaatttatgaagccatgtctg

SEQ ID NO: 211336 - DNA, 22 bp, Artificial Sequence
  Synthetic oligonucleotide; TTC chr2 60546829 60546850 60546834 60546829 -
taatttatgaagccatgtctgt

SEQ ID NO: 211337 - DNA, 22 bp, Artificial Sequence
  Synthetic oligonucleotide; CTA chr2 60546827 60546848 60546832 60546827 -
atttatgaagccatgtctgttt

SEQ ID NO: 211338 - DNA, 22 bp, Artificial Sequence
  Synthetic oligonucleotide; TTT chr2 60546823 60546844 60546828 60546823 -
atgaagccatgtctgtttactt

SEQ ID NO: 211339 - DNA, 22 bp, Artificial Sequence
  Synthetic oligonucleotide; TTA chr2 60546822 60546843 60546827 60546822 -
tgaagccatgtctgtttactta

SEQ ID NO: 211340 - DNA, 22 bp, Artificial Sequence
  Synthetic oligonucleotide; CTG chr2 60546808 60546829 60546813 60546808 -
tttacttaggagtatatacatt

SEQ ID NO: 211341 - DNA, 22 bp, Artificial Sequence
  Synthetic oligonucleotide; TTT chr2 60546805 60546826 60546810 60546805 -
acttaggagtatatacattcac

SEQ ID NO: 211342 - DNA, 22 bp, Artificial Sequence
  Synthetic oligonucleotide; TTA chr2 60546804 60546825 60546809 60546804 -
cttaggagtatatacattcaca

SEQ ID NO: 211343 - DNA, 22 bp, Artificial Sequence
  Synthetic oligonucleotide; CTT chr2 60546801 60546822 60546806 60546801 -
aggagtatatacattcacacac

SEQ ID NO: 211344 - DNA, 22 bp, Artificial Sequence
  Synthetic oligonucleotide; TTA chr2 60546800 60546821 60546805 60546800 -
ggagtatatacattcacacaca

SEQ ID NO: 211345 - DNA, 22 bp, Artificial Sequence
  Synthetic oligonucleotide; TTC chr2 60546785 60546806 60546790 60546785 -
acacacaaagggtgtgtgtgtt

SEQ ID NO: 211346 - DNA, 22 bp, Artificial Sequence
  Synthetic oligonucleotide; TTT chr2 60546762 60546783 60546767 60546762 -
attcacctctcctttcattctt

SEQ ID NO: 211347 - DNA, 22 bp, Artificial Sequence
  Synthetic oligonucleotide; TTA chr2 60546761 60546782 60546766 60546761 -
ttcacctctcctttcattcttt

SEQ ID NO: 211348 - DNA, 22 bp, Artificial Sequence
  Synthetic oligonucleotide; TTC chr2 60546758 60546779 60546763 60546758 -
acctctcctttcattctttggc

SEQ ID NO: 211349 - DNA, 22 bp, Artificial Sequence
  Synthetic oligonucleotide; CTC chr2 60546753 60546774 60546758 60546753 -
tcctttcattctttggcacaat

SEQ ID NO: 211350 - DNA, 22 bp, Artificial Sequence
  Synthetic oligonucleotide; CTC chr2 60546751 60546772 60546756 60546751 -
ctttcattctttggcacaatgg

SEQ ID NO: 211351 - DNA, 22 bp, Artificial Sequence
  Synthetic oligonucleotide; CTT chr2 60546748 60546769 60546753 60546748 -
tcattctttggcacaatggaca

SEQ ID NO: 211352 - DNA, 22 bp, Artificial Sequence
  Synthetic oligonucleotide; TTT chr2 60546747 60546768 60546752 60546747 -
cattctttggcacaatggacaa

SEQ ID NO: 211353 - DNA, 22 bp, Artificial Sequence
  Synthetic oligonucleotide; TTC chr2 60546746 60546767 60546751 60546746 -
attctttggcacaatggacaac

SEQ ID NO: 211354 - DNA, 22 bp, Artificial Sequence
  Synthetic oligonucleotide; TTC chr2 60546742 60546763 60546747 60546742 -
tttggcacaatggacaacttgg

SEQ ID NO: 211355 - DNA, 22 bp, Artificial Sequence
  Synthetic oligonucleotide; CTT chr2 60546740 60546761 60546745 60546740 -
tggcacaatggacaacttggtg

SEQ ID NO: 211356 - DNA, 22 bp, Artificial Sequence
  Synthetic oligonucleotide; TTT chr2 60546739 60546760 60546744 60546739 -
ggcacaatggacaacttggtgt

SEQ ID NO: 211357 - DNA, 22 bp, Artificial Sequence
  Synthetic oligonucleotide; TTG chr2 60546738 60546759 60546743 60546738 -
gcacaatggacaacttggtgta

SEQ ID NO: 211358 - DNA, 22 bp, Artificial Sequence
  Synthetic oligonucleotide; CTT chr2 60546722 60546743 60546727 60546722 -
ggtgtataggaaaaaagaaaca

SEQ ID NO: 211359 - DNA, 22 bp, Artificial Sequence
  Synthetic oligonucleotide; TTG chr2 60546721 60546742 60546726 60546721 -
gtgtataggaaaaaagaaacaa

SEQ ID NO: 211360 - DNA, 22 bp, Artificial Sequence
  Synthetic oligonucleotide; TTT chr2 60546695 60546716 60546700 60546695 -
ggtttctatccacttttttttt

SEQ ID NO: 211361 - DNA, 22 bp, Artificial Sequence
  Synthetic oligonucleotide; TTG chr2 60546694 60546715 60546699 60546694 -
gtttctatccactttttttttt

SEQ ID NO: 211362 - DNA, 22 bp, Artificial Sequence
  Synthetic oligonucleotide; TTT chr2 60546690 60546711 60546695 60546690 -
ctatccacttttttttttaacc

SEQ ID NO: 211363 - DNA, 22 bp, Artificial Sequence
  Synthetic oligonucleotide; TTC chr2 60546689 60546710 60546694 60546689 -
tatccacttttttttttaacca

SEQ ID NO: 211364 - DNA, 22 bp, Artificial Sequence
  Synthetic oligonucleotide; CTA chr2 60546687 60546708 60546692 60546687 -
tccacttttttttttaaccagt

SEQ ID NO: 211365 - DNA, 22 bp, Artificial Sequence
  Synthetic oligonucleotide; CTT chr2 60546680 60546701 60546685 60546680 -
ttttttttaaccagtttttctt

SEQ ID NO: 211366 - DNA, 22 bp, Artificial Sequence
  Synthetic oligonucleotide; TTT chr2 60546679 60546700 60546684 60546679 -
tttttttaaccagtttttcttg

SEQ ID NO: 211367 - DNA, 22 bp, Artificial Sequence
  Synthetic oligonucleotide; TTT chr2 60546678 60546699 60546683 60546678 -
ttttttaaccagtttttcttgt

SEQ ID NO: 211368 - DNA, 22 bp, Artificial Sequence
  Synthetic oligonucleotide; TTT chr2 60546677 60546698 60546682 60546677 -
tttttaaccagtttttcttgta

SEQ ID NO: 211369 - DNA, 22 bp, Artificial Sequence
  Synthetic oligonucleotide; TTT chr2 60546676 60546697 60546681 60546676 -
ttttaaccagtttttcttgtag

SEQ ID NO: 211370 - DNA, 22 bp, Artificial Sequence
  Synthetic oligonucleotide; TTT chr2 60546675 60546696 60546680 60546675 -
tttaaccagtttttcttgtagt

SEQ ID NO: 211371 - DNA, 22 bp, Artificial Sequence
  Synthetic oligonucleotide; TTT chr2 60546674 60546695 60546679 60546674 -
ttaaccagtttttcttgtagtt

SEQ ID NO: 211372 - DNA, 22 bp, Artificial Sequence
  Synthetic oligonucleotide; TTT chr2 60546673 60546694 60546678 60546673 -
taaccagtttttcttgtagtta

SEQ ID NO: 211373 - DNA, 22 bp, Artificial Sequence
  Synthetic oligonucleotide; TTT chr2 60546672 60546693 60546677 60546672 -
aaccagtttttcttgtagttat

SEQ ID NO: 211374 - DNA, 22 bp, Artificial Sequence
  Synthetic oligonucleotide; TTA chr2 60546671 60546692 60546676 60546671 -
accagtttttcttgtagttatt

SEQ ID NO: 211375 - DNA, 22 bp, Artificial Sequence
  Synthetic oligonucleotide; TTT chr2 60546663 60546684 60546668 60546663 -
ttcttgtagttattatttaagc

SEQ ID NO: 211376 - DNA, 22 bp, Artificial Sequence
  Synthetic oligonucleotide; TTT chr2 60546662 60546683 60546667 60546662 -
tcttgtagttattatttaagct

SEQ ID NO: 211377 - DNA, 22 bp, Artificial Sequence
  Synthetic oligonucleotide; TTT chr2 60546661 60546682 60546666 60546661 -
cttgtagttattatttaagctt

SEQ ID NO: 211378 - DNA, 22 bp, Artificial Sequence
  Synthetic oligonucleotide; TTC chr2 60546660 60546681 60546665 60546660 -
ttgtagttattatttaagcttt

SEQ ID NO: 211379 - DNA, 22 bp, Artificial Sequence
  Synthetic oligonucleotide; CTT chr2 60546658 60546679 60546663 60546658 -
gtagttattatttaagctttct

SEQ ID NO: 211380 - DNA, 22 bp, Artificial Sequence
  Synthetic oligonucleotide; TTG chr2 60546657 60546678 60546662 60546657 -
tagttattatttaagctttctt

SEQ ID NO: 211381 - DNA, 22 bp, Artificial Sequence
  Synthetic oligonucleotide; TTA chr2 60546651 60546672 60546656 60546651 -
ttatttaagctttctttatgtt

SEQ ID NO: 211382 - DNA, 22 bp, Artificial Sequence
  Synthetic oligonucleotide; TTA chr2 60546648 60546669 60546653 60546648 -
tttaagctttctttatgttccc

SEQ ID NO: 211383 - DNA, 22 bp, Artificial Sequence
  Synthetic oligonucleotide; TTT chr2 60546645 60546666 60546650 60546645 -
aagctttctttatgttccctgt

SEQ ID NO: 211384 - DNA, 22 bp, Artificial Sequence
  Synthetic oligonucleotide; TTA chr2 60546644 60546665 60546649 60546644 -
agctttctttatgttccctgtg

SEQ ID NO: 211385 - DNA, 22 bp, Artificial Sequence
  Synthetic oligonucleotide; CTT chr2 60546639 60546660 60546644 60546639 -
tctttatgttccctgtgttaac

SEQ ID NO: 211386 - DNA, 22 bp, Artificial Sequence
  Synthetic oligonucleotide; TTT chr2 60546638 60546659 60546643 60546638 -
ctttatgttccctgtgttaact

SEQ ID NO: 211387 - DNA, 22 bp, Artificial Sequence
  Synthetic oligonucleotide; TTC chr2 60546637 60546658 60546642 60546637 -
tttatgttccctgtgttaacta

SEQ ID NO: 211388 - DNA, 22 bp, Artificial Sequence
  Synthetic oligonucleotide; CTT chr2 60546635 60546656 60546640 60546635 -
tatgttccctgtgttaactatt

SEQ ID NO: 211389 - DNA, 22 bp, Artificial Sequence
  Synthetic oligonucleotide; TTT chr2 60546634 60546655 60546639 60546634 -
atgttccctgtgttaactattt

SEQ ID NO: 211390 - DNA, 22 bp, Artificial Sequence
  Synthetic oligonucleotide; TTA chr2 60546633 60546654 60546638 60546633 -
tgttccctgtgttaactattta

SEQ ID NO: 211391 - DNA, 22 bp, Artificial Sequence
  Synthetic oligonucleotide; TTC chr2 60546628 60546649 60546633 60546628 -
cctgtgttaactatttaagtag

SEQ ID NO: 211392 - DNA, 22 bp, Artificial Sequence
  Synthetic oligonucleotide; CTG chr2 60546624 60546645 60546629 60546624 -
tgttaactatttaagtagcatt

SEQ ID NO: 211393 - DNA, 22 bp, Artificial Sequence
  Synthetic oligonucleotide; TTA chr2 60546619 60546640 60546624 60546619 -
actatttaagtagcattctttc

SEQ ID NO: 211394 - DNA, 22 bp, Artificial Sequence
  Synthetic oligonucleotide; CTA chr2 60546615 60546636 60546620 60546615 -
tttaagtagcattctttctaaa

SEQ ID NO: 211395 - DNA, 22 bp, Artificial Sequence
  Synthetic oligonucleotide; TTT chr2 60546612 60546633 60546617 60546612 -
aagtagcattctttctaaactt

SEQ ID NO: 211396 - DNA, 22 bp, Artificial Sequence
  Synthetic oligonucleotide; TTA chr2 60546611 60546632 60546616 60546611 -
agtagcattctttctaaactta

SEQ ID NO: 211397 - DNA, 22 bp, Artificial Sequence
  Synthetic oligonucleotide; TTC chr2 60546601 60546622 60546606 60546601 -
tttctaaacttacaaaccagac

SEQ ID NO: 211398 - DNA, 22 bp, Artificial Sequence
  Synthetic oligonucleotide; CTT chr2 60546599 60546620 60546604 60546599 -
tctaaacttacaaaccagacac

SEQ ID NO: 211399 - DNA, 22 bp, Artificial Sequence
  Synthetic oligonucleotide; TTT chr2 60546598 60546619 60546603 60546598 -
ctaaacttacaaaccagacaca

SEQ ID NO: 211400 - DNA, 22 bp, Artificial Sequence
  Synthetic oligonucleotide; TTC chr2 60546597 60546618 60546602 60546597 -
taaacttacaaaccagacacat

SEQ ID NO: 211401 - DNA, 22 bp, Artificial Sequence
  Synthetic oligonucleotide; CTA chr2 60546595 60546616 60546600 60546595 -
aacttacaaaccagacacattt

SEQ ID NO: 211402 - DNA, 22 bp, Artificial Sequence
  Synthetic oligonucleotide; CTT chr2 60546590 60546611 60546595 60546590 -
acaaaccagacacatttgttgc

SEQ ID NO: 211403 - DNA, 22 bp, Artificial Sequence
  Synthetic oligonucleotide; TTA chr2 60546589 60546610 60546594 60546589 -
caaaccagacacatttgttgct

SEQ ID NO: 211404 - DNA, 22 bp, Artificial Sequence
  Synthetic oligonucleotide; TTT chr2 60546573 60546594 60546578 60546573 -
gttgctgtgggtgtgtgcatgg

SEQ ID NO: 211405 - DNA, 22 bp, Artificial Sequence
  Synthetic oligonucleotide; TTG chr2 60546572 60546593 60546577 60546572 -
ttgctgtgggtgtgtgcatggg

SEQ ID NO: 211406 - DNA, 22 bp, Artificial Sequence
  Synthetic oligonucleotide; TTG chr2 60546569 60546590 60546574 60546569 -
ctgtgggtgtgtgcatgggtat

SEQ ID NO: 211407 - DNA, 22 bp, Artificial Sequence
  Synthetic oligonucleotide; CTG chr2 60546566 60546587 60546571 60546566 -
tgggtgtgtgcatgggtatatg

SEQ ID NO: 211408 - DNA, 22 bp, Artificial Sequence
  Synthetic oligonucleotide; TTC chr2 60546529 60546550 60546534 60546529 -
tctggagttatgcaaggaagac

SEQ ID NO: 211409 - DNA, 22 bp, Artificial Sequence
  Synthetic oligonucleotide; CTC chr2 60546527 60546548 60546532 60546527 -
tggagttatgcaaggaagactg

SEQ ID NO: 211410 - DNA, 22 bp, Artificial Sequence
  Synthetic oligonucleotide; CTG chr2 60546525 60546546 60546530 60546525 -
gagttatgcaaggaagactgtt

SEQ ID NO: 211411 - DNA, 22 bp, Artificial Sequence
  Synthetic oligonucleotide; TTA chr2 60546519 60546540 60546524 60546519 -
tgcaaggaagactgttttcttt

SEQ ID NO: 211412 - DNA, 22 bp, Artificial Sequence
  Synthetic oligonucleotide; CTG chr2 60546505 60546526 60546510 60546505 -
ttttctttacatatgtgatgat

SEQ ID NO: 211413 - DNA, 22 bp, Artificial Sequence
  Synthetic oligonucleotide; TTT chr2 60546502 60546523 60546507 60546502 -
tctttacatatgtgatgatttg

SEQ ID NO: 211414 - DNA, 22 bp, Artificial Sequence
  Synthetic oligonucleotide; TTT chr2 60546501 60546522 60546506 60546501 -
ctttacatatgtgatgatttgc

SEQ ID NO: 211415 - DNA, 22 bp, Artificial Sequence
  Synthetic oligonucleotide; TTC chr2 60546500 60546521 60546505 60546500 -
tttacatatgtgatgatttgcc

SEQ ID NO: 211416 - DNA, 22 bp, Artificial Sequence
  Synthetic oligonucleotide; CTT chr2 60546498 60546519 60546503 60546498 -
tacatatgtgatgatttgcctc

SEQ ID NO: 211417 - DNA, 22 bp, Artificial Sequence
  Synthetic oligonucleotide; TTT chr2 60546497 60546518 60546502 60546497 -
acatatgtgatgatttgcctca

SEQ ID NO: 211418 - DNA, 22 bp, Artificial Sequence
  Synthetic oligonucleotide; TTA chr2 60546496 60546517 60546501 60546496 -
catatgtgatgatttgcctcat

SEQ ID NO: 211419 - DNA, 22 bp, Artificial Sequence
  Synthetic oligonucleotide; TTT chr2 60546481 60546502 60546486 60546481 -
gcctcattgacaaatttgctct

SEQ ID NO: 211420 - DNA, 22 bp, Artificial Sequence
  Synthetic oligonucleotide; TTG chr2 60546480 60546501 60546485 60546480 -
cctcattgacaaatttgctctc

SEQ ID NO: 211421 - DNA, 22 bp, Artificial Sequence
  Synthetic oligonucleotide; CTC chr2 60546476 60546497 60546481 60546476 -
attgacaaatttgctctctggt

SEQ ID NO: 211422 - DNA, 22 bp, Artificial Sequence
  Synthetic oligonucleotide; TTG chr2 60546472 60546493 60546477 60546472 -
acaaatttgctctctggttgat

SEQ ID NO: 211423 - DNA, 22 bp, Artificial Sequence
  Synthetic oligonucleotide; TTT chr2 60546464 60546485 60546469 60546464 -
gctctctggttgataaccttca

SEQ ID NO: 211424 - DNA, 22 bp, Artificial Sequence
  Synthetic oligonucleotide; TTG chr2 60546463 60546484 60546468 60546463 -
ctctctggttgataaccttcac

SEQ ID NO: 211425 - DNA, 22 bp, Artificial Sequence
  Synthetic oligonucleotide; CTC chr2 60546460 60546481 60546465 60546460 -
tctggttgataaccttcacatc

SEQ ID NO: 211426 - DNA, 22 bp, Artificial Sequence
  Synthetic oligonucleotide; CTC chr2 60546458 60546479 60546463 60546458 -
tggttgataaccttcacatcct

SEQ ID NO: 211427 - DNA, 22 bp, Artificial Sequence
  Synthetic oligonucleotide; CTG chr2 60546456 60546477 60546461 60546456 -
gttgataaccttcacatccttg

SEQ ID NO: 211428 - DNA, 22 bp, Artificial Sequence
  Synthetic oligonucleotide; TTG chr2 60546452 60546473 60546457 60546452 -
ataaccttcacatccttgtact

SEQ ID NO: 211429 - DNA, 22 bp, Artificial Sequence
  Synthetic oligonucleotide; CTT chr2 60546444 60546465 60546449 60546444 -
cacatccttgtactttttgtat

SEQ ID NO: 211430 - DNA, 22 bp, Artificial Sequence
  Synthetic oligonucleotide; TTC chr2 60546443 60546464 60546448 60546443 -
acatccttgtactttttgtatg

SEQ ID NO: 211431 - DNA, 22 bp, Artificial Sequence
  Synthetic oligonucleotide; CTT chr2 60546435 60546456 60546440 60546435 -
gtactttttgtatgctcacatt

SEQ ID NO: 211432 - DNA, 22 bp, Artificial Sequence
  Synthetic oligonucleotide; TTG chr2 60546434 60546455 60546439 60546434 -
tactttttgtatgctcacattt

SEQ ID NO: 211433 - DNA, 22 bp, Artificial Sequence
  Synthetic oligonucleotide; CTT chr2 60546429 60546450 60546434 60546429 -
tttgtatgctcacattttctgg

SEQ ID NO: 211434 - DNA, 22 bp, Artificial Sequence
  Synthetic oligonucleotide; TTT chr2 60546428 60546449 60546433 60546428 -
ttgtatgctcacattttctggg

SEQ ID NO: 211435 - DNA, 22 bp, Artificial Sequence
  Synthetic oligonucleotide; TTT chr2 60546427 60546448 60546432 60546427 -
tgtatgctcacattttctgggt

SEQ ID NO: 211436 - DNA, 22 bp, Artificial Sequence
  Synthetic oligonucleotide; TTT chr2 60546426 60546447 60546431 60546426 -
gtatgctcacattttctgggta

SEQ ID NO: 211437 - DNA, 22 bp, Artificial Sequence
  Synthetic oligonucleotide; TTG chr2 60546425 60546446 60546430 60546425 -
tatgctcacattttctgggtat

SEQ ID NO: 211438 - DNA, 22 bp, Artificial Sequence
  Synthetic oligonucleotide; CTC chr2 60546418 60546439 60546423 60546418 -
acattttctgggtattatatag

SEQ ID NO: 211439 - DNA, 22 bp, Artificial Sequence
  Synthetic oligonucleotide; TTT chr2 60546412 60546433 60546417 60546412 -
tctgggtattatatagagaagc

SEQ ID NO: 211440 - DNA, 22 bp, Artificial Sequence
  Synthetic oligonucleotide; TTT chr2 60546411 60546432 60546416 60546411 -
ctgggtattatatagagaagcc

SEQ ID NO: 211441 - DNA, 22 bp, Artificial Sequence
  Synthetic oligonucleotide; TTC chr2 60546410 60546431 60546415 60546410 -
tgggtattatatagagaagcct

SEQ ID NO: 211442 - DNA, 22 bp, Artificial Sequence
  Synthetic oligonucleotide; CTG chr2 60546408 60546429 60546413 60546408 -
ggtattatatagagaagcctag

SEQ ID NO: 211443 - DNA, 22 bp, Artificial Sequence
  Synthetic oligonucleotide; TTA chr2 60546401 60546422 60546406 60546401 -
tatagagaagcctagaaacact

SEQ ID NO: 211444 - DNA, 22 bp, Artificial Sequence
  Synthetic oligonucleotide; CTA chr2 60546387 60546408 60546392 60546387 -
gaaacactttacatgatgtggt

SEQ ID NO: 211445 - DNA, 22 bp, Artificial Sequence
  Synthetic oligonucleotide; CTT chr2 60546378 60546399 60546383 60546378 -
tacatgatgtggtgggatggca

SEQ ID NO: 211446 - DNA, 22 bp, Artificial Sequence
  Synthetic oligonucleotide; TTT chr2 60546377 60546398 60546382 60546377 -
acatgatgtggtgggatggcat

SEQ ID NO: 211447 - DNA, 22 bp, Artificial Sequence
  Synthetic oligonucleotide; TTA chr2 60546376 60546397 60546381 60546376 -
catgatgtggtgggatggcatg

SEQ ID NO: 211448 - DNA, 22 bp, Artificial Sequence
  Synthetic oligonucleotide; TTG chr2 60546348 60546369 60546353 60546348 -
agatgtgcttctcccctttctg

SEQ ID NO: 211449 - DNA, 22 bp, Artificial Sequence
  Synthetic oligonucleotide; CTT chr2 60546338 60546359 60546343 60546338 -
ctcccctttctgtcctctctgg

SEQ ID NO: 211450 - DNA, 22 bp, Artificial Sequence
  Synthetic oligonucleotide; TTC chr2 60546337 60546358 60546342 60546337 -
tcccctttctgtcctctctggc

SEQ ID NO: 211451 - DNA, 22 bp, Artificial Sequence
  Synthetic oligonucleotide; CTC chr2 60546335 60546356 60546340 60546335 -
ccctttctgtcctctctggcac

SEQ ID NO: 211452 - DNA, 22 bp, Artificial Sequence
  Synthetic oligonucleotide; CTT chr2 60546330 60546351 60546335 60546330 -
tctgtcctctctggcactctaa

SEQ ID NO: 211453 - DNA, 22 bp, Artificial Sequence
  Synthetic oligonucleotide; TTT chr2 60546329 60546350 60546334 60546329 -
ctgtcctctctggcactctaat

SEQ ID NO: 211454 - DNA, 22 bp, Artificial Sequence
  Synthetic oligonucleotide; TTC chr2 60546328 60546349 60546333 60546328 -
tgtcctctctggcactctaata

SEQ ID NO: 211455 - DNA, 22 bp, Artificial Sequence
  Synthetic oligonucleotide; CTG chr2 60546326 60546347 60546331 60546326 -
tcctctctggcactctaataat

SEQ ID NO: 211456 - DNA, 22 bp, Artificial Sequence
  Synthetic oligonucleotide; CTC chr2 60546321 60546342 60546326 60546321 -
tctggcactctaataattgtgc

SEQ ID NO: 211457 - DNA, 22 bp, Artificial Sequence
  Synthetic oligonucleotide; CTC chr2 60546319 60546340 60546324 60546319 -
tggcactctaataattgtgctt

SEQ ID NO: 211458 - DNA, 22 bp, Artificial Sequence
  Synthetic oligonucleotide; CTG chr2 60546317 60546338 60546322 60546317 -
gcactctaataattgtgctttt

SEQ ID NO: 211459 - DNA, 22 bp, Artificial Sequence
  Synthetic oligonucleotide; CTC chr2 60546311 60546332 60546316 60546311 -
taataattgtgcttttgtttct

SEQ ID NO: 211460 - DNA, 22 bp, Artificial Sequence
  Synthetic oligonucleotide; CTA chr2 60546309 60546330 60546314 60546309 -
ataattgtgcttttgtttctcc

SEQ ID NO: 211461 - DNA, 22 bp, Artificial Sequence
  Synthetic oligonucleotide; TTG chr2 60546302 60546323 60546307 60546302 -
tgcttttgtttctccaaccaca

SEQ ID NO: 211462 - DNA, 22 bp, Artificial Sequence
  Synthetic oligonucleotide; CTT chr2 60546297 60546318 60546302 60546297 -
ttgtttctccaaccacagccga

SEQ ID NO: 211463 - DNA, 22 bp, Artificial Sequence
  Synthetic oligonucleotide; TTT chr2 60546296 60546317 60546301 60546296 -
tgtttctccaaccacagccgag

SEQ ID NO: 211464 - DNA, 22 bp, Artificial Sequence
  Synthetic oligonucleotide; TTT chr2 60546295 60546316 60546300 60546295 -
gtttctccaaccacagccgagc

SEQ ID NO: 211465 - DNA, 22 bp, Artificial Sequence
  Synthetic oligonucleotide; TTG chr2 60546294 60546315 60546299 60546294 -
tttctccaaccacagccgagcc

SEQ ID NO: 211466 - DNA, 22 bp, Artificial Sequence
  Synthetic oligonucleotide; TTT chr2 60546291 60546312 60546296 60546291 -
ctccaaccacagccgagcctct

SEQ ID NO: 211467 - DNA, 22 bp, Artificial Sequence
  Synthetic oligonucleotide; TTC chr2 60546290 60546311 60546295 60546290 -
tccaaccacagccgagcctctt

SEQ ID NO: 211468 - DNA, 22 bp, Artificial Sequence
  Synthetic oligonucleotide; CTC chr2 60546288 60546309 60546293 60546288 -
caaccacagccgagcctcttga

SEQ ID NO: 211469 - DNA, 22 bp, Artificial Sequence
  Synthetic oligonucleotide; CTC chr2 60546270 60546291 60546275 60546270 -
ttgaagccattcttacagatga

SEQ ID NO: 211470 - DNA, 22 bp, Artificial Sequence
  Synthetic oligonucleotide; CTT chr2 60546268 60546289 60546273 60546268 -
gaagccattcttacagatgatg

SEQ ID NO: 211471 - DNA, 22 bp, Artificial Sequence
  Synthetic oligonucleotide; TTG chr2 60546267 60546288 60546272 60546267 -
aagccattcttacagatgatga

SEQ ID NO: 211472 - DNA, 22 bp, Artificial Sequence
  Synthetic oligonucleotide; TTC chr2 60546258 60546279 60546263 60546258 -
ttacagatgatgaaccagacca

SEQ ID NO: 211473 - DNA, 22 bp, Artificial Sequence
  Synthetic oligonucleotide; CTT chr2 60546256 60546277 60546261 60546256 -
acagatgatgaaccagaccacg

SEQ ID NO: 211474 - DNA, 22 bp, Artificial Sequence
  Synthetic oligonucleotide; TTA chr2 60546255 60546276 60546260 60546255 -
cagatgatgaaccagaccacgg

SEQ ID NO: 211475 - DNA, 22 bp, Artificial Sequence
  Synthetic oligonucleotide; TTG chr2 60546226 60546247 60546231 60546226 -
ggagctccagaaggggatcatg

SEQ ID NO: 211476 - DNA, 22 bp, Artificial Sequence
  Synthetic oligonucleotide; CTC chr2 60546219 60546240 60546224 60546219 -
cagaaggggatcatgacctcct

SEQ ID NO: 211477 - DNA, 22 bp, Artificial Sequence
  Synthetic oligonucleotide; CTC chr2 60546199 60546220 60546204 60546199 -
ctcacctgtgggcagtgccaga

SEQ ID NO: 211478 - DNA, 22 bp, Artificial Sequence
  Synthetic oligonucleotide; CTC chr2 60546196 60546217 60546201 60546196 -
acctgtgggcagtgccagatga

SEQ ID NO: 211479 - DNA, 22 bp, Artificial Sequence
  Synthetic oligonucleotide; CTG chr2 60546191 60546212 60546196 60546191 -
tgggcagtgccagatgaacttc

SEQ ID NO: 211480 - DNA, 22 bp, Artificial Sequence
  Synthetic oligonucleotide; CTT chr2 60546170 60546191 60546175 60546170 -
cccattgggggacattcttatt

SEQ ID NO: 211481 - DNA, 22 bp, Artificial Sequence
  Synthetic oligonucleotide; TTC chr2 60546169 60546190 60546174 60546169 -
ccattgggggacattcttattt

SEQ ID NO: 211482 - DNA, 22 bp, Artificial Sequence
  Synthetic oligonucleotide; TTG chr2 60546163 60546184 60546168 60546163 -
ggggacattcttatttttatcg

SEQ ID NO: 211483 - DNA, 22 bp, Artificial Sequence
  Synthetic oligonucleotide; TTC chr2 60546153 60546174 60546158 60546153 -
ttatttttatcgagcacaaacg

SEQ ID NO: 211484 - DNA, 22 bp, Artificial Sequence
  Synthetic oligonucleotide; CTT chr2 60546151 60546172 60546156 60546151 -
atttttatcgagcacaaacgga

SEQ ID NO: 211485 - DNA, 22 bp, Artificial Sequence
  Synthetic oligonucleotide; TTA chr2 60546150 60546171 60546155 60546150 -
tttttatcgagcacaaacggaa

SEQ ID NO: 211486 - DNA, 22 bp, Artificial Sequence
  Synthetic oligonucleotide; TTT chr2 60546147 60546168 60546152 60546147 -
ttatcgagcacaaacggaaaca

SEQ ID NO: 211487 - DNA, 22 bp, Artificial Sequence
  Synthetic oligonucleotide; TTT chr2 60546146 60546167 60546151 60546146 -
tatcgagcacaaacggaaacaa

SEQ ID NO: 211488 - DNA, 22 bp, Artificial Sequence
  Synthetic oligonucleotide; TTT chr2 60546145 60546166 60546150 60546145 -
atcgagcacaaacggaaacaat

SEQ ID NO: 211489 - DNA, 22 bp, Artificial Sequence
  Synthetic oligonucleotide; TTA chr2 60546144 60546165 60546149 60546144 -
tcgagcacaaacggaaacaatg

SEQ ID NO: 211490 - DNA, 22 bp, Artificial Sequence
  Synthetic oligonucleotide; CTC chr2 60546109 60546130 60546114 60546109 -
tgcttagaaaaagctgtggata

SEQ ID NO: 211491 - DNA, 22 bp, Artificial Sequence
  Synthetic oligonucleotide; CTG chr2 60546107 60546128 60546112 60546107 -
cttagaaaaagctgtggataag

SEQ ID NO: 211492 - DNA, 22 bp, Artificial Sequence
  Synthetic oligonucleotide; CTT chr2 60546104 60546125 60546109 60546104 -
agaaaaagctgtggataagcca

SEQ ID NO: 211493 - DNA, 22 bp, Artificial Sequence
  Synthetic oligonucleotide; TTA chr2 60546103 60546124 60546108 60546103 -
gaaaaagctgtggataagccac

SEQ ID NO: 211494 - DNA, 22 bp, Artificial Sequence
  Synthetic oligonucleotide; CTG chr2 60546093 60546114 60546098 60546093 -
tggataagccaccttccccttc

SEQ ID NO: 211495 - DNA, 22 bp, Artificial Sequence
  Synthetic oligonucleotide; CTT chr2 60546078 60546099 60546083 60546078 -
ccccttcaccaatcgagatgaa

SEQ ID NO: 211496 - DNA, 22 bp, Artificial Sequence
  Synthetic oligonucleotide; TTC chr2 60546077 60546098 60546082 60546077 -
cccttcaccaatcgagatgaaa

SEQ ID NO: 211497 - DNA, 22 bp, Artificial Sequence
  Synthetic oligonucleotide; CTT chr2 60546072 60546093 60546077 60546072 -
caccaatcgagatgaaaaaagc

SEQ ID NO: 211498 - DNA, 22 bp, Artificial Sequence
  Synthetic oligonucleotide; TTC chr2 60546071 60546092 60546076 60546071 -
accaatcgagatgaaaaaagca

SEQ ID NO: 211499 - DNA, 22 bp, Artificial Sequence
  Synthetic oligonucleotide; TTG chr2 60546030 60546051 60546035 60546030 -
gcatccaggtcacgccagagga

SEQ ID NO: 211500 - DNA, 22 bp, Artificial Sequence
  Synthetic oligonucleotide; TTG chr2 60545999 60546020 60546004 60545999 -
tttatcaacgtcatctagagga

SEQ ID NO: 211501 - DNA, 22 bp, Artificial Sequence
  Synthetic oligonucleotide; TTT chr2 60545996 60546017 60546001 60545996 -
atcaacgtcatctagaggaatt

SEQ ID NO: 211502 - DNA, 22 bp, Artificial Sequence
  Synthetic oligonucleotide; TTA chr2 60545995 60546016 60546000 60545995 -
tcaacgtcatctagaggaattt

SEQ ID NO: 211503 - DNA, 22 bp, Artificial Sequence
  Synthetic oligonucleotide; CTA chr2 60545982 60546003 60545987 60545982 -
gaggaatttgccccaaacagga

SEQ ID NO: 211504 - DNA, 22 bp, Artificial Sequence
  Synthetic oligonucleotide; TTT chr2 60545973 60545994 60545978 60545973 -
gccccaaacaggaacacatagc

SEQ ID NO: 211505 - DNA, 22 bp, Artificial Sequence
  Synthetic oligonucleotide; TTG chr2 60545972 60545993 60545977 60545972 -
ccccaaacaggaacacatagca

SEQ ID NO: 211506 - DNA, 22 bp, Artificial Sequence
  Synthetic oligonucleotide; CTG chr2 60545922 60545943 60545927 60545922 -
tttgcatgttttcttttcattt

SEQ ID NO: 211507 - DNA, 22 bp, Artificial Sequence
  Synthetic oligonucleotide; TTT chr2 60545919 60545940 60545924 60545919 -
gcatgttttcttttcattttca

SEQ ID NO: 211508 - DNA, 22 bp, Artificial Sequence
  Synthetic oligonucleotide; TTG chr2 60545918 60545939 60545923 60545918 -
catgttttcttttcattttcag

SEQ ID NO: 211509 - DNA, 22 bp, Artificial Sequence
  Synthetic oligonucleotide; TTT chr2 60545911 60545932 60545916 60545911 -
tcttttcattttcagaggtgct

SEQ ID NO: 211510 - DNA, 22 bp, Artificial Sequence
  Synthetic oligonucleotide; TTT chr2 60545910 60545931 60545915 60545910 -
cttttcattttcagaggtgctg

SEQ ID NO: 211511 - DNA, 22 bp, Artificial Sequence
  Synthetic oligonucleotide; TTC chr2 60545909 60545930 60545914 60545909 -
ttttcattttcagaggtgctgt

SEQ ID NO: 211512 - DNA, 22 bp, Artificial Sequence
  Synthetic oligonucleotide; CTT chr2 60545907 60545928 60545912 60545907 -
ttcattttcagaggtgctgtag

SEQ ID NO: 211513 - DNA, 22 bp, Artificial Sequence
  Synthetic oligonucleotide; TTT chr2 60545906 60545927 60545911 60545906 -
tcattttcagaggtgctgtagc

SEQ ID NO: 211514 - DNA, 22 bp, Artificial Sequence
  Synthetic oligonucleotide; TTT chr2 60545905 60545926 60545910 60545905 -
cattttcagaggtgctgtagcc

SEQ ID NO: 211515 - DNA, 22 bp, Artificial Sequence
  Synthetic oligonucleotide; TTC chr2 60545904 60545925 60545909 60545904 -
attttcagaggtgctgtagcca

SEQ ID NO: 211516 - DNA, 22 bp, Artificial Sequence
  Synthetic oligonucleotide; TTT chr2 60545900 60545921 60545905 60545900 -
tcagaggtgctgtagccaagca

SEQ ID NO: 211517 - DNA, 22 bp, Artificial Sequence
  Synthetic oligonucleotide; TTT chr2 60545899 60545920 60545904 60545899 -
cagaggtgctgtagccaagcag

SEQ ID NO: 211518 - DNA, 22 bp, Artificial Sequence
  Synthetic oligonucleotide; TTC chr2 60545898 60545919 60545903 60545898 -
agaggtgctgtagccaagcagt

SEQ ID NO: 211519 - DNA, 22 bp, Artificial Sequence
  Synthetic oligonucleotide; CTG chr2 60545888 60545909 60545893 60545888 -
tagccaagcagtaaggagttgt

SEQ ID NO: 211520 - DNA, 22 bp, Artificial Sequence
  Synthetic oligonucleotide; TTG chr2 60545867 60545888 60545872 60545867 -
tgaagtgctttctctattactc

SEQ ID NO: 211521 - DNA, 22 bp, Artificial Sequence
  Synthetic oligonucleotide; CTT chr2 60545857 60545878 60545862 60545857 -
tctctattactctatgtgactg

SEQ ID NO: 211522 - DNA, 22 bp, Artificial Sequence
  Synthetic oligonucleotide; TTT chr2 60545856 60545877 60545861 60545856 -
ctctattactctatgtgactgt

SEQ ID NO: 211523 - DNA, 22 bp, Artificial Sequence
  Synthetic oligonucleotide; TTC chr2 60545855 60545876 60545860 60545855 -
tctattactctatgtgactgtc

SEQ ID NO: 211524 - DNA, 22 bp, Artificial Sequence
  Synthetic oligonucleotide; CTC chr2 60545853 60545874 60545858 60545853 -
tattactctatgtgactgtcca

SEQ ID NO: 211525 - DNA, 22 bp, Artificial Sequence
  Synthetic oligonucleotide; CTA chr2 60545851 60545872 60545856 60545851 -
ttactctatgtgactgtccatg

SEQ ID NO: 211526 - DNA, 22 bp, Artificial Sequence
  Synthetic oligonucleotide; TTA chr2 60545848 60545869 60545853 60545848 -
ctctatgtgactgtccatgaca

SEQ ID NO: 211527 - DNA, 22 bp, Artificial Sequence
  Synthetic oligonucleotide; CTC chr2 60545845 60545866 60545850 60545845 -
tatgtgactgtccatgacagcc

SEQ ID NO: 211528 - DNA, 22 bp, Artificial Sequence
  Synthetic oligonucleotide; CTA chr2 60545843 60545864 60545848 60545843 -
tgtgactgtccatgacagccct

SEQ ID NO: 211529 - DNA, 22 bp, Artificial Sequence
  Synthetic oligonucleotide; CTG chr2 60545835 60545856 60545840 60545835 -
tccatgacagccctgtaatgtt

SEQ ID NO: 211530 - DNA, 22 bp, Artificial Sequence
  Synthetic oligonucleotide; CTG chr2 60545820 60545841 60545825 60545820 -
taatgttaaaataatcatttct

SEQ ID NO: 211531 - DNA, 22 bp, Artificial Sequence
  Synthetic oligonucleotide; TTA chr2 60545812 60545833 60545817 60545812 -
aaataatcatttctgttgctta

SEQ ID NO: 211532 - DNA, 22 bp, Artificial Sequence
  Synthetic oligonucleotide; TTT chr2 60545800 60545821 60545805 60545800 -
ctgttgcttacgtccagaacac

SEQ ID NO: 211533 - DNA, 22 bp, Artificial Sequence
  Synthetic oligonucleotide; TTC chr2 60545799 60545820 60545804 60545799 -
tgttgcttacgtccagaacaca

SEQ ID NO: 211534 - DNA, 22 bp, Artificial Sequence
  Synthetic oligonucleotide; CTG chr2 60545797 60545818 60545802 60545797 -
ttgcttacgtccagaacacaga

SEQ ID NO: 211535 - DNA, 22 bp, Artificial Sequence
  Synthetic oligonucleotide; TTG chr2 60545794 60545815 60545799 60545794 -
cttacgtccagaacacagaaaa

SEQ ID NO: 211536 - DNA, 22 bp, Artificial Sequence
  Synthetic oligonucleotide; CTT chr2 60545791 60545812 60545796 60545791 -
acgtccagaacacagaaaaata

SEQ ID NO: 211537 - DNA, 22 bp, Artificial Sequence
  Synthetic oligonucleotide; TTA chr2 60545790 60545811 60545795 60545790 -
cgtccagaacacagaaaaataa

SEQ ID NO: 211538 - DNA, 22 bp, Artificial Sequence
  Synthetic oligonucleotide; TTT chr2 60545762 60545783 60545767 60545762 -
tccacctcactgaatcagatgt

SEQ ID NO: 211539 - DNA, 22 bp, Artificial Sequence
  Synthetic oligonucleotide; TTT chr2 60545761 60545782 60545766 60545761 -
ccacctcactgaatcagatgta

SEQ ID NO: 211540 - DNA, 22 bp, Artificial Sequence
  Synthetic oligonucleotide; TTC chr2 60545760 60545781 60545765 60545760 -
cacctcactgaatcagatgtag

SEQ ID NO: 211541 - DNA, 22 bp, Artificial Sequence
  Synthetic oligonucleotide; CTC chr2 60545754 60545775 60545759 60545754 -
actgaatcagatgtaggcagga

SEQ ID NO: 211542 - DNA, 22 bp, Artificial Sequence
  Synthetic oligonucleotide; CTG chr2 60545750 60545771 60545755 60545750 -
aatcagatgtaggcaggatagg

SEQ ID NO: 211543 - DNA, 22 bp, Artificial Sequence
  Synthetic oligonucleotide; CTT chr2 60545709 60545730 60545714 60545709 -
ctctctggatctgtcgattttg

SEQ ID NO: 211544 - DNA, 22 bp, Artificial Sequence
  Synthetic oligonucleotide; TTC chr2 60545708 60545729 60545713 60545708 -
tctctggatctgtcgattttgg

SEQ ID NO: 211545 - DNA, 22 bp, Artificial Sequence
  Synthetic oligonucleotide; CTC chr2 60545706 60545727 60545711 60545706 -
tctggatctgtcgattttggat

SEQ ID NO: 211546 - DNA, 22 bp, Artificial Sequence
  Synthetic oligonucleotide; CTC chr2 60545704 60545725 60545709 60545704 -
tggatctgtcgattttggattt

SEQ ID NO: 211547 - DNA, 22 bp, Artificial Sequence
  Synthetic oligonucleotide; CTG chr2 60545702 60545723 60545707 60545702 -
gatctgtcgattttggatttct

SEQ ID NO: 211548 - DNA, 22 bp, Artificial Sequence
  Synthetic oligonucleotide; CTG chr2 60545696 60545717 60545701 60545696 -
tcgattttggatttcttttctt

SEQ ID NO: 211549 - DNA, 22 bp, Artificial Sequence
  Synthetic oligonucleotide; TTT chr2 60545689 60545710 60545694 60545689 -
tggatttcttttcttccccatc

SEQ ID NO: 211550 - DNA, 22 bp, Artificial Sequence
  Synthetic oligonucleotide; TTT chr2 60545688 60545709 60545693 60545688 -
ggatttcttttcttccccatcc

SEQ ID NO: 211551 - DNA, 22 bp, Artificial Sequence
  Synthetic oligonucleotide; TTG chr2 60545687 60545708 60545692 60545687 -
gatttcttttcttccccatccc

SEQ ID NO: 211552 - DNA, 22 bp, Artificial Sequence
  Synthetic oligonucleotide; TTT chr2 60545682 60545703 60545687 60545682 -
cttttcttccccatccccacct

SEQ ID NO: 211553 - DNA, 22 bp, Artificial Sequence
  Synthetic oligonucleotide; TTC chr2 60545681 60545702 60545686 60545681 -
ttttcttccccatccccacctt

SEQ ID NO: 211554 - DNA, 22 bp, Artificial Sequence
  Synthetic oligonucleotide; CTT chr2 60545679 60545700 60545684 60545679 -
ttcttccccatccccaccttct

SEQ ID NO: 211555 - DNA, 22 bp, Artificial Sequence
  Synthetic oligonucleotide; TTT chr2 60545678 60545699 60545683 60545678 -
tcttccccatccccaccttctc

SEQ ID NO: 211556 - DNA, 22 bp, Artificial Sequence
  Synthetic oligonucleotide; TTT chr2 60545677 60545698 60545682 60545677 -
cttccccatccccaccttctca

SEQ ID NO: 211557 - DNA, 22 bp, Artificial Sequence
  Synthetic oligonucleotide; TTC chr2 60545676 60545697 60545681 60545676 -
ttccccatccccaccttctcat

SEQ ID NO: 211558 - DNA, 22 bp, Artificial Sequence
  Synthetic oligonucleotide; CTT chr2 60545674 60545695 60545679 60545674 -
ccccatccccaccttctcattt

SEQ ID NO: 211559 - DNA, 22 bp, Artificial Sequence
  Synthetic oligonucleotide; TTC chr2 60545673 60545694 60545678 60545673 -
cccatccccaccttctcatttt

SEQ ID NO: 211560 - DNA, 22 bp, Artificial Sequence
  Synthetic oligonucleotide; CTT chr2 60545659 60545680 60545664 60545659 -
ctcattttgaagtattgagctt

SEQ ID NO: 211561 - DNA, 22 bp, Artificial Sequence
  Synthetic oligonucleotide; TTC chr2 60545658 60545679 60545663 60545658 -
tcattttgaagtattgagcttt

SEQ ID NO: 211562 - DNA, 22 bp, Artificial Sequence
  Synthetic oligonucleotide; CTC chr2 60545656 60545677 60545661 60545656 -
attttgaagtattgagctttac

SEQ ID NO: 211563 - DNA, 22 bp, Artificial Sequence
  Synthetic oligonucleotide; TTT chr2 60545652 60545673 60545657 60545652 -
tgaagtattgagctttactaca

SEQ ID NO: 211564 - DNA, 22 bp, Artificial Sequence
  Synthetic oligonucleotide; TTT chr2 60545651 60545672 60545656 60545651 -
gaagtattgagctttactacac

SEQ ID NO: 211565 - DNA, 22 bp, Artificial Sequence
  Synthetic oligonucleotide; TTG chr2 60545650 60545671 60545655 60545650 -
aagtattgagctttactacacc

SEQ ID NO: 211566 - DNA, 22 bp, Artificial Sequence
  Synthetic oligonucleotide; TTG chr2 60545642 60545663 60545647 60545642 -
agctttactacacctagtccag

SEQ ID NO: 211567 - DNA, 22 bp, Artificial Sequence
  Synthetic oligonucleotide; CTT chr2 60545637 60545658 60545642 60545637 -
tactacacctagtccagcttcc

SEQ ID NO: 211568 - DNA, 22 bp, Artificial Sequence
  Synthetic oligonucleotide; TTT chr2 60545636 60545657 60545641 60545636 -
actacacctagtccagcttcca

SEQ ID NO: 211569 - DNA, 22 bp, Artificial Sequence
  Synthetic oligonucleotide; TTA chr2 60545635 60545656 60545640 60545635 -
ctacacctagtccagcttccat

SEQ ID NO: 211570 - DNA, 22 bp, Artificial Sequence
  Synthetic oligonucleotide; CTA chr2 60545632 60545653 60545637 60545632 -
cacctagtccagcttccattgt

SEQ ID NO: 211571 - DNA, 22 bp, Artificial Sequence
  Synthetic oligonucleotide; CTA chr2 60545626 60545647 60545631 60545626 -
gtccagcttccattgtccattt

SEQ ID NO: 211572 - DNA, 22 bp, Artificial Sequence
  Synthetic oligonucleotide; CTT chr2 60545617 60545638 60545622 60545617 -
ccattgtccatttccagccttg

SEQ ID NO: 211573 - DNA, 22 bp, Artificial Sequence
  Synthetic oligonucleotide; TTC chr2 60545616 60545637 60545621 60545616 -
cattgtccatttccagccttgg

SEQ ID NO: 211574 - DNA, 22 bp, Artificial Sequence
  Synthetic oligonucleotide; TTG chr2 60545611 60545632 60545616 60545611 -
tccatttccagccttggtgacg

SEQ ID NO: 211575 - DNA, 22 bp, Artificial Sequence
  Synthetic oligonucleotide; TTT chr2 60545604 60545625 60545609 60545604 -
ccagccttggtgacgtgtcaga

SEQ ID NO: 211576 - DNA, 22 bp, Artificial Sequence
  Synthetic oligonucleotide; TTC chr2 60545603 60545624 60545608 60545603 -
cagccttggtgacgtgtcagag

SEQ ID NO: 211577 - DNA, 22 bp, Artificial Sequence
  Synthetic oligonucleotide; CTT chr2 60545596 60545617 60545601 60545596 -
ggtgacgtgtcagaggcaaagt

SEQ ID NO: 211578 - DNA, 22 bp, Artificial Sequence
  Synthetic oligonucleotide; TTG chr2 60545595 60545616 60545600 60545595 -
gtgacgtgtcagaggcaaagtg

SEQ ID NO: 211579 - DNA, 22 bp, Artificial Sequence
  Synthetic oligonucleotide; TTT chr2 60545558 60545579 60545563 60545558 -
gcagttcagccaatgacttgtt

SEQ ID NO: 211580 - DNA, 22 bp, Artificial Sequence
  Synthetic oligonucleotide; TTG chr2 60545557 60545578 60545562 60545557 -
cagttcagccaatgacttgttt

SEQ ID NO: 211581 - DNA, 22 bp, Artificial Sequence
  Synthetic oligonucleotide; TTC chr2 60545551 60545572 60545556 60545551 -
agccaatgacttgtttgactca

SEQ ID NO: 211582 - DNA, 22 bp, Artificial Sequence
  Synthetic oligonucleotide; CTT chr2 60545539 60545560 60545544 60545539 -
gtttgactcagaacatctggcc

SEQ ID NO: 211583 - DNA, 22 bp, Artificial Sequence
  Synthetic oligonucleotide; TTG chr2 60545538 60545559 60545543 60545538 -
tttgactcagaacatctggcca

SEQ ID NO: 211584 - DNA, 22 bp, Artificial Sequence
  Synthetic oligonucleotide; TTT chr2 60545535 60545556 60545540 60545535 -
gactcagaacatctggccaggc

SEQ ID NO: 211585 - DNA, 22 bp, Artificial Sequence
  Synthetic oligonucleotide; TTG chr2 60545534 60545555 60545539 60545534 -
actcagaacatctggccaggcc

SEQ ID NO: 211586 - DNA, 22 bp, Artificial Sequence
  Synthetic oligonucleotide; CTC chr2 60545530 60545551 60545535 60545530 -
agaacatctggccaggcctcct

SEQ ID NO: 211587 - DNA, 22 bp, Artificial Sequence
  Synthetic oligonucleotide; CTG chr2 60545520 60545541 60545525 60545520 -
gccaggcctccttaggggttca

SEQ ID NO: 211588 - DNA, 22 bp, Artificial Sequence
  Synthetic oligonucleotide; CTC chr2 60545510 60545531 60545515 60545510 -
cttaggggttcagctcgttctc

SEQ ID NO: 211589 - DNA, 22 bp, Artificial Sequence
  Synthetic oligonucleotide; CTT chr2 60545507 60545528 60545512 60545507 -
aggggttcagctcgttctcaag

SEQ ID NO: 211590 - DNA, 22 bp, Artificial Sequence
  Synthetic oligonucleotide; TTA chr2 60545506 60545527 60545511 60545506 -
ggggttcagctcgttctcaagg

SEQ ID NO: 211591 - DNA, 22 bp, Artificial Sequence
  Synthetic oligonucleotide; TTC chr2 60545499 60545520 60545504 60545499 -
agctcgttctcaaggcttccct

SEQ ID NO: 211592 - DNA, 22 bp, Artificial Sequence
  Synthetic oligonucleotide; CTC chr2 60545494 60545515 60545499 60545494 -
gttctcaaggcttccctgaagt

SEQ ID NO: 211593 - DNA, 22 bp, Artificial Sequence
  Synthetic oligonucleotide; TTC chr2 60545490 60545511 60545495 60545490 -
tcaaggcttccctgaagtagag

SEQ ID NO: 211594 - DNA, 22 bp, Artificial Sequence
  Synthetic oligonucleotide; CTC chr2 60545488 60545509 60545493 60545488 -
aaggcttccctgaagtagagtg

SEQ ID NO: 211595 - DNA, 22 bp, Artificial Sequence
  Synthetic oligonucleotide; CTT chr2 60545481 60545502 60545486 60545481 -
ccctgaagtagagtgggctggc

SEQ ID NO: 211596 - DNA, 22 bp, Artificial Sequence
  Synthetic oligonucleotide; TTC chr2 60545480 60545501 60545485 60545480 -
cctgaagtagagtgggctggca

SEQ ID NO: 211597 - DNA, 22 bp, Artificial Sequence
  Synthetic oligonucleotide; CTG chr2 60545476 60545497 60545481 60545476 -
aagtagagtgggctggcagggt

SEQ ID NO: 211598 - DNA, 22 bp, Artificial Sequence
  Synthetic oligonucleotide; CTG chr2 60545461 60545482 60545466 60545461 -
gcagggtagttggaggtggtgg

SEQ ID NO: 211599 - DNA, 22 bp, Artificial Sequence
  Synthetic oligonucleotide; TTG chr2 60545449 60545470 60545454 60545449 -
gaggtggtggaaagagttaact

SEQ ID NO: 211600 - DNA, 22 bp, Artificial Sequence
  Synthetic oligonucleotide; TTA chr2 60545430 60545451 60545435 60545430 -
actgagcttcagggctagcctt

SEQ ID NO: 211601 - DNA, 22 bp, Artificial Sequence
  Synthetic oligonucleotide; CTG chr2 60545426 60545447 60545431 60545426 -
agcttcagggctagccttggat

SEQ ID NO: 211602 - DNA, 22 bp, Artificial Sequence
  Synthetic oligonucleotide; CTT chr2 60545421 60545442 60545426 60545421 -
cagggctagccttggatccata

SEQ ID NO: 211603 - DNA, 22 bp, Artificial Sequence
  Synthetic oligonucleotide; TTC chr2 60545420 60545441 60545425 60545420 -
agggctagccttggatccatat

SEQ ID NO: 211604 - DNA, 22 bp, Artificial Sequence
  Synthetic oligonucleotide; CTA chr2 60545413 60545434 60545418 60545413 -
gccttggatccatattggctgt

SEQ ID NO: 211605 - DNA, 22 bp, Artificial Sequence
  Synthetic oligonucleotide; CTT chr2 60545408 60545429 60545413 60545408 -
ggatccatattggctgtcagcc

SEQ ID NO: 211606 - DNA, 22 bp, Artificial Sequence
  Synthetic oligonucleotide; TTG chr2 60545407 60545428 60545412 60545407 -
gatccatattggctgtcagccc

SEQ ID NO: 211607 - DNA, 22 bp, Artificial Sequence
  Synthetic oligonucleotide; TTG chr2 60545396 60545417 60545401 60545396 -
gctgtcagcccggatggggctg

SEQ ID NO: 211608 - DNA, 22 bp, Artificial Sequence
  Synthetic oligonucleotide; CTG chr2 60545392 60545413 60545397 60545392 -
tcagcccggatggggctgtaat

SEQ ID NO: 211609 - DNA, 22 bp, Artificial Sequence
  Synthetic oligonucleotide; CTG chr2 60545374 60545395 60545379 60545374 -
taattaaacacagccccgtggt

SEQ ID NO: 211610 - DNA, 22 bp, Artificial Sequence
  Synthetic oligonucleotide; TTA chr2 60545368 60545389 60545373 60545368 -
aacacagccccgtggtgggatg

SEQ ID NO: 211611 - DNA, 22 bp, Artificial Sequence
  Synthetic oligonucleotide; CTT chr2 60545333 60545354 60545338 60545333 -
gactttaagatgccattttcga

SEQ ID NO: 211612 - DNA, 22 bp, Artificial Sequence
  Synthetic oligonucleotide; TTG chr2 60545332 60545353 60545337 60545332 -
actttaagatgccattttcgac

SEQ ID NO: 211613 - DNA, 22 bp, Artificial Sequence
  Synthetic oligonucleotide; CTT chr2 60545328 60545349 60545333 60545328 -
taagatgccattttcgactggc

SEQ ID NO: 211614 - DNA, 22 bp, Artificial Sequence
  Synthetic oligonucleotide; TTT chr2 60545327 60545348 60545332 60545327 -
aagatgccattttcgactggcc

SEQ ID NO: 211615 - DNA, 22 bp, Artificial Sequence
  Synthetic oligonucleotide; TTA chr2 60545326 60545347 60545331 60545326 -
agatgccattttcgactggcca

SEQ ID NO: 211616 - DNA, 22 bp, Artificial Sequence
  Synthetic oligonucleotide; TTT chr2 60545315 60545336 60545320 60545315 -
tcgactggccaggccagagtag

SEQ ID NO: 211617 - DNA, 22 bp, Artificial Sequence
  Synthetic oligonucleotide; TTT chr2 60545314 60545335 60545319 60545314 -
cgactggccaggccagagtaga

SEQ ID NO: 211618 - DNA, 22 bp, Artificial Sequence
  Synthetic oligonucleotide; TTC chr2 60545313 60545334 60545318 60545313 -
gactggccaggccagagtagag

SEQ ID NO: 211619 - DNA, 22 bp, Artificial Sequence
  Synthetic oligonucleotide; CTG chr2 60545308 60545329 60545313 60545308 -
gccaggccagagtagagagggc

SEQ ID NO: 211620 - DNA, 22 bp, Artificial Sequence
  Synthetic oligonucleotide; TTG chr2 60545281 60545302 60545286 60545281 -
ctgaagcgcacagacatgctta

SEQ ID NO: 211621 - DNA, 22 bp, Artificial Sequence
  Synthetic oligonucleotide; CTG chr2 60545278 60545299 60545283 60545278 -
aagcgcacagacatgcttactc

SEQ ID NO: 211622 - DNA, 22 bp, Artificial Sequence
  Synthetic oligonucleotide; CTT chr2 60545260 60545281 60545265 60545260 -
actcgaaaagtttaagggcatg

SEQ ID NO: 211623 - DNA, 22 bp, Artificial Sequence
  Synthetic oligonucleotide; TTA chr2 60545259 60545280 60545264 60545259 -
ctcgaaaagtttaagggcatgt

SEQ ID NO: 211624 - DNA, 22 bp, Artificial Sequence
  Synthetic oligonucleotide; CTC chr2 60545256 60545277 60545261 60545256 -
gaaaagtttaagggcatgttgg

SEQ ID NO: 211625 - DNA, 22 bp, Artificial Sequence
  Synthetic oligonucleotide; TTT chr2 60545247 60545268 60545252 60545247 -
aagggcatgttggaaatttcaa

SEQ ID NO: 211626 - DNA, 22 bp, Artificial Sequence
  Synthetic oligonucleotide; TTA chr2 60545246 60545267 60545251 60545246 -
agggcatgttggaaatttcaaa

SEQ ID NO: 211627 - DNA, 22 bp, Artificial Sequence
  Synthetic oligonucleotide; TTG chr2 60545235 60545256 60545240 60545235 -
gaaatttcaaaaggttggtttg

SEQ ID NO: 211628 - DNA, 22 bp, Artificial Sequence
  Synthetic oligonucleotide; TTT chr2 60545228 60545249 60545233 60545228 -
caaaaggttggtttgacaggaa

SEQ ID NO: 211629 - DNA, 22 bp, Artificial Sequence
  Synthetic oligonucleotide; TTC chr2 60545227 60545248 60545232 60545227 -
aaaaggttggtttgacaggaac

SEQ ID NO: 211630 - DNA, 22 bp, Artificial Sequence
  Synthetic oligonucleotide; TTG chr2 60545218 60545239 60545223 60545218 -
gtttgacaggaacggctgctcc

SEQ ID NO: 211631 - DNA, 22 bp, Artificial Sequence
  Synthetic oligonucleotide; TTT chr2 60545214 60545235 60545219 60545214 -
gacaggaacggctgctccctgc

SEQ ID NO: 211632 - DNA, 22 bp, Artificial Sequence
  Synthetic oligonucleotide; TTG chr2 60545213 60545234 60545218 60545213 -
acaggaacggctgctccctgca

SEQ ID NO: 211633 - DNA, 22 bp, Artificial Sequence
  Synthetic oligonucleotide; CTG chr2 60545200 60545221 60545205 60545200 -
ctccctgcagcctgcctcctca

SEQ ID NO: 211634 - DNA, 22 bp, Artificial Sequence
  Synthetic oligonucleotide; CTC chr2 60545197 60545218 60545202 60545197 -
cctgcagcctgcctcctcagct

SEQ ID NO: 211635 - DNA, 22 bp, Artificial Sequence
  Synthetic oligonucleotide; CTG chr2 60545193 60545214 60545198 60545193 -
cagcctgcctcctcagctaaat

SEQ ID NO: 211636 - DNA, 22 bp, Artificial Sequence
  Synthetic oligonucleotide; CTG chr2 60545186 60545207 60545191 60545186 -
cctcctcagctaaatgataaat

SEQ ID NO: 211637 - DNA, 22 bp, Artificial Sequence
  Synthetic oligonucleotide; CTC chr2 60545182 60545203 60545187 60545182 -
ctcagctaaatgataaatgctt

SEQ ID NO: 211638 - DNA, 22 bp, Artificial Sequence
  Synthetic oligonucleotide; CTC chr2 60545179 60545200 60545184 60545179 -
agctaaatgataaatgcttctc

SEQ ID NO: 211639 - DNA, 22 bp, Artificial Sequence
  Synthetic oligonucleotide; CTA chr2 60545174 60545195 60545179 60545174 -
aatgataaatgcttctctgtgc

SEQ ID NO: 211640 - DNA, 22 bp, Artificial Sequence
  Synthetic oligonucleotide; CTT chr2 60545160 60545181 60545165 60545160 -
ctctgtgctctctcttgtctct

SEQ ID NO: 211641 - DNA, 22 bp, Artificial Sequence
  Synthetic oligonucleotide; TTC chr2 60545159 60545180 60545164 60545159 -
tctgtgctctctcttgtctctg

SEQ ID NO: 211642 - DNA, 22 bp, Artificial Sequence
  Synthetic oligonucleotide; CTC chr2 60545157 60545178 60545162 60545157 -
tgtgctctctcttgtctctgat

SEQ ID NO: 211643 - DNA, 22 bp, Artificial Sequence
  Synthetic oligonucleotide; CTG chr2 60545155 60545176 60545160 60545155 -
tgctctctcttgtctctgatgt

SEQ ID NO: 211644 - DNA, 22 bp, Artificial Sequence
  Synthetic oligonucleotide; CTC chr2 60545150 60545171 60545155 60545150 -
tctcttgtctctgatgtggttt

SEQ ID NO: 211645 - DNA, 22 bp, Artificial Sequence
  Synthetic oligonucleotide; CTC chr2 60545148 60545169 60545153 60545148 -
tcttgtctctgatgtggttttg

SEQ ID NO: 211646 - DNA, 22 bp, Artificial Sequence
  Synthetic oligonucleotide; CTC chr2 60545146 60545167 60545151 60545146 -
ttgtctctgatgtggttttgac

SEQ ID NO: 211647 - DNA, 22 bp, Artificial Sequence
  Synthetic oligonucleotide; CTT chr2 60545144 60545165 60545149 60545144 -
gtctctgatgtggttttgacag

SEQ ID NO: 211648 - DNA, 22 bp, Artificial Sequence
  Synthetic oligonucleotide; TTG chr2 60545143 60545164 60545148 60545143 -
tctctgatgtggttttgacaga

SEQ ID NO: 211649 - DNA, 22 bp, Artificial Sequence
  Synthetic oligonucleotide; CTC chr2 60545139 60545160 60545144 60545139 -
tgatgtggttttgacagatgta

SEQ ID NO: 211650 - DNA, 22 bp, Artificial Sequence
  Synthetic oligonucleotide; CTG chr2 60545137 60545158 60545142 60545137 -
atgtggttttgacagatgtatc

SEQ ID NO: 211651 - DNA, 22 bp, Artificial Sequence
  Synthetic oligonucleotide; TTT chr2 60545128 60545149 60545133 60545128 -
tgacagatgtatcttgattttg

SEQ ID NO: 211652 - DNA, 22 bp, Artificial Sequence
  Synthetic oligonucleotide; TTT chr2 60545127 60545148 60545132 60545127 -
gacagatgtatcttgattttgt

SEQ ID NO: 211653 - DNA, 22 bp, Artificial Sequence
  Synthetic oligonucleotide; TTG chr2 60545126 60545147 60545131 60545126 -
acagatgtatcttgattttgtt

SEQ ID NO: 211654 - DNA, 22 bp, Artificial Sequence
  Synthetic oligonucleotide; CTT chr2 60545113 60545134 60545118 60545113 -
gattttgtttgtggtttacaca

SEQ ID NO: 211655 - DNA, 22 bp, Artificial Sequence
  Synthetic oligonucleotide; TTG chr2 60545112 60545133 60545117 60545112 -
attttgtttgtggtttacacag

SEQ ID NO: 211656 - DNA, 22 bp, Artificial Sequence
  Synthetic oligonucleotide; TTT chr2 60545108 60545129 60545113 60545108 -
tgtttgtggtttacacagccac

SEQ ID NO: 211657 - DNA, 22 bp, Artificial Sequence
  Synthetic oligonucleotide; TTT chr2 60545107 60545128 60545112 60545107 -
gtttgtggtttacacagccaca

SEQ ID NO: 211658 - DNA, 22 bp, Artificial Sequence
  Synthetic oligonucleotide; TTG chr2 60545106 60545127 60545111 60545106 -
tttgtggtttacacagccacat

SEQ ID NO: 211659 - DNA, 22 bp, Artificial Sequence
  Synthetic oligonucleotide; TTT chr2 60545103 60545124 60545108 60545103 -
gtggtttacacagccacatgtc

SEQ ID NO: 211660 - DNA, 22 bp, Artificial Sequence
  Synthetic oligonucleotide; TTG chr2 60545102 60545123 60545107 60545102 -
tggtttacacagccacatgtca

SEQ ID NO: 211661 - DNA, 22 bp, Artificial Sequence
  Synthetic oligonucleotide; TTT chr2 60545096 60545117 60545101 60545096 -
acacagccacatgtcaccctta

SEQ ID NO: 211662 - DNA, 22 bp, Artificial Sequence
  Synthetic oligonucleotide; TTA chr2 60545095 60545116 60545100 60545095 -
cacagccacatgtcacccttac

SEQ ID NO: 211663 - DNA, 22 bp, Artificial Sequence
  Synthetic oligonucleotide; CTT chr2 60545075 60545096 60545080 60545075 -
acaaatgtccagtccagactcc

SEQ ID NO: 211664 - DNA, 22 bp, Artificial Sequence
  Synthetic oligonucleotide; TTA chr2 60545074 60545095 60545079 60545074 -
caaatgtccagtccagactcca

SEQ ID NO: 211665 - DNA, 22 bp, Artificial Sequence
  Synthetic oligonucleotide; CTC chr2 60545054 60545075 60545059 60545054 -
cactgtttctgctataacacaa

SEQ ID NO: 211666 - DNA, 22 bp, Artificial Sequence
  Synthetic oligonucleotide; CTG chr2 60545049 60545070 60545054 60545049 -
tttctgctataacacaatgtaa

SEQ ID NO: 211667 - DNA, 22 bp, Artificial Sequence
  Synthetic oligonucleotide; TTT chr2 60545046 60545067 60545051 60545046 -
ctgctataacacaatgtaaaaa

SEQ ID NO: 211668 - DNA, 22 bp, Artificial Sequence
  Synthetic oligonucleotide; TTC chr2 60545045 60545066 60545050 60545045 -
tgctataacacaatgtaaaaat

SEQ ID NO: 211669 - DNA, 22 bp, Artificial Sequence
  Synthetic oligonucleotide; CTG chr2 60545043 60545064 60545048 60545043 -
ctataacacaatgtaaaaattt

SEQ ID NO: 211670 - DNA, 22 bp, Artificial Sequence
  Synthetic oligonucleotide; CTA chr2 60545040 60545061 60545045 60545040 -
taacacaatgtaaaaattttct

SEQ ID NO: 211671 - DNA, 22 bp, Artificial Sequence
  Synthetic oligonucleotide; TTT chr2 60545021 60545042 60545026 60545021 -
tcttggaaaaatacacacacgt

SEQ ID NO: 211672 - DNA, 22 bp, Artificial Sequence
  Synthetic oligonucleotide; TTT chr2 60545020 60545041 60545025 60545020 -
cttggaaaaatacacacacgta

SEQ ID NO: 211673 - DNA, 22 bp, Artificial Sequence
  Synthetic oligonucleotide; TTC chr2 60545019 60545040 60545024 60545019 -
ttggaaaaatacacacacgtat

SEQ ID NO: 211674 - DNA, 22 bp, Artificial Sequence
  Synthetic oligonucleotide; CTT chr2 60545017 60545038 60545022 60545017 -
ggaaaaatacacacacgtattc

SEQ ID NO: 211675 - DNA, 22 bp, Artificial Sequence
  Synthetic oligonucleotide; TTG chr2 60545016 60545037 60545021 60545016 -
gaaaaatacacacacgtattca

SEQ ID NO: 211676 - DNA, 22 bp, Artificial Sequence
  Synthetic oligonucleotide; TTC chr2 60544995 60545016 60545000 60544995 -
aacagccctccctcctttggtt

SEQ ID NO: 211677 - DNA, 22 bp, Artificial Sequence
  Synthetic oligonucleotide; CTC chr2 60544985 60545006 60544990 60544985 -
cctcctttggttaattttagca

SEQ ID NO: 211678 - DNA, 22 bp, Artificial Sequence
  Synthetic oligonucleotide; CTC chr2 60544981 60545002 60544986 60544981 -
ctttggttaattttagcaggga

SEQ ID NO: 211679 - DNA, 22 bp, Artificial Sequence
  Synthetic oligonucleotide; CTT chr2 60544978 60544999 60544983 60544978 -
tggttaattttagcagggaggc

SEQ ID NO: 211680 - DNA, 22 bp, Artificial Sequence
  Synthetic oligonucleotide; TTT chr2 60544977 60544998 60544982 60544977 -
ggttaattttagcagggaggca

SEQ ID NO: 211681 - DNA, 22 bp, Artificial Sequence
  Synthetic oligonucleotide; TTG chr2 60544976 60544997 60544981 60544976 -
gttaattttagcagggaggcag

SEQ ID NO: 211682 - DNA, 22 bp, Artificial Sequence
  Synthetic oligonucleotide; TTA chr2 60544972 60544993 60544977 60544972 -
attttagcagggaggcagctag

SEQ ID NO: 211683 - DNA, 22 bp, Artificial Sequence
  Synthetic oligonucleotide; TTT chr2 60544968 60544989 60544973 60544968 -
tagcagggaggcagctaggtgt

SEQ ID NO: 211684 - DNA, 22 bp, Artificial Sequence
  Synthetic oligonucleotide; TTT chr2 60544967 60544988 60544972 60544967 -
agcagggaggcagctaggtgtg

SEQ ID NO: 211685 - DNA, 22 bp, Artificial Sequence
  Synthetic oligonucleotide; TTA chr2 60544966 60544987 60544971 60544966 -
gcagggaggcagctaggtgtgt

SEQ ID NO: 211686 - DNA, 22 bp, Artificial Sequence
  Synthetic oligonucleotide; CTA chr2 60544951 60544972 60544956 60544951 -
ggtgtgtgggtttctcggcagc

SEQ ID NO: 211687 - DNA, 22 bp, Artificial Sequence
  Synthetic oligonucleotide; TTT chr2 60544938 60544959 60544943 60544938 -
ctcggcagctcaagggaaaagg

SEQ ID NO: 211688 - DNA, 22 bp, Artificial Sequence
  Synthetic oligonucleotide; TTC chr2 60544937 60544958 60544942 60544937 -
tcggcagctcaagggaaaagga

SEQ ID NO: 211689 - DNA, 22 bp, Artificial Sequence
  Synthetic oligonucleotide; CTC chr2 60544935 60544956 60544940 60544935 -
ggcagctcaagggaaaaggaat

SEQ ID NO: 211690 - DNA, 22 bp, Artificial Sequence
  Synthetic oligonucleotide; CTC chr2 60544927 60544948 60544932 60544927 -
aagggaaaaggaattaaaggct

SEQ ID NO: 211691 - DNA, 22 bp, Artificial Sequence
  Synthetic oligonucleotide; TTA chr2 60544911 60544932 60544916 60544911 -
aaggctagcagtgggacttaaa

SEQ ID NO: 211692 - DNA, 22 bp, Artificial Sequence
  Synthetic oligonucleotide; CTA chr2 60544904 60544925 60544909 60544904 -
gcagtgggacttaaattccctt

SEQ ID NO: 211693 - DNA, 22 bp, Artificial Sequence
  Synthetic oligonucleotide; CTT chr2 60544892 60544913 60544897 60544892 -
aaattcccttctctaagtgata

SEQ ID NO: 211694 - DNA, 22 bp, Artificial Sequence
  Synthetic oligonucleotide; TTA chr2 60544891 60544912 60544896 60544891 -
aattcccttctctaagtgataa

SEQ ID NO: 211695 - DNA, 22 bp, Artificial Sequence
  Synthetic oligonucleotide; TTC chr2 60544886 60544907 60544891 60544886 -
ccttctctaagtgataaacagt

SEQ ID NO: 211696 - DNA, 22 bp, Artificial Sequence
  Synthetic oligonucleotide; CTT chr2 60544882 60544903 60544887 60544882 -
ctctaagtgataaacagtaaca

SEQ ID NO: 211697 - DNA, 22 bp, Artificial Sequence
  Synthetic oligonucleotide; TTC chr2 60544881 60544902 60544886 60544881 -
tctaagtgataaacagtaacac

SEQ ID NO: 211698 - DNA, 22 bp, Artificial Sequence
  Synthetic oligonucleotide; CTC chr2 60544879 60544900 60544884 60544879 -
taagtgataaacagtaacacta

SEQ ID NO: 211699 - DNA, 22 bp, Artificial Sequence
  Synthetic oligonucleotide; CTA chr2 60544877 60544898 60544882 60544877 -
agtgataaacagtaacactata

SEQ ID NO: 211700 - DNA, 22 bp, Artificial Sequence
  Synthetic oligonucleotide; CTA chr2 60544857 60544878 60544862 60544857 -
tatagtgaccctcaaaacattt

SEQ ID NO: 211701 - DNA, 22 bp, Artificial Sequence
  Synthetic oligonucleotide; CTC chr2 60544844 60544865 60544849 60544844 -
aaaacattttttgcttgagcat

SEQ ID NO: 211702 - DNA, 22 bp, Artificial Sequence
  Synthetic oligonucleotide; TTT chr2 60544835 60544856 60544840 60544835 -
tttgcttgagcatgttagacaa

SEQ ID NO: 211703 - DNA, 22 bp, Artificial Sequence
  Synthetic oligonucleotide; TTT chr2 60544834 60544855 60544839 60544834 -
ttgcttgagcatgttagacaaa

SEQ ID NO: 211704 - DNA, 22 bp, Artificial Sequence
  Synthetic oligonucleotide; TTT chr2 60544833 60544854 60544838 60544833 -
tgcttgagcatgttagacaaaa

SEQ ID NO: 211705 - DNA, 22 bp, Artificial Sequence
  Synthetic oligonucleotide; TTT chr2 60544832 60544853 60544837 60544832 -
gcttgagcatgttagacaaaag

SEQ ID NO: 211706 - DNA, 22 bp, Artificial Sequence
  Synthetic oligonucleotide; TTG chr2 60544831 60544852 60544836 60544831 -
cttgagcatgttagacaaaagt

SEQ ID NO: 211707 - DNA, 22 bp, Artificial Sequence
  Synthetic oligonucleotide; CTT chr2 60544828 60544849 60544833 60544828 -
gagcatgttagacaaaagtcaa

SEQ ID NO: 211708 - DNA, 22 bp, Artificial Sequence
  Synthetic oligonucleotide; TTG chr2 60544827 60544848 60544832 60544827 -
agcatgttagacaaaagtcaat

SEQ ID NO: 211709 - DNA, 22 bp, Artificial Sequence
  Synthetic oligonucleotide; TTA chr2 60544818 60544839 60544823 60544818 -
gacaaaagtcaatgcagattct

SEQ ID NO: 211710 - DNA, 22 bp, Artificial Sequence
  Synthetic oligonucleotide; TTC chr2 60544797 60544818 60544802 60544797 -
tgtgatgacagacatgccatgc

SEQ ID NO: 211711 - DNA, 22 bp, Artificial Sequence
  Synthetic oligonucleotide; CTG chr2 60544795 60544816 60544800 60544795 -
tgatgacagacatgccatgcct

SEQ ID NO: 211712 - DNA, 22 bp, Artificial Sequence
  Synthetic oligonucleotide; CTG chr2 60544772 60544793 60544777 60544772 -
ttggtggatcgctttcttccat

SEQ ID NO: 211713 - DNA, 22 bp, Artificial Sequence
  Synthetic oligonucleotide; TTG chr2 60544769 60544790 60544774 60544769 -
gtggatcgctttcttccatcta

SEQ ID NO: 211714 - DNA, 22 bp, Artificial Sequence
  Synthetic oligonucleotide; CTT chr2 60544758 60544779 60544763 60544758 -
tcttccatctacctaccaccca

SEQ ID NO: 211715 - DNA, 22 bp, Artificial Sequence
  Synthetic oligonucleotide; TTT chr2 60544757 60544778 60544762 60544757 -
cttccatctacctaccacccag

SEQ ID NO: 211716 - DNA, 22 bp, Artificial Sequence
  Synthetic oligonucleotide; TTC chr2 60544756 60544777 60544761 60544756 -
ttccatctacctaccacccagc

SEQ ID NO: 211717 - DNA, 22 bp, Artificial Sequence
  Synthetic oligonucleotide; CTT chr2 60544754 60544775 60544759 60544754 -
ccatctacctaccacccagctc

SEQ ID NO: 211718 - DNA, 22 bp, Artificial Sequence
  Synthetic oligonucleotide; TTC chr2 60544753 60544774 60544758 60544753 -
catctacctaccacccagctcc

SEQ ID NO: 211719 - DNA, 22 bp, Artificial Sequence
  Synthetic oligonucleotide; CTA chr2 60544747 60544768 60544752 60544747 -
cctaccacccagctcccgaaag

SEQ ID NO: 211720 - DNA, 22 bp, Artificial Sequence
  Synthetic oligonucleotide; CTA chr2 60544743 60544764 60544748 60544743 -
ccacccagctcccgaaaggcaa

SEQ ID NO: 211721 - DNA, 22 bp, Artificial Sequence
  Synthetic oligonucleotide; CTC chr2 60544732 60544753 60544737 60544732 -
ccgaaaggcaagaggtttgttc

SEQ ID NO: 211722 - DNA, 22 bp, Artificial Sequence
  Synthetic oligonucleotide; TTT chr2 60544714 60544735 60544719 60544714 -
gttcagttttaggaaaggtagt

SEQ ID NO: 211723 - DNA, 22 bp, Artificial Sequence
  Synthetic oligonucleotide; TTG chr2 60544713 60544734 60544718 60544713 -
ttcagttttaggaaaggtagtg

SEQ ID NO: 211724 - DNA, 22 bp, Artificial Sequence
  Synthetic oligonucleotide; TTC chr2 60544710 60544731 60544715 60544710 -
agttttaggaaaggtagtgcat

SEQ ID NO: 211725 - DNA, 22 bp, Artificial Sequence
  Synthetic oligonucleotide; TTT chr2 60544705 60544726 60544710 60544705 -
taggaaaggtagtgcatatcat

SEQ ID NO: 211726 - DNA, 22 bp, Artificial Sequence
  Synthetic oligonucleotide; TTT chr2 60544704 60544725 60544709 60544704 -
aggaaaggtagtgcatatcatg

SEQ ID NO: 211727 - DNA, 22 bp, Artificial Sequence
  Synthetic oligonucleotide; TTA chr2 60544703 60544724 60544708 60544703 -
ggaaaggtagtgcatatcatga

SEQ ID NO: 211728 - DNA, 22 bp, Artificial Sequence
  Synthetic oligonucleotide; TTG chr2 60544677 60544698 60544682 60544677 -
attcactggaacttgtctctcc

SEQ ID NO: 211729 - DNA, 22 bp, Artificial Sequence
  Synthetic oligonucleotide; TTC chr2 60544673 60544694 60544678 60544673 -
actggaacttgtctctccgacc

SEQ ID NO: 211730 - DNA, 22 bp, Artificial Sequence
  Synthetic oligonucleotide; CTG chr2 60544669 60544690 60544674 60544669 -
gaacttgtctctccgacctagt

SEQ ID NO: 211731 - DNA, 22 bp, Artificial Sequence
  Synthetic oligonucleotide; CTT chr2 60544663 60544684 60544668 60544663 -
gtctctccgacctagtttgacc

SEQ ID NO: 211732 - DNA, 22 bp, Artificial Sequence
  Synthetic oligonucleotide; TTG chr2 60544662 60544683 60544667 60544662 -
tctctccgacctagtttgacca

SEQ ID NO: 211733 - DNA, 22 bp, Artificial Sequence
  Synthetic oligonucleotide; CTC chr2 60544658 60544679 60544663 60544658 -
tccgacctagtttgaccacaaa

SEQ ID NO: 211734 - DNA, 22 bp, Artificial Sequence
  Synthetic oligonucleotide; CTC chr2 60544656 60544677 60544661 60544656 -
cgacctagtttgaccacaaagt

SEQ ID NO: 211735 - DNA, 22 bp, Artificial Sequence
  Synthetic oligonucleotide; CTA chr2 60544649 60544670 60544654 60544649 -
gtttgaccacaaagttgaacca

SEQ ID NO: 211736 - DNA, 22 bp, Artificial Sequence
  Synthetic oligonucleotide; TTT chr2 60544645 60544666 60544650 60544645 -
gaccacaaagttgaaccataat

SEQ ID NO: 211737 - DNA, 22 bp, Artificial Sequence
  Synthetic oligonucleotide; TTG chr2 60544644 60544665 60544649 60544644 -
accacaaagttgaaccataata

SEQ ID NO: 211738 - DNA, 22 bp, Artificial Sequence
  Synthetic oligonucleotide; TTG chr2 60544632 60544653 60544637 60544632 -
aaccataataggtcagtggtct

SEQ ID NO: 211739 - DNA, 22 bp, Artificial Sequence
  Synthetic oligonucleotide; CTA chr2 60544609 60544630 60544614 60544609 -
gaggggattaaatgtcatatta

SEQ ID NO: 211740 - DNA, 22 bp, Artificial Sequence
  Synthetic oligonucleotide; TTA chr2 60544599 60544620 60544604 60544599 -
aatgtcatattatttctcctct

SEQ ID NO: 211741 - DNA, 22 bp, Artificial Sequence
  Synthetic oligonucleotide; TTA chr2 60544587 60544608 60544592 60544587 -
tttctcctctccccctctagaa

SEQ ID NO: 211742 - DNA, 22 bp, Artificial Sequence
  Synthetic oligonucleotide; TTT chr2 60544584 60544605 60544589 60544584 -
ctcctctccccctctagaattt

SEQ ID NO: 211743 - DNA, 22 bp, Artificial Sequence
  Synthetic oligonucleotide; TTC chr2 60544583 60544604 60544588 60544583 -
tcctctccccctctagaatttg

SEQ ID NO: 211744 - DNA, 22 bp, Artificial Sequence
  Synthetic oligonucleotide; CTC chr2 60544581 60544602 60544586 60544581 -
ctctccccctctagaatttgat

SEQ ID NO: 211745 - DNA, 22 bp, Artificial Sequence
  Synthetic oligonucleotide; CTC chr2 60544578 60544599 60544583 60544578 -
tccccctctagaatttgatcat

SEQ ID NO: 211746 - DNA, 22 bp, Artificial Sequence
  Synthetic oligonucleotide; CTC chr2 60544576 60544597 60544581 60544576 -
cccctctagaatttgatcatta

SEQ ID NO: 211747 - DNA, 22 bp, Artificial Sequence
  Synthetic oligonucleotide; CTC chr2 60544570 60544591 60544575 60544570 -
tagaatttgatcattaaaacca

SEQ ID NO: 211748 - DNA, 22 bp, Artificial Sequence
  Synthetic oligonucleotide; CTA chr2 60544568 60544589 60544573 60544568 -
gaatttgatcattaaaaccaaa

SEQ ID NO: 211749 - DNA, 22 bp, Artificial Sequence
  Synthetic oligonucleotide; TTT chr2 60544562 60544583 60544567 60544562 -
gatcattaaaaccaaacatggc

SEQ ID NO: 211750 - DNA, 22 bp, Artificial Sequence
  Synthetic oligonucleotide; TTG chr2 60544561 60544582 60544566 60544561 -
atcattaaaaccaaacatggca

SEQ ID NO: 211751 - DNA, 22 bp, Artificial Sequence
  Synthetic oligonucleotide; TTA chr2 60544554 60544575 60544559 60544554 -
aaaccaaacatggcattttctt

SEQ ID NO: 211752 - DNA, 22 bp, Artificial Sequence
  Synthetic oligonucleotide; TTT chr2 60544536 60544557 60544541 60544536 -
tctttctttttttagtgctttc

SEQ ID NO: 211753 - DNA, 22 bp, Artificial Sequence
  Synthetic oligonucleotide; TTT chr2 60544535 60544556 60544540 60544535 -
ctttctttttttagtgctttct

SEQ ID NO: 211754 - DNA, 22 bp, Artificial Sequence
  Synthetic oligonucleotide; TTC chr2 60544534 60544555 60544539 60544534 -
tttctttttttagtgctttctg

SEQ ID NO: 211755 - DNA, 22 bp, Artificial Sequence
  Synthetic oligonucleotide; CTT chr2 60544532 60544553 60544537 60544532 -
tctttttttagtgctttctgtg

SEQ ID NO: 211756 - DNA, 22 bp, Artificial Sequence
  Synthetic oligonucleotide; TTT chr2 60544531 60544552 60544536 60544531 -
ctttttttagtgctttctgtga

SEQ ID NO: 211757 - DNA, 22 bp, Artificial Sequence
  Synthetic oligonucleotide; TTC chr2 60544530 60544551 60544535 60544530 -
tttttttagtgctttctgtgat

SEQ ID NO: 211758 - DNA, 22 bp, Artificial Sequence
  Synthetic oligonucleotide; CTT chr2 60544528 60544549 60544533 60544528 -
tttttagtgctttctgtgatag

SEQ ID NO: 211759 - DNA, 22 bp, Artificial Sequence
  Synthetic oligonucleotide; TTT chr2 60544527 60544548 60544532 60544527 -
ttttagtgctttctgtgatagc

SEQ ID NO: 211760 - DNA, 22 bp, Artificial Sequence
  Synthetic oligonucleotide; TTT chr2 60544526 60544547 60544531 60544526 -
tttagtgctttctgtgatagca

SEQ ID NO: 211761 - DNA, 22 bp, Artificial Sequence
  Synthetic oligonucleotide; TTT chr2 60544525 60544546 60544530 60544525 -
ttagtgctttctgtgatagcac

SEQ ID NO: 211762 - DNA, 22 bp, Artificial Sequence
  Synthetic oligonucleotide; TTT chr2 60544524 60544545 60544529 60544524 -
tagtgctttctgtgatagcact

SEQ ID NO: 211763 - DNA, 22 bp, Artificial Sequence
  Synthetic oligonucleotide; TTT chr2 60544523 60544544 60544528 60544523 -
agtgctttctgtgatagcactc

SEQ ID NO: 211764 - DNA, 22 bp, Artificial Sequence
  Synthetic oligonucleotide; TTA chr2 60544522 60544543 60544527 60544522 -
gtgctttctgtgatagcactca

SEQ ID NO: 211765 - DNA, 22 bp, Artificial Sequence
  Synthetic oligonucleotide; CTT chr2 60544516 60544537 60544521 60544516 -
tctgtgatagcactcagatact

SEQ ID NO: 211766 - DNA, 22 bp, Artificial Sequence
  Synthetic oligonucleotide; TTT chr2 60544515 60544536 60544520 60544515 -
ctgtgatagcactcagatactt

SEQ ID NO: 211767 - DNA, 22 bp, Artificial Sequence
  Synthetic oligonucleotide; TTC chr2 60544514 60544535 60544519 60544514 -
tgtgatagcactcagatacttt

SEQ ID NO: 211768 - DNA, 22 bp, Artificial Sequence
  Synthetic oligonucleotide; CTG chr2 60544512 60544533 60544517 60544512 -
tgatagcactcagatactttcc

SEQ ID NO: 211769 - DNA, 22 bp, Artificial Sequence
  Synthetic oligonucleotide; CTC chr2 60544501 60544522 60544506 60544501 -
agatactttccctttagtgaaa

SEQ ID NO: 211770 - DNA, 22 bp, Artificial Sequence
  Synthetic oligonucleotide; CTT chr2 60544493 60544514 60544498 60544493 -
tccctttagtgaaatgggaaat

SEQ ID NO: 211771 - DNA, 22 bp, Artificial Sequence
  Synthetic oligonucleotide; TTT chr2 60544492 60544513 60544497 60544492 -
ccctttagtgaaatgggaaatc

SEQ ID NO: 211772 - DNA, 22 bp, Artificial Sequence
  Synthetic oligonucleotide; TTC chr2 60544491 60544512 60544496 60544491 -
cctttagtgaaatgggaaatct

SEQ ID NO: 211773 - DNA, 22 bp, Artificial Sequence
  Synthetic oligonucleotide; CTT chr2 60544487 60544508 60544492 60544487 -
tagtgaaatgggaaatctgctg

SEQ ID NO: 211774 - DNA, 22 bp, Artificial Sequence
  Synthetic oligonucleotide; TTT chr2 60544486 60544507 60544491 60544486 -
agtgaaatgggaaatctgctgc

SEQ ID NO: 211775 - DNA, 22 bp, Artificial Sequence
  Synthetic oligonucleotide; TTA chr2 60544485 60544506 60544490 60544485 -
gtgaaatgggaaatctgctgct

SEQ ID NO: 211776 - DNA, 22 bp, Artificial Sequence
  Synthetic oligonucleotide; CTG chr2 60544468 60544489 60544473 60544468 -
ctgctagggaagctgcatttgt

SEQ ID NO: 211777 - DNA, 22 bp, Artificial Sequence
  Synthetic oligonucleotide; CTG chr2 60544465 60544486 60544470 60544465 -
ctagggaagctgcatttgtgga

SEQ ID NO: 211778 - DNA, 22 bp, Artificial Sequence
  Synthetic oligonucleotide; CTA chr2 60544462 60544483 60544467 60544462 -
gggaagctgcatttgtggagtg

SEQ ID NO: 211779 - DNA, 22 bp, Artificial Sequence
  Synthetic oligonucleotide; CTG chr2 60544453 60544474 60544458 60544453 -
catttgtggagtgtatttcttg

SEQ ID NO: 211780 - DNA, 22 bp, Artificial Sequence
  Synthetic oligonucleotide; TTT chr2 60544448 60544469 60544453 60544448 -
gtggagtgtatttcttgaatcc

SEQ ID NO: 211781 - DNA, 22 bp, Artificial Sequence
  Synthetic oligonucleotide; TTG chr2 60544447 60544468 60544452 60544447 -
tggagtgtatttcttgaatcca

SEQ ID NO: 211782 - DNA, 22 bp, Artificial Sequence
  Synthetic oligonucleotide; TTT chr2 60544435 60544456 60544440 60544435 -
cttgaatccaccacatttacct

SEQ ID NO: 211783 - DNA, 22 bp, Artificial Sequence
  Synthetic oligonucleotide; TTC chr2 60544434 60544455 60544439 60544434 -
ttgaatccaccacatttacctt

SEQ ID NO: 211784 - DNA, 22 bp, Artificial Sequence
  Synthetic oligonucleotide; CTT chr2 60544432 60544453 60544437 60544432 -
gaatccaccacatttaccttat

SEQ ID NO: 211785 - DNA, 22 bp, Artificial Sequence
  Synthetic oligonucleotide; TTG chr2 60544431 60544452 60544436 60544431 -
aatccaccacatttaccttatg

SEQ ID NO: 211786 - DNA, 22 bp, Artificial Sequence
  Synthetic oligonucleotide; TTT chr2 60544417 60544438 60544422 60544417 -
accttatgtgacatgtaggtga

SEQ ID NO: 211787 - DNA, 22 bp, Artificial Sequence
  Synthetic oligonucleotide; TTA chr2 60544416 60544437 60544421 60544416 -
ccttatgtgacatgtaggtgaa

SEQ ID NO: 211788 - DNA, 22 bp, Artificial Sequence
  Synthetic oligonucleotide; CTT chr2 60544412 60544433 60544417 60544412 -
atgtgacatgtaggtgaagatt

SEQ ID NO: 211789 - DNA, 22 bp, Artificial Sequence
  Synthetic oligonucleotide; TTA chr2 60544411 60544432 60544416 60544411 -
tgtgacatgtaggtgaagattt

SEQ ID NO: 211790 - DNA, 22 bp, Artificial Sequence
  Synthetic oligonucleotide; TTT chr2 60544389 60544410 60544394 60544389 -
tatctcccctaccccccagcag

SEQ ID NO: 211791 - DNA, 22 bp, Artificial Sequence
  Synthetic oligonucleotide; TTT chr2 60544388 60544409 60544393 60544388 -
atctcccctaccccccagcagg

SEQ ID NO: 211792 - DNA, 22 bp, Artificial Sequence
  Synthetic oligonucleotide; TTA chr2 60544387 60544408 60544392 60544387 -
tctcccctaccccccagcagga

SEQ ID NO: 211793 - DNA, 22 bp, Artificial Sequence
  Synthetic oligonucleotide; CTC chr2 60544383 60544404 60544388 60544383 -
ccctaccccccagcaggatgtg

SEQ ID NO: 211794 - DNA, 22 bp, Artificial Sequence
  Synthetic oligonucleotide; CTA chr2 60544378 60544399 60544383 60544378 -
ccccccagcaggatgtgggaat

SEQ ID NO: 211795 - DNA, 22 bp, Artificial Sequence
  Synthetic oligonucleotide; TTT chr2 60544348 60544369 60544353 60544348 -
ccatgtgttgtcttgtgactgg

SEQ ID NO: 211796 - DNA, 22 bp, Artificial Sequence
  Synthetic oligonucleotide; TTC chr2 60544347 60544368 60544352 60544347 -
catgtgttgtcttgtgactgga

SEQ ID NO: 211797 - DNA, 22 bp, Artificial Sequence
  Synthetic oligonucleotide; TTG chr2 60544338 60544359 60544343 60544338 -
tcttgtgactggaaggaaaatg

SEQ ID NO: 211798 - DNA, 22 bp, Artificial Sequence
  Synthetic oligonucleotide; CTT chr2 60544334 60544355 60544339 60544334 -
gtgactggaaggaaaatgaaca

SEQ ID NO: 211799 - DNA, 22 bp, Artificial Sequence
  Synthetic oligonucleotide; TTG chr2 60544333 60544354 60544338 60544333 -
tgactggaaggaaaatgaacag

SEQ ID NO: 211800 - DNA, 22 bp, Artificial Sequence
  Synthetic oligonucleotide; CTG chr2 60544327 60544348 60544332 60544327 -
gaaggaaaatgaacagaagtgt

SEQ ID NO: 211801 - DNA, 22 bp, Artificial Sequence
  Synthetic oligonucleotide; TTA chr2 60544293 60544314 60544298 60544293 -
atgaagcaagagcaggcggaag

SEQ ID NO: 211802 - DNA, 22 bp, Artificial Sequence
  Synthetic oligonucleotide; TTT chr2 60544264 60544285 60544269 60544264 -
gtcgtcttcggagatccaaagc

SEQ ID NO: 211803 - DNA, 22 bp, Artificial Sequence
  Synthetic oligonucleotide; TTG chr2 60544263 60544284 60544268 60544263 -
tcgtcttcggagatccaaagcc

SEQ ID NO: 211804 - DNA, 22 bp, Artificial Sequence
  Synthetic oligonucleotide; CTT chr2 60544256 60544277 60544261 60544256 -
cggagatccaaagccttgctaa

SEQ ID NO: 211805 - DNA, 22 bp, Artificial Sequence
  Synthetic oligonucleotide; TTC chr2 60544255 60544276 60544260 60544255 -
ggagatccaaagccttgctaaa

SEQ ID NO: 211806 - DNA, 22 bp, Artificial Sequence
  Synthetic oligonucleotide; CTT chr2 60544239 60544260 60544244 60544239 -
gctaaatcaccaaatatggagt

SEQ ID NO: 211807 - DNA, 22 bp, Artificial Sequence
  Synthetic oligonucleotide; TTG chr2 60544238 60544259 60544243 60544238 -
ctaaatcaccaaatatggagta

SEQ ID NO: 211808 - DNA, 22 bp, Artificial Sequence
  Synthetic oligonucleotide; CTA chr2 60544235 60544256 60544240 60544235 -
aatcaccaaatatggagtaaca

SEQ ID NO: 211809 - DNA, 22 bp, Artificial Sequence
  Synthetic oligonucleotide; CTT chr2 60544210 60544231 60544215 60544210 -
gcgtgatgtaacatcgtattta

SEQ ID NO: 211810 - DNA, 22 bp, Artificial Sequence
  Synthetic oligonucleotide; TTG chr2 60544209 60544230 60544214 60544209 -
cgtgatgtaacatcgtatttac

SEQ ID NO: 211811 - DNA, 22 bp, Artificial Sequence
  Synthetic oligonucleotide; TTT chr2 60544189 60544210 60544194 60544189 -
acatatcgagctgctcgtttaa

SEQ ID NO: 211812 - DNA, 22 bp, Artificial Sequence
  Synthetic oligonucleotide; TTA chr2 60544188 60544209 60544193 60544188 -
catatcgagctgctcgtttaaa

SEQ ID NO: 211813 - DNA, 22 bp, Artificial Sequence
  Synthetic oligonucleotide; CTG chr2 60544176 60544197 60544181 60544176 -
ctcgtttaaaagacaaaacaca

SEQ ID NO: 211814 - DNA, 22 bp, Artificial Sequence
  Synthetic oligonucleotide; CTC chr2 60544173 60544194 60544178 60544173 -
gtttaaaagacaaaacacagtg

SEQ ID NO: 211815 - DNA, 22 bp, Artificial Sequence
  Synthetic oligonucleotide; TTT chr2 60544169 60544190 60544174 60544169 -
aaaagacaaaacacagtgtctg

SEQ ID NO: 211816 - DNA, 22 bp, Artificial Sequence
  Synthetic oligonucleotide; TTA chr2 60544168 60544189 60544173 60544168 -
aaagacaaaacacagtgtctgt

SEQ ID NO: 211817 - DNA, 22 bp, Artificial Sequence
  Synthetic oligonucleotide; CTG chr2 60544147 60544168 60544152 60544147 -
tcaagcaagaattaaaaccaca

SEQ ID NO: 211818 - DNA, 22 bp, Artificial Sequence
  Synthetic oligonucleotide; TTA chr2 60544133 60544154 60544138 60544133 -
aaaccacacttcttactgaggt

SEQ ID NO: 211819 - DNA, 22 bp, Artificial Sequence
  Synthetic oligonucleotide; CTT chr2 60544122 60544143 60544127 60544122 -
cttactgaggtcccaaataggt

SEQ ID NO: 211820 - DNA, 22 bp, Artificial Sequence
  Synthetic oligonucleotide; TTC chr2 60544121 60544142 60544126 60544121 -
ttactgaggtcccaaataggtt

SEQ ID NO: 211821 - DNA, 22 bp, Artificial Sequence
  Synthetic oligonucleotide; CTT chr2 60544119 60544140 60544124 60544119 -
actgaggtcccaaataggttat

SEQ ID NO: 211822 - DNA, 22 bp, Artificial Sequence
  Synthetic oligonucleotide; TTA chr2 60544118 60544139 60544123 60544118 -
ctgaggtcccaaataggttatt

SEQ ID NO: 211823 - DNA, 22 bp, Artificial Sequence
  Synthetic oligonucleotide; CTG chr2 60544115 60544136 60544120 60544115 -
aggtcccaaataggttattcag

SEQ ID NO: 211824 - DNA, 22 bp, Artificial Sequence
  Synthetic oligonucleotide; TTA chr2 60544098 60544119 60544103 60544098 -
ttcagtcttagattaaccagct

SEQ ID NO: 211825 - DNA, 22 bp, Artificial Sequence
  Synthetic oligonucleotide; TTC chr2 60544095 60544116 60544100 60544095 -
agtcttagattaaccagctcaa

SEQ ID NO: 211826 - DNA, 22 bp, Artificial Sequence
  Synthetic oligonucleotide; CTT chr2 60544089 60544110 60544094 60544089 -
agattaaccagctcaaaaattc

SEQ ID NO: 211827 - DNA, 22 bp, Artificial Sequence
  Synthetic oligonucleotide; TTA chr2 60544088 60544109 60544093 60544088 -
gattaaccagctcaaaaattct

SEQ ID NO: 211828 - DNA, 22 bp, Artificial Sequence
  Synthetic oligonucleotide; TTA chr2 60544083 60544104 60544088 60544083 -
accagctcaaaaattctgtgcc

SEQ ID NO: 211829 - DNA, 22 bp, Artificial Sequence
  Synthetic oligonucleotide; CTC chr2 60544075 60544096 60544080 60544075 -
aaaaattctgtgcctctgtatt

SEQ ID NO: 211830 - DNA, 22 bp, Artificial Sequence
  Synthetic oligonucleotide; TTC chr2 60544067 60544088 60544072 60544067 -
tgtgcctctgtatttagaggag

SEQ ID NO: 211831 - DNA, 22 bp, Artificial Sequence
  Synthetic oligonucleotide; CTG chr2 60544065 60544086 60544070 60544065 -
tgcctctgtatttagaggagga

SEQ ID NO: 211832 - DNA, 22 bp, Artificial Sequence
  Synthetic oligonucleotide; CTC chr2 60544059 60544080 60544064 60544059 -
tgtatttagaggaggaatctaa

SEQ ID NO: 211833 - DNA, 22 bp, Artificial Sequence
  Synthetic oligonucleotide; CTG chr2 60544057 60544078 60544062 60544057 -
tatttagaggaggaatctaaat

SEQ ID NO: 211834 - DNA, 22 bp, Artificial Sequence
  Synthetic oligonucleotide; TTT chr2 60544052 60544073 60544057 60544052 -
agaggaggaatctaaatgctgg

SEQ ID NO: 211835 - DNA, 22 bp, Artificial Sequence
  Synthetic oligonucleotide; TTA chr2 60544051 60544072 60544056 60544051 -
gaggaggaatctaaatgctggg

SEQ ID NO: 211836 - DNA, 22 bp, Artificial Sequence
  Synthetic oligonucleotide; CTA chr2 60544038 60544059 60544043 60544038 -
aatgctggggggaaggccttac

SEQ ID NO: 211837 - DNA, 22 bp, Artificial Sequence
  Synthetic oligonucleotide; CTG chr2 60544031 60544052 60544036 60544031 -
gggggaaggccttacatatagt

SEQ ID NO: 211838 - DNA, 22 bp, Artificial Sequence
  Synthetic oligonucleotide; CTT chr2 60544018 60544039 60544023 60544018 -
acatatagttaagacttttact

SEQ ID NO: 211839 - DNA, 22 bp, Artificial Sequence
  Synthetic oligonucleotide; TTA chr2 60544017 60544038 60544022 60544017 -
catatagttaagacttttactg

SEQ ID NO: 211840 - DNA, 22 bp, Artificial Sequence
  Synthetic oligonucleotide; TTA chr2 60544007 60544028 60544012 60544007 -
agacttttactgctatagttgt

SEQ ID NO: 211841 - DNA, 22 bp, Artificial Sequence
  Synthetic oligonucleotide; CTT chr2 60544001 60544022 60544006 60544001 -
ttactgctatagttgtgaatct

SEQ ID NO: 211842 - DNA, 22 bp, Artificial Sequence
  Synthetic oligonucleotide; TTT chr2 60544000 60544021 60544005 60544000 -
tactgctatagttgtgaatcta

SEQ ID NO: 211843 - DNA, 22 bp, Artificial Sequence
  Synthetic oligonucleotide; TTT chr2 60543999 60544020 60544004 60543999 -
actgctatagttgtgaatctat

SEQ ID NO: 211844 - DNA, 22 bp, Artificial Sequence
  Synthetic oligonucleotide; TTA chr2 60543998 60544019 60544003 60543998 -
ctgctatagttgtgaatctatg

SEQ ID NO: 211845 - DNA, 22 bp, Artificial Sequence
  Synthetic oligonucleotide; CTG chr2 60543995 60544016 60544000 60543995 -
ctatagttgtgaatctatgtag

SEQ ID NO: 211846 - DNA, 22 bp, Artificial Sequence
  Synthetic oligonucleotide; CTA chr2 60543992 60544013 60543997 60543992 -
tagttgtgaatctatgtaggga

SEQ ID NO: 211847 - DNA, 22 bp, Artificial Sequence
  Synthetic oligonucleotide; TTG chr2 60543986 60544007 60543991 60543986 -
tgaatctatgtagggaaataag

SEQ ID NO: 211848 - DNA, 22 bp, Artificial Sequence
  Synthetic oligonucleotide; CTA chr2 60543978 60543999 60543983 60543978 -
tgtagggaaataagagatattt

SEQ ID NO: 211849 - DNA, 22 bp, Artificial Sequence
  Synthetic oligonucleotide; TTT chr2 60543956 60543977 60543961 60543956 -
gcttgaactccctggttgtcta

SEQ ID NO: 211850 - DNA, 22 bp, Artificial Sequence
  Synthetic oligonucleotide; TTG chr2 60543955 60543976 60543960 60543955 -
cttgaactccctggttgtctaa

SEQ ID NO: 211851 - DNA, 22 bp, Artificial Sequence
  Synthetic oligonucleotide; CTT chr2 60543952 60543973 60543957 60543952 -
gaactccctggttgtctaaagg

SEQ ID NO: 211852 - DNA, 22 bp, Artificial Sequence
  Synthetic oligonucleotide; TTG chr2 60543951 60543972 60543956 60543951 -
aactccctggttgtctaaaggt

SEQ ID NO: 211853 - DNA, 22 bp, Artificial Sequence
  Synthetic oligonucleotide; CTC chr2 60543946 60543967 60543951 60543946 -
cctggttgtctaaaggttctgt

SEQ ID NO: 211854 - DNA, 22 bp, Artificial Sequence
  Synthetic oligonucleotide; CTG chr2 60543942 60543963 60543947 60543942 -
gttgtctaaaggttctgttatt

SEQ ID NO: 211855 - DNA, 22 bp, Artificial Sequence
  Synthetic oligonucleotide; TTG chr2 60543938 60543959 60543943 60543938 -
tctaaaggttctgttattattt

SEQ ID NO: 211856 - DNA, 22 bp, Artificial Sequence
  Synthetic oligonucleotide; CTA chr2 60543934 60543955 60543939 60543934 -
aaggttctgttattattttttt

SEQ ID NO: 211857 - DNA, 22 bp, Artificial Sequence
  Synthetic oligonucleotide; TTC chr2 60543927 60543948 60543932 60543927 -
tgttattatttttttaaagaac

SEQ ID NO: 211858 - DNA, 22 bp, Artificial Sequence
  Synthetic oligonucleotide; CTG chr2 60543925 60543946 60543930 60543925 -
ttattatttttttaaagaacaa

SEQ ID NO: 211859 - DNA, 22 bp, Artificial Sequence
  Synthetic oligonucleotide; TTA chr2 60543922 60543943 60543927 60543922 -
ttatttttttaaagaacaagta

SEQ ID NO: 211860 - DNA, 22 bp, Artificial Sequence
  Synthetic oligonucleotide; TTA chr2 60543919 60543940 60543924 60543919 -
tttttttaaagaacaagtataa

SEQ ID NO: 211861 - DNA, 22 bp, Artificial Sequence
  Synthetic oligonucleotide; TTT chr2 60543916 60543937 60543921 60543916 -
ttttaaagaacaagtataatag

SEQ ID NO: 211862 - DNA, 22 bp, Artificial Sequence
  Synthetic oligonucleotide; TTT chr2 60543915 60543936 60543920 60543915 -
tttaaagaacaagtataatagc

SEQ ID NO: 211863 - DNA, 22 bp, Artificial Sequence
  Synthetic oligonucleotide; TTT chr2 60543914 60543935 60543919 60543914 -
ttaaagaacaagtataatagca

SEQ ID NO: 211864 - DNA, 22 bp, Artificial Sequence
  Synthetic oligonucleotide; TTT chr2 60543913 60543934 60543918 60543913 -
taaagaacaagtataatagcag

SEQ ID NO: 211865 - DNA, 22 bp, Artificial Sequence
  Synthetic oligonucleotide; TTT chr2 60543912 60543933 60543917 60543912 -
aaagaacaagtataatagcaga

SEQ ID NO: 211866 - DNA, 22 bp, Artificial Sequence
  Synthetic oligonucleotide; TTA chr2 60543911 60543932 60543916 60543911 -
aagaacaagtataatagcagag

SEQ ID NO: 211867 - DNA, 22 bp, Artificial Sequence
  Synthetic oligonucleotide; CTA chr2 60543885 60543906 60543890 60543885 -
gagaagccaaaaccaaaagcaa

SEQ ID NO: 211868 - DNA, 22 bp, Artificial Sequence
  Synthetic oligonucleotide; TTT chr2 60543859 60543880 60543864 60543859 -
aaaatatattttatagcgctaa

SEQ ID NO: 211869 - DNA, 22 bp, Artificial Sequence
  Synthetic oligonucleotide; TTA chr2 60543858 60543879 60543863 60543858 -
aaatatattttatagcgctaat

SEQ ID NO: 211870 - DNA, 22 bp, Artificial Sequence
  Synthetic oligonucleotide; TTT chr2 60543848 60543869 60543853 60543848 -
tatagcgctaataatcaatcat

SEQ ID NO: 211871 - DNA, 22 bp, Artificial Sequence
  Synthetic oligonucleotide; TTT chr2 60543847 60543868 60543852 60543847 -
atagcgctaataatcaatcatt

SEQ ID NO: 211872 - DNA, 22 bp, Artificial Sequence
  Synthetic oligonucleotide; TTA chr2 60543846 60543867 60543851 60543846 -
tagcgctaataatcaatcattt

SEQ ID NO: 211873 - DNA, 22 bp, Artificial Sequence
  Synthetic oligonucleotide; CTA chr2 60543838 60543859 60543843 60543838 -
ataatcaatcatttaactgaga

SEQ ID NO: 211874 - DNA, 22 bp, Artificial Sequence
  Synthetic oligonucleotide; TTT chr2 60543824 60543845 60543829 60543824 -
aactgagacgaaaagctctcta

SEQ ID NO: 211875 - DNA, 22 bp, Artificial Sequence
  Synthetic oligonucleotide; TTA chr2 60543823 60543844 60543828 60543823 -
actgagacgaaaagctctctaa

SEQ ID NO: 211876 - DNA, 22 bp, Artificial Sequence
  Synthetic oligonucleotide; CTG chr2 60543819 60543840 60543824 60543819 -
agacgaaaagctctctaagatg

SEQ ID NO: 211877 - DNA, 22 bp, Artificial Sequence
  Synthetic oligonucleotide; CTC chr2 60543806 60543827 60543811 60543806 -
tctaagatgtctaagatattca

SEQ ID NO: 211878 - DNA, 22 bp, Artificial Sequence
  Synthetic oligonucleotide; CTC chr2 60543804 60543825 60543809 60543804 -
taagatgtctaagatattcaat

SEQ ID NO: 211879 - DNA, 22 bp, Artificial Sequence
  Synthetic oligonucleotide; CTA chr2 60543802 60543823 60543807 60543802 -
agatgtctaagatattcaatgg

SEQ ID NO: 211880 - DNA, 22 bp, Artificial Sequence
  Synthetic oligonucleotide; CTA chr2 60543793 60543814 60543798 60543793 -
agatattcaatgggcgcacaac

SEQ ID NO: 211881 - DNA, 22 bp, Artificial Sequence
  Synthetic oligonucleotide; TTC chr2 60543785 60543806 60543790 60543785 -
aatgggcgcacaacaagtgctg

SEQ ID NO: 211882 - DNA, 22 bp, Artificial Sequence
  Synthetic oligonucleotide; CTG chr2 60543763 60543784 60543768 60543763 -
tgacccaggtgaggtaaacctt

SEQ ID NO: 211883 - DNA, 22 bp, Artificial Sequence
  Synthetic oligonucleotide; CTT chr2 60543741 60543762 60543746 60543741 -
tcgtgcatgaataattacaaag

SEQ ID NO: 211884 - DNA, 22 bp, Artificial Sequence
  Synthetic oligonucleotide; TTT chr2 60543740 60543761 60543745 60543740 -
cgtgcatgaataattacaaagt

SEQ ID NO: 211885 - DNA, 22 bp, Artificial Sequence
  Synthetic oligonucleotide; TTC chr2 60543739 60543760 60543744 60543739 -
gtgcatgaataattacaaagtc

SEQ ID NO: 211886 - DNA, 22 bp, Artificial Sequence
  Synthetic oligonucleotide; TTA chr2 60543724 60543745 60543729 60543724 -
caaagtcttgatttctttcatt

SEQ ID NO: 211887 - DNA, 22 bp, Artificial Sequence
  Synthetic oligonucleotide; CTT chr2 60543715 60543736 60543720 60543715 -
gatttctttcattgtgtttaat

SEQ ID NO: 211888 - DNA, 22 bp, Artificial Sequence
  Synthetic oligonucleotide; TTG chr2 60543714 60543735 60543719 60543714 -
atttctttcattgtgtttaatc

SEQ ID NO: 211889 - DNA, 22 bp, Artificial Sequence
  Synthetic oligonucleotide; TTT chr2 60543710 60543731 60543715 60543710 -
ctttcattgtgtttaatcacct

SEQ ID NO: 211890 - DNA, 22 bp, Artificial Sequence
  Synthetic oligonucleotide; TTC chr2 60543709 60543730 60543714 60543709 -
tttcattgtgtttaatcacctg

SEQ ID NO: 211891 - DNA, 22 bp, Artificial Sequence
  Synthetic oligonucleotide; CTT chr2 60543707 60543728 60543712 60543707 -
tcattgtgtttaatcacctgtt

SEQ ID NO: 211892 - DNA, 22 bp, Artificial Sequence
  Synthetic oligonucleotide; TTT chr2 60543706 60543727 60543711 60543706 -
cattgtgtttaatcacctgttc

SEQ ID NO: 211893 - DNA, 22 bp, Artificial Sequence
  Synthetic oligonucleotide; TTC chr2 60543705 60543726 60543710 60543705 -
attgtgtttaatcacctgttcc

SEQ ID NO: 211894 - DNA, 22 bp, Artificial Sequence
  Synthetic oligonucleotide; TTG chr2 60543701 60543722 60543706 60543701 -
tgtttaatcacctgttcccacc

SEQ ID NO: 211895 - DNA, 22 bp, Artificial Sequence
  Synthetic oligonucleotide; TTT chr2 60543696 60543717 60543701 60543696 -
aatcacctgttcccaccctgga

SEQ ID NO: 211896 - DNA, 22 bp, Artificial Sequence
  Synthetic oligonucleotide; TTA chr2 60543695 60543716 60543700 60543695 -
atcacctgttcccaccctggaa

SEQ ID NO: 211897 - DNA, 22 bp, Artificial Sequence
  Synthetic oligonucleotide; CTG chr2 60543687 60543708 60543692 60543687 -
ttcccaccctggaactggctga

SEQ ID NO: 211898 - DNA, 22 bp, Artificial Sequence
  Synthetic oligonucleotide; TTC chr2 60543684 60543705 60543689 60543684 -
ccaccctggaactggctgaaca

SEQ ID NO: 211899 - DNA, 22 bp, Artificial Sequence
  Synthetic oligonucleotide; CTG chr2 60543676 60543697 60543681 60543676 -
gaactggctgaacataaatagt

SEQ ID NO: 211900 - DNA, 22 bp, Artificial Sequence
  Synthetic oligonucleotide; CTG chr2 60543670 60543691 60543675 60543670 -
gctgaacataaatagtgtggtc

SEQ ID NO: 211901 - DNA, 22 bp, Artificial Sequence
  Synthetic oligonucleotide; CTG chr2 60543666 60543687 60543671 60543666 -
aacataaatagtgtggtcacat

SEQ ID NO: 211902 - DNA, 22 bp, Artificial Sequence
  Synthetic oligonucleotide; CTC chr2 60543641 60543662 60543646 60543641 -
aaagtgagatgtcagtaactag

SEQ ID NO: 211903 - DNA, 22 bp, Artificial Sequence
  Synthetic oligonucleotide; CTA chr2 60543620 60543641 60543625 60543620 -
gaatcacgacttctcataattc

SEQ ID NO: 211904 - DNA, 22 bp, Artificial Sequence
  Synthetic oligonucleotide; CTT chr2 60543608 60543629 60543613 60543608 -
ctcataattcacagtaatgaat

SEQ ID NO: 211905 - DNA, 22 bp, Artificial Sequence
  Synthetic oligonucleotide; TTC chr2 60543607 60543628 60543612 60543607 -
tcataattcacagtaatgaatt

SEQ ID NO: 211906 - DNA, 22 bp, Artificial Sequence
  Synthetic oligonucleotide; CTC chr2 60543605 60543626 60543610 60543605 -
ataattcacagtaatgaattaa

SEQ ID NO: 211907 - DNA, 22 bp, Artificial Sequence
  Synthetic oligonucleotide; TTC chr2 60543598 60543619 60543603 60543598 -
acagtaatgaattaagagtttc

SEQ ID NO: 211908 - DNA, 22 bp, Artificial Sequence
  Synthetic oligonucleotide; TTA chr2 60543584 60543605 60543589 60543584 -
agagtttcctatggtgaagtta

SEQ ID NO: 211909 - DNA, 22 bp, Artificial Sequence
  Synthetic oligonucleotide; TTT chr2 60543577 60543598 60543582 60543577 -
cctatggtgaagttaacattct

SEQ ID NO: 211910 - DNA, 22 bp, Artificial Sequence
  Synthetic oligonucleotide; TTC chr2 60543576 60543597 60543581 60543576 -
ctatggtgaagttaacattcta

SEQ ID NO: 211911 - DNA, 22 bp, Artificial Sequence
  Synthetic oligonucleotide; CTA chr2 60543573 60543594 60543578 60543573 -
tggtgaagttaacattctacca

SEQ ID NO: 211912 - DNA, 22 bp, Artificial Sequence
  Synthetic oligonucleotide; TTA chr2 60543562 60543583 60543567 60543562 -
acattctaccattgcacataaa

SEQ ID NO: 211913 - DNA, 22 bp, Artificial Sequence
  Synthetic oligonucleotide; TTC chr2 60543556 60543577 60543561 60543556 -
taccattgcacataaattccga

SEQ ID NO: 211914 - DNA, 22 bp, Artificial Sequence
  Synthetic oligonucleotide; CTA chr2 60543554 60543575 60543559 60543554 -
ccattgcacataaattccgacg

SEQ ID NO: 211915 - DNA, 22 bp, Artificial Sequence
  Synthetic oligonucleotide; TTG chr2 60543548 60543569 60543553 60543548 -
cacataaattccgacgctctgg

SEQ ID NO: 211916 - DNA, 22 bp, Artificial Sequence
  Synthetic oligonucleotide; TTC chr2 60543537 60543558 60543542 60543537 -
cgacgctctggccctcaggtgc

SEQ ID NO: 211917 - DNA, 22 bp, Artificial Sequence
  Synthetic oligonucleotide; CTC chr2 60543529 60543550 60543534 60543529 -
tggccctcaggtgcccctgaag

SEQ ID NO: 211918 - DNA, 22 bp, Artificial Sequence
  Synthetic oligonucleotide; CTG chr2 60543527 60543548 60543532 60543527 -
gccctcaggtgcccctgaagcg

SEQ ID NO: 211919 - DNA, 22 bp, Artificial Sequence
  Synthetic oligonucleotide; CTC chr2 60543521 60543542 60543526 60543521 -
aggtgcccctgaagcgaagttc

SEQ ID NO: 211920 - DNA, 22 bp, Artificial Sequence
  Synthetic oligonucleotide; CTG chr2 60543510 60543531 60543515 60543510 -
aagcgaagttctggaagacggc

SEQ ID NO: 211921 - DNA, 22 bp, Artificial Sequence
  Synthetic oligonucleotide; TTC chr2 60543499 60543520 60543504 60543499 -
tggaagacggctgtgtgtgtac

SEQ ID NO: 211922 - DNA, 22 bp, Artificial Sequence
  Synthetic oligonucleotide; CTG chr2 60543497 60543518 60543502 60543497 -
gaagacggctgtgtgtgtaccc

SEQ ID NO: 211923 - DNA, 22 bp, Artificial Sequence
  Synthetic oligonucleotide; CTG chr2 60543486 60543507 60543491 60543486 -
tgtgtgtacccccagcccattt

SEQ ID NO: 211924 - DNA, 22 bp, Artificial Sequence
  Synthetic oligonucleotide; TTT chr2 60543464 60543485 60543469 60543464 -
ctctaaagcacgtctgcacaat

SEQ ID NO: 211925 - DNA, 22 bp, Artificial Sequence
  Synthetic oligonucleotide; TTC chr2 60543463 60543484 60543468 60543463 -
tctaaagcacgtctgcacaatt

SEQ ID NO: 211926 - DNA, 22 bp, Artificial Sequence
  Synthetic oligonucleotide; CTC chr2 60543461 60543482 60543466 60543461 -
taaagcacgtctgcacaattcc

SEQ ID NO: 211927 - DNA, 22 bp, Artificial Sequence
  Synthetic oligonucleotide; CTA chr2 60543459 60543480 60543464 60543459 -
aagcacgtctgcacaattccaa

SEQ ID NO: 211928 - DNA, 22 bp, Artificial Sequence
  Synthetic oligonucleotide; CTG chr2 60543448 60543469 60543453 60543448 -
cacaattccaagtctgcttttc

SEQ ID NO: 211929 - DNA, 22 bp, Artificial Sequence
  Synthetic oligonucleotide; TTC chr2 60543440 60543461 60543445 60543440 -
caagtctgcttttctttttatg

SEQ ID NO: 211930 - DNA, 22 bp, Artificial Sequence
  Synthetic oligonucleotide; CTG chr2 60543432 60543453 60543437 60543432 -
cttttctttttatgatgaggaa

SEQ ID NO: 211931 - DNA, 22 bp, Artificial Sequence
  Synthetic oligonucleotide; CTT chr2 60543429 60543450 60543434 60543429 -
ttctttttatgatgaggaagga

SEQ ID NO: 211932 - DNA, 22 bp, Artificial Sequence
  Synthetic oligonucleotide; TTT chr2 60543428 60543449 60543433 60543428 -
tctttttatgatgaggaaggaa

SEQ ID NO: 211933 - DNA, 22 bp, Artificial Sequence
  Synthetic oligonucleotide; TTT chr2 60543427 60543448 60543432 60543427 -
ctttttatgatgaggaaggaaa

SEQ ID NO: 211934 - DNA, 22 bp, Artificial Sequence
  Synthetic oligonucleotide; TTC chr2 60543426 60543447 60543431 60543426 -
tttttatgatgaggaaggaaac

SEQ ID NO: 211935 - DNA, 22 bp, Artificial Sequence
  Synthetic oligonucleotide; CTT chr2 60543424 60543445 60543429 60543424 -
tttatgatgaggaaggaaacaa

SEQ ID NO: 211936 - DNA, 22 bp, Artificial Sequence
  Synthetic oligonucleotide; TTT chr2 60543423 60543444 60543428 60543423 -
ttatgatgaggaaggaaacaat

SEQ ID NO: 211937 - DNA, 22 bp, Artificial Sequence
  Synthetic oligonucleotide; TTT chr2 60543422 60543443 60543427 60543422 -
tatgatgaggaaggaaacaata

SEQ ID NO: 211938 - DNA, 22 bp, Artificial Sequence
  Synthetic oligonucleotide; TTT chr2 60543421 60543442 60543426 60543421 -
atgatgaggaaggaaacaataa

SEQ ID NO: 211939 - DNA, 22 bp, Artificial Sequence
  Synthetic oligonucleotide; TTA chr2 60543420 60543441 60543425 60543420 -
tgatgaggaaggaaacaataac

SEQ ID NO: 211940 - DNA, 22 bp, Artificial Sequence
  Synthetic oligonucleotide; TTC chr2 60543387 60543408 60543392 60543387 -
agtagatatttgaattgtgtca

SEQ ID NO: 211941 - DNA, 22 bp, Artificial Sequence
  Synthetic oligonucleotide; TTT chr2 60543376 60543397 60543381 60543376 -
gaattgtgtcacaaaaagaaag

SEQ ID NO: 211942 - DNA, 22 bp, Artificial Sequence
  Synthetic oligonucleotide; TTG chr2 60543375 60543396 60543380 60543375 -
aattgtgtcacaaaaagaaagg

SEQ ID NO: 211943 - DNA, 22 bp, Artificial Sequence
  Synthetic oligonucleotide; TTG chr2 60543370 60543391 60543375 60543370 -
tgtcacaaaaagaaaggagaag

SEQ ID NO: 211944 - DNA, 22 bp, Artificial Sequence
  Synthetic oligonucleotide; CTT chr2 60543339 60543360 60543344 60543339 -
gtattaaggaaagagatatatt

SEQ ID NO: 211945 - DNA, 22 bp, Artificial Sequence
  Synthetic oligonucleotide; TTG chr2 60543338 60543359 60543343 60543338 -
tattaaggaaagagatatattg

SEQ ID NO: 211946 - DNA, 22 bp, Artificial Sequence
  Synthetic oligonucleotide; TTA chr2 60543333 60543354 60543338 60543333 -
aggaaagagatatattgatgaa

SEQ ID NO: 211947 - DNA, 22 bp, Artificial Sequence
  Synthetic oligonucleotide; TTG chr2 60543316 60543337 60543321 60543316 -
atgaatctctagaagaatgtgt

SEQ ID NO: 211948 - DNA, 22 bp, Artificial Sequence
  Synthetic oligonucleotide; CTC chr2 60543307 60543328 60543312 60543307 -
tagaagaatgtgtttggcaacc

SEQ ID NO: 211949 - DNA, 22 bp, Artificial Sequence
  Synthetic oligonucleotide; CTA chr2 60543305 60543326 60543310 60543305 -
gaagaatgtgtttggcaaccac

SEQ ID NO: 211950 - DNA, 22 bp, Artificial Sequence
  Synthetic oligonucleotide; TTT chr2 60543292 60543313 60543297 60543292 -
ggcaaccacataaaaggtagtc

SEQ ID NO: 211951 - DNA, 22 bp, Artificial Sequence
  Synthetic oligonucleotide; TTG chr2 60543291 60543312 60543296 60543291 -
gcaaccacataaaaggtagtca

SEQ ID NO: 211952 - DNA, 22 bp, Artificial Sequence
  Synthetic oligonucleotide; TTT chr2 60543266 60543287 60543271 60543266 -
aagcgtgctgggtaggaaaggc

SEQ ID NO: 211953 - DNA, 22 bp, Artificial Sequence
  Synthetic oligonucleotide; TTA chr2 60543265 60543286 60543270 60543265 -
agcgtgctgggtaggaaaggct

SEQ ID NO: 211954 - DNA, 22 bp, Artificial Sequence
  Synthetic oligonucleotide; CTG chr2 60543256 60543277 60543261 60543256 -
ggtaggaaaggctttattaaag

SEQ ID NO: 211955 - DNA, 22 bp, Artificial Sequence
  Synthetic oligonucleotide; CTT chr2 60543242 60543263 60543247 60543242 -
tattaaagtgatgtaagttgga

SEQ ID NO: 211956 - DNA, 22 bp, Artificial Sequence
  Synthetic oligonucleotide; TTT chr2 60543241 60543262 60543246 60543241 -
attaaagtgatgtaagttggat

SEQ ID NO: 211957 - DNA, 22 bp, Artificial Sequence
  Synthetic oligonucleotide; TTA chr2 60543240 60543261 60543245 60543240 -
ttaaagtgatgtaagttggatt

SEQ ID NO: 211958 - DNA, 22 bp, Artificial Sequence
  Synthetic oligonucleotide; TTA chr2 60543237 60543258 60543242 60543237 -
aagtgatgtaagttggatttga

SEQ ID NO: 211959 - DNA, 22 bp, Artificial Sequence
  Synthetic oligonucleotide; TTG chr2 60543222 60543243 60543227 60543222 -
gatttgagttcactgtgagcct

SEQ ID NO: 211960 - DNA, 22 bp, Artificial Sequence
  Synthetic oligonucleotide; TTT chr2 60543217 60543238 60543222 60543217 -
gagttcactgtgagcctgtact

SEQ ID NO: 211961 - DNA, 22 bp, Artificial Sequence
  Synthetic oligonucleotide; TTG chr2 60543216 60543237 60543221 60543216 -
agttcactgtgagcctgtacta

SEQ ID NO: 211962 - DNA, 22 bp, Artificial Sequence
  Synthetic oligonucleotide; TTC chr2 60543211 60543232 60543216 60543211 -
actgtgagcctgtactatttta

SEQ ID NO: 211963 - DNA, 22 bp, Artificial Sequence
  Synthetic oligonucleotide; CTG chr2 60543207 60543228 60543212 60543207 -
tgagcctgtactattttatagg

SEQ ID NO: 211964 - DNA, 22 bp, Artificial Sequence
  Synthetic oligonucleotide; CTG chr2 60543199 60543220 60543204 60543199 -
tactattttataggcaggaagc

SEQ ID NO: 211965 - DNA, 22 bp, Artificial Sequence
  Synthetic oligonucleotide; CTA chr2 60543194 60543215 60543199 60543194 -
ttttataggcaggaagcaagaa

SEQ ID NO: 211966 - DNA, 22 bp, Artificial Sequence
  Synthetic oligonucleotide; TTT chr2 60543191 60543212 60543196 60543191 -
tataggcaggaagcaagaataa

SEQ ID NO: 211967 - DNA, 22 bp, Artificial Sequence
  Synthetic oligonucleotide; TTT chr2 60543190 60543211 60543195 60543190 -
ataggcaggaagcaagaataaa

SEQ ID NO: 211968 - DNA, 22 bp, Artificial Sequence
  Synthetic oligonucleotide; TTA chr2 60543189 60543210 60543194 60543189 -
taggcaggaagcaagaataaaa

SEQ ID NO: 211969 - DNA, 22 bp, Artificial Sequence
  Synthetic oligonucleotide; CTT chr2 60543153 60543174 60543158 60543153 -
cttcctaagataaataaagctt

SEQ ID NO: 211970 - DNA, 22 bp, Artificial Sequence
  Synthetic oligonucleotide; TTC chr2 60543152 60543173 60543157 60543152 -
ttcctaagataaataaagctta

SEQ ID NO: 211971 - DNA, 22 bp, Artificial Sequence
  Synthetic oligonucleotide; CTT chr2 60543150 60543171 60543155 60543150 -
cctaagataaataaagcttaga

SEQ ID NO: 211972 - DNA, 22 bp, Artificial Sequence
  Synthetic oligonucleotide; TTC chr2 60543149 60543170 60543154 60543149 -
ctaagataaataaagcttagaa

SEQ ID NO: 211973 - DNA, 22 bp, Artificial Sequence
  Synthetic oligonucleotide; CTA chr2 60543146 60543167 60543151 60543146 -
agataaataaagcttagaattc

SEQ ID NO: 211974 - DNA, 22 bp, Artificial Sequence
  Synthetic oligonucleotide; CTT chr2 60543131 60543152 60543136 60543131 -
agaattcgggactttcagatag

SEQ ID NO: 211975 - DNA, 22 bp, Artificial Sequence
  Synthetic oligonucleotide; TTA chr2 60543130 60543151 60543135 60543130 -
gaattcgggactttcagatagg

SEQ ID NO: 211976 - DNA, 22 bp, Artificial Sequence
  Synthetic oligonucleotide; TTC chr2 60543124 60543145 60543129 60543124 -
gggactttcagataggagaata

SEQ ID NO: 211977 - DNA, 22 bp, Artificial Sequence
  Synthetic oligonucleotide; CTT chr2 60543117 60543138 60543122 60543117 -
tcagataggagaataaggcaga

SEQ ID NO: 211978 - DNA, 22 bp, Artificial Sequence
  Synthetic oligonucleotide; TTT chr2 60543116 60543137 60543121 60543116 -
cagataggagaataaggcagag

SEQ ID NO: 211979 - DNA, 22 bp, Artificial Sequence
  Synthetic oligonucleotide; TTC chr2 60543115 60543136 60543120 60543115 -
agataggagaataaggcagagt

SEQ ID NO: 211980 - DNA, 22 bp, Artificial Sequence
  Synthetic oligonucleotide; TTC chr2 60543091 60543112 60543096 60543091 -
tttaaatcttgagtaaaatggt

SEQ ID NO: 211981 - DNA, 22 bp, Artificial Sequence
  Synthetic oligonucleotide; CTT chr2 60543089 60543110 60543094 60543089 -
taaatcttgagtaaaatggtat

SEQ ID NO: 211982 - DNA, 22 bp, Artificial Sequence
  Synthetic oligonucleotide; TTT chr2 60543088 60543109 60543093 60543088 -
aaatcttgagtaaaatggtatg

SEQ ID NO: 211983 - DNA, 22 bp, Artificial Sequence
  Synthetic oligonucleotide; TTA chr2 60543087 60543108 60543092 60543087 -
aatcttgagtaaaatggtatgc

SEQ ID NO: 211984 - DNA, 22 bp, Artificial Sequence
  Synthetic oligonucleotide; CTT chr2 60543081 60543102 60543086 60543081 -
gagtaaaatggtatgcattttc

SEQ ID NO: 211985 - DNA, 22 bp, Artificial Sequence
  Synthetic oligonucleotide; TTG chr2 60543080 60543101 60543085 60543080 -
agtaaaatggtatgcattttca

SEQ ID NO: 211986 - DNA, 22 bp, Artificial Sequence
  Synthetic oligonucleotide; TTT chr2 60543061 60543082 60543066 60543061 -
tcactgtactcaggcctctcca

SEQ ID NO: 211987 - DNA, 22 bp, Artificial Sequence
  Synthetic oligonucleotide; TTT chr2 60543060 60543081 60543065 60543060 -
cactgtactcaggcctctccaa

SEQ ID NO: 211988 - DNA, 22 bp, Artificial Sequence
  Synthetic oligonucleotide; TTC chr2 60543059 60543080 60543064 60543059 -
actgtactcaggcctctccaag

SEQ ID NO: 211989 - DNA, 22 bp, Artificial Sequence
  Synthetic oligonucleotide; CTG chr2 60543055 60543076 60543060 60543055 -
tactcaggcctctccaagctga

SEQ ID NO: 211990 - DNA, 22 bp, Artificial Sequence
  Synthetic oligonucleotide; CTC chr2 60543050 60543071 60543055 60543050 -
aggcctctccaagctgagtttt

SEQ ID NO: 211991 - DNA, 22 bp, Artificial Sequence
  Synthetic oligonucleotide; CTC chr2 60543043 60543064 60543048 60543043 -
tccaagctgagttttttttttt

SEQ ID NO: 211992 - DNA, 22 bp, Artificial Sequence
  Synthetic oligonucleotide; CTC chr2 60543041 60543062 60543046 60543041 -
caagctgagttttttttttttt

SEQ ID NO: 211993 - DNA, 22 bp, Artificial Sequence
  Synthetic oligonucleotide; CTG chr2 60543034 60543055 60543039 60543034 -
agtttttttttttttttttttt

SEQ ID NO: 211994 - DNA, 22 bp, Artificial Sequence
  Synthetic oligonucleotide; TTT chr2 60543029 60543050 60543034 60543029 -
ttttttttttttttttttttta

SEQ ID NO: 211995 - DNA, 22 bp, Artificial Sequence
  Synthetic oligonucleotide; TTT chr2 60543028 60543049 60543033 60543028 -
ttttttttttttttttttttag

SEQ ID NO: 211996 - DNA, 22 bp, Artificial Sequence
  Synthetic oligonucleotide; TTT chr2 60543027 60543048 60543032 60543027 -
tttttttttttttttttttaga

SEQ ID NO: 211997 - DNA, 22 bp, Artificial Sequence
  Synthetic oligonucleotide; TTT chr2 60543026 60543047 60543031 60543026 -
ttttttttttttttttttagac

SEQ ID NO: 211998 - DNA, 22 bp, Artificial Sequence
  Synthetic oligonucleotide; TTT chr2 60543025 60543046 60543030 60543025 -
tttttttttttttttttagaca

SEQ ID NO: 211999 - DNA, 22 bp, Artificial Sequence
  Synthetic oligonucleotide; TTT chr2 60543024 60543045 60543029 60543024 -
ttttttttttttttttagacag

SEQ ID NO: 212000 - DNA, 22 bp, Artificial Sequence
  Synthetic oligonucleotide; TTT chr2 60543023 60543044 60543028 60543023 -
tttttttttttttttagacaga

SEQ ID NO: 212001 - DNA, 22 bp, Artificial Sequence
  Synthetic oligonucleotide; TTT chr2 60543022 60543043 60543027 60543022 -
ttttttttttttttagacagag

SEQ ID NO: 212002 - DNA, 22 bp, Artificial Sequence
  Synthetic oligonucleotide; TTT chr2 60543021 60543042 60543026 60543021 -
tttttttttttttagacagagt

SEQ ID NO: 212003 - DNA, 22 bp, Artificial Sequence
  Synthetic oligonucleotide; TTT chr2 60543020 60543041 60543025 60543020 -
ttttttttttttagacagagtt

SEQ ID NO: 212004 - DNA, 22 bp, Artificial Sequence
  Synthetic oligonucleotide; TTT chr2 60543019 60543040 60543024 60543019 -
tttttttttttagacagagttt

SEQ ID NO: 212005 - DNA, 22 bp, Artificial Sequence
  Synthetic oligonucleotide; TTT chr2 60543018 60543039 60543023 60543018 -
ttttttttttagacagagtttt

SEQ ID NO: 212006 - DNA, 22 bp, Artificial Sequence
  Synthetic oligonucleotide; TTT chr2 60543017 60543038 60543022 60543017 -
tttttttttagacagagttttg

SEQ ID NO: 212007 - DNA, 22 bp, Artificial Sequence
  Synthetic oligonucleotide; TTT chr2 60543016 60543037 60543021 60543016 -
ttttttttagacagagttttgc

SEQ ID NO: 212008 - DNA, 22 bp, Artificial Sequence
  Synthetic oligonucleotide; TTT chr2 60543015 60543036 60543020 60543015 -
tttttttagacagagttttgct

SEQ ID NO: 212009 - DNA, 22 bp, Artificial Sequence
  Synthetic oligonucleotide; TTT chr2 60543014 60543035 60543019 60543014 -
ttttttagacagagttttgctc

SEQ ID NO: 212010 - DNA, 22 bp, Artificial Sequence
  Synthetic oligonucleotide; TTT chr2 60543013 60543034 60543018 60543013 -
tttttagacagagttttgctct

SEQ ID NO: 212011 - DNA, 22 bp, Artificial Sequence
  Synthetic oligonucleotide; TTT chr2 60543012 60543033 60543017 60543012 -
ttttagacagagttttgctctt

SEQ ID NO: 212012 - DNA, 22 bp, Artificial Sequence
  Synthetic oligonucleotide; TTT chr2 60543011 60543032 60543016 60543011 -
tttagacagagttttgctcttg

SEQ ID NO: 212013 - DNA, 22 bp, Artificial Sequence
  Synthetic oligonucleotide; TTT chr2 60543010 60543031 60543015 60543010 -
ttagacagagttttgctcttgt

SEQ ID NO: 212014 - DNA, 22 bp, Artificial Sequence
  Synthetic oligonucleotide; TTT chr2 60543009 60543030 60543014 60543009 -
tagacagagttttgctcttgtt

SEQ ID NO: 212015 - DNA, 22 bp, Artificial Sequence
  Synthetic oligonucleotide; TTT chr2 60543008 60543029 60543013 60543008 -
agacagagttttgctcttgttg

SEQ ID NO: 212016 - DNA, 22 bp, Artificial Sequence
  Synthetic oligonucleotide; TTA chr2 60543007 60543028 60543012 60543007 -
gacagagttttgctcttgttgc

SEQ ID NO: 212017 - DNA, 22 bp, Artificial Sequence
  Synthetic oligonucleotide; TTT chr2 60542997 60543018 60543002 60542997 -
tgctcttgttgcccaggctgga

SEQ ID NO: 212018 - DNA, 22 bp, Artificial Sequence
  Synthetic oligonucleotide; TTT chr2 60542996 60543017 60543001 60542996 -
gctcttgttgcccaggctggag

SEQ ID NO: 212019 - DNA, 22 bp, Artificial Sequence
  Synthetic oligonucleotide; TTG chr2 60542995 60543016 60543000 60542995 -
ctcttgttgcccaggctggagt

SEQ ID NO: 212020 - DNA, 22 bp, Artificial Sequence
  Synthetic oligonucleotide; CTC chr2 60542992 60543013 60542997 60542992 -
ttgttgcccaggctggagtgca

SEQ ID NO: 212021 - DNA, 22 bp, Artificial Sequence
  Synthetic oligonucleotide; CTT chr2 60542990 60543011 60542995 60542990 -
gttgcccaggctggagtgcagt

SEQ ID NO: 212022 - DNA, 22 bp, Artificial Sequence
  Synthetic oligonucleotide; TTG chr2 60542989 60543010 60542994 60542989 -
ttgcccaggctggagtgcagtg

SEQ ID NO: 212023 - DNA, 22 bp, Artificial Sequence
  Synthetic oligonucleotide; TTG chr2 60542986 60543007 60542991 60542986 -
cccaggctggagtgcagtggca

SEQ ID NO: 212024 - DNA, 22 bp, Artificial Sequence
  Synthetic oligonucleotide; CTG chr2 60542977 60542998 60542982 60542977 -
gagtgcagtggcatgattttgg

SEQ ID NO: 212025 - DNA, 22 bp, Artificial Sequence
  Synthetic oligonucleotide; TTT chr2 60542958 60542979 60542963 60542958 -
tggctcactgcaacctctgcct

SEQ ID NO: 212026 - DNA, 22 bp, Artificial Sequence
  Synthetic oligonucleotide; TTT chr2 60542957 60542978 60542962 60542957 -
ggctcactgcaacctctgcctc

SEQ ID NO: 212027 - DNA, 22 bp, Artificial Sequence
  Synthetic oligonucleotide; TTG chr2 60542956 60542977 60542961 60542956 -
gctcactgcaacctctgcctcc

SEQ ID NO: 212028 - DNA, 22 bp, Artificial Sequence
  Synthetic oligonucleotide; CTC chr2 60542952 60542973 60542957 60542952 -
actgcaacctctgcctcctagg

SEQ ID NO: 212029 - DNA, 22 bp, Artificial Sequence
  Synthetic oligonucleotide; CTG chr2 60542948 60542969 60542953 60542948 -
caacctctgcctcctaggttca

SEQ ID NO: 212030 - DNA, 22 bp, Artificial Sequence
  Synthetic oligonucleotide; CTC chr2 60542941 60542962 60542946 60542941 -
tgcctcctaggttcaagcgatt

SEQ ID NO: 212031 - DNA, 22 bp, Artificial Sequence
  Synthetic oligonucleotide; CTG chr2 60542939 60542960 60542944 60542939 -
cctcctaggttcaagcgattct

SEQ ID NO: 212032 - DNA, 22 bp, Artificial Sequence
  Synthetic oligonucleotide; CTC chr2 60542935 60542956 60542940 60542935 -
ctaggttcaagcgattctcctg

SEQ ID NO: 212033 - DNA, 22 bp, Artificial Sequence
  Synthetic oligonucleotide; CTA chr2 60542932 60542953 60542937 60542932 -
ggttcaagcgattctcctgcct

SEQ ID NO: 212034 - DNA, 22 bp, Artificial Sequence
  Synthetic oligonucleotide; TTC chr2 60542927 60542948 60542932 60542927 -
aagcgattctcctgcctcagcc

SEQ ID NO: 212035 - DNA, 22 bp, Artificial Sequence
  Synthetic oligonucleotide; TTC chr2 60542918 60542939 60542923 60542918 -
tcctgcctcagcctcccaagta

SEQ ID NO: 212036 - DNA, 22 bp, Artificial Sequence
  Synthetic oligonucleotide; CTC chr2 60542916 60542937 60542921 60542916 -
ctgcctcagcctcccaagtagc

SEQ ID NO: 212037 - DNA, 22 bp, Artificial Sequence
  Synthetic oligonucleotide; CTG chr2 60542913 60542934 60542918 60542913 -
cctcagcctcccaagtagctgg

SEQ ID NO: 212038 - DNA, 22 bp, Artificial Sequence
  Synthetic oligonucleotide; CTC chr2 60542909 60542930 60542914 60542909 -
agcctcccaagtagctgggatt

SEQ ID NO: 212039 - DNA, 22 bp, Artificial Sequence
  Synthetic oligonucleotide; CTC chr2 60542903 60542924 60542908 60542903 -
ccaagtagctgggattacaggc

SEQ ID NO: 212040 - DNA, 22 bp, Artificial Sequence
  Synthetic oligonucleotide; CTG chr2 60542892 60542913 60542897 60542892 -
ggattacaggcgtgtgccacta

SEQ ID NO: 212041 - DNA, 22 bp, Artificial Sequence
  Synthetic oligonucleotide; TTA chr2 60542886 60542907 60542891 60542886 -
caggcgtgtgccactacgccca

SEQ ID NO: 212042 - DNA, 22 bp, Artificial Sequence
  Synthetic oligonucleotide; CTA chr2 60542870 60542891 60542875 60542870 -
cgcccagctagttttttgtatt

SEQ ID NO: 212043 - DNA, 22 bp, Artificial Sequence
  Synthetic oligonucleotide; CTA chr2 60542860 60542881 60542865 60542860 -
gttttttgtattttcagtagag

SEQ ID NO: 212044 - DNA, 22 bp, Artificial Sequence
  Synthetic oligonucleotide; TTT chr2 60542856 60542877 60542861 60542856 -
tttgtattttcagtagaggcag

SEQ ID NO: 212045 - DNA, 22 bp, Artificial Sequence
  Synthetic oligonucleotide; TTT chr2 60542855 60542876 60542860 60542855 -
ttgtattttcagtagaggcagg

SEQ ID NO: 212046 - DNA, 22 bp, Artificial Sequence
  Synthetic oligonucleotide; TTT chr2 60542854 60542875 60542859 60542854 -
tgtattttcagtagaggcaggg

SEQ ID NO: 212047 - DNA, 22 bp, Artificial Sequence
  Synthetic oligonucleotide; TTT chr2 60542853 60542874 60542858 60542853 -
gtattttcagtagaggcagggt

SEQ ID NO: 212048 - DNA, 22 bp, Artificial Sequence
  Synthetic oligonucleotide; TTG chr2 60542852 60542873 60542857 60542852 -
tattttcagtagaggcagggtt

SEQ ID NO: 212049 - DNA, 22 bp, Artificial Sequence
  Synthetic oligonucleotide; TTT chr2 60542847 60542868 60542852 60542847 -
tcagtagaggcagggtttcacc

SEQ ID NO: 212050 - DNA, 22 bp, Artificial Sequence
  Synthetic oligonucleotide; TTT chr2 60542846 60542867 60542851 60542846 -
cagtagaggcagggtttcacca

SEQ ID NO: 212051 - DNA, 22 bp, Artificial Sequence
  Synthetic oligonucleotide; TTC chr2 60542845 60542866 60542850 60542845 -
agtagaggcagggtttcaccat

SEQ ID NO: 212052 - DNA, 22 bp, Artificial Sequence
  Synthetic oligonucleotide; TTT chr2 60542829 60542850 60542834 60542829 -
caccatgttggccaggctggtc

SEQ ID NO: 212053 - DNA, 22 bp, Artificial Sequence
  Synthetic oligonucleotide; TTC chr2 60542828 60542849 60542833 60542828 -
accatgttggccaggctggtct

SEQ ID NO: 212054 - DNA, 22 bp, Artificial Sequence
  Synthetic oligonucleotide; TTG chr2 60542819 60542840 60542824 60542819 -
gccaggctggtcttgaactcct

SEQ ID NO: 212055 - DNA, 22 bp, Artificial Sequence
  Synthetic oligonucleotide; CTG chr2 60542810 60542831 60542815 60542810 -
gtcttgaactcctgacctcagg

SEQ ID NO: 212056 - DNA, 22 bp, Artificial Sequence
  Synthetic oligonucleotide; CTT chr2 60542805 60542826 60542810 60542805 -
gaactcctgacctcaggtgatc

SEQ ID NO: 212057 - DNA, 22 bp, Artificial Sequence
  Synthetic oligonucleotide; TTG chr2 60542804 60542825 60542809 60542804 -
aactcctgacctcaggtgatcc

SEQ ID NO: 212058 - DNA, 22 bp, Artificial Sequence
  Synthetic oligonucleotide; CTC chr2 60542799 60542820 60542804 60542799 -
ctgacctcaggtgatccacctg

SEQ ID NO: 212059 - DNA, 22 bp, Artificial Sequence
  Synthetic oligonucleotide; CTG chr2 60542796 60542817 60542801 60542796 -
acctcaggtgatccacctggct

SEQ ID NO: 212060 - DNA, 22 bp, Artificial Sequence
  Synthetic oligonucleotide; CTC chr2 60542791 60542812 60542796 60542791 -
aggtgatccacctggcttggcc

SEQ ID NO: 212061 - DNA, 22 bp, Artificial Sequence
  Synthetic oligonucleotide; CTG chr2 60542777 60542798 60542782 60542777 -
gcttggcctcccaaagtgctgg

SEQ ID NO: 212062 - DNA, 22 bp, Artificial Sequence
  Synthetic oligonucleotide; CTT chr2 60542773 60542794 60542778 60542773 -
ggcctcccaaagtgctgggatt

SEQ ID NO: 212063 - DNA, 22 bp, Artificial Sequence
  Synthetic oligonucleotide; TTG chr2 60542772 60542793 60542777 60542772 -
gcctcccaaagtgctgggatta

SEQ ID NO: 212064 - DNA, 22 bp, Artificial Sequence
  Synthetic oligonucleotide; CTC chr2 60542767 60542788 60542772 60542767 -
ccaaagtgctgggattacaggc

SEQ ID NO: 212065 - DNA, 22 bp, Artificial Sequence
  Synthetic oligonucleotide; CTG chr2 60542756 60542777 60542761 60542756 -
ggattacaggcttgagcgaccg

SEQ ID NO: 212066 - DNA, 22 bp, Artificial Sequence
  Synthetic oligonucleotide; TTA chr2 60542750 60542771 60542755 60542750 -
caggcttgagcgaccgcacctg

SEQ ID NO: 212067 - DNA, 22 bp, Artificial Sequence
  Synthetic oligonucleotide; CTT chr2 60542743 60542764 60542748 60542743 -
gagcgaccgcacctggcccaaa

SEQ ID NO: 212068 - DNA, 22 bp, Artificial Sequence
  Synthetic oligonucleotide; TTG chr2 60542742 60542763 60542747 60542742 -
agcgaccgcacctggcccaaac

SEQ ID NO: 212069 - DNA, 22 bp, Artificial Sequence
  Synthetic oligonucleotide; CTG chr2 60542728 60542749 60542733 60542728 -
gcccaaactgagtattttttag

SEQ ID NO: 212070 - DNA, 22 bp, Artificial Sequence
  Synthetic oligonucleotide; CTG chr2 60542718 60542739 60542723 60542718 -
agtattttttagaggattcttt

SEQ ID NO: 212071 - DNA, 22 bp, Artificial Sequence
  Synthetic oligonucleotide; TTT chr2 60542711 60542732 60542716 60542711 -
tttagaggattctttttacctg

SEQ ID NO: 212072 - DNA, 22 bp, Artificial Sequence
  Synthetic oligonucleotide; TTT chr2 60542710 60542731 60542715 60542710 -
ttagaggattctttttacctgg

SEQ ID NO: 212073 - DNA, 22 bp, Artificial Sequence
  Synthetic oligonucleotide; TTT chr2 60542709 60542730 60542714 60542709 -
tagaggattctttttacctggt

SEQ ID NO: 212074 - DNA, 22 bp, Artificial Sequence
  Synthetic oligonucleotide; TTT chr2 60542708 60542729 60542713 60542708 -
agaggattctttttacctggtg

SEQ ID NO: 212075 - DNA, 22 bp, Artificial Sequence
  Synthetic oligonucleotide; TTA chr2 60542707 60542728 60542712 60542707 -
gaggattctttttacctggtga

SEQ ID NO: 212076 - DNA, 22 bp, Artificial Sequence
  Synthetic oligonucleotide; TTC chr2 60542699 60542720 60542704 60542699 -
tttttacctggtgaatagatgg

SEQ ID NO: 212077 - DNA, 22 bp, Artificial Sequence
  Synthetic oligonucleotide; CTT chr2 60542697 60542718 60542702 60542697 -
tttacctggtgaatagatgggt

SEQ ID NO: 212078 - DNA, 22 bp, Artificial Sequence
  Synthetic oligonucleotide; TTT chr2 60542696 60542717 60542701 60542696 -
ttacctggtgaatagatgggta

SEQ ID NO: 212079 - DNA, 22 bp, Artificial Sequence
  Synthetic oligonucleotide; TTT chr2 60542695 60542716 60542700 60542695 -
tacctggtgaatagatgggtat

SEQ ID NO: 212080 - DNA, 22 bp, Artificial Sequence
  Synthetic oligonucleotide; TTT chr2 60542694 60542715 60542699 60542694 -
acctggtgaatagatgggtatg

SEQ ID NO: 212081 - DNA, 22 bp, Artificial Sequence
  Synthetic oligonucleotide; TTA chr2 60542693 60542714 60542698 60542693 -
cctggtgaatagatgggtatgt

SEQ ID NO: 212082 - DNA, 22 bp, Artificial Sequence
  Synthetic oligonucleotide; CTG chr2 60542689 60542710 60542694 60542689 -
gtgaatagatgggtatgtgctc

SEQ ID NO: 212083 - DNA, 22 bp, Artificial Sequence
  Synthetic oligonucleotide; CTC chr2 60542667 60542688 60542672 60542667 -
ccccacttcatccacgtacaca

SEQ ID NO: 212084 - DNA, 22 bp, Artificial Sequence
  Synthetic oligonucleotide; CTT chr2 60542659 60542680 60542664 60542659 -
catccacgtacacatatgagct

SEQ ID NO: 212085 - DNA, 22 bp, Artificial Sequence
  Synthetic oligonucleotide; TTC chr2 60542658 60542679 60542663 60542658 -
atccacgtacacatatgagctg

SEQ ID NO: 212086 - DNA, 22 bp, Artificial Sequence
  Synthetic oligonucleotide; CTG chr2 60542636 60542657 60542641 60542636 -
tacacatagatgttaatcaggt

SEQ ID NO: 212087 - DNA, 22 bp, Artificial Sequence
  Synthetic oligonucleotide; TTA chr2 60542621 60542642 60542626 60542621 -
atcaggttgcttttttcatttt

SEQ ID NO: 212088 - DNA, 22 bp, Artificial Sequence
  Synthetic oligonucleotide; TTG chr2 60542612 60542633 60542617 60542612 -
cttttttcattttatttaaata

SEQ ID NO: 212089 - DNA, 22 bp, Artificial Sequence
  Synthetic oligonucleotide; CTT chr2 60542609 60542630 60542614 60542609 -
ttttcattttatttaaatattc

SEQ ID NO: 212090 - DNA, 22 bp, Artificial Sequence
  Synthetic oligonucleotide; TTT chr2 60542608 60542629 60542613 60542608 -
tttcattttatttaaatattca

SEQ ID NO: 212091 - DNA, 22 bp, Artificial Sequence
  Synthetic oligonucleotide; TTT chr2 60542607 60542628 60542612 60542607 -
ttcattttatttaaatattcaa

SEQ ID NO: 212092 - DNA, 22 bp, Artificial Sequence
  Synthetic oligonucleotide; TTT chr2 60542606 60542627 60542611 60542606 -
tcattttatttaaatattcaaa

SEQ ID NO: 212093 - DNA, 22 bp, Artificial Sequence
  Synthetic oligonucleotide; TTT chr2 60542605 60542626 60542610 60542605 -
cattttatttaaatattcaaaa

SEQ ID NO: 212094 - DNA, 22 bp, Artificial Sequence
  Synthetic oligonucleotide; TTC chr2 60542604 60542625 60542609 60542604 -
attttatttaaatattcaaaat

SEQ ID NO: 212095 - DNA, 22 bp, Artificial Sequence
  Synthetic oligonucleotide; TTT chr2 60542600 60542621 60542605 60542600 -
tatttaaatattcaaaatattg

SEQ ID NO: 212096 - DNA, 22 bp, Artificial Sequence
  Synthetic oligonucleotide; TTT chr2 60542599 60542620 60542604 60542599 -
atttaaatattcaaaatattgt

SEQ ID NO: 212097 - DNA, 22 bp, Artificial Sequence
  Synthetic oligonucleotide; TTA chr2 60542598 60542619 60542603 60542598 -
tttaaatattcaaaatattgtg

SEQ ID NO: 212098 - DNA, 22 bp, Artificial Sequence
  Synthetic oligonucleotide; TTT chr2 60542595 60542616 60542600 60542595 -
aaatattcaaaatattgtgtga

SEQ ID NO: 212099 - DNA, 22 bp, Artificial Sequence
  Synthetic oligonucleotide; TTA chr2 60542594 60542615 60542599 60542594 -
aatattcaaaatattgtgtgat

SEQ ID NO: 212100 - DNA, 22 bp, Artificial Sequence
  Synthetic oligonucleotide; TTC chr2 60542587 60542608 60542592 60542587 -
aaaatattgtgtgattgtgatc

SEQ ID NO: 212101 - DNA, 22 bp, Artificial Sequence
  Synthetic oligonucleotide; TTG chr2 60542578 60542599 60542583 60542578 -
tgtgattgtgatccattgagat

SEQ ID NO: 212102 - DNA, 22 bp, Artificial Sequence
  Synthetic oligonucleotide; TTG chr2 60542570 60542591 60542575 60542570 -
tgatccattgagatcattgaag

SEQ ID NO: 212103 - DNA, 22 bp, Artificial Sequence
  Synthetic oligonucleotide; TTG chr2 60542560 60542581 60542565 60542560 -
agatcattgaagtagtattaat

SEQ ID NO: 212104 - DNA, 22 bp, Artificial Sequence
  Synthetic oligonucleotide; TTG chr2 60542551 60542572 60542556 60542551 -
aagtagtattaatttagctggg

SEQ ID NO: 212105 - DNA, 22 bp, Artificial Sequence
  Synthetic oligonucleotide; TTA chr2 60542540 60542561 60542545 60542540 -
atttagctgggaattagcagct

SEQ ID NO: 212106 - DNA, 22 bp, Artificial Sequence
  Synthetic oligonucleotide; TTT chr2 60542536 60542557 60542541 60542536 -
agctgggaattagcagcttatg

SEQ ID NO: 212107 - DNA, 22 bp, Artificial Sequence
  Synthetic oligonucleotide; TTA chr2 60542535 60542556 60542540 60542535 -
gctgggaattagcagcttatgt

SEQ ID NO: 212108 - DNA, 22 bp, Artificial Sequence
  Synthetic oligonucleotide; CTG chr2 60542531 60542552 60542536 60542531 -
ggaattagcagcttatgttgtg

SEQ ID NO: 212109 - DNA, 22 bp, Artificial Sequence
  Synthetic oligonucleotide; TTA chr2 60542524 60542545 60542529 60542524 -
gcagcttatgttgtgtgggccc

SEQ ID NO: 212110 - DNA, 22 bp, Artificial Sequence
  Synthetic oligonucleotide; CTT chr2 60542517 60542538 60542522 60542517 -
atgttgtgtgggcccagttcat

SEQ ID NO: 212111 - DNA, 22 bp, Artificial Sequence
  Synthetic oligonucleotide; TTA chr2 60542516 60542537 60542521 60542516 -
tgttgtgtgggcccagttcatc

SEQ ID NO: 212112 - DNA, 22 bp, Artificial Sequence
  Synthetic oligonucleotide; TTG chr2 60542511 60542532 60542516 60542511 -
tgtgggcccagttcatcaatat

SEQ ID NO: 212113 - DNA, 22 bp, Artificial Sequence
  Synthetic oligonucleotide; TTC chr2 60542497 60542518 60542502 60542497 -
atcaatatgtgtgtcaaatatc

SEQ ID NO: 212114 - DNA, 22 bp, Artificial Sequence
  Synthetic oligonucleotide; CTC chr2 60542468 60542489 60542473 60542468 -
agatatcagcagcctttgactt

SEQ ID NO: 212115 - DNA, 22 bp, Artificial Sequence
  Synthetic oligonucleotide; CTT chr2 60542452 60542473 60542457 60542452 -
tgacttgcagtcagagctttca

SEQ ID NO: 212116 - DNA, 22 bp, Artificial Sequence
  Synthetic oligonucleotide; TTT chr2 60542451 60542472 60542456 60542451 -
gacttgcagtcagagctttcaa

SEQ ID NO: 212117 - DNA, 22 bp, Artificial Sequence
  Synthetic oligonucleotide; TTG chr2 60542450 60542471 60542455 60542450 -
acttgcagtcagagctttcaat

SEQ ID NO: 212118 - DNA, 22 bp, Artificial Sequence
  Synthetic oligonucleotide; CTT chr2 60542446 60542467 60542451 60542446 -
gcagtcagagctttcaataggg

SEQ ID NO: 212119 - DNA, 22 bp, Artificial Sequence
  Synthetic oligonucleotide; TTG chr2 60542445 60542466 60542450 60542445 -
cagtcagagctttcaatagggg

SEQ ID NO: 212120 - DNA, 22 bp, Artificial Sequence
  Synthetic oligonucleotide; CTT chr2 60542433 60542454 60542438 60542433 -
tcaataggggttttgttttgtt

SEQ ID NO: 212121 - DNA, 22 bp, Artificial Sequence
  Synthetic oligonucleotide; TTT chr2 60542432 60542453 60542437 60542432 -
caataggggttttgttttgttt

SEQ ID NO: 212122 - DNA, 22 bp, Artificial Sequence
  Synthetic oligonucleotide; TTC chr2 60542431 60542452 60542436 60542431 -
aataggggttttgttttgtttt

SEQ ID NO: 212123 - DNA, 22 bp, Artificial Sequence
  Synthetic oligonucleotide; TTT chr2 60542420 60542441 60542425 60542420 -
tgttttgttttgttttcttttt

SEQ ID NO: 212124 - DNA, 22 bp, Artificial Sequence
  Synthetic oligonucleotide; TTT chr2 60542419 60542440 60542424 60542419 -
gttttgttttgttttctttttt

SEQ ID NO: 212125 - DNA, 22 bp, Artificial Sequence
  Synthetic oligonucleotide; TTG chr2 60542418 60542439 60542423 60542418 -
ttttgttttgttttcttttttt

SEQ ID NO: 212126 - DNA, 22 bp, Artificial Sequence
  Synthetic oligonucleotide; TTT chr2 60542415 60542436 60542420 60542415 -
tgttttgttttcttttttttta

SEQ ID NO: 212127 - DNA, 22 bp, Artificial Sequence
  Synthetic oligonucleotide; TTT chr2 60542414 60542435 60542419 60542414 -
gttttgttttctttttttttag

SEQ ID NO: 212128 - DNA, 22 bp, Artificial Sequence
  Synthetic oligonucleotide; TTG chr2 60542413 60542434 60542418 60542413 -
ttttgttttctttttttttagt

SEQ ID NO: 212129 - DNA, 22 bp, Artificial Sequence
  Synthetic oligonucleotide; TTT chr2 60542410 60542431 60542415 60542410 -
tgttttctttttttttagtctc

SEQ ID NO: 212130 - DNA, 22 bp, Artificial Sequence
  Synthetic oligonucleotide; TTT chr2 60542409 60542430 60542414 60542409 -
gttttctttttttttagtctca

SEQ ID NO: 212131 - DNA, 22 bp, Artificial Sequence
  Synthetic oligonucleotide; TTG chr2 60542408 60542429 60542413 60542408 -
ttttctttttttttagtctcat

SEQ ID NO: 212132 - DNA, 22 bp, Artificial Sequence
  Synthetic oligonucleotide; TTT chr2 60542405 60542426 60542410 60542405 -
tctttttttttagtctcatatt

SEQ ID NO: 212133 - DNA, 22 bp, Artificial Sequence
  Synthetic oligonucleotide; TTT chr2 60542404 60542425 60542409 60542404 -
ctttttttttagtctcatattt

SEQ ID NO: 212134 - DNA, 22 bp, Artificial Sequence
  Synthetic oligonucleotide; TTC chr2 60542403 60542424 60542408 60542403 -
tttttttttagtctcatatttt

SEQ ID NO: 212135 - DNA, 22 bp, Artificial Sequence
  Synthetic oligonucleotide; CTT chr2 60542401 60542422 60542406 60542401 -
tttttttagtctcatattttat

SEQ ID NO: 212136 - DNA, 22 bp, Artificial Sequence
  Synthetic oligonucleotide; TTT chr2 60542400 60542421 60542405 60542400 -
ttttttagtctcatattttatg

SEQ ID NO: 212137 - DNA, 22 bp, Artificial Sequence
  Synthetic oligonucleotide; TTT chr2 60542399 60542420 60542404 60542399 -
tttttagtctcatattttatga

SEQ ID NO: 212138 - DNA, 22 bp, Artificial Sequence
  Synthetic oligonucleotide; TTT chr2 60542398 60542419 60542403 60542398 -
ttttagtctcatattttatgat

SEQ ID NO: 212139 - DNA, 22 bp, Artificial Sequence
  Synthetic oligonucleotide; TTT chr2 60542397 60542418 60542402 60542397 -
tttagtctcatattttatgatg

SEQ ID NO: 212140 - DNA, 22 bp, Artificial Sequence
  Synthetic oligonucleotide; TTT chr2 60542396 60542417 60542401 60542396 -
ttagtctcatattttatgatgg

SEQ ID NO: 212141 - DNA, 22 bp, Artificial Sequence
  Synthetic oligonucleotide; TTT chr2 60542395 60542416 60542400 60542395 -
tagtctcatattttatgatggg

SEQ ID NO: 212142 - DNA, 22 bp, Artificial Sequence
  Synthetic oligonucleotide; TTT chr2 60542394 60542415 60542399 60542394 -
agtctcatattttatgatgggg

SEQ ID NO: 212143 - DNA, 22 bp, Artificial Sequence
  Synthetic oligonucleotide; TTA chr2 60542393 60542414 60542398 60542393 -
gtctcatattttatgatggggg

SEQ ID NO: 212144 - DNA, 22 bp, Artificial Sequence
  Synthetic oligonucleotide; CTC chr2 60542388 60542409 60542393 60542388 -
atattttatgatggggggaaat

SEQ ID NO: 212145 - DNA, 22 bp, Artificial Sequence
  Synthetic oligonucleotide; TTT chr2 60542382 60542403 60542387 60542382 -
tatgatggggggaaatattcat

SEQ ID NO: 212146 - DNA, 22 bp, Artificial Sequence
  Synthetic oligonucleotide; TTT chr2 60542381 60542402 60542386 60542381 -
atgatggggggaaatattcatg

SEQ ID NO: 212147 - DNA, 22 bp, Artificial Sequence
  Synthetic oligonucleotide; TTA chr2 60542380 60542401 60542385 60542380 -
tgatggggggaaatattcatgg

SEQ ID NO: 212148 - DNA, 22 bp, Artificial Sequence
  Synthetic oligonucleotide; TTC chr2 60542362 60542383 60542367 60542362 -
atggaagattactgaatgtgaa

SEQ ID NO: 212149 - DNA, 22 bp, Artificial Sequence
  Synthetic oligonucleotide; TTA chr2 60542351 60542372 60542356 60542351 -
ctgaatgtgaaactgctgttcc

SEQ ID NO: 212150 - DNA, 22 bp, Artificial Sequence
  Synthetic oligonucleotide; CTG chr2 60542348 60542369 60542353 60542348 -
aatgtgaaactgctgttccctt

SEQ ID NO: 212151 - DNA, 22 bp, Artificial Sequence
  Synthetic oligonucleotide; CTG chr2 60542336 60542357 60542341 60542336 -
ctgttcccttatagaaaagacc

SEQ ID NO: 212152 - DNA, 22 bp, Artificial Sequence
  Synthetic oligonucleotide; CTG chr2 60542333 60542354 60542338 60542333 -
ttcccttatagaaaagacccaa

SEQ ID NO: 212153 - DNA, 22 bp, Artificial Sequence
  Synthetic oligonucleotide; TTC chr2 60542330 60542351 60542335 60542330 -
ccttatagaaaagacccaaaca

SEQ ID NO: 212154 - DNA, 22 bp, Artificial Sequence
  Synthetic oligonucleotide; CTT chr2 60542326 60542347 60542331 60542326 -
atagaaaagacccaaacattat

SEQ ID NO: 212155 - DNA, 22 bp, Artificial Sequence
  Synthetic oligonucleotide; TTA chr2 60542325 60542346 60542330 60542325 -
tagaaaagacccaaacattatc

SEQ ID NO: 212156 - DNA, 22 bp, Artificial Sequence
  Synthetic oligonucleotide; TTA chr2 60542305 60542326 60542310 60542305 -
tcccatcatgtcagatttgagg

SEQ ID NO: 212157 - DNA, 22 bp, Artificial Sequence
  Synthetic oligonucleotide; TTT chr2 60542287 60542308 60542292 60542287 -
gaggttttggcttattgcacat

SEQ ID NO: 212158 - DNA, 22 bp, Artificial Sequence
  Synthetic oligonucleotide; TTG chr2 60542286 60542307 60542291 60542286 -
aggttttggcttattgcacata

SEQ ID NO: 212159 - DNA, 22 bp, Artificial Sequence
  Synthetic oligonucleotide; TTT chr2 60542280 60542301 60542285 60542280 -
tggcttattgcacataggaatc

SEQ ID NO: 212160 - DNA, 22 bp, Artificial Sequence
  Synthetic oligonucleotide; TTT chr2 60542279 60542300 60542284 60542279 -
ggcttattgcacataggaatct

SEQ ID NO: 212161 - DNA, 22 bp, Artificial Sequence
  Synthetic oligonucleotide; TTG chr2 60542278 60542299 60542283 60542278 -
gcttattgcacataggaatctt

SEQ ID NO: 212162 - DNA, 22 bp, Artificial Sequence
  Synthetic oligonucleotide; CTT chr2 60542274 60542295 60542279 60542274 -
attgcacataggaatctttaaa

SEQ ID NO: 212163 - DNA, 22 bp, Artificial Sequence
  Synthetic oligonucleotide; TTA chr2 60542273 60542294 60542278 60542273 -
ttgcacataggaatctttaaat

SEQ ID NO: 212164 - DNA, 22 bp, Artificial Sequence
  Synthetic oligonucleotide; TTG chr2 60542270 60542291 60542275 60542270 -
cacataggaatctttaaattag

SEQ ID NO: 212165 - DNA, 22 bp, Artificial Sequence
  Synthetic oligonucleotide; CTT chr2 60542256 60542277 60542261 60542256 -
taaattaggtttgggctgtcat

SEQ ID NO: 212166 - DNA, 22 bp, Artificial Sequence
  Synthetic oligonucleotide; TTT chr2 60542255 60542276 60542260 60542255 -
aaattaggtttgggctgtcata

SEQ ID NO: 212167 - DNA, 22 bp, Artificial Sequence
  Synthetic oligonucleotide; TTA chr2 60542254 60542275 60542259 60542254 -
aattaggtttgggctgtcataa

SEQ ID NO: 212168 - DNA, 22 bp, Artificial Sequence
  Synthetic oligonucleotide; TTA chr2 60542249 60542270 60542254 60542249 -
ggtttgggctgtcataaagtta

SEQ ID NO: 212169 - DNA, 22 bp, Artificial Sequence
  Synthetic oligonucleotide; TTT chr2 60542244 60542265 60542249 60542244 -
gggctgtcataaagttagcttt

SEQ ID NO: 212170 - DNA, 22 bp, Artificial Sequence
  Synthetic oligonucleotide; TTG chr2 60542243 60542264 60542248 60542243 -
ggctgtcataaagttagctttt

SEQ ID NO: 212171 - DNA, 22 bp, Artificial Sequence
  Synthetic oligonucleotide; CTG chr2 60542238 60542259 60542243 60542238 -
tcataaagttagctttttgaga

SEQ ID NO: 212172 - DNA, 22 bp, Artificial Sequence
  Synthetic oligonucleotide; TTA chr2 60542227 60542248 60542232 60542227 -
gctttttgagagactagagaaa

SEQ ID NO: 212173 - DNA, 22 bp, Artificial Sequence
  Synthetic oligonucleotide; CTT chr2 60542223 60542244 60542228 60542223 -
tttgagagactagagaaaaaat

SEQ ID NO: 212174 - DNA, 22 bp, Artificial Sequence
  Synthetic oligonucleotide; TTT chr2 60542222 60542243 60542227 60542222 -
ttgagagactagagaaaaaata

SEQ ID NO: 212175 - DNA, 22 bp, Artificial Sequence
  Synthetic oligonucleotide; TTT chr2 60542221 60542242 60542226 60542221 -
tgagagactagagaaaaaatat

SEQ ID NO: 212176 - DNA, 22 bp, Artificial Sequence
  Synthetic oligonucleotide; TTT chr2 60542220 60542241 60542225 60542220 -
gagagactagagaaaaaatatg

SEQ ID NO: 212177 - DNA, 22 bp, Artificial Sequence
  Synthetic oligonucleotide; TTG chr2 60542219 60542240 60542224 60542219 -
agagactagagaaaaaatatga

SEQ ID NO: 212178 - DNA, 22 bp, Artificial Sequence
  Synthetic oligonucleotide; CTA chr2 60542211 60542232 60542216 60542211 -
gagaaaaaatatgacaagtcct

SEQ ID NO: 212179 - DNA, 22 bp, Artificial Sequence
  Synthetic oligonucleotide; CTA chr2 60542188 60542209 60542193 60542188 -
taaaatgtagtaaagtctgctc

SEQ ID NO: 212180 - DNA, 22 bp, Artificial Sequence
  Synthetic oligonucleotide; CTG chr2 60542169 60542190 60542174 60542169 -
ctcctgttgatatataacattt

SEQ ID NO: 212181 - DNA, 22 bp, Artificial Sequence
  Synthetic oligonucleotide; CTC chr2 60542166 60542187 60542171 60542166 -
ctgttgatatataacatttttt

SEQ ID NO: 212182 - DNA, 22 bp, Artificial Sequence
  Synthetic oligonucleotide; CTG chr2 60542163 60542184 60542168 60542163 -
ttgatatataacattttttctc

SEQ ID NO: 212183 - DNA, 22 bp, Artificial Sequence
  Synthetic oligonucleotide; TTG chr2 60542160 60542181 60542165 60542160 -
atatataacattttttctcttt

SEQ ID NO: 212184 - DNA, 22 bp, Artificial Sequence
  Synthetic oligonucleotide; TTT chr2 60542147 60542168 60542152 60542147 -
tttctctttaaaatcatgaaca

SEQ ID NO: 212185 - DNA, 22 bp, Artificial Sequence
  Synthetic oligonucleotide; TTT chr2 60542146 60542167 60542151 60542146 -
ttctctttaaaatcatgaacat

SEQ ID NO: 212186 - DNA, 22 bp, Artificial Sequence
  Synthetic oligonucleotide; TTT chr2 60542145 60542166 60542150 60542145 -
tctctttaaaatcatgaacata

SEQ ID NO: 212187 - DNA, 22 bp, Artificial Sequence
  Synthetic oligonucleotide; TTT chr2 60542144 60542165 60542149 60542144 -
ctctttaaaatcatgaacatag

SEQ ID NO: 212188 - DNA, 22 bp, Artificial Sequence
  Synthetic oligonucleotide; TTC chr2 60542143 60542164 60542148 60542143 -
tctttaaaatcatgaacataga

SEQ ID NO: 212189 - DNA, 22 bp, Artificial Sequence
  Synthetic oligonucleotide; CTC chr2 60542141 60542162 60542146 60542141 -
tttaaaatcatgaacatagaca

SEQ ID NO: 212190 - DNA, 22 bp, Artificial Sequence
  Synthetic oligonucleotide; CTT chr2 60542139 60542160 60542144 60542139 -
taaaatcatgaacatagacatt

SEQ ID NO: 212191 - DNA, 22 bp, Artificial Sequence
  Synthetic oligonucleotide; TTT chr2 60542138 60542159 60542143 60542138 -
aaaatcatgaacatagacattt

SEQ ID NO: 212192 - DNA, 22 bp, Artificial Sequence
  Synthetic oligonucleotide; TTA chr2 60542137 60542158 60542142 60542137 -
aaatcatgaacatagacattta

SEQ ID NO: 212193 - DNA, 22 bp, Artificial Sequence
  Synthetic oligonucleotide; TTT chr2 60542116 60542137 60542121 60542116 -
atatcagggtatttaaaattat

SEQ ID NO: 212194 - DNA, 22 bp, Artificial Sequence
  Synthetic oligonucleotide; TTA chr2 60542115 60542136 60542120 60542115 -
tatcagggtatttaaaattatt

SEQ ID NO: 212195 - DNA, 22 bp, Artificial Sequence
  Synthetic oligonucleotide; TTT chr2 60542102 60542123 60542107 60542102 -
aaaattatttgcctagacagta

SEQ ID NO: 212196 - DNA, 22 bp, Artificial Sequence
  Synthetic oligonucleotide; TTA chr2 60542101 60542122 60542106 60542101 -
aaattatttgcctagacagtat

SEQ ID NO: 212197 - DNA, 22 bp, Artificial Sequence
  Synthetic oligonucleotide; TTA chr2 60542095 60542116 60542100 60542095 -
tttgcctagacagtatagctgg

SEQ ID NO: 212198 - DNA, 22 bp, Artificial Sequence
  Synthetic oligonucleotide; TTT chr2 60542092 60542113 60542097 60542092 -
gcctagacagtatagctggtat

SEQ ID NO: 212199 - DNA, 22 bp, Artificial Sequence
  Synthetic oligonucleotide; TTG chr2 60542091 60542112 60542096 60542091 -
cctagacagtatagctggtatt

SEQ ID NO: 212200 - DNA, 22 bp, Artificial Sequence
  Synthetic oligonucleotide; CTA chr2 60542087 60542108 60542092 60542087 -
gacagtatagctggtatttaga

SEQ ID NO: 212201 - DNA, 22 bp, Artificial Sequence
  Synthetic oligonucleotide; CTG chr2 60542074 60542095 60542079 60542074 -
gtatttagataatgatatatca

SEQ ID NO: 212202 - DNA, 22 bp, Artificial Sequence
  Synthetic oligonucleotide; TTT chr2 60542068 60542089 60542073 60542068 -
agataatgatatatcagacaga

SEQ ID NO: 212203 - DNA, 22 bp, Artificial Sequence
  Synthetic oligonucleotide; TTA chr2 60542067 60542088 60542072 60542067 -
gataatgatatatcagacagat

SEQ ID NO: 212204 - DNA, 22 bp, Artificial Sequence
  Synthetic oligonucleotide; CTC chr2 60542041 60542062 60542046 60542041 -
taaagaagggagatatagtaat

SEQ ID NO: 212205 - DNA, 22 bp, Artificial Sequence
  Synthetic oligonucleotide; CTA chr2 60542039 60542060 60542044 60542039 -
aagaagggagatatagtaattc

SEQ ID NO: 212206 - DNA, 22 bp, Artificial Sequence
  Synthetic oligonucleotide; TTC chr2 60542017 60542038 60542022 60542017 -
aaaatggaaatacattagcatg

SEQ ID NO: 212207 - DNA, 22 bp, Artificial Sequence
  Synthetic oligonucleotide; TTA chr2 60542000 60542021 60542005 60542000 -
gcatgctcttaaaagtaaatca

SEQ ID NO: 212208 - DNA, 22 bp, Artificial Sequence
  Synthetic oligonucleotide; CTC chr2 60541992 60542013 60541997 60541992 -
ttaaaagtaaatcaaatacaat

SEQ ID NO: 212209 - DNA, 22 bp, Artificial Sequence
  Synthetic oligonucleotide; CTT chr2 60541990 60542011 60541995 60541990 -
aaaagtaaatcaaatacaatat

SEQ ID NO: 212210 - DNA, 22 bp, Artificial Sequence
  Synthetic oligonucleotide; TTA chr2 60541989 60542010 60541994 60541989 -
aaagtaaatcaaatacaatatg

SEQ ID NO: 212211 - DNA, 22 bp, Artificial Sequence
  Synthetic oligonucleotide; CTT chr2 60541964 60541985 60541969 60541964 -
ttcagaatttagaaaatgaact

SEQ ID NO: 212212 - DNA, 22 bp, Artificial Sequence
  Synthetic oligonucleotide; TTT chr2 60541963 60541984 60541968 60541963 -
tcagaatttagaaaatgaactt

SEQ ID NO: 212213 - DNA, 22 bp, Artificial Sequence
  Synthetic oligonucleotide; TTT chr2 60541962 60541983 60541967 60541962 -
cagaatttagaaaatgaactta

SEQ ID NO: 212214 - DNA, 22 bp, Artificial Sequence
  Synthetic oligonucleotide; TTC chr2 60541961 60541982 60541966 60541961 -
agaatttagaaaatgaacttac

SEQ ID NO: 212215 - DNA, 22 bp, Artificial Sequence
  Synthetic oligonucleotide; TTT chr2 60541954 60541975 60541959 60541954 -
agaaaatgaacttaccttttct

SEQ ID NO: 212216 - DNA, 22 bp, Artificial Sequence
  Synthetic oligonucleotide; TTA chr2 60541953 60541974 60541958 60541953 -
gaaaatgaacttaccttttctt

SEQ ID NO: 212217 - DNA, 22 bp, Artificial Sequence
  Synthetic oligonucleotide; CTT chr2 60541941 60541962 60541946 60541941 -
accttttctttttgtatccatt

SEQ ID NO: 212218 - DNA, 22 bp, Artificial Sequence
  Synthetic oligonucleotide; TTA chr2 60541940 60541961 60541945 60541940 -
ccttttctttttgtatccattc

SEQ ID NO: 212219 - DNA, 22 bp, Artificial Sequence
  Synthetic oligonucleotide; CTT chr2 60541936 60541957 60541941 60541936 -
ttctttttgtatccattctgat

SEQ ID NO: 212220 - DNA, 22 bp, Artificial Sequence
  Synthetic oligonucleotide; TTT chr2 60541935 60541956 60541940 60541935 -
tctttttgtatccattctgatt

SEQ ID NO: 212221 - DNA, 22 bp, Artificial Sequence
  Synthetic oligonucleotide; TTT chr2 60541934 60541955 60541939 60541934 -
ctttttgtatccattctgattc

SEQ ID NO: 212222 - DNA, 22 bp, Artificial Sequence
  Synthetic oligonucleotide; TTC chr2 60541933 60541954 60541938 60541933 -
tttttgtatccattctgattct

SEQ ID NO: 212223 - DNA, 22 bp, Artificial Sequence
  Synthetic oligonucleotide; CTT chr2 60541931 60541952 60541936 60541931 -
tttgtatccattctgattctct

SEQ ID NO: 212224 - DNA, 22 bp, Artificial Sequence
  Synthetic oligonucleotide; TTT chr2 60541930 60541951 60541935 60541930 -
ttgtatccattctgattctctc

SEQ ID NO: 212225 - DNA, 22 bp, Artificial Sequence
  Synthetic oligonucleotide; TTT chr2 60541929 60541950 60541934 60541929 -
tgtatccattctgattctctcc

SEQ ID NO: 212226 - DNA, 22 bp, Artificial Sequence
  Synthetic oligonucleotide; TTT chr2 60541928 60541949 60541933 60541928 -
gtatccattctgattctctcct

SEQ ID NO: 212227 - DNA, 22 bp, Artificial Sequence
  Synthetic oligonucleotide; TTG chr2 60541927 60541948 60541932 60541927 -
tatccattctgattctctccta

SEQ ID NO: 212228 - DNA, 22 bp, Artificial Sequence
  Synthetic oligonucleotide; TTC chr2 60541918 60541939 60541923 60541918 -
tgattctctcctagctcagact

SEQ ID NO: 212229 - DNA, 22 bp, Artificial Sequence
  Synthetic oligonucleotide; CTG chr2 60541916 60541937 60541921 60541916 -
attctctcctagctcagactga

SEQ ID NO: 212230 - DNA, 22 bp, Artificial Sequence
  Synthetic oligonucleotide; TTC chr2 60541912 60541933 60541917 60541912 -
tctcctagctcagactgaactg

SEQ ID NO: 212231 - DNA, 22 bp, Artificial Sequence
  Synthetic oligonucleotide; CTC chr2 60541910 60541931 60541915 60541910 -
tcctagctcagactgaactgga

SEQ ID NO: 212232 - DNA, 22 bp, Artificial Sequence
  Synthetic oligonucleotide; CTC chr2 60541908 60541929 60541913 60541908 -
ctagctcagactgaactggagg

SEQ ID NO: 212233 - DNA, 22 bp, Artificial Sequence
  Synthetic oligonucleotide; CTA chr2 60541905 60541926 60541910 60541905 -
gctcagactgaactggaggatg

SEQ ID NO: 212234 - DNA, 22 bp, Artificial Sequence
  Synthetic oligonucleotide; CTC chr2 60541901 60541922 60541906 60541901 -
agactgaactggaggatgtatt

SEQ ID NO: 212235 - DNA, 22 bp, Artificial Sequence
  Synthetic oligonucleotide; CTG chr2 60541895 60541916 60541900 60541895 -
aactggaggatgtatttgtgta

SEQ ID NO: 212236 - DNA, 22 bp, Artificial Sequence
  Synthetic oligonucleotide; CTG chr2 60541890 60541911 60541895 60541890 -
gaggatgtatttgtgtacctta

SEQ ID NO: 212237 - DNA, 22 bp, Artificial Sequence
  Synthetic oligonucleotide; TTT chr2 60541878 60541899 60541883 60541878 -
gtgtaccttatggtgtaattgt

SEQ ID NO: 212238 - DNA, 22 bp, Artificial Sequence
  Synthetic oligonucleotide; TTG chr2 60541877 60541898 60541882 60541877 -
tgtaccttatggtgtaattgta

SEQ ID NO: 212239 - DNA, 22 bp, Artificial Sequence
  Synthetic oligonucleotide; CTT chr2 60541869 60541890 60541874 60541869 -
atggtgtaattgtaaatgagac

SEQ ID NO: 212240 - DNA, 22 bp, Artificial Sequence
  Synthetic oligonucleotide; TTA chr2 60541868 60541889 60541873 60541868 -
tggtgtaattgtaaatgagact

SEQ ID NO: 212241 - DNA, 22 bp, Artificial Sequence
  Synthetic oligonucleotide; TTG chr2 60541857 60541878 60541862 60541857 -
taaatgagactataaattatag

SEQ ID NO: 212242 - DNA, 22 bp, Artificial Sequence
  Synthetic oligonucleotide; CTA chr2 60541845 60541866 60541850 60541845 -
taaattatagtatgctattatg

SEQ ID NO: 212243 - DNA, 22 bp, Artificial Sequence
  Synthetic oligonucleotide; TTA chr2 60541838 60541859 60541843 60541838 -
tagtatgctattatgactactt

SEQ ID NO: 212244 - DNA, 22 bp, Artificial Sequence
  Synthetic oligonucleotide; CTA chr2 60541828 60541849 60541833 60541828 -
ttatgactacttatttttcttt

SEQ ID NO: 212245 - DNA, 22 bp, Artificial Sequence
  Synthetic oligonucleotide; TTA chr2 60541825 60541846 60541830 60541825 -
tgactacttatttttcttttct

SEQ ID NO: 212246 - DNA, 22 bp, Artificial Sequence
  Synthetic oligonucleotide; CTA chr2 60541819 60541840 60541824 60541819 -
cttatttttcttttctctttat

SEQ ID NO: 212247 - DNA, 22 bp, Artificial Sequence
  Synthetic oligonucleotide; CTT chr2 60541816 60541837 60541821 60541816 -
atttttcttttctctttattta

SEQ ID NO: 212248 - DNA, 22 bp, Artificial Sequence
  Synthetic oligonucleotide; TTA chr2 60541815 60541836 60541820 60541815 -
tttttcttttctctttatttat

SEQ ID NO: 212249 - DNA, 22 bp, Artificial Sequence
  Synthetic oligonucleotide; TTT chr2 60541812 60541833 60541817 60541812 -
ttcttttctctttatttatgtg

SEQ ID NO: 212250 - DNA, 22 bp, Artificial Sequence
  Synthetic oligonucleotide; TTT chr2 60541811 60541832 60541816 60541811 -
tcttttctctttatttatgtga

SEQ ID NO: 212251 - DNA, 22 bp, Artificial Sequence
  Synthetic oligonucleotide; TTT chr2 60541810 60541831 60541815 60541810 -
cttttctctttatttatgtgat

SEQ ID NO: 212252 - DNA, 22 bp, Artificial Sequence
  Synthetic oligonucleotide; TTC chr2 60541809 60541830 60541814 60541809 -
ttttctctttatttatgtgatt

SEQ ID NO: 212253 - DNA, 22 bp, Artificial Sequence
  Synthetic oligonucleotide; CTT chr2 60541807 60541828 60541812 60541807 -
ttctctttatttatgtgattct

SEQ ID NO: 212254 - DNA, 22 bp, Artificial Sequence
  Synthetic oligonucleotide; TTT chr2 60541806 60541827 60541811 60541806 -
tctctttatttatgtgattctg

SEQ ID NO: 212255 - DNA, 22 bp, Artificial Sequence
  Synthetic oligonucleotide; TTT chr2 60541805 60541826 60541810 60541805 -
ctctttatttatgtgattctga

SEQ ID NO: 212256 - DNA, 22 bp, Artificial Sequence
  Synthetic oligonucleotide; TTC chr2 60541804 60541825 60541809 60541804 -
tctttatttatgtgattctgaa

SEQ ID NO: 212257 - DNA, 22 bp, Artificial Sequence
  Synthetic oligonucleotide; CTC chr2 60541802 60541823 60541807 60541802 -
tttatttatgtgattctgaata

SEQ ID NO: 212258 - DNA, 22 bp, Artificial Sequence
  Synthetic oligonucleotide; CTT chr2 60541800 60541821 60541805 60541800 -
tatttatgtgattctgaataaa

SEQ ID NO: 212259 - DNA, 22 bp, Artificial Sequence
  Synthetic oligonucleotide; TTT chr2 60541799 60541820 60541804 60541799 -
atttatgtgattctgaataaaa

SEQ ID NO: 212260 - DNA, 22 bp, Artificial Sequence
  Synthetic oligonucleotide; TTA chr2 60541798 60541819 60541803 60541798 -
tttatgtgattctgaataaaaa

SEQ ID NO: 212261 - DNA, 22 bp, Artificial Sequence
  Synthetic oligonucleotide; TTT chr2 60541795 60541816 60541800 60541795 -
atgtgattctgaataaaaacga

SEQ ID NO: 212262 - DNA, 22 bp, Artificial Sequence
  Synthetic oligonucleotide; TTA chr2 60541794 60541815 60541799 60541794 -
tgtgattctgaataaaaacgac

SEQ ID NO: 212263 - DNA, 22 bp, Artificial Sequence
  Synthetic oligonucleotide; TTC chr2 60541786 60541807 60541791 60541786 -
tgaataaaaacgactgacttct

SEQ ID NO: 212264 - DNA, 22 bp, Artificial Sequence
  Synthetic oligonucleotide; CTG chr2 60541784 60541805 60541789 60541784 -
aataaaaacgactgacttctga

SEQ ID NO: 212265 - DNA, 22 bp, Artificial Sequence
  Synthetic oligonucleotide; CTG chr2 60541770 60541791 60541775 60541770 -
acttctgaagtgaattttcagc

SEQ ID NO: 212266 - DNA, 22 bp, Artificial Sequence
  Synthetic oligonucleotide; CTT chr2 60541766 60541787 60541771 60541766 -
ctgaagtgaattttcagcatgg

SEQ ID NO: 212267 - DNA, 22 bp, Artificial Sequence
  Synthetic oligonucleotide; TTC chr2 60541765 60541786 60541770 60541765 -
tgaagtgaattttcagcatggc

SEQ ID NO: 212268 - DNA, 22 bp, Artificial Sequence
  Synthetic oligonucleotide; CTG chr2 60541763 60541784 60541768 60541763 -
aagtgaattttcagcatggcag

SEQ ID NO: 212269 - DNA, 22 bp, Artificial Sequence
  Synthetic oligonucleotide; TTT chr2 60541753 60541774 60541758 60541753 -
tcagcatggcagttaaaacaaa

SEQ ID NO: 212270 - DNA, 22 bp, Artificial Sequence
  Synthetic oligonucleotide; TTT chr2 60541752 60541773 60541757 60541752 -
cagcatggcagttaaaacaaaa

SEQ ID NO: 212271 - DNA, 22 bp, Artificial Sequence
  Synthetic oligonucleotide; TTC chr2 60541751 60541772 60541756 60541751 -
agcatggcagttaaaacaaaaa

SEQ ID NO: 212272 - DNA, 22 bp, Artificial Sequence
  Synthetic oligonucleotide; TTA chr2 60541738 60541759 60541743 60541738 -
aaacaaaaaaacaccactacca

SEQ ID NO: 212273 - DNA, 22 bp, Artificial Sequence
  Synthetic oligonucleotide; CTA chr2 60541719 60541740 60541724 60541719 -
ccacaaaaaacaatatactggt

SEQ ID NO: 212274 - DNA, 22 bp, Artificial Sequence
  Synthetic oligonucleotide; CTG chr2 60541699 60541720 60541704 60541699 -
gtgaacattttacttaccttca

SEQ ID NO: 212275 - DNA, 22 bp, Artificial Sequence
  Synthetic oligonucleotide; TTT chr2 60541689 60541710 60541694 60541689 -
tacttaccttcaaaatccagag

SEQ ID NO: 212276 - DNA, 22 bp, Artificial Sequence
  Synthetic oligonucleotide; TTT chr2 60541688 60541709 60541693 60541688 -
acttaccttcaaaatccagaga

SEQ ID NO: 212277 - DNA, 22 bp, Artificial Sequence
  Synthetic oligonucleotide; TTA chr2 60541687 60541708 60541692 60541687 -
cttaccttcaaaatccagagag

SEQ ID NO: 212278 - DNA, 22 bp, Artificial Sequence
  Synthetic oligonucleotide; CTT chr2 60541684 60541705 60541689 60541684 -
accttcaaaatccagagagtag

SEQ ID NO: 212279 - DNA, 22 bp, Artificial Sequence
  Synthetic oligonucleotide; TTA chr2 60541683 60541704 60541688 60541683 -
ccttcaaaatccagagagtaga

SEQ ID NO: 212280 - DNA, 22 bp, Artificial Sequence
  Synthetic oligonucleotide; CTT chr2 60541679 60541700 60541684 60541679 -
caaaatccagagagtagagaat

SEQ ID NO: 212281 - DNA, 22 bp, Artificial Sequence
  Synthetic oligonucleotide; TTC chr2 60541678 60541699 60541683 60541678 -
aaaatccagagagtagagaata

SEQ ID NO: 212282 - DNA, 22 bp, Artificial Sequence
  Synthetic oligonucleotide; TTG chr2 60541653 60541674 60541658 60541653 -
ttttctaataagtacctaggat

SEQ ID NO: 212283 - DNA, 22 bp, Artificial Sequence
  Synthetic oligonucleotide; TTT chr2 60541650 60541671 60541655 60541650 -
tctaataagtacctaggatttt

SEQ ID NO: 212284 - DNA, 22 bp, Artificial Sequence
  Synthetic oligonucleotide; TTT chr2 60541649 60541670 60541654 60541649 -
ctaataagtacctaggattttc

SEQ ID NO: 212285 - DNA, 22 bp, Artificial Sequence
  Synthetic oligonucleotide; TTC chr2 60541648 60541669 60541653 60541648 -
taataagtacctaggattttca

SEQ ID NO: 212286 - DNA, 22 bp, Artificial Sequence
  Synthetic oligonucleotide; CTA chr2 60541646 60541667 60541651 60541646 -
ataagtacctaggattttcata

SEQ ID NO: 212287 - DNA, 22 bp, Artificial Sequence
  Synthetic oligonucleotide; CTA chr2 60541635 60541656 60541640 60541635 -
ggattttcatagggagcctatg

SEQ ID NO: 212288 - DNA, 22 bp, Artificial Sequence
  Synthetic oligonucleotide; TTT chr2 60541629 60541650 60541634 60541629 -
tcatagggagcctatgtttgtg

SEQ ID NO: 212289 - DNA, 22 bp, Artificial Sequence
  Synthetic oligonucleotide; TTT chr2 60541628 60541649 60541633 60541628 -
catagggagcctatgtttgtga

SEQ ID NO: 212290 - DNA, 22 bp, Artificial Sequence
  Synthetic oligonucleotide; TTC chr2 60541627 60541648 60541632 60541627 -
atagggagcctatgtttgtgag

SEQ ID NO: 212291 - DNA, 22 bp, Artificial Sequence
  Synthetic oligonucleotide; CTA chr2 60541615 60541636 60541620 60541615 -
tgtttgtgaggccactatccaa

SEQ ID NO: 212292 - DNA, 22 bp, Artificial Sequence
  Synthetic oligonucleotide; TTT chr2 60541610 60541631 60541615 60541610 -
gtgaggccactatccaaagact

SEQ ID NO: 212293 - DNA, 22 bp, Artificial Sequence
  Synthetic oligonucleotide; TTG chr2 60541609 60541630 60541614 60541609 -
tgaggccactatccaaagacta

SEQ ID NO: 212294 - DNA, 22 bp, Artificial Sequence
  Synthetic oligonucleotide; CTA chr2 60541598 60541619 60541603 60541598 -
tccaaagactaatgttcatgaa

SEQ ID NO: 212295 - DNA, 22 bp, Artificial Sequence
  Synthetic oligonucleotide; CTA chr2 60541587 60541608 60541592 60541587 -
atgttcatgaaactgggagtcc

SEQ ID NO: 212296 - DNA, 22 bp, Artificial Sequence
  Synthetic oligonucleotide; TTC chr2 60541581 60541602 60541586 60541581 -
atgaaactgggagtcctatata

SEQ ID NO: 212297 - DNA, 22 bp, Artificial Sequence
  Synthetic oligonucleotide; CTG chr2 60541572 60541593 60541577 60541572 -
ggagtcctatatacaagctgta

SEQ ID NO: 212298 - DNA, 22 bp, Artificial Sequence
  Synthetic oligonucleotide; CTA chr2 60541563 60541584 60541568 60541563 -
tatacaagctgtatttgtaaat

SEQ ID NO: 212299 - DNA, 22 bp, Artificial Sequence
  Synthetic oligonucleotide; CTG chr2 60541552 60541573 60541557 60541552 -
tatttgtaaataagacagagaa

SEQ ID NO: 212300 - DNA, 22 bp, Artificial Sequence
  Synthetic oligonucleotide; TTT chr2 60541547 60541568 60541552 60541547 -
gtaaataagacagagaaaggtt

SEQ ID NO: 212301 - DNA, 22 bp, Artificial Sequence
  Synthetic oligonucleotide; TTG chr2 60541546 60541567 60541551 60541546 -
taaataagacagagaaaggttg

SEQ ID NO: 212302 - DNA, 22 bp, Artificial Sequence
  Synthetic oligonucleotide; TTG chr2 60541524 60541545 60541529 60541524 -
tgaactggcagcttggatgttt

SEQ ID NO: 212303 - DNA, 22 bp, Artificial Sequence
  Synthetic oligonucleotide; CTG chr2 60541517 60541538 60541522 60541517 -
gcagcttggatgttttgtcaaa

SEQ ID NO: 212304 - DNA, 22 bp, Artificial Sequence
  Synthetic oligonucleotide; CTT chr2 60541510 60541531 60541515 60541510 -
ggatgttttgtcaaagtacaat

SEQ ID NO: 212305 - DNA, 22 bp, Artificial Sequence
  Synthetic oligonucleotide; TTG chr2 60541509 60541530 60541514 60541509 -
gatgttttgtcaaagtacaatg

SEQ ID NO: 212306 - DNA, 22 bp, Artificial Sequence
  Synthetic oligonucleotide; TTT chr2 60541502 60541523 60541507 60541502 -
tgtcaaagtacaatgtcagaga

SEQ ID NO: 212307 - DNA, 22 bp, Artificial Sequence
  Synthetic oligonucleotide; TTT chr2 60541501 60541522 60541506 60541501 -
gtcaaagtacaatgtcagagaa

SEQ ID NO: 212308 - DNA, 22 bp, Artificial Sequence
  Synthetic oligonucleotide; TTG chr2 60541500 60541521 60541505 60541500 -
tcaaagtacaatgtcagagaaa

SEQ ID NO: 212309 - DNA, 22 bp, Artificial Sequence
  Synthetic oligonucleotide; CTC chr2 60541475 60541496 60541480 60541475 -
tttctaagacaaattgtaaata

SEQ ID NO: 212310 - DNA, 22 bp, Artificial Sequence
  Synthetic oligonucleotide; CTT chr2 60541473 60541494 60541478 60541473 -
tctaagacaaattgtaaataga

SEQ ID NO: 212311 - DNA, 22 bp, Artificial Sequence
  Synthetic oligonucleotide; TTT chr2 60541472 60541493 60541477 60541472 -
ctaagacaaattgtaaatagaa

SEQ ID NO: 212312 - DNA, 22 bp, Artificial Sequence
  Synthetic oligonucleotide; TTC chr2 60541471 60541492 60541476 60541471 -
taagacaaattgtaaatagaac

SEQ ID NO: 212313 - DNA, 22 bp, Artificial Sequence
  Synthetic oligonucleotide; CTA chr2 60541469 60541490 60541474 60541469 -
agacaaattgtaaatagaactg

SEQ ID NO: 212314 - DNA, 22 bp, Artificial Sequence
  Synthetic oligonucleotide; TTG chr2 60541459 60541480 60541464 60541459 -
taaatagaactgtcacagtgat

SEQ ID NO: 212315 - DNA, 22 bp, Artificial Sequence
  Synthetic oligonucleotide; CTG chr2 60541447 60541468 60541452 60541447 -
tcacagtgattgcatgattgag

SEQ ID NO: 212316 - DNA, 22 bp, Artificial Sequence
  Synthetic oligonucleotide; TTG chr2 60541435 60541456 60541440 60541435 -
catgattgagccgcagaagtgt

SEQ ID NO: 212317 - DNA, 22 bp, Artificial Sequence
  Synthetic oligonucleotide; TTG chr2 60541427 60541448 60541432 60541427 -
agccgcagaagtgtcctacaat

SEQ ID NO: 212318 - DNA, 22 bp, Artificial Sequence
  Synthetic oligonucleotide; CTA chr2 60541409 60541430 60541414 60541409 -
caattgttggcattgtcaggac

SEQ ID NO: 212319 - DNA, 22 bp, Artificial Sequence
  Synthetic oligonucleotide; TTG chr2 60541403 60541424 60541408 60541403 -
ttggcattgtcaggacttttga

SEQ ID NO: 212320 - DNA, 22 bp, Artificial Sequence
  Synthetic oligonucleotide; TTG chr2 60541400 60541421 60541405 60541400 -
gcattgtcaggacttttgaaag

SEQ ID NO: 212321 - DNA, 22 bp, Artificial Sequence
  Synthetic oligonucleotide; TTG chr2 60541394 60541415 60541399 60541394 -
tcaggacttttgaaagcttaat

SEQ ID NO: 212322 - DNA, 22 bp, Artificial Sequence
  Synthetic oligonucleotide; CTT chr2 60541385 60541406 60541390 60541385 -
ttgaaagcttaattaaacacag

SEQ ID NO: 212323 - DNA, 22 bp, Artificial Sequence
  Synthetic oligonucleotide; TTT chr2 60541384 60541405 60541389 60541384 -
tgaaagcttaattaaacacagt

SEQ ID NO: 212324 - DNA, 22 bp, Artificial Sequence
  Synthetic oligonucleotide; TTT chr2 60541383 60541404 60541388 60541383 -
gaaagcttaattaaacacagtg

SEQ ID NO: 212325 - DNA, 22 bp, Artificial Sequence
  Synthetic oligonucleotide; TTG chr2 60541382 60541403 60541387 60541382 -
aaagcttaattaaacacagtgg

SEQ ID NO: 212326 - DNA, 22 bp, Artificial Sequence
  Synthetic oligonucleotide; CTT chr2 60541375 60541396 60541380 60541375 -
aattaaacacagtggcccgcat

SEQ ID NO: 212327 - DNA, 22 bp, Artificial Sequence
  Synthetic oligonucleotide; TTA chr2 60541374 60541395 60541379 60541374 -
attaaacacagtggcccgcatg

SEQ ID NO: 212328 - DNA, 22 bp, Artificial Sequence
  Synthetic oligonucleotide; TTA chr2 60541370 60541391 60541375 60541370 -
aacacagtggcccgcatggctg

SEQ ID NO: 212329 - DNA, 22 bp, Artificial Sequence
  Synthetic oligonucleotide; CTG chr2 60541348 60541369 60541353 60541348 -
ctaaacttactaaggaaagcca

SEQ ID NO: 212330 - DNA, 22 bp, Artificial Sequence
  Synthetic oligonucleotide; CTA chr2 60541345 60541366 60541350 60541345 -
aacttactaaggaaagccaaaa

SEQ ID NO: 212331 - DNA, 22 bp, Artificial Sequence
  Synthetic oligonucleotide; CTT chr2 60541340 60541361 60541345 60541340 -
actaaggaaagccaaaaggaaa

SEQ ID NO: 212332 - DNA, 22 bp, Artificial Sequence
  Synthetic oligonucleotide; TTA chr2 60541339 60541360 60541344 60541339 -
ctaaggaaagccaaaaggaaaa

SEQ ID NO: 212333 - DNA, 22 bp, Artificial Sequence
  Synthetic oligonucleotide; CTA chr2 60541336 60541357 60541341 60541336 -
aggaaagccaaaaggaaaaaaa

SEQ ID NO: 212334 - DNA, 22 bp, Artificial Sequence
  Synthetic oligonucleotide; CTA chr2 60541303 60541324 60541308 60541303 -
aaatgtagaagatcctaaagat

SEQ ID NO: 212335 - DNA, 22 bp, Artificial Sequence
  Synthetic oligonucleotide; CTA chr2 60541286 60541307 60541291 60541286 -
aagatcccaaacttcttcagac

SEQ ID NO: 212336 - DNA, 22 bp, Artificial Sequence
  Synthetic oligonucleotide; CTT chr2 60541272 60541293 60541277 60541272 -
cttcagacattacccttgtggt

SEQ ID NO: 212337 - DNA, 22 bp, Artificial Sequence
  Synthetic oligonucleotide; TTC chr2 60541271 60541292 60541276 60541271 -
ttcagacattacccttgtggtg

SEQ ID NO: 212338 - DNA, 22 bp, Artificial Sequence
  Synthetic oligonucleotide; CTT chr2 60541269 60541290 60541274 60541269 -
cagacattacccttgtggtgac

SEQ ID NO: 212339 - DNA, 22 bp, Artificial Sequence
  Synthetic oligonucleotide; TTC chr2 60541268 60541289 60541273 60541268 -
agacattacccttgtggtgaca

SEQ ID NO: 212340 - DNA, 22 bp, Artificial Sequence
  Synthetic oligonucleotide; TTA chr2 60541260 60541281 60541265 60541260 -
cccttgtggtgacacagaaaag

SEQ ID NO: 212341 - DNA, 22 bp, Artificial Sequence
  Synthetic oligonucleotide; CTT chr2 60541255 60541276 60541260 60541255 -
gtggtgacacagaaaagatgca

SEQ ID NO: 212342 - DNA, 22 bp, Artificial Sequence
  Synthetic oligonucleotide; TTG chr2 60541254 60541275 60541259 60541254 -
tggtgacacagaaaagatgcat

SEQ ID NO: 212343 - DNA, 22 bp, Artificial Sequence
  Synthetic oligonucleotide; TTG chr2 60541230 60541251 60541235 60541230 -
tgcattttcctagtcatctttt

SEQ ID NO: 212344 - DNA, 22 bp, Artificial Sequence
  Synthetic oligonucleotide; TTT chr2 60541223 60541244 60541228 60541223 -
tcctagtcatcttttataaata

SEQ ID NO: 212345 - DNA, 22 bp, Artificial Sequence
  Synthetic oligonucleotide; TTT chr2 60541222 60541243 60541227 60541222 -
cctagtcatcttttataaataa

SEQ ID NO: 212346 - DNA, 22 bp, Artificial Sequence
  Synthetic oligonucleotide; TTC chr2 60541221 60541242 60541226 60541221 -
ctagtcatcttttataaataat

SEQ ID NO: 212347 - DNA, 22 bp, Artificial Sequence
  Synthetic oligonucleotide; CTA chr2 60541218 60541239 60541223 60541218 -
gtcatcttttataaataatgtt

SEQ ID NO: 212348 - DNA, 22 bp, Artificial Sequence
  Synthetic oligonucleotide; CTT chr2 60541210 60541231 60541215 60541210 -
ttataaataatgttttgagaat

SEQ ID NO: 212349 - DNA, 22 bp, Artificial Sequence
  Synthetic oligonucleotide; TTT chr2 60541209 60541230 60541214 60541209 -
tataaataatgttttgagaata

SEQ ID NO: 212350 - DNA, 22 bp, Artificial Sequence
  Synthetic oligonucleotide; TTT chr2 60541208 60541229 60541213 60541208 -
ataaataatgttttgagaatag

SEQ ID NO: 212351 - DNA, 22 bp, Artificial Sequence
  Synthetic oligonucleotide; TTA chr2 60541207 60541228 60541212 60541207 -
taaataatgttttgagaatagg

SEQ ID NO: 212352 - DNA, 22 bp, Artificial Sequence
  Synthetic oligonucleotide; TTT chr2 60541195 60541216 60541200 60541195 -
tgagaataggtccacgtgatat

SEQ ID NO: 212353 - DNA, 22 bp, Artificial Sequence
  Synthetic oligonucleotide; TTT chr2 60541194 60541215 60541199 60541194 -
gagaataggtccacgtgatatg

SEQ ID NO: 212354 - DNA, 22 bp, Artificial Sequence
  Synthetic oligonucleotide; TTG chr2 60541193 60541214 60541198 60541193 -
agaataggtccacgtgatatga

SEQ ID NO: 212355 - DNA, 22 bp, Artificial Sequence
  Synthetic oligonucleotide; CTG chr2 60541160 60541181 60541165 60541160 -
tgtgtgatgtggagattgtgtt

SEQ ID NO: 212356 - DNA, 22 bp, Artificial Sequence
  Synthetic oligonucleotide; TTG chr2 60541142 60541163 60541147 60541142 -
tgttagtttttctgtctcctgc

SEQ ID NO: 212357 - DNA, 22 bp, Artificial Sequence
  Synthetic oligonucleotide; TTA chr2 60541137 60541158 60541142 60541137 -
gtttttctgtctcctgctgtta

SEQ ID NO: 212358 - DNA, 22 bp, Artificial Sequence
  Synthetic oligonucleotide; TTT chr2 60541133 60541154 60541138 60541133 -
ttctgtctcctgctgttacaga

SEQ ID NO: 212359 - DNA, 22 bp, Artificial Sequence
  Synthetic oligonucleotide; TTT chr2 60541132 60541153 60541137 60541132 -
tctgtctcctgctgttacagac

SEQ ID NO: 212360 - DNA, 22 bp, Artificial Sequence
  Synthetic oligonucleotide; TTT chr2 60541131 60541152 60541136 60541131 -
ctgtctcctgctgttacagaca

SEQ ID NO: 212361 - DNA, 22 bp, Artificial Sequence
  Synthetic oligonucleotide; TTC chr2 60541130 60541151 60541135 60541130 -
tgtctcctgctgttacagacag

SEQ ID NO: 212362 - DNA, 22 bp, Artificial Sequence
  Synthetic oligonucleotide; CTG chr2 60541128 60541149 60541133 60541128 -
tctcctgctgttacagacagtt

SEQ ID NO: 212363 - DNA, 22 bp, Artificial Sequence
  Synthetic oligonucleotide; CTC chr2 60541124 60541145 60541129 60541124 -
ctgctgttacagacagttaatg

SEQ ID NO: 212364 - DNA, 22 bp, Artificial Sequence
  Synthetic oligonucleotide; CTG chr2 60541121 60541142 60541126 60541121 -
ctgttacagacagttaatgtaa

SEQ ID NO: 212365 - DNA, 22 bp, Artificial Sequence
  Synthetic oligonucleotide; CTG chr2 60541118 60541139 60541123 60541118 -
ttacagacagttaatgtaaaaa

SEQ ID NO: 212366 - DNA, 22 bp, Artificial Sequence
  Synthetic oligonucleotide; TTA chr2 60541115 60541136 60541120 60541115 -
cagacagttaatgtaaaaatgg

SEQ ID NO: 212367 - DNA, 22 bp, Artificial Sequence
  Synthetic oligonucleotide; TTA chr2 60541105 60541126 60541110 60541105 -
atgtaaaaatggccttttattg

SEQ ID NO: 212368 - DNA, 22 bp, Artificial Sequence
  Synthetic oligonucleotide; CTT chr2 60541089 60541110 60541094 60541089 -
ttattggaaacacaaatatgta

SEQ ID NO: 212369 - DNA, 22 bp, Artificial Sequence
  Synthetic oligonucleotide; TTT chr2 60541088 60541109 60541093 60541088 -
tattggaaacacaaatatgtat

SEQ ID NO: 212370 - DNA, 22 bp, Artificial Sequence
  Synthetic oligonucleotide; TTT chr2 60541087 60541108 60541092 60541087 -
attggaaacacaaatatgtatt

SEQ ID NO: 212371 - DNA, 22 bp, Artificial Sequence
  Synthetic oligonucleotide; TTA chr2 60541086 60541107 60541091 60541086 -
ttggaaacacaaatatgtattc

SEQ ID NO: 212372 - DNA, 22 bp, Artificial Sequence
  Synthetic oligonucleotide; TTG chr2 60541083 60541104 60541088 60541083 -
gaaacacaaatatgtattcact

SEQ ID NO: 212373 - DNA, 22 bp, Artificial Sequence
  Synthetic oligonucleotide; TTC chr2 60541064 60541085 60541069 60541064 -
acttcaagaacaggagcagagg

SEQ ID NO: 212374 - DNA, 22 bp, Artificial Sequence
  Synthetic oligonucleotide; CTT chr2 60541060 60541081 60541065 60541060 -
caagaacaggagcagaggggga

SEQ ID NO: 212375 - DNA, 22 bp, Artificial Sequence
  Synthetic oligonucleotide; TTC chr2 60541059 60541080 60541064 60541059 -
aagaacaggagcagagggggac

SEQ ID NO: 212376 - DNA, 22 bp, Artificial Sequence
  Synthetic oligonucleotide; TTT chr2 60541030 60541051 60541035 60541030 -
ccctcccgttctctgtgtttat

SEQ ID NO: 212377 - DNA, 22 bp, Artificial Sequence
  Synthetic oligonucleotide; TTC chr2 60541029 60541050 60541034 60541029 -
cctcccgttctctgtgtttatt

SEQ ID NO: 212378 - DNA, 22 bp, Artificial Sequence
  Synthetic oligonucleotide; CTC chr2 60541025 60541046 60541030 60541025 -
ccgttctctgtgtttattctgt

SEQ ID NO: 212379 - DNA, 22 bp, Artificial Sequence
  Synthetic oligonucleotide; TTC chr2 60541019 60541040 60541024 60541019 -
tctgtgtttattctgtgaaagc

SEQ ID NO: 212380 - DNA, 22 bp, Artificial Sequence
  Synthetic oligonucleotide; CTC chr2 60541017 60541038 60541022 60541017 -
tgtgtttattctgtgaaagctt

SEQ ID NO: 212381 - DNA, 22 bp, Artificial Sequence
  Synthetic oligonucleotide; CTG chr2 60541015 60541036 60541020 60541015 -
tgtttattctgtgaaagcttaa

SEQ ID NO: 212382 - DNA, 22 bp, Artificial Sequence
  Synthetic oligonucleotide; TTT chr2 60541010 60541031 60541015 60541010 -
attctgtgaaagcttaaaaaaa

SEQ ID NO: 212383 - DNA, 22 bp, Artificial Sequence
  Synthetic oligonucleotide; TTA chr2 60541009 60541030 60541014 60541009 -
ttctgtgaaagcttaaaaaaac

SEQ ID NO: 212384 - DNA, 22 bp, Artificial Sequence
  Synthetic oligonucleotide; TTC chr2 60541006 60541027 60541011 60541006 -
tgtgaaagcttaaaaaaacaaa

SEQ ID NO: 212385 - DNA, 22 bp, Artificial Sequence
  Synthetic oligonucleotide; CTG chr2 60541004 60541025 60541009 60541004 -
tgaaagcttaaaaaaacaaaaa

SEQ ID NO: 212386 - DNA, 22 bp, Artificial Sequence
  Synthetic oligonucleotide; CTT chr2 60540995 60541016 60541000 60540995 -
aaaaaaacaaaaaaacaaaata

SEQ ID NO: 212387 - DNA, 22 bp, Artificial Sequence
  Synthetic oligonucleotide; TTA chr2 60540994 60541015 60540999 60540994 -
aaaaaacaaaaaaacaaaataa

SEQ ID NO: 212388 - DNA, 22 bp, Artificial Sequence
  Synthetic oligonucleotide; CTG chr2 60540913 60540934 60540918 60540913 -
taatttcttaaatcaccccatt

SEQ ID NO: 212389 - DNA, 22 bp, Artificial Sequence
  Synthetic oligonucleotide; TTT chr2 60540907 60540928 60540912 60540907 -
cttaaatcaccccattccttgt

SEQ ID NO: 212390 - DNA, 22 bp, Artificial Sequence
  Synthetic oligonucleotide; TTC chr2 60540906 60540927 60540911 60540906 -
ttaaatcaccccattccttgtt

SEQ ID NO: 212391 - DNA, 22 bp, Artificial Sequence
  Synthetic oligonucleotide; CTT chr2 60540904 60540925 60540909 60540904 -
aaatcaccccattccttgttgt

SEQ ID NO: 212392 - DNA, 22 bp, Artificial Sequence
  Synthetic oligonucleotide; TTA chr2 60540903 60540924 60540908 60540903 -
aatcaccccattccttgttgtg

SEQ ID NO: 212393 - DNA, 22 bp, Artificial Sequence
  Synthetic oligonucleotide; TTC chr2 60540890 60540911 60540895 60540890 -
cttgttgtgttgcaagttgtgc

SEQ ID NO: 212394 - DNA, 22 bp, Artificial Sequence
  Synthetic oligonucleotide; CTT chr2 60540887 60540908 60540892 60540887 -
gttgtgttgcaagttgtgcctt

SEQ ID NO: 212395 - DNA, 22 bp, Artificial Sequence
  Synthetic oligonucleotide; TTG chr2 60540886 60540907 60540891 60540886 -
ttgtgttgcaagttgtgccttt

SEQ ID NO: 212396 - DNA, 22 bp, Artificial Sequence
  Synthetic oligonucleotide; TTG chr2 60540883 60540904 60540888 60540883 -
tgttgcaagttgtgcctttact

SEQ ID NO: 212397 - DNA, 22 bp, Artificial Sequence
  Synthetic oligonucleotide; TTG chr2 60540878 60540899 60540883 60540878 -
caagttgtgcctttactataaa

SEQ ID NO: 212398 - DNA, 22 bp, Artificial Sequence
  Synthetic oligonucleotide; TTG chr2 60540871 60540892 60540876 60540871 -
tgcctttactataaaggatctg

SEQ ID NO: 212399 - DNA, 22 bp, Artificial Sequence
  Synthetic oligonucleotide; CTT chr2 60540865 60540886 60540870 60540865 -
tactataaaggatctgaaatat

SEQ ID NO: 212400 - DNA, 22 bp, Artificial Sequence
  Synthetic oligonucleotide; TTT chr2 60540864 60540885 60540869 60540864 -
actataaaggatctgaaatatg

SEQ ID NO: 212401 - DNA, 22 bp, Artificial Sequence
  Synthetic oligonucleotide; TTA chr2 60540863 60540884 60540868 60540863 -
ctataaaggatctgaaatatgt

SEQ ID NO: 212402 - DNA, 22 bp, Artificial Sequence
  Synthetic oligonucleotide; CTA chr2 60540860 60540881 60540865 60540860 -
taaaggatctgaaatatgtttt

SEQ ID NO: 212403 - DNA, 22 bp, Artificial Sequence
  Synthetic oligonucleotide; CTG chr2 60540849 60540870 60540854 60540849 -
aaatatgttttgcacacctttc

SEQ ID NO: 212404 - DNA, 22 bp, Artificial Sequence
  Synthetic oligonucleotide; TTT chr2 60540839 60540860 60540844 60540839 -
tgcacacctttctcttagtgaa

SEQ ID NO: 212405 - DNA, 22 bp, Artificial Sequence
  Synthetic oligonucleotide; TTT chr2 60540838 60540859 60540843 60540838 -
gcacacctttctcttagtgaat

SEQ ID NO: 212406 - DNA, 22 bp, Artificial Sequence
  Synthetic oligonucleotide; TTG chr2 60540837 60540858 60540842 60540837 -
cacacctttctcttagtgaatg

SEQ ID NO: 212407 - DNA, 22 bp, Artificial Sequence
  Synthetic oligonucleotide; CTT chr2 60540829 60540850 60540834 60540829 -
tctcttagtgaatgtggcatat

SEQ ID NO: 212408 - DNA, 22 bp, Artificial Sequence
  Synthetic oligonucleotide; TTT chr2 60540828 60540849 60540833 60540828 -
ctcttagtgaatgtggcatata

SEQ ID NO: 212409 - DNA, 22 bp, Artificial Sequence
  Synthetic oligonucleotide; TTC chr2 60540827 60540848 60540832 60540827 -
tcttagtgaatgtggcatataa

SEQ ID NO: 212410 - DNA, 22 bp, Artificial Sequence
  Synthetic oligonucleotide; CTC chr2 60540825 60540846 60540830 60540825 -
ttagtgaatgtggcatataatt

SEQ ID NO: 212411 - DNA, 22 bp, Artificial Sequence
  Synthetic oligonucleotide; CTT chr2 60540823 60540844 60540828 60540823 -
agtgaatgtggcatataattgt

SEQ ID NO: 212412 - DNA, 22 bp, Artificial Sequence
  Synthetic oligonucleotide; TTA chr2 60540822 60540843 60540827 60540822 -
gtgaatgtggcatataattgtg

SEQ ID NO: 212413 - DNA, 22 bp, Artificial Sequence
  Synthetic oligonucleotide; TTG chr2 60540802 60540823 60540807 60540802 -
tggagctgcacatgggctggaa

SEQ ID NO: 212414 - DNA, 22 bp, Artificial Sequence
  Synthetic oligonucleotide; CTG chr2 60540794 60540815 60540799 60540794 -
cacatgggctggaaaatgcaac

SEQ ID NO: 212415 - DNA, 22 bp, Artificial Sequence
  Synthetic oligonucleotide; CTG chr2 60540783 60540804 60540788 60540783 -
gaaaatgcaactgggtgtagaa

SEQ ID NO: 212416 - DNA, 22 bp, Artificial Sequence
  Synthetic oligonucleotide; CTG chr2 60540770 60540791 60540775 60540770 -
ggtgtagaaacgtgcaggcagg

SEQ ID NO: 212417 - DNA, 22 bp, Artificial Sequence
  Synthetic oligonucleotide; CTT chr2 60540730 60540751 60540735 60540730 -
cagctcagggaggaggcgagtt

SEQ ID NO: 212418 - DNA, 22 bp, Artificial Sequence
  Synthetic oligonucleotide; TTC chr2 60540729 60540750 60540734 60540729 -
agctcagggaggaggcgagttg

SEQ ID NO: 212419 - DNA, 22 bp, Artificial Sequence
  Synthetic oligonucleotide; CTC chr2 60540724 60540745 60540729 60540724 -
agggaggaggcgagttggatgc

SEQ ID NO: 212420 - DNA, 22 bp, Artificial Sequence
  Synthetic oligonucleotide; TTG chr2 60540707 60540728 60540712 60540707 -
gatgcttattaatggcatcttt

SEQ ID NO: 212421 - DNA, 22 bp, Artificial Sequence
  Synthetic oligonucleotide; CTT chr2 60540700 60540721 60540705 60540700 -
attaatggcatcttttagagtc

SEQ ID NO: 212422 - DNA, 22 bp, Artificial Sequence
  Synthetic oligonucleotide; TTA chr2 60540699 60540720 60540704 60540699 -
ttaatggcatcttttagagtcc

SEQ ID NO: 212423 - DNA, 22 bp, Artificial Sequence
  Synthetic oligonucleotide; TTA chr2 60540696 60540717 60540701 60540696 -
atggcatcttttagagtcctgg

SEQ ID NO: 212424 - DNA, 22 bp, Artificial Sequence
  Synthetic oligonucleotide; CTT chr2 60540686 60540707 60540691 60540686 -
ttagagtcctggaaaatcatta

SEQ ID NO: 212425 - DNA, 22 bp, Artificial Sequence
  Synthetic oligonucleotide; TTT chr2 60540685 60540706 60540690 60540685 -
tagagtcctggaaaatcattaa

SEQ ID NO: 212426 - DNA, 22 bp, Artificial Sequence
  Synthetic oligonucleotide; TTT chr2 60540684 60540705 60540689 60540684 -
agagtcctggaaaatcattaat

SEQ ID NO: 212427 - DNA, 22 bp, Artificial Sequence
  Synthetic oligonucleotide; TTA chr2 60540683 60540704 60540688 60540683 -
gagtcctggaaaatcattaatt

SEQ ID NO: 212428 - DNA, 22 bp, Artificial Sequence
  Synthetic oligonucleotide; CTG chr2 60540675 60540696 60540680 60540675 -
gaaaatcattaatttcacactg

SEQ ID NO: 212429 - DNA, 22 bp, Artificial Sequence
  Synthetic oligonucleotide; TTA chr2 60540664 60540685 60540669 60540664 -
atttcacactgcagcttccatg

SEQ ID NO: 212430 - DNA, 22 bp, Artificial Sequence
  Synthetic oligonucleotide; TTT chr2 60540660 60540681 60540665 60540660 -
cacactgcagcttccatgtagt

SEQ ID NO: 212431 - DNA, 22 bp, Artificial Sequence
  Synthetic oligonucleotide; TTC chr2 60540659 60540680 60540664 60540659 -
acactgcagcttccatgtagtt

SEQ ID NO: 212432 - DNA, 22 bp, Artificial Sequence
  Synthetic oligonucleotide; CTG chr2 60540653 60540674 60540658 60540653 -
cagcttccatgtagtttggcta

SEQ ID NO: 212433 - DNA, 22 bp, Artificial Sequence
  Synthetic oligonucleotide; CTT chr2 60540647 60540668 60540652 60540647 -
ccatgtagtttggctaatgtgg

SEQ ID NO: 212434 - DNA, 22 bp, Artificial Sequence
  Synthetic oligonucleotide; TTC chr2 60540646 60540667 60540651 60540646 -
catgtagtttggctaatgtggg

SEQ ID NO: 212435 - DNA, 22 bp, Artificial Sequence
  Synthetic oligonucleotide; TTT chr2 60540636 60540657 60540641 60540636 -
ggctaatgtgggagtactaaat

SEQ ID NO: 212436 - DNA, 22 bp, Artificial Sequence
  Synthetic oligonucleotide; TTG chr2 60540635 60540656 60540640 60540635 -
gctaatgtgggagtactaaatt

SEQ ID NO: 212437 - DNA, 22 bp, Artificial Sequence
  Synthetic oligonucleotide; CTA chr2 60540631 60540652 60540636 60540631 -
atgtgggagtactaaattgggg

SEQ ID NO: 212438 - DNA, 22 bp, Artificial Sequence
  Synthetic oligonucleotide; CTA chr2 60540617 60540638 60540622 60540617 -
aattggggtacataaaaaacat

SEQ ID NO: 212439 - DNA, 22 bp, Artificial Sequence
  Synthetic oligonucleotide; TTG chr2 60540612 60540633 60540617 60540612 -
gggtacataaaaaacatgcaaa

SEQ ID NO: 212440 - DNA, 22 bp, Artificial Sequence
  Synthetic oligonucleotide; CTA chr2 60540585 60540606 60540590 60540585 -
gggaaacattttttagattttt

SEQ ID NO: 212441 - DNA, 22 bp, Artificial Sequence
  Synthetic oligonucleotide; TTT chr2 60540574 60540595 60540579 60540574 -
tttagatttttgtgatttctca

SEQ ID NO: 212442 - DNA, 22 bp, Artificial Sequence
  Synthetic oligonucleotide; TTT chr2 60540573 60540594 60540578 60540573 -
ttagatttttgtgatttctcaa

SEQ ID NO: 212443 - DNA, 22 bp, Artificial Sequence
  Synthetic oligonucleotide; TTT chr2 60540572 60540593 60540577 60540572 -
tagatttttgtgatttctcaat

SEQ ID NO: 212444 - DNA, 22 bp, Artificial Sequence
  Synthetic oligonucleotide; TTT chr2 60540571 60540592 60540576 60540571 -
agatttttgtgatttctcaatg

SEQ ID NO: 212445 - DNA, 22 bp, Artificial Sequence
  Synthetic oligonucleotide; TTA chr2 60540570 60540591 60540575 60540570 -
gatttttgtgatttctcaatga

SEQ ID NO: 212446 - DNA, 22 bp, Artificial Sequence
  Synthetic oligonucleotide; TTT chr2 60540565 60540586 60540570 60540565 -
ttgtgatttctcaatgaaaatg

SEQ ID NO: 212447 - DNA, 22 bp, Artificial Sequence
  Synthetic oligonucleotide; TTT chr2 60540564 60540585 60540569 60540564 -
tgtgatttctcaatgaaaatgt

SEQ ID NO: 212448 - DNA, 22 bp, Artificial Sequence
  Synthetic oligonucleotide; TTT chr2 60540563 60540584 60540568 60540563 -
gtgatttctcaatgaaaatgtt

SEQ ID NO: 212449 - DNA, 22 bp, Artificial Sequence
  Synthetic oligonucleotide; TTG chr2 60540562 60540583 60540567 60540562 -
tgatttctcaatgaaaatgttt

SEQ ID NO: 212450 - DNA, 22 bp, Artificial Sequence
  Synthetic oligonucleotide; TTT chr2 60540556 60540577 60540561 60540556 -
ctcaatgaaaatgtttaataaa

SEQ ID NO: 212451 - DNA, 22 bp, Artificial Sequence
  Synthetic oligonucleotide; TTC chr2 60540555 60540576 60540560 60540555 -
tcaatgaaaatgtttaataaag

SEQ ID NO: 212452 - DNA, 22 bp, Artificial Sequence
  Synthetic oligonucleotide; CTC chr2 60540553 60540574 60540558 60540553 -
aatgaaaatgtttaataaagga

SEQ ID NO: 212453 - DNA, 22 bp, Artificial Sequence
  Synthetic oligonucleotide; TTT chr2 60540540 60540561 60540545 60540540 -
aataaaggagaataggtgaatg

SEQ ID NO: 212454 - DNA, 22 bp, Artificial Sequence
  Synthetic oligonucleotide; TTA chr2 60540539 60540560 60540544 60540539 -
ataaaggagaataggtgaatgg

SEQ ID NO: 212455 - DNA, 22 bp, Artificial Sequence
  Synthetic oligonucleotide; CTT chr2 60540511 60540532 60540516 60540511 -
tgcgtgctggtcagtaagaaag

SEQ ID NO: 212456 - DNA, 22 bp, Artificial Sequence
  Synthetic oligonucleotide; TTT chr2 60540510 60540531 60540515 60540510 -
gcgtgctggtcagtaagaaagg

SEQ ID NO: 212457 - DNA, 22 bp, Artificial Sequence
  Synthetic oligonucleotide; TTG chr2 60540509 60540530 60540514 60540509 -
cgtgctggtcagtaagaaagga

SEQ ID NO: 212458 - DNA, 22 bp, Artificial Sequence
  Synthetic oligonucleotide; CTG chr2 60540502 60540523 60540507 60540502 -
gtcagtaagaaaggaaacaaat

SEQ ID NO: 212459 - DNA, 22 bp, Artificial Sequence
  Synthetic oligonucleotide; TTT chr2 60540478 60540499 60540483 60540478 -
tggctttcctttggggggaaat

SEQ ID NO: 212460 - DNA, 22 bp, Artificial Sequence
  Synthetic oligonucleotide; TTT chr2 60540477 60540498 60540482 60540477 -
ggctttcctttggggggaaata

SEQ ID NO: 212461 - DNA, 22 bp, Artificial Sequence
  Synthetic oligonucleotide; TTG chr2 60540476 60540497 60540481 60540476 -
gctttcctttggggggaaatat

SEQ ID NO: 212462 - DNA, 22 bp, Artificial Sequence
  Synthetic oligonucleotide; CTT chr2 60540472 60540493 60540477 60540472 -
tcctttggggggaaatattaaa

SEQ ID NO: 212463 - DNA, 22 bp, Artificial Sequence
  Synthetic oligonucleotide; TTT chr2 60540471 60540492 60540476 60540471 -
cctttggggggaaatattaaat

SEQ ID NO: 212464 - DNA, 22 bp, Artificial Sequence
  Synthetic oligonucleotide; TTC chr2 60540470 60540491 60540475 60540470 -
ctttggggggaaatattaaatt

SEQ ID NO: 212465 - DNA, 22 bp, Artificial Sequence
  Synthetic oligonucleotide; CTT chr2 60540467 60540488 60540472 60540467 -
tggggggaaatattaaatttaa

SEQ ID NO: 212466 - DNA, 22 bp, Artificial Sequence
  Synthetic oligonucleotide; TTT chr2 60540466 60540487 60540471 60540466 -
ggggggaaatattaaatttaac

SEQ ID NO: 212467 - DNA, 22 bp, Artificial Sequence
  Synthetic oligonucleotide; TTG chr2 60540465 60540486 60540470 60540465 -
gggggaaatattaaatttaacc

SEQ ID NO: 212468 - DNA, 22 bp, Artificial Sequence
  Synthetic oligonucleotide; TTA chr2 60540452 60540473 60540457 60540452 -
aatttaaccgaagtagaaagca

SEQ ID NO: 212469 - DNA, 22 bp, Artificial Sequence
  Synthetic oligonucleotide; TTT chr2 60540447 60540468 60540452 60540447 -
aaccgaagtagaaagcacagct

SEQ ID NO: 212470 - DNA, 22 bp, Artificial Sequence
  Synthetic oligonucleotide; TTA chr2 60540446 60540467 60540451 60540446 -
accgaagtagaaagcacagcta

SEQ ID NO: 212471 - DNA, 22 bp, Artificial Sequence
  Synthetic oligonucleotide; CTA chr2 60540424 60540445 60540429 60540424 -
gggagatgcaccaagattgcgt

SEQ ID NO: 212472 - DNA, 22 bp, Artificial Sequence
  Synthetic oligonucleotide; TTG chr2 60540405 60540426 60540410 60540405 -
cgtcactggatgttaatttaat

SEQ ID NO: 212473 - DNA, 22 bp, Artificial Sequence
  Synthetic oligonucleotide; CTG chr2 60540397 60540418 60540402 60540397 -
gatgttaatttaatctactttg

SEQ ID NO: 212474 - DNA, 22 bp, Artificial Sequence
  Synthetic oligonucleotide; TTA chr2 60540390 60540411 60540395 60540390 -
atttaatctactttggttggtc

SEQ ID NO: 212475 - DNA, 22 bp, Artificial Sequence
  Synthetic oligonucleotide; TTT chr2 60540386 60540407 60540391 60540386 -
aatctactttggttggtctgtt

SEQ ID NO: 212476 - DNA, 22 bp, Artificial Sequence
  Synthetic oligonucleotide; TTA chr2 60540385 60540406 60540390 60540385 -
atctactttggttggtctgttc

SEQ ID NO: 212477 - DNA, 22 bp, Artificial Sequence
  Synthetic oligonucleotide; CTA chr2 60540380 60540401 60540385 60540380 -
ctttggttggtctgttcacacc

SEQ ID NO: 212478 - DNA, 22 bp, Artificial Sequence
  Synthetic oligonucleotide; CTT chr2 60540377 60540398 60540382 60540377 -
tggttggtctgttcacaccctt

SEQ ID NO: 212479 - DNA, 22 bp, Artificial Sequence
  Synthetic oligonucleotide; TTT chr2 60540376 60540397 60540381 60540376 -
ggttggtctgttcacacccttt

SEQ ID NO: 212480 - DNA, 22 bp, Artificial Sequence
  Synthetic oligonucleotide; TTG chr2 60540375 60540396 60540380 60540375 -
gttggtctgttcacacccttta

SEQ ID NO: 212481 - DNA, 22 bp, Artificial Sequence
  Synthetic oligonucleotide; TTG chr2 60540371 60540392 60540376 60540371 -
gtctgttcacaccctttattgc

SEQ ID NO: 212482 - DNA, 22 bp, Artificial Sequence
  Synthetic oligonucleotide; CTG chr2 60540366 60540387 60540371 60540366 -
ttcacaccctttattgcacaaa

SEQ ID NO: 212483 - DNA, 22 bp, Artificial Sequence
  Synthetic oligonucleotide; TTC chr2 60540363 60540384 60540368 60540363 -
acaccctttattgcacaaagaa

SEQ ID NO: 212484 - DNA, 22 bp, Artificial Sequence
  Synthetic oligonucleotide; CTT chr2 60540355 60540376 60540360 60540355 -
tattgcacaaagaagtcatttg

SEQ ID NO: 212485 - DNA, 22 bp, Artificial Sequence
  Synthetic oligonucleotide; TTT chr2 60540354 60540375 60540359 60540354 -
attgcacaaagaagtcatttga

SEQ ID NO: 212486 - DNA, 22 bp, Artificial Sequence
  Synthetic oligonucleotide; TTA chr2 60540353 60540374 60540358 60540353 -
ttgcacaaagaagtcatttgac

SEQ ID NO: 212487 - DNA, 22 bp, Artificial Sequence
  Synthetic oligonucleotide; TTG chr2 60540350 60540371 60540355 60540350 -
cacaaagaagtcatttgacaaa

SEQ ID NO: 212488 - DNA, 22 bp, Artificial Sequence
  Synthetic oligonucleotide; TTT chr2 60540334 60540355 60540339 60540334 -
gacaaaatttaccccaagccca

SEQ ID NO: 212489 - DNA, 22 bp, Artificial Sequence
  Synthetic oligonucleotide; TTG chr2 60540333 60540354 60540338 60540333 -
acaaaatttaccccaagcccaa

SEQ ID NO: 212490 - DNA, 22 bp, Artificial Sequence
  Synthetic oligonucleotide; TTT chr2 60540324 60540345 60540329 60540324 -
accccaagcccaagtctgtttt

SEQ ID NO: 212491 - DNA, 22 bp, Artificial Sequence
  Synthetic oligonucleotide; TTA chr2 60540323 60540344 60540328 60540323 -
ccccaagcccaagtctgttttt

SEQ ID NO: 212492 - DNA, 22 bp, Artificial Sequence
  Synthetic oligonucleotide; CTG chr2 60540306 60540327 60540311 60540306 -
tttttacatacagtagtaccag

SEQ ID NO: 212493 - DNA, 22 bp, Artificial Sequence
  Synthetic oligonucleotide; TTT chr2 60540303 60540324 60540308 60540303 -
ttacatacagtagtaccagctt

SEQ ID NO: 212494 - DNA, 22 bp, Artificial Sequence
  Synthetic oligonucleotide; TTT chr2 60540302 60540323 60540307 60540302 -
tacatacagtagtaccagcttt

SEQ ID NO: 212495 - DNA, 22 bp, Artificial Sequence
  Synthetic oligonucleotide; TTT chr2 60540301 60540322 60540306 60540301 -
acatacagtagtaccagctttg

SEQ ID NO: 212496 - DNA, 22 bp, Artificial Sequence
  Synthetic oligonucleotide; TTA chr2 60540300 60540321 60540305 60540300 -
catacagtagtaccagctttgt

SEQ ID NO: 212497 - DNA, 22 bp, Artificial Sequence
  Synthetic oligonucleotide; CTT chr2 60540281 60540302 60540286 60540281 -
tgtgcaataaaaagcacttagc

SEQ ID NO: 212498 - DNA, 22 bp, Artificial Sequence
  Synthetic oligonucleotide; TTT chr2 60540280 60540301 60540285 60540280 -
gtgcaataaaaagcacttagca

SEQ ID NO: 212499 - DNA, 22 bp, Artificial Sequence
  Synthetic oligonucleotide; TTG chr2 60540279 60540300 60540284 60540279 -
tgcaataaaaagcacttagcat

SEQ ID NO: 212500 - DNA, 22 bp, Artificial Sequence
  Synthetic oligonucleotide; CTT chr2 60540262 60540283 60540267 60540262 -
agcatcaagctggacccagcct

SEQ ID NO: 212501 - DNA, 22 bp, Artificial Sequence
  Synthetic oligonucleotide; TTA chr2 60540261 60540282 60540266 60540261 -
gcatcaagctggacccagcctg

SEQ ID NO: 212502 - DNA, 22 bp, Artificial Sequence
  Synthetic oligonucleotide; CTG chr2 60540250 60540271 60540255 60540250 -
gacccagcctggcaccttgcca

SEQ ID NO: 212503 - DNA, 22 bp, Artificial Sequence
  Synthetic oligonucleotide; CTG chr2 60540239 60540260 60540244 60540239 -
gcaccttgccacttttttagca

SEQ ID NO: 212504 - DNA, 22 bp, Artificial Sequence
  Synthetic oligonucleotide; CTT chr2 60540232 60540253 60540237 60540232 -
gccacttttttagcatgagatt

SEQ ID NO: 212505 - DNA, 22 bp, Artificial Sequence
  Synthetic oligonucleotide; TTG chr2 60540231 60540252 60540236 60540231 -
ccacttttttagcatgagattt

SEQ ID NO: 212506 - DNA, 22 bp, Artificial Sequence
  Synthetic oligonucleotide; CTT chr2 60540225 60540246 60540230 60540225 -
ttttagcatgagatttaatcac

SEQ ID NO: 212507 - DNA, 22 bp, Artificial Sequence
  Synthetic oligonucleotide; TTT chr2 60540224 60540245 60540229 60540224 -
tttagcatgagatttaatcacc

SEQ ID NO: 212508 - DNA, 22 bp, Artificial Sequence
  Synthetic oligonucleotide; TTT chr2 60540223 60540244 60540228 60540223 -
ttagcatgagatttaatcacca

SEQ ID NO: 212509 - DNA, 22 bp, Artificial Sequence
  Synthetic oligonucleotide; TTT chr2 60540222 60540243 60540227 60540222 -
tagcatgagatttaatcaccaa

SEQ ID NO: 212510 - DNA, 22 bp, Artificial Sequence
  Synthetic oligonucleotide; TTT chr2 60540221 60540242 60540226 60540221 -
agcatgagatttaatcaccaag

SEQ ID NO: 212511 - DNA, 22 bp, Artificial Sequence
  Synthetic oligonucleotide; TTA chr2 60540220 60540241 60540225 60540220 -
gcatgagatttaatcaccaagc

SEQ ID NO: 212512 - DNA, 22 bp, Artificial Sequence
  Synthetic oligonucleotide; TTT chr2 60540209 60540230 60540214 60540209 -
aatcaccaagcatctttagtac

SEQ ID NO: 212513 - DNA, 22 bp, Artificial Sequence
  Synthetic oligonucleotide; TTA chr2 60540208 60540229 60540213 60540208 -
atcaccaagcatctttagtacc

SEQ ID NO: 212514 - DNA, 22 bp, Artificial Sequence
  Synthetic oligonucleotide; CTT chr2 60540193 60540214 60540198 60540193 -
tagtacctttctgcttgttcag

SEQ ID NO: 212515 - DNA, 22 bp, Artificial Sequence
  Synthetic oligonucleotide; TTT chr2 60540192 60540213 60540197 60540192 -
agtacctttctgcttgttcaga

SEQ ID NO: 212516 - DNA, 22 bp, Artificial Sequence
  Synthetic oligonucleotide; TTA chr2 60540191 60540212 60540196 60540191 -
gtacctttctgcttgttcagat

SEQ ID NO: 212517 - DNA, 22 bp, Artificial Sequence
  Synthetic oligonucleotide; CTT chr2 60540184 60540205 60540189 60540184 -
tctgcttgttcagatttcattt

SEQ ID NO: 212518 - DNA, 22 bp, Artificial Sequence
  Synthetic oligonucleotide; TTT chr2 60540183 60540204 60540188 60540183 -
ctgcttgttcagatttcatttg

SEQ ID NO: 212519 - DNA, 22 bp, Artificial Sequence
  Synthetic oligonucleotide; TTC chr2 60540182 60540203 60540187 60540182 -
tgcttgttcagatttcatttgg

SEQ ID NO: 212520 - DNA, 22 bp, Artificial Sequence
  Synthetic oligonucleotide; CTG chr2 60540180 60540201 60540185 60540180 -
cttgttcagatttcatttgggt

SEQ ID NO: 212521 - DNA, 22 bp, Artificial Sequence
  Synthetic oligonucleotide; CTT chr2 60540177 60540198 60540182 60540177 -
gttcagatttcatttgggtcat

SEQ ID NO: 212522 - DNA, 22 bp, Artificial Sequence
  Synthetic oligonucleotide; TTG chr2 60540176 60540197 60540181 60540176 -
ttcagatttcatttgggtcatg

SEQ ID NO: 212523 - DNA, 22 bp, Artificial Sequence
  Synthetic oligonucleotide; TTC chr2 60540173 60540194 60540178 60540173 -
agatttcatttgggtcatggct

SEQ ID NO: 212524 - DNA, 22 bp, Artificial Sequence
  Synthetic oligonucleotide; TTT chr2 60540167 60540188 60540172 60540167 -
catttgggtcatggctatgtca

SEQ ID NO: 212525 - DNA, 22 bp, Artificial Sequence
  Synthetic oligonucleotide; TTC chr2 60540166 60540187 60540171 60540166 -
atttgggtcatggctatgtcag

SEQ ID NO: 212526 - DNA, 22 bp, Artificial Sequence
  Synthetic oligonucleotide; TTT chr2 60540162 60540183 60540167 60540162 -
gggtcatggctatgtcagcagt

SEQ ID NO: 212527 - DNA, 22 bp, Artificial Sequence
  Synthetic oligonucleotide; TTG chr2 60540161 60540182 60540166 60540161 -
ggtcatggctatgtcagcagtg

SEQ ID NO: 212528 - DNA, 22 bp, Artificial Sequence
  Synthetic oligonucleotide; CTA chr2 60540150 60540171 60540155 60540150 -
tgtcagcagtgttgttatttca

SEQ ID NO: 212529 - DNA, 22 bp, Artificial Sequence
  Synthetic oligonucleotide; TTG chr2 60540136 60540157 60540141 60540136 -
ttatttcaaggattaaaaaaaa

SEQ ID NO: 212530 - DNA, 22 bp, Artificial Sequence
  Synthetic oligonucleotide; TTA chr2 60540133 60540154 60540138 60540133 -
tttcaaggattaaaaaaaaaga

SEQ ID NO: 212531 - DNA, 22 bp, Artificial Sequence
  Synthetic oligonucleotide; TTT chr2 60540130 60540151 60540135 60540130 -
caaggattaaaaaaaaagattc

SEQ ID NO: 212532 - DNA, 22 bp, Artificial Sequence
  Synthetic oligonucleotide; TTC chr2 60540129 60540150 60540134 60540129 -
aaggattaaaaaaaaagattct

SEQ ID NO: 212533 - DNA, 22 bp, Artificial Sequence
  Synthetic oligonucleotide; TTA chr2 60540121 60540142 60540126 60540121 -
aaaaaaaagattctaacttaga

SEQ ID NO: 212534 - DNA, 22 bp, Artificial Sequence
  Synthetic oligonucleotide; TTC chr2 60540108 60540129 60540113 60540108 -
taacttagagcccacttttaac

SEQ ID NO: 212535 - DNA, 22 bp, Artificial Sequence
  Synthetic oligonucleotide; CTA chr2 60540106 60540127 60540111 60540106 -
acttagagcccacttttaacat

SEQ ID NO: 212536 - DNA, 22 bp, Artificial Sequence
  Synthetic oligonucleotide; CTT chr2 60540102 60540123 60540107 60540102 -
agagcccacttttaacattatt

SEQ ID NO: 212537 - DNA, 22 bp, Artificial Sequence
  Synthetic oligonucleotide; TTA chr2 60540101 60540122 60540106 60540101 -
gagcccacttttaacattattt

SEQ ID NO: 212538 - DNA, 22 bp, Artificial Sequence
  Synthetic oligonucleotide; CTT chr2 60540091 60540112 60540096 60540091 -
ttaacattatttcaaatcaagc

SEQ ID NO: 212539 - DNA, 22 bp, Artificial Sequence
  Synthetic oligonucleotide; TTT chr2 60540090 60540111 60540095 60540090 -
taacattatttcaaatcaagca

SEQ ID NO: 212540 - DNA, 22 bp, Artificial Sequence
  Synthetic oligonucleotide; TTT chr2 60540089 60540110 60540094 60540089 -
aacattatttcaaatcaagcag

SEQ ID NO: 212541 - DNA, 22 bp, Artificial Sequence
  Synthetic oligonucleotide; TTA chr2 60540088 60540109 60540093 60540088 -
acattatttcaaatcaagcagg

SEQ ID NO: 212542 - DNA, 22 bp, Artificial Sequence
  Synthetic oligonucleotide; TTA chr2 60540082 60540103 60540087 60540082 -
tttcaaatcaagcaggttttta

SEQ ID NO: 212543 - DNA, 22 bp, Artificial Sequence
  Synthetic oligonucleotide; TTT chr2 60540079 60540100 60540084 60540079 -
caaatcaagcaggtttttatgt

SEQ ID NO: 212544 - DNA, 22 bp, Artificial Sequence
  Synthetic oligonucleotide; TTC chr2 60540078 60540099 60540083 60540078 -
aaatcaagcaggtttttatgtt

SEQ ID NO: 212545 - DNA, 22 bp, Artificial Sequence
  Synthetic oligonucleotide; TTT chr2 60540063 60540084 60540068 60540063 -
ttatgttatgtatcaatttgga

SEQ ID NO: 212546 - DNA, 22 bp, Artificial Sequence
  Synthetic oligonucleotide; TTT chr2 60540062 60540083 60540067 60540062 -
tatgttatgtatcaatttggat

SEQ ID NO: 212547 - DNA, 22 bp, Artificial Sequence
  Synthetic oligonucleotide; TTT chr2 60540061 60540082 60540066 60540061 -
atgttatgtatcaatttggatg

SEQ ID NO: 212548 - DNA, 22 bp, Artificial Sequence
  Synthetic oligonucleotide; TTA chr2 60540060 60540081 60540065 60540060 -
tgttatgtatcaatttggatga

SEQ ID NO: 212549 - DNA, 22 bp, Artificial Sequence
  Synthetic oligonucleotide; TTA chr2 60540055 60540076 60540060 60540055 -
tgtatcaatttggatgacatta

SEQ ID NO: 212550 - DNA, 22 bp, Artificial Sequence
  Synthetic oligonucleotide; TTT chr2 60540044 60540065 60540049 60540044 -
ggatgacattaatgaagttcat

SEQ ID NO: 212551 - DNA, 22 bp, Artificial Sequence
  Synthetic oligonucleotide; TTG chr2 60540043 60540064 60540048 60540043 -
gatgacattaatgaagttcata

SEQ ID NO: 212552 - DNA, 22 bp, Artificial Sequence
  Synthetic oligonucleotide; TTA chr2 60540033 60540054 60540038 60540033 -
atgaagttcataaaatatgttc

SEQ ID NO: 212553 - DNA, 22 bp, Artificial Sequence
  Synthetic oligonucleotide; TTC chr2 60540024 60540045 60540029 60540024 -
ataaaatatgttcagactatat

SEQ ID NO: 212554 - DNA, 22 bp, Artificial Sequence
  Synthetic oligonucleotide; TTC chr2 60540011 60540032 60540016 60540011 -
agactatataatttaatggata

SEQ ID NO: 212555 - DNA, 22 bp, Artificial Sequence
  Synthetic oligonucleotide; CTA chr2 60540005 60540026 60540010 60540005 -
tataatttaatggataatgact

SEQ ID NO: 212556 - DNA, 22 bp, Artificial Sequence
  Synthetic oligonucleotide; TTT chr2 60539997 60540018 60540002 60539997 -
aatggataatgactactatttt

SEQ ID NO: 212557 - DNA, 22 bp, Artificial Sequence
  Synthetic oligonucleotide; TTA chr2 60539996 60540017 60540001 60539996 -
atggataatgactactattttt

SEQ ID NO: 212558 - DNA, 22 bp, Artificial Sequence
  Synthetic oligonucleotide; CTA chr2 60539982 60540003 60539987 60539982 -
ctatttttatttgtaatacaaa

SEQ ID NO: 212559 - DNA, 22 bp, Artificial Sequence
  Synthetic oligonucleotide; CTA chr2 60539979 60540000 60539984 60539979 -
tttttatttgtaatacaaatag

SEQ ID NO: 212560 - DNA, 22 bp, Artificial Sequence
  Synthetic oligonucleotide; TTT chr2 60539976 60539997 60539981 60539976 -
ttatttgtaatacaaataggaa

SEQ ID NO: 212561 - DNA, 22 bp, Artificial Sequence
  Synthetic oligonucleotide; TTT chr2 60539975 60539996 60539980 60539975 -
tatttgtaatacaaataggaaa

SEQ ID NO: 212562 - DNA, 22 bp, Artificial Sequence
  Synthetic oligonucleotide; TTT chr2 60539974 60539995 60539979 60539974 -
atttgtaatacaaataggaaat

SEQ ID NO: 212563 - DNA, 22 bp, Artificial Sequence
  Synthetic oligonucleotide; TTA chr2 60539973 60539994 60539978 60539973 -
tttgtaatacaaataggaaatt

SEQ ID NO: 212564 - DNA, 22 bp, Artificial Sequence
  Synthetic oligonucleotide; TTT chr2 60539970 60539991 60539975 60539970 -
gtaatacaaataggaaattgac

SEQ ID NO: 212565 - DNA, 22 bp, Artificial Sequence
  Synthetic oligonucleotide; TTG chr2 60539969 60539990 60539974 60539969 -
taatacaaataggaaattgact

SEQ ID NO: 212566 - DNA, 22 bp, Artificial Sequence
  Synthetic oligonucleotide; TTG chr2 60539950 60539971 60539955 60539950 -
actgttgtctccctccctcctt

SEQ ID NO: 212567 - DNA, 22 bp, Artificial Sequence
  Synthetic oligonucleotide; CTG chr2 60539946 60539967 60539951 60539946 -
ttgtctccctccctccttggtt

SEQ ID NO: 212568 - DNA, 22 bp, Artificial Sequence
  Synthetic oligonucleotide; TTG chr2 60539943 60539964 60539948 60539943 -
tctccctccctccttggttctt

SEQ ID NO: 212569 - DNA, 22 bp, Artificial Sequence
  Synthetic oligonucleotide; CTC chr2 60539939 60539960 60539944 60539939 -
cctccctccttggttcttttct

SEQ ID NO: 212570 - DNA, 22 bp, Artificial Sequence
  Synthetic oligonucleotide; CTC chr2 60539935 60539956 60539940 60539935 -
cctccttggttcttttctccta

SEQ ID NO: 212571 - DNA, 22 bp, Artificial Sequence
  Synthetic oligonucleotide; CTC chr2 60539931 60539952 60539936 60539931 -
cttggttcttttctcctaccta

SEQ ID NO: 212572 - DNA, 22 bp, Artificial Sequence
  Synthetic oligonucleotide; CTT chr2 60539928 60539949 60539933 60539928 -
ggttcttttctcctacctaggt

SEQ ID NO: 212573 - DNA, 22 bp, Artificial Sequence
  Synthetic oligonucleotide; TTG chr2 60539927 60539948 60539932 60539927 -
gttcttttctcctacctaggta

SEQ ID NO: 212574 - DNA, 22 bp, Artificial Sequence
  Synthetic oligonucleotide; TTC chr2 60539923 60539944 60539928 60539923 -
ttttctcctacctaggtaaatg

SEQ ID NO: 212575 - DNA, 22 bp, Artificial Sequence
  Synthetic oligonucleotide; CTT chr2 60539921 60539942 60539926 60539921 -
ttctcctacctaggtaaatggg

SEQ ID NO: 212576 - DNA, 22 bp, Artificial Sequence
  Synthetic oligonucleotide; TTT chr2 60539920 60539941 60539925 60539920 -
tctcctacctaggtaaatgggc

SEQ ID NO: 212577 - DNA, 22 bp, Artificial Sequence
  Synthetic oligonucleotide; TTT chr2 60539919 60539940 60539924 60539919 -
ctcctacctaggtaaatgggca

SEQ ID NO: 212578 - DNA, 22 bp, Artificial Sequence
  Synthetic oligonucleotide; TTC chr2 60539918 60539939 60539923 60539918 -
tcctacctaggtaaatgggcat

SEQ ID NO: 212579 - DNA, 22 bp, Artificial Sequence
  Synthetic oligonucleotide; CTC chr2 60539916 60539937 60539921 60539916 -
ctacctaggtaaatgggcatcc

SEQ ID NO: 212580 - DNA, 22 bp, Artificial Sequence
  Synthetic oligonucleotide; CTA chr2 60539913 60539934 60539918 60539913 -
cctaggtaaatgggcatcctta

SEQ ID NO: 212581 - DNA, 22 bp, Artificial Sequence
  Synthetic oligonucleotide; CTA chr2 60539909 60539930 60539914 60539909 -
ggtaaatgggcatccttaaaca

SEQ ID NO: 212582 - DNA, 22 bp, Artificial Sequence
  Synthetic oligonucleotide; CTT chr2 60539892 60539913 60539897 60539892 -
aaacagcttctcccctttacga

SEQ ID NO: 212583 - DNA, 22 bp, Artificial Sequence
  Synthetic oligonucleotide; TTA chr2 60539891 60539912 60539896 60539891 -
aacagcttctcccctttacgac

SEQ ID NO: 212584 - DNA, 22 bp, Artificial Sequence
  Synthetic oligonucleotide; CTT chr2 60539883 60539904 60539888 60539883 -
ctcccctttacgaccagggtat

SEQ ID NO: 212585 - DNA, 22 bp, Artificial Sequence
  Synthetic oligonucleotide; TTC chr2 60539882 60539903 60539887 60539882 -
tcccctttacgaccagggtata

SEQ ID NO: 212586 - DNA, 22 bp, Artificial Sequence
  Synthetic oligonucleotide; CTC chr2 60539880 60539901 60539885 60539880 -
ccctttacgaccagggtataga

SEQ ID NO: 212587 - DNA, 22 bp, Artificial Sequence
  Synthetic oligonucleotide; CTT chr2 60539875 60539896 60539880 60539875 -
tacgaccagggtatagagcact

SEQ ID NO: 212588 - DNA, 22 bp, Artificial Sequence
  Synthetic oligonucleotide; TTT chr2 60539874 60539895 60539879 60539874 -
acgaccagggtatagagcactg

SEQ ID NO: 212589 - DNA, 22 bp, Artificial Sequence
  Synthetic oligonucleotide; TTA chr2 60539873 60539894 60539878 60539873 -
cgaccagggtatagagcactgg

SEQ ID NO: 212590 - DNA, 22 bp, Artificial Sequence
  Synthetic oligonucleotide; CTG chr2 60539852 60539873 60539857 60539852 -
gccaatatcagtaaatttacct

SEQ ID NO: 212591 - DNA, 22 bp, Artificial Sequence
  Synthetic oligonucleotide; TTT chr2 60539834 60539855 60539839 60539834 -
acctttgtaatttgccacgtag

SEQ ID NO: 212592 - DNA, 22 bp, Artificial Sequence
  Synthetic oligonucleotide; TTA chr2 60539833 60539854 60539838 60539833 -
cctttgtaatttgccacgtagt

SEQ ID NO: 212593 - DNA, 22 bp, Artificial Sequence
  Synthetic oligonucleotide; CTT chr2 60539829 60539850 60539834 60539829 -
tgtaatttgccacgtagttttt

SEQ ID NO: 212594 - DNA, 22 bp, Artificial Sequence
  Synthetic oligonucleotide; TTT chr2 60539828 60539849 60539833 60539828 -
gtaatttgccacgtagttttta

SEQ ID NO: 212595 - DNA, 22 bp, Artificial Sequence
  Synthetic oligonucleotide; TTG chr2 60539827 60539848 60539832 60539827 -
taatttgccacgtagtttttac

SEQ ID NO: 212596 - DNA, 22 bp, Artificial Sequence
  Synthetic oligonucleotide; TTT chr2 60539821 60539842 60539826 60539821 -
gccacgtagtttttacaacatg

SEQ ID NO: 212597 - DNA, 22 bp, Artificial Sequence
  Synthetic oligonucleotide; TTG chr2 60539820 60539841 60539825 60539820 -
ccacgtagtttttacaacatga

SEQ ID NO: 212598 - DNA, 22 bp, Artificial Sequence
  Synthetic oligonucleotide; TTT chr2 60539809 60539830 60539814 60539809 -
ttacaacatgacctaattaatt

SEQ ID NO: 212599 - DNA, 22 bp, Artificial Sequence
  Synthetic oligonucleotide; TTT chr2 60539808 60539829 60539813 60539808 -
tacaacatgacctaattaattt

SEQ ID NO: 212600 - DNA, 22 bp, Artificial Sequence
  Synthetic oligonucleotide; TTT chr2 60539807 60539828 60539812 60539807 -
acaacatgacctaattaatttg

SEQ ID NO: 212601 - DNA, 22 bp, Artificial Sequence
  Synthetic oligonucleotide; TTA chr2 60539806 60539827 60539811 60539806 -
caacatgacctaattaatttga

SEQ ID NO: 212602 - DNA, 22 bp, Artificial Sequence
  Synthetic oligonucleotide; CTA chr2 60539794 60539815 60539799 60539794 -
attaatttgagcacgaaccata

SEQ ID NO: 212603 - DNA, 22 bp, Artificial Sequence
  Synthetic oligonucleotide; TTA chr2 60539790 60539811 60539795 60539790 -
atttgagcacgaaccatattat

SEQ ID NO: 212604 - DNA, 22 bp, Artificial Sequence
  Synthetic oligonucleotide; TTT chr2 60539786 60539807 60539791 60539786 -
gagcacgaaccatattattgct

SEQ ID NO: 212605 - DNA, 22 bp, Artificial Sequence
  Synthetic oligonucleotide; TTG chr2 60539785 60539806 60539790 60539785 -
agcacgaaccatattattgcta

SEQ ID NO: 212606 - DNA, 22 bp, Artificial Sequence
  Synthetic oligonucleotide; TTA chr2 60539769 60539790 60539774 60539769 -
ttgctactggagtcattttctg

SEQ ID NO: 212607 - DNA, 22 bp, Artificial Sequence
  Synthetic oligonucleotide; TTG chr2 60539766 60539787 60539771 60539766 -
ctactggagtcattttctgtca

SEQ ID NO: 212608 - DNA, 22 bp, Artificial Sequence
  Synthetic oligonucleotide; CTA chr2 60539763 60539784 60539768 60539763 -
ctggagtcattttctgtcacaa

SEQ ID NO: 212609 - DNA, 22 bp, Artificial Sequence
  Synthetic oligonucleotide; CTG chr2 60539760 60539781 60539765 60539760 -
gagtcattttctgtcacaaact

SEQ ID NO: 212610 - DNA, 22 bp, Artificial Sequence
  Synthetic oligonucleotide; TTT chr2 60539751 60539772 60539756 60539751 -
tctgtcacaaacttaatttcca

SEQ ID NO: 212611 - DNA, 22 bp, Artificial Sequence
  Synthetic oligonucleotide; TTT chr2 60539750 60539771 60539755 60539750 -
ctgtcacaaacttaatttccag

SEQ ID NO: 212612 - DNA, 22 bp, Artificial Sequence
  Synthetic oligonucleotide; TTC chr2 60539749 60539770 60539754 60539749 -
tgtcacaaacttaatttccagg

SEQ ID NO: 212613 - DNA, 22 bp, Artificial Sequence
  Synthetic oligonucleotide; CTG chr2 60539747 60539768 60539752 60539747 -
tcacaaacttaatttccaggaa

SEQ ID NO: 212614 - DNA, 22 bp, Artificial Sequence
  Synthetic oligonucleotide; CTT chr2 60539737 60539758 60539742 60539737 -
aatttccaggaaatgtaacctg

SEQ ID NO: 212615 - DNA, 22 bp, Artificial Sequence
  Synthetic oligonucleotide; TTA chr2 60539736 60539757 60539741 60539736 -
atttccaggaaatgtaacctga

SEQ ID NO: 212616 - DNA, 22 bp, Artificial Sequence
  Synthetic oligonucleotide; TTT chr2 60539732 60539753 60539737 60539732 -
ccaggaaatgtaacctgacaaa

SEQ ID NO: 212617 - DNA, 22 bp, Artificial Sequence
  Synthetic oligonucleotide; TTC chr2 60539731 60539752 60539736 60539731 -
caggaaatgtaacctgacaaat

SEQ ID NO: 212618 - DNA, 22 bp, Artificial Sequence
  Synthetic oligonucleotide; CTG chr2 60539715 60539736 60539720 60539715 -
acaaataagaattctttagctc

SEQ ID NO: 212619 - DNA, 22 bp, Artificial Sequence
  Synthetic oligonucleotide; TTC chr2 60539701 60539722 60539706 60539701 -
tttagctctctacatgtgctcc

SEQ ID NO: 212620 - DNA, 22 bp, Artificial Sequence
  Synthetic oligonucleotide; CTT chr2 60539699 60539720 60539704 60539699 -
tagctctctacatgtgctccta

SEQ ID NO: 212621 - DNA, 22 bp, Artificial Sequence
  Synthetic oligonucleotide; TTT chr2 60539698 60539719 60539703 60539698 -
agctctctacatgtgctcctag

SEQ ID NO: 212622 - DNA, 22 bp, Artificial Sequence
  Synthetic oligonucleotide; TTA chr2 60539697 60539718 60539702 60539697 -
gctctctacatgtgctcctaga

SEQ ID NO: 212623 - DNA, 22 bp, Artificial Sequence
  Synthetic oligonucleotide; CTC chr2 60539693 60539714 60539698 60539693 -
tctacatgtgctcctagagacc

SEQ ID NO: 212624 - DNA, 22 bp, Artificial Sequence
  Synthetic oligonucleotide; CTC chr2 60539691 60539712 60539696 60539691 -
tacatgtgctcctagagaccaa

SEQ ID NO: 212625 - DNA, 22 bp, Artificial Sequence
  Synthetic oligonucleotide; CTA chr2 60539689 60539710 60539694 60539689 -
catgtgctcctagagaccaaag

SEQ ID NO: 212626 - DNA, 22 bp, Artificial Sequence
  Synthetic oligonucleotide; CTC chr2 60539680 60539701 60539685 60539680 -
ctagagaccaaaggcagattta

SEQ ID NO: 212627 - DNA, 22 bp, Artificial Sequence
  Synthetic oligonucleotide; CTA chr2 60539677 60539698 60539682 60539677 -
gagaccaaaggcagatttaaaa

SEQ ID NO: 212628 - DNA, 22 bp, Artificial Sequence
  Synthetic oligonucleotide; TTT chr2 60539659 60539680 60539664 60539659 -
aaaataataataattttaaaag

SEQ ID NO: 212629 - DNA, 22 bp, Artificial Sequence
  Synthetic oligonucleotide; TTA chr2 60539658 60539679 60539663 60539658 -
aaataataataattttaaaagt

SEQ ID NO: 212630 - DNA, 22 bp, Artificial Sequence
  Synthetic oligonucleotide; TTT chr2 60539643 60539664 60539648 60539643 -
taaaagtgccagcattattaaa

SEQ ID NO: 212631 - DNA, 22 bp, Artificial Sequence
  Synthetic oligonucleotide; TTT chr2 60539642 60539663 60539647 60539642 -
aaaagtgccagcattattaaag

SEQ ID NO: 212632 - DNA, 22 bp, Artificial Sequence
  Synthetic oligonucleotide; TTA chr2 60539641 60539662 60539646 60539641 -
aaagtgccagcattattaaagc

SEQ ID NO: 212633 - DNA, 22 bp, Artificial Sequence
  Synthetic oligonucleotide; TTA chr2 60539626 60539647 60539631 60539626 -
ttaaagccagtatacttgatgc

SEQ ID NO: 212634 - DNA, 22 bp, Artificial Sequence
  Synthetic oligonucleotide; TTA chr2 60539623 60539644 60539628 60539623 -
aagccagtatacttgatgccaa

SEQ ID NO: 212635 - DNA, 22 bp, Artificial Sequence
  Synthetic oligonucleotide; CTT chr2 60539609 60539630 60539614 60539609 -
gatgccaaactcaatttgaagc

SEQ ID NO: 212636 - DNA, 22 bp, Artificial Sequence
  Synthetic oligonucleotide; TTG chr2 60539608 60539629 60539613 60539608 -
atgccaaactcaatttgaagcc

SEQ ID NO: 212637 - DNA, 22 bp, Artificial Sequence
  Synthetic oligonucleotide; CTC chr2 60539597 60539618 60539602 60539597 -
aatttgaagccagtaaacatca

SEQ ID NO: 212638 - DNA, 22 bp, Artificial Sequence
  Synthetic oligonucleotide; TTT chr2 60539592 60539613 60539597 60539592 -
gaagccagtaaacatcagactg

SEQ ID NO: 212639 - DNA, 22 bp, Artificial Sequence
  Synthetic oligonucleotide; TTG chr2 60539591 60539612 60539596 60539591 -
aagccagtaaacatcagactgt

SEQ ID NO: 212640 - DNA, 22 bp, Artificial Sequence
  Synthetic oligonucleotide; CTG chr2 60539570 60539591 60539575 60539570 -
tatttctaatcagttttaaaat

SEQ ID NO: 212641 - DNA, 22 bp, Artificial Sequence
  Synthetic oligonucleotide; TTT chr2 60539565 60539586 60539570 60539565 -
ctaatcagttttaaaatgtaac

SEQ ID NO: 212642 - DNA, 22 bp, Artificial Sequence
  Synthetic oligonucleotide; TTC chr2 60539564 60539585 60539569 60539564 -
taatcagttttaaaatgtaact

SEQ ID NO: 212643 - DNA, 22 bp, Artificial Sequence
  Synthetic oligonucleotide; CTA chr2 60539562 60539583 60539567 60539562 -
atcagttttaaaatgtaactta

SEQ ID NO: 212644 - DNA, 22 bp, Artificial Sequence
  Synthetic oligonucleotide; TTT chr2 60539554 60539575 60539559 60539554 -
taaaatgtaacttattccatat

SEQ ID NO: 212645 - DNA, 22 bp, Artificial Sequence
  Synthetic oligonucleotide; TTT chr2 60539553 60539574 60539558 60539553 -
aaaatgtaacttattccatatt

SEQ ID NO: 212646 - DNA, 22 bp, Artificial Sequence
  Synthetic oligonucleotide; TTA chr2 60539552 60539573 60539557 60539552 -
aaatgtaacttattccatattg

SEQ ID NO: 212647 - DNA, 22 bp, Artificial Sequence
  Synthetic oligonucleotide; CTT chr2 60539541 60539562 60539546 60539541 -
attccatattgggttcattgga

SEQ ID NO: 212648 - DNA, 22 bp, Artificial Sequence
  Synthetic oligonucleotide; TTA chr2 60539540 60539561 60539545 60539540 -
ttccatattgggttcattggaa

SEQ ID NO: 212649 - DNA, 22 bp, Artificial Sequence
  Synthetic oligonucleotide; TTC chr2 60539537 60539558 60539542 60539537 -
catattgggttcattggaattt

SEQ ID NO: 212650 - DNA, 22 bp, Artificial Sequence
  Synthetic oligonucleotide; TTG chr2 60539530 60539551 60539535 60539530 -
ggttcattggaatttgtctccc

SEQ ID NO: 212651 - DNA, 22 bp, Artificial Sequence
  Synthetic oligonucleotide; TTC chr2 60539525 60539546 60539530 60539525 -
attggaatttgtctccctgctt

SEQ ID NO: 212652 - DNA, 22 bp, Artificial Sequence
  Synthetic oligonucleotide; TTG chr2 60539521 60539542 60539526 60539521 -
gaatttgtctccctgcttttta

SEQ ID NO: 212653 - DNA, 22 bp, Artificial Sequence
  Synthetic oligonucleotide; TTT chr2 60539515 60539536 60539520 60539515 -
gtctccctgctttttactggcc

SEQ ID NO: 212654 - DNA, 22 bp, Artificial Sequence
  Synthetic oligonucleotide; TTG chr2 60539514 60539535 60539519 60539514 -
tctccctgctttttactggcca

SEQ ID NO: 212655 - DNA, 22 bp, Artificial Sequence
  Synthetic oligonucleotide; CTC chr2 60539510 60539531 60539515 60539510 -
cctgctttttactggccagctg

SEQ ID NO: 212656 - DNA, 22 bp, Artificial Sequence
  Synthetic oligonucleotide; CTG chr2 60539506 60539527 60539511 60539506 -
ctttttactggccagctgcact

SEQ ID NO: 212657 - DNA, 22 bp, Artificial Sequence
  Synthetic oligonucleotide; CTT chr2 60539503 60539524 60539508 60539503 -
tttactggccagctgcactccc

SEQ ID NO: 212658 - DNA, 22 bp, Artificial Sequence
  Synthetic oligonucleotide; TTT chr2 60539502 60539523 60539507 60539502 -
ttactggccagctgcactccct

SEQ ID NO: 212659 - DNA, 22 bp, Artificial Sequence
  Synthetic oligonucleotide; TTT chr2 60539501 60539522 60539506 60539501 -
tactggccagctgcactcccta

SEQ ID NO: 212660 - DNA, 22 bp, Artificial Sequence
  Synthetic oligonucleotide; TTT chr2 60539500 60539521 60539505 60539500 -
actggccagctgcactccctat

SEQ ID NO: 212661 - DNA, 22 bp, Artificial Sequence
  Synthetic oligonucleotide; TTA chr2 60539499 60539520 60539504 60539499 -
ctggccagctgcactccctatg

SEQ ID NO: 212662 - DNA, 22 bp, Artificial Sequence
  Synthetic oligonucleotide; CTG chr2 60539496 60539517 60539501 60539496 -
gccagctgcactccctatgcat

SEQ ID NO: 212663 - DNA, 22 bp, Artificial Sequence
  Synthetic oligonucleotide; CTG chr2 60539488 60539509 60539493 60539488 -
cactccctatgcatttttaaaa

SEQ ID NO: 212664 - DNA, 22 bp, Artificial Sequence
  Synthetic oligonucleotide; CTC chr2 60539483 60539504 60539488 60539483 -
cctatgcatttttaaaacattt

SEQ ID NO: 212665 - DNA, 22 bp, Artificial Sequence
  Synthetic oligonucleotide; CTA chr2 60539479 60539500 60539484 60539479 -
tgcatttttaaaacatttcagc

SEQ ID NO: 212666 - DNA, 22 bp, Artificial Sequence
  Synthetic oligonucleotide; TTT chr2 60539472 60539493 60539477 60539472 -
ttaaaacatttcagcaaaggct

SEQ ID NO: 212667 - DNA, 22 bp, Artificial Sequence
  Synthetic oligonucleotide; TTT chr2 60539471 60539492 60539476 60539471 -
taaaacatttcagcaaaggctt

SEQ ID NO: 212668 - DNA, 22 bp, Artificial Sequence
  Synthetic oligonucleotide; TTT chr2 60539470 60539491 60539475 60539470 -
aaaacatttcagcaaaggcttt

SEQ ID NO: 212669 - DNA, 22 bp, Artificial Sequence
  Synthetic oligonucleotide; TTA chr2 60539469 60539490 60539474 60539469 -
aaacatttcagcaaaggctttt

SEQ ID NO: 212670 - DNA, 22 bp, Artificial Sequence
  Synthetic oligonucleotide; TTT chr2 60539461 60539482 60539466 60539461 -
cagcaaaggcttttgctgttct

SEQ ID NO: 212671 - DNA, 22 bp, Artificial Sequence
  Synthetic oligonucleotide; TTC chr2 60539460 60539481 60539465 60539460 -
agcaaaggcttttgctgttctt

SEQ ID NO: 212672 - DNA, 22 bp, Artificial Sequence
  Synthetic oligonucleotide; CTT chr2 60539449 60539470 60539454 60539449 -
ttgctgttcttagcagggttag

SEQ ID NO: 212673 - DNA, 22 bp, Artificial Sequence
  Synthetic oligonucleotide; TTT chr2 60539448 60539469 60539453 60539448 -
tgctgttcttagcagggttagt

SEQ ID NO: 212674 - DNA, 22 bp, Artificial Sequence
  Synthetic oligonucleotide; TTT chr2 60539447 60539468 60539452 60539447 -
gctgttcttagcagggttagta

SEQ ID NO: 212675 - DNA, 22 bp, Artificial Sequence
  Synthetic oligonucleotide; TTG chr2 60539446 60539467 60539451 60539446 -
ctgttcttagcagggttagtaa

SEQ ID NO: 212676 - DNA, 22 bp, Artificial Sequence
  Synthetic oligonucleotide; CTG chr2 60539443 60539464 60539448 60539443 -
ttcttagcagggttagtaactt

SEQ ID NO: 212677 - DNA, 22 bp, Artificial Sequence
  Synthetic oligonucleotide; TTC chr2 60539440 60539461 60539445 60539440 -
ttagcagggttagtaacttggg

SEQ ID NO: 212678 - DNA, 22 bp, Artificial Sequence
  Synthetic oligonucleotide; CTT chr2 60539438 60539459 60539443 60539438 -
agcagggttagtaacttggggt

SEQ ID NO: 212679 - DNA, 22 bp, Artificial Sequence
  Synthetic oligonucleotide; TTA chr2 60539437 60539458 60539442 60539437 -
gcagggttagtaacttggggtc

SEQ ID NO: 212680 - DNA, 22 bp, Artificial Sequence
  Synthetic oligonucleotide; TTA chr2 60539428 60539449 60539433 60539428 -
gtaacttggggtctatttctga

SEQ ID NO: 212681 - DNA, 22 bp, Artificial Sequence
  Synthetic oligonucleotide; CTT chr2 60539421 60539442 60539426 60539421 -
ggggtctatttctgagctcatt

SEQ ID NO: 212682 - DNA, 22 bp, Artificial Sequence
  Synthetic oligonucleotide; TTG chr2 60539420 60539441 60539425 60539420 -
gggtctatttctgagctcattc

SEQ ID NO: 212683 - DNA, 22 bp, Artificial Sequence
  Synthetic oligonucleotide; CTA chr2 60539413 60539434 60539418 60539413 -
tttctgagctcattcgtcattc

SEQ ID NO: 212684 - DNA, 22 bp, Artificial Sequence
  Synthetic oligonucleotide; TTT chr2 60539410 60539431 60539415 60539410 -
ctgagctcattcgtcattctgc

SEQ ID NO: 212685 - DNA, 22 bp, Artificial Sequence
  Synthetic oligonucleotide; TTC chr2 60539409 60539430 60539414 60539409 -
tgagctcattcgtcattctgca

SEQ ID NO: 212686 - DNA, 22 bp, Artificial Sequence
  Synthetic oligonucleotide; CTG chr2 60539407 60539428 60539412 60539407 -
agctcattcgtcattctgcaat

SEQ ID NO: 212687 - DNA, 22 bp, Artificial Sequence
  Synthetic oligonucleotide; CTC chr2 60539402 60539423 60539407 60539402 -
attcgtcattctgcaatggcat

SEQ ID NO: 212688 - DNA, 22 bp, Artificial Sequence
  Synthetic oligonucleotide; TTC chr2 60539398 60539419 60539403 60539398 -
gtcattctgcaatggcattgag

SEQ ID NO: 212689 - DNA, 22 bp, Artificial Sequence
  Synthetic oligonucleotide; TTC chr2 60539391 60539412 60539396 60539391 -
tgcaatggcattgagttaggtt

SEQ ID NO: 212690 - DNA, 22 bp, Artificial Sequence
  Synthetic oligonucleotide; CTG chr2 60539389 60539410 60539394 60539389 -
caatggcattgagttaggttgg

SEQ ID NO: 212691 - DNA, 22 bp, Artificial Sequence
  Synthetic oligonucleotide; TTG chr2 60539378 60539399 60539383 60539378 -
agttaggttggcaagggaagga

SEQ ID NO: 212692 - DNA, 22 bp, Artificial Sequence
  Synthetic oligonucleotide; TTA chr2 60539373 60539394 60539378 60539373 -
ggttggcaagggaaggatttga

SEQ ID NO: 212693 - DNA, 22 bp, Artificial Sequence
  Synthetic oligonucleotide; TTG chr2 60539368 60539389 60539373 60539368 -
gcaagggaaggatttgaggcat

SEQ ID NO: 212694 - DNA, 22 bp, Artificial Sequence
  Synthetic oligonucleotide; TTT chr2 60539353 60539374 60539358 60539353 -
gaggcatggggggtggtgaggt

SEQ ID NO: 212695 - DNA, 22 bp, Artificial Sequence
  Synthetic oligonucleotide; TTG chr2 60539352 60539373 60539357 60539352 -
aggcatggggggtggtgaggtc

SEQ ID NO: 212696 - DNA, 22 bp, Artificial Sequence
  Synthetic oligonucleotide; CTT chr2 60539326 60539347 60539331 60539326 -
ctgatcccagcagggaataggt

SEQ ID NO: 212697 - DNA, 22 bp, Artificial Sequence
  Synthetic oligonucleotide; TTC chr2 60539325 60539346 60539330 60539325 -
tgatcccagcagggaataggtg

SEQ ID NO: 212698 - DNA, 22 bp, Artificial Sequence
  Synthetic oligonucleotide; CTG chr2 60539323 60539344 60539328 60539323 -
atcccagcagggaataggtgag

SEQ ID NO: 212699 - DNA, 22 bp, Artificial Sequence
  Synthetic oligonucleotide; CTT chr2 60539298 60539319 60539303 60539298 -
catttgcctttacaataggcgc

SEQ ID NO: 212700 - DNA, 22 bp, Artificial Sequence
  Synthetic oligonucleotide; TTC chr2 60539297 60539318 60539302 60539297 -
atttgcctttacaataggcgca

SEQ ID NO: 212701 - DNA, 22 bp, Artificial Sequence
  Synthetic oligonucleotide; TTT chr2 60539293 60539314 60539298 60539293 -
gcctttacaataggcgcacagt

SEQ ID NO: 212702 - DNA, 22 bp, Artificial Sequence
  Synthetic oligonucleotide; TTG chr2 60539292 60539313 60539297 60539292 -
cctttacaataggcgcacagtt

SEQ ID NO: 212703 - DNA, 22 bp, Artificial Sequence
  Synthetic oligonucleotide; CTT chr2 60539288 60539309 60539293 60539288 -
tacaataggcgcacagttactg

SEQ ID NO: 212704 - DNA, 22 bp, Artificial Sequence
  Synthetic oligonucleotide; TTT chr2 60539287 60539308 60539292 60539287 -
acaataggcgcacagttactgc

SEQ ID NO: 212705 - DNA, 22 bp, Artificial Sequence
  Synthetic oligonucleotide; TTA chr2 60539286 60539307 60539291 60539286 -
caataggcgcacagttactgca

SEQ ID NO: 212706 - DNA, 22 bp, Artificial Sequence
  Synthetic oligonucleotide; TTA chr2 60539269 60539290 60539274 60539269 -
ctgcaccttggaggagctctca

SEQ ID NO: 212707 - DNA, 22 bp, Artificial Sequence
  Synthetic oligonucleotide; CTG chr2 60539266 60539287 60539271 60539266 -
caccttggaggagctctcaggt

SEQ ID NO: 212708 - DNA, 22 bp, Artificial Sequence
  Synthetic oligonucleotide; CTT chr2 60539260 60539281 60539265 60539260 -
ggaggagctctcaggtgccgct

SEQ ID NO: 212709 - DNA, 22 bp, Artificial Sequence
  Synthetic oligonucleotide; TTG chr2 60539259 60539280 60539264 60539259 -
gaggagctctcaggtgccgctc

SEQ ID NO: 212710 - DNA, 22 bp, Artificial Sequence
  Synthetic oligonucleotide; CTC chr2 60539250 60539271 60539255 60539250 -
tcaggtgccgctcagatgggcg

SEQ ID NO: 212711 - DNA, 22 bp, Artificial Sequence
  Synthetic oligonucleotide; CTC chr2 60539248 60539269 60539253 60539248 -
aggtgccgctcagatgggcgca

SEQ ID NO: 212712 - DNA, 22 bp, Artificial Sequence
  Synthetic oligonucleotide; CTC chr2 60539237 60539258 60539242 60539237 -
agatgggcgcatgtaaatgccc

SEQ ID NO: 212713 - DNA, 22 bp, Artificial Sequence
  Synthetic oligonucleotide; CTG chr2 60539213 60539234 60539218 60539213 -
tcagatgcggagctggaatatt

SEQ ID NO: 212714 - DNA, 22 bp, Artificial Sequence
  Synthetic oligonucleotide; CTG chr2 60539198 60539219 60539203 60539198 -
gaatattaatgcttcttccacc

SEQ ID NO: 212715 - DNA, 22 bp, Artificial Sequence
  Synthetic oligonucleotide; TTA chr2 60539190 60539211 60539195 60539190 -
atgcttcttccaccaccacacc

SEQ ID NO: 212716 - DNA, 22 bp, Artificial Sequence
  Synthetic oligonucleotide; CTT chr2 60539184 60539205 60539189 60539184 -
cttccaccaccacaccataata

SEQ ID NO: 212717 - DNA, 22 bp, Artificial Sequence
  Synthetic oligonucleotide; TTC chr2 60539183 60539204 60539188 60539183 -
ttccaccaccacaccataataa

SEQ ID NO: 212718 - DNA, 22 bp, Artificial Sequence
  Synthetic oligonucleotide; CTT chr2 60539181 60539202 60539186 60539181 -
ccaccaccacaccataataaag

SEQ ID NO: 212719 - DNA, 22 bp, Artificial Sequence
  Synthetic oligonucleotide; TTC chr2 60539180 60539201 60539185 60539180 -
caccaccacaccataataaagc

SEQ ID NO: 212720 - DNA, 22 bp, Artificial Sequence
  Synthetic oligonucleotide; CTG chr2 60539156 60539177 60539161 60539156 -
tacacagcaagcttaatatgca

SEQ ID NO: 212721 - DNA, 22 bp, Artificial Sequence
  Synthetic oligonucleotide; CTT chr2 60539142 60539163 60539147 60539142 -
aatatgcagctagtctggggaa

SEQ ID NO: 212722 - DNA, 22 bp, Artificial Sequence
  Synthetic oligonucleotide; TTA chr2 60539141 60539162 60539146 60539141 -
atatgcagctagtctggggaat

SEQ ID NO: 212723 - DNA, 22 bp, Artificial Sequence
  Synthetic oligonucleotide; CTA chr2 60539130 60539151 60539135 60539130 -
gtctggggaattgtataaactt

SEQ ID NO: 212724 - DNA, 22 bp, Artificial Sequence
  Synthetic oligonucleotide; CTG chr2 60539125 60539146 60539130 60539125 -
gggaattgtataaacttagata

SEQ ID NO: 212725 - DNA, 22 bp, Artificial Sequence
  Synthetic oligonucleotide; TTG chr2 60539117 60539138 60539122 60539117 -
tataaacttagatagcccagtg

SEQ ID NO: 212726 - DNA, 22 bp, Artificial Sequence
  Synthetic oligonucleotide; CTT chr2 60539108 60539129 60539113 60539108 -
agatagcccagtgtgaaagaca

SEQ ID NO: 212727 - DNA, 22 bp, Artificial Sequence
  Synthetic oligonucleotide; TTA chr2 60539107 60539128 60539112 60539107 -
gatagcccagtgtgaaagacag

SEQ ID NO: 212728 - DNA, 22 bp, Artificial Sequence
  Synthetic oligonucleotide; CTC chr2 60539069 60539090 60539074 60539069 -
gatatgccacagtttccattct

SEQ ID NO: 212729 - DNA, 22 bp, Artificial Sequence
  Synthetic oligonucleotide; TTT chr2 60539054 60539075 60539059 60539054 -
ccattcttgttctcctttgatc

SEQ ID NO: 212730 - DNA, 22 bp, Artificial Sequence
  Synthetic oligonucleotide; TTC chr2 60539053 60539074 60539058 60539053 -
cattcttgttctcctttgatct

SEQ ID NO: 212731 - DNA, 22 bp, Artificial Sequence
  Synthetic oligonucleotide; TTC chr2 60539048 60539069 60539053 60539048 -
ttgttctcctttgatctatagc

SEQ ID NO: 212732 - DNA, 22 bp, Artificial Sequence
  Synthetic oligonucleotide; CTT chr2 60539046 60539067 60539051 60539046 -
gttctcctttgatctatagcga

SEQ ID NO: 212733 - DNA, 22 bp, Artificial Sequence
  Synthetic oligonucleotide; TTG chr2 60539045 60539066 60539050 60539045 -
ttctcctttgatctatagcgaa

SEQ ID NO: 212734 - DNA, 22 bp, Artificial Sequence
  Synthetic oligonucleotide; TTC chr2 60539042 60539063 60539047 60539042 -
tcctttgatctatagcgaaatg

SEQ ID NO: 212735 - DNA, 22 bp, Artificial Sequence
  Synthetic oligonucleotide; CTC chr2 60539040 60539061 60539045 60539040 -
ctttgatctatagcgaaatgaa

SEQ ID NO: 212736 - DNA, 22 bp, Artificial Sequence
  Synthetic oligonucleotide; CTT chr2 60539037 60539058 60539042 60539037 -
tgatctatagcgaaatgaaaac

SEQ ID NO: 212737 - DNA, 22 bp, Artificial Sequence
  Synthetic oligonucleotide; TTT chr2 60539036 60539057 60539041 60539036 -
gatctatagcgaaatgaaaaca

SEQ ID NO: 212738 - DNA, 22 bp, Artificial Sequence
  Synthetic oligonucleotide; TTG chr2 60539035 60539056 60539040 60539035 -
atctatagcgaaatgaaaacat

SEQ ID NO: 212739 - DNA, 22 bp, Artificial Sequence
  Synthetic oligonucleotide; CTA chr2 60539030 60539051 60539035 60539030 -
tagcgaaatgaaaacatcatcc

SEQ ID NO: 212740 - DNA, 22 bp, Artificial Sequence
  Synthetic oligonucleotide; CTT chr2 60539006 60539027 60539011 60539006 -
ttcttctcttggagttgtctcc

SEQ ID NO: 212741 - DNA, 22 bp, Artificial Sequence
  Synthetic oligonucleotide; TTT chr2 60539005 60539026 60539010 60539005 -
tcttctcttggagttgtctccc

SEQ ID NO: 212742 - DNA, 22 bp, Artificial Sequence
  Synthetic oligonucleotide; TTT chr2 60539004 60539025 60539009 60539004 -
cttctcttggagttgtctcccc

SEQ ID NO: 212743 - DNA, 22 bp, Artificial Sequence
  Synthetic oligonucleotide; TTC chr2 60539003 60539024 60539008 60539003 -
ttctcttggagttgtctcccca

SEQ ID NO: 212744 - DNA, 22 bp, Artificial Sequence
  Synthetic oligonucleotide; CTT chr2 60539001 60539022 60539006 60539001 -
ctcttggagttgtctccccaac

SEQ ID NO: 212745 - DNA, 22 bp, Artificial Sequence
  Synthetic oligonucleotide; TTC chr2 60539000 60539021 60539005 60539000 -
tcttggagttgtctccccaact

SEQ ID NO: 212746 - DNA, 22 bp, Artificial Sequence
  Synthetic oligonucleotide; CTC chr2 60538998 60539019 60539003 60538998 -
ttggagttgtctccccaactct

SEQ ID NO: 212747 - DNA, 22 bp, Artificial Sequence
  Synthetic oligonucleotide; CTT chr2 60538996 60539017 60539001 60538996 -
ggagttgtctccccaactctgc

SEQ ID NO: 212748 - DNA, 22 bp, Artificial Sequence
  Synthetic oligonucleotide; TTG chr2 60538995 60539016 60539000 60538995 -
gagttgtctccccaactctgcc

SEQ ID NO: 212749 - DNA, 22 bp, Artificial Sequence
  Synthetic oligonucleotide; TTG chr2 60538989 60539010 60538994 60538989 -
tctccccaactctgccacctcc

SEQ ID NO: 212750 - DNA, 22 bp, Artificial Sequence
  Synthetic oligonucleotide; CTC chr2 60538985 60539006 60538990 60538985 -
cccaactctgccacctcccaat

SEQ ID NO: 212751 - DNA, 22 bp, Artificial Sequence
  Synthetic oligonucleotide; CTC chr2 60538977 60538998 60538982 60538977 -
tgccacctcccaattcaccacc

SEQ ID NO: 212752 - DNA, 22 bp, Artificial Sequence
  Synthetic oligonucleotide; CTG chr2 60538975 60538996 60538980 60538975 -
ccacctcccaattcaccaccag

SEQ ID NO: 212753 - DNA, 22 bp, Artificial Sequence
  Synthetic oligonucleotide; CTC chr2 60538968 60538989 60538973 60538968 -
ccaattcaccaccagaattttt

SEQ ID NO: 212754 - DNA, 22 bp, Artificial Sequence
  Synthetic oligonucleotide; TTC chr2 60538961 60538982 60538966 60538961 -
accaccagaatttttttgcatg

SEQ ID NO: 212755 - DNA, 22 bp, Artificial Sequence
  Synthetic oligonucleotide; TTT chr2 60538948 60538969 60538953 60538948 -
ttttgcatgtgctggtatggag

SEQ ID NO: 212756 - DNA, 22 bp, Artificial Sequence
  Synthetic oligonucleotide; TTT chr2 60538947 60538968 60538952 60538947 -
tttgcatgtgctggtatggaga

SEQ ID NO: 212757 - DNA, 22 bp, Artificial Sequence
  Synthetic oligonucleotide; TTT chr2 60538946 60538967 60538951 60538946 -
ttgcatgtgctggtatggagaa

SEQ ID NO: 212758 - DNA, 22 bp, Artificial Sequence
  Synthetic oligonucleotide; TTT chr2 60538945 60538966 60538950 60538945 -
tgcatgtgctggtatggagaaa

SEQ ID NO: 212759 - DNA, 22 bp, Artificial Sequence
  Synthetic oligonucleotide; TTT chr2 60538944 60538965 60538949 60538944 -
gcatgtgctggtatggagaaat

SEQ ID NO: 212760 - DNA, 22 bp, Artificial Sequence
  Synthetic oligonucleotide; TTG chr2 60538943 60538964 60538948 60538943 -
catgtgctggtatggagaaatg

SEQ ID NO: 212761 - DNA, 22 bp, Artificial Sequence
  Synthetic oligonucleotide; CTG chr2 60538934 60538955 60538939 60538934 -
gtatggagaaatgcaacataat

SEQ ID NO: 212762 - DNA, 22 bp, Artificial Sequence
  Synthetic oligonucleotide; TTT chr2 60538910 60538931 60538915 60538910 -
gtttcatatggttaattacagg

SEQ ID NO: 212763 - DNA, 22 bp, Artificial Sequence
  Synthetic oligonucleotide; TTG chr2 60538909 60538930 60538914 60538909 -
tttcatatggttaattacaggc

SEQ ID NO: 212764 - DNA, 22 bp, Artificial Sequence
  Synthetic oligonucleotide; TTT chr2 60538906 60538927 60538911 60538906 -
catatggttaattacaggcgtt

SEQ ID NO: 212765 - DNA, 22 bp, Artificial Sequence
  Synthetic oligonucleotide; TTC chr2 60538905 60538926 60538910 60538905 -
atatggttaattacaggcgttt

SEQ ID NO: 212766 - DNA, 22 bp, Artificial Sequence
  Synthetic oligonucleotide; TTA chr2 60538896 60538917 60538901 60538896 -
attacaggcgtttgaatattta

SEQ ID NO: 212767 - DNA, 22 bp, Artificial Sequence
  Synthetic oligonucleotide; TTA chr2 60538892 60538913 60538897 60538892 -
caggcgtttgaatatttaaaat

SEQ ID NO: 212768 - DNA, 22 bp, Artificial Sequence
  Synthetic oligonucleotide; TTT chr2 60538883 60538904 60538888 60538883 -
gaatatttaaaattttaaatag

SEQ ID NO: 212769 - DNA, 22 bp, Artificial Sequence
  Synthetic oligonucleotide; TTG chr2 60538882 60538903 60538887 60538882 -
aatatttaaaattttaaatagc

SEQ ID NO: 212770 - DNA, 22 bp, Artificial Sequence
  Synthetic oligonucleotide; TTT chr2 60538875 60538896 60538880 60538875 -
aaaattttaaatagccacagtt

SEQ ID NO: 212771 - DNA, 22 bp, Artificial Sequence
  Synthetic oligonucleotide; TTA chr2 60538874 60538895 60538879 60538874 -
aaattttaaatagccacagttc

SEQ ID NO: 212772 - DNA, 22 bp, Artificial Sequence
  Synthetic oligonucleotide; TTT chr2 60538868 60538889 60538873 60538868 -
taaatagccacagttccagctt

SEQ ID NO: 212773 - DNA, 22 bp, Artificial Sequence
  Synthetic oligonucleotide; TTT chr2 60538867 60538888 60538872 60538867 -
aaatagccacagttccagcttt

SEQ ID NO: 212774 - DNA, 22 bp, Artificial Sequence
  Synthetic oligonucleotide; TTA chr2 60538866 60538887 60538871 60538866 -
aatagccacagttccagctttt

SEQ ID NO: 212775 - DNA, 22 bp, Artificial Sequence
  Synthetic oligonucleotide; TTC chr2 60538852 60538873 60538857 60538852 -
cagcttttcccgttaaaagtat

SEQ ID NO: 212776 - DNA, 22 bp, Artificial Sequence
  Synthetic oligonucleotide; CTT chr2 60538846 60538867 60538851 60538846 -
ttcccgttaaaagtatgtgatt

SEQ ID NO: 212777 - DNA, 22 bp, Artificial Sequence
  Synthetic oligonucleotide; TTT chr2 60538845 60538866 60538850 60538845 -
tcccgttaaaagtatgtgattt

SEQ ID NO: 212778 - DNA, 22 bp, Artificial Sequence
  Synthetic oligonucleotide; TTT chr2 60538844 60538865 60538849 60538844 -
cccgttaaaagtatgtgatttg

SEQ ID NO: 212779 - DNA, 22 bp, Artificial Sequence
  Synthetic oligonucleotide; TTC chr2 60538843 60538864 60538848 60538843 -
ccgttaaaagtatgtgatttga

SEQ ID NO: 212780 - DNA, 22 bp, Artificial Sequence
  Synthetic oligonucleotide; TTA chr2 60538837 60538858 60538842 60538837 -
aaagtatgtgatttgaacaaag

SEQ ID NO: 212781 - DNA, 22 bp, Artificial Sequence
  Synthetic oligonucleotide; TTT chr2 60538823 60538844 60538828 60538823 -
gaacaaagggagtacagtgtaa

SEQ ID NO: 212782 - DNA, 22 bp, Artificial Sequence
  Synthetic oligonucleotide; TTG chr2 60538822 60538843 60538827 60538822 -
aacaaagggagtacagtgtaaa

SEQ ID NO: 212783 - DNA, 22 bp, Artificial Sequence
  Synthetic oligonucleotide; TTT chr2 60538795 60538816 60538800 60538795 -
gtggtgatttgcaacacccctc

SEQ ID NO: 212784 - DNA, 22 bp, Artificial Sequence
  Synthetic oligonucleotide; TTG chr2 60538794 60538815 60538799 60538794 -
tggtgatttgcaacacccctct

SEQ ID NO: 212785 - DNA, 22 bp, Artificial Sequence
  Synthetic oligonucleotide; TTT chr2 60538785 60538806 60538790 60538785 -
gcaacacccctctttccccatt

SEQ ID NO: 212786 - DNA, 22 bp, Artificial Sequence
  Synthetic oligonucleotide; TTG chr2 60538784 60538805 60538789 60538784 -
caacacccctctttccccatta

SEQ ID NO: 212787 - DNA, 22 bp, Artificial Sequence
  Synthetic oligonucleotide; CTC chr2 60538773 60538794 60538778 60538773 -
tttccccattacacacacacac

SEQ ID NO: 212788 - DNA, 22 bp, Artificial Sequence
  Synthetic oligonucleotide; CTT chr2 60538771 60538792 60538776 60538771 -
tccccattacacacacacacac

SEQ ID NO: 212789 - DNA, 22 bp, Artificial Sequence
  Synthetic oligonucleotide; TTT chr2 60538770 60538791 60538775 60538770 -
ccccattacacacacacacaca

SEQ ID NO: 212790 - DNA, 22 bp, Artificial Sequence
  Synthetic oligonucleotide; TTC chr2 60538769 60538790 60538774 60538769 -
cccattacacacacacacacac

SEQ ID NO: 212791 - DNA, 22 bp, Artificial Sequence
  Synthetic oligonucleotide; TTA chr2 60538762 60538783 60538767 60538762 -
cacacacacacacacacacaca

SEQ ID NO: 212792 - DNA, 22 bp, Artificial Sequence
  Synthetic oligonucleotide; TTC chr2 60538693 60538714 60538698 60538693 -
agtttaaatctagtactgatct

SEQ ID NO: 212793 - DNA, 22 bp, Artificial Sequence
  Synthetic oligonucleotide; TTT chr2 60538688 60538709 60538693 60538688 -
aaatctagtactgatctaaagg

SEQ ID NO: 212794 - DNA, 22 bp, Artificial Sequence
  Synthetic oligonucleotide; TTA chr2 60538687 60538708 60538692 60538687 -
aatctagtactgatctaaagga

SEQ ID NO: 212795 - DNA, 22 bp, Artificial Sequence
  Synthetic oligonucleotide; CTA chr2 60538681 60538702 60538686 60538681 -
gtactgatctaaaggacttctg

SEQ ID NO: 212796 - DNA, 22 bp, Artificial Sequence
  Synthetic oligonucleotide; CTG chr2 60538675 60538696 60538680 60538675 -
atctaaaggacttctgtacctt

SEQ ID NO: 212797 - DNA, 22 bp, Artificial Sequence
  Synthetic oligonucleotide; CTA chr2 60538670 60538691 60538675 60538670 -
aaggacttctgtaccttcattt

SEQ ID NO: 212798 - DNA, 22 bp, Artificial Sequence
  Synthetic oligonucleotide; CTT chr2 60538662 60538683 60538667 60538662 -
ctgtaccttcatttgtactttt

SEQ ID NO: 212799 - DNA, 22 bp, Artificial Sequence
  Synthetic oligonucleotide; TTC chr2 60538661 60538682 60538666 60538661 -
tgtaccttcatttgtacttttt

SEQ ID NO: 212800 - DNA, 22 bp, Artificial Sequence
  Synthetic oligonucleotide; CTG chr2 60538659 60538680 60538664 60538659 -
taccttcatttgtacttttttt

SEQ ID NO: 212801 - DNA, 22 bp, Artificial Sequence
  Synthetic oligonucleotide; CTT chr2 60538653 60538674 60538658 60538653 -
catttgtactttttttaaaaaa

SEQ ID NO: 212802 - DNA, 22 bp, Artificial Sequence
  Synthetic oligonucleotide; TTC chr2 60538652 60538673 60538657 60538652 -
atttgtactttttttaaaaaac

SEQ ID NO: 212803 - DNA, 22 bp, Artificial Sequence
  Synthetic oligonucleotide; TTT chr2 60538648 60538669 60538653 60538648 -
gtactttttttaaaaaacaact

SEQ ID NO: 212804 - DNA, 22 bp, Artificial Sequence
  Synthetic oligonucleotide; TTG chr2 60538647 60538668 60538652 60538647 -
tactttttttaaaaaacaactt

SEQ ID NO: 212805 - DNA, 22 bp, Artificial Sequence
  Synthetic oligonucleotide; CTT chr2 60538642 60538663 60538647 60538642 -
tttttaaaaaacaactttcaac

SEQ ID NO: 212806 - DNA, 22 bp, Artificial Sequence
  Synthetic oligonucleotide; TTT chr2 60538641 60538662 60538646 60538641 -
ttttaaaaaacaactttcaact

SEQ ID NO: 212807 - DNA, 22 bp, Artificial Sequence
  Synthetic oligonucleotide; TTT chr2 60538640 60538661 60538645 60538640 -
tttaaaaaacaactttcaactg

SEQ ID NO: 212808 - DNA, 22 bp, Artificial Sequence
  Synthetic oligonucleotide; TTT chr2 60538639 60538660 60538644 60538639 -
ttaaaaaacaactttcaactgg

SEQ ID NO: 212809 - DNA, 22 bp, Artificial Sequence
  Synthetic oligonucleotide; TTT chr2 60538638 60538659 60538643 60538638 -
taaaaaacaactttcaactgga

SEQ ID NO: 212810 - DNA, 22 bp, Artificial Sequence
  Synthetic oligonucleotide; TTT chr2 60538637 60538658 60538642 60538637 -
aaaaaacaactttcaactggaa

SEQ ID NO: 212811 - DNA, 22 bp, Artificial Sequence
  Synthetic oligonucleotide; TTA chr2 60538636 60538657 60538641 60538636 -
aaaaacaactttcaactggaat

SEQ ID NO: 212812 - DNA, 22 bp, Artificial Sequence
  Synthetic oligonucleotide; CTT chr2 60538625 60538646 60538630 60538625 -
tcaactggaattccattaaaat

SEQ ID NO: 212813 - DNA, 22 bp, Artificial Sequence
  Synthetic oligonucleotide; TTT chr2 60538624 60538645 60538629 60538624 -
caactggaattccattaaaata

SEQ ID NO: 212814 - DNA, 22 bp, Artificial Sequence
  Synthetic oligonucleotide; TTC chr2 60538623 60538644 60538628 60538623 -
aactggaattccattaaaatat

SEQ ID NO: 212815 - DNA, 22 bp, Artificial Sequence
  Synthetic oligonucleotide; CTG chr2 60538618 60538639 60538623 60538618 -
gaattccattaaaatatttcac

SEQ ID NO: 212816 - DNA, 22 bp, Artificial Sequence
  Synthetic oligonucleotide; TTC chr2 60538612 60538633 60538617 60538612 -
cattaaaatatttcaccattat

SEQ ID NO: 212817 - DNA, 22 bp, Artificial Sequence
  Synthetic oligonucleotide; TTA chr2 60538607 60538628 60538612 60538607 -
aaatatttcaccattatatttt

SEQ ID NO: 212818 - DNA, 22 bp, Artificial Sequence
  Synthetic oligonucleotide; TTT chr2 60538599 60538620 60538604 60538599 -
caccattatatttttgagtcca

SEQ ID NO: 212819 - DNA, 22 bp, Artificial Sequence
  Synthetic oligonucleotide; TTC chr2 60538598 60538619 60538603 60538598 -
accattatatttttgagtccac

SEQ ID NO: 212820 - DNA, 22 bp, Artificial Sequence
  Synthetic oligonucleotide; TTA chr2 60538591 60538612 60538596 60538591 -
tatttttgagtccacattgctt

SEQ ID NO: 212821 - DNA, 22 bp, Artificial Sequence
  Synthetic oligonucleotide; TTT chr2 60538586 60538607 60538591 60538586 -
ttgagtccacattgcttgaggt

SEQ ID NO: 212822 - DNA, 22 bp, Artificial Sequence
  Synthetic oligonucleotide; TTT chr2 60538585 60538606 60538590 60538585 -
tgagtccacattgcttgaggtt

SEQ ID NO: 212823 - DNA, 22 bp, Artificial Sequence
  Synthetic oligonucleotide; TTT chr2 60538584 60538605 60538589 60538584 -
gagtccacattgcttgaggttt

SEQ ID NO: 212824 - DNA, 22 bp, Artificial Sequence
  Synthetic oligonucleotide; TTG chr2 60538583 60538604 60538588 60538583 -
agtccacattgcttgaggtttt

SEQ ID NO: 212825 - DNA, 22 bp, Artificial Sequence
  Synthetic oligonucleotide; TTG chr2 60538572 60538593 60538577 60538572 -
cttgaggttttaaagaagattt

SEQ ID NO: 212826 - DNA, 22 bp, Artificial Sequence
  Synthetic oligonucleotide; CTT chr2 60538569 60538590 60538574 60538569 -
gaggttttaaagaagattttta

SEQ ID NO: 212827 - DNA, 22 bp, Artificial Sequence
  Synthetic oligonucleotide; TTG chr2 60538568 60538589 60538573 60538568 -
aggttttaaagaagatttttat

SEQ ID NO: 212828 - DNA, 22 bp, Artificial Sequence
  Synthetic oligonucleotide; TTT chr2 60538562 60538583 60538567 60538562 -
taaagaagatttttataatgtg

SEQ ID NO: 212829 - DNA, 22 bp, Artificial Sequence
  Synthetic oligonucleotide; TTT chr2 60538561 60538582 60538566 60538561 -
aaagaagatttttataatgtgt

SEQ ID NO: 212830 - DNA, 22 bp, Artificial Sequence
  Synthetic oligonucleotide; TTA chr2 60538560 60538581 60538565 60538560 -
aagaagatttttataatgtgtt

SEQ ID NO: 212831 - DNA, 22 bp, Artificial Sequence
  Synthetic oligonucleotide; TTT chr2 60538550 60538571 60538555 60538550 -
ttataatgtgttcctttaacag

SEQ ID NO: 212832 - DNA, 22 bp, Artificial Sequence
  Synthetic oligonucleotide; TTT chr2 60538549 60538570 60538554 60538549 -
tataatgtgttcctttaacaga

SEQ ID NO: 212833 - DNA, 22 bp, Artificial Sequence
  Synthetic oligonucleotide; TTT chr2 60538548 60538569 60538553 60538548 -
ataatgtgttcctttaacagaa

SEQ ID NO: 212834 - DNA, 22 bp, Artificial Sequence
  Synthetic oligonucleotide; TTA chr2 60538547 60538568 60538552 60538547 -
taatgtgttcctttaacagaat

SEQ ID NO: 212835 - DNA, 22 bp, Artificial Sequence
  Synthetic oligonucleotide; TTC chr2 60538537 60538558 60538542 60538537 -
ctttaacagaatcaacagctgt

SEQ ID NO: 212836 - DNA, 22 bp, Artificial Sequence
  Synthetic oligonucleotide; CTT chr2 60538534 60538555 60538539 60538534 -
taacagaatcaacagctgtcag

SEQ ID NO: 212837 - DNA, 22 bp, Artificial Sequence
  Synthetic oligonucleotide; TTT chr2 60538533 60538554 60538538 60538533 -
aacagaatcaacagctgtcaga

SEQ ID NO: 212838 - DNA, 22 bp, Artificial Sequence
  Synthetic oligonucleotide; TTA chr2 60538532 60538553 60538537 60538532 -
acagaatcaacagctgtcagaa

SEQ ID NO: 212839 - DNA, 22 bp, Artificial Sequence
  Synthetic oligonucleotide; CTG chr2 60538516 60538537 60538521 60538516 -
tcagaagcagttgtggtagatc

SEQ ID NO: 212840 - DNA, 22 bp, Artificial Sequence
  Synthetic oligonucleotide; TTG chr2 60538503 60538524 60538508 60538503 -
tggtagatccacaaaacgtata

SEQ ID NO: 212841 - DNA, 22 bp, Artificial Sequence
  Synthetic oligonucleotide; TTT chr2 60538464 60538485 60538469 60538464 -
cctgaaacaaaacacttggaaa

SEQ ID NO: 212842 - DNA, 22 bp, Artificial Sequence
  Synthetic oligonucleotide; TTC chr2 60538463 60538484 60538468 60538463 -
ctgaaacaaaacacttggaaaa

SEQ ID NO: 212843 - DNA, 22 bp, Artificial Sequence
  Synthetic oligonucleotide; CTG chr2 60538460 60538481 60538465 60538460 -
aaacaaaacacttggaaaaata

SEQ ID NO: 212844 - DNA, 22 bp, Artificial Sequence
  Synthetic oligonucleotide; CTT chr2 60538447 60538468 60538452 60538447 -
ggaaaaataagctgctaagaac

SEQ ID NO: 212845 - DNA, 22 bp, Artificial Sequence
  Synthetic oligonucleotide; TTG chr2 60538446 60538467 60538451 60538446 -
gaaaaataagctgctaagaact

SEQ ID NO: 212846 - DNA, 22 bp, Artificial Sequence
  Synthetic oligonucleotide; CTG chr2 60538433 60538454 60538438 60538433 -
ctaagaactggcgaattagaag

SEQ ID NO: 212847 - DNA, 22 bp, Artificial Sequence
  Synthetic oligonucleotide; CTA chr2 60538430 60538451 60538435 60538430 -
agaactggcgaattagaagttt

SEQ ID NO: 212848 - DNA, 22 bp, Artificial Sequence
  Synthetic oligonucleotide; CTG chr2 60538423 60538444 60538428 60538423 -
gcgaattagaagtttgcagaca

SEQ ID NO: 212849 - DNA, 22 bp, Artificial Sequence
  Synthetic oligonucleotide; TTA chr2 60538415 60538436 60538420 60538415 -
gaagtttgcagacagggaactg

SEQ ID NO: 212850 - DNA, 22 bp, Artificial Sequence
  Synthetic oligonucleotide; TTT chr2 60538408 60538429 60538413 60538408 -
gcagacagggaactgaagtgtc

SEQ ID NO: 212851 - DNA, 22 bp, Artificial Sequence
  Synthetic oligonucleotide; TTG chr2 60538407 60538428 60538412 60538407 -
cagacagggaactgaagtgtca

SEQ ID NO: 212852 - DNA, 22 bp, Artificial Sequence
  Synthetic oligonucleotide; CTG chr2 60538393 60538414 60538398 60538393 -
aagtgtcatctcttggttcacc

SEQ ID NO: 212853 - DNA, 22 bp, Artificial Sequence
  Synthetic oligonucleotide; CTC chr2 60538381 60538402 60538386 60538381 -
ttggttcaccctggagactgat

SEQ ID NO: 212854 - DNA, 22 bp, Artificial Sequence
  Synthetic oligonucleotide; CTT chr2 60538379 60538400 60538384 60538379 -
ggttcaccctggagactgatgt

SEQ ID NO: 212855 - DNA, 22 bp, Artificial Sequence
  Synthetic oligonucleotide; TTG chr2 60538378 60538399 60538383 60538378 -
gttcaccctggagactgatgtg

SEQ ID NO: 212856 - DNA, 22 bp, Artificial Sequence
  Synthetic oligonucleotide; TTC chr2 60538374 60538395 60538379 60538374 -
accctggagactgatgtgagtg

SEQ ID NO: 212857 - DNA, 22 bp, Artificial Sequence
  Synthetic oligonucleotide; CTG chr2 60538368 60538389 60538373 60538368 -
gagactgatgtgagtggatctg

SEQ ID NO: 212858 - DNA, 22 bp, Artificial Sequence
  Synthetic oligonucleotide; CTG chr2 60538361 60538382 60538366 60538361 -
atgtgagtggatctgatgcaat

SEQ ID NO: 212859 - DNA, 22 bp, Artificial Sequence
  Synthetic oligonucleotide; CTG chr2 60538346 60538367 60538351 60538346 -
atgcaatgctgctggaagattt

SEQ ID NO: 212860 - DNA, 22 bp, Artificial Sequence
  Synthetic oligonucleotide; CTG chr2 60538335 60538356 60538340 60538335 -
ctggaagatttacctgcacagg

SEQ ID NO: 212861 - DNA, 22 bp, Artificial Sequence
  Synthetic oligonucleotide; CTG chr2 60538332 60538353 60538337 60538332 -
gaagatttacctgcacaggttg

SEQ ID NO: 212862 - DNA, 22 bp, Artificial Sequence
  Synthetic oligonucleotide; TTT chr2 60538324 60538345 60538329 60538324 -
acctgcacaggttgctcctcta

SEQ ID NO: 212863 - DNA, 22 bp, Artificial Sequence
  Synthetic oligonucleotide; TTA chr2 60538323 60538344 60538328 60538323 -
cctgcacaggttgctcctctaa

SEQ ID NO: 212864 - DNA, 22 bp, Artificial Sequence
  Synthetic oligonucleotide; CTG chr2 60538319 60538340 60538324 60538319 -
cacaggttgctcctctaaggca

SEQ ID NO: 212865 - DNA, 22 bp, Artificial Sequence
  Synthetic oligonucleotide; TTG chr2 60538310 60538331 60538315 60538310 -
ctcctctaaggcaacgcgcagt

SEQ ID NO: 212866 - DNA, 22 bp, Artificial Sequence
  Synthetic oligonucleotide; CTC chr2 60538307 60538328 60538312 60538307 -
ctctaaggcaacgcgcagtgca

SEQ ID NO: 212867 - DNA, 22 bp, Artificial Sequence
  Synthetic oligonucleotide; CTC chr2 60538304 60538325 60538309 60538304 -
taaggcaacgcgcagtgcacga

SEQ ID NO: 212868 - DNA, 22 bp, Artificial Sequence
  Synthetic oligonucleotide; CTA chr2 60538302 60538323 60538307 60538302 -
aggcaacgcgcagtgcacgatt

SEQ ID NO: 212869 - DNA, 22 bp, Artificial Sequence
  Synthetic oligonucleotide; TTG chr2 60538279 60538300 60538284 60538279 -
acgtatgcaccagagctaggct

SEQ ID NO: 212870 - DNA, 22 bp, Artificial Sequence
  Synthetic oligonucleotide; CTA chr2 60538261 60538282 60538266 60538261 -
ggctgggcctcagctcgctcca

SEQ ID NO: 212871 - DNA, 22 bp, Artificial Sequence
  Synthetic oligonucleotide; CTG chr2 60538256 60538277 60538261 60538256 -
ggcctcagctcgctccatcttt

SEQ ID NO: 212872 - DNA, 22 bp, Artificial Sequence
  Synthetic oligonucleotide; CTC chr2 60538250 60538271 60538255 60538250 -
agctcgctccatcttttgccct

SEQ ID NO: 212873 - DNA, 22 bp, Artificial Sequence
  Synthetic oligonucleotide; CTC chr2 60538245 60538266 60538250 60538245 -
gctccatcttttgccctttttg

SEQ ID NO: 212874 - DNA, 22 bp, Artificial Sequence
  Synthetic oligonucleotide; CTC chr2 60538241 60538262 60538246 60538241 -
catcttttgccctttttgatct

SEQ ID NO: 212875 - DNA, 22 bp, Artificial Sequence
  Synthetic oligonucleotide; CTT chr2 60538235 60538256 60538240 60538235 -
ttgccctttttgatctctttag

SEQ ID NO: 212876 - DNA, 22 bp, Artificial Sequence
  Synthetic oligonucleotide; TTT chr2 60538234 60538255 60538239 60538234 -
tgccctttttgatctctttaga

SEQ ID NO: 212877 - DNA, 22 bp, Artificial Sequence
  Synthetic oligonucleotide; TTT chr2 60538233 60538254 60538238 60538233 -
gccctttttgatctctttagat

SEQ ID NO: 212878 - DNA, 22 bp, Artificial Sequence
  Synthetic oligonucleotide; TTG chr2 60538232 60538253 60538237 60538232 -
ccctttttgatctctttagata

SEQ ID NO: 212879 - DNA, 22 bp, Artificial Sequence
  Synthetic oligonucleotide; CTT chr2 60538227 60538248 60538232 60538227 -
tttgatctctttagatagataa

SEQ ID NO: 212880 - DNA, 22 bp, Artificial Sequence
  Synthetic oligonucleotide; TTT chr2 60538226 60538247 60538231 60538226 -
ttgatctctttagatagataaa

SEQ ID NO: 212881 - DNA, 22 bp, Artificial Sequence
  Synthetic oligonucleotide; TTT chr2 60538225 60538246 60538230 60538225 -
tgatctctttagatagataaaa

SEQ ID NO: 212882 - DNA, 22 bp, Artificial Sequence
  Synthetic oligonucleotide; TTT chr2 60538224 60538245 60538229 60538224 -
gatctctttagatagataaaat

SEQ ID NO: 212883 - DNA, 22 bp, Artificial Sequence
  Synthetic oligonucleotide; TTG chr2 60538223 60538244 60538228 60538223 -
atctctttagatagataaaata

SEQ ID NO: 212884 - DNA, 22 bp, Artificial Sequence
  Synthetic oligonucleotide; CTC chr2 60538218 60538239 60538223 60538218 -
tttagatagataaaataccaag

SEQ ID NO: 212885 - DNA, 22 bp, Artificial Sequence
  Synthetic oligonucleotide; CTT chr2 60538216 60538237 60538221 60538216 -
tagatagataaaataccaagtt

SEQ ID NO: 212886 - DNA, 22 bp, Artificial Sequence
  Synthetic oligonucleotide; TTT chr2 60538215 60538236 60538220 60538215 -
agatagataaaataccaagttc

SEQ ID NO: 212887 - DNA, 22 bp, Artificial Sequence
  Synthetic oligonucleotide; TTA chr2 60538214 60538235 60538219 60538214 -
gatagataaaataccaagttct

SEQ ID NO: 212888 - DNA, 22 bp, Artificial Sequence
  Synthetic oligonucleotide; TTC chr2 60538193 60538214 60538198 60538193 -
tcagagtgctaaacaacaaatt

SEQ ID NO: 212889 - DNA, 22 bp, Artificial Sequence
  Synthetic oligonucleotide; CTC chr2 60538191 60538212 60538196 60538191 -
agagtgctaaacaacaaattat

SEQ ID NO: 212890 - DNA, 22 bp, Artificial Sequence
  Synthetic oligonucleotide; CTA chr2 60538182 60538203 60538187 60538182 -
aacaacaaattatatataccta

SEQ ID NO: 212891 - DNA, 22 bp, Artificial Sequence
  Synthetic oligonucleotide; TTA chr2 60538170 60538191 60538175 60538170 -
tatatacctaaaggtgagatga

SEQ ID NO: 212892 - DNA, 22 bp, Artificial Sequence
  Synthetic oligonucleotide; CTA chr2 60538160 60538181 60538165 60538160 -
aaggtgagatgatcaggtttaa

SEQ ID NO: 212893 - DNA, 22 bp, Artificial Sequence
  Synthetic oligonucleotide; TTT chr2 60538140 60538161 60538145 60538140 -
aaacttcctgtaaaagaggcga

SEQ ID NO: 212894 - DNA, 22 bp, Artificial Sequence
  Synthetic oligonucleotide; TTA chr2 60538139 60538160 60538144 60538139 -
aacttcctgtaaaagaggcgag

SEQ ID NO: 212895 - DNA, 22 bp, Artificial Sequence
  Synthetic oligonucleotide; CTT chr2 60538134 60538155 60538139 60538134 -
cctgtaaaagaggcgagaaggc

SEQ ID NO: 212896 - DNA, 22 bp, Artificial Sequence
  Synthetic oligonucleotide; TTC chr2 60538133 60538154 60538138 60538133 -
ctgtaaaagaggcgagaaggcg

SEQ ID NO: 212897 - DNA, 22 bp, Artificial Sequence
  Synthetic oligonucleotide; CTG chr2 60538130 60538151 60538135 60538130 -
taaaagaggcgagaaggcgcct

SEQ ID NO: 212898 - DNA, 22 bp, Artificial Sequence
  Synthetic oligonucleotide; CTT chr2 60538107 60538128 60538112 60538107 -
gcacacccttttccagataggg

SEQ ID NO: 212899 - DNA, 22 bp, Artificial Sequence
  Synthetic oligonucleotide; TTG chr2 60538106 60538127 60538111 60538106 -
cacacccttttccagatagggc

SEQ ID NO: 212900 - DNA, 22 bp, Artificial Sequence
  Synthetic oligonucleotide; CTT chr2 60538097 60538118 60538102 60538097 -
ttccagatagggctggcagcat

SEQ ID NO: 212901 - DNA, 22 bp, Artificial Sequence
  Synthetic oligonucleotide; TTT chr2 60538096 60538117 60538101 60538096 -
tccagatagggctggcagcatg

SEQ ID NO: 212902 - DNA, 22 bp, Artificial Sequence
  Synthetic oligonucleotide; TTT chr2 60538095 60538116 60538100 60538095 -
ccagatagggctggcagcatgt

SEQ ID NO: 212903 - DNA, 22 bp, Artificial Sequence
  Synthetic oligonucleotide; TTC chr2 60538094 60538115 60538099 60538094 -
cagatagggctggcagcatgtt

SEQ ID NO: 212904 - DNA, 22 bp, Artificial Sequence
  Synthetic oligonucleotide; CTG chr2 60538082 60538103 60538087 60538082 -
gcagcatgttattcagaactga

SEQ ID NO: 212905 - DNA, 22 bp, Artificial Sequence
  Synthetic oligonucleotide; TTA chr2 60538071 60538092 60538076 60538071 -
ttcagaactgaatcagtctctg

SEQ ID NO: 212906 - DNA, 22 bp, Artificial Sequence
  Synthetic oligonucleotide; TTC chr2 60538068 60538089 60538073 60538068 -
agaactgaatcagtctctgcca

SEQ ID NO: 212907 - DNA, 22 bp, Artificial Sequence
  Synthetic oligonucleotide; CTG chr2 60538061 60538082 60538066 60538061 -
aatcagtctctgccagagaatt

SEQ ID NO: 212908 - DNA, 22 bp, Artificial Sequence
  Synthetic oligonucleotide; CTC chr2 60538051 60538072 60538056 60538051 -
tgccagagaattcccagtggga

SEQ ID NO: 212909 - DNA, 22 bp, Artificial Sequence
  Synthetic oligonucleotide; CTG chr2 60538049 60538070 60538054 60538049 -
ccagagaattcccagtgggaac

SEQ ID NO: 212910 - DNA, 22 bp, Artificial Sequence
  Synthetic oligonucleotide; TTC chr2 60538038 60538059 60538043 60538038 -
ccagtgggaacctggagcaggt

SEQ ID NO: 212911 - DNA, 22 bp, Artificial Sequence
  Synthetic oligonucleotide; CTG chr2 60538024 60538045 60538029 60538024 -
gagcaggtatgttgatgaaggg

SEQ ID NO: 212912 - DNA, 22 bp, Artificial Sequence
  Synthetic oligonucleotide; TTG chr2 60538010 60538031 60538015 60538010 -
atgaaggggatacctggggacc

SEQ ID NO: 212913 - DNA, 22 bp, Artificial Sequence
  Synthetic oligonucleotide; CTG chr2 60537994 60538015 60537999 60537994 -
gggacctttggtcactcacaat

SEQ ID NO: 212914 - DNA, 22 bp, Artificial Sequence
  Synthetic oligonucleotide; CTT chr2 60537986 60538007 60537991 60537986 -
tggtcactcacaatgagttttt

SEQ ID NO: 212915 - DNA, 22 bp, Artificial Sequence
  Synthetic oligonucleotide; TTT chr2 60537985 60538006 60537990 60537985 -
ggtcactcacaatgagtttttg

SEQ ID NO: 212916 - DNA, 22 bp, Artificial Sequence
  Synthetic oligonucleotide; TTG chr2 60537984 60538005 60537989 60537984 -
gtcactcacaatgagtttttgt

SEQ ID NO: 212917 - DNA, 22 bp, Artificial Sequence
  Synthetic oligonucleotide; CTC chr2 60537977 60537998 60537982 60537977 -
acaatgagtttttgtttgtatt

SEQ ID NO: 212918 - DNA, 22 bp, Artificial Sequence
  Synthetic oligonucleotide; TTT chr2 60537966 60537987 60537971 60537966 -
ttgtttgtattctcactgttgt

SEQ ID NO: 212919 - DNA, 22 bp, Artificial Sequence
  Synthetic oligonucleotide; TTT chr2 60537965 60537986 60537970 60537965 -
tgtttgtattctcactgttgtt

SEQ ID NO: 212920 - DNA, 22 bp, Artificial Sequence
  Synthetic oligonucleotide; TTT chr2 60537964 60537985 60537969 60537964 -
gtttgtattctcactgttgtta

SEQ ID NO: 212921 - DNA, 22 bp, Artificial Sequence
  Synthetic oligonucleotide; TTG chr2 60537963 60537984 60537968 60537963 -
tttgtattctcactgttgttag

SEQ ID NO: 212922 - DNA, 22 bp, Artificial Sequence
  Synthetic oligonucleotide; TTT chr2 60537960 60537981 60537965 60537960 -
gtattctcactgttgttagcat

SEQ ID NO: 212923 - DNA, 22 bp, Artificial Sequence
  Synthetic oligonucleotide; TTG chr2 60537959 60537980 60537964 60537959 -
tattctcactgttgttagcatt

SEQ ID NO: 212924 - DNA, 22 bp, Artificial Sequence
  Synthetic oligonucleotide; TTC chr2 60537954 60537975 60537959 60537954 -
tcactgttgttagcattgccaa

SEQ ID NO: 212925 - DNA, 22 bp, Artificial Sequence
  Synthetic oligonucleotide; CTC chr2 60537952 60537973 60537957 60537952 -
actgttgttagcattgccaatg

SEQ ID NO: 212926 - DNA, 22 bp, Artificial Sequence
  Synthetic oligonucleotide; CTG chr2 60537948 60537969 60537953 60537948 -
ttgttagcattgccaatgaaca

SEQ ID NO: 212927 - DNA, 22 bp, Artificial Sequence
  Synthetic oligonucleotide; TTG chr2 60537945 60537966 60537950 60537945 -
ttagcattgccaatgaacaatt

SEQ ID NO: 212928 - DNA, 22 bp, Artificial Sequence
  Synthetic oligonucleotide; TTA chr2 60537942 60537963 60537947 60537942 -
gcattgccaatgaacaattgca

SEQ ID NO: 212929 - DNA, 22 bp, Artificial Sequence
  Synthetic oligonucleotide; TTG chr2 60537936 60537957 60537941 60537936 -
ccaatgaacaattgcacctaca

SEQ ID NO: 212930 - DNA, 22 bp, Artificial Sequence
  Synthetic oligonucleotide; TTG chr2 60537922 60537943 60537927 60537922 -
cacctacaatttgattttagtt

SEQ ID NO: 212931 - DNA, 22 bp, Artificial Sequence
  Synthetic oligonucleotide; CTA chr2 60537916 60537937 60537921 60537916 -
caatttgattttagttttagat

SEQ ID NO: 212932 - DNA, 22 bp, Artificial Sequence
  Synthetic oligonucleotide; TTT chr2 60537910 60537931 60537915 60537910 -
gattttagttttagatagaggc

SEQ ID NO: 212933 - DNA, 22 bp, Artificial Sequence
  Synthetic oligonucleotide; TTG chr2 60537909 60537930 60537914 60537909 -
attttagttttagatagaggcg

SEQ ID NO: 212934 - DNA, 22 bp, Artificial Sequence
  Synthetic oligonucleotide; TTT chr2 60537905 60537926 60537910 60537905 -
tagttttagatagaggcgaatc

SEQ ID NO: 212935 - DNA, 22 bp, Artificial Sequence
  Synthetic oligonucleotide; TTT chr2 60537904 60537925 60537909 60537904 -
agttttagatagaggcgaatcc

SEQ ID NO: 212936 - DNA, 22 bp, Artificial Sequence
  Synthetic oligonucleotide; TTA chr2 60537903 60537924 60537908 60537903 -
gttttagatagaggcgaatcca

SEQ ID NO: 212937 - DNA, 22 bp, Artificial Sequence
  Synthetic oligonucleotide; TTT chr2 60537899 60537920 60537904 60537899 -
tagatagaggcgaatccactga

SEQ ID NO: 212938 - DNA, 22 bp, Artificial Sequence
  Synthetic oligonucleotide; TTT chr2 60537898 60537919 60537903 60537898 -
agatagaggcgaatccactgat

SEQ ID NO: 212939 - DNA, 22 bp, Artificial Sequence
  Synthetic oligonucleotide; TTA chr2 60537897 60537918 60537902 60537897 -
gatagaggcgaatccactgatt

SEQ ID NO: 212940 - DNA, 22 bp, Artificial Sequence
  Synthetic oligonucleotide; CTG chr2 60537878 60537899 60537883 60537878 -
attaaaaactcccattaaaata

SEQ ID NO: 212941 - DNA, 22 bp, Artificial Sequence
  Synthetic oligonucleotide; TTA chr2 60537874 60537895 60537879 60537874 -
aaaactcccattaaaataaaga

SEQ ID NO: 212942 - DNA, 22 bp, Artificial Sequence
  Synthetic oligonucleotide; CTC chr2 60537867 60537888 60537872 60537867 -
ccattaaaataaagaatggaat

SEQ ID NO: 212943 - DNA, 22 bp, Artificial Sequence
  Synthetic oligonucleotide; TTA chr2 60537861 60537882 60537866 60537861 -
aaataaagaatggaattattgt

SEQ ID NO: 212944 - DNA, 22 bp, Artificial Sequence
  Synthetic oligonucleotide; TTA chr2 60537843 60537864 60537848 60537843 -
ttgtgaaacctgcaagggtgcc

SEQ ID NO: 212945 - DNA, 22 bp, Artificial Sequence
  Synthetic oligonucleotide; TTG chr2 60537840 60537861 60537845 60537840 -
tgaaacctgcaagggtgccttc

SEQ ID NO: 212946 - DNA, 22 bp, Artificial Sequence
  Synthetic oligonucleotide; CTG chr2 60537831 60537852 60537836 60537831 -
caagggtgccttcaaaaagaaa

SEQ ID NO: 212947 - DNA, 22 bp, Artificial Sequence
  Synthetic oligonucleotide; CTT chr2 60537819 60537840 60537824 60537819 -
caaaaagaaaaccagtgctgtt

SEQ ID NO: 212948 - DNA, 22 bp, Artificial Sequence
  Synthetic oligonucleotide; TTC chr2 60537818 60537839 60537823 60537818 -
aaaaagaaaaccagtgctgttg

SEQ ID NO: 212949 - DNA, 22 bp, Artificial Sequence
  Synthetic oligonucleotide; CTG chr2 60537799 60537820 60537804 60537799 -
ttgtatacctacctcgcctttc

SEQ ID NO: 212950 - DNA, 22 bp, Artificial Sequence
  Synthetic oligonucleotide; TTG chr2 60537796 60537817 60537801 60537796 -
tatacctacctcgcctttctat

SEQ ID NO: 212951 - DNA, 22 bp, Artificial Sequence
  Synthetic oligonucleotide; CTA chr2 60537788 60537809 60537793 60537788 -
cctcgcctttctatttgctttt

SEQ ID NO: 212952 - DNA, 22 bp, Artificial Sequence
  Synthetic oligonucleotide; CTC chr2 60537784 60537805 60537789 60537784 -
gcctttctatttgctttttgaa

SEQ ID NO: 212953 - DNA, 22 bp, Artificial Sequence
  Synthetic oligonucleotide; CTT chr2 60537779 60537800 60537784 60537779 -
tctatttgctttttgaactttc

SEQ ID NO: 212954 - DNA, 22 bp, Artificial Sequence
  Synthetic oligonucleotide; TTT chr2 60537778 60537799 60537783 60537778 -
ctatttgctttttgaactttct

SEQ ID NO: 212955 - DNA, 22 bp, Artificial Sequence
  Synthetic oligonucleotide; TTC chr2 60537777 60537798 60537782 60537777 -
tatttgctttttgaactttcta

SEQ ID NO: 212956 - DNA, 22 bp, Artificial Sequence
  Synthetic oligonucleotide; CTA chr2 60537775 60537796 60537780 60537775 -
tttgctttttgaactttctaaa

SEQ ID NO: 212957 - DNA, 22 bp, Artificial Sequence
  Synthetic oligonucleotide; TTT chr2 60537772 60537793 60537777 60537772 -
gctttttgaactttctaaaaaa

SEQ ID NO: 212958 - DNA, 22 bp, Artificial Sequence
  Synthetic oligonucleotide; TTG chr2 60537771 60537792 60537776 60537771 -
ctttttgaactttctaaaaaac

SEQ ID NO: 212959 - DNA, 22 bp, Artificial Sequence
  Synthetic oligonucleotide; CTT chr2 60537768 60537789 60537773 60537768 -
tttgaactttctaaaaaacaca

SEQ ID NO: 212960 - DNA, 22 bp, Artificial Sequence
  Synthetic oligonucleotide; TTT chr2 60537767 60537788 60537772 60537767 -
ttgaactttctaaaaaacacaa

SEQ ID NO: 212961 - DNA, 22 bp, Artificial Sequence
  Synthetic oligonucleotide; TTT chr2 60537766 60537787 60537771 60537766 -
tgaactttctaaaaaacacaag

SEQ ID NO: 212962 - DNA, 22 bp, Artificial Sequence
  Synthetic oligonucleotide; TTT chr2 60537765 60537786 60537770 60537765 -
gaactttctaaaaaacacaagg

SEQ ID NO: 212963 - DNA, 22 bp, Artificial Sequence
  Synthetic oligonucleotide; TTG chr2 60537764 60537785 60537769 60537764 -
aactttctaaaaaacacaagga

SEQ ID NO: 212964 - DNA, 22 bp, Artificial Sequence
  Synthetic oligonucleotide; CTT chr2 60537759 60537780 60537764 60537759 -
tctaaaaaacacaaggaagctt

SEQ ID NO: 212965 - DNA, 22 bp, Artificial Sequence
  Synthetic oligonucleotide; TTT chr2 60537758 60537779 60537763 60537758 -
ctaaaaaacacaaggaagcttt

SEQ ID NO: 212966 - DNA, 22 bp, Artificial Sequence
  Synthetic oligonucleotide; TTC chr2 60537757 60537778 60537762 60537757 -
taaaaaacacaaggaagctttt

SEQ ID NO: 212967 - DNA, 22 bp, Artificial Sequence
  Synthetic oligonucleotide; CTA chr2 60537755 60537776 60537760 60537755 -
aaaaacacaaggaagctttttg

SEQ ID NO: 212968 - DNA, 22 bp, Artificial Sequence
  Synthetic oligonucleotide; CTT chr2 60537737 60537758 60537742 60537737 -
tttgctaagcatcagggcattt

SEQ ID NO: 212969 - DNA, 22 bp, Artificial Sequence
  Synthetic oligonucleotide; TTT chr2 60537736 60537757 60537741 60537736 -
ttgctaagcatcagggcattta

SEQ ID NO: 212970 - DNA, 22 bp, Artificial Sequence
  Synthetic oligonucleotide; TTT chr2 60537735 60537756 60537740 60537735 -
tgctaagcatcagggcatttaa

SEQ ID NO: 212971 - DNA, 22 bp, Artificial Sequence
  Synthetic oligonucleotide; TTT chr2 60537734 60537755 60537739 60537734 -
gctaagcatcagggcatttaaa

SEQ ID NO: 212972 - DNA, 22 bp, Artificial Sequence
  Synthetic oligonucleotide; TTG chr2 60537733 60537754 60537738 60537733 -
ctaagcatcagggcatttaaat

SEQ ID NO: 212973 - DNA, 22 bp, Artificial Sequence
  Synthetic oligonucleotide; CTA chr2 60537730 60537751 60537735 60537730 -
agcatcagggcatttaaattta

SEQ ID NO: 212974 - DNA, 22 bp, Artificial Sequence
  Synthetic oligonucleotide; TTT chr2 60537715 60537736 60537720 60537715 -
aaatttatattcatcagttgtt

SEQ ID NO: 212975 - DNA, 22 bp, Artificial Sequence
  Synthetic oligonucleotide; TTA chr2 60537714 60537735 60537719 60537714 -
aatttatattcatcagttgttc

SEQ ID NO: 212976 - DNA, 22 bp, Artificial Sequence
  Synthetic oligonucleotide; TTT chr2 60537709 60537730 60537714 60537709 -
atattcatcagttgttcatttt

SEQ ID NO: 212977 - DNA, 22 bp, Artificial Sequence
  Synthetic oligonucleotide; TTA chr2 60537708 60537729 60537713 60537708 -
tattcatcagttgttcattttc

SEQ ID NO: 212978 - DNA, 22 bp, Artificial Sequence
  Synthetic oligonucleotide; TTC chr2 60537703 60537724 60537708 60537703 -
atcagttgttcattttcttaat

SEQ ID NO: 212979 - DNA, 22 bp, Artificial Sequence
  Synthetic oligonucleotide; TTG chr2 60537695 60537716 60537700 60537695 -
ttcattttcttaatatgtaatg

SEQ ID NO: 212980 - DNA, 22 bp, Artificial Sequence
  Synthetic oligonucleotide; TTC chr2 60537692 60537713 60537697 60537692 -
attttcttaatatgtaatgatg

SEQ ID NO: 212981 - DNA, 22 bp, Artificial Sequence
  Synthetic oligonucleotide; TTT chr2 60537688 60537709 60537693 60537688 -
tcttaatatgtaatgatgcata

SEQ ID NO: 212982 - DNA, 22 bp, Artificial Sequence
  Synthetic oligonucleotide; TTT chr2 60537687 60537708 60537692 60537687 -
cttaatatgtaatgatgcataa

SEQ ID NO: 212983 - DNA, 22 bp, Artificial Sequence
  Synthetic oligonucleotide; TTC chr2 60537686 60537707 60537691 60537686 -
ttaatatgtaatgatgcataaa

SEQ ID NO: 212984 - DNA, 22 bp, Artificial Sequence
  Synthetic oligonucleotide; CTT chr2 60537684 60537705 60537689 60537684 -
aatatgtaatgatgcataaaaa

SEQ ID NO: 212985 - DNA, 22 bp, Artificial Sequence
  Synthetic oligonucleotide; TTA chr2 60537683 60537704 60537688 60537683 -
atatgtaatgatgcataaaaag

SEQ ID NO: 212986 - DNA, 22 bp, Artificial Sequence
  Synthetic oligonucleotide; CTG chr2 60537657 60537678 60537662 60537657 -
caaggaaatcacatctgttaat

SEQ ID NO: 212987 - DNA, 22 bp, Artificial Sequence
  Synthetic oligonucleotide; CTG chr2 60537640 60537661 60537645 60537640 -
ttaatttttagggaaataaagt

SEQ ID NO: 212988 - DNA, 22 bp, Artificial Sequence
  Synthetic oligonucleotide; TTA chr2 60537637 60537658 60537642 60537637 -
atttttagggaaataaagtgta

SEQ ID NO: 212989 - DNA, 22 bp, Artificial Sequence
  Synthetic oligonucleotide; TTT chr2 60537633 60537654 60537638 60537633 -
ttagggaaataaagtgtagctt

SEQ ID NO: 212990 - DNA, 22 bp, Artificial Sequence
  Synthetic oligonucleotide; TTT chr2 60537632 60537653 60537637 60537632 -
tagggaaataaagtgtagcttg

SEQ ID NO: 212991 - DNA, 22 bp, Artificial Sequence
  Synthetic oligonucleotide; TTT chr2 60537631 60537652 60537636 60537631 -
agggaaataaagtgtagcttgg

SEQ ID NO: 212992 - DNA, 22 bp, Artificial Sequence
  Synthetic oligonucleotide; TTA chr2 60537630 60537651 60537635 60537630 -
gggaaataaagtgtagcttgga

SEQ ID NO: 212993 - DNA, 22 bp, Artificial Sequence
  Synthetic oligonucleotide; CTT chr2 60537611 60537632 60537616 60537611 -
ggattcttatgttggagcacaa

SEQ ID NO: 212994 - DNA, 22 bp, Artificial Sequence
  Synthetic oligonucleotide; TTG chr2 60537610 60537631 60537615 60537610 -
gattcttatgttggagcacaaa

SEQ ID NO: 212995 - DNA, 22 bp, Artificial Sequence
  Synthetic oligonucleotide; TTC chr2 60537605 60537626 60537610 60537605 -
ttatgttggagcacaaagcact

SEQ ID NO: 212996 - DNA, 22 bp, Artificial Sequence
  Synthetic oligonucleotide; CTT chr2 60537603 60537624 60537608 60537603 -
atgttggagcacaaagcactat

SEQ ID NO: 212997 - DNA, 22 bp, Artificial Sequence
  Synthetic oligonucleotide; TTA chr2 60537602 60537623 60537607 60537602 -
tgttggagcacaaagcactatg

SEQ ID NO: 212998 - DNA, 22 bp, Artificial Sequence
  Synthetic oligonucleotide; TTG chr2 60537597 60537618 60537602 60537597 -
gagcacaaagcactatgtgcca

SEQ ID NO: 212999 - DNA, 22 bp, Artificial Sequence
  Synthetic oligonucleotide; CTA chr2 60537582 60537603 60537587 60537582 -
tgtgccaagtctgttcctgtac

SEQ ID NO: 213000 - DNA, 22 bp, Artificial Sequence
  Synthetic oligonucleotide; CTG chr2 60537569 60537590 60537574 60537569 -
ttcctgtacattttaaatatag

SEQ ID NO: 213001 - DNA, 22 bp, Artificial Sequence
  Synthetic oligonucleotide; TTC chr2 60537566 60537587 60537571 60537566 -
ctgtacattttaaatatagagt

SEQ ID NO: 213002 - DNA, 22 bp, Artificial Sequence
  Synthetic oligonucleotide; CTG chr2 60537563 60537584 60537568 60537563 -
tacattttaaatatagagtttt

SEQ ID NO: 213003 - DNA, 22 bp, Artificial Sequence
  Synthetic oligonucleotide; TTT chr2 60537556 60537577 60537561 60537556 -
taaatatagagttttaatattt

SEQ ID NO: 213004 - DNA, 22 bp, Artificial Sequence
  Synthetic oligonucleotide; TTT chr2 60537555 60537576 60537560 60537555 -
aaatatagagttttaatatttg

SEQ ID NO: 213005 - DNA, 22 bp, Artificial Sequence
  Synthetic oligonucleotide; TTA chr2 60537554 60537575 60537559 60537554 -
aatatagagttttaatatttgg

SEQ ID NO: 213006 - DNA, 22 bp, Artificial Sequence
  Synthetic oligonucleotide; TTT chr2 60537542 60537563 60537547 60537542 -
taatatttggccaatccctgca

SEQ ID NO: 213007 - DNA, 22 bp, Artificial Sequence
  Synthetic oligonucleotide; TTT chr2 60537541 60537562 60537546 60537541 -
aatatttggccaatccctgcac

SEQ ID NO: 213008 - DNA, 22 bp, Artificial Sequence
  Synthetic oligonucleotide; TTA chr2 60537540 60537561 60537545 60537540 -
atatttggccaatccctgcacc

SEQ ID NO: 213009 - DNA, 22 bp, Artificial Sequence
  Synthetic oligonucleotide; TTT chr2 60537534 60537555 60537539 60537534 -
ggccaatccctgcacctcctca

SEQ ID NO: 213010 - DNA, 22 bp, Artificial Sequence
  Synthetic oligonucleotide; TTG chr2 60537533 60537554 60537538 60537533 -
gccaatccctgcacctcctcaa

SEQ ID NO: 213011 - DNA, 22 bp, Artificial Sequence
  Synthetic oligonucleotide; CTG chr2 60537522 60537543 60537527 60537522 -
cacctcctcaaacaaaaacaaa

SEQ ID NO: 213012 - DNA, 22 bp, Artificial Sequence
  Synthetic oligonucleotide; CTC chr2 60537516 60537537 60537521 60537516 -
ctcaaacaaaaacaaacctcaa

SEQ ID NO: 213013 - DNA, 22 bp, Artificial Sequence
  Synthetic oligonucleotide; CTC chr2 60537513 60537534 60537518 60537513 -
aaacaaaaacaaacctcaaaaa

SEQ ID NO: 213014 - DNA, 22 bp, Artificial Sequence
  Synthetic oligonucleotide; CTC chr2 60537496 60537517 60537501 60537496 -
aaaaaactaagagaaccaaacc

SEQ ID NO: 213015 - DNA, 22 bp, Artificial Sequence
  Synthetic oligonucleotide; CTA chr2 60537487 60537508 60537492 60537487 -
agagaaccaaacctgaagtatt

SEQ ID NO: 213016 - DNA, 22 bp, Artificial Sequence
  Synthetic oligonucleotide; CTG chr2 60537472 60537493 60537477 60537472 -
aagtattctccttcaccaactc

SEQ ID NO: 213017 - DNA, 22 bp, Artificial Sequence
  Synthetic oligonucleotide; TTC chr2 60537464 60537485 60537469 60537464 -
tccttcaccaactcaaggtata

SEQ ID NO: 213018 - DNA, 22 bp, Artificial Sequence
  Synthetic oligonucleotide; CTC chr2 60537462 60537483 60537467 60537462 -
cttcaccaactcaaggtatacc

SEQ ID NO: 213019 - DNA, 22 bp, Artificial Sequence
  Synthetic oligonucleotide; CTT chr2 60537459 60537480 60537464 60537459 -
caccaactcaaggtataccatg

SEQ ID NO: 213020 - DNA, 22 bp, Artificial Sequence
  Synthetic oligonucleotide; TTC chr2 60537458 60537479 60537463 60537458 -
accaactcaaggtataccatga

SEQ ID NO: 213021 - DNA, 22 bp, Artificial Sequence
  Synthetic oligonucleotide; CTC chr2 60537450 60537471 60537455 60537450 -
aaggtataccatgattttatga

SEQ ID NO: 213022 - DNA, 22 bp, Artificial Sequence
  Synthetic oligonucleotide; TTT chr2 60537433 60537454 60537438 60537433 -
tatgatttatttacatttaggg

SEQ ID NO: 213023 - DNA, 22 bp, Artificial Sequence
  Synthetic oligonucleotide; TTT chr2 60537432 60537453 60537437 60537432 -
atgatttatttacatttagggg

SEQ ID NO: 213024 - DNA, 22 bp, Artificial Sequence
  Synthetic oligonucleotide; TTA chr2 60537431 60537452 60537436 60537431 -
tgatttatttacatttaggggg

SEQ ID NO: 213025 - DNA, 22 bp, Artificial Sequence
  Synthetic oligonucleotide; TTT chr2 60537425 60537446 60537430 60537425 -
atttacatttaggggggaaccc

SEQ ID NO: 213026 - DNA, 22 bp, Artificial Sequence
  Synthetic oligonucleotide; TTA chr2 60537424 60537445 60537429 60537424 -
tttacatttaggggggaacccc

SEQ ID NO: 213027 - DNA, 22 bp, Artificial Sequence
  Synthetic oligonucleotide; TTT chr2 60537421 60537442 60537426 60537421 -
acatttaggggggaacccctca

SEQ ID NO: 213028 - DNA, 22 bp, Artificial Sequence
  Synthetic oligonucleotide; TTA chr2 60537420 60537441 60537425 60537420 -
catttaggggggaacccctcag

SEQ ID NO: 213029 - DNA, 22 bp, Artificial Sequence
  Synthetic oligonucleotide; TTT chr2 60537415 60537436 60537420 60537415 -
aggggggaacccctcagtgaac

SEQ ID NO: 213030 - DNA, 22 bp, Artificial Sequence
  Synthetic oligonucleotide; TTA chr2 60537414 60537435 60537419 60537414 -
ggggggaacccctcagtgaacc

SEQ ID NO: 213031 - DNA, 22 bp, Artificial Sequence
  Synthetic oligonucleotide; CTC chr2 60537400 60537421 60537405 60537400 -
agtgaaccatttactccccatt

SEQ ID NO: 213032 - DNA, 22 bp, Artificial Sequence
  Synthetic oligonucleotide; TTT chr2 60537388 60537409 60537393 60537388 -
actccccattttaactcccctg

SEQ ID NO: 213033 - DNA, 22 bp, Artificial Sequence
  Synthetic oligonucleotide; TTA chr2 60537387 60537408 60537392 60537387 -
ctccccattttaactcccctgc

SEQ ID NO: 213034 - DNA, 22 bp, Artificial Sequence
  Synthetic oligonucleotide; CTC chr2 60537384 60537405 60537389 60537384 -
cccattttaactcccctgcccc

SEQ ID NO: 213035 - DNA, 22 bp, Artificial Sequence
  Synthetic oligonucleotide; TTT chr2 60537377 60537398 60537382 60537377 -
taactcccctgccccgatcctt

SEQ ID NO: 213036 - DNA, 22 bp, Artificial Sequence
  Synthetic oligonucleotide; TTT chr2 60537376 60537397 60537381 60537376 -
aactcccctgccccgatccttt

SEQ ID NO: 213037 - DNA, 22 bp, Artificial Sequence
  Synthetic oligonucleotide; TTA chr2 60537375 60537396 60537380 60537375 -
actcccctgccccgatcctttc

SEQ ID NO: 213038 - DNA, 22 bp, Artificial Sequence
  Synthetic oligonucleotide; CTC chr2 60537371 60537392 60537376 60537371 -
ccctgccccgatcctttcagtt

SEQ ID NO: 213039 - DNA, 22 bp, Artificial Sequence
  Synthetic oligonucleotide; CTG chr2 60537366 60537387 60537371 60537366 -
ccccgatcctttcagtttccag

SEQ ID NO: 213040 - DNA, 22 bp, Artificial Sequence
  Synthetic oligonucleotide; CTT chr2 60537355 60537376 60537360 60537355 -
tcagtttccagttaaaacaatg

SEQ ID NO: 213041 - DNA, 22 bp, Artificial Sequence
  Synthetic oligonucleotide; TTT chr2 60537354 60537375 60537359 60537354 -
cagtttccagttaaaacaatgc

SEQ ID NO: 213042 - DNA, 22 bp, Artificial Sequence
  Synthetic oligonucleotide; TTC chr2 60537353 60537374 60537358 60537353 -
agtttccagttaaaacaatgca

SEQ ID NO: 213043 - DNA, 22 bp, Artificial Sequence
  Synthetic oligonucleotide; TTT chr2 60537348 60537369 60537353 60537348 -
ccagttaaaacaatgcattaac

SEQ ID NO: 213044 - DNA, 22 bp, Artificial Sequence
  Synthetic oligonucleotide; TTC chr2 60537347 60537368 60537352 60537347 -
cagttaaaacaatgcattaacc

SEQ ID NO: 213045 - DNA, 22 bp, Artificial Sequence
  Synthetic oligonucleotide; TTA chr2 60537341 60537362 60537346 60537341 -
aaacaatgcattaaccaatgtt

SEQ ID NO: 213046 - DNA, 22 bp, Artificial Sequence
  Synthetic oligonucleotide; TTA chr2 60537328 60537349 60537333 60537328 -
accaatgttaaatcttaaatct

SEQ ID NO: 213047 - DNA, 22 bp, Artificial Sequence
  Synthetic oligonucleotide; TTA chr2 60537318 60537339 60537323 60537318 -
aatcttaaatctcgtgagtttc

SEQ ID NO: 213048 - DNA, 22 bp, Artificial Sequence
  Synthetic oligonucleotide; CTT chr2 60537312 60537333 60537317 60537312 -
aaatctcgtgagtttctctcca

SEQ ID NO: 213049 - DNA, 22 bp, Artificial Sequence
  Synthetic oligonucleotide; TTA chr2 60537311 60537332 60537316 60537311 -
aatctcgtgagtttctctccat

SEQ ID NO: 213050 - DNA, 22 bp, Artificial Sequence
  Synthetic oligonucleotide; CTC chr2 60537305 60537326 60537310 60537305 -
gtgagtttctctccatcacacc

SEQ ID NO: 213051 - DNA, 22 bp, Artificial Sequence
  Synthetic oligonucleotide; TTT chr2 60537297 60537318 60537302 60537297 -
ctctccatcacaccctaatatt

SEQ ID NO: 213052 - DNA, 22 bp, Artificial Sequence
  Synthetic oligonucleotide; TTC chr2 60537296 60537317 60537301 60537296 -
tctccatcacaccctaatattt

SEQ ID NO: 213053 - DNA, 22 bp, Artificial Sequence
  Synthetic oligonucleotide; CTC chr2 60537294 60537315 60537299 60537294 -
tccatcacaccctaatatttta

SEQ ID NO: 213054 - DNA, 22 bp, Artificial Sequence
  Synthetic oligonucleotide; CTC chr2 60537292 60537313 60537297 60537292 -
catcacaccctaatattttaaa

SEQ ID NO: 213055 - DNA, 22 bp, Artificial Sequence
  Synthetic oligonucleotide; CTA chr2 60537280 60537301 60537285 60537280 -
atattttaaaaaaattattcct

SEQ ID NO: 213056 - DNA, 22 bp, Artificial Sequence
  Synthetic oligonucleotide; TTT chr2 60537274 60537295 60537279 60537274 -
taaaaaaattattcctttacat

SEQ ID NO: 213057 - DNA, 22 bp, Artificial Sequence
  Synthetic oligonucleotide; TTT chr2 60537273 60537294 60537278 60537273 -
aaaaaaattattcctttacatt

SEQ ID NO: 213058 - DNA, 22 bp, Artificial Sequence
  Synthetic oligonucleotide; TTA chr2 60537272 60537293 60537277 60537272 -
aaaaaattattcctttacattt

SEQ ID NO: 213059 - DNA, 22 bp, Artificial Sequence
  Synthetic oligonucleotide; TTA chr2 60537263 60537284 60537268 60537263 -
ttcctttacatttaaaactgaa

SEQ ID NO: 213060 - DNA, 22 bp, Artificial Sequence
  Synthetic oligonucleotide; TTC chr2 60537260 60537281 60537265 60537260 -
ctttacatttaaaactgaacat

SEQ ID NO: 213061 - DNA, 22 bp, Artificial Sequence
  Synthetic oligonucleotide; CTT chr2 60537257 60537278 60537262 60537257 -
tacatttaaaactgaacattgg

SEQ ID NO: 213062 - DNA, 22 bp, Artificial Sequence
  Synthetic oligonucleotide; TTT chr2 60537256 60537277 60537261 60537256 -
acatttaaaactgaacattggc

SEQ ID NO: 213063 - DNA, 22 bp, Artificial Sequence
  Synthetic oligonucleotide; TTA chr2 60537255 60537276 60537260 60537255 -
catttaaaactgaacattggct

SEQ ID NO: 213064 - DNA, 22 bp, Artificial Sequence
  Synthetic oligonucleotide; TTT chr2 60537250 60537271 60537255 60537250 -
aaaactgaacattggctactga

SEQ ID NO: 213065 - DNA, 22 bp, Artificial Sequence
  Synthetic oligonucleotide; TTA chr2 60537249 60537270 60537254 60537249 -
aaactgaacattggctactgaa

SEQ ID NO: 213066 - DNA, 22 bp, Artificial Sequence
  Synthetic oligonucleotide; CTG chr2 60537243 60537264 60537248 60537243 -
aacattggctactgaagaatga

SEQ ID NO: 213067 - DNA, 22 bp, Artificial Sequence
  Synthetic oligonucleotide; TTG chr2 60537236 60537257 60537241 60537236 -
gctactgaagaatgatttaaag

SEQ ID NO: 213068 - DNA, 22 bp, Artificial Sequence
  Synthetic oligonucleotide; CTA chr2 60537232 60537253 60537237 60537232 -
ctgaagaatgatttaaaggctg

SEQ ID NO: 213069 - DNA, 22 bp, Artificial Sequence
  Synthetic oligonucleotide; CTG chr2 60537229 60537250 60537234 60537229 -
aagaatgatttaaaggctgaaa

SEQ ID NO: 213070 - DNA, 22 bp, Artificial Sequence
  Synthetic oligonucleotide; TTT chr2 60537218 60537239 60537223 60537218 -
aaaggctgaaaaaaattttaat

SEQ ID NO: 213071 - DNA, 22 bp, Artificial Sequence
  Synthetic oligonucleotide; TTA chr2 60537217 60537238 60537222 60537217 -
aaggctgaaaaaaattttaata

SEQ ID NO: 213072 - DNA, 22 bp, Artificial Sequence
  Synthetic oligonucleotide; CTG chr2 60537210 60537231 60537215 60537210 -
aaaaaaattttaataataaatc

SEQ ID NO: 213073 - DNA, 22 bp, Artificial Sequence
  Synthetic oligonucleotide; TTT chr2 60537200 60537221 60537205 60537200 -
taataataaatcgtaaccttct

SEQ ID NO: 213074 - DNA, 22 bp, Artificial Sequence
  Synthetic oligonucleotide; TTT chr2 60537199 60537220 60537204 60537199 -
aataataaatcgtaaccttctc

SEQ ID NO: 213075 - DNA, 22 bp, Artificial Sequence
  Synthetic oligonucleotide; TTA chr2 60537198 60537219 60537203 60537198 -
ataataaatcgtaaccttctca

SEQ ID NO: 213076 - DNA, 22 bp, Artificial Sequence
  Synthetic oligonucleotide; CTT chr2 60537180 60537201 60537185 60537180 -
ctcatgttatgtttttgttatg

SEQ ID NO: 213077 - DNA, 22 bp, Artificial Sequence
  Synthetic oligonucleotide; TTC chr2 60537179 60537200 60537184 60537179 -
tcatgttatgtttttgttatgt

SEQ ID NO: 213078 - DNA, 22 bp, Artificial Sequence
  Synthetic oligonucleotide; CTC chr2 60537177 60537198 60537182 60537177 -
atgttatgtttttgttatgtta

SEQ ID NO: 213079 - DNA, 22 bp, Artificial Sequence
  Synthetic oligonucleotide; TTA chr2 60537171 60537192 60537176 60537171 -
tgtttttgttatgttaaggaga

SEQ ID NO: 213080 - DNA, 22 bp, Artificial Sequence
  Synthetic oligonucleotide; TTT chr2 60537166 60537187 60537171 60537166 -
ttgttatgttaaggagaaaaaa

SEQ ID NO: 213081 - DNA, 22 bp, Artificial Sequence
  Synthetic oligonucleotide; TTT chr2 60537165 60537186 60537170 60537165 -
tgttatgttaaggagaaaaaaa

SEQ ID NO: 213082 - DNA, 22 bp, Artificial Sequence
  Synthetic oligonucleotide; TTT chr2 60537164 60537185 60537169 60537164 -
gttatgttaaggagaaaaaaat

SEQ ID NO: 213083 - DNA, 22 bp, Artificial Sequence
  Synthetic oligonucleotide; TTG chr2 60537163 60537184 60537168 60537163 -
ttatgttaaggagaaaaaaatc

SEQ ID NO: 213084 - DNA, 22 bp, Artificial Sequence
  Synthetic oligonucleotide; TTA chr2 60537160 60537181 60537165 60537160 -
tgttaaggagaaaaaaatcaat

SEQ ID NO: 213085 - DNA, 22 bp, Artificial Sequence
  Synthetic oligonucleotide; TTA chr2 60537155 60537176 60537160 60537155 -
aggagaaaaaaatcaataagga

SEQ ID NO: 213086 - DNA, 22 bp, Artificial Sequence
  Synthetic oligonucleotide; TTT chr2 60537126 60537147 60537131 60537126 -
aattctgataaagatactcttg

SEQ ID NO: 213087 - DNA, 22 bp, Artificial Sequence
  Synthetic oligonucleotide; TTA chr2 60537125 60537146 60537130 60537125 -
attctgataaagatactcttgg

SEQ ID NO: 213088 - DNA, 22 bp, Artificial Sequence
  Synthetic oligonucleotide; TTC chr2 60537121 60537142 60537126 60537121 -
tgataaagatactcttggatct

SEQ ID NO: 213089 - DNA, 22 bp, Artificial Sequence
  Synthetic oligonucleotide; CTG chr2 60537119 60537140 60537124 60537119 -
ataaagatactcttggatcttt

SEQ ID NO: 213090 - DNA, 22 bp, Artificial Sequence
  Synthetic oligonucleotide; CTC chr2 60537107 60537128 60537112 60537107 -
ttggatctttgaaaacaactgc

SEQ ID NO: 213091 - DNA, 22 bp, Artificial Sequence
  Synthetic oligonucleotide; CTT chr2 60537105 60537126 60537110 60537105 -
ggatctttgaaaacaactgctg

SEQ ID NO: 213092 - DNA, 22 bp, Artificial Sequence
  Synthetic oligonucleotide; TTG chr2 60537104 60537125 60537109 60537104 -
gatctttgaaaacaactgctgt

SEQ ID NO: 213093 - DNA, 22 bp, Artificial Sequence
  Synthetic oligonucleotide; CTT chr2 60537098 60537119 60537103 60537098 -
tgaaaacaactgctgtcctttt

SEQ ID NO: 213094 - DNA, 22 bp, Artificial Sequence
  Synthetic oligonucleotide; TTT chr2 60537097 60537118 60537102 60537097 -
gaaaacaactgctgtcctttta

SEQ ID NO: 213095 - DNA, 22 bp, Artificial Sequence
  Synthetic oligonucleotide; TTG chr2 60537096 60537117 60537101 60537096 -
aaaacaactgctgtccttttaa

SEQ ID NO: 213096 - DNA, 22 bp, Artificial Sequence
  Synthetic oligonucleotide; CTG chr2 60537086 60537107 60537091 60537086 -
ctgtccttttaactaaaacatt

SEQ ID NO: 213097 - DNA, 22 bp, Artificial Sequence
  Synthetic oligonucleotide; CTG chr2 60537083 60537104 60537088 60537083 -
tccttttaactaaaacatttga

SEQ ID NO: 213098 - DNA, 22 bp, Artificial Sequence
  Synthetic oligonucleotide; CTT chr2 60537078 60537099 60537083 60537078 -
ttaactaaaacatttgagcagc

SEQ ID NO: 213099 - DNA, 22 bp, Artificial Sequence
  Synthetic oligonucleotide; TTT chr2 60537077 60537098 60537082 60537077 -
taactaaaacatttgagcagct

SEQ ID NO: 213100 - DNA, 22 bp, Artificial Sequence
  Synthetic oligonucleotide; TTT chr2 60537076 60537097 60537081 60537076 -
aactaaaacatttgagcagctt

SEQ ID NO: 213101 - DNA, 22 bp, Artificial Sequence
  Synthetic oligonucleotide; TTA chr2 60537075 60537096 60537080 60537075 -
actaaaacatttgagcagcttc

SEQ ID NO: 213102 - DNA, 22 bp, Artificial Sequence
  Synthetic oligonucleotide; CTA chr2 60537071 60537092 60537076 60537071 -
aaacatttgagcagcttcaaag

SEQ ID NO: 213103 - DNA, 22 bp, Artificial Sequence
  Synthetic oligonucleotide; TTT chr2 60537063 60537084 60537068 60537063 -
gagcagcttcaaagactatgta

SEQ ID NO: 213104 - DNA, 22 bp, Artificial Sequence
  Synthetic oligonucleotide; TTG chr2 60537062 60537083 60537067 60537062 -
agcagcttcaaagactatgtat

SEQ ID NO: 213105 - DNA, 22 bp, Artificial Sequence
  Synthetic oligonucleotide; CTT chr2 60537054 60537075 60537059 60537054 -
caaagactatgtatttcttctg

SEQ ID NO: 213106 - DNA, 22 bp, Artificial Sequence
  Synthetic oligonucleotide; TTC chr2 60537053 60537074 60537058 60537053 -
aaagactatgtatttcttctga

SEQ ID NO: 213107 - DNA, 22 bp, Artificial Sequence
  Synthetic oligonucleotide; CTA chr2 60537045 60537066 60537050 60537045 -
tgtatttcttctgatcttggag

SEQ ID NO: 213108 - DNA, 22 bp, Artificial Sequence
  Synthetic oligonucleotide; TTT chr2 60537038 60537059 60537043 60537038 -
cttctgatcttggagctgtgtg

SEQ ID NO: 213109 - DNA, 22 bp, Artificial Sequence
  Synthetic oligonucleotide; TTC chr2 60537037 60537058 60537042 60537037 -
ttctgatcttggagctgtgtga

SEQ ID NO: 213110 - DNA, 22 bp, Artificial Sequence
  Synthetic oligonucleotide; CTT chr2 60537035 60537056 60537040 60537035 -
ctgatcttggagctgtgtgact

SEQ ID NO: 213111 - DNA, 22 bp, Artificial Sequence
  Synthetic oligonucleotide; TTC chr2 60537034 60537055 60537039 60537034 -
tgatcttggagctgtgtgactg

SEQ ID NO: 213112 - DNA, 22 bp, Artificial Sequence
  Synthetic oligonucleotide; CTG chr2 60537032 60537053 60537037 60537032 -
atcttggagctgtgtgactggt

SEQ ID NO: 213113 - DNA, 22 bp, Artificial Sequence
  Synthetic oligonucleotide; CTT chr2 60537027 60537048 60537032 60537027 -
ggagctgtgtgactggtagcaa

SEQ ID NO: 213114 - DNA, 22 bp, Artificial Sequence
  Synthetic oligonucleotide; TTG chr2 60537026 60537047 60537031 60537026 -
gagctgtgtgactggtagcaag

SEQ ID NO: 213115 - DNA, 22 bp, Artificial Sequence
  Synthetic oligonucleotide; CTG chr2 60537020 60537041 60537025 60537020 -
tgtgactggtagcaagaaagaa

SEQ ID NO: 213116 - DNA, 22 bp, Artificial Sequence
  Synthetic oligonucleotide; CTG chr2 60537012 60537033 60537017 60537012 -
gtagcaagaaagaaaaaaaatc

SEQ ID NO: 213117 - DNA, 22 bp, Artificial Sequence
  Synthetic oligonucleotide; CTT chr2 60536988 60537009 60536993 60536988 -
attctacatacaagtggattgc

SEQ ID NO: 213118 - DNA, 22 bp, Artificial Sequence
  Synthetic oligonucleotide; TTA chr2 60536987 60537008 60536992 60536987 -
ttctacatacaagtggattgct

SEQ ID NO: 213119 - DNA, 22 bp, Artificial Sequence
  Synthetic oligonucleotide; TTC chr2 60536984 60537005 60536989 60536984 -
tacatacaagtggattgcttaa

SEQ ID NO: 213120 - DNA, 22 bp, Artificial Sequence
  Synthetic oligonucleotide; CTA chr2 60536982 60537003 60536987 60536982 -
catacaagtggattgcttaaca

SEQ ID NO: 213121 - DNA, 22 bp, Artificial Sequence
  Synthetic oligonucleotide; TTG chr2 60536967 60536988 60536972 60536967 -
cttaacaagtcagcacagacac

SEQ ID NO: 213122 - DNA, 22 bp, Artificial Sequence
  Synthetic oligonucleotide; CTT chr2 60536964 60536985 60536969 60536964 -
aacaagtcagcacagacacgta

SEQ ID NO: 213123 - DNA, 22 bp, Artificial Sequence
  Synthetic oligonucleotide; TTA chr2 60536963 60536984 60536968 60536963 -
acaagtcagcacagacacgtac

SEQ ID NO: 213124 - DNA, 22 bp, Artificial Sequence
  Synthetic oligonucleotide; CTT chr2 60536939 60536960 60536944 60536939 -
gtttgtacaatagagataaaaa

SEQ ID NO: 213125 - DNA, 22 bp, Artificial Sequence
  Synthetic oligonucleotide; TTG chr2 60536938 60536959 60536943 60536938 -
tttgtacaatagagataaaaat

SEQ ID NO: 213126 - DNA, 22 bp, Artificial Sequence
  Synthetic oligonucleotide; TTT chr2 60536935 60536956 60536940 60536935 -
gtacaatagagataaaaattcc

SEQ ID NO: 213127 - DNA, 22 bp, Artificial Sequence
  Synthetic oligonucleotide; TTG chr2 60536934 60536955 60536939 60536934 -
tacaatagagataaaaattcct

SEQ ID NO: 213128 - DNA, 22 bp, Artificial Sequence
  Synthetic oligonucleotide; TTC chr2 60536914 60536935 60536919 60536914 -
ctgtataaaaataattcagctg

SEQ ID NO: 213129 - DNA, 22 bp, Artificial Sequence
  Synthetic oligonucleotide; CTG chr2 60536911 60536932 60536916 60536911 -
tataaaaataattcagctgctg

SEQ ID NO: 213130 - DNA, 22 bp, Artificial Sequence
  Synthetic oligonucleotide; TTC chr2 60536897 60536918 60536902 60536897 -
agctgctgacagcaggcattgt

SEQ ID NO: 213131 - DNA, 22 bp, Artificial Sequence
  Synthetic oligonucleotide; CTG chr2 60536892 60536913 60536897 60536892 -
ctgacagcaggcattgttgttg

SEQ ID NO: 213132 - DNA, 22 bp, Artificial Sequence
  Synthetic oligonucleotide; CTG chr2 60536889 60536910 60536894 60536889 -
acagcaggcattgttgttggac

SEQ ID NO: 213133 - DNA, 22 bp, Artificial Sequence
  Synthetic oligonucleotide; TTG chr2 60536876 60536897 60536881 60536876 -
ttgttggacctgtcttttgtgc

SEQ ID NO: 213134 - DNA, 22 bp, Artificial Sequence
  Synthetic oligonucleotide; TTG chr2 60536873 60536894 60536878 60536873 -
ttggacctgtcttttgtgcttg

SEQ ID NO: 213135 - DNA, 22 bp, Artificial Sequence
  Synthetic oligonucleotide; TTG chr2 60536870 60536891 60536875 60536870 -
gacctgtcttttgtgcttgtcc

SEQ ID NO: 213136 - DNA, 22 bp, Artificial Sequence
  Synthetic oligonucleotide; CTG chr2 60536864 60536885 60536869 60536864 -
tcttttgtgcttgtcccagctc

SEQ ID NO: 213137 - DNA, 22 bp, Artificial Sequence
  Synthetic oligonucleotide; CTT chr2 60536860 60536881 60536865 60536860 -
ttgtgcttgtcccagctctggg

SEQ ID NO: 213138 - DNA, 22 bp, Artificial Sequence
  Synthetic oligonucleotide; TTT chr2 60536859 60536880 60536864 60536859 -
tgtgcttgtcccagctctgggt

SEQ ID NO: 213139 - DNA, 22 bp, Artificial Sequence
  Synthetic oligonucleotide; TTT chr2 60536858 60536879 60536863 60536858 -
gtgcttgtcccagctctgggtc

SEQ ID NO: 213140 - DNA, 22 bp, Artificial Sequence
  Synthetic oligonucleotide; TTG chr2 60536857 60536878 60536862 60536857 -
tgcttgtcccagctctgggtcc

SEQ ID NO: 213141 - DNA, 22 bp, Artificial Sequence
  Synthetic oligonucleotide; CTT chr2 60536852 60536873 60536857 60536852 -
gtcccagctctgggtccccctc

SEQ ID NO: 213142 - DNA, 22 bp, Artificial Sequence
  Synthetic oligonucleotide; TTG chr2 60536851 60536872 60536856 60536851 -
tcccagctctgggtccccctcc

SEQ ID NO: 213143 - DNA, 22 bp, Artificial Sequence
  Synthetic oligonucleotide; CTC chr2 60536842 60536863 60536847 60536842 -
tgggtccccctcccctcctatc

SEQ ID NO: 213144 - DNA, 22 bp, Artificial Sequence
  Synthetic oligonucleotide; CTG chr2 60536840 60536861 60536845 60536840 -
ggtccccctcccctcctatctg

SEQ ID NO: 213145 - DNA, 22 bp, Artificial Sequence
  Synthetic oligonucleotide; CTC chr2 60536830 60536851 60536835 60536830 -
ccctcctatctgcttggggcag

SEQ ID NO: 213146 - DNA, 22 bp, Artificial Sequence
  Synthetic oligonucleotide; CTC chr2 60536825 60536846 60536830 60536825 -
ctatctgcttggggcagcctgc

SEQ ID NO: 213147 - DNA, 22 bp, Artificial Sequence
  Synthetic oligonucleotide; CTA chr2 60536822 60536843 60536827 60536822 -
tctgcttggggcagcctgctgc

SEQ ID NO: 213148 - DNA, 22 bp, Artificial Sequence
  Synthetic oligonucleotide; CTG chr2 60536818 60536839 60536823 60536818 -
cttggggcagcctgctgcctgc

SEQ ID NO: 213149 - DNA, 22 bp, Artificial Sequence
  Synthetic oligonucleotide; CTT chr2 60536815 60536836 60536820 60536815 -
ggggcagcctgctgcctgcaca

SEQ ID NO: 213150 - DNA, 22 bp, Artificial Sequence
  Synthetic oligonucleotide; TTG chr2 60536814 60536835 60536819 60536814 -
gggcagcctgctgcctgcacac

SEQ ID NO: 213151 - DNA, 22 bp, Artificial Sequence
  Synthetic oligonucleotide; CTG chr2 60536804 60536825 60536809 60536804 -
ctgcctgcacactgctgaccag

SEQ ID NO: 213152 - DNA, 22 bp, Artificial Sequence
  Synthetic oligonucleotide; CTG chr2 60536801 60536822 60536806 60536801 -
cctgcacactgctgaccagaag

SEQ ID NO: 213153 - DNA, 22 bp, Artificial Sequence
  Synthetic oligonucleotide; CTG chr2 60536797 60536818 60536802 60536797 -
cacactgctgaccagaagttaa

SEQ ID NO: 213154 - DNA, 22 bp, Artificial Sequence
  Synthetic oligonucleotide; CTG chr2 60536790 60536811 60536795 60536790 -
ctgaccagaagttaattgctat

SEQ ID NO: 213155 - DNA, 22 bp, Artificial Sequence
  Synthetic oligonucleotide; CTG chr2 60536787 60536808 60536792 60536787 -
accagaagttaattgctatata

SEQ ID NO: 213156 - DNA, 22 bp, Artificial Sequence
  Synthetic oligonucleotide; TTA chr2 60536776 60536797 60536781 60536776 -
attgctatatattaagtatata

SEQ ID NO: 213157 - DNA, 22 bp, Artificial Sequence
  Synthetic oligonucleotide; TTG chr2 60536772 60536793 60536777 60536772 -
ctatatattaagtatataggta

SEQ ID NO: 213158 - DNA, 22 bp, Artificial Sequence
  Synthetic oligonucleotide; CTA chr2 60536769 60536790 60536774 60536769 -
tatattaagtatataggtattg

SEQ ID NO: 213159 - DNA, 22 bp, Artificial Sequence
  Synthetic oligonucleotide; TTA chr2 60536762 60536783 60536767 60536762 -
agtatataggtattgtatttaa

SEQ ID NO: 213160 - DNA, 22 bp, Artificial Sequence
  Synthetic oligonucleotide; TTG chr2 60536747 60536768 60536752 60536747 -
tatttaaagaggaatatctcaa

SEQ ID NO: 213161 - DNA, 22 bp, Artificial Sequence
  Synthetic oligonucleotide; TTT chr2 60536742 60536763 60536747 60536742 -
aaagaggaatatctcaaggctt

SEQ ID NO: 213162 - DNA, 22 bp, Artificial Sequence
  Synthetic oligonucleotide; TTA chr2 60536741 60536762 60536746 60536741 -
aagaggaatatctcaaggcttc

SEQ ID NO: 213163 - DNA, 22 bp, Artificial Sequence
  Synthetic oligonucleotide; CTC chr2 60536727 60536748 60536732 60536727 -
aaggcttcctatatgcattcca

SEQ ID NO: 213164 - DNA, 22 bp, Artificial Sequence
  Synthetic oligonucleotide; CTT chr2 60536720 60536741 60536725 60536720 -
cctatatgcattccactttact

SEQ ID NO: 213165 - DNA, 22 bp, Artificial Sequence
  Synthetic oligonucleotide; TTC chr2 60536719 60536740 60536724 60536719 -
ctatatgcattccactttactt

SEQ ID NO: 213166 - DNA, 22 bp, Artificial Sequence
  Synthetic oligonucleotide; CTA chr2 60536716 60536737 60536721 60536716 -
tatgcattccactttactttct

SEQ ID NO: 213167 - DNA, 22 bp, Artificial Sequence
  Synthetic oligonucleotide; TTC chr2 60536707 60536728 60536712 60536707 -
cactttactttctgatgtgatt

SEQ ID NO: 213168 - DNA, 22 bp, Artificial Sequence
  Synthetic oligonucleotide; CTT chr2 60536702 60536723 60536707 60536702 -
tactttctgatgtgattgcggt

SEQ ID NO: 213169 - DNA, 22 bp, Artificial Sequence
  Synthetic oligonucleotide; TTT chr2 60536701 60536722 60536706 60536701 -
actttctgatgtgattgcggtg

SEQ ID NO: 213170 - DNA, 22 bp, Artificial Sequence
  Synthetic oligonucleotide; TTA chr2 60536700 60536721 60536705 60536700 -
ctttctgatgtgattgcggtgt

SEQ ID NO: 213171 - DNA, 22 bp, Artificial Sequence
  Synthetic oligonucleotide; CTT chr2 60536697 60536718 60536702 60536697 -
tctgatgtgattgcggtgttgc

SEQ ID NO: 213172 - DNA, 22 bp, Artificial Sequence
  Synthetic oligonucleotide; TTT chr2 60536696 60536717 60536701 60536696 -
ctgatgtgattgcggtgttgcc

SEQ ID NO: 213173 - DNA, 22 bp, Artificial Sequence
  Synthetic oligonucleotide; TTC chr2 60536695 60536716 60536700 60536695 -
tgatgtgattgcggtgttgcca

SEQ ID NO: 213174 - DNA, 22 bp, Artificial Sequence
  Synthetic oligonucleotide; CTG chr2 60536693 60536714 60536698 60536693 -
atgtgattgcggtgttgccagc

SEQ ID NO: 213175 - DNA, 22 bp, Artificial Sequence
  Synthetic oligonucleotide; TTG chr2 60536684 60536705 60536689 60536684 -
cggtgttgccagcaggggggtg

SEQ ID NO: 213176 - DNA, 22 bp, Artificial Sequence
  Synthetic oligonucleotide; TTG chr2 60536676 60536697 60536681 60536676 -
ccagcaggggggtggcaggcaa

SEQ ID NO: 213177 - DNA, 22 bp, Artificial Sequence
  Synthetic oligonucleotide; CTC chr2 60536648 60536669 60536653 60536648 -
taatagggaaaatcacttgaag

SEQ ID NO: 213178 - DNA, 22 bp, Artificial Sequence
  Synthetic oligonucleotide; CTA chr2 60536646 60536667 60536651 60536646 -
atagggaaaatcacttgaaggc

SEQ ID NO: 213179 - DNA, 22 bp, Artificial Sequence
  Synthetic oligonucleotide; CTT chr2 60536630 60536651 60536635 60536630 -
gaaggcagttaggggaaatttg

SEQ ID NO: 213180 - DNA, 22 bp, Artificial Sequence
  Synthetic oligonucleotide; TTG chr2 60536629 60536650 60536634 60536629 -
aaggcagttaggggaaatttgg

SEQ ID NO: 213181 - DNA, 22 bp, Artificial Sequence
  Synthetic oligonucleotide; TTA chr2 60536619 60536640 60536624 60536619 -
ggggaaatttggccttcaagtc

SEQ ID NO: 213182 - DNA, 22 bp, Artificial Sequence
  Synthetic oligonucleotide; TTT chr2 60536609 60536630 60536614 60536609 -
ggccttcaagtcccatttgctc

SEQ ID NO: 213183 - DNA, 22 bp, Artificial Sequence
  Synthetic oligonucleotide; TTG chr2 60536608 60536629 60536613 60536608 -
gccttcaagtcccatttgctct

SEQ ID NO: 213184 - DNA, 22 bp, Artificial Sequence
  Synthetic oligonucleotide; CTT chr2 60536603 60536624 60536608 60536603 -
caagtcccatttgctctgtagt

SEQ ID NO: 213185 - DNA, 22 bp, Artificial Sequence
  Synthetic oligonucleotide; TTC chr2 60536602 60536623 60536607 60536602 -
aagtcccatttgctctgtagtg

SEQ ID NO: 213186 - DNA, 22 bp, Artificial Sequence
  Synthetic oligonucleotide; TTT chr2 60536591 60536612 60536596 60536591 -
gctctgtagtgtagcattggtt

SEQ ID NO: 213187 - DNA, 22 bp, Artificial Sequence
  Synthetic oligonucleotide; TTG chr2 60536590 60536611 60536595 60536590 -
ctctgtagtgtagcattggttt

SEQ ID NO: 213188 - DNA, 22 bp, Artificial Sequence
  Synthetic oligonucleotide; CTC chr2 60536587 60536608 60536592 60536587 -
tgtagtgtagcattggtttcta

SEQ ID NO: 213189 - DNA, 22 bp, Artificial Sequence
  Synthetic oligonucleotide; CTG chr2 60536585 60536606 60536590 60536585 -
tagtgtagcattggtttctaaa

SEQ ID NO: 213190 - DNA, 22 bp, Artificial Sequence
  Synthetic oligonucleotide; TTG chr2 60536572 60536593 60536577 60536572 -
gtttctaaacttttgtttttaa

SEQ ID NO: 213191 - DNA, 22 bp, Artificial Sequence
  Synthetic oligonucleotide; TTT chr2 60536568 60536589 60536573 60536568 -
ctaaacttttgtttttaatcta

SEQ ID NO: 213192 - DNA, 22 bp, Artificial Sequence
  Synthetic oligonucleotide; TTC chr2 60536567 60536588 60536572 60536567 -
taaacttttgtttttaatctaa

SEQ ID NO: 213193 - DNA, 22 bp, Artificial Sequence
  Synthetic oligonucleotide; CTA chr2 60536565 60536586 60536570 60536565 -
aacttttgtttttaatctaatt

SEQ ID NO: 213194 - DNA, 22 bp, Artificial Sequence
  Synthetic oligonucleotide; CTT chr2 60536560 60536581 60536565 60536560 -
ttgtttttaatctaattctgat

SEQ ID NO: 213195 - DNA, 22 bp, Artificial Sequence
  Synthetic oligonucleotide; TTT chr2 60536559 60536580 60536564 60536559 -
tgtttttaatctaattctgatt

SEQ ID NO: 213196 - DNA, 22 bp, Artificial Sequence
  Synthetic oligonucleotide; TTT chr2 60536558 60536579 60536563 60536558 -
gtttttaatctaattctgattt

SEQ ID NO: 213197 - DNA, 22 bp, Artificial Sequence
  Synthetic oligonucleotide; TTG chr2 60536557 60536578 60536562 60536557 -
tttttaatctaattctgatttg

SEQ ID NO: 213198 - DNA, 22 bp, Artificial Sequence
  Synthetic oligonucleotide; TTT chr2 60536554 60536575 60536559 60536554 -
ttaatctaattctgatttgccc

SEQ ID NO: 213199 - DNA, 22 bp, Artificial Sequence
  Synthetic oligonucleotide; TTT chr2 60536553 60536574 60536558 60536553 -
taatctaattctgatttgccct

SEQ ID NO: 213200 - DNA, 22 bp, Artificial Sequence
  Synthetic oligonucleotide; TTT chr2 60536552 60536573 60536557 60536552 -
aatctaattctgatttgccctg

SEQ ID NO: 213201 - DNA, 22 bp, Artificial Sequence
  Synthetic oligonucleotide; TTA chr2 60536551 60536572 60536556 60536551 -
atctaattctgatttgccctgt

SEQ ID NO: 213202 - DNA, 22 bp, Artificial Sequence
  Synthetic oligonucleotide; CTA chr2 60536546 60536567 60536551 60536546 -
attctgatttgccctgtcacat

SEQ ID NO: 213203 - DNA, 22 bp, Artificial Sequence
  Synthetic oligonucleotide; TTC chr2 60536542 60536563 60536547 60536542 -
tgatttgccctgtcacatccca

SEQ ID NO: 213204 - DNA, 22 bp, Artificial Sequence
  Synthetic oligonucleotide; CTG chr2 60536540 60536561 60536545 60536540 -
atttgccctgtcacatcccata

SEQ ID NO: 213205 - DNA, 22 bp, Artificial Sequence
  Synthetic oligonucleotide; TTT chr2 60536536 60536557 60536541 60536536 -
gccctgtcacatcccatatcaa

SEQ ID NO: 213206 - DNA, 22 bp, Artificial Sequence
  Synthetic oligonucleotide; TTG chr2 60536535 60536556 60536540 60536535 -
ccctgtcacatcccatatcaac

SEQ ID NO: 213207 - DNA, 22 bp, Artificial Sequence
  Synthetic oligonucleotide; CTG chr2 60536530 60536551 60536535 60536530 -
tcacatcccatatcaaccctca

SEQ ID NO: 213208 - DNA, 22 bp, Artificial Sequence
  Synthetic oligonucleotide; CTC chr2 60536509 60536530 60536514 60536509 -
attgaactctactcatgtagag

SEQ ID NO: 213209 - DNA, 22 bp, Artificial Sequence
  Synthetic oligonucleotide; TTG chr2 60536505 60536526 60536510 60536505 -
aactctactcatgtagagtaac

SEQ ID NO: 213210 - DNA, 22 bp, Artificial Sequence
  Synthetic oligonucleotide; CTC chr2 60536500 60536521 60536505 60536500 -
tactcatgtagagtaacattag

SEQ ID NO: 213211 - DNA, 22 bp, Artificial Sequence
  Synthetic oligonucleotide; CTA chr2 60536498 60536519 60536503 60536498 -
ctcatgtagagtaacattagtg

SEQ ID NO: 213212 - DNA, 22 bp, Artificial Sequence
  Synthetic oligonucleotide; CTC chr2 60536495 60536516 60536500 60536495 -
atgtagagtaacattagtgtca

SEQ ID NO: 213213 - DNA, 22 bp, Artificial Sequence
  Synthetic oligonucleotide; TTA chr2 60536479 60536500 60536484 60536479 -
gtgtcaaacggaattggtcagg

SEQ ID NO: 213214 - DNA, 22 bp, Artificial Sequence
  Synthetic oligonucleotide; TTG chr2 60536463 60536484 60536468 60536463 -
gtcaggactgtggacctgtggc

SEQ ID NO: 213215 - DNA, 22 bp, Artificial Sequence
  Synthetic oligonucleotide; CTG chr2 60536453 60536474 60536458 60536453 -
tggacctgtggctcatacagat

SEQ ID NO: 213216 - DNA, 22 bp, Artificial Sequence
  Synthetic oligonucleotide; CTG chr2 60536445 60536466 60536450 60536445 -
tggctcatacagatggttgtgg

SEQ ID NO: 213217 - DNA, 22 bp, Artificial Sequence
  Synthetic oligonucleotide; CTC chr2 60536439 60536460 60536444 60536439 -
atacagatggttgtggatgtgg

SEQ ID NO: 213218 - DNA, 22 bp, Artificial Sequence
  Synthetic oligonucleotide; TTG chr2 60536426 60536447 60536431 60536426 -
tggatgtgggttccatgcagct

SEQ ID NO: 213219 - DNA, 22 bp, Artificial Sequence
  Synthetic oligonucleotide; TTC chr2 60536413 60536434 60536418 60536413 -
catgcagctctgcatcctatcc

SEQ ID NO: 213220 - DNA, 22 bp, Artificial Sequence
  Synthetic oligonucleotide; CTC chr2 60536403 60536424 60536408 60536403 -
tgcatcctatcctttctaataa

SEQ ID NO: 213221 - DNA, 22 bp, Artificial Sequence
  Synthetic oligonucleotide; CTG chr2 60536401 60536422 60536406 60536401 -
catcctatcctttctaataaat

SEQ ID NO: 213222 - DNA, 22 bp, Artificial Sequence
  Synthetic oligonucleotide; CTA chr2 60536394 60536415 60536399 60536394 -
tcctttctaataaatgttaaaa

SEQ ID NO: 213223 - DNA, 22 bp, Artificial Sequence
  Synthetic oligonucleotide; CTT chr2 60536389 60536410 60536394 60536389 -
tctaataaatgttaaaatgtgg

SEQ ID NO: 213224 - DNA, 22 bp, Artificial Sequence
  Synthetic oligonucleotide; TTT chr2 60536388 60536409 60536393 60536388 -
ctaataaatgttaaaatgtggc

SEQ ID NO: 213225 - DNA, 22 bp, Artificial Sequence
  Synthetic oligonucleotide; TTC chr2 60536387 60536408 60536392 60536387 -
taataaatgttaaaatgtggca

SEQ ID NO: 213226 - DNA, 22 bp, Artificial Sequence
  Synthetic oligonucleotide; CTA chr2 60536385 60536406 60536390 60536385 -
ataaatgttaaaatgtggcaca

SEQ ID NO: 213227 - DNA, 22 bp, Artificial Sequence
  Synthetic oligonucleotide; TTA chr2 60536375 60536396 60536380 60536375 -
aaatgtggcacatttctgagca

SEQ ID NO: 213228 - DNA, 22 bp, Artificial Sequence
  Synthetic oligonucleotide; TTT chr2 60536360 60536381 60536365 60536360 -
ctgagcagggcccaaggataag

SEQ ID NO: 213229 - DNA, 22 bp, Artificial Sequence
  Synthetic oligonucleotide; TTC chr2 60536359 60536380 60536364 60536359 -
tgagcagggcccaaggataaga

SEQ ID NO: 213230 - DNA, 22 bp, Artificial Sequence
  Synthetic oligonucleotide; CTG chr2 60536357 60536378 60536362 60536357 -
agcagggcccaaggataagaga

SEQ ID NO: 213231 - DNA, 22 bp, Artificial Sequence
  Synthetic oligonucleotide; TTA chr2 60536331 60536352 60536336 60536331 -
agaaatcagggggtagtacctg

SEQ ID NO: 213232 - DNA, 22 bp, Artificial Sequence
  Synthetic oligonucleotide; CTG chr2 60536309 60536330 60536314 60536309 -
agatttttctcccttctctttc

SEQ ID NO: 213233 - DNA, 22 bp, Artificial Sequence
  Synthetic oligonucleotide; TTT chr2 60536303 60536324 60536308 60536303 -
ttctcccttctctttccgattt

SEQ ID NO: 213234 - DNA, 22 bp, Artificial Sequence
  Synthetic oligonucleotide; TTT chr2 60536302 60536323 60536307 60536302 -
tctcccttctctttccgatttc

SEQ ID NO: 213235 - DNA, 22 bp, Artificial Sequence
  Synthetic oligonucleotide; TTT chr2 60536301 60536322 60536306 60536301 -
ctcccttctctttccgatttcc

SEQ ID NO: 213236 - DNA, 22 bp, Artificial Sequence
  Synthetic oligonucleotide; TTC chr2 60536300 60536321 60536305 60536300 -
tcccttctctttccgatttcct

SEQ ID NO: 213237 - DNA, 22 bp, Artificial Sequence
  Synthetic oligonucleotide; CTC chr2 60536298 60536319 60536303 60536298 -
ccttctctttccgatttccttg

SEQ ID NO: 213238 - DNA, 22 bp, Artificial Sequence
  Synthetic oligonucleotide; CTT chr2 60536294 60536315 60536299 60536294 -
ctctttccgatttccttgataa

SEQ ID NO: 213239 - DNA, 22 bp, Artificial Sequence
  Synthetic oligonucleotide; TTC chr2 60536293 60536314 60536298 60536293 -
tctttccgatttccttgataac

SEQ ID NO: 213240 - DNA, 22 bp, Artificial Sequence
  Synthetic oligonucleotide; CTC chr2 60536291 60536312 60536296 60536291 -
tttccgatttccttgataacat

SEQ ID NO: 213241 - DNA, 22 bp, Artificial Sequence
  Synthetic oligonucleotide; CTT chr2 60536289 60536310 60536294 60536289 -
tccgatttccttgataacatcc

SEQ ID NO: 213242 - DNA, 22 bp, Artificial Sequence
  Synthetic oligonucleotide; TTT chr2 60536288 60536309 60536293 60536288 -
ccgatttccttgataacatcca

SEQ ID NO: 213243 - DNA, 22 bp, Artificial Sequence
  Synthetic oligonucleotide; TTC chr2 60536287 60536308 60536292 60536287 -
cgatttccttgataacatccac

SEQ ID NO: 213244 - DNA, 22 bp, Artificial Sequence
  Synthetic oligonucleotide; TTT chr2 60536281 60536302 60536286 60536281 -
ccttgataacatccacatttcc

SEQ ID NO: 213245 - DNA, 22 bp, Artificial Sequence
  Synthetic oligonucleotide; TTC chr2 60536280 60536301 60536285 60536280 -
cttgataacatccacatttccg

SEQ ID NO: 213246 - DNA, 22 bp, Artificial Sequence
  Synthetic oligonucleotide; CTT chr2 60536277 60536298 60536282 60536277 -
gataacatccacatttccggta

SEQ ID NO: 213247 - DNA, 22 bp, Artificial Sequence
  Synthetic oligonucleotide; TTG chr2 60536276 60536297 60536281 60536276 -
ataacatccacatttccggtaa

SEQ ID NO: 213248 - DNA, 22 bp, Artificial Sequence
  Synthetic oligonucleotide; TTT chr2 60536261 60536282 60536266 60536261 -
ccggtaagatcaactctaggag

SEQ ID NO: 213249 - DNA, 22 bp, Artificial Sequence
  Synthetic oligonucleotide; TTC chr2 60536260 60536281 60536265 60536260 -
cggtaagatcaactctaggaga

SEQ ID NO: 213250 - DNA, 22 bp, Artificial Sequence
  Synthetic oligonucleotide; CTC chr2 60536245 60536266 60536250 60536245 -
taggagaaagtctgaggctggg

SEQ ID NO: 213251 - DNA, 22 bp, Artificial Sequence
  Synthetic oligonucleotide; CTA chr2 60536243 60536264 60536248 60536243 -
ggagaaagtctgaggctggggg

SEQ ID NO: 213252 - DNA, 22 bp, Artificial Sequence
  Synthetic oligonucleotide; CTG chr2 60536231 60536252 60536236 60536231 -
aggctgggggagagagggggag

SEQ ID NO: 213253 - DNA, 22 bp, Artificial Sequence
  Synthetic oligonucleotide; CTG chr2 60536225 60536246 60536230 60536225 -
ggggagagagggggagaagggt

SEQ ID NO: 213254 - DNA, 22 bp, Artificial Sequence
  Synthetic oligonucleotide; TTC chr2 60536189 60536210 60536194 60536189 -
ttggaatattcttcgatagcag

SEQ ID NO: 213255 - DNA, 22 bp, Artificial Sequence
  Synthetic oligonucleotide; CTT chr2 60536187 60536208 60536192 60536187 -
ggaatattcttcgatagcagtt

SEQ ID NO: 213256 - DNA, 22 bp, Artificial Sequence
  Synthetic oligonucleotide; TTG chr2 60536186 60536207 60536191 60536186 -
gaatattcttcgatagcagttc

SEQ ID NO: 213257 - DNA, 22 bp, Artificial Sequence
  Synthetic oligonucleotide; TTC chr2 60536178 60536199 60536183 60536178 -
ttcgatagcagttcaaatgaaa

SEQ ID NO: 213258 - DNA, 22 bp, Artificial Sequence
  Synthetic oligonucleotide; CTT chr2 60536176 60536197 60536181 60536176 -
cgatagcagttcaaatgaaatc

SEQ ID NO: 213259 - DNA, 22 bp, Artificial Sequence
  Synthetic oligonucleotide; TTC chr2 60536175 60536196 60536180 60536175 -
gatagcagttcaaatgaaatcc

SEQ ID NO: 213260 - DNA, 22 bp, Artificial Sequence
  Synthetic oligonucleotide; TTC chr2 60536164 60536185 60536169 60536164 -
aaatgaaatccccacagcagag

SEQ ID NO: 213261 - DNA, 22 bp, Artificial Sequence
  Synthetic oligonucleotide; CTT chr2 60536137 60536158 60536142 60536137 -
ttgggtctagcagtggagcggt

SEQ ID NO: 213262 - DNA, 22 bp, Artificial Sequence
  Synthetic oligonucleotide; TTT chr2 60536136 60536157 60536141 60536136 -
tgggtctagcagtggagcggta

SEQ ID NO: 213263 - DNA, 22 bp, Artificial Sequence
  Synthetic oligonucleotide; TTT chr2 60536135 60536156 60536140 60536135 -
gggtctagcagtggagcggtaa

SEQ ID NO: 213264 - DNA, 22 bp, Artificial Sequence
  Synthetic oligonucleotide; TTG chr2 60536134 60536155 60536139 60536134 -
ggtctagcagtggagcggtaag

SEQ ID NO: 213265 - DNA, 22 bp, Artificial Sequence
  Synthetic oligonucleotide; CTA chr2 60536128 60536149 60536133 60536128 -
gcagtggagcggtaagctggga

SEQ ID NO: 213266 - DNA, 22 bp, Artificial Sequence
  Synthetic oligonucleotide; CTG chr2 60536109 60536130 60536114 60536109 -
ggacacgtggcctttcgaagct

SEQ ID NO: 213267 - DNA, 22 bp, Artificial Sequence
  Synthetic oligonucleotide; CTT chr2 60536095 60536116 60536100 60536095 -
tcgaagctgttattctcagtct

SEQ ID NO: 213268 - DNA, 22 bp, Artificial Sequence
  Synthetic oligonucleotide; TTT chr2 60536094 60536115 60536099 60536094 -
cgaagctgttattctcagtctg

SEQ ID NO: 213269 - DNA, 22 bp, Artificial Sequence
  Synthetic oligonucleotide; TTC chr2 60536093 60536114 60536098 60536093 -
gaagctgttattctcagtctga

SEQ ID NO: 213270 - DNA, 22 bp, Artificial Sequence
  Synthetic oligonucleotide; CTG chr2 60536086 60536107 60536091 60536086 -
ttattctcagtctgacttgcac

SEQ ID NO: 213271 - DNA, 22 bp, Artificial Sequence
  Synthetic oligonucleotide; TTA chr2 60536083 60536104 60536088 60536083 -
ttctcagtctgacttgcacacc

SEQ ID NO: 213272 - DNA, 22 bp, Artificial Sequence
  Synthetic oligonucleotide; TTC chr2 60536080 60536101 60536085 60536080 -
tcagtctgacttgcacaccagc

SEQ ID NO: 213273 - DNA, 22 bp, Artificial Sequence
  Synthetic oligonucleotide; CTC chr2 60536078 60536099 60536083 60536078 -
agtctgacttgcacaccagctg

SEQ ID NO: 213274 - DNA, 22 bp, Artificial Sequence
  Synthetic oligonucleotide; CTG chr2 60536072 60536093 60536077 60536072 -
acttgcacaccagctgagatag

SEQ ID NO: 213275 - DNA, 22 bp, Artificial Sequence
  Synthetic oligonucleotide; CTT chr2 60536068 60536089 60536073 60536068 -
gcacaccagctgagataggact

SEQ ID NO: 213276 - DNA, 22 bp, Artificial Sequence
  Synthetic oligonucleotide; TTG chr2 60536067 60536088 60536072 60536067 -
cacaccagctgagataggactt

SEQ ID NO: 213277 - DNA, 22 bp, Artificial Sequence
  Synthetic oligonucleotide; CTG chr2 60536056 60536077 60536061 60536056 -
agataggacttaacatatactt

SEQ ID NO: 213278 - DNA, 22 bp, Artificial Sequence
  Synthetic oligonucleotide; CTT chr2 60536045 60536066 60536050 60536045 -
aacatatactttcttgctttca

SEQ ID NO: 213279 - DNA, 22 bp, Artificial Sequence
  Synthetic oligonucleotide; TTA chr2 60536044 60536065 60536049 60536044 -
acatatactttcttgctttcac

SEQ ID NO: 213280 - DNA, 22 bp, Artificial Sequence
  Synthetic oligonucleotide; CTT chr2 60536034 60536055 60536039 60536034 -
tcttgctttcacctgggttgga

SEQ ID NO: 213281 - DNA, 22 bp, Artificial Sequence
  Synthetic oligonucleotide; TTT chr2 60536033 60536054 60536038 60536033 -
cttgctttcacctgggttggag

SEQ ID NO: 213282 - DNA, 22 bp, Artificial Sequence
  Synthetic oligonucleotide; TTC chr2 60536032 60536053 60536037 60536032 -
ttgctttcacctgggttggaga

SEQ ID NO: 213283 - DNA, 22 bp, Artificial Sequence
  Synthetic oligonucleotide; CTT chr2 60536030 60536051 60536035 60536030 -
gctttcacctgggttggagagg

SEQ ID NO: 213284 - DNA, 22 bp, Artificial Sequence
  Synthetic oligonucleotide; TTG chr2 60536029 60536050 60536034 60536029 -
ctttcacctgggttggagaggt

SEQ ID NO: 213285 - DNA, 22 bp, Artificial Sequence
  Synthetic oligonucleotide; CTT chr2 60536026 60536047 60536031 60536026 -
tcacctgggttggagaggttgg

SEQ ID NO: 213286 - DNA, 22 bp, Artificial Sequence
  Synthetic oligonucleotide; TTT chr2 60536025 60536046 60536030 60536025 -
cacctgggttggagaggttggg

SEQ ID NO: 213287 - DNA, 22 bp, Artificial Sequence
  Synthetic oligonucleotide; TTC chr2 60536024 60536045 60536029 60536024 -
acctgggttggagaggttgggg

SEQ ID NO: 213288 - DNA, 22 bp, Artificial Sequence
  Synthetic oligonucleotide; CTG chr2 60536019 60536040 60536024 60536019 -
ggttggagaggttggggttggg

SEQ ID NO: 213289 - DNA, 22 bp, Artificial Sequence
  Synthetic oligonucleotide; TTG chr2 60536014 60536035 60536019 60536014 -
gagaggttggggttgggaggaa

SEQ ID NO: 213290 - DNA, 22 bp, Artificial Sequence
  Synthetic oligonucleotide; TTG chr2 60536005 60536026 60536010 60536005 -
gggttgggaggaagaggaggag

SEQ ID NO: 213291 - DNA, 22 bp, Artificial Sequence
  Synthetic oligonucleotide; TTG chr2 60535999 60536020 60536004 60535999 -
ggaggaagaggaggagttcatt

SEQ ID NO: 213292 - DNA, 22 bp, Artificial Sequence
  Synthetic oligonucleotide; TTC chr2 60535980 60536001 60535985 60535980 -
attgggaattctgtcactagaa

SEQ ID NO: 213293 - DNA, 22 bp, Artificial Sequence
  Synthetic oligonucleotide; TTG chr2 60535976 60535997 60535981 60535976 -
ggaattctgtcactagaatttt

SEQ ID NO: 213294 - DNA, 22 bp, Artificial Sequence
  Synthetic oligonucleotide; TTC chr2 60535969 60535990 60535974 60535969 -
tgtcactagaattttttaaatg

SEQ ID NO: 213295 - DNA, 22 bp, Artificial Sequence
  Synthetic oligonucleotide; CTG chr2 60535967 60535988 60535972 60535967 -
tcactagaattttttaaatgtc

SEQ ID NO: 213296 - DNA, 22 bp, Artificial Sequence
  Synthetic oligonucleotide; CTA chr2 60535961 60535982 60535966 60535961 -
gaattttttaaatgtcaggagg

SEQ ID NO: 213297 - DNA, 22 bp, Artificial Sequence
  Synthetic oligonucleotide; TTT chr2 60535955 60535976 60535960 60535955 -
tttaaatgtcaggaggttagca

SEQ ID NO: 213298 - DNA, 22 bp, Artificial Sequence
  Synthetic oligonucleotide; TTT chr2 60535954 60535975 60535959 60535954 -
ttaaatgtcaggaggttagcaa

SEQ ID NO: 213299 - DNA, 22 bp, Artificial Sequence
  Synthetic oligonucleotide; TTT chr2 60535953 60535974 60535958 60535953 -
taaatgtcaggaggttagcaag

SEQ ID NO: 213300 - DNA, 22 bp, Artificial Sequence
  Synthetic oligonucleotide; TTT chr2 60535952 60535973 60535957 60535952 -
aaatgtcaggaggttagcaagg

SEQ ID NO: 213301 - DNA, 22 bp, Artificial Sequence
  Synthetic oligonucleotide; TTA chr2 60535951 60535972 60535956 60535951 -
aatgtcaggaggttagcaaggt

SEQ ID NO: 213302 - DNA, 22 bp, Artificial Sequence
  Synthetic oligonucleotide; TTA chr2 60535936 60535957 60535941 60535936 -
gcaaggtgtgagttagcattca

SEQ ID NO: 213303 - DNA, 22 bp, Artificial Sequence
  Synthetic oligonucleotide; TTA chr2 60535921 60535942 60535926 60535921 -
gcattcaagcaaaggattcttc

SEQ ID NO: 213304 - DNA, 22 bp, Artificial Sequence
  Synthetic oligonucleotide; TTC chr2 60535915 60535936 60535920 60535915 -
aagcaaaggattcttctccaga

SEQ ID NO: 213305 - DNA, 22 bp, Artificial Sequence
  Synthetic oligonucleotide; TTC chr2 60535902 60535923 60535907 60535902 -
ttctccagactagtaattggaa

SEQ ID NO: 213306 - DNA, 22 bp, Artificial Sequence
  Synthetic oligonucleotide; CTT chr2 60535900 60535921 60535905 60535900 -
ctccagactagtaattggaaag

SEQ ID NO: 213307 - DNA, 22 bp, Artificial Sequence
  Synthetic oligonucleotide; TTC chr2 60535899 60535920 60535904 60535899 -
tccagactagtaattggaaagc

SEQ ID NO: 213308 - DNA, 22 bp, Artificial Sequence
  Synthetic oligonucleotide; CTC chr2 60535897 60535918 60535902 60535897 -
cagactagtaattggaaagcct

SEQ ID NO: 213309 - DNA, 22 bp, Artificial Sequence
  Synthetic oligonucleotide; CTA chr2 60535890 60535911 60535895 60535890 -
gtaattggaaagcctgcaaatc

SEQ ID NO: 213310 - DNA, 22 bp, Artificial Sequence
  Synthetic oligonucleotide; TTG chr2 60535883 60535904 60535888 60535883 -
gaaagcctgcaaatccaggttc

SEQ ID NO: 213311 - DNA, 22 bp, Artificial Sequence
  Synthetic oligonucleotide; CTG chr2 60535874 60535895 60535879 60535874 -
caaatccaggttcccacgatac

SEQ ID NO: 213312 - DNA, 22 bp, Artificial Sequence
  Synthetic oligonucleotide; TTC chr2 60535861 60535882 60535866 60535861 -
ccacgatactctctaataactg

SEQ ID NO: 213313 - DNA, 22 bp, Artificial Sequence
  Synthetic oligonucleotide; CTC chr2 60535850 60535871 60535855 60535850 -
tctaataactggggtgggatgg

SEQ ID NO: 213314 - DNA, 22 bp, Artificial Sequence
  Synthetic oligonucleotide; CTC chr2 60535848 60535869 60535853 60535848 -
taataactggggtgggatggtg

SEQ ID NO: 213315 - DNA, 22 bp, Artificial Sequence
  Synthetic oligonucleotide; CTA chr2 60535846 60535867 60535851 60535846 -
ataactggggtgggatggtggt

SEQ ID NO: 213316 - DNA, 22 bp, Artificial Sequence
  Synthetic oligonucleotide; CTG chr2 60535839 60535860 60535844 60535839 -
gggtgggatggtggtggtgggt

SEQ ID NO: 213317 - DNA, 22 bp, Artificial Sequence
  Synthetic oligonucleotide; CTT chr2 60535803 60535824 60535808 60535803 -
tctgaatgtcagctgatgtctg

SEQ ID NO: 213318 - DNA, 22 bp, Artificial Sequence
  Synthetic oligonucleotide; TTT chr2 60535802 60535823 60535807 60535802 -
ctgaatgtcagctgatgtctgc

SEQ ID NO: 213319 - DNA, 22 bp, Artificial Sequence
  Synthetic oligonucleotide; TTC chr2 60535801 60535822 60535806 60535801 -
tgaatgtcagctgatgtctgca

SEQ ID NO: 213320 - DNA, 22 bp, Artificial Sequence
  Synthetic oligonucleotide; CTG chr2 60535799 60535820 60535804 60535799 -
aatgtcagctgatgtctgcatg

SEQ ID NO: 213321 - DNA, 22 bp, Artificial Sequence
  Synthetic oligonucleotide; CTG chr2 60535788 60535809 60535793 60535788 -
atgtctgcatgacccgttcacc

SEQ ID NO: 213322 - DNA, 22 bp, Artificial Sequence
  Synthetic oligonucleotide; CTG chr2 60535781 60535802 60535786 60535781 -
catgacccgttcaccatggatt

SEQ ID NO: 213323 - DNA, 22 bp, Artificial Sequence
  Synthetic oligonucleotide; TTC chr2 60535769 60535790 60535774 60535769 -
accatggattaaatgcggctgg

SEQ ID NO: 213324 - DNA, 22 bp, Artificial Sequence
  Synthetic oligonucleotide; TTA chr2 60535758 60535779 60535763 60535758 -
aatgcggctggtgccgaatgga

SEQ ID NO: 213325 - DNA, 22 bp, Artificial Sequence
  Synthetic oligonucleotide; CTG chr2 60535748 60535769 60535753 60535748 -
gtgccgaatggaggaaatcaga

SEQ ID NO: 213326 - DNA, 22 bp, Artificial Sequence
  Synthetic oligonucleotide; CTC chr2 60535714 60535735 60535719 60535714 -
aagcaacaggatttgcactcct

SEQ ID NO: 213327 - DNA, 22 bp, Artificial Sequence
  Synthetic oligonucleotide; TTT chr2 60535700 60535721 60535705 60535700 -
gcactcctcagaagtaaaccag

SEQ ID NO: 213328 - DNA, 22 bp, Artificial Sequence
  Synthetic oligonucleotide; TTG chr2 60535699 60535720 60535704 60535699 -
cactcctcagaagtaaaccaga

SEQ ID NO: 213329 - DNA, 22 bp, Artificial Sequence
  Synthetic oligonucleotide; CTC chr2 60535694 60535715 60535699 60535694 -
ctcagaagtaaaccagaccttg

SEQ ID NO: 213330 - DNA, 22 bp, Artificial Sequence
  Synthetic oligonucleotide; CTC chr2 60535691 60535712 60535696 60535691 -
agaagtaaaccagaccttgctc

SEQ ID NO: 213331 - DNA, 22 bp, Artificial Sequence
  Synthetic oligonucleotide; CTT chr2 60535673 60535694 60535678 60535673 -
gctcctctccctcctgtgcttc

SEQ ID NO: 213332 - DNA, 22 bp, Artificial Sequence
  Synthetic oligonucleotide; TTG chr2 60535672 60535693 60535677 60535672 -
ctcctctccctcctgtgcttct

SEQ ID NO: 213333 - DNA, 22 bp, Artificial Sequence
  Synthetic oligonucleotide; CTC chr2 60535669 60535690 60535674 60535669 -
ctctccctcctgtgcttctcct

SEQ ID NO: 213334 - DNA, 22 bp, Artificial Sequence
  Synthetic oligonucleotide; CTC chr2 60535666 60535687 60535671 60535666 -
tccctcctgtgcttctcctttc

SEQ ID NO: 213335 - DNA, 22 bp, Artificial Sequence
  Synthetic oligonucleotide; CTC chr2 60535664 60535685 60535669 60535664 -
cctcctgtgcttctcctttctt

SEQ ID NO: 213336 - DNA, 22 bp, Artificial Sequence
  Synthetic oligonucleotide; CTC chr2 60535660 60535681 60535665 60535660 -
ctgtgcttctcctttcttgctg

SEQ ID NO: 213337 - DNA, 22 bp, Artificial Sequence
  Synthetic oligonucleotide; CTG chr2 60535657 60535678 60535662 60535657 -
tgcttctcctttcttgctggtt

SEQ ID NO: 213338 - DNA, 22 bp, Artificial Sequence
  Synthetic oligonucleotide; CTT chr2 60535652 60535673 60535657 60535652 -
ctcctttcttgctggtttccct

SEQ ID NO: 213339 - DNA, 22 bp, Artificial Sequence
  Synthetic oligonucleotide; TTC chr2 60535651 60535672 60535656 60535651 -
tcctttcttgctggtttccctt

SEQ ID NO: 213340 - DNA, 22 bp, Artificial Sequence
  Synthetic oligonucleotide; CTC chr2 60535649 60535670 60535654 60535649 -
ctttcttgctggtttccctttg

SEQ ID NO: 213341 - DNA, 22 bp, Artificial Sequence
  Synthetic oligonucleotide; CTT chr2 60535646 60535667 60535651 60535646 -
tcttgctggtttccctttggaa

SEQ ID NO: 213342 - DNA, 22 bp, Artificial Sequence
  Synthetic oligonucleotide; TTT chr2 60535645 60535666 60535650 60535645 -
cttgctggtttccctttggaag

SEQ ID NO: 213343 - DNA, 22 bp, Artificial Sequence
  Synthetic oligonucleotide; TTC chr2 60535644 60535665 60535649 60535644 -
ttgctggtttccctttggaagc

SEQ ID NO: 213344 - DNA, 22 bp, Artificial Sequence
  Synthetic oligonucleotide; CTT chr2 60535642 60535663 60535647 60535642 -
gctggtttccctttggaagcag

SEQ ID NO: 213345 - DNA, 22 bp, Artificial Sequence
  Synthetic oligonucleotide; TTG chr2 60535641 60535662 60535646 60535641 -
ctggtttccctttggaagcaga

SEQ ID NO: 213346 - DNA, 22 bp, Artificial Sequence
  Synthetic oligonucleotide; CTG chr2 60535638 60535659 60535643 60535638 -
gtttccctttggaagcagaaac

SEQ ID NO: 213347 - DNA, 22 bp, Artificial Sequence
  Synthetic oligonucleotide; TTT chr2 60535634 60535655 60535639 60535634 -
ccctttggaagcagaaacttct

SEQ ID NO: 213348 - DNA, 22 bp, Artificial Sequence
  Synthetic oligonucleotide; TTC chr2 60535633 60535654 60535638 60535633 -
cctttggaagcagaaacttcta

SEQ ID NO: 213349 - DNA, 22 bp, Artificial Sequence
  Synthetic oligonucleotide; CTT chr2 60535629 60535650 60535634 60535629 -
tggaagcagaaacttctaaaat

SEQ ID NO: 213350 - DNA, 22 bp, Artificial Sequence
  Synthetic oligonucleotide; TTT chr2 60535628 60535649 60535633 60535628 -
ggaagcagaaacttctaaaatt

SEQ ID NO: 213351 - DNA, 22 bp, Artificial Sequence
  Synthetic oligonucleotide; TTG chr2 60535627 60535648 60535632 60535627 -
gaagcagaaacttctaaaatta

SEQ ID NO: 213352 - DNA, 22 bp, Artificial Sequence
  Synthetic oligonucleotide; CTT chr2 60535614 60535635 60535619 60535614 -
ctaaaattaatgccactccaag

SEQ ID NO: 213353 - DNA, 22 bp, Artificial Sequence
  Synthetic oligonucleotide; TTC chr2 60535613 60535634 60535618 60535613 -
taaaattaatgccactccaagc

SEQ ID NO: 213354 - DNA, 22 bp, Artificial Sequence
  Synthetic oligonucleotide; CTA chr2 60535611 60535632 60535616 60535611 -
aaattaatgccactccaagcca

SEQ ID NO: 213355 - DNA, 22 bp, Artificial Sequence
  Synthetic oligonucleotide; TTA chr2 60535605 60535626 60535610 60535605 -
atgccactccaagccaatgaaa

SEQ ID NO: 213356 - DNA, 22 bp, Artificial Sequence
  Synthetic oligonucleotide; CTC chr2 60535596 60535617 60535601 60535596 -
caagccaatgaaaaagctgttt

SEQ ID NO: 213357 - DNA, 22 bp, Artificial Sequence
  Synthetic oligonucleotide; CTG chr2 60535577 60535598 60535582 60535577 -
tttttataccacagtggatgtt

SEQ ID NO: 213358 - DNA, 22 bp, Artificial Sequence
  Synthetic oligonucleotide; TTT chr2 60535574 60535595 60535579 60535574 -
ttataccacagtggatgtttac

SEQ ID NO: 213359 - DNA, 22 bp, Artificial Sequence
  Synthetic oligonucleotide; TTT chr2 60535573 60535594 60535578 60535573 -
tataccacagtggatgtttaca

SEQ ID NO: 213360 - DNA, 22 bp, Artificial Sequence
  Synthetic oligonucleotide; TTT chr2 60535572 60535593 60535577 60535572 -
ataccacagtggatgtttacac

SEQ ID NO: 213361 - DNA, 22 bp, Artificial Sequence
  Synthetic oligonucleotide; TTA chr2 60535571 60535592 60535576 60535571 -
taccacagtggatgtttacaca

SEQ ID NO: 213362 - DNA, 22 bp, Artificial Sequence
  Synthetic oligonucleotide; TTT chr2 60535554 60535575 60535559 60535554 -
acacaggagagacaacttgagg

SEQ ID NO: 213363 - DNA, 22 bp, Artificial Sequence
  Synthetic oligonucleotide; TTA chr2 60535553 60535574 60535558 60535553 -
cacaggagagacaacttgaggg

SEQ ID NO: 213364 - DNA, 22 bp, Artificial Sequence
  Synthetic oligonucleotide; CTT chr2 60535536 60535557 60535541 60535536 -
gagggggaaaaggctttttgga

SEQ ID NO: 213365 - DNA, 22 bp, Artificial Sequence
  Synthetic oligonucleotide; TTG chr2 60535535 60535556 60535540 60535535 -
agggggaaaaggctttttggaa

SEQ ID NO: 213366 - DNA, 22 bp, Artificial Sequence
  Synthetic oligonucleotide; CTT chr2 60535520 60535541 60535525 60535520 -
tttggaagggtggagggactcg

SEQ ID NO: 213367 - DNA, 22 bp, Artificial Sequence
  Synthetic oligonucleotide; TTT chr2 60535519 60535540 60535524 60535519 -
ttggaagggtggagggactcgt

SEQ ID NO: 213368 - DNA, 22 bp, Artificial Sequence
  Synthetic oligonucleotide; TTT chr2 60535518 60535539 60535523 60535518 -
tggaagggtggagggactcgtg

SEQ ID NO: 213369 - DNA, 22 bp, Artificial Sequence
  Synthetic oligonucleotide; TTT chr2 60535517 60535538 60535522 60535517 -
ggaagggtggagggactcgtgt

SEQ ID NO: 213370 - DNA, 22 bp, Artificial Sequence
  Synthetic oligonucleotide; TTG chr2 60535516 60535537 60535521 60535516 -
gaagggtggagggactcgtgtt

SEQ ID NO: 213371 - DNA, 22 bp, Artificial Sequence
  Synthetic oligonucleotide; CTC chr2 60535499 60535520 60535504 60535499 -
gtgttaatctgttctgttggag

SEQ ID NO: 213372 - DNA, 22 bp, Artificial Sequence
  Synthetic oligonucleotide; TTA chr2 60535493 60535514 60535498 60535493 -
atctgttctgttggaggactat

SEQ ID NO: 213373 - DNA, 22 bp, Artificial Sequence
  Synthetic oligonucleotide; CTG chr2 60535488 60535509 60535493 60535488 -
ttctgttggaggactatgcagt

SEQ ID NO: 213374 - DNA, 22 bp, Artificial Sequence
  Synthetic oligonucleotide; TTC chr2 60535485 60535506 60535490 60535485 -
tgttggaggactatgcagtatt

SEQ ID NO: 213375 - DNA, 22 bp, Artificial Sequence
  Synthetic oligonucleotide; CTG chr2 60535483 60535504 60535488 60535483 -
ttggaggactatgcagtattgc

SEQ ID NO: 213376 - DNA, 22 bp, Artificial Sequence
  Synthetic oligonucleotide; TTG chr2 60535480 60535501 60535485 60535480 -
gaggactatgcagtattgccta

SEQ ID NO: 213377 - DNA, 22 bp, Artificial Sequence
  Synthetic oligonucleotide; CTA chr2 60535472 60535493 60535477 60535472 -
tgcagtattgcctatgagcgac

SEQ ID NO: 213378 - DNA, 22 bp, Artificial Sequence
  Synthetic oligonucleotide; TTG chr2 60535462 60535483 60535467 60535462 -
cctatgagcgactctgggctgt

SEQ ID NO: 213379 - DNA, 22 bp, Artificial Sequence
  Synthetic oligonucleotide; CTA chr2 60535458 60535479 60535463 60535458 -
tgagcgactctgggctgttttt

SEQ ID NO: 213380 - DNA, 22 bp, Artificial Sequence
  Synthetic oligonucleotide; CTC chr2 60535448 60535469 60535453 60535448 -
tgggctgtttttgataaattac

SEQ ID NO: 213381 - DNA, 22 bp, Artificial Sequence
  Synthetic oligonucleotide; CTG chr2 60535446 60535467 60535451 60535446 -
ggctgtttttgataaattacca

SEQ ID NO: 213382 - DNA, 22 bp, Artificial Sequence
  Synthetic oligonucleotide; CTG chr2 60535441 60535462 60535446 60535441 -
tttttgataaattaccatgttt

SEQ ID NO: 213383 - DNA, 22 bp, Artificial Sequence
  Synthetic oligonucleotide; TTT chr2 60535438 60535459 60535443 60535438 -
ttgataaattaccatgtttaga

SEQ ID NO: 213384 - DNA, 22 bp, Artificial Sequence
  Synthetic oligonucleotide; TTT chr2 60535437 60535458 60535442 60535437 -
tgataaattaccatgtttagag

SEQ ID NO: 213385 - DNA, 22 bp, Artificial Sequence
  Synthetic oligonucleotide; TTT chr2 60535436 60535457 60535441 60535436 -
gataaattaccatgtttagaga

SEQ ID NO: 213386 - DNA, 22 bp, Artificial Sequence
  Synthetic oligonucleotide; TTG chr2 60535435 60535456 60535440 60535435 -
ataaattaccatgtttagagat

SEQ ID NO: 213387 - DNA, 22 bp, Artificial Sequence
  Synthetic oligonucleotide; TTA chr2 60535427 60535448 60535432 60535427 -
ccatgtttagagataggtttgg

SEQ ID NO: 213388 - DNA, 22 bp, Artificial Sequence
  Synthetic oligonucleotide; TTT chr2 60535419 60535440 60535424 60535419 -
agagataggtttggctcttaag

SEQ ID NO: 213389 - DNA, 22 bp, Artificial Sequence
  Synthetic oligonucleotide; TTA chr2 60535418 60535439 60535423 60535418 -
gagataggtttggctcttaagg

SEQ ID NO: 213390 - DNA, 22 bp, Artificial Sequence
  Synthetic oligonucleotide; TTT chr2 60535407 60535428 60535412 60535407 -
ggctcttaagggcttagtttta

SEQ ID NO: 213391 - DNA, 22 bp, Artificial Sequence
  Synthetic oligonucleotide; TTG chr2 60535406 60535427 60535411 60535406 -
gctcttaagggcttagttttat

SEQ ID NO: 213392 - DNA, 22 bp, Artificial Sequence
  Synthetic oligonucleotide; CTC chr2 60535402 60535423 60535407 60535402 -
ttaagggcttagttttatgaac

SEQ ID NO: 213393 - DNA, 22 bp, Artificial Sequence
  Synthetic oligonucleotide; CTT chr2 60535400 60535421 60535405 60535400 -
aagggcttagttttatgaacaa

SEQ ID NO: 213394 - DNA, 22 bp, Artificial Sequence
  Synthetic oligonucleotide; TTA chr2 60535399 60535420 60535404 60535399 -
agggcttagttttatgaacaaa

SEQ ID NO: 213395 - DNA, 22 bp, Artificial Sequence
  Synthetic oligonucleotide; CTT chr2 60535392 60535413 60535397 60535392 -
agttttatgaacaaagtccgtg

SEQ ID NO: 213396 - DNA, 22 bp, Artificial Sequence
  Synthetic oligonucleotide; TTA chr2 60535391 60535412 60535396 60535391 -
gttttatgaacaaagtccgtga

SEQ ID NO: 213397 - DNA, 22 bp, Artificial Sequence
  Synthetic oligonucleotide; TTT chr2 60535387 60535408 60535392 60535387 -
tatgaacaaagtccgtgacgat

SEQ ID NO: 213398 - DNA, 22 bp, Artificial Sequence
  Synthetic oligonucleotide; TTT chr2 60535386 60535407 60535391 60535386 -
atgaacaaagtccgtgacgatg

SEQ ID NO: 213399 - DNA, 22 bp, Artificial Sequence
  Synthetic oligonucleotide; TTA chr2 60535385 60535406 60535390 60535385 -
tgaacaaagtccgtgacgatgt

SEQ ID NO: 213400 - DNA, 22 bp, Artificial Sequence
  Synthetic oligonucleotide; TTT chr2 60535361 60535382 60535366 60535361 -
gcagcctctgtttgtatcttag

SEQ ID NO: 213401 - DNA, 22 bp, Artificial Sequence
  Synthetic oligonucleotide; TTG chr2 60535360 60535381 60535365 60535360 -
cagcctctgtttgtatcttagc

SEQ ID NO: 213402 - DNA, 22 bp, Artificial Sequence
  Synthetic oligonucleotide; CTC chr2 60535353 60535374 60535358 60535353 -
tgtttgtatcttagcccctttg

SEQ ID NO: 213403 - DNA, 22 bp, Artificial Sequence
  Synthetic oligonucleotide; CTG chr2 60535351 60535372 60535356 60535351 -
tttgtatcttagcccctttggc

SEQ ID NO: 213404 - DNA, 22 bp, Artificial Sequence
  Synthetic oligonucleotide; TTT chr2 60535348 60535369 60535353 60535348 -
gtatcttagcccctttggcttg

SEQ ID NO: 213405 - DNA, 22 bp, Artificial Sequence
  Synthetic oligonucleotide; TTG chr2 60535347 60535368 60535352 60535347 -
tatcttagcccctttggcttga

SEQ ID NO: 213406 - DNA, 22 bp, Artificial Sequence
  Synthetic oligonucleotide; CTT chr2 60535341 60535362 60535346 60535341 -
agcccctttggcttgactagaa

SEQ ID NO: 213407 - DNA, 22 bp, Artificial Sequence
  Synthetic oligonucleotide; TTA chr2 60535340 60535361 60535345 60535340 -
gcccctttggcttgactagaag

SEQ ID NO: 213408 - DNA, 22 bp, Artificial Sequence
  Synthetic oligonucleotide; CTT chr2 60535333 60535354 60535338 60535333 -
tggcttgactagaagctctatg

SEQ ID NO: 213409 - DNA, 22 bp, Artificial Sequence
  Synthetic oligonucleotide; TTT chr2 60535332 60535353 60535337 60535332 -
ggcttgactagaagctctatgt

SEQ ID NO: 213410 - DNA, 22 bp, Artificial Sequence
  Synthetic oligonucleotide; TTG chr2 60535331 60535352 60535336 60535331 -
gcttgactagaagctctatgtt

SEQ ID NO: 213411 - DNA, 22 bp, Artificial Sequence
  Synthetic oligonucleotide; CTT chr2 60535327 60535348 60535332 60535327 -
gactagaagctctatgtttagt

SEQ ID NO: 213412 - DNA, 22 bp, Artificial Sequence
  Synthetic oligonucleotide; TTG chr2 60535326 60535347 60535331 60535326 -
actagaagctctatgtttagtt

SEQ ID NO: 213413 - DNA, 22 bp, Artificial Sequence
  Synthetic oligonucleotide; CTA chr2 60535322 60535343 60535327 60535322 -
gaagctctatgtttagtttaag

SEQ ID NO: 213414 - DNA, 22 bp, Artificial Sequence
  Synthetic oligonucleotide; CTC chr2 60535315 60535336 60535320 60535315 -
tatgtttagtttaagctcagtc

SEQ ID NO: 213415 - DNA, 22 bp, Artificial Sequence
  Synthetic oligonucleotide; CTA chr2 60535313 60535334 60535318 60535313 -
tgtttagtttaagctcagtctg

SEQ ID NO: 213416 - DNA, 22 bp, Artificial Sequence
  Synthetic oligonucleotide; TTT chr2 60535308 60535329 60535313 60535308 -
agtttaagctcagtctggaaga

SEQ ID NO: 213417 - DNA, 22 bp, Artificial Sequence
  Synthetic oligonucleotide; TTA chr2 60535307 60535328 60535312 60535307 -
gtttaagctcagtctggaagat

SEQ ID NO: 213418 - DNA, 22 bp, Artificial Sequence
  Synthetic oligonucleotide; TTT chr2 60535303 60535324 60535308 60535303 -
aagctcagtctggaagatatta

SEQ ID NO: 213419 - DNA, 22 bp, Artificial Sequence
  Synthetic oligonucleotide; TTA chr2 60535302 60535323 60535307 60535302 -
agctcagtctggaagatattac

SEQ ID NO: 213420 - DNA, 22 bp, Artificial Sequence
  Synthetic oligonucleotide; CTC chr2 60535297 60535318 60535302 60535297 -
agtctggaagatattacaattt

SEQ ID NO: 213421 - DNA, 22 bp, Artificial Sequence
  Synthetic oligonucleotide; CTG chr2 60535291 60535312 60535296 60535291 -
gaagatattacaattttgcatt

SEQ ID NO: 213422 - DNA, 22 bp, Artificial Sequence
  Synthetic oligonucleotide; TTA chr2 60535281 60535302 60535286 60535281 -
caattttgcattaaaaaaatga

SEQ ID NO: 213423 - DNA, 22 bp, Artificial Sequence
  Synthetic oligonucleotide; TTT chr2 60535275 60535296 60535280 60535275 -
tgcattaaaaaaatgaggaaat

SEQ ID NO: 213424 - DNA, 22 bp, Artificial Sequence
  Synthetic oligonucleotide; TTT chr2 60535274 60535295 60535279 60535274 -
gcattaaaaaaatgaggaaatc

SEQ ID NO: 213425 - DNA, 22 bp, Artificial Sequence
  Synthetic oligonucleotide; TTG chr2 60535273 60535294 60535278 60535273 -
cattaaaaaaatgaggaaatca

SEQ ID NO: 213426 - DNA, 22 bp, Artificial Sequence
  Synthetic oligonucleotide; TTA chr2 60535268 60535289 60535273 60535268 -
aaaaaatgaggaaatcatagga

SEQ ID NO: 213427 - DNA, 22 bp, Artificial Sequence
  Synthetic oligonucleotide; CTT chr2 60535234 60535255 60535239 60535234 -
tgctttttggatgaatcttact

SEQ ID NO: 213428 - DNA, 22 bp, Artificial Sequence
  Synthetic oligonucleotide; TTT chr2 60535233 60535254 60535238 60535233 -
gctttttggatgaatcttactg

SEQ ID NO: 213429 - DNA, 22 bp, Artificial Sequence
  Synthetic oligonucleotide; TTG chr2 60535232 60535253 60535237 60535232 -
ctttttggatgaatcttactga

SEQ ID NO: 213430 - DNA, 22 bp, Artificial Sequence
  Synthetic oligonucleotide; CTT chr2 60535229 60535250 60535234 60535229 -
tttggatgaatcttactgataa

SEQ ID NO: 213431 - DNA, 22 bp, Artificial Sequence
  Synthetic oligonucleotide; TTT chr2 60535228 60535249 60535233 60535228 -
ttggatgaatcttactgataat

SEQ ID NO: 213432 - DNA, 22 bp, Artificial Sequence
  Synthetic oligonucleotide; TTT chr2 60535227 60535248 60535232 60535227 -
tggatgaatcttactgataatt

SEQ ID NO: 213433 - DNA, 22 bp, Artificial Sequence
  Synthetic oligonucleotide; TTT chr2 60535226 60535247 60535231 60535226 -
ggatgaatcttactgataattt

SEQ ID NO: 213434 - DNA, 22 bp, Artificial Sequence
  Synthetic oligonucleotide; TTG chr2 60535225 60535246 60535230 60535225 -
gatgaatcttactgataatttg

SEQ ID NO: 213435 - DNA, 22 bp, Artificial Sequence
  Synthetic oligonucleotide; CTT chr2 60535215 60535236 60535220 60535215 -
actgataatttgctaaagctca

SEQ ID NO: 213436 - DNA, 22 bp, Artificial Sequence
  Synthetic oligonucleotide; TTA chr2 60535214 60535235 60535219 60535214 -
ctgataatttgctaaagctcat

SEQ ID NO: 213437 - DNA, 22 bp, Artificial Sequence
  Synthetic oligonucleotide; CTG chr2 60535211 60535232 60535216 60535211 -
ataatttgctaaagctcatttg

SEQ ID NO: 213438 - DNA, 22 bp, Artificial Sequence
  Synthetic oligonucleotide; TTT chr2 60535204 60535225 60535209 60535204 -
gctaaagctcatttgaatttta

SEQ ID NO: 213439 - DNA, 22 bp, Artificial Sequence
  Synthetic oligonucleotide; TTG chr2 60535203 60535224 60535208 60535203 -
ctaaagctcatttgaattttaa

SEQ ID NO: 213440 - DNA, 22 bp, Artificial Sequence
  Synthetic oligonucleotide; CTA chr2 60535200 60535221 60535205 60535200 -
aagctcatttgaattttaagca

SEQ ID NO: 213441 - DNA, 22 bp, Artificial Sequence
  Synthetic oligonucleotide; CTC chr2 60535194 60535215 60535199 60535194 -
atttgaattttaagcacttctt

SEQ ID NO: 213442 - DNA, 22 bp, Artificial Sequence
  Synthetic oligonucleotide; TTT chr2 60535190 60535211 60535195 60535190 -
gaattttaagcacttctttaat

SEQ ID NO: 213443 - DNA, 22 bp, Artificial Sequence
  Synthetic oligonucleotide; TTG chr2 60535189 60535210 60535194 60535189 -
aattttaagcacttctttaatc

SEQ ID NO: 213444 - DNA, 22 bp, Artificial Sequence
  Synthetic oligonucleotide; TTT chr2 60535184 60535205 60535189 60535184 -
taagcacttctttaatcttcaa

SEQ ID NO: 213445 - DNA, 22 bp, Artificial Sequence
  Synthetic oligonucleotide; TTT chr2 60535183 60535204 60535188 60535183 -
aagcacttctttaatcttcaaa

SEQ ID NO: 213446 - DNA, 22 bp, Artificial Sequence
  Synthetic oligonucleotide; TTA chr2 60535182 60535203 60535187 60535182 -
agcacttctttaatcttcaaag

SEQ ID NO: 213447 - DNA, 22 bp, Artificial Sequence
  Synthetic oligonucleotide; CTT chr2 60535175 60535196 60535180 60535175 -
ctttaatcttcaaaggctaaat

SEQ ID NO: 213448 - DNA, 22 bp, Artificial Sequence
  Synthetic oligonucleotide; TTC chr2 60535174 60535195 60535179 60535174 -
tttaatcttcaaaggctaaatt

SEQ ID NO: 213449 - DNA, 22 bp, Artificial Sequence
  Synthetic oligonucleotide; CTT chr2 60535172 60535193 60535177 60535172 -
taatcttcaaaggctaaattgc

SEQ ID NO: 213450 - DNA, 22 bp, Artificial Sequence
  Synthetic oligonucleotide; TTT chr2 60535171 60535192 60535176 60535171 -
aatcttcaaaggctaaattgct

SEQ ID NO: 213451 - DNA, 22 bp, Artificial Sequence
  Synthetic oligonucleotide; TTA chr2 60535170 60535191 60535175 60535170 -
atcttcaaaggctaaattgctt

SEQ ID NO: 213452 - DNA, 22 bp, Artificial Sequence
  Synthetic oligonucleotide; CTT chr2 60535165 60535186 60535170 60535165 -
caaaggctaaattgctttatga

SEQ ID NO: 213453 - DNA, 22 bp, Artificial Sequence
  Synthetic oligonucleotide; TTC chr2 60535164 60535185 60535169 60535164 -
aaaggctaaattgctttatgaa

SEQ ID NO: 213454 - DNA, 22 bp, Artificial Sequence
  Synthetic oligonucleotide; CTA chr2 60535156 60535177 60535161 60535156 -
aattgctttatgaatatgcatg

SEQ ID NO: 213455 - DNA, 22 bp, Artificial Sequence
  Synthetic oligonucleotide; TTG chr2 60535151 60535172 60535156 60535151 -
ctttatgaatatgcatggtgtg

SEQ ID NO: 213456 - DNA, 22 bp, Artificial Sequence
  Synthetic oligonucleotide; CTT chr2 60535148 60535169 60535153 60535148 -
tatgaatatgcatggtgtgggc

SEQ ID NO: 213457 - DNA, 22 bp, Artificial Sequence
  Synthetic oligonucleotide; TTT chr2 60535147 60535168 60535152 60535147 -
atgaatatgcatggtgtgggca

SEQ ID NO: 213458 - DNA, 22 bp, Artificial Sequence
  Synthetic oligonucleotide; TTA chr2 60535146 60535167 60535151 60535146 -
tgaatatgcatggtgtgggcag

SEQ ID NO: 213459 - DNA, 22 bp, Artificial Sequence
  Synthetic oligonucleotide; CTT chr2 60535120 60535141 60535125 60535120 -
cagttcattacctagttgtaaa

SEQ ID NO: 213460 - DNA, 22 bp, Artificial Sequence
  Synthetic oligonucleotide; TTC chr2 60535119 60535140 60535124 60535119 -
agttcattacctagttgtaaat

SEQ ID NO: 213461 - DNA, 22 bp, Artificial Sequence
  Synthetic oligonucleotide; TTC chr2 60535114 60535135 60535119 60535114 -
attacctagttgtaaattctaa

SEQ ID NO: 213462 - DNA, 22 bp, Artificial Sequence
  Synthetic oligonucleotide; TTA chr2 60535110 60535131 60535115 60535110 -
cctagttgtaaattctaatgac

SEQ ID NO: 213463 - DNA, 22 bp, Artificial Sequence
  Synthetic oligonucleotide; CTA chr2 60535106 60535127 60535111 60535106 -
gttgtaaattctaatgaccatt

SEQ ID NO: 213464 - DNA, 22 bp, Artificial Sequence
  Synthetic oligonucleotide; TTG chr2 60535102 60535123 60535107 60535102 -
taaattctaatgaccattaggt

SEQ ID NO: 213465 - DNA, 22 bp, Artificial Sequence
  Synthetic oligonucleotide; TTC chr2 60535095 60535116 60535100 60535095 -
taatgaccattaggtccttcca

SEQ ID NO: 213466 - DNA, 22 bp, Artificial Sequence
  Synthetic oligonucleotide; CTA chr2 60535093 60535114 60535098 60535093 -
atgaccattaggtccttccagt

SEQ ID NO: 213467 - DNA, 22 bp, Artificial Sequence
  Synthetic oligonucleotide; TTA chr2 60535083 60535104 60535088 60535083 -
ggtccttccagtaattgcgaat

SEQ ID NO: 213468 - DNA, 22 bp, Artificial Sequence
  Synthetic oligonucleotide; CTT chr2 60535076 60535097 60535081 60535076 -
ccagtaattgcgaattgttttg

SEQ ID NO: 213469 - DNA, 22 bp, Artificial Sequence
  Synthetic oligonucleotide; TTC chr2 60535075 60535096 60535080 60535075 -
cagtaattgcgaattgttttgc

SEQ ID NO: 213470 - DNA, 22 bp, Artificial Sequence
  Synthetic oligonucleotide; TTG chr2 60535066 60535087 60535071 60535066 -
cgaattgttttgcatttttgat

SEQ ID NO: 213471 - DNA, 22 bp, Artificial Sequence
  Synthetic oligonucleotide; TTG chr2 60535059 60535080 60535064 60535059 -
ttttgcatttttgattggccta

SEQ ID NO: 213472 - DNA, 22 bp, Artificial Sequence
  Synthetic oligonucleotide; TTT chr2 60535056 60535077 60535061 60535056 -
tgcatttttgattggcctatta

SEQ ID NO: 213473 - DNA, 22 bp, Artificial Sequence
  Synthetic oligonucleotide; TTT chr2 60535055 60535076 60535060 60535055 -
gcatttttgattggcctattaa

SEQ ID NO: 213474 - DNA, 22 bp, Artificial Sequence
  Synthetic oligonucleotide; TTG chr2 60535054 60535075 60535059 60535054 -
catttttgattggcctattaac

SEQ ID NO: 213475 - DNA, 22 bp, Artificial Sequence
  Synthetic oligonucleotide; TTT chr2 60535049 60535070 60535054 60535049 -
ttgattggcctattaacatgta

SEQ ID NO: 213476 - DNA, 22 bp, Artificial Sequence
  Synthetic oligonucleotide; TTT chr2 60535048 60535069 60535053 60535048 -
tgattggcctattaacatgtac

SEQ ID NO: 213477 - DNA, 22 bp, Artificial Sequence
  Synthetic oligonucleotide; TTT chr2 60535047 60535068 60535052 60535047 -
gattggcctattaacatgtaca

SEQ ID NO: 213478 - DNA, 22 bp, Artificial Sequence
  Synthetic oligonucleotide; TTG chr2 60535046 60535067 60535051 60535046 -
attggcctattaacatgtacat

SEQ ID NO: 213479 - DNA, 22 bp, Artificial Sequence
  Synthetic oligonucleotide; TTG chr2 60535042 60535063 60535047 60535042 -
gcctattaacatgtacattcgg

SEQ ID NO: 213480 - DNA, 22 bp, Artificial Sequence
  Synthetic oligonucleotide; CTA chr2 60535037 60535058 60535042 60535037 -
ttaacatgtacattcggtgcac

SEQ ID NO: 213481 - DNA, 22 bp, Artificial Sequence
  Synthetic oligonucleotide; TTA chr2 60535034 60535055 60535039 60535034 -
acatgtacattcggtgcacatc

SEQ ID NO: 213482 - DNA, 22 bp, Artificial Sequence
  Synthetic oligonucleotide; TTC chr2 60535022 60535043 60535027 60535022 -
ggtgcacatcaggctggcctgt

SEQ ID NO: 213483 - DNA, 22 bp, Artificial Sequence
  Synthetic oligonucleotide; CTG chr2 60535006 60535027 60535011 60535006 -
gcctgtcagcctgctgaaggag

SEQ ID NO: 213484 - DNA, 22 bp, Artificial Sequence
  Synthetic oligonucleotide; CTG chr2 60535001 60535022 60535006 60535001 -
tcagcctgctgaaggagaaaaa

SEQ ID NO: 213485 - DNA, 22 bp, Artificial Sequence
  Synthetic oligonucleotide; CTG chr2 60534993 60535014 60534998 60534993 -
ctgaaggagaaaaaaaaggtga

SEQ ID NO: 213486 - DNA, 22 bp, Artificial Sequence
  Synthetic oligonucleotide; CTG chr2 60534990 60535011 60534995 60534990 -
aaggagaaaaaaaaggtgaaaa

SEQ ID NO: 213487 - DNA, 22 bp, Artificial Sequence
  Synthetic oligonucleotide; TTG chr2 60534965 60534986 60534970 60534965 -
tttatagcaccaagattcttag

SEQ ID NO: 213488 - DNA, 22 bp, Artificial Sequence
  Synthetic oligonucleotide; TTT chr2 60534962 60534983 60534967 60534962 -
atagcaccaagattcttagatt

SEQ ID NO: 213489 - DNA, 22 bp, Artificial Sequence
  Synthetic oligonucleotide; TTA chr2 60534961 60534982 60534966 60534961 -
tagcaccaagattcttagattt

SEQ ID NO: 213490 - DNA, 22 bp, Artificial Sequence
  Synthetic oligonucleotide; TTC chr2 60534947 60534968 60534952 60534947 -
ttagattttcaatcttgcaaaa

SEQ ID NO: 213491 - DNA, 22 bp, Artificial Sequence
  Synthetic oligonucleotide; CTT chr2 60534945 60534966 60534950 60534945 -
agattttcaatcttgcaaaatt

SEQ ID NO: 213492 - DNA, 22 bp, Artificial Sequence
  Synthetic oligonucleotide; TTA chr2 60534944 60534965 60534949 60534944 -
gattttcaatcttgcaaaattg

SEQ ID NO: 213493 - DNA, 22 bp, Artificial Sequence
  Synthetic oligonucleotide; TTT chr2 60534939 60534960 60534944 60534939 -
tcaatcttgcaaaattgatgat

SEQ ID NO: 213494 - DNA, 22 bp, Artificial Sequence
  Synthetic oligonucleotide; TTT chr2 60534938 60534959 60534943 60534938 -
caatcttgcaaaattgatgatg

SEQ ID NO: 213495 - DNA, 22 bp, Artificial Sequence
  Synthetic oligonucleotide; TTC chr2 60534937 60534958 60534942 60534937 -
aatcttgcaaaattgatgatgt

SEQ ID NO: 213496 - DNA, 22 bp, Artificial Sequence
  Synthetic oligonucleotide; CTT chr2 60534931 60534952 60534936 60534931 -
gcaaaattgatgatgtaaaaaa

SEQ ID NO: 213497 - DNA, 22 bp, Artificial Sequence
  Synthetic oligonucleotide; TTG chr2 60534930 60534951 60534935 60534930 -
caaaattgatgatgtaaaaaaa

SEQ ID NO: 213498 - DNA, 22 bp, Artificial Sequence
  Synthetic oligonucleotide; TTG chr2 60534922 60534943 60534927 60534922 -
atgatgtaaaaaaattaaagca

SEQ ID NO: 213499 - DNA, 22 bp, Artificial Sequence
  Synthetic oligonucleotide; TTA chr2 60534905 60534926 60534910 60534905 -
aagcagtgttttttcttctcaa

SEQ ID NO: 213500 - DNA, 22 bp, Artificial Sequence
  Synthetic oligonucleotide; TTT chr2 60534894 60534915 60534899 60534894 -
tttcttctcaagattaaaagtt

SEQ ID NO: 213501 - DNA, 22 bp, Artificial Sequence
  Synthetic oligonucleotide; TTT chr2 60534893 60534914 60534898 60534893 -
ttcttctcaagattaaaagttc

SEQ ID NO: 213502 - DNA, 22 bp, Artificial Sequence
  Synthetic oligonucleotide; TTT chr2 60534892 60534913 60534897 60534892 -
tcttctcaagattaaaagttca

SEQ ID NO: 213503 - DNA, 22 bp, Artificial Sequence
  Synthetic oligonucleotide; TTT chr2 60534891 60534912 60534896 60534891 -
cttctcaagattaaaagttcac

SEQ ID NO: 213504 - DNA, 22 bp, Artificial Sequence
  Synthetic oligonucleotide; TTC chr2 60534890 60534911 60534895 60534890 -
ttctcaagattaaaagttcacc

SEQ ID NO: 213505 - DNA, 22 bp, Artificial Sequence
  Synthetic oligonucleotide; CTT chr2 60534888 60534909 60534893 60534888 -
ctcaagattaaaagttcaccaa

SEQ ID NO: 213506 - DNA, 22 bp, Artificial Sequence
  Synthetic oligonucleotide; TTC chr2 60534887 60534908 60534892 60534887 -
tcaagattaaaagttcaccaag

SEQ ID NO: 213507 - DNA, 22 bp, Artificial Sequence
  Synthetic oligonucleotide; CTC chr2 60534885 60534906 60534890 60534885 -
aagattaaaagttcaccaagag

SEQ ID NO: 213508 - DNA, 22 bp, Artificial Sequence
  Synthetic oligonucleotide; TTA chr2 60534878 60534899 60534883 60534878 -
aaagttcaccaagagatttgac

SEQ ID NO: 213509 - DNA, 22 bp, Artificial Sequence
  Synthetic oligonucleotide; TTC chr2 60534871 60534892 60534876 60534871 -
accaagagatttgacatattta

SEQ ID NO: 213510 - DNA, 22 bp, Artificial Sequence
  Synthetic oligonucleotide; TTT chr2 60534859 60534880 60534864 60534859 -
gacatatttaatttacatgatg

SEQ ID NO: 213511 - DNA, 22 bp, Artificial Sequence
  Synthetic oligonucleotide; TTG chr2 60534858 60534879 60534863 60534858 -
acatatttaatttacatgatga

SEQ ID NO: 213512 - DNA, 22 bp, Artificial Sequence
  Synthetic oligonucleotide; TTT chr2 60534850 60534871 60534855 60534850 -
aatttacatgatgactttgcac

SEQ ID NO: 213513 - DNA, 22 bp, Artificial Sequence
  Synthetic oligonucleotide; TTA chr2 60534849 60534870 60534854 60534849 -
atttacatgatgactttgcact

SEQ ID NO: 213514 - DNA, 22 bp, Artificial Sequence
  Synthetic oligonucleotide; TTT chr2 60534845 60534866 60534850 60534845 -
acatgatgactttgcactcctt

SEQ ID NO: 213515 - DNA, 22 bp, Artificial Sequence
  Synthetic oligonucleotide; TTA chr2 60534844 60534865 60534849 60534844 -
catgatgactttgcactccttc

SEQ ID NO: 213516 - DNA, 22 bp, Artificial Sequence
  Synthetic oligonucleotide; CTT chr2 60534833 60534854 60534838 60534833 -
tgcactccttcattaatgtaat

SEQ ID NO: 213517 - DNA, 22 bp, Artificial Sequence
  Synthetic oligonucleotide; TTT chr2 60534832 60534853 60534837 60534832 -
gcactccttcattaatgtaatt

SEQ ID NO: 213518 - DNA, 22 bp, Artificial Sequence
  Synthetic oligonucleotide; TTG chr2 60534831 60534852 60534836 60534831 -
cactccttcattaatgtaattt

SEQ ID NO: 213519 - DNA, 22 bp, Artificial Sequence
  Synthetic oligonucleotide; CTC chr2 60534826 60534847 60534831 60534826 -
cttcattaatgtaatttgcata

SEQ ID NO: 213520 - DNA, 22 bp, Artificial Sequence
  Synthetic oligonucleotide; CTT chr2 60534823 60534844 60534828 60534823 -
cattaatgtaatttgcatatga

SEQ ID NO: 213521 - DNA, 22 bp, Artificial Sequence
  Synthetic oligonucleotide; TTC chr2 60534822 60534843 60534827 60534822 -
attaatgtaatttgcatatgaa

SEQ ID NO: 213522 - DNA, 22 bp, Artificial Sequence
  Synthetic oligonucleotide; TTA chr2 60534818 60534839 60534823 60534818 -
atgtaatttgcatatgaagctg

SEQ ID NO: 213523 - DNA, 22 bp, Artificial Sequence
  Synthetic oligonucleotide; TTT chr2 60534809 60534830 60534814 60534809 -
gcatatgaagctgttgttaatc

SEQ ID NO: 213524 - DNA, 22 bp, Artificial Sequence
  Synthetic oligonucleotide; TTG chr2 60534808 60534829 60534813 60534808 -
catatgaagctgttgttaatca

SEQ ID NO: 213525 - DNA, 22 bp, Artificial Sequence
  Synthetic oligonucleotide; CTG chr2 60534796 60534817 60534801 60534796 -
ttgttaatcacttttgatcatg

SEQ ID NO: 213526 - DNA, 22 bp, Artificial Sequence
  Synthetic oligonucleotide; TTG chr2 60534793 60534814 60534798 60534793 -
ttaatcacttttgatcatgttt

SEQ ID NO: 213527 - DNA, 22 bp, Artificial Sequence
  Synthetic oligonucleotide; TTA chr2 60534790 60534811 60534795 60534790 -
atcacttttgatcatgttttgt

SEQ ID NO: 213528 - DNA, 22 bp, Artificial Sequence
  Synthetic oligonucleotide; CTT chr2 60534783 60534804 60534788 60534783 -
ttgatcatgttttgtgtattag

SEQ ID NO: 213529 - DNA, 22 bp, Artificial Sequence
  Synthetic oligonucleotide; TTT chr2 60534782 60534803 60534787 60534782 -
tgatcatgttttgtgtattagc

SEQ ID NO: 213530 - DNA, 22 bp, Artificial Sequence
  Synthetic oligonucleotide; TTT chr2 60534781 60534802 60534786 60534781 -
gatcatgttttgtgtattagct

SEQ ID NO: 213531 - DNA, 22 bp, Artificial Sequence
  Synthetic oligonucleotide; TTG chr2 60534780 60534801 60534785 60534780 -
atcatgttttgtgtattagctg

SEQ ID NO: 213532 - DNA, 22 bp, Artificial Sequence
  Synthetic oligonucleotide; TTT chr2 60534771 60534792 60534776 60534771 -
tgtgtattagctgcctcagtgg

SEQ ID NO: 213533 - DNA, 22 bp, Artificial Sequence
  Synthetic oligonucleotide; TTT chr2 60534770 60534791 60534775 60534770 -
gtgtattagctgcctcagtggc

SEQ ID NO: 213534 - DNA, 22 bp, Artificial Sequence
  Synthetic oligonucleotide; TTG chr2 60534769 60534790 60534774 60534769 -
tgtattagctgcctcagtggct

SEQ ID NO: 213535 - DNA, 22 bp, Artificial Sequence
  Synthetic oligonucleotide; TTA chr2 60534762 60534783 60534767 60534762 -
gctgcctcagtggctctcctcc

SEQ ID NO: 213536 - DNA, 22 bp, Artificial Sequence
  Synthetic oligonucleotide; CTG chr2 60534758 60534779 60534763 60534758 -
cctcagtggctctcctcctcag

SEQ ID NO: 213537 - DNA, 22 bp, Artificial Sequence
  Synthetic oligonucleotide; CTC chr2 60534754 60534775 60534759 60534754 -
agtggctctcctcctcagatgc

SEQ ID NO: 213538 - DNA, 22 bp, Artificial Sequence
  Synthetic oligonucleotide; CTC chr2 60534746 60534767 60534751 60534746 -
tcctcctcagatgccccagtag

SEQ ID NO: 213539 - DNA, 22 bp, Artificial Sequence
  Synthetic oligonucleotide; CTC chr2 60534744 60534765 60534749 60534744 -
ctcctcagatgccccagtagaa

SEQ ID NO: 213540 - DNA, 22 bp, Artificial Sequence
  Synthetic oligonucleotide; CTC chr2 60534741 60534762 60534746 60534741 -
ctcagatgccccagtagaaagg

SEQ ID NO: 213541 - DNA, 22 bp, Artificial Sequence
  Synthetic oligonucleotide; CTC chr2 60534738 60534759 60534743 60534738 -
agatgccccagtagaaaggagc

SEQ ID NO: 213542 - DNA, 22 bp, Artificial Sequence
  Synthetic oligonucleotide; CTT chr2 60534701 60534722 60534706 60534701 -
cttgccaagtttcctttagtga

SEQ ID NO: 213543 - DNA, 22 bp, Artificial Sequence
  Synthetic oligonucleotide; TTC chr2 60534700 60534721 60534705 60534700 -
ttgccaagtttcctttagtgaa

SEQ ID NO: 213544 - DNA, 22 bp, Artificial Sequence
  Synthetic oligonucleotide; CTT chr2 60534698 60534719 60534703 60534698 -
gccaagtttcctttagtgaatt

SEQ ID NO: 213545 - DNA, 22 bp, Artificial Sequence
  Synthetic oligonucleotide; TTG chr2 60534697 60534718 60534702 60534697 -
ccaagtttcctttagtgaattg

SEQ ID NO: 213546 - DNA, 22 bp, Artificial Sequence
  Synthetic oligonucleotide; TTT chr2 60534689 60534710 60534694 60534689 -
cctttagtgaattgaggaatta

SEQ ID NO: 213547 - DNA, 22 bp, Artificial Sequence
  Synthetic oligonucleotide; TTC chr2 60534688 60534709 60534693 60534688 -
ctttagtgaattgaggaattag

SEQ ID NO: 213548 - DNA, 22 bp, Artificial Sequence
  Synthetic oligonucleotide; CTT chr2 60534685 60534706 60534690 60534685 -
tagtgaattgaggaattagaag

SEQ ID NO: 213549 - DNA, 22 bp, Artificial Sequence
  Synthetic oligonucleotide; TTT chr2 60534684 60534705 60534689 60534684 -
agtgaattgaggaattagaagt

SEQ ID NO: 213550 - DNA, 22 bp, Artificial Sequence
  Synthetic oligonucleotide; TTA chr2 60534683 60534704 60534688 60534683 -
gtgaattgaggaattagaagtc

SEQ ID NO: 213551 - DNA, 22 bp, Artificial Sequence
  Synthetic oligonucleotide; TTG chr2 60534675 60534696 60534680 60534675 -
aggaattagaagtctaaccttg

SEQ ID NO: 213552 - DNA, 22 bp, Artificial Sequence
  Synthetic oligonucleotide; TTA chr2 60534667 60534688 60534672 60534667 -
gaagtctaaccttgagtaatta

SEQ ID NO: 213553 - DNA, 22 bp, Artificial Sequence
  Synthetic oligonucleotide; CTA chr2 60534659 60534680 60534664 60534659 -
accttgagtaattacatatgtt

SEQ ID NO: 213554 - DNA, 22 bp, Artificial Sequence
  Synthetic oligonucleotide; CTT chr2 60534654 60534675 60534659 60534654 -
gagtaattacatatgttttatc

SEQ ID NO: 213555 - DNA, 22 bp, Artificial Sequence
  Synthetic oligonucleotide; TTG chr2 60534653 60534674 60534658 60534653 -
agtaattacatatgttttatcc

SEQ ID NO: 213556 - DNA, 22 bp, Artificial Sequence
  Synthetic oligonucleotide; TTA chr2 60534645 60534666 60534650 60534645 -
catatgttttatccgttttctt

SEQ ID NO: 213557 - DNA, 22 bp, Artificial Sequence
  Synthetic oligonucleotide; TTT chr2 60534636 60534657 60534641 60534636 -
tatccgttttcttttaacgtta

SEQ ID NO: 213558 - DNA, 22 bp, Artificial Sequence
  Synthetic oligonucleotide; TTT chr2 60534635 60534656 60534640 60534635 -
atccgttttcttttaacgttaa

SEQ ID NO: 213559 - DNA, 22 bp, Artificial Sequence
  Synthetic oligonucleotide; TTA chr2 60534634 60534655 60534639 60534634 -
tccgttttcttttaacgttaag

SEQ ID NO: 213560 - DNA, 22 bp, Artificial Sequence
  Synthetic oligonucleotide; TTT chr2 60534627 60534648 60534632 60534627 -
tcttttaacgttaagtacagtt

SEQ ID NO: 213561 - DNA, 22 bp, Artificial Sequence
  Synthetic oligonucleotide; TTT chr2 60534626 60534647 60534631 60534626 -
cttttaacgttaagtacagttt

SEQ ID NO: 213562 - DNA, 22 bp, Artificial Sequence
  Synthetic oligonucleotide; TTC chr2 60534625 60534646 60534630 60534625 -
ttttaacgttaagtacagtttg

SEQ ID NO: 213563 - DNA, 22 bp, Artificial Sequence
  Synthetic oligonucleotide; CTT chr2 60534623 60534644 60534628 60534623 -
ttaacgttaagtacagtttgtg

SEQ ID NO: 213564 - DNA, 22 bp, Artificial Sequence
  Synthetic oligonucleotide; TTT chr2 60534622 60534643 60534627 60534622 -
taacgttaagtacagtttgtga

SEQ ID NO: 213565 - DNA, 22 bp, Artificial Sequence
  Synthetic oligonucleotide; TTT chr2 60534621 60534642 60534626 60534621 -
aacgttaagtacagtttgtgaa

SEQ ID NO: 213566 - DNA, 22 bp, Artificial Sequence
  Synthetic oligonucleotide; TTA chr2 60534620 60534641 60534625 60534620 -
acgttaagtacagtttgtgaac

SEQ ID NO: 213567 - DNA, 22 bp, Artificial Sequence
  Synthetic oligonucleotide; TTA chr2 60534614 60534635 60534619 60534614 -
agtacagtttgtgaacgtgttg

SEQ ID NO: 213568 - DNA, 22 bp, Artificial Sequence
  Synthetic oligonucleotide; TTT chr2 60534604 60534625 60534609 60534604 -
gtgaacgtgttggctggaaatc

SEQ ID NO: 213569 - DNA, 22 bp, Artificial Sequence
  Synthetic oligonucleotide; TTG chr2 60534603 60534624 60534608 60534603 -
tgaacgtgttggctggaaatcg

SEQ ID NO: 213570 - DNA, 22 bp, Artificial Sequence
  Synthetic oligonucleotide; TTG chr2 60534592 60534613 60534597 60534592 -
gctggaaatcgttctcatttgg

SEQ ID NO: 213571 - DNA, 22 bp, Artificial Sequence
  Synthetic oligonucleotide; CTG chr2 60534588 60534609 60534593 60534588 -
gaaatcgttctcatttggggag

SEQ ID NO: 213572 - DNA, 22 bp, Artificial Sequence
  Synthetic oligonucleotide; TTC chr2 60534578 60534599 60534583 60534578 -
tcatttggggagaagactgtaa

SEQ ID NO: 213573 - DNA, 22 bp, Artificial Sequence
  Synthetic oligonucleotide; CTC chr2 60534576 60534597 60534581 60534576 -
atttggggagaagactgtaaaa

SEQ ID NO: 213574 - DNA, 22 bp, Artificial Sequence
  Synthetic oligonucleotide; TTT chr2 60534572 60534593 60534577 60534572 -
ggggagaagactgtaaaattta

SEQ ID NO: 213575 - DNA, 22 bp, Artificial Sequence
  Synthetic oligonucleotide; TTG chr2 60534571 60534592 60534576 60534571 -
gggagaagactgtaaaatttaa

SEQ ID NO: 213576 - DNA, 22 bp, Artificial Sequence
  Synthetic oligonucleotide; CTG chr2 60534559 60534580 60534564 60534559 -
taaaatttaagtatatgattga

SEQ ID NO: 213577 - DNA, 22 bp, Artificial Sequence
  Synthetic oligonucleotide; TTT chr2 60534551 60534572 60534556 60534551 -
aagtatatgattgaggcacttc

SEQ ID NO: 213578 - DNA, 22 bp, Artificial Sequence
  Synthetic oligonucleotide; TTA chr2 60534550 60534571 60534555 60534550 -
agtatatgattgaggcacttcc

SEQ ID NO: 213579 - DNA, 22 bp, Artificial Sequence
  Synthetic oligonucleotide; TTG chr2 60534538 60534559 60534543 60534538 -
aggcacttccagatacatagag

SEQ ID NO: 213580 - DNA, 22 bp, Artificial Sequence
  Synthetic oligonucleotide; CTT chr2 60534530 60534551 60534535 60534530 -
ccagatacatagagaaatatgt

SEQ ID NO: 213581 - DNA, 22 bp, Artificial Sequence
  Synthetic oligonucleotide; TTC chr2 60534529 60534550 60534534 60534529 -
cagatacatagagaaatatgta

SEQ ID NO: 213582 - DNA, 22 bp, Artificial Sequence
  Synthetic oligonucleotide; TTG chr2 60534504 60534525 60534509 60534504 -
cctgtttctgttccccacgaac

SEQ ID NO: 213583 - DNA, 22 bp, Artificial Sequence
  Synthetic oligonucleotide; CTG chr2 60534500 60534521 60534505 60534500 -
tttctgttccccacgaacattg

SEQ ID NO: 213584 - DNA, 22 bp, Artificial Sequence
  Synthetic oligonucleotide; TTT chr2 60534497 60534518 60534502 60534497 -
ctgttccccacgaacattgcag

SEQ ID NO: 213585 - DNA, 22 bp, Artificial Sequence
  Synthetic oligonucleotide; TTC chr2 60534496 60534517 60534501 60534496 -
tgttccccacgaacattgcagg

SEQ ID NO: 213586 - DNA, 22 bp, Artificial Sequence
  Synthetic oligonucleotide; CTG chr2 60534494 60534515 60534499 60534494 -
ttccccacgaacattgcagggc

SEQ ID NO: 213587 - DNA, 22 bp, Artificial Sequence
  Synthetic oligonucleotide; TTC chr2 60534491 60534512 60534496 60534491 -
cccacgaacattgcagggcagt

SEQ ID NO: 213588 - DNA, 22 bp, Artificial Sequence
  Synthetic oligonucleotide; TTG chr2 60534478 60534499 60534483 60534478 -
cagggcagttttattgttagca

SEQ ID NO: 213589 - DNA, 22 bp, Artificial Sequence
  Synthetic oligonucleotide; TTT chr2 60534467 60534488 60534472 60534467 -
tattgttagcagtttgatggca

SEQ ID NO: 213590 - DNA, 22 bp, Artificial Sequence
  Synthetic oligonucleotide; TTT chr2 60534466 60534487 60534471 60534466 -
attgttagcagtttgatggcag

SEQ ID NO: 213591 - DNA, 22 bp, Artificial Sequence
  Synthetic oligonucleotide; TTA chr2 60534465 60534486 60534470 60534465 -
ttgttagcagtttgatggcagg

SEQ ID NO: 213592 - DNA, 22 bp, Artificial Sequence
  Synthetic oligonucleotide; TTG chr2 60534462 60534483 60534467 60534462 -
ttagcagtttgatggcaggaag

SEQ ID NO: 213593 - DNA, 22 bp, Artificial Sequence
  Synthetic oligonucleotide; TTA chr2 60534459 60534480 60534464 60534459 -
gcagtttgatggcaggaagcct

SEQ ID NO: 213594 - DNA, 22 bp, Artificial Sequence
  Synthetic oligonucleotide; TTT chr2 60534452 60534473 60534457 60534452 -
gatggcaggaagccttggctat

SEQ ID NO: 213595 - DNA, 22 bp, Artificial Sequence
  Synthetic oligonucleotide; TTG chr2 60534451 60534472 60534456 60534451 -
atggcaggaagccttggctatt

SEQ ID NO: 213596 - DNA, 22 bp, Artificial Sequence
  Synthetic oligonucleotide; CTT chr2 60534436 60534457 60534441 60534436 -
ggctattatagtgtattaagac

SEQ ID NO: 213597 - DNA, 22 bp, Artificial Sequence
  Synthetic oligonucleotide; TTG chr2 60534435 60534456 60534440 60534435 -
gctattatagtgtattaagaca

SEQ ID NO: 213598 - DNA, 22 bp, Artificial Sequence
  Synthetic oligonucleotide; CTA chr2 60534431 60534452 60534436 60534431 -
ttatagtgtattaagacatcag

SEQ ID NO: 213599 - DNA, 22 bp, Artificial Sequence
  Synthetic oligonucleotide; TTA chr2 60534428 60534449 60534433 60534428 -
tagtgtattaagacatcaggtt

SEQ ID NO: 213600 - DNA, 22 bp, Artificial Sequence
  Synthetic oligonucleotide; TTA chr2 60534418 60534439 60534423 60534418 -
agacatcaggttcctcctttgg

SEQ ID NO: 213601 - DNA, 22 bp, Artificial Sequence
  Synthetic oligonucleotide; TTC chr2 60534405 60534426 60534410 60534405 -
ctcctttggaggagggaaggct

SEQ ID NO: 213602 - DNA, 22 bp, Artificial Sequence
  Synthetic oligonucleotide; CTC chr2 60534402 60534423 60534407 60534402 -
ctttggaggagggaaggctaca

SEQ ID NO: 213603 - DNA, 22 bp, Artificial Sequence
  Synthetic oligonucleotide; CTT chr2 60534399 60534420 60534404 60534399 -
tggaggagggaaggctacagaa

SEQ ID NO: 213604 - DNA, 22 bp, Artificial Sequence
  Synthetic oligonucleotide; TTT chr2 60534398 60534419 60534403 60534398 -
ggaggagggaaggctacagaac

SEQ ID NO: 213605 - DNA, 22 bp, Artificial Sequence
  Synthetic oligonucleotide; TTG chr2 60534397 60534418 60534402 60534397 -
gaggagggaaggctacagaact

SEQ ID NO: 213606 - DNA, 22 bp, Artificial Sequence
  Synthetic oligonucleotide; CTA chr2 60534382 60534403 60534387 60534382 -
cagaactacaaacctttctaac

SEQ ID NO: 213607 - DNA, 22 bp, Artificial Sequence
  Synthetic oligonucleotide; CTA chr2 60534374 60534395 60534379 60534374 -
caaacctttctaacaatgcttt

SEQ ID NO: 213608 - DNA, 22 bp, Artificial Sequence
  Synthetic oligonucleotide; CTT chr2 60534366 60534387 60534371 60534366 -
tctaacaatgctttaggtttct

SEQ ID NO: 213609 - DNA, 22 bp, Artificial Sequence
  Synthetic oligonucleotide; TTT chr2 60534365 60534386 60534370 60534365 -
ctaacaatgctttaggtttctt

SEQ ID NO: 213610 - DNA, 22 bp, Artificial Sequence
  Synthetic oligonucleotide; TTC chr2 60534364 60534385 60534369 60534364 -
taacaatgctttaggtttcttc

SEQ ID NO: 213611 - DNA, 22 bp, Artificial Sequence
  Synthetic oligonucleotide; CTA chr2 60534362 60534383 60534367 60534362 -
acaatgctttaggtttcttctt

SEQ ID NO: 213612 - DNA, 22 bp, Artificial Sequence
  Synthetic oligonucleotide; CTT chr2 60534353 60534374 60534358 60534353 -
taggtttcttctttagatagat

SEQ ID NO: 213613 - DNA, 22 bp, Artificial Sequence
  Synthetic oligonucleotide; TTT chr2 60534352 60534373 60534357 60534352 -
aggtttcttctttagatagatg

SEQ ID NO: 213614 - DNA, 22 bp, Artificial Sequence
  Synthetic oligonucleotide; TTA chr2 60534351 60534372 60534356 60534351 -
ggtttcttctttagatagatgg

SEQ ID NO: 213615 - DNA, 22 bp, Artificial Sequence
  Synthetic oligonucleotide; TTT chr2 60534346 60534367 60534351 60534346 -
cttctttagatagatggctggc

SEQ ID NO: 213616 - DNA, 22 bp, Artificial Sequence
  Synthetic oligonucleotide; TTC chr2 60534345 60534366 60534350 60534345 -
ttctttagatagatggctggca

SEQ ID NO: 213617 - DNA, 22 bp, Artificial Sequence
  Synthetic oligonucleotide; CTT chr2 60534343 60534364 60534348 60534343 -
ctttagatagatggctggcacc

SEQ ID NO: 213618 - DNA, 22 bp, Artificial Sequence
  Synthetic oligonucleotide; TTC chr2 60534342 60534363 60534347 60534342 -
tttagatagatggctggcacct

SEQ ID NO: 213619 - DNA, 22 bp, Artificial Sequence
  Synthetic oligonucleotide; CTT chr2 60534340 60534361 60534345 60534340 -
tagatagatggctggcacctaa

SEQ ID NO: 213620 - DNA, 22 bp, Artificial Sequence
  Synthetic oligonucleotide; TTT chr2 60534339 60534360 60534344 60534339 -
agatagatggctggcacctaaa

SEQ ID NO: 213621 - DNA, 22 bp, Artificial Sequence
  Synthetic oligonucleotide; TTA chr2 60534338 60534359 60534343 60534338 -
gatagatggctggcacctaaag

SEQ ID NO: 213622 - DNA, 22 bp, Artificial Sequence
  Synthetic oligonucleotide; CTG chr2 60534326 60534347 60534331 60534326 -
gcacctaaaggacttgggcctg

SEQ ID NO: 213623 - DNA, 22 bp, Artificial Sequence
  Synthetic oligonucleotide; CTA chr2 60534319 60534340 60534324 60534319 -
aaggacttgggcctgggtttgg

SEQ ID NO: 213624 - DNA, 22 bp, Artificial Sequence
  Synthetic oligonucleotide; CTT chr2 60534311 60534332 60534316 60534311 -
gggcctgggtttggctgactct

SEQ ID NO: 213625 - DNA, 22 bp, Artificial Sequence
  Synthetic oligonucleotide; TTG chr2 60534310 60534331 60534315 60534310 -
ggcctgggtttggctgactctt

SEQ ID NO: 213626 - DNA, 22 bp, Artificial Sequence
  Synthetic oligonucleotide; CTG chr2 60534304 60534325 60534309 60534304 -
ggtttggctgactcttttatct

SEQ ID NO: 213627 - DNA, 22 bp, Artificial Sequence
  Synthetic oligonucleotide; TTT chr2 60534299 60534320 60534304 60534299 -
ggctgactcttttatcttttag

SEQ ID NO: 213628 - DNA, 22 bp, Artificial Sequence
  Synthetic oligonucleotide; TTG chr2 60534298 60534319 60534303 60534298 -
gctgactcttttatcttttaga

SEQ ID NO: 213629 - DNA, 22 bp, Artificial Sequence
  Synthetic oligonucleotide; CTG chr2 60534294 60534315 60534299 60534294 -
actcttttatcttttagatcaa

SEQ ID NO: 213630 - DNA, 22 bp, Artificial Sequence
  Synthetic oligonucleotide; CTC chr2 60534290 60534311 60534295 60534290 -
ttttatcttttagatcaagtaa

SEQ ID NO: 213631 - DNA, 22 bp, Artificial Sequence
  Synthetic oligonucleotide; CTT chr2 60534288 60534309 60534293 60534288 -
ttatcttttagatcaagtaagt

SEQ ID NO: 213632 - DNA, 22 bp, Artificial Sequence
  Synthetic oligonucleotide; TTT chr2 60534287 60534308 60534292 60534287 -
tatcttttagatcaagtaagtt

SEQ ID NO: 213633 - DNA, 22 bp, Artificial Sequence
  Synthetic oligonucleotide; TTT chr2 60534286 60534307 60534291 60534286 -
atcttttagatcaagtaagttt

SEQ ID NO: 213634 - DNA, 22 bp, Artificial Sequence
  Synthetic oligonucleotide; TTA chr2 60534285 60534306 60534290 60534285 -
tcttttagatcaagtaagtttt

SEQ ID NO: 213635 - DNA, 22 bp, Artificial Sequence
  Synthetic oligonucleotide; CTT chr2 60534281 60534302 60534286 60534281 -
ttagatcaagtaagttttctca

SEQ ID NO: 213636 - DNA, 22 bp, Artificial Sequence
  Synthetic oligonucleotide; TTT chr2 60534280 60534301 60534285 60534280 -
tagatcaagtaagttttctcat

SEQ ID NO: 213637 - DNA, 22 bp, Artificial Sequence
  Synthetic oligonucleotide; TTT chr2 60534279 60534300 60534284 60534279 -
agatcaagtaagttttctcatt

SEQ ID NO: 213638 - DNA, 22 bp, Artificial Sequence
  Synthetic oligonucleotide; TTA chr2 60534278 60534299 60534283 60534278 -
gatcaagtaagttttctcattc

SEQ ID NO: 213639 - DNA, 22 bp, Artificial Sequence
  Synthetic oligonucleotide; TTT chr2 60534264 60534285 60534269 60534264 -
tctcattcagctgctgctctga

SEQ ID NO: 213640 - DNA, 22 bp, Artificial Sequence
  Synthetic oligonucleotide; TTT chr2 60534263 60534284 60534268 60534263 -
ctcattcagctgctgctctgag

SEQ ID NO: 213641 - DNA, 22 bp, Artificial Sequence
  Synthetic oligonucleotide; TTC chr2 60534262 60534283 60534267 60534262 -
tcattcagctgctgctctgagc

SEQ ID NO: 213642 - DNA, 22 bp, Artificial Sequence
  Synthetic oligonucleotide; CTC chr2 60534260 60534281 60534265 60534260 -
attcagctgctgctctgagcta

SEQ ID NO: 213643 - DNA, 22 bp, Artificial Sequence
  Synthetic oligonucleotide; TTC chr2 60534256 60534277 60534261 60534256 -
agctgctgctctgagctacaat

SEQ ID NO: 213644 - DNA, 22 bp, Artificial Sequence
  Synthetic oligonucleotide; CTG chr2 60534251 60534272 60534256 60534251 -
ctgctctgagctacaatgtgtc

SEQ ID NO: 213645 - DNA, 22 bp, Artificial Sequence
  Synthetic oligonucleotide; CTG chr2 60534248 60534269 60534253 60534248 -
ctctgagctacaatgtgtcctc

SEQ ID NO: 213646 - DNA, 22 bp, Artificial Sequence
  Synthetic oligonucleotide; CTC chr2 60534245 60534266 60534250 60534245 -
tgagctacaatgtgtcctcccc

SEQ ID NO: 213647 - DNA, 22 bp, Artificial Sequence
  Synthetic oligonucleotide; CTG chr2 60534243 60534264 60534248 60534243 -
agctacaatgtgtcctcccctc

SEQ ID NO: 213648 - DNA, 22 bp, Artificial Sequence
  Synthetic oligonucleotide; CTA chr2 60534238 60534259 60534243 60534238 -
caatgtgtcctcccctcatcac

SEQ ID NO: 213649 - DNA, 22 bp, Artificial Sequence
  Synthetic oligonucleotide; CTC chr2 60534226 60534247 60534231 60534226 -
ccctcatcaccaaagtatatcc

SEQ ID NO: 213650 - DNA, 22 bp, Artificial Sequence
  Synthetic oligonucleotide; CTC chr2 60534221 60534242 60534226 60534221 -
atcaccaaagtatatcctggtc

SEQ ID NO: 213651 - DNA, 22 bp, Artificial Sequence
  Synthetic oligonucleotide; CTG chr2 60534202 60534223 60534207 60534202 -
gtctccaggctccctgggctcc

SEQ ID NO: 213652 - DNA, 22 bp, Artificial Sequence
  Synthetic oligonucleotide; CTC chr2 60534197 60534218 60534202 60534197 -
caggctccctgggctcccagtg

SEQ ID NO: 213653 - DNA, 22 bp, Artificial Sequence
  Synthetic oligonucleotide; CTC chr2 60534190 60534211 60534195 60534190 -
cctgggctcccagtgtctccct

SEQ ID NO: 213654 - DNA, 22 bp, Artificial Sequence
  Synthetic oligonucleotide; CTG chr2 60534186 60534207 60534191 60534186 -
ggctcccagtgtctccctcaag

SEQ ID NO: 213655 - DNA, 22 bp, Artificial Sequence
  Synthetic oligonucleotide; CTC chr2 60534181 60534202 60534186 60534181 -
ccagtgtctccctcaaggtaca

SEQ ID NO: 213656 - DNA, 22 bp, Artificial Sequence
  Synthetic oligonucleotide; CTC chr2 60534171 60534192 60534176 60534171 -
cctcaaggtacacgagtgccct

SEQ ID NO: 213657 - DNA, 22 bp, Artificial Sequence
  Synthetic oligonucleotide; CTC chr2 60534167 60534188 60534172 60534167 -
aaggtacacgagtgccctggtg

SEQ ID NO: 213658 - DNA, 22 bp, Artificial Sequence
  Synthetic oligonucleotide; CTG chr2 60534148 60534169 60534153 60534148 -
gtggtgaaaacaaggtgctaac

SEQ ID NO: 213659 - DNA, 22 bp, Artificial Sequence
  Synthetic oligonucleotide; CTA chr2 60534128 60534149 60534133 60534128 -
actaacggtttccgatttttga

SEQ ID NO: 213660 - DNA, 22 bp, Artificial Sequence
  Synthetic oligonucleotide; CTA chr2 60534124 60534145 60534129 60534124 -
acggtttccgatttttgagagc

SEQ ID NO: 213661 - DNA, 22 bp, Artificial Sequence
  Synthetic oligonucleotide; TTT chr2 60534117 60534138 60534122 60534117 -
ccgatttttgagagcctgtgat

SEQ ID NO: 213662 - DNA, 22 bp, Artificial Sequence
  Synthetic oligonucleotide; TTC chr2 60534116 60534137 60534121 60534116 -
cgatttttgagagcctgtgatt

SEQ ID NO: 213663 - DNA, 22 bp, Artificial Sequence
  Synthetic oligonucleotide; TTT chr2 60534110 60534131 60534115 60534110 -
ttgagagcctgtgattttggtg

SEQ ID NO: 213664 - DNA, 22 bp, Artificial Sequence
  Synthetic oligonucleotide; TTT chr2 60534109 60534130 60534114 60534109 -
tgagagcctgtgattttggtgt

SEQ ID NO: 213665 - DNA, 22 bp, Artificial Sequence
  Synthetic oligonucleotide; TTT chr2 60534108 60534129 60534113 60534108 -
gagagcctgtgattttggtgtt

SEQ ID NO: 213666 - DNA, 22 bp, Artificial Sequence
  Synthetic oligonucleotide; TTG chr2 60534107 60534128 60534112 60534107 -
agagcctgtgattttggtgttt

SEQ ID NO: 213667 - DNA, 22 bp, Artificial Sequence
  Synthetic oligonucleotide; CTG chr2 60534099 60534120 60534104 60534099 -
tgattttggtgtttgcctttgc

SEQ ID NO: 213668 - DNA, 22 bp, Artificial Sequence
  Synthetic oligonucleotide; TTT chr2 60534093 60534114 60534098 60534093 -
tggtgtttgcctttgctgttga

SEQ ID NO: 213669 - DNA, 22 bp, Artificial Sequence
  Synthetic oligonucleotide; TTT chr2 60534092 60534113 60534097 60534092 -
ggtgtttgcctttgctgttgaa

SEQ ID NO: 213670 - DNA, 22 bp, Artificial Sequence
  Synthetic oligonucleotide; TTG chr2 60534091 60534112 60534096 60534091 -
gtgtttgcctttgctgttgaat

SEQ ID NO: 213671 - DNA, 22 bp, Artificial Sequence
  Synthetic oligonucleotide; TTT chr2 60534085 60534106 60534090 60534085 -
gcctttgctgttgaataacctg

SEQ ID NO: 213672 - DNA, 22 bp, Artificial Sequence
  Synthetic oligonucleotide; TTG chr2 60534084 60534105 60534089 60534084 -
cctttgctgttgaataacctgt

SEQ ID NO: 213673 - DNA, 22 bp, Artificial Sequence
  Synthetic oligonucleotide; CTT chr2 60534080 60534101 60534085 60534080 -
tgctgttgaataacctgtgctg

SEQ ID NO: 213674 - DNA, 22 bp, Artificial Sequence
  Synthetic oligonucleotide; TTT chr2 60534079 60534100 60534084 60534079 -
gctgttgaataacctgtgctgt

SEQ ID NO: 213675 - DNA, 22 bp, Artificial Sequence
  Synthetic oligonucleotide; TTG chr2 60534078 60534099 60534083 60534078 -
ctgttgaataacctgtgctgta

SEQ ID NO: 213676 - DNA, 22 bp, Artificial Sequence
  Synthetic oligonucleotide; CTG chr2 60534075 60534096 60534080 60534075 -
ttgaataacctgtgctgtatta

SEQ ID NO: 213677 - DNA, 22 bp, Artificial Sequence
  Synthetic oligonucleotide; TTG chr2 60534072 60534093 60534077 60534072 -
aataacctgtgctgtattattg

SEQ ID NO: 213678 - DNA, 22 bp, Artificial Sequence
  Synthetic oligonucleotide; CTG chr2 60534063 60534084 60534068 60534063 -
tgctgtattattgatgttcatc

SEQ ID NO: 213679 - DNA, 22 bp, Artificial Sequence
  Synthetic oligonucleotide; CTG chr2 60534058 60534079 60534063 60534058 -
tattattgatgttcatctttgg

SEQ ID NO: 213680 - DNA, 22 bp, Artificial Sequence
  Synthetic oligonucleotide; TTA chr2 60534053 60534074 60534058 60534053 -
ttgatgttcatctttggtttat

SEQ ID NO: 213681 - DNA, 22 bp, Artificial Sequence
  Synthetic oligonucleotide; TTG chr2 60534050 60534071 60534055 60534050 -
atgttcatctttggtttatgag

SEQ ID NO: 213682 - DNA, 22 bp, Artificial Sequence
  Synthetic oligonucleotide; TTC chr2 60534044 60534065 60534049 60534044 -
atctttggtttatgagtttatc

SEQ ID NO: 213683 - DNA, 22 bp, Artificial Sequence
  Synthetic oligonucleotide; CTT chr2 60534039 60534060 60534044 60534039 -
tggtttatgagtttatcactgg

SEQ ID NO: 213684 - DNA, 22 bp, Artificial Sequence
  Synthetic oligonucleotide; TTT chr2 60534038 60534059 60534043 60534038 -
ggtttatgagtttatcactggt

SEQ ID NO: 213685 - DNA, 22 bp, Artificial Sequence
  Synthetic oligonucleotide; TTG chr2 60534037 60534058 60534042 60534037 -
gtttatgagtttatcactggtt

SEQ ID NO: 213686 - DNA, 22 bp, Artificial Sequence
  Synthetic oligonucleotide; TTT chr2 60534033 60534054 60534038 60534033 -
atgagtttatcactggttaaca

SEQ ID NO: 213687 - DNA, 22 bp, Artificial Sequence
  Synthetic oligonucleotide; TTA chr2 60534032 60534053 60534037 60534032 -
tgagtttatcactggttaacaa

SEQ ID NO: 213688 - DNA, 22 bp, Artificial Sequence
  Synthetic oligonucleotide; TTT chr2 60534025 60534046 60534030 60534025 -
atcactggttaacaagcagaat

SEQ ID NO: 213689 - DNA, 22 bp, Artificial Sequence
  Synthetic oligonucleotide; TTA chr2 60534024 60534045 60534029 60534024 -
tcactggttaacaagcagaatc

SEQ ID NO: 213690 - DNA, 22 bp, Artificial Sequence
  Synthetic oligonucleotide; CTG chr2 60534018 60534039 60534023 60534018 -
gttaacaagcagaatcagaaca

SEQ ID NO: 213691 - DNA, 22 bp, Artificial Sequence
  Synthetic oligonucleotide; TTA chr2 60534014 60534035 60534019 60534014 -
acaagcagaatcagaacagtgt

SEQ ID NO: 213692 - DNA, 22 bp, Artificial Sequence
  Synthetic oligonucleotide; CTG chr2 60533987 60534008 60533992 60533987 -
atattctgattaaaacgaatgt

SEQ ID NO: 213693 - DNA, 22 bp, Artificial Sequence
  Synthetic oligonucleotide; TTC chr2 60533981 60534002 60533986 60533981 -
tgattaaaacgaatgtttaatg

SEQ ID NO: 213694 - DNA, 22 bp, Artificial Sequence
  Synthetic oligonucleotide; CTG chr2 60533979 60534000 60533984 60533979 -
attaaaacgaatgtttaatgaa

SEQ ID NO: 213695 - DNA, 22 bp, Artificial Sequence
  Synthetic oligonucleotide; TTA chr2 60533975 60533996 60533980 60533975 -
aaacgaatgtttaatgaaagaa

SEQ ID NO: 213696 - DNA, 22 bp, Artificial Sequence
  Synthetic oligonucleotide; TTT chr2 60533963 60533984 60533968 60533963 -
aatgaaagaaaataaattgtga

SEQ ID NO: 213697 - DNA, 22 bp, Artificial Sequence
  Synthetic oligonucleotide; TTA chr2 60533962 60533983 60533967 60533962 -
atgaaagaaaataaattgtgat

SEQ ID NO: 213698 - DNA, 22 bp, Artificial Sequence
  Synthetic oligonucleotide; TTG chr2 60533944 60533965 60533949 60533944 -
tgatggaaaatgaacagtgtgt

SEQ ID NO: 213699 - DNA, 22 bp, Artificial Sequence
  Synthetic oligonucleotide; CTA chr2 60533908 60533929 60533913 60533908 -
taattttaacctccgagggacc

SEQ ID NO: 213700 - DNA, 22 bp, Artificial Sequence
  Synthetic oligonucleotide; TTT chr2 60533902 60533923 60533907 60533902 -
taacctccgagggacctagcac

SEQ ID NO: 213701 - DNA, 22 bp, Artificial Sequence
  Synthetic oligonucleotide; TTT chr2 60533901 60533922 60533906 60533901 -
aacctccgagggacctagcact

SEQ ID NO: 213702 - DNA, 22 bp, Artificial Sequence
  Synthetic oligonucleotide; TTA chr2 60533900 60533921 60533905 60533900 -
acctccgagggacctagcactg

SEQ ID NO: 213703 - DNA, 22 bp, Artificial Sequence
  Synthetic oligonucleotide; CTC chr2 60533895 60533916 60533900 60533895 -
cgagggacctagcactgcccta

SEQ ID NO: 213704 - DNA, 22 bp, Artificial Sequence
  Synthetic oligonucleotide; CTA chr2 60533884 60533905 60533889 60533884 -
gcactgccctaccgtgacttcc

SEQ ID NO: 213705 - DNA, 22 bp, Artificial Sequence
  Synthetic oligonucleotide; CTG chr2 60533878 60533899 60533883 60533878 -
ccctaccgtgacttccatccat

SEQ ID NO: 213706 - DNA, 22 bp, Artificial Sequence
  Synthetic oligonucleotide; CTA chr2 60533873 60533894 60533878 60533873 -
ccgtgacttccatccataccat

SEQ ID NO: 213707 - DNA, 22 bp, Artificial Sequence
  Synthetic oligonucleotide; CTT chr2 60533864 60533885 60533869 60533864 -
ccatccataccatgctaaaagc

SEQ ID NO: 213708 - DNA, 22 bp, Artificial Sequence
  Synthetic oligonucleotide; TTC chr2 60533863 60533884 60533868 60533863 -
catccataccatgctaaaagca

SEQ ID NO: 213709 - DNA, 22 bp, Artificial Sequence
  Synthetic oligonucleotide; CTA chr2 60533847 60533868 60533852 60533847 -
aaagcatgcttcagtttaaagt

SEQ ID NO: 213710 - DNA, 22 bp, Artificial Sequence
  Synthetic oligonucleotide; CTT chr2 60533836 60533857 60533841 60533836 -
cagtttaaagttgttaatattc

SEQ ID NO: 213711 - DNA, 22 bp, Artificial Sequence
  Synthetic oligonucleotide; TTC chr2 60533835 60533856 60533840 60533835 -
agtttaaagttgttaatattca

SEQ ID NO: 213712 - DNA, 22 bp, Artificial Sequence
  Synthetic oligonucleotide; TTT chr2 60533830 60533851 60533835 60533830 -
aaagttgttaatattcagctgg

SEQ ID NO: 213713 - DNA, 22 bp, Artificial Sequence
  Synthetic oligonucleotide; TTA chr2 60533829 60533850 60533834 60533829 -
aagttgttaatattcagctggg

SEQ ID NO: 213714 - DNA, 22 bp, Artificial Sequence
  Synthetic oligonucleotide; TTG chr2 60533823 60533844 60533828 60533823 -
ttaatattcagctgggaaacag

SEQ ID NO: 213715 - DNA, 22 bp, Artificial Sequence
  Synthetic oligonucleotide; TTA chr2 60533820 60533841 60533825 60533820 -
atattcagctgggaaacagtat

SEQ ID NO: 213716 - DNA, 22 bp, Artificial Sequence
  Synthetic oligonucleotide; TTC chr2 60533814 60533835 60533819 60533814 -
agctgggaaacagtatccagaa

SEQ ID NO: 213717 - DNA, 22 bp, Artificial Sequence
  Synthetic oligonucleotide; CTG chr2 60533809 60533830 60533814 60533809 -
ggaaacagtatccagaacacaa

SEQ ID NO: 213718 - DNA, 22 bp, Artificial Sequence
  Synthetic oligonucleotide; TTA chr2 60533779 60533800 60533784 60533779 -
ttaagtgcatgaactttttagg

SEQ ID NO: 213719 - DNA, 22 bp, Artificial Sequence
  Synthetic oligonucleotide; TTA chr2 60533776 60533797 60533781 60533776 -
agtgcatgaactttttaggcag

SEQ ID NO: 213720 - DNA, 22 bp, Artificial Sequence
  Synthetic oligonucleotide; CTT chr2 60533763 60533784 60533768 60533763 -
tttaggcagtaagatgaactga

SEQ ID NO: 213721 - DNA, 22 bp, Artificial Sequence
  Synthetic oligonucleotide; TTT chr2 60533762 60533783 60533767 60533762 -
ttaggcagtaagatgaactgat

SEQ ID NO: 213722 - DNA, 22 bp, Artificial Sequence
  Synthetic oligonucleotide; TTT chr2 60533761 60533782 60533766 60533761 -
taggcagtaagatgaactgatg

SEQ ID NO: 213723 - DNA, 22 bp, Artificial Sequence
  Synthetic oligonucleotide; TTT chr2 60533760 60533781 60533765 60533760 -
aggcagtaagatgaactgatgg

SEQ ID NO: 213724 - DNA, 22 bp, Artificial Sequence
  Synthetic oligonucleotide; TTA chr2 60533759 60533780 60533764 60533759 -
ggcagtaagatgaactgatggg

SEQ ID NO: 213725 - DNA, 22 bp, Artificial Sequence
  Synthetic oligonucleotide; CTG chr2 60533742 60533763 60533747 60533742 -
atggggtccatctgtgagatcc

SEQ ID NO: 213726 - DNA, 22 bp, Artificial Sequence
  Synthetic oligonucleotide; CTG chr2 60533728 60533749 60533733 60533728 -
tgagatccaggggctttttatt

SEQ ID NO: 213727 - DNA, 22 bp, Artificial Sequence
  Synthetic oligonucleotide; CTT chr2 60533712 60533733 60533717 60533712 -
tttatttgtgtgtgtcgagcga

SEQ ID NO: 213728 - DNA, 22 bp, Artificial Sequence
  Synthetic oligonucleotide; TTT chr2 60533711 60533732 60533716 60533711 -
ttatttgtgtgtgtcgagcgat

SEQ ID NO: 213729 - DNA, 22 bp, Artificial Sequence
  Synthetic oligonucleotide; TTT chr2 60533710 60533731 60533715 60533710 -
tatttgtgtgtgtcgagcgatt

SEQ ID NO: 213730 - DNA, 22 bp, Artificial Sequence
  Synthetic oligonucleotide; TTT chr2 60533709 60533730 60533714 60533709 -
atttgtgtgtgtcgagcgattc

SEQ ID NO: 213731 - DNA, 22 bp, Artificial Sequence
  Synthetic oligonucleotide; TTA chr2 60533708 60533729 60533713 60533708 -
tttgtgtgtgtcgagcgattct

SEQ ID NO: 213732 - DNA, 22 bp, Artificial Sequence
  Synthetic oligonucleotide; TTT chr2 60533705 60533726 60533710 60533705 -
gtgtgtgtcgagcgattctgcc

SEQ ID NO: 213733 - DNA, 22 bp, Artificial Sequence
  Synthetic oligonucleotide; TTG chr2 60533704 60533725 60533709 60533704 -
tgtgtgtcgagcgattctgccc

SEQ ID NO: 213734 - DNA, 22 bp, Artificial Sequence
  Synthetic oligonucleotide; TTC chr2 60533687 60533708 60533692 60533687 -
tgccctctccgacttcacagcc

SEQ ID NO: 213735 - DNA, 22 bp, Artificial Sequence
  Synthetic oligonucleotide; CTG chr2 60533685 60533706 60533690 60533685 -
ccctctccgacttcacagcctt

SEQ ID NO: 213736 - DNA, 22 bp, Artificial Sequence
  Synthetic oligonucleotide; CTC chr2 60533680 60533701 60533685 60533680 -
tccgacttcacagcctttggtc

SEQ ID NO: 213737 - DNA, 22 bp, Artificial Sequence
  Synthetic oligonucleotide; CTC chr2 60533678 60533699 60533683 60533678 -
cgacttcacagcctttggtctc

SEQ ID NO: 213738 - DNA, 22 bp, Artificial Sequence
  Synthetic oligonucleotide; CTT chr2 60533672 60533693 60533677 60533672 -
cacagcctttggtctccggcca

SEQ ID NO: 213739 - DNA, 22 bp, Artificial Sequence
  Synthetic oligonucleotide; TTC chr2 60533671 60533692 60533676 60533671 -
acagcctttggtctccggccaa

SEQ ID NO: 213740 - DNA, 22 bp, Artificial Sequence
  Synthetic oligonucleotide; CTT chr2 60533663 60533684 60533668 60533663 -
tggtctccggccaactgcatgc

SEQ ID NO: 213741 - DNA, 22 bp, Artificial Sequence
  Synthetic oligonucleotide; TTT chr2 60533662 60533683 60533667 60533662 -
ggtctccggccaactgcatgca

SEQ ID NO: 213742 - DNA, 22 bp, Artificial Sequence
  Synthetic oligonucleotide; TTG chr2 60533661 60533682 60533666 60533661 -
gtctccggccaactgcatgcat

SEQ ID NO: 213743 - DNA, 22 bp, Artificial Sequence
  Synthetic oligonucleotide; CTC chr2 60533656 60533677 60533661 60533656 -
cggccaactgcatgcataattg

SEQ ID NO: 213744 - DNA, 22 bp, Artificial Sequence
  Synthetic oligonucleotide; CTG chr2 60533646 60533667 60533651 60533646 -
catgcataattgattccacacg

SEQ ID NO: 213745 - DNA, 22 bp, Artificial Sequence
  Synthetic oligonucleotide; TTG chr2 60533634 60533655 60533639 60533634 -
attccacacgcactatcatttt

SEQ ID NO: 213746 - DNA, 22 bp, Artificial Sequence
  Synthetic oligonucleotide; TTC chr2 60533630 60533651 60533635 60533630 -
cacacgcactatcattttcttg

SEQ ID NO: 213747 - DNA, 22 bp, Artificial Sequence
  Synthetic oligonucleotide; CTA chr2 60533619 60533640 60533624 60533619 -
tcattttcttgatgtaattgct

SEQ ID NO: 213748 - DNA, 22 bp, Artificial Sequence
  Synthetic oligonucleotide; TTT chr2 60533613 60533634 60533618 60533613 -
tcttgatgtaattgctttacta

SEQ ID NO: 213749 - DNA, 22 bp, Artificial Sequence
  Synthetic oligonucleotide; TTT chr2 60533612 60533633 60533617 60533612 -
cttgatgtaattgctttactaa

SEQ ID NO: 213750 - DNA, 22 bp, Artificial Sequence
  Synthetic oligonucleotide; TTC chr2 60533611 60533632 60533616 60533611 -
ttgatgtaattgctttactaag

SEQ ID NO: 213751 - DNA, 22 bp, Artificial Sequence
  Synthetic oligonucleotide; CTT chr2 60533609 60533630 60533614 60533609 -
gatgtaattgctttactaagat

SEQ ID NO: 213752 - DNA, 22 bp, Artificial Sequence
  Synthetic oligonucleotide; TTG chr2 60533608 60533629 60533613 60533608 -
atgtaattgctttactaagata

SEQ ID NO: 213753 - DNA, 22 bp, Artificial Sequence
  Synthetic oligonucleotide; TTG chr2 60533599 60533620 60533604 60533599 -
ctttactaagatatgatgaaat

SEQ ID NO: 213754 - DNA, 22 bp, Artificial Sequence
  Synthetic oligonucleotide; CTT chr2 60533596 60533617 60533601 60533596 -
tactaagatatgatgaaatcta

SEQ ID NO: 213755 - DNA, 22 bp, Artificial Sequence
  Synthetic oligonucleotide; TTT chr2 60533595 60533616 60533600 60533595 -
actaagatatgatgaaatctaa

SEQ ID NO: 213756 - DNA, 22 bp, Artificial Sequence
  Synthetic oligonucleotide; TTA chr2 60533594 60533615 60533599 60533594 -
ctaagatatgatgaaatctaat

SEQ ID NO: 213757 - DNA, 22 bp, Artificial Sequence
  Synthetic oligonucleotide; CTA chr2 60533591 60533612 60533596 60533591 -
agatatgatgaaatctaatgga

SEQ ID NO: 213758 - DNA, 22 bp, Artificial Sequence
  Synthetic oligonucleotide; CTA chr2 60533574 60533595 60533579 60533574 -
atggataatttgctatttgaaa

SEQ ID NO: 213759 - DNA, 22 bp, Artificial Sequence
  Synthetic oligonucleotide; TTT chr2 60533563 60533584 60533568 60533563 -
gctatttgaaaatggtcaaaaa

SEQ ID NO: 213760 - DNA, 22 bp, Artificial Sequence
  Synthetic oligonucleotide; TTG chr2 60533562 60533583 60533567 60533562 -
ctatttgaaaatggtcaaaaaa

SEQ ID NO: 213761 - DNA, 22 bp, Artificial Sequence
  Synthetic oligonucleotide; CTA chr2 60533559 60533580 60533564 60533559 -
tttgaaaatggtcaaaaaaaat

SEQ ID NO: 213762 - DNA, 22 bp, Artificial Sequence
  Synthetic oligonucleotide; TTT chr2 60533556 60533577 60533561 60533556 -
gaaaatggtcaaaaaaaatctt

SEQ ID NO: 213763 - DNA, 22 bp, Artificial Sequence
  Synthetic oligonucleotide; TTG chr2 60533555 60533576 60533560 60533555 -
aaaatggtcaaaaaaaatcttc

SEQ ID NO: 213764 - DNA, 22 bp, Artificial Sequence
  Synthetic oligonucleotide; CTT chr2 60533534 60533555 60533539 60533534 -
catactttatgtggggctgagt

SEQ ID NO: 213765 - DNA, 22 bp, Artificial Sequence
  Synthetic oligonucleotide; TTC chr2 60533533 60533554 60533538 60533533 -
atactttatgtggggctgagtg

SEQ ID NO: 213766 - DNA, 22 bp, Artificial Sequence
  Synthetic oligonucleotide; CTT chr2 60533527 60533548 60533532 60533527 -
tatgtggggctgagtgggcagt

SEQ ID NO: 213767 - DNA, 22 bp, Artificial Sequence
  Synthetic oligonucleotide; TTT chr2 60533526 60533547 60533531 60533526 -
atgtggggctgagtgggcagtg

SEQ ID NO: 213768 - DNA, 22 bp, Artificial Sequence
  Synthetic oligonucleotide; TTA chr2 60533525 60533546 60533530 60533525 -
tgtggggctgagtgggcagtgg

SEQ ID NO: 213769 - DNA, 22 bp, Artificial Sequence
  Synthetic oligonucleotide; CTG chr2 60533515 60533536 60533520 60533515 -
agtgggcagtggagaaaggggt

SEQ ID NO: 213770 - DNA, 22 bp, Artificial Sequence
  Synthetic oligonucleotide; TTC chr2 60533489 60533510 60533494 60533489 -
agctgacccggtatttaagaaa

SEQ ID NO: 213771 - DNA, 22 bp, Artificial Sequence
  Synthetic oligonucleotide; CTG chr2 60533484 60533505 60533489 60533484 -
acccggtatttaagaaaacaaa

SEQ ID NO: 213772 - DNA, 22 bp, Artificial Sequence
  Synthetic oligonucleotide; TTT chr2 60533473 60533494 60533478 60533473 -
aagaaaacaaaacaagcaacac

SEQ ID NO: 213773 - DNA, 22 bp, Artificial Sequence
  Synthetic oligonucleotide; TTA chr2 60533472 60533493 60533477 60533472 -
agaaaacaaaacaagcaacact

SEQ ID NO: 213774 - DNA, 22 bp, Artificial Sequence
  Synthetic oligonucleotide; CTA chr2 60533449 60533470 60533454 60533449 -
acttatgcatgctgcttcagtc

SEQ ID NO: 213775 - DNA, 22 bp, Artificial Sequence
  Synthetic oligonucleotide; CTT chr2 60533445 60533466 60533450 60533445 -
atgcatgctgcttcagtcgcgt

SEQ ID NO: 213776 - DNA, 22 bp, Artificial Sequence
  Synthetic oligonucleotide; TTA chr2 60533444 60533465 60533449 60533444 -
tgcatgctgcttcagtcgcgtt

SEQ ID NO: 213777 - DNA, 22 bp, Artificial Sequence
  Synthetic oligonucleotide; CTG chr2 60533435 60533456 60533440 60533435 -
cttcagtcgcgttggctgtgga

SEQ ID NO: 213778 - DNA, 22 bp, Artificial Sequence
  Synthetic oligonucleotide; CTT chr2 60533432 60533453 60533437 60533432 -
cagtcgcgttggctgtggatag

SEQ ID NO: 213779 - DNA, 22 bp, Artificial Sequence
  Synthetic oligonucleotide; TTC chr2 60533431 60533452 60533436 60533431 -
agtcgcgttggctgtggatagg

SEQ ID NO: 213780 - DNA, 22 bp, Artificial Sequence
  Synthetic oligonucleotide; TTG chr2 60533421 60533442 60533426 60533421 -
gctgtggataggaaggtctttg

SEQ ID NO: 213781 - DNA, 22 bp, Artificial Sequence
  Synthetic oligonucleotide; CTG chr2 60533417 60533438 60533422 60533417 -
tggataggaaggtctttgtgac

SEQ ID NO: 213782 - DNA, 22 bp, Artificial Sequence
  Synthetic oligonucleotide; CTT chr2 60533401 60533422 60533406 60533401 -
tgtgacatatggaagccagtgt

SEQ ID NO: 213783 - DNA, 22 bp, Artificial Sequence
  Synthetic oligonucleotide; TTT chr2 60533400 60533421 60533405 60533400 -
gtgacatatggaagccagtgta

SEQ ID NO: 213784 - DNA, 22 bp, Artificial Sequence
  Synthetic oligonucleotide; TTG chr2 60533399 60533420 60533404 60533399 -
tgacatatggaagccagtgtat

SEQ ID NO: 213785 - DNA, 22 bp, Artificial Sequence
  Synthetic oligonucleotide; CTC chr2 60533370 60533391 60533375 60533370 -
tctccttctatcttgcatcacc

SEQ ID NO: 213786 - DNA, 22 bp, Artificial Sequence
  Synthetic oligonucleotide; CTC chr2 60533368 60533389 60533373 60533368 -
tccttctatcttgcatcacccc

SEQ ID NO: 213787 - DNA, 22 bp, Artificial Sequence
  Synthetic oligonucleotide; CTC chr2 60533366 60533387 60533371 60533366 -
cttctatcttgcatcaccccct

SEQ ID NO: 213788 - DNA, 22 bp, Artificial Sequence
  Synthetic oligonucleotide; CTT chr2 60533363 60533384 60533368 60533363 -
ctatcttgcatcacccccttca

SEQ ID NO: 213789 - DNA, 22 bp, Artificial Sequence
  Synthetic oligonucleotide; TTC chr2 60533362 60533383 60533367 60533362 -
tatcttgcatcacccccttcat

SEQ ID NO: 213790 - DNA, 22 bp, Artificial Sequence
  Synthetic oligonucleotide; CTA chr2 60533360 60533381 60533365 60533360 -
tcttgcatcacccccttcattc

SEQ ID NO: 213791 - DNA, 22 bp, Artificial Sequence
  Synthetic oligonucleotide; CTT chr2 60533356 60533377 60533361 60533356 -
gcatcacccccttcattccttc

SEQ ID NO: 213792 - DNA, 22 bp, Artificial Sequence
  Synthetic oligonucleotide; TTG chr2 60533355 60533376 60533360 60533355 -
catcacccccttcattccttct

SEQ ID NO: 213793 - DNA, 22 bp, Artificial Sequence
  Synthetic oligonucleotide; CTT chr2 60533343 60533364 60533348 60533343 -
cattccttctctctttctctcc

SEQ ID NO: 213794 - DNA, 22 bp, Artificial Sequence
  Synthetic oligonucleotide; TTC chr2 60533342 60533363 60533347 60533342 -
attccttctctctttctctcct

SEQ ID NO: 213795 - DNA, 22 bp, Artificial Sequence
  Synthetic oligonucleotide; TTC chr2 60533338 60533359 60533343 60533338 -
cttctctctttctctcctctct

SEQ ID NO: 213796 - DNA, 22 bp, Artificial Sequence
  Synthetic oligonucleotide; CTT chr2 60533335 60533356 60533340 60533335 -
ctctctttctctcctctctctc

SEQ ID NO: 213797 - DNA, 22 bp, Artificial Sequence
  Synthetic oligonucleotide; TTC chr2 60533334 60533355 60533339 60533334 -
tctctttctctcctctctctct

SEQ ID NO: 213798 - DNA, 22 bp, Artificial Sequence
  Synthetic oligonucleotide; CTC chr2 60533332 60533353 60533337 60533332 -
tctttctctcctctctctctcc

SEQ ID NO: 213799 - DNA, 22 bp, Artificial Sequence
  Synthetic oligonucleotide; CTC chr2 60533330 60533351 60533335 60533330 -
tttctctcctctctctctcccc

SEQ ID NO: 213800 - DNA, 22 bp, Artificial Sequence
  Synthetic oligonucleotide; CTT chr2 60533328 60533349 60533333 60533328 -
tctctcctctctctctccccca

SEQ ID NO: 213801 - DNA, 22 bp, Artificial Sequence
  Synthetic oligonucleotide; TTT chr2 60533327 60533348 60533332 60533327 -
ctctcctctctctctcccccaa

SEQ ID NO: 213802 - DNA, 22 bp, Artificial Sequence
  Synthetic oligonucleotide; TTC chr2 60533326 60533347 60533331 60533326 -
tctcctctctctctcccccaaa

SEQ ID NO: 213803 - DNA, 22 bp, Artificial Sequence
  Synthetic oligonucleotide; CTC chr2 60533324 60533345 60533329 60533324 -
tcctctctctctcccccaaact

SEQ ID NO: 213804 - DNA, 22 bp, Artificial Sequence
  Synthetic oligonucleotide; CTC chr2 60533322 60533343 60533327 60533322 -
ctctctctctcccccaaacttt

SEQ ID NO: 213805 - DNA, 22 bp, Artificial Sequence
  Synthetic oligonucleotide; CTC chr2 60533319 60533340 60533324 60533319 -
tctctctcccccaaactttaca

SEQ ID NO: 213806 - DNA, 22 bp, Artificial Sequence
  Synthetic oligonucleotide; CTC chr2 60533317 60533338 60533322 60533317 -
tctctcccccaaactttacaag

SEQ ID NO: 213807 - DNA, 22 bp, Artificial Sequence
  Synthetic oligonucleotide; CTC chr2 60533315 60533336 60533320 60533315 -
tctcccccaaactttacaagaa

SEQ ID NO: 213808 - DNA, 22 bp, Artificial Sequence
  Synthetic oligonucleotide; CTC chr2 60533313 60533334 60533318 60533313 -
tcccccaaactttacaagaaag

SEQ ID NO: 213809 - DNA, 22 bp, Artificial Sequence
  Synthetic oligonucleotide; CTC chr2 60533311 60533332 60533316 60533311 -
ccccaaactttacaagaaaggg

SEQ ID NO: 213810 - DNA, 22 bp, Artificial Sequence
  Synthetic oligonucleotide; CTT chr2 60533301 60533322 60533306 60533301 -
tacaagaaagggatcctaacaa

SEQ ID NO: 213811 - DNA, 22 bp, Artificial Sequence
  Synthetic oligonucleotide; TTT chr2 60533300 60533321 60533305 60533300 -
acaagaaagggatcctaacaag

SEQ ID NO: 213812 - DNA, 22 bp, Artificial Sequence
  Synthetic oligonucleotide; TTA chr2 60533299 60533320 60533304 60533299 -
caagaaagggatcctaacaagg

SEQ ID NO: 213813 - DNA, 22 bp, Artificial Sequence
  Synthetic oligonucleotide; CTA chr2 60533283 60533304 60533288 60533283 -
acaaggtaaaaagtaaacaatt

SEQ ID NO: 213814 - DNA, 22 bp, Artificial Sequence
  Synthetic oligonucleotide; TTT chr2 60533260 60533281 60533265 60533260 -
agtcatcacaagccttattatt

SEQ ID NO: 213815 - DNA, 22 bp, Artificial Sequence
  Synthetic oligonucleotide; TTA chr2 60533259 60533280 60533264 60533259 -
gtcatcacaagccttattattc

SEQ ID NO: 213816 - DNA, 22 bp, Artificial Sequence
  Synthetic oligonucleotide; CTT chr2 60533244 60533265 60533249 60533244 -
attattcagtctatccaggagt

SEQ ID NO: 213817 - DNA, 22 bp, Artificial Sequence
  Synthetic oligonucleotide; TTA chr2 60533243 60533264 60533248 60533243 -
ttattcagtctatccaggagtt

SEQ ID NO: 213818 - DNA, 22 bp, Artificial Sequence
  Synthetic oligonucleotide; TTA chr2 60533240 60533261 60533245 60533240 -
ttcagtctatccaggagttttg

SEQ ID NO: 213819 - DNA, 22 bp, Artificial Sequence
  Synthetic oligonucleotide; TTC chr2 60533237 60533258 60533242 60533237 -
agtctatccaggagttttgcca

SEQ ID NO: 213820 - DNA, 22 bp, Artificial Sequence
  Synthetic oligonucleotide; CTA chr2 60533231 60533252 60533236 60533231 -
tccaggagttttgccatgtcgg

SEQ ID NO: 213821 - DNA, 22 bp, Artificial Sequence
  Synthetic oligonucleotide; TTT chr2 60533220 60533241 60533225 60533220 -
tgccatgtcggtttatttaact

SEQ ID NO: 213822 - DNA, 22 bp, Artificial Sequence
  Synthetic oligonucleotide; TTT chr2 60533219 60533240 60533224 60533219 -
gccatgtcggtttatttaactt

SEQ ID NO: 213823 - DNA, 22 bp, Artificial Sequence
  Synthetic oligonucleotide; TTG chr2 60533218 60533239 60533223 60533218 -
ccatgtcggtttatttaacttc

SEQ ID NO: 213824 - DNA, 22 bp, Artificial Sequence
  Synthetic oligonucleotide; TTT chr2 60533206 60533227 60533211 60533206 -
atttaacttccaggaatgtaaa

SEQ ID NO: 213825 - DNA, 22 bp, Artificial Sequence
  Synthetic oligonucleotide; TTA chr2 60533205 60533226 60533210 60533205 -
tttaacttccaggaatgtaaac

SEQ ID NO: 213826 - DNA, 22 bp, Artificial Sequence
  Synthetic oligonucleotide; TTT chr2 60533202 60533223 60533207 60533202 -
aacttccaggaatgtaaacact

SEQ ID NO: 213827 - DNA, 22 bp, Artificial Sequence
  Synthetic oligonucleotide; TTA chr2 60533201 60533222 60533206 60533201 -
acttccaggaatgtaaacactg

SEQ ID NO: 213828 - DNA, 22 bp, Artificial Sequence
  Synthetic oligonucleotide; CTT chr2 60533197 60533218 60533202 60533197 -
ccaggaatgtaaacactgacac

SEQ ID NO: 213829 - DNA, 22 bp, Artificial Sequence
  Synthetic oligonucleotide; TTC chr2 60533196 60533217 60533201 60533196 -
caggaatgtaaacactgacaca

SEQ ID NO: 213830 - DNA, 22 bp, Artificial Sequence
  Synthetic oligonucleotide; CTG chr2 60533179 60533200 60533184 60533179 -
acacagccctagaagcagcaag

SEQ ID NO: 213831 - DNA, 22 bp, Artificial Sequence
  Synthetic oligonucleotide; CTA chr2 60533168 60533189 60533173 60533168 -
gaagcagcaagaaagattacag

SEQ ID NO: 213832 - DNA, 22 bp, Artificial Sequence
  Synthetic oligonucleotide; TTA chr2 60533149 60533170 60533154 60533149 -
cagtattagagttaaaaacgtg

SEQ ID NO: 213833 - DNA, 22 bp, Artificial Sequence
  Synthetic oligonucleotide; TTA chr2 60533141 60533162 60533146 60533141 -
gagttaaaaacgtgagcatgga

SEQ ID NO: 213834 - DNA, 22 bp, Artificial Sequence
  Synthetic oligonucleotide; TTA chr2 60533135 60533156 60533140 60533135 -
aaaacgtgagcatggaggagct

SEQ ID NO: 213835 - DNA, 22 bp, Artificial Sequence
  Synthetic oligonucleotide; CTG chr2 60533112 60533133 60533117 60533112 -
tgctttatactctgctataata

SEQ ID NO: 213836 - DNA, 22 bp, Artificial Sequence
  Synthetic oligonucleotide; CTT chr2 60533107 60533128 60533112 60533107 -
tatactctgctataataacact

SEQ ID NO: 213837 - DNA, 22 bp, Artificial Sequence
  Synthetic oligonucleotide; TTT chr2 60533106 60533127 60533111 60533106 -
atactctgctataataacactt

SEQ ID NO: 213838 - DNA, 22 bp, Artificial Sequence
  Synthetic oligonucleotide; TTA chr2 60533105 60533126 60533110 60533105 -
tactctgctataataacacttt

SEQ ID NO: 213839 - DNA, 22 bp, Artificial Sequence
  Synthetic oligonucleotide; CTC chr2 60533100 60533121 60533105 60533100 -
tgctataataacactttacatt

SEQ ID NO: 213840 - DNA, 22 bp, Artificial Sequence
  Synthetic oligonucleotide; CTG chr2 60533098 60533119 60533103 60533098 -
ctataataacactttacattga

SEQ ID NO: 213841 - DNA, 22 bp, Artificial Sequence
  Synthetic oligonucleotide; CTA chr2 60533095 60533116 60533100 60533095 -
taataacactttacattgaaac

SEQ ID NO: 213842 - DNA, 22 bp, Artificial Sequence
  Synthetic oligonucleotide; CTT chr2 60533084 60533105 60533089 60533084 -
tacattgaaacataatggtaag

SEQ ID NO: 213843 - DNA, 22 bp, Artificial Sequence
  Synthetic oligonucleotide; TTT chr2 60533083 60533104 60533088 60533083 -
acattgaaacataatggtaagt

SEQ ID NO: 213844 - DNA, 22 bp, Artificial Sequence
  Synthetic oligonucleotide; TTA chr2 60533082 60533103 60533087 60533082 -
cattgaaacataatggtaagtc

SEQ ID NO: 213845 - DNA, 22 bp, Artificial Sequence
  Synthetic oligonucleotide; TTG chr2 60533077 60533098 60533082 60533077 -
aaacataatggtaagtcaaaag

SEQ ID NO: 213846 - DNA, 22 bp, Artificial Sequence
  Synthetic oligonucleotide; CTG chr2 60533049 60533070 60533054 60533049 -
gaaacttctgcttatatggagt

SEQ ID NO: 213847 - DNA, 22 bp, Artificial Sequence
  Synthetic oligonucleotide; CTT chr2 60533042 60533063 60533047 60533042 -
ctgcttatatggagtacaaatt

SEQ ID NO: 213848 - DNA, 22 bp, Artificial Sequence
  Synthetic oligonucleotide; TTC chr2 60533041 60533062 60533046 60533041 -
tgcttatatggagtacaaattt

SEQ ID NO: 213849 - DNA, 22 bp, Artificial Sequence
  Synthetic oligonucleotide; CTG chr2 60533039 60533060 60533044 60533039 -
cttatatggagtacaaatttca

SEQ ID NO: 213850 - DNA, 22 bp, Artificial Sequence
  Synthetic oligonucleotide; CTT chr2 60533036 60533057 60533041 60533036 -
atatggagtacaaatttcattc

SEQ ID NO: 213851 - DNA, 22 bp, Artificial Sequence
  Synthetic oligonucleotide; TTA chr2 60533035 60533056 60533040 60533035 -
tatggagtacaaatttcattct

SEQ ID NO: 213852 - DNA, 22 bp, Artificial Sequence
  Synthetic oligonucleotide; TTT chr2 60533019 60533040 60533024 60533019 -
cattctaatagattggcataat

SEQ ID NO: 213853 - DNA, 22 bp, Artificial Sequence
  Synthetic oligonucleotide; TTC chr2 60533018 60533039 60533023 60533018 -
attctaatagattggcataatc

SEQ ID NO: 213854 - DNA, 22 bp, Artificial Sequence
  Synthetic oligonucleotide; TTC chr2 60533014 60533035 60533019 60533014 -
taatagattggcataatctagt

SEQ ID NO: 213855 - DNA, 22 bp, Artificial Sequence
  Synthetic oligonucleotide; CTA chr2 60533012 60533033 60533017 60533012 -
atagattggcataatctagtgt

SEQ ID NO: 213856 - DNA, 22 bp, Artificial Sequence
  Synthetic oligonucleotide; TTG chr2 60533004 60533025 60533009 60533004 -
gcataatctagtgtacccaggg

SEQ ID NO: 213857 - DNA, 22 bp, Artificial Sequence
  Synthetic oligonucleotide; CTA chr2 60532994 60533015 60532999 60532994 -
gtgtacccagggtagattgtta

SEQ ID NO: 213858 - DNA, 22 bp, Artificial Sequence
  Synthetic oligonucleotide; TTG chr2 60532975 60532996 60532980 60532975 -
ttatataatggagaaactgtat

SEQ ID NO: 213859 - DNA, 22 bp, Artificial Sequence
  Synthetic oligonucleotide; TTA chr2 60532972 60532993 60532977 60532972 -
tataatggagaaactgtataaa

SEQ ID NO: 213860 - DNA, 22 bp, Artificial Sequence
  Synthetic oligonucleotide; CTG chr2 60532956 60532977 60532961 60532956 -
tataaatgtcaagtacacaaat

SEQ ID NO: 213861 - DNA, 22 bp, Artificial Sequence
  Synthetic oligonucleotide; TTC chr2 60532929 60532950 60532934 60532929 -
tacaggaagtaaataaaaagta

SEQ ID NO: 213862 - DNA, 22 bp, Artificial Sequence
  Synthetic oligonucleotide; CTA chr2 60532927 60532948 60532932 60532927 -
caggaagtaaataaaaagtatt

SEQ ID NO: 213863 - DNA, 22 bp, Artificial Sequence
  Synthetic oligonucleotide; TTA chr2 60532904 60532925 60532909 60532904 -
gaatttcttaagtcaccattaa

SEQ ID NO: 213864 - DNA, 22 bp, Artificial Sequence
  Synthetic oligonucleotide; TTT chr2 60532898 60532919 60532903 60532898 -
cttaagtcaccattaaattttg

SEQ ID NO: 213865 - DNA, 22 bp, Artificial Sequence
  Synthetic oligonucleotide; TTC chr2 60532897 60532918 60532902 60532897 -
ttaagtcaccattaaattttgg

SEQ ID NO: 213866 - DNA, 22 bp, Artificial Sequence
  Synthetic oligonucleotide; CTT chr2 60532895 60532916 60532900 60532895 -
aagtcaccattaaattttggtg

SEQ ID NO: 213867 - DNA, 22 bp, Artificial Sequence
  Synthetic oligonucleotide; TTA chr2 60532894 60532915 60532899 60532894 -
agtcaccattaaattttggtgg

SEQ ID NO: 213868 - DNA, 22 bp, Artificial Sequence
  Synthetic oligonucleotide; TTA chr2 60532883 60532904 60532888 60532883 -
aattttggtggtgggacaatct

SEQ ID NO: 213869 - DNA, 22 bp, Artificial Sequence
  Synthetic oligonucleotide; TTT chr2 60532878 60532899 60532883 60532878 -
tggtggtgggacaatctcatta

SEQ ID NO: 213870 - DNA, 22 bp, Artificial Sequence
  Synthetic oligonucleotide; TTT chr2 60532877 60532898 60532882 60532877 -
ggtggtgggacaatctcattag

SEQ ID NO: 213871 - DNA, 22 bp, Artificial Sequence
  Synthetic oligonucleotide; TTG chr2 60532876 60532897 60532881 60532876 -
gtggtgggacaatctcattagc

SEQ ID NO: 213872 - DNA, 22 bp, Artificial Sequence
  Synthetic oligonucleotide; CTC chr2 60532860 60532881 60532865 60532860 -
attagctccttcaaaatcatgt

SEQ ID NO: 213873 - DNA, 22 bp, Artificial Sequence
  Synthetic oligonucleotide; TTA chr2 60532856 60532877 60532861 60532856 -
gctccttcaaaatcatgtggct

SEQ ID NO: 213874 - DNA, 22 bp, Artificial Sequence
  Synthetic oligonucleotide; CTC chr2 60532852 60532873 60532857 60532852 -
cttcaaaatcatgtggctttgc

SEQ ID NO: 213875 - DNA, 22 bp, Artificial Sequence
  Synthetic oligonucleotide; CTT chr2 60532849 60532870 60532854 60532849 -
caaaatcatgtggctttgcata

SEQ ID NO: 213876 - DNA, 22 bp, Artificial Sequence
  Synthetic oligonucleotide; TTC chr2 60532848 60532869 60532853 60532848 -
aaaatcatgtggctttgcataa

SEQ ID NO: 213877 - DNA, 22 bp, Artificial Sequence
  Synthetic oligonucleotide; CTT chr2 60532833 60532854 60532838 60532833 -
tgcataagtcttttgaaaatgt

SEQ ID NO: 213878 - DNA, 22 bp, Artificial Sequence
  Synthetic oligonucleotide; TTT chr2 60532832 60532853 60532837 60532832 -
gcataagtcttttgaaaatgta

SEQ ID NO: 213879 - DNA, 22 bp, Artificial Sequence
  Synthetic oligonucleotide; TTG chr2 60532831 60532852 60532836 60532831 -
cataagtcttttgaaaatgtat

SEQ ID NO: 213880 - DNA, 22 bp, Artificial Sequence
  Synthetic oligonucleotide; CTT chr2 60532821 60532842 60532826 60532821 -
ttgaaaatgtattttcagggaa

SEQ ID NO: 213881 - DNA, 22 bp, Artificial Sequence
  Synthetic oligonucleotide; TTT chr2 60532820 60532841 60532825 60532820 -
tgaaaatgtattttcagggaat

SEQ ID NO: 213882 - DNA, 22 bp, Artificial Sequence
  Synthetic oligonucleotide; TTT chr2 60532819 60532840 60532824 60532819 -
gaaaatgtattttcagggaatt

SEQ ID NO: 213883 - DNA, 22 bp, Artificial Sequence
  Synthetic oligonucleotide; TTG chr2 60532818 60532839 60532823 60532818 -
aaaatgtattttcagggaattt

SEQ ID NO: 213884 - DNA, 22 bp, Artificial Sequence
  Synthetic oligonucleotide; TTT chr2 60532807 60532828 60532812 60532807 -
tcagggaatttacagatggtga

SEQ ID NO: 213885 - DNA, 22 bp, Artificial Sequence
  Synthetic oligonucleotide; TTT chr2 60532806 60532827 60532811 60532806 -
cagggaatttacagatggtgaa

SEQ ID NO: 213886 - DNA, 22 bp, Artificial Sequence
  Synthetic oligonucleotide; TTC chr2 60532805 60532826 60532810 60532805 -
agggaatttacagatggtgaaa

SEQ ID NO: 213887 - DNA, 22 bp, Artificial Sequence
  Synthetic oligonucleotide; TTT chr2 60532796 60532817 60532801 60532796 -
acagatggtgaaacattgtttt

SEQ ID NO: 213888 - DNA, 22 bp, Artificial Sequence
  Synthetic oligonucleotide; TTA chr2 60532795 60532816 60532800 60532795 -
cagatggtgaaacattgtttta

SEQ ID NO: 213889 - DNA, 22 bp, Artificial Sequence
  Synthetic oligonucleotide; TTG chr2 60532778 60532799 60532783 60532778 -
ttttaatccaaaccagttaatg

SEQ ID NO: 213890 - DNA, 22 bp, Artificial Sequence
  Synthetic oligonucleotide; TTT chr2 60532775 60532796 60532780 60532775 -
taatccaaaccagttaatgctt

SEQ ID NO: 213891 - DNA, 22 bp, Artificial Sequence
  Synthetic oligonucleotide; TTT chr2 60532774 60532795 60532779 60532774 -
aatccaaaccagttaatgcttt

SEQ ID NO: 213892 - DNA, 22 bp, Artificial Sequence
  Synthetic oligonucleotide; TTA chr2 60532773 60532794 60532778 60532773 -
atccaaaccagttaatgcttta

SEQ ID NO: 213893 - DNA, 22 bp, Artificial Sequence
  Synthetic oligonucleotide; TTA chr2 60532759 60532780 60532764 60532759 -
atgctttaaatctacctttaaa

SEQ ID NO: 213894 - DNA, 22 bp, Artificial Sequence
  Synthetic oligonucleotide; CTT chr2 60532753 60532774 60532758 60532753 -
taaatctacctttaaaaaaatt

SEQ ID NO: 213895 - DNA, 22 bp, Artificial Sequence
  Synthetic oligonucleotide; TTT chr2 60532752 60532773 60532757 60532752 -
aaatctacctttaaaaaaattg

SEQ ID NO: 213896 - DNA, 22 bp, Artificial Sequence
  Synthetic oligonucleotide; TTA chr2 60532751 60532772 60532756 60532751 -
aatctacctttaaaaaaattgt

SEQ ID NO: 213897 - DNA, 22 bp, Artificial Sequence
  Synthetic oligonucleotide; CTA chr2 60532745 60532766 60532750 60532745 -
cctttaaaaaaattgtactgtt

SEQ ID NO: 213898 - DNA, 22 bp, Artificial Sequence
  Synthetic oligonucleotide; CTT chr2 60532741 60532762 60532746 60532741 -
taaaaaaattgtactgtttttc

SEQ ID NO: 213899 - DNA, 22 bp, Artificial Sequence
  Synthetic oligonucleotide; TTT chr2 60532740 60532761 60532745 60532740 -
aaaaaaattgtactgtttttcg

SEQ ID NO: 213900 - DNA, 22 bp, Artificial Sequence
  Synthetic oligonucleotide; TTA chr2 60532739 60532760 60532744 60532739 -
aaaaaattgtactgtttttcga

SEQ ID NO: 213901 - DNA, 22 bp, Artificial Sequence
  Synthetic oligonucleotide; TTG chr2 60532730 60532751 60532735 60532730 -
tactgtttttcgaagtacttaa

SEQ ID NO: 213902 - DNA, 22 bp, Artificial Sequence
  Synthetic oligonucleotide; CTG chr2 60532725 60532746 60532730 60532725 -
tttttcgaagtacttaaaggga

SEQ ID NO: 213903 - DNA, 22 bp, Artificial Sequence
  Synthetic oligonucleotide; TTT chr2 60532722 60532743 60532727 60532722 -
ttcgaagtacttaaagggagtg

SEQ ID NO: 213904 - DNA, 22 bp, Artificial Sequence
  Synthetic oligonucleotide; TTT chr2 60532721 60532742 60532726 60532721 -
tcgaagtacttaaagggagtgg

SEQ ID NO: 213905 - DNA, 22 bp, Artificial Sequence
  Synthetic oligonucleotide; TTT chr2 60532720 60532741 60532725 60532720 -
cgaagtacttaaagggagtgga

SEQ ID NO: 213906 - DNA, 22 bp, Artificial Sequence
  Synthetic oligonucleotide; TTC chr2 60532719 60532740 60532724 60532719 -
gaagtacttaaagggagtggag

SEQ ID NO: 213907 - DNA, 22 bp, Artificial Sequence
  Synthetic oligonucleotide; CTT chr2 60532710 60532731 60532715 60532710 -
aaagggagtggaggggtagaaa

SEQ ID NO: 213908 - DNA, 22 bp, Artificial Sequence
  Synthetic oligonucleotide; TTA chr2 60532709 60532730 60532714 60532709 -
aagggagtggaggggtagaaag

SEQ ID NO: 213909 - DNA, 22 bp, Artificial Sequence
  Synthetic oligonucleotide; CTC chr2 60532667 60532688 60532672 60532667 -
actgtggcaaactgtttttcaa

SEQ ID NO: 213910 - DNA, 22 bp, Artificial Sequence
  Synthetic oligonucleotide; CTG chr2 60532663 60532684 60532668 60532663 -
tggcaaactgtttttcaagtaa

SEQ ID NO: 213911 - DNA, 22 bp, Artificial Sequence
  Synthetic oligonucleotide; CTG chr2 60532653 60532674 60532658 60532653 -
tttttcaagtaaagtcataata

SEQ ID NO: 213912 - DNA, 22 bp, Artificial Sequence
  Synthetic oligonucleotide; TTT chr2 60532650 60532671 60532655 60532650 -
ttcaagtaaagtcataataatg

SEQ ID NO: 213913 - DNA, 22 bp, Artificial Sequence
  Synthetic oligonucleotide; TTT chr2 60532649 60532670 60532654 60532649 -
tcaagtaaagtcataataatga

SEQ ID NO: 213914 - DNA, 22 bp, Artificial Sequence
  Synthetic oligonucleotide; TTT chr2 60532648 60532669 60532653 60532648 -
caagtaaagtcataataatgaa

SEQ ID NO: 213915 - DNA, 22 bp, Artificial Sequence
  Synthetic oligonucleotide; TTC chr2 60532647 60532668 60532652 60532647 -
aagtaaagtcataataatgaac

SEQ ID NO: 213916 - DNA, 22 bp, Artificial Sequence
  Synthetic oligonucleotide; CTG chr2 60532612 60532633 60532617 60532612 -
aaatttgatcagcaaacatatc

SEQ ID NO: 213917 - DNA, 22 bp, Artificial Sequence
  Synthetic oligonucleotide; TTT chr2 60532606 60532627 60532611 60532606 -
gatcagcaaacatatccttatg

SEQ ID NO: 213918 - DNA, 22 bp, Artificial Sequence
  Synthetic oligonucleotide; TTG chr2 60532605 60532626 60532610 60532605 -
atcagcaaacatatccttatgc

SEQ ID NO: 213919 - DNA, 22 bp, Artificial Sequence
  Synthetic oligonucleotide; CTT chr2 60532587 60532608 60532592 60532587 -
atgccaaggaattttctttttt

SEQ ID NO: 213920 - DNA, 22 bp, Artificial Sequence
  Synthetic oligonucleotide; TTA chr2 60532586 60532607 60532591 60532586 -
tgccaaggaattttcttttttt

SEQ ID NO: 213921 - DNA, 22 bp, Artificial Sequence
  Synthetic oligonucleotide; TTT chr2 60532573 60532594 60532578 60532573 -
tctttttttctttccttttttt

SEQ ID NO: 213922 - DNA, 22 bp, Artificial Sequence
  Synthetic oligonucleotide; TTT chr2 60532572 60532593 60532577 60532572 -
ctttttttctttcctttttttt

SEQ ID NO: 213923 - DNA, 22 bp, Artificial Sequence
  Synthetic oligonucleotide; TTC chr2 60532571 60532592 60532576 60532571 -
tttttttctttccttttttttc

SEQ ID NO: 213924 - DNA, 22 bp, Artificial Sequence
  Synthetic oligonucleotide; CTT chr2 60532569 60532590 60532574 60532569 -
tttttctttccttttttttctt

SEQ ID NO: 213925 - DNA, 22 bp, Artificial Sequence
  Synthetic oligonucleotide; TTT chr2 60532568 60532589 60532573 60532568 -
ttttctttccttttttttcttt

SEQ ID NO: 213926 - DNA, 22 bp, Artificial Sequence
  Synthetic oligonucleotide; TTT chr2 60532567 60532588 60532572 60532567 -
tttctttccttttttttctttt

SEQ ID NO: 213927 - DNA, 22 bp, Artificial Sequence
  Synthetic oligonucleotide; TTT chr2 60532566 60532587 60532571 60532566 -
ttctttccttttttttcttttt

SEQ ID NO: 213928 - DNA, 22 bp, Artificial Sequence
  Synthetic oligonucleotide; TTT chr2 60532565 60532586 60532570 60532565 -
tctttccttttttttctttttc

SEQ ID NO: 213929 - DNA, 22 bp, Artificial Sequence
  Synthetic oligonucleotide; TTT chr2 60532564 60532585 60532569 60532564 -
ctttccttttttttctttttcg

SEQ ID NO: 213930 - DNA, 22 bp, Artificial Sequence
  Synthetic oligonucleotide; TTC chr2 60532563 60532584 60532568 60532563 -
tttccttttttttctttttcgc

SEQ ID NO: 213931 - DNA, 22 bp, Artificial Sequence
  Synthetic oligonucleotide; CTT chr2 60532561 60532582 60532566 60532561 -
tccttttttttctttttcgcca

SEQ ID NO: 213932 - DNA, 22 bp, Artificial Sequence
  Synthetic oligonucleotide; TTT chr2 60532560 60532581 60532565 60532560 -
ccttttttttctttttcgccat

SEQ ID NO: 213933 - DNA, 22 bp, Artificial Sequence
  Synthetic oligonucleotide; TTC chr2 60532559 60532580 60532564 60532559 -
cttttttttctttttcgccatt

SEQ ID NO: 213934 - DNA, 22 bp, Artificial Sequence
  Synthetic oligonucleotide; CTT chr2 60532556 60532577 60532561 60532556 -
ttttttctttttcgccattcac

SEQ ID NO: 213935 - DNA, 22 bp, Artificial Sequence
  Synthetic oligonucleotide; TTT chr2 60532555 60532576 60532560 60532555 -
tttttctttttcgccattcaca

SEQ ID NO: 213936 - DNA, 22 bp, Artificial Sequence
  Synthetic oligonucleotide; TTT chr2 60532554 60532575 60532559 60532554 -
ttttctttttcgccattcacat

SEQ ID NO: 213937 - DNA, 22 bp, Artificial Sequence
  Synthetic oligonucleotide; TTT chr2 60532553 60532574 60532558 60532553 -
tttctttttcgccattcacata

SEQ ID NO: 213938 - DNA, 22 bp, Artificial Sequence
  Synthetic oligonucleotide; TTT chr2 60532552 60532573 60532557 60532552 -
ttctttttcgccattcacatac

SEQ ID NO: 213939 - DNA, 22 bp, Artificial Sequence
  Synthetic oligonucleotide; TTT chr2 60532551 60532572 60532556 60532551 -
tctttttcgccattcacatacc

SEQ ID NO: 213940 - DNA, 22 bp, Artificial Sequence
  Synthetic oligonucleotide; TTT chr2 60532550 60532571 60532555 60532550 -
ctttttcgccattcacatacca

SEQ ID NO: 213941 - DNA, 22 bp, Artificial Sequence
  Synthetic oligonucleotide; TTC chr2 60532549 60532570 60532554 60532549 -
tttttcgccattcacataccaa

SEQ ID NO: 213942 - DNA, 22 bp, Artificial Sequence
  Synthetic oligonucleotide; CTT chr2 60532547 60532568 60532552 60532547 -
tttcgccattcacataccaagg

SEQ ID NO: 213943 - DNA, 22 bp, Artificial Sequence
  Synthetic oligonucleotide; TTT chr2 60532546 60532567 60532551 60532546 -
ttcgccattcacataccaaggt

SEQ ID NO: 213944 - DNA, 22 bp, Artificial Sequence
  Synthetic oligonucleotide; TTT chr2 60532545 60532566 60532550 60532545 -
tcgccattcacataccaaggtt

SEQ ID NO: 213945 - DNA, 22 bp, Artificial Sequence
  Synthetic oligonucleotide; TTT chr2 60532544 60532565 60532549 60532544 -
cgccattcacataccaaggttc

SEQ ID NO: 213946 - DNA, 22 bp, Artificial Sequence
  Synthetic oligonucleotide; TTC chr2 60532543 60532564 60532548 60532543 -
gccattcacataccaaggttct

SEQ ID NO: 213947 - DNA, 22 bp, Artificial Sequence
  Synthetic oligonucleotide; TTC chr2 60532536 60532557 60532541 60532536 -
acataccaaggttctgtaaatc

SEQ ID NO: 213948 - DNA, 22 bp, Artificial Sequence
  Synthetic oligonucleotide; TTC chr2 60532522 60532543 60532527 60532522 -
tgtaaatcagtaaaccaggcag

SEQ ID NO: 213949 - DNA, 22 bp, Artificial Sequence
  Synthetic oligonucleotide; CTG chr2 60532520 60532541 60532525 60532520 -
taaatcagtaaaccaggcagag

SEQ ID NO: 213950 - DNA, 22 bp, Artificial Sequence
  Synthetic oligonucleotide; CTA chr2 60532490 60532511 60532495 60532490 -
ttgtaagggggaaaccaaatca

SEQ ID NO: 213951 - DNA, 22 bp, Artificial Sequence
  Synthetic oligonucleotide; TTG chr2 60532487 60532508 60532492 60532487 -
taagggggaaaccaaatcataa

SEQ ID NO: 213952 - DNA, 22 bp, Artificial Sequence
  Synthetic oligonucleotide; CTG chr2 60532442 60532463 60532447 60532442 -
tctttctgaagaaacattaacg

SEQ ID NO: 213953 - DNA, 22 bp, Artificial Sequence
  Synthetic oligonucleotide; CTT chr2 60532438 60532459 60532443 60532438 -
tctgaagaaacattaacgccac

SEQ ID NO: 213954 - DNA, 22 bp, Artificial Sequence
  Synthetic oligonucleotide; TTT chr2 60532437 60532458 60532442 60532437 -
ctgaagaaacattaacgccacc

SEQ ID NO: 213955 - DNA, 22 bp, Artificial Sequence
  Synthetic oligonucleotide; TTC chr2 60532436 60532457 60532441 60532436 -
tgaagaaacattaacgccacca

SEQ ID NO: 213956 - DNA, 22 bp, Artificial Sequence
  Synthetic oligonucleotide; CTG chr2 60532434 60532455 60532439 60532434 -
aagaaacattaacgccaccacc

SEQ ID NO: 213957 - DNA, 22 bp, Artificial Sequence
  Synthetic oligonucleotide; TTA chr2 60532423 60532444 60532428 60532423 -
acgccaccaccaccaaaaaaag

SEQ ID NO: 213958 - DNA, 22 bp, Artificial Sequence
  Synthetic oligonucleotide; CTT chr2 60532357 60532378 60532362 60532357 -
tttaaaaaactggaaatgacag

SEQ ID NO: 213959 - DNA, 22 bp, Artificial Sequence
  Synthetic oligonucleotide; TTT chr2 60532356 60532377 60532361 60532356 -
ttaaaaaactggaaatgacaga

SEQ ID NO: 213960 - DNA, 22 bp, Artificial Sequence
  Synthetic oligonucleotide; TTT chr2 60532355 60532376 60532360 60532355 -
taaaaaactggaaatgacagaa

SEQ ID NO: 213961 - DNA, 22 bp, Artificial Sequence
  Synthetic oligonucleotide; TTT chr2 60532354 60532375 60532359 60532354 -
aaaaaactggaaatgacagaat

SEQ ID NO: 213962 - DNA, 22 bp, Artificial Sequence
  Synthetic oligonucleotide; TTA chr2 60532353 60532374 60532358 60532353 -
aaaaactggaaatgacagaata

SEQ ID NO: 213963 - DNA, 22 bp, Artificial Sequence
  Synthetic oligonucleotide; CTG chr2 60532345 60532366 60532350 60532345 -
gaaatgacagaatagttttaaa

SEQ ID NO: 213964 - DNA, 22 bp, Artificial Sequence
  Synthetic oligonucleotide; TTT chr2 60532327 60532348 60532332 60532327 -
taaaaggaaaaaaaaaaaaacc

SEQ ID NO: 213965 - DNA, 22 bp, Artificial Sequence
  Synthetic oligonucleotide; TTT chr2 60532326 60532347 60532331 60532326 -
aaaaggaaaaaaaaaaaaaccc

SEQ ID NO: 213966 - DNA, 22 bp, Artificial Sequence
  Synthetic oligonucleotide; TTA chr2 60532325 60532346 60532330 60532325 -
aaaggaaaaaaaaaaaaaccca

SEQ ID NO: 213967 - DNA, 22 bp, Artificial Sequence
  Synthetic oligonucleotide; CTT chr2 60532278 60532299 60532283 60532278 -
ctgacgctcaaaacttcaaact

SEQ ID NO: 213968 - DNA, 22 bp, Artificial Sequence
  Synthetic oligonucleotide; TTC chr2 60532277 60532298 60532282 60532277 -
tgacgctcaaaacttcaaacta

SEQ ID NO: 213969 - DNA, 22 bp, Artificial Sequence
  Synthetic oligonucleotide; CTG chr2 60532275 60532296 60532280 60532275 -
acgctcaaaacttcaaactatt

SEQ ID NO: 213970 - DNA, 22 bp, Artificial Sequence
  Synthetic oligonucleotide; CTC chr2 60532269 60532290 60532274 60532269 -
aaaacttcaaactattaataga

SEQ ID NO: 213971 - DNA, 22 bp, Artificial Sequence
  Synthetic oligonucleotide; CTT chr2 60532262 60532283 60532267 60532262 -
caaactattaatagaccaccag

SEQ ID NO: 213972 - DNA, 22 bp, Artificial Sequence
  Synthetic oligonucleotide; TTC chr2 60532261 60532282 60532266 60532261 -
aaactattaatagaccaccagt

SEQ ID NO: 213973 - DNA, 22 bp, Artificial Sequence
  Synthetic oligonucleotide; CTA chr2 60532255 60532276 60532260 60532255 -
ttaatagaccaccagtgagata

SEQ ID NO: 213974 - DNA, 22 bp, Artificial Sequence
  Synthetic oligonucleotide; TTA chr2 60532252 60532273 60532257 60532252 -
atagaccaccagtgagatagac

SEQ ID NO: 213975 - DNA, 22 bp, Artificial Sequence
  Synthetic oligonucleotide; CTG chr2 60532228 60532249 60532233 60532228 -
tctttgtgccttgaaatgcaaa

SEQ ID NO: 213976 - DNA, 22 bp, Artificial Sequence
  Synthetic oligonucleotide; CTT chr2 60532224 60532245 60532229 60532224 -
tgtgccttgaaatgcaaaatga

SEQ ID NO: 213977 - DNA, 22 bp, Artificial Sequence
  Synthetic oligonucleotide; TTT chr2 60532223 60532244 60532228 60532223 -
gtgccttgaaatgcaaaatgag

SEQ ID NO: 213978 - DNA, 22 bp, Artificial Sequence
  Synthetic oligonucleotide; TTG chr2 60532222 60532243 60532227 60532222 -
tgccttgaaatgcaaaatgagg

SEQ ID NO: 213979 - DNA, 22 bp, Artificial Sequence
  Synthetic oligonucleotide; CTT chr2 60532216 60532237 60532221 60532216 -
gaaatgcaaaatgagggaaata

SEQ ID NO: 213980 - DNA, 22 bp, Artificial Sequence
  Synthetic oligonucleotide; TTG chr2 60532215 60532236 60532220 60532215 -
aaatgcaaaatgagggaaataa

SEQ ID NO: 213981 - DNA, 22 bp, Artificial Sequence
  Synthetic oligonucleotide; TTA chr2 60532190 60532211 60532195 60532190 -
gcagaggaacaaaattctcaaa

SEQ ID NO: 213982 - DNA, 22 bp, Artificial Sequence
  Synthetic oligonucleotide; TTC chr2 60532173 60532194 60532178 60532173 -
tcaaaatttgaagaacttctgt

SEQ ID NO: 213983 - DNA, 22 bp, Artificial Sequence
  Synthetic oligonucleotide; CTC chr2 60532171 60532192 60532176 60532171 -
aaaatttgaagaacttctgtga

SEQ ID NO: 213984 - DNA, 22 bp, Artificial Sequence
  Synthetic oligonucleotide; TTT chr2 60532164 60532185 60532169 60532164 -
gaagaacttctgtgattactgg

SEQ ID NO: 213985 - DNA, 22 bp, Artificial Sequence
  Synthetic oligonucleotide; TTG chr2 60532163 60532184 60532168 60532163 -
aagaacttctgtgattactggg

SEQ ID NO: 213986 - DNA, 22 bp, Artificial Sequence
  Synthetic oligonucleotide; CTT chr2 60532155 60532176 60532160 60532155 -
ctgtgattactgggggtacagt

SEQ ID NO: 213987 - DNA, 22 bp, Artificial Sequence
  Synthetic oligonucleotide; TTC chr2 60532154 60532175 60532159 60532154 -
tgtgattactgggggtacagtg

SEQ ID NO: 213988 - DNA, 22 bp, Artificial Sequence
  Synthetic oligonucleotide; CTG chr2 60532152 60532173 60532157 60532152 -
tgattactgggggtacagtgaa

SEQ ID NO: 213989 - DNA, 22 bp, Artificial Sequence
  Synthetic oligonucleotide; TTA chr2 60532146 60532167 60532151 60532146 -
ctgggggtacagtgaaaagaaa

SEQ ID NO: 213990 - DNA, 22 bp, Artificial Sequence
  Synthetic oligonucleotide; CTG chr2 60532143 60532164 60532148 60532143 -
ggggtacagtgaaaagaaaatg

SEQ ID NO: 213991 - DNA, 22 bp, Artificial Sequence
  Synthetic oligonucleotide; TTT chr2 60532114 60532135 60532119 60532114 -
cttcctgatcttaattagattc

SEQ ID NO: 213992 - DNA, 22 bp, Artificial Sequence
  Synthetic oligonucleotide; TTC chr2 60532113 60532134 60532118 60532113 -
ttcctgatcttaattagattcg

SEQ ID NO: 213993 - DNA, 22 bp, Artificial Sequence
  Synthetic oligonucleotide; CTT chr2 60532111 60532132 60532116 60532111 -
cctgatcttaattagattcgat

SEQ ID NO: 213994 - DNA, 22 bp, Artificial Sequence
  Synthetic oligonucleotide; TTC chr2 60532110 60532131 60532115 60532110 -
ctgatcttaattagattcgatt

SEQ ID NO: 213995 - DNA, 22 bp, Artificial Sequence
  Synthetic oligonucleotide; CTG chr2 60532107 60532128 60532112 60532107 -
atcttaattagattcgattgtg

SEQ ID NO: 213996 - DNA, 22 bp, Artificial Sequence
  Synthetic oligonucleotide; CTT chr2 60532102 60532123 60532107 60532102 -
aattagattcgattgtgcggtg

SEQ ID NO: 213997 - DNA, 22 bp, Artificial Sequence
  Synthetic oligonucleotide; TTA chr2 60532101 60532122 60532106 60532101 -
attagattcgattgtgcggtgg

SEQ ID NO: 213998 - DNA, 22 bp, Artificial Sequence
  Synthetic oligonucleotide; TTA chr2 60532097 60532118 60532102 60532097 -
gattcgattgtgcggtgggtgt

SEQ ID NO: 213999 - DNA, 22 bp, Artificial Sequence
  Synthetic oligonucleotide; TTC chr2 60532092 60532113 60532097 60532092 -
gattgtgcggtgggtgtgttgg

SEQ ID NO: 214000 - DNA, 22 bp, Artificial Sequence
  Synthetic oligonucleotide; TTG chr2 60532087 60532108 60532092 60532087 -
tgcggtgggtgtgttggatttg

SEQ ID NO: 214001 - DNA, 22 bp, Artificial Sequence
  Synthetic oligonucleotide; TTG chr2 60532071 60532092 60532076 60532071 -
gatttggggggaggggcagagg

SEQ ID NO: 214002 - DNA, 22 bp, Artificial Sequence
  Synthetic oligonucleotide; TTT chr2 60532066 60532087 60532071 60532066 -
ggggggaggggcagaggcaggg

SEQ ID NO: 214003 - DNA, 22 bp, Artificial Sequence
  Synthetic oligonucleotide; TTG chr2 60532065 60532086 60532070 60532065 -
gggggaggggcagaggcaggga

SEQ ID NO: 214004 - DNA, 22 bp, Artificial Sequence
  Synthetic oligonucleotide; CTG chr2 60532037 60532058 60532042 60532037 -
gggtgaggcgtgaggctgagtg

SEQ ID NO: 214005 - DNA, 22 bp, Artificial Sequence
  Synthetic oligonucleotide; CTG chr2 60532019 60532040 60532024 60532019 -
agtgttgtggagacaggttagc

SEQ ID NO: 214006 - DNA, 22 bp, Artificial Sequence
  Synthetic oligonucleotide; TTG chr2 60532012 60532033 60532017 60532012 -
tggagacaggttagcaggggcc

SEQ ID NO: 214007 - DNA, 22 bp, Artificial Sequence
  Synthetic oligonucleotide; TTA chr2 60531999 60532020 60532004 60531999 -
gcaggggcccggcggtgtggca

SEQ ID NO: 214008 - DNA, 22 bp, Artificial Sequence
  Synthetic oligonucleotide; CTT chr2 60531961 60531982 60531966 60531961 -
ccaacgctggtgcaggattccg

SEQ ID NO: 214009 - DNA, 22 bp, Artificial Sequence
  Synthetic oligonucleotide; TTC chr2 60531960 60531981 60531965 60531960 -
caacgctggtgcaggattccga

SEQ ID NO: 214010 - DNA, 22 bp, Artificial Sequence
  Synthetic oligonucleotide; CTG chr2 60531952 60531973 60531957 60531952 -
gtgcaggattccgagccttaac

SEQ ID NO: 214011 - DNA, 22 bp, Artificial Sequence
  Synthetic oligonucleotide; TTC chr2 60531941 60531962 60531946 60531941 -
cgagccttaacccagatgctca

SEQ ID NO: 214012 - DNA, 22 bp, Artificial Sequence
  Synthetic oligonucleotide; CTT chr2 60531933 60531954 60531938 60531933 -
aacccagatgctcatggtgccc

SEQ ID NO: 214013 - DNA, 22 bp, Artificial Sequence
  Synthetic oligonucleotide; TTA chr2 60531932 60531953 60531937 60531932 -
acccagatgctcatggtgccct

SEQ ID NO: 214014 - DNA, 22 bp, Artificial Sequence
  Synthetic oligonucleotide; CTC chr2 60531920 60531941 60531925 60531920 -
atggtgccctagtcttgagttc

SEQ ID NO: 214015 - DNA, 22 bp, Artificial Sequence
  Synthetic oligonucleotide; CTA chr2 60531909 60531930 60531914 60531909 -
gtcttgagttcttcatttaggt

SEQ ID NO: 214016 - DNA, 22 bp, Artificial Sequence
  Synthetic oligonucleotide; CTT chr2 60531904 60531925 60531909 60531904 -
gagttcttcatttaggtgggct

SEQ ID NO: 214017 - DNA, 22 bp, Artificial Sequence
  Synthetic oligonucleotide; TTG chr2 60531903 60531924 60531908 60531903 -
agttcttcatttaggtgggctt

SEQ ID NO: 214018 - DNA, 22 bp, Artificial Sequence
  Synthetic oligonucleotide; TTC chr2 60531898 60531919 60531903 60531898 -
ttcatttaggtgggcttatttc

SEQ ID NO: 214019 - DNA, 22 bp, Artificial Sequence
  Synthetic oligonucleotide; CTT chr2 60531896 60531917 60531901 60531896 -
catttaggtgggcttatttccc

SEQ ID NO: 214020 - DNA, 22 bp, Artificial Sequence
  Synthetic oligonucleotide; TTC chr2 60531895 60531916 60531900 60531895 -
atttaggtgggcttatttccca

SEQ ID NO: 214021 - DNA, 22 bp, Artificial Sequence
  Synthetic oligonucleotide; TTT chr2 60531891 60531912 60531896 60531891 -
aggtgggcttatttcccactgg

SEQ ID NO: 214022 - DNA, 22 bp, Artificial Sequence
  Synthetic oligonucleotide; TTA chr2 60531890 60531911 60531895 60531890 -
ggtgggcttatttcccactggg

SEQ ID NO: 214023 - DNA, 22 bp, Artificial Sequence
  Synthetic oligonucleotide; CTT chr2 60531881 60531902 60531886 60531881 -
atttcccactgggtctggggga

SEQ ID NO: 214024 - DNA, 22 bp, Artificial Sequence
  Synthetic oligonucleotide; TTA chr2 60531880 60531901 60531885 60531880 -
tttcccactgggtctgggggat

SEQ ID NO: 214025 - DNA, 22 bp, Artificial Sequence
  Synthetic oligonucleotide; TTT chr2 60531877 60531898 60531882 60531877 -
cccactgggtctgggggatttc

SEQ ID NO: 214026 - DNA, 22 bp, Artificial Sequence
  Synthetic oligonucleotide; TTC chr2 60531876 60531897 60531881 60531876 -
ccactgggtctgggggatttca

SEQ ID NO: 214027 - DNA, 22 bp, Artificial Sequence
  Synthetic oligonucleotide; CTG chr2 60531870 60531891 60531875 60531870 -
ggtctgggggatttcatttgtc

SEQ ID NO: 214028 - DNA, 22 bp, Artificial Sequence
  Synthetic oligonucleotide; CTG chr2 60531864 60531885 60531869 60531864 -
ggggatttcatttgtcctttga

SEQ ID NO: 214029 - DNA, 22 bp, Artificial Sequence
  Synthetic oligonucleotide; TTT chr2 60531856 60531877 60531861 60531856 -
catttgtcctttgaggggcagg

SEQ ID NO: 214030 - DNA, 22 bp, Artificial Sequence
  Synthetic oligonucleotide; TTC chr2 60531855 60531876 60531860 60531855 -
atttgtcctttgaggggcaggg

SEQ ID NO: 214031 - DNA, 22 bp, Artificial Sequence
  Synthetic oligonucleotide; TTT chr2 60531851 60531872 60531856 60531851 -
gtcctttgaggggcagggtgga

SEQ ID NO: 214032 - DNA, 22 bp, Artificial Sequence
  Synthetic oligonucleotide; TTG chr2 60531850 60531871 60531855 60531850 -
tcctttgaggggcagggtggac

SEQ ID NO: 214033 - DNA, 22 bp, Artificial Sequence
  Synthetic oligonucleotide; CTT chr2 60531845 60531866 60531850 60531845 -
tgaggggcagggtggacactga

SEQ ID NO: 214034 - DNA, 22 bp, Artificial Sequence
  Synthetic oligonucleotide; TTT chr2 60531844 60531865 60531849 60531844 -
gaggggcagggtggacactgac

SEQ ID NO: 214035 - DNA, 22 bp, Artificial Sequence
  Synthetic oligonucleotide; TTG chr2 60531843 60531864 60531848 60531843 -
aggggcagggtggacactgaca

SEQ ID NO: 214036 - DNA, 22 bp, Artificial Sequence
  Synthetic oligonucleotide; CTG chr2 60531824 60531845 60531829 60531824 -
acagaacagctgcggccggcag

SEQ ID NO: 214037 - DNA, 22 bp, Artificial Sequence
  Synthetic oligonucleotide; CTG chr2 60531812 60531833 60531817 60531812 -
cggccggcagagagggtggtta

SEQ ID NO: 214038 - DNA, 22 bp, Artificial Sequence
  Synthetic oligonucleotide; TTA chr2 60531790 60531811 60531795 60531790 -
ggaagagggaagcagcctgtgg

SEQ ID NO: 214039 - DNA, 22 bp, Artificial Sequence
  Synthetic oligonucleotide; CTG chr2 60531771 60531792 60531776 60531771 -
tgggtaacttcccgaccacatg

SEQ ID NO: 214040 - DNA, 22 bp, Artificial Sequence
  Synthetic oligonucleotide; CTT chr2 60531761 60531782 60531766 60531761 -
cccgaccacatggaaaggctga

SEQ ID NO: 214041 - DNA, 22 bp, Artificial Sequence
  Synthetic oligonucleotide; TTC chr2 60531760 60531781 60531765 60531760 -
ccgaccacatggaaaggctgaa

SEQ ID NO: 214042 - DNA, 22 bp, Artificial Sequence
  Synthetic oligonucleotide; CTG chr2 60531740 60531761 60531745 60531740 -
aataagacgttatggaccctgc

SEQ ID NO: 214043 - DNA, 22 bp, Artificial Sequence
  Synthetic oligonucleotide; TTA chr2 60531728 60531749 60531733 60531728 -
tggaccctgccttgggtactgg

SEQ ID NO: 214044 - DNA, 22 bp, Artificial Sequence
  Synthetic oligonucleotide; CTG chr2 60531719 60531740 60531724 60531719 -
ccttgggtactggggtcagcgt

SEQ ID NO: 214045 - DNA, 22 bp, Artificial Sequence
  Synthetic oligonucleotide; CTT chr2 60531715 60531736 60531720 60531715 -
gggtactggggtcagcgtctcc

SEQ ID NO: 214046 - DNA, 22 bp, Artificial Sequence
  Synthetic oligonucleotide; TTG chr2 60531714 60531735 60531719 60531714 -
ggtactggggtcagcgtctcct

SEQ ID NO: 214047 - DNA, 22 bp, Artificial Sequence
  Synthetic oligonucleotide; CTG chr2 60531707 60531728 60531712 60531707 -
gggtcagcgtctcctggtggtg

SEQ ID NO: 214048 - DNA, 22 bp, Artificial Sequence
  Synthetic oligonucleotide; CTC chr2 60531694 60531715 60531699 60531694 -
ctggtggtgtctgcacagggcc

SEQ ID NO: 214049 - DNA, 22 bp, Artificial Sequence
  Synthetic oligonucleotide; CTG chr2 60531691 60531712 60531696 60531691 -
gtggtgtctgcacagggccccc

SEQ ID NO: 214050 - DNA, 22 bp, Artificial Sequence
  Synthetic oligonucleotide; CTG chr2 60531681 60531702 60531686 60531681 -
cacagggccccccaatgccagg

SEQ ID NO: 214051 - DNA, 22 bp, Artificial Sequence
  Synthetic oligonucleotide; CTG chr2 60531653 60531674 60531658 60531653 -
ccaaaacacgctcttgagttta

SEQ ID NO: 214052 - DNA, 22 bp, Artificial Sequence
  Synthetic oligonucleotide; CTC chr2 60531640 60531661 60531645 60531640 -
ttgagtttaatggtagtggttg

SEQ ID NO: 214053 - DNA, 22 bp, Artificial Sequence
  Synthetic oligonucleotide; CTT chr2 60531638 60531659 60531643 60531638 -
gagtttaatggtagtggttggt

SEQ ID NO: 214054 - DNA, 22 bp, Artificial Sequence
  Synthetic oligonucleotide; TTG chr2 60531637 60531658 60531642 60531637 -
agtttaatggtagtggttggtc

SEQ ID NO: 214055 - DNA, 22 bp, Artificial Sequence
  Synthetic oligonucleotide; TTT chr2 60531632 60531653 60531637 60531632 -
aatggtagtggttggtctgagt

SEQ ID NO: 214056 - DNA, 22 bp, Artificial Sequence
  Synthetic oligonucleotide; TTA chr2 60531631 60531652 60531636 60531631 -
atggtagtggttggtctgagtc

SEQ ID NO: 214057 - DNA, 22 bp, Artificial Sequence
  Synthetic oligonucleotide; TTG chr2 60531618 60531639 60531623 60531618 -
gtctgagtcctgccaaagtgta

SEQ ID NO: 214058 - DNA, 22 bp, Artificial Sequence
  Synthetic oligonucleotide; CTG chr2 60531613 60531634 60531618 60531613 -
agtcctgccaaagtgtatggag

SEQ ID NO: 214059 - DNA, 22 bp, Artificial Sequence
  Synthetic oligonucleotide; CTG chr2 60531606 60531627 60531611 60531606 -
ccaaagtgtatggagcaagttt

SEQ ID NO: 214060 - DNA, 22 bp, Artificial Sequence
  Synthetic oligonucleotide; TTT chr2 60531584 60531605 60531589 60531584 -
cattggctggactttccccttg

SEQ ID NO: 214061 - DNA, 22 bp, Artificial Sequence
  Synthetic oligonucleotide; TTC chr2 60531583 60531604 60531588 60531583 -
attggctggactttccccttgc

SEQ ID NO: 214062 - DNA, 22 bp, Artificial Sequence
  Synthetic oligonucleotide; TTG chr2 60531579 60531600 60531584 60531579 -
gctggactttccccttgcatga

SEQ ID NO: 214063 - DNA, 22 bp, Artificial Sequence
  Synthetic oligonucleotide; CTG chr2 60531575 60531596 60531580 60531575 -
gactttccccttgcatgaaata

SEQ ID NO: 214064 - DNA, 22 bp, Artificial Sequence
  Synthetic oligonucleotide; CTT chr2 60531570 60531591 60531575 60531570 -
tccccttgcatgaaataataaa

SEQ ID NO: 214065 - DNA, 22 bp, Artificial Sequence
  Synthetic oligonucleotide; TTT chr2 60531569 60531590 60531574 60531569 -
ccccttgcatgaaataataaaa

SEQ ID NO: 214066 - DNA, 22 bp, Artificial Sequence
  Synthetic oligonucleotide; TTC chr2 60531568 60531589 60531573 60531568 -
cccttgcatgaaataataaaag

SEQ ID NO: 214067 - DNA, 22 bp, Artificial Sequence
  Synthetic oligonucleotide; CTT chr2 60531563 60531584 60531568 60531563 -
gcatgaaataataaaagccctg

SEQ ID NO: 214068 - DNA, 22 bp, Artificial Sequence
  Synthetic oligonucleotide; TTG chr2 60531562 60531583 60531567 60531562 -
catgaaataataaaagccctgg

SEQ ID NO: 214069 - DNA, 22 bp, Artificial Sequence
  Synthetic oligonucleotide; CTG chr2 60531541 60531562 60531546 60531541 -
gccaaggcttatgaatctattt

SEQ ID NO: 214070 - DNA, 22 bp, Artificial Sequence
  Synthetic oligonucleotide; CTT chr2 60531531 60531552 60531536 60531531 -
atgaatctatttttgtttcatt

SEQ ID NO: 214071 - DNA, 22 bp, Artificial Sequence
  Synthetic oligonucleotide; TTA chr2 60531530 60531551 60531535 60531530 -
tgaatctatttttgtttcatta

SEQ ID NO: 214072 - DNA, 22 bp, Artificial Sequence
  Synthetic oligonucleotide; CTA chr2 60531522 60531543 60531527 60531522 -
tttttgtttcattaatattatt

SEQ ID NO: 214073 - DNA, 22 bp, Artificial Sequence
  Synthetic oligonucleotide; TTT chr2 60531519 60531540 60531524 60531519 -
ttgtttcattaatattatttat

SEQ ID NO: 214074 - DNA, 22 bp, Artificial Sequence
  Synthetic oligonucleotide; TTT chr2 60531518 60531539 60531523 60531518 -
tgtttcattaatattatttatt

SEQ ID NO: 214075 - DNA, 22 bp, Artificial Sequence
  Synthetic oligonucleotide; TTT chr2 60531517 60531538 60531522 60531517 -
gtttcattaatattatttatta

SEQ ID NO: 214076 - DNA, 22 bp, Artificial Sequence
  Synthetic oligonucleotide; TTG chr2 60531516 60531537 60531521 60531516 -
tttcattaatattatttattat

SEQ ID NO: 214077 - DNA, 22 bp, Artificial Sequence
  Synthetic oligonucleotide; TTT chr2 60531513 60531534 60531518 60531513 -
cattaatattatttattatgta

SEQ ID NO: 214078 - DNA, 22 bp, Artificial Sequence
  Synthetic oligonucleotide; TTC chr2 60531512 60531533 60531517 60531512 -
attaatattatttattatgtat

SEQ ID NO: 214079 - DNA, 22 bp, Artificial Sequence
  Synthetic oligonucleotide; TTA chr2 60531508 60531529 60531513 60531508 -
atattatttattatgtatttta

SEQ ID NO: 214080 - DNA, 22 bp, Artificial Sequence
  Synthetic oligonucleotide; TTA chr2 60531502 60531523 60531507 60531502 -
tttattatgtattttattaata

SEQ ID NO: 214081 - DNA, 22 bp, Artificial Sequence
  Synthetic oligonucleotide; TTT chr2 60531499 60531520 60531504 60531499 -
attatgtattttattaatattt

SEQ ID NO: 214082 - DNA, 22 bp, Artificial Sequence
  Synthetic oligonucleotide; TTA chr2 60531498 60531519 60531503 60531498 -
ttatgtattttattaatatttt

SEQ ID NO: 214083 - DNA, 22 bp, Artificial Sequence
  Synthetic oligonucleotide; TTA chr2 60531495 60531516 60531500 60531495 -
tgtattttattaatattttttg

SEQ ID NO: 214084 - DNA, 22 bp, Artificial Sequence
  Synthetic oligonucleotide; TTT chr2 60531488 60531509 60531493 60531488 -
tattaatattttttggagggac

SEQ ID NO: 214085 - DNA, 22 bp, Artificial Sequence
  Synthetic oligonucleotide; TTT chr2 60531487 60531508 60531492 60531487 -
attaatattttttggagggacc

SEQ ID NO: 214086 - DNA, 22 bp, Artificial Sequence
  Synthetic oligonucleotide; TTA chr2 60531486 60531507 60531491 60531486 -
ttaatattttttggagggacct

SEQ ID NO: 214087 - DNA, 22 bp, Artificial Sequence
  Synthetic oligonucleotide; TTA chr2 60531483 60531504 60531488 60531483 -
atattttttggagggaccttgc

SEQ ID NO: 214088 - DNA, 22 bp, Artificial Sequence
  Synthetic oligonucleotide; TTT chr2 60531477 60531498 60531482 60531477 -
tttggagggaccttgctctcat

SEQ ID NO: 214089 - DNA, 22 bp, Artificial Sequence
  Synthetic oligonucleotide; TTT chr2 60531476 60531497 60531481 60531476 -
ttggagggaccttgctctcatt

SEQ ID NO: 214090 - DNA, 22 bp, Artificial Sequence
  Synthetic oligonucleotide; TTT chr2 60531475 60531496 60531480 60531475 -
tggagggaccttgctctcattt

SEQ ID NO: 214091 - DNA, 22 bp, Artificial Sequence
  Synthetic oligonucleotide; TTT chr2 60531474 60531495 60531479 60531474 -
ggagggaccttgctctcatttg

SEQ ID NO: 214092 - DNA, 22 bp, Artificial Sequence
  Synthetic oligonucleotide; TTG chr2 60531473 60531494 60531478 60531473 -
gagggaccttgctctcatttga

SEQ ID NO: 214093 - DNA, 22 bp, Artificial Sequence
  Synthetic oligonucleotide; CTT chr2 60531463 60531484 60531468 60531463 -
gctctcatttgaccatttgtag

SEQ ID NO: 214094 - DNA, 22 bp, Artificial Sequence
  Synthetic oligonucleotide; TTG chr2 60531462 60531483 60531467 60531462 -
ctctcatttgaccatttgtagt

SEQ ID NO: 214095 - DNA, 22 bp, Artificial Sequence
  Synthetic oligonucleotide; CTC chr2 60531459 60531480 60531464 60531459 -
tcatttgaccatttgtagttat

SEQ ID NO: 214096 - DNA, 22 bp, Artificial Sequence
  Synthetic oligonucleotide; CTC chr2 60531457 60531478 60531462 60531457 -
atttgaccatttgtagttataa

SEQ ID NO: 214097 - DNA, 22 bp, Artificial Sequence
  Synthetic oligonucleotide; TTT chr2 60531453 60531474 60531458 60531453 -
gaccatttgtagttataattaa

SEQ ID NO: 214098 - DNA, 22 bp, Artificial Sequence
  Synthetic oligonucleotide; TTG chr2 60531452 60531473 60531457 60531452 -
accatttgtagttataattaat

SEQ ID NO: 214099 - DNA, 22 bp, Artificial Sequence
  Synthetic oligonucleotide; TTT chr2 60531445 60531466 60531450 60531445 -
gtagttataattaatgcattcc

SEQ ID NO: 214100 - DNA, 22 bp, Artificial Sequence
  Synthetic oligonucleotide; TTG chr2 60531444 60531465 60531449 60531444 -
tagttataattaatgcattccg

SEQ ID NO: 214101 - DNA, 22 bp, Artificial Sequence
  Synthetic oligonucleotide; TTA chr2 60531438 60531459 60531443 60531438 -
taattaatgcattccgtactgg

SEQ ID NO: 214102 - DNA, 22 bp, Artificial Sequence
  Synthetic oligonucleotide; TTA chr2 60531432 60531453 60531437 60531432 -
atgcattccgtactggttgtaa

SEQ ID NO: 214103 - DNA, 22 bp, Artificial Sequence
  Synthetic oligonucleotide; TTC chr2 60531424 60531445 60531429 60531424 -
cgtactggttgtaaaaagtgtg

SEQ ID NO: 214104 - DNA, 22 bp, Artificial Sequence
  Synthetic oligonucleotide; CTG chr2 60531417 60531438 60531422 60531417 -
gttgtaaaaagtgtgcttgcat

SEQ ID NO: 214105 - DNA, 22 bp, Artificial Sequence
  Synthetic oligonucleotide; TTG chr2 60531413 60531434 60531418 60531413 -
taaaaagtgtgcttgcatttaa

SEQ ID NO: 214106 - DNA, 22 bp, Artificial Sequence
  Synthetic oligonucleotide; CTT chr2 60531399 60531420 60531404 60531399 -
gcatttaattgcaagtcagggt

SEQ ID NO: 214107 - DNA, 22 bp, Artificial Sequence
  Synthetic oligonucleotide; TTG chr2 60531398 60531419 60531403 60531398 -
catttaattgcaagtcagggta

SEQ ID NO: 214108 - DNA, 22 bp, Artificial Sequence
  Synthetic oligonucleotide; TTT chr2 60531393 60531414 60531398 60531393 -
aattgcaagtcagggtaaatta

SEQ ID NO: 214109 - DNA, 22 bp, Artificial Sequence
  Synthetic oligonucleotide; TTA chr2 60531392 60531413 60531397 60531392 -
attgcaagtcagggtaaattaa

SEQ ID NO: 214110 - DNA, 22 bp, Artificial Sequence
  Synthetic oligonucleotide; TTG chr2 60531388 60531409 60531393 60531388 -
caagtcagggtaaattaatgga

SEQ ID NO: 214111 - DNA, 22 bp, Artificial Sequence
  Synthetic oligonucleotide; TTA chr2 60531371 60531392 60531376 60531371 -
atggatatgatttaaaacaaaa

SEQ ID NO: 214112 - DNA, 22 bp, Artificial Sequence
  Synthetic oligonucleotide; TTT chr2 60531358 60531379 60531363 60531358 -
aaaacaaaactcacttaaaata

SEQ ID NO: 214113 - DNA, 22 bp, Artificial Sequence
  Synthetic oligonucleotide; TTA chr2 60531357 60531378 60531362 60531357 -
aaacaaaactcacttaaaatat

SEQ ID NO: 214114 - DNA, 22 bp, Artificial Sequence
  Synthetic oligonucleotide; CTC chr2 60531346 60531367 60531351 60531346 -
acttaaaatattcttgcagaac

SEQ ID NO: 214115 - DNA, 22 bp, Artificial Sequence
  Synthetic oligonucleotide; CTT chr2 60531342 60531363 60531347 60531342 -
aaaatattcttgcagaacgcaa

SEQ ID NO: 214116 - DNA, 22 bp, Artificial Sequence
  Synthetic oligonucleotide; TTA chr2 60531341 60531362 60531346 60531341 -
aaatattcttgcagaacgcaaa

SEQ ID NO: 214117 - DNA, 22 bp, Artificial Sequence
  Synthetic oligonucleotide; TTC chr2 60531333 60531354 60531338 60531333 -
ttgcagaacgcaaaggaggggg

SEQ ID NO: 214118 - DNA, 22 bp, Artificial Sequence
  Synthetic oligonucleotide; CTT chr2 60531331 60531352 60531336 60531331 -
gcagaacgcaaaggagggggca

SEQ ID NO: 214119 - DNA, 22 bp, Artificial Sequence
  Synthetic oligonucleotide; TTG chr2 60531330 60531351 60531335 60531330 -
cagaacgcaaaggagggggcag

SEQ ID NO: 214120 - DNA, 22 bp, Artificial Sequence
  Synthetic oligonucleotide; TTT chr2 60531297 60531318 60531302 60531297 -
aatttattttctggtttagtgt

SEQ ID NO: 214121 - DNA, 22 bp, Artificial Sequence
  Synthetic oligonucleotide; TTA chr2 60531296 60531317 60531301 60531296 -
atttattttctggtttagtgtt

SEQ ID NO: 214122 - DNA, 22 bp, Artificial Sequence
  Synthetic oligonucleotide; TTT chr2 60531292 60531313 60531297 60531292 -
attttctggtttagtgttagtg

SEQ ID NO: 214123 - DNA, 22 bp, Artificial Sequence
  Synthetic oligonucleotide; TTA chr2 60531291 60531312 60531296 60531291 -
ttttctggtttagtgttagtgt

SEQ ID NO: 214124 - DNA, 22 bp, Artificial Sequence
  Synthetic oligonucleotide; TTT chr2 60531288 60531309 60531293 60531288 -
tctggtttagtgttagtgtgag

SEQ ID NO: 214125 - DNA, 22 bp, Artificial Sequence
  Synthetic oligonucleotide; TTT chr2 60531287 60531308 60531292 60531287 -
ctggtttagtgttagtgtgaga

SEQ ID NO: 214126 - DNA, 22 bp, Artificial Sequence
  Synthetic oligonucleotide; TTC chr2 60531286 60531307 60531291 60531286 -
tggtttagtgttagtgtgagag

SEQ ID NO: 214127 - DNA, 22 bp, Artificial Sequence
  Synthetic oligonucleotide; CTG chr2 60531284 60531305 60531289 60531284 -
gtttagtgttagtgtgagaggg

SEQ ID NO: 214128 - DNA, 22 bp, Artificial Sequence
  Synthetic oligonucleotide; TTT chr2 60531280 60531301 60531285 60531280 -
agtgttagtgtgagagggtcga

SEQ ID NO: 214129 - DNA, 22 bp, Artificial Sequence
  Synthetic oligonucleotide; TTA chr2 60531279 60531300 60531284 60531279 -
gtgttagtgtgagagggtcgaa

SEQ ID NO: 214130 - DNA, 22 bp, Artificial Sequence
  Synthetic oligonucleotide; TTA chr2 60531273 60531294 60531278 60531273 -
gtgtgagagggtcgaaaagatt

SEQ ID NO: 214131 - DNA, 22 bp, Artificial Sequence
  Synthetic oligonucleotide; TTC chr2 60531250 60531271 60531255 60531250 -
tgtgggtccaacgggatttgtg

SEQ ID NO: 214132 - DNA, 22 bp, Artificial Sequence
  Synthetic oligonucleotide; CTG chr2 60531248 60531269 60531253 60531248 -
tgggtccaacgggatttgtgtc

SEQ ID NO: 214133 - DNA, 22 bp, Artificial Sequence
  Synthetic oligonucleotide; TTT chr2 60531231 60531252 60531236 60531231 -
gtgtctgtgtgtgcaggaccgt

SEQ ID NO: 214134 - DNA, 22 bp, Artificial Sequence
  Synthetic oligonucleotide; TTG chr2 60531230 60531251 60531235 60531230 -
tgtctgtgtgtgcaggaccgtc

SEQ ID NO: 214135 - DNA, 22 bp, Artificial Sequence
  Synthetic oligonucleotide; CTG chr2 60531224 60531245 60531229 60531224 -
tgtgtgcaggaccgtcgggcaa

SEQ ID NO: 214136 - DNA, 22 bp, Artificial Sequence
  Synthetic oligonucleotide; CTG chr2 60531179 60531200 60531184 60531179 -
gaccggagtagggtagccagga

SEQ ID NO: 214137 - DNA, 22 bp, Artificial Sequence
  Synthetic oligonucleotide; CTC chr2 60531153 60531174 60531158 60531153 -
tttttttttttttctctaattt

SEQ ID NO: 214138 - DNA, 22 bp, Artificial Sequence
  Synthetic oligonucleotide; CTT chr2 60531151 60531172 60531156 60531151 -
tttttttttttctctaatttct

SEQ ID NO: 214139 - DNA, 22 bp, Artificial Sequence
  Synthetic oligonucleotide; TTT chr2 60531150 60531171 60531155 60531150 -
ttttttttttctctaatttctg

SEQ ID NO: 214140 - DNA, 22 bp, Artificial Sequence
  Synthetic oligonucleotide; TTT chr2 60531149 60531170 60531154 60531149 -
tttttttttctctaatttctga

SEQ ID NO: 214141 - DNA, 22 bp, Artificial Sequence
  Synthetic oligonucleotide; TTT chr2 60531148 60531169 60531153 60531148 -
ttttttttctctaatttctgag

SEQ ID NO: 214142 - DNA, 22 bp, Artificial Sequence
  Synthetic oligonucleotide; TTT chr2 60531147 60531168 60531152 60531147 -
tttttttctctaatttctgagg

SEQ ID NO: 214143 - DNA, 22 bp, Artificial Sequence
  Synthetic oligonucleotide; TTT chr2 60531146 60531167 60531151 60531146 -
ttttttctctaatttctgaggt

SEQ ID NO: 214144 - DNA, 22 bp, Artificial Sequence
  Synthetic oligonucleotide; TTT chr2 60531145 60531166 60531150 60531145 -
tttttctctaatttctgaggtt

SEQ ID NO: 214145 - DNA, 22 bp, Artificial Sequence
  Synthetic oligonucleotide; TTT chr2 60531144 60531165 60531149 60531144 -
ttttctctaatttctgaggttg

SEQ ID NO: 214146 - DNA, 22 bp, Artificial Sequence
  Synthetic oligonucleotide; TTT chr2 60531143 60531164 60531148 60531143 -
tttctctaatttctgaggttgc

SEQ ID NO: 214147 - DNA, 22 bp, Artificial Sequence
  Synthetic oligonucleotide; TTT chr2 60531142 60531163 60531147 60531142 -
ttctctaatttctgaggttgcc

SEQ ID NO: 214148 - DNA, 22 bp, Artificial Sequence
  Synthetic oligonucleotide; TTT chr2 60531141 60531162 60531146 60531141 -
tctctaatttctgaggttgcca

SEQ ID NO: 214149 - DNA, 22 bp, Artificial Sequence
  Synthetic oligonucleotide; TTT chr2 60531140 60531161 60531145 60531140 -
ctctaatttctgaggttgccag

SEQ ID NO: 214150 - DNA, 22 bp, Artificial Sequence
  Synthetic oligonucleotide; TTC chr2 60531139 60531160 60531144 60531139 -
tctaatttctgaggttgccagg

SEQ ID NO: 214151 - DNA, 22 bp, Artificial Sequence
  Synthetic oligonucleotide; CTC chr2 60531137 60531158 60531142 60531137 -
taatttctgaggttgccaggag

SEQ ID NO: 214152 - DNA, 22 bp, Artificial Sequence
  Synthetic oligonucleotide; CTA chr2 60531135 60531156 60531140 60531135 -
atttctgaggttgccaggaggg

SEQ ID NO: 214153 - DNA, 22 bp, Artificial Sequence
  Synthetic oligonucleotide; TTT chr2 60531131 60531152 60531136 60531131 -
ctgaggttgccaggaggggctt

SEQ ID NO: 214154 - DNA, 22 bp, Artificial Sequence
  Synthetic oligonucleotide; TTC chr2 60531130 60531151 60531135 60531130 -
tgaggttgccaggaggggctta

SEQ ID NO: 214155 - DNA, 22 bp, Artificial Sequence
  Synthetic oligonucleotide; CTG chr2 60531128 60531149 60531133 60531128 -
aggttgccaggaggggcttaag

SEQ ID NO: 214156 - DNA, 22 bp, Artificial Sequence
  Synthetic oligonucleotide; TTG chr2 60531122 60531143 60531127 60531122 -
ccaggaggggcttaagcaaagt

SEQ ID NO: 214157 - DNA, 22 bp, Artificial Sequence
  Synthetic oligonucleotide; CTT chr2 60531109 60531130 60531114 60531109 -
aagcaaagtggtcaagtccatc

SEQ ID NO: 214158 - DNA, 22 bp, Artificial Sequence
  Synthetic oligonucleotide; TTA chr2 60531108 60531129 60531113 60531108 -
agcaaagtggtcaagtccatct

SEQ ID NO: 214159 - DNA, 22 bp, Artificial Sequence
  Synthetic oligonucleotide; CTG chr2 60531085 60531106 60531090 60531085 -
ctccggagaaggtggtaaagaa

SEQ ID NO: 214160 - DNA, 22 bp, Artificial Sequence
  Synthetic oligonucleotide; CTC chr2 60531082 60531103 60531087 60531082 -
cggagaaggtggtaaagaaaag

SEQ ID NO: 214161 - DNA, 22 bp, Artificial Sequence
  Synthetic oligonucleotide; TTA chr2 60531054 60531075 60531059 60531054 -
gtggcaagagggaaggagcaca

SEQ ID NO: 214162 - DNA, 22 bp, Artificial Sequence
  Synthetic oligonucleotide; TTG chr2 60531020 60531041 60531025 60531020 -
tacattgggagcgttactctcc

SEQ ID NO: 214163 - DNA, 22 bp, Artificial Sequence
  Synthetic oligonucleotide; TTG chr2 60531013 60531034 60531018 60531013 -
ggagcgttactctccctggcca

SEQ ID NO: 214164 - DNA, 22 bp, Artificial Sequence
  Synthetic oligonucleotide; TTA chr2 60531004 60531025 60531009 60531004 -
ctctccctggccatggtgtagc

SEQ ID NO: 214165 - DNA, 22 bp, Artificial Sequence
  Synthetic oligonucleotide; CTC chr2 60531001 60531022 60531006 60531001 -
tccctggccatggtgtagccag

SEQ ID NO: 214166 - DNA, 22 bp, Artificial Sequence
  Synthetic oligonucleotide; CTC chr2 60530999 60531020 60531004 60530999 -
cctggccatggtgtagccagac

SEQ ID NO: 214167 - DNA, 22 bp, Artificial Sequence
  Synthetic oligonucleotide; CTG chr2 60530995 60531016 60531000 60530995 -
gccatggtgtagccagactggt

SEQ ID NO: 214168 - DNA, 22 bp, Artificial Sequence
  Synthetic oligonucleotide; CTG chr2 60530975 60530996 60530980 60530975 -
gtttagcagacagaatgataga

SEQ ID NO: 214169 - DNA, 22 bp, Artificial Sequence
  Synthetic oligonucleotide; TTT chr2 60530971 60530992 60530976 60530971 -
agcagacagaatgatagattgt

SEQ ID NO: 214170 - DNA, 22 bp, Artificial Sequence
  Synthetic oligonucleotide; TTA chr2 60530970 60530991 60530975 60530970 -
gcagacagaatgatagattgtt

SEQ ID NO: 214171 - DNA, 22 bp, Artificial Sequence
  Synthetic oligonucleotide; TTG chr2 60530950 60530971 60530955 60530950 -
ttttgtcaggggtcccagggtg

SEQ ID NO: 214172 - DNA, 22 bp, Artificial Sequence
  Synthetic oligonucleotide; TTT chr2 60530947 60530968 60530952 60530947 -
tgtcaggggtcccagggtgcgc

SEQ ID NO: 214173 - DNA, 22 bp, Artificial Sequence
  Synthetic oligonucleotide; TTT chr2 60530946 60530967 60530951 60530946 -
gtcaggggtcccagggtgcgcc

SEQ ID NO: 214174 - DNA, 22 bp, Artificial Sequence
  Synthetic oligonucleotide; TTG chr2 60530945 60530966 60530950 60530945 -
tcaggggtcccagggtgcgccc

SEQ ID NO: 214175 - DNA, 22 bp, Artificial Sequence
  Synthetic oligonucleotide; CTG chr2 60530921 60530942 60530926 60530921 -
aacttgaagcactttgtttatc

SEQ ID NO: 214176 - DNA, 22 bp, Artificial Sequence
  Synthetic oligonucleotide; CTT chr2 60530916 60530937 60530921 60530916 -
gaagcactttgtttatcttgaa

SEQ ID NO: 214177 - DNA, 22 bp, Artificial Sequence
  Synthetic oligonucleotide; TTG chr2 60530915 60530936 60530920 60530915 -
aagcactttgtttatcttgaat

SEQ ID NO: 214178 - DNA, 22 bp, Artificial Sequence
  Synthetic oligonucleotide; CTT chr2 60530907 60530928 60530912 60530907 -
tgtttatcttgaatagaaaggg

SEQ ID NO: 214179 - DNA, 22 bp, Artificial Sequence
  Synthetic oligonucleotide; TTT chr2 60530906 60530927 60530911 60530906 -
gtttatcttgaatagaaaggga

SEQ ID NO: 214180 - DNA, 22 bp, Artificial Sequence
  Synthetic oligonucleotide; TTG chr2 60530905 60530926 60530910 60530905 -
tttatcttgaatagaaagggaa

SEQ ID NO: 214181 - DNA, 22 bp, Artificial Sequence
  Synthetic oligonucleotide; TTT chr2 60530902 60530923 60530907 60530902 -
atcttgaatagaaagggaaaag

SEQ ID NO: 214182 - DNA, 22 bp, Artificial Sequence
  Synthetic oligonucleotide; TTA chr2 60530901 60530922 60530906 60530901 -
tcttgaatagaaagggaaaagc

SEQ ID NO: 214183 - DNA, 22 bp, Artificial Sequence
  Synthetic oligonucleotide; CTT chr2 60530897 60530918 60530902 60530897 -
gaatagaaagggaaaagcgcag

SEQ ID NO: 214184 - DNA, 22 bp, Artificial Sequence
  Synthetic oligonucleotide; TTG chr2 60530896 60530917 60530901 60530896 -
aatagaaagggaaaagcgcaga

SEQ ID NO: 214185 - DNA, 22 bp, Artificial Sequence
  Synthetic oligonucleotide; CTA chr2 60530859 60530880 60530864 60530859 -
gtttttaggagctcgaaagagg

SEQ ID NO: 214186 - DNA, 22 bp, Artificial Sequence
  Synthetic oligonucleotide; TTT chr2 60530855 60530876 60530860 60530855 -
ttaggagctcgaaagaggtagg

SEQ ID NO: 214187 - DNA, 22 bp, Artificial Sequence
  Synthetic oligonucleotide; TTT chr2 60530854 60530875 60530859 60530854 -
taggagctcgaaagaggtagga

SEQ ID NO: 214188 - DNA, 22 bp, Artificial Sequence
  Synthetic oligonucleotide; TTT chr2 60530853 60530874 60530858 60530853 -
aggagctcgaaagaggtaggag

SEQ ID NO: 214189 - DNA, 22 bp, Artificial Sequence
  Synthetic oligonucleotide; TTA chr2 60530852 60530873 60530857 60530852 -
ggagctcgaaagaggtaggaga

SEQ ID NO: 214190 - DNA, 22 bp, Artificial Sequence
  Synthetic oligonucleotide; CTC chr2 60530845 60530866 60530850 60530845 -
gaaagaggtaggagaacagaga

SEQ ID NO: 214191 - DNA, 22 bp, Artificial Sequence
  Synthetic oligonucleotide; CTC chr2 60530817 60530838 60530822 60530817 -
aggaggggtagtgggaggtggg

SEQ ID NO: 214192 - DNA, 22 bp, Artificial Sequence
  Synthetic oligonucleotide; CTG chr2 60530779 60530800 60530784 60530779 -
gttgtggttgtccattaacaga

SEQ ID NO: 214193 - DNA, 22 bp, Artificial Sequence
  Synthetic oligonucleotide; TTG chr2 60530775 60530796 60530780 60530775 -
tggttgtccattaacagatgaa

SEQ ID NO: 214194 - DNA, 22 bp, Artificial Sequence
  Synthetic oligonucleotide; TTG chr2 60530769 60530790 60530774 60530769 -
tccattaacagatgaacttggc

SEQ ID NO: 214195 - DNA, 22 bp, Artificial Sequence
  Synthetic oligonucleotide; TTA chr2 60530762 60530783 60530767 60530762 -
acagatgaacttggccgagggc

SEQ ID NO: 214196 - DNA, 22 bp, Artificial Sequence
  Synthetic oligonucleotide; CTT chr2 60530750 60530771 60530755 60530750 -
ggccgagggccaggctttagat

SEQ ID NO: 214197 - DNA, 22 bp, Artificial Sequence
  Synthetic oligonucleotide; TTG chr2 60530749 60530770 60530754 60530749 -
gccgagggccaggctttagatg

SEQ ID NO: 214198 - DNA, 22 bp, Artificial Sequence
  Synthetic oligonucleotide; CTT chr2 60530733 60530754 60530738 60530733 -
tagatgagagcgtgtcagggcc

SEQ ID NO: 214199 - DNA, 22 bp, Artificial Sequence
  Synthetic oligonucleotide; TTT chr2 60530732 60530753 60530737 60530732 -
agatgagagcgtgtcagggccc

SEQ ID NO: 214200 - DNA, 22 bp, Artificial Sequence
  Synthetic oligonucleotide; TTA chr2 60530731 60530752 60530736 60530731 -
gatgagagcgtgtcagggcccc

SEQ ID NO: 214201 - DNA, 22 bp, Artificial Sequence
  Synthetic oligonucleotide; CTT chr2 60530693 60530714 60530698 60530693 -
ttcagtgttttttttttccttt

SEQ ID NO: 214202 - DNA, 22 bp, Artificial Sequence
  Synthetic oligonucleotide; TTT chr2 60530692 60530713 60530697 60530692 -
tcagtgttttttttttcctttt

SEQ ID NO: 214203 - DNA, 22 bp, Artificial Sequence
  Synthetic oligonucleotide; TTT chr2 60530691 60530712 60530696 60530691 -
cagtgttttttttttccttttt

SEQ ID NO: 214204 - DNA, 22 bp, Artificial Sequence
  Synthetic oligonucleotide; TTC chr2 60530690 60530711 60530695 60530690 -
agtgttttttttttcctttttc

SEQ ID NO: 214205 - DNA, 22 bp, Artificial Sequence
  Synthetic oligonucleotide; TTT chr2 60530683 60530704 60530688 60530683 -
tttttttcctttttctttcttt

SEQ ID NO: 214206 - DNA, 22 bp, Artificial Sequence
  Synthetic oligonucleotide; TTT chr2 60530682 60530703 60530687 60530682 -
ttttttcctttttctttctttc

SEQ ID NO: 214207 - DNA, 22 bp, Artificial Sequence
  Synthetic oligonucleotide; TTT chr2 60530681 60530702 60530686 60530681 -
tttttcctttttctttctttct

SEQ ID NO: 214208 - DNA, 22 bp, Artificial Sequence
  Synthetic oligonucleotide; TTT chr2 60530680 60530701 60530685 60530680 -
ttttcctttttctttctttctt

SEQ ID NO: 214209 - DNA, 22 bp, Artificial Sequence
  Synthetic oligonucleotide; TTT chr2 60530679 60530700 60530684 60530679 -
tttcctttttctttctttcttt

SEQ ID NO: 214210 - DNA, 22 bp, Artificial Sequence
  Synthetic oligonucleotide; TTT chr2 60530678 60530699 60530683 60530678 -
ttcctttttctttctttctttt

SEQ ID NO: 214211 - DNA, 22 bp, Artificial Sequence
  Synthetic oligonucleotide; TTT chr2 60530677 60530698 60530682 60530677 -
tcctttttctttctttcttttt

SEQ ID NO: 214212 - DNA, 22 bp, Artificial Sequence
  Synthetic oligonucleotide; TTT chr2 60530676 60530697 60530681 60530676 -
cctttttctttctttctttttt

SEQ ID NO: 214213 - DNA, 22 bp, Artificial Sequence
  Synthetic oligonucleotide; TTC chr2 60530675 60530696 60530680 60530675 -
ctttttctttctttctttttta

SEQ ID NO: 214214 - DNA, 22 bp, Artificial Sequence
  Synthetic oligonucleotide; CTT chr2 60530672 60530693 60530677 60530672 -
tttctttctttcttttttaaat

SEQ ID NO: 214215 - DNA, 22 bp, Artificial Sequence
  Synthetic oligonucleotide; TTT chr2 60530671 60530692 60530676 60530671 -
ttctttctttcttttttaaata

SEQ ID NO: 214216 - DNA, 22 bp, Artificial Sequence
  Synthetic oligonucleotide; TTT chr2 60530670 60530691 60530675 60530670 -
tctttctttcttttttaaatac

SEQ ID NO: 214217 - DNA, 22 bp, Artificial Sequence
  Synthetic oligonucleotide; TTT chr2 60530669 60530690 60530674 60530669 -
ctttctttcttttttaaatacc

SEQ ID NO: 214218 - DNA, 22 bp, Artificial Sequence
  Synthetic oligonucleotide; TTC chr2 60530668 60530689 60530673 60530668 -
tttctttcttttttaaatacct

SEQ ID NO: 214219 - DNA, 22 bp, Artificial Sequence
  Synthetic oligonucleotide; CTT chr2 60530666 60530687 60530671 60530666 -
tctttcttttttaaatacctgc

SEQ ID NO: 214220 - DNA, 22 bp, Artificial Sequence
  Synthetic oligonucleotide; TTT chr2 60530665 60530686 60530670 60530665 -
ctttcttttttaaatacctgct

SEQ ID NO: 214221 - DNA, 22 bp, Artificial Sequence
  Synthetic oligonucleotide; TTC chr2 60530664 60530685 60530669 60530664 -
tttcttttttaaatacctgctg

SEQ ID NO: 214222 - DNA, 22 bp, Artificial Sequence
  Synthetic oligonucleotide; CTT chr2 60530662 60530683 60530667 60530662 -
tcttttttaaatacctgctgac

SEQ ID NO: 214223 - DNA, 22 bp, Artificial Sequence
  Synthetic oligonucleotide; TTT chr2 60530661 60530682 60530666 60530661 -
cttttttaaatacctgctgact

SEQ ID NO: 214224 - DNA, 22 bp, Artificial Sequence
  Synthetic oligonucleotide; TTC chr2 60530660 60530681 60530665 60530660 -
ttttttaaatacctgctgactg

SEQ ID NO: 214225 - DNA, 22 bp, Artificial Sequence
  Synthetic oligonucleotide; CTT chr2 60530658 60530679 60530663 60530658 -
ttttaaatacctgctgactgta

SEQ ID NO: 214226 - DNA, 22 bp, Artificial Sequence
  Synthetic oligonucleotide; TTT chr2 60530657 60530678 60530662 60530657 -
tttaaatacctgctgactgtac

SEQ ID NO: 214227 - DNA, 22 bp, Artificial Sequence
  Synthetic oligonucleotide; TTT chr2 60530656 60530677 60530661 60530656 -
ttaaatacctgctgactgtaca

SEQ ID NO: 214228 - DNA, 22 bp, Artificial Sequence
  Synthetic oligonucleotide; TTT chr2 60530655 60530676 60530660 60530655 -
taaatacctgctgactgtacat

SEQ ID NO: 214229 - DNA, 22 bp, Artificial Sequence
  Synthetic oligonucleotide; TTT chr2 60530654 60530675 60530659 60530654 -
aaatacctgctgactgtacatc

SEQ ID NO: 214230 - DNA, 22 bp, Artificial Sequence
  Synthetic oligonucleotide; TTA chr2 60530653 60530674 60530658 60530653 -
aatacctgctgactgtacatca

SEQ ID NO: 214231 - DNA, 22 bp, Artificial Sequence
  Synthetic oligonucleotide; CTG chr2 60530645 60530666 60530650 60530645 -
ctgactgtacatcaaatgctcc

SEQ ID NO: 214232 - DNA, 22 bp, Artificial Sequence
  Synthetic oligonucleotide; CTG chr2 60530642 60530663 60530647 60530642 -
actgtacatcaaatgctccctg

SEQ ID NO: 214233 - DNA, 22 bp, Artificial Sequence
  Synthetic oligonucleotide; CTG chr2 60530638 60530659 60530643 60530638 -
tacatcaaatgctccctggtct

SEQ ID NO: 214234 - DNA, 22 bp, Artificial Sequence
  Synthetic oligonucleotide; CTC chr2 60530624 60530645 60530629 60530624 -
cctggtcttttggctaaaggca

SEQ ID NO: 214235 - DNA, 22 bp, Artificial Sequence
  Synthetic oligonucleotide; CTG chr2 60530620 60530641 60530625 60530620 -
gtcttttggctaaaggcaaaaa

SEQ ID NO: 214236 - DNA, 22 bp, Artificial Sequence
  Synthetic oligonucleotide; CTT chr2 60530615 60530636 60530620 60530615 -
ttggctaaaggcaaaaaaataa

SEQ ID NO: 214237 - DNA, 22 bp, Artificial Sequence
  Synthetic oligonucleotide; TTT chr2 60530614 60530635 60530619 60530614 -
tggctaaaggcaaaaaaataaa

SEQ ID NO: 214238 - DNA, 22 bp, Artificial Sequence
  Synthetic oligonucleotide; TTT chr2 60530613 60530634 60530618 60530613 -
ggctaaaggcaaaaaaataaaa

SEQ ID NO: 214239 - DNA, 22 bp, Artificial Sequence
  Synthetic oligonucleotide; TTG chr2 60530612 60530633 60530617 60530612 -
gctaaaggcaaaaaaataaaaa

SEQ ID NO: 214240 - DNA, 22 bp, Artificial Sequence
  Synthetic oligonucleotide; CTA chr2 60530608 60530629 60530613 60530608 -
aaggcaaaaaaataaaaaataa

SEQ ID NO: 214241 - DNA, 22 bp, Artificial Sequence
  Synthetic oligonucleotide; CTC chr2 60530563 60530584 60530568 60530563 -
aattttttccctcctctgaacc

SEQ ID NO: 214242 - DNA, 22 bp, Artificial Sequence
  Synthetic oligonucleotide; TTT chr2 60530558 60530579 60530563 60530558 -
tttccctcctctgaaccagttg

SEQ ID NO: 214243 - DNA, 22 bp, Artificial Sequence
  Synthetic oligonucleotide; TTT chr2 60530557 60530578 60530562 60530557 -
ttccctcctctgaaccagttga

SEQ ID NO: 214244 - DNA, 22 bp, Artificial Sequence
  Synthetic oligonucleotide; TTT chr2 60530556 60530577 60530561 60530556 -
tccctcctctgaaccagttgag

SEQ ID NO: 214245 - DNA, 22 bp, Artificial Sequence
  Synthetic oligonucleotide; TTT chr2 60530555 60530576 60530560 60530555 -
ccctcctctgaaccagttgagg

SEQ ID NO: 214246 - DNA, 22 bp, Artificial Sequence
  Synthetic oligonucleotide; TTC chr2 60530554 60530575 60530559 60530554 -
cctcctctgaaccagttgaggc

SEQ ID NO: 214247 - DNA, 22 bp, Artificial Sequence
  Synthetic oligonucleotide; CTC chr2 60530550 60530571 60530555 60530550 -
ctctgaaccagttgaggccagt

SEQ ID NO: 214248 - DNA, 22 bp, Artificial Sequence
  Synthetic oligonucleotide; CTC chr2 60530547 60530568 60530552 60530547 -
tgaaccagttgaggccagtctt

SEQ ID NO: 214249 - DNA, 22 bp, Artificial Sequence
  Synthetic oligonucleotide; CTG chr2 60530545 60530566 60530550 60530545 -
aaccagttgaggccagtctttt

SEQ ID NO: 214250 - DNA, 22 bp, Artificial Sequence
  Synthetic oligonucleotide; TTG chr2 60530536 60530557 60530541 60530536 -
aggccagtcttttggctacata

SEQ ID NO: 214251 - DNA, 22 bp, Artificial Sequence
  Synthetic oligonucleotide; CTT chr2 60530525 60530546 60530530 60530525 -
ttggctacatatgcgggttcta

SEQ ID NO: 214252 - DNA, 22 bp, Artificial Sequence
  Synthetic oligonucleotide; TTT chr2 60530524 60530545 60530529 60530524 -
tggctacatatgcgggttctat

SEQ ID NO: 214253 - DNA, 22 bp, Artificial Sequence
  Synthetic oligonucleotide; TTT chr2 60530523 60530544 60530528 60530523 -
ggctacatatgcgggttctatc

SEQ ID NO: 214254 - DNA, 22 bp, Artificial Sequence
  Synthetic oligonucleotide; TTG chr2 60530522 60530543 60530527 60530522 -
gctacatatgcgggttctatca

SEQ ID NO: 214255 - DNA, 22 bp, Artificial Sequence
  Synthetic oligonucleotide; CTA chr2 60530518 60530539 60530523 60530518 -
catatgcgggttctatcatctt

SEQ ID NO: 214256 - DNA, 22 bp, Artificial Sequence
  Synthetic oligonucleotide; TTC chr2 60530505 60530526 60530510 60530505 -
tatcatctttcctggcttgccg

SEQ ID NO: 214257 - DNA, 22 bp, Artificial Sequence
  Synthetic oligonucleotide; CTA chr2 60530503 60530524 60530508 60530503 -
tcatctttcctggcttgccgtt

SEQ ID NO: 214258 - DNA, 22 bp, Artificial Sequence
  Synthetic oligonucleotide; CTT chr2 60530496 60530517 60530501 60530496 -
tcctggcttgccgttgggaaaa

SEQ ID NO: 214259 - DNA, 22 bp, Artificial Sequence
  Synthetic oligonucleotide; TTT chr2 60530495 60530516 60530500 60530495 -
cctggcttgccgttgggaaaaa

SEQ ID NO: 214260 - DNA, 22 bp, Artificial Sequence
  Synthetic oligonucleotide; TTC chr2 60530494 60530515 60530499 60530494 -
ctggcttgccgttgggaaaaaa

SEQ ID NO: 214261 - DNA, 22 bp, Artificial Sequence
  Synthetic oligonucleotide; CTG chr2 60530491 60530512 60530496 60530491 -
gcttgccgttgggaaaaaaagt

SEQ ID NO: 214262 - DNA, 22 bp, Artificial Sequence
  Synthetic oligonucleotide; CTT chr2 60530487 60530508 60530492 60530487 -
gccgttgggaaaaaaagttgtg

SEQ ID NO: 214263 - DNA, 22 bp, Artificial Sequence
  Synthetic oligonucleotide; TTG chr2 60530486 60530507 60530491 60530486 -
ccgttgggaaaaaaagttgtga

SEQ ID NO: 214264 - DNA, 22 bp, Artificial Sequence
  Synthetic oligonucleotide; TTG chr2 60530480 60530501 60530485 60530480 -
ggaaaaaaagttgtgataacgc

SEQ ID NO: 214265 - DNA, 22 bp, Artificial Sequence
  Synthetic oligonucleotide; TTG chr2 60530467 60530488 60530472 60530467 -
tgataacgccagtaacccgagg

SEQ ID NO: 214266 - DNA, 22 bp, Artificial Sequence
  Synthetic oligonucleotide; TTT chr2 60530427 60530448 60530432 60530427 -
ggttgtgttcaggcgaccaggt

SEQ ID NO: 214267 - DNA, 22 bp, Artificial Sequence
  Synthetic oligonucleotide; TTG chr2 60530426 60530447 60530431 60530426 -
gttgtgttcaggcgaccaggtg

SEQ ID NO: 214268 - DNA, 22 bp, Artificial Sequence
  Synthetic oligonucleotide; TTG chr2 60530422 60530443 60530427 60530422 -
tgttcaggcgaccaggtgtgag

SEQ ID NO: 214269 - DNA, 22 bp, Artificial Sequence
  Synthetic oligonucleotide; TTC chr2 60530417 60530438 60530422 60530417 -
aggcgaccaggtgtgagagctc

SEQ ID NO: 214270 - DNA, 22 bp, Artificial Sequence
  Synthetic oligonucleotide; CTC chr2 60530395 60530416 60530400 60530395 -
gtggtgcagtggggtggggcgt

SEQ ID NO: 214271 - DNA, 22 bp, Artificial Sequence
  Synthetic oligonucleotide; CTG chr2 60530359 60530380 60530364 60530359 -
cgtgtgcaggtaagaaatcagt

SEQ ID NO: 214272 - DNA, 22 bp, Artificial Sequence
  Synthetic oligonucleotide; CTC chr2 60530329 60530350 60530334 60530329 -
ttttttttttttttttttaaat

SEQ ID NO: 214273 - DNA, 22 bp, Artificial Sequence
  Synthetic oligonucleotide; CTT chr2 60530327 60530348 60530332 60530327 -
ttttttttttttttttaaatgg

SEQ ID NO: 214274 - DNA, 22 bp, Artificial Sequence
  Synthetic oligonucleotide; TTT chr2 60530326 60530347 60530331 60530326 -
tttttttttttttttaaatggc

SEQ ID NO: 214275 - DNA, 22 bp, Artificial Sequence
  Synthetic oligonucleotide; TTT chr2 60530325 60530346 60530330 60530325 -
ttttttttttttttaaatggct

SEQ ID NO: 214276 - DNA, 22 bp, Artificial Sequence
  Synthetic oligonucleotide; TTT chr2 60530324 60530345 60530329 60530324 -
tttttttttttttaaatggctg

SEQ ID NO: 214277 - DNA, 22 bp, Artificial Sequence
  Synthetic oligonucleotide; TTT chr2 60530323 60530344 60530328 60530323 -
ttttttttttttaaatggctga

SEQ ID NO: 214278 - DNA, 22 bp, Artificial Sequence
  Synthetic oligonucleotide; TTT chr2 60530322 60530343 60530327 60530322 -
tttttttttttaaatggctgaa

SEQ ID NO: 214279 - DNA, 22 bp, Artificial Sequence
  Synthetic oligonucleotide; TTT chr2 60530321 60530342 60530326 60530321 -
ttttttttttaaatggctgaag

SEQ ID NO: 214280 - DNA, 22 bp, Artificial Sequence
  Synthetic oligonucleotide; TTT chr2 60530320 60530341 60530325 60530320 -
tttttttttaaatggctgaagt

SEQ ID NO: 214281 - DNA, 22 bp, Artificial Sequence
  Synthetic oligonucleotide; TTT chr2 60530319 60530340 60530324 60530319 -
ttttttttaaatggctgaagtt

SEQ ID NO: 214282 - DNA, 22 bp, Artificial Sequence
  Synthetic oligonucleotide; TTT chr2 60530318 60530339 60530323 60530318 -
tttttttaaatggctgaagttt

SEQ ID NO: 214283 - DNA, 22 bp, Artificial Sequence
  Synthetic oligonucleotide; TTT chr2 60530317 60530338 60530322 60530317 -
ttttttaaatggctgaagttta

SEQ ID NO: 214284 - DNA, 22 bp, Artificial Sequence
  Synthetic oligonucleotide; TTT chr2 60530316 60530337 60530321 60530316 -
tttttaaatggctgaagtttaa

SEQ ID NO: 214285 - DNA, 22 bp, Artificial Sequence
  Synthetic oligonucleotide; TTT chr2 60530315 60530336 60530320 60530315 -
ttttaaatggctgaagtttaac

SEQ ID NO: 214286 - DNA, 22 bp, Artificial Sequence
  Synthetic oligonucleotide; TTT chr2 60530314 60530335 60530319 60530314 -
tttaaatggctgaagtttaact

SEQ ID NO: 214287 - DNA, 22 bp, Artificial Sequence
  Synthetic oligonucleotide; TTT chr2 60530313 60530334 60530318 60530313 -
ttaaatggctgaagtttaactt

SEQ ID NO: 214288 - DNA, 22 bp, Artificial Sequence
  Synthetic oligonucleotide; TTT chr2 60530312 60530333 60530317 60530312 -
taaatggctgaagtttaacttg

SEQ ID NO: 214289 - DNA, 22 bp, Artificial Sequence
  Synthetic oligonucleotide; TTT chr2 60530311 60530332 60530316 60530311 -
aaatggctgaagtttaacttgt

SEQ ID NO: 214290 - DNA, 22 bp, Artificial Sequence
  Synthetic oligonucleotide; TTA chr2 60530310 60530331 60530315 60530310 -
aatggctgaagtttaacttgtt

SEQ ID NO: 214291 - DNA, 22 bp, Artificial Sequence
  Synthetic oligonucleotide; CTG chr2 60530302 60530323 60530307 60530302 -
aagtttaacttgttggaagggc

SEQ ID NO: 214292 - DNA, 22 bp, Artificial Sequence
  Synthetic oligonucleotide; TTT chr2 60530296 60530317 60530301 60530296 -
aacttgttggaagggcctgtga

SEQ ID NO: 214293 - DNA, 22 bp, Artificial Sequence
  Synthetic oligonucleotide; TTA chr2 60530295 60530316 60530300 60530295 -
acttgttggaagggcctgtgaa

SEQ ID NO: 214294 - DNA, 22 bp, Artificial Sequence
  Synthetic oligonucleotide; CTT chr2 60530291 60530312 60530296 60530291 -
gttggaagggcctgtgaattaa

SEQ ID NO: 214295 - DNA, 22 bp, Artificial Sequence
  Synthetic oligonucleotide; TTG chr2 60530290 60530311 60530295 60530290 -
ttggaagggcctgtgaattaag

SEQ ID NO: 214296 - DNA, 22 bp, Artificial Sequence
  Synthetic oligonucleotide; TTG chr2 60530287 60530308 60530292 60530287 -
gaagggcctgtgaattaagctg

SEQ ID NO: 214297 - DNA, 22 bp, Artificial Sequence
  Synthetic oligonucleotide; CTG chr2 60530277 60530298 60530282 60530277 -
tgaattaagctgtcggtggctg

SEQ ID NO: 214298 - DNA, 22 bp, Artificial Sequence
  Synthetic oligonucleotide; TTA chr2 60530270 60530291 60530275 60530270 -
agctgtcggtggctgagaacga

SEQ ID NO: 214299 - DNA, 22 bp, Artificial Sequence
  Synthetic oligonucleotide; CTG chr2 60530265 60530286 60530270 60530265 -
tcggtggctgagaacgataata

SEQ ID NO: 214300 - DNA, 22 bp, Artificial Sequence
  Synthetic oligonucleotide; CTG chr2 60530255 60530276 60530260 60530255 -
agaacgataatatgcaaggaag

SEQ ID NO: 214301 - DNA, 22 bp, Artificial Sequence
  Synthetic oligonucleotide; CTC chr2 60530229 60530250 60530234 60530229 -
aaggaaggctcaagaaaggcca

SEQ ID NO: 214302 - DNA, 22 bp, Artificial Sequence
  Synthetic oligonucleotide; CTC chr2 60530218 60530239 60530223 60530218 -
aagaaaggccaggggtggggaa

SEQ ID NO: 214303 - DNA, 22 bp, Artificial Sequence
  Synthetic oligonucleotide; CTC chr2 60530187 60530208 60530192 60530187 -
ttgttagaggcgcagcctttcc

SEQ ID NO: 214304 - DNA, 22 bp, Artificial Sequence
  Synthetic oligonucleotide; CTT chr2 60530185 60530206 60530190 60530185 -
gttagaggcgcagcctttcctg

SEQ ID NO: 214305 - DNA, 22 bp, Artificial Sequence
  Synthetic oligonucleotide; TTG chr2 60530184 60530205 60530189 60530184 -
ttagaggcgcagcctttcctgg

SEQ ID NO: 214306 - DNA, 22 bp, Artificial Sequence
  Synthetic oligonucleotide; TTA chr2 60530181 60530202 60530186 60530181 -
gaggcgcagcctttcctgggca

SEQ ID NO: 214307 - DNA, 22 bp, Artificial Sequence
  Synthetic oligonucleotide; CTT chr2 60530168 60530189 60530173 60530168 -
tcctgggcaggacccaggaccg

SEQ ID NO: 214308 - DNA, 22 bp, Artificial Sequence
  Synthetic oligonucleotide; TTT chr2 60530167 60530188 60530172 60530167 -
cctgggcaggacccaggaccga

SEQ ID NO: 214309 - DNA, 22 bp, Artificial Sequence
  Synthetic oligonucleotide; TTC chr2 60530166 60530187 60530171 60530166 -
ctgggcaggacccaggaccgat

SEQ ID NO: 214310 - DNA, 22 bp, Artificial Sequence
  Synthetic oligonucleotide; CTG chr2 60530163 60530184 60530168 60530163 -
ggcaggacccaggaccgatggc

SEQ ID NO: 214311 - DNA, 22 bp, Artificial Sequence
  Synthetic oligonucleotide; TTT chr2 60530127 60530148 60530132 60530127 -
gggcttgttttgttctcgattt

SEQ ID NO: 214312 - DNA, 22 bp, Artificial Sequence
  Synthetic oligonucleotide; TTG chr2 60530126 60530147 60530131 60530126 -
ggcttgttttgttctcgatttt

SEQ ID NO: 214313 - DNA, 22 bp, Artificial Sequence
  Synthetic oligonucleotide; CTT chr2 60530121 60530142 60530126 60530121 -
gttttgttctcgattttcttat

SEQ ID NO: 214314 - DNA, 22 bp, Artificial Sequence
  Synthetic oligonucleotide; TTG chr2 60530120 60530141 60530125 60530120 -
ttttgttctcgattttcttatc

SEQ ID NO: 214315 - DNA, 22 bp, Artificial Sequence
  Synthetic oligonucleotide; TTT chr2 60530117 60530138 60530122 60530117 -
tgttctcgattttcttatcttc

SEQ ID NO: 214316 - DNA, 22 bp, Artificial Sequence
  Synthetic oligonucleotide; TTT chr2 60530116 60530137 60530121 60530116 -
gttctcgattttcttatcttct

SEQ ID NO: 214317 - DNA, 22 bp, Artificial Sequence
  Synthetic oligonucleotide; TTG chr2 60530115 60530136 60530120 60530115 -
ttctcgattttcttatcttctt

SEQ ID NO: 214318 - DNA, 22 bp, Artificial Sequence
  Synthetic oligonucleotide; TTC chr2 60530112 60530133 60530117 60530112 -
tcgattttcttatcttcttggc

SEQ ID NO: 214319 - DNA, 22 bp, Artificial Sequence
  Synthetic oligonucleotide; CTC chr2 60530110 60530131 60530115 60530110 -
gattttcttatcttcttggcct

SEQ ID NO: 214320 - DNA, 22 bp, Artificial Sequence
  Synthetic oligonucleotide; TTT chr2 60530105 60530126 60530110 60530105 -
tcttatcttcttggcctcttcc

SEQ ID NO: 214321 - DNA, 22 bp, Artificial Sequence
  Synthetic oligonucleotide; TTT chr2 60530104 60530125 60530109 60530104 -
cttatcttcttggcctcttcct

SEQ ID NO: 214322 - DNA, 22 bp, Artificial Sequence
  Synthetic oligonucleotide; TTC chr2 60530103 60530124 60530108 60530103 -
ttatcttcttggcctcttcctg

SEQ ID NO: 214323 - DNA, 22 bp, Artificial Sequence
  Synthetic oligonucleotide; CTT chr2 60530101 60530122 60530106 60530101 -
atcttcttggcctcttcctgtg

SEQ ID NO: 214324 - DNA, 22 bp, Artificial Sequence
  Synthetic oligonucleotide; TTA chr2 60530100 60530121 60530105 60530100 -
tcttcttggcctcttcctgtgt

SEQ ID NO: 214325 - DNA, 22 bp, Artificial Sequence
  Synthetic oligonucleotide; CTT chr2 60530096 60530117 60530101 60530096 -
cttggcctcttcctgtgttttt

SEQ ID NO: 214326 - DNA, 22 bp, Artificial Sequence
  Synthetic oligonucleotide; TTC chr2 60530095 60530116 60530100 60530095 -
ttggcctcttcctgtgtttttt

SEQ ID NO: 214327 - DNA, 22 bp, Artificial Sequence
  Synthetic oligonucleotide; CTT chr2 60530093 60530114 60530098 60530093 -
ggcctcttcctgtgttttttag

SEQ ID NO: 214328 - DNA, 22 bp, Artificial Sequence
  Synthetic oligonucleotide; TTG chr2 60530092 60530113 60530097 60530092 -
gcctcttcctgtgttttttagt

SEQ ID NO: 214329 - DNA, 22 bp, Artificial Sequence
  Synthetic oligonucleotide; CTC chr2 60530087 60530108 60530092 60530087 -
ttcctgtgttttttagtttatt

SEQ ID NO: 214330 - DNA, 22 bp, Artificial Sequence
  Synthetic oligonucleotide; CTT chr2 60530085 60530106 60530090 60530085 -
cctgtgttttttagtttattgt

SEQ ID NO: 214331 - DNA, 22 bp, Artificial Sequence
  Synthetic oligonucleotide; TTC chr2 60530084 60530105 60530089 60530084 -
ctgtgttttttagtttattgtg

SEQ ID NO: 214332 - DNA, 22 bp, Artificial Sequence
  Synthetic oligonucleotide; CTG chr2 60530081 60530102 60530086 60530081 -
tgttttttagtttattgtgaca

SEQ ID NO: 214333 - DNA, 22 bp, Artificial Sequence
  Synthetic oligonucleotide; TTT chr2 60530076 60530097 60530081 60530076 -
tttagtttattgtgacattatg

SEQ ID NO: 214334 - DNA, 22 bp, Artificial Sequence
  Synthetic oligonucleotide; TTT chr2 60530075 60530096 60530080 60530075 -
ttagtttattgtgacattatgc

SEQ ID NO: 214335 - DNA, 22 bp, Artificial Sequence
  Synthetic oligonucleotide; TTT chr2 60530074 60530095 60530079 60530074 -
tagtttattgtgacattatgca

SEQ ID NO: 214336 - DNA, 22 bp, Artificial Sequence
  Synthetic oligonucleotide; TTT chr2 60530073 60530094 60530078 60530073 -
agtttattgtgacattatgcat

SEQ ID NO: 214337 - DNA, 22 bp, Artificial Sequence
  Synthetic oligonucleotide; TTA chr2 60530072 60530093 60530077 60530072 -
gtttattgtgacattatgcatt

SEQ ID NO: 214338 - DNA, 22 bp, Artificial Sequence
  Synthetic oligonucleotide; TTT chr2 60530068 60530089 60530073 60530068 -
attgtgacattatgcattcata

SEQ ID NO: 214339 - DNA, 22 bp, Artificial Sequence
  Synthetic oligonucleotide; TTA chr2 60530067 60530088 60530072 60530067 -
ttgtgacattatgcattcatat

SEQ ID NO: 214340 - DNA, 22 bp, Artificial Sequence
  Synthetic oligonucleotide; TTG chr2 60530064 60530085 60530069 60530064 -
tgacattatgcattcatatatg

SEQ ID NO: 214341 - DNA, 22 bp, Artificial Sequence
  Synthetic oligonucleotide; TTA chr2 60530056 60530077 60530061 60530056 -
tgcattcatatatgaatgttgg

SEQ ID NO: 214342 - DNA, 22 bp, Artificial Sequence
  Synthetic oligonucleotide; TTC chr2 60530049 60530070 60530054 60530049 -
atatatgaatgttggcaagcag

SEQ ID NO: 214343 - DNA, 22 bp, Artificial Sequence
  Synthetic oligonucleotide; TTG chr2 60530035 60530056 60530040 60530035 -
gcaagcaggagtcatcatccca

SEQ ID NO: 214344 - DNA, 22 bp, Artificial Sequence
  Synthetic oligonucleotide; CTT chr2 60530006 60530027 60530011 60530006 -
cctgacatttttagctctttta

SEQ ID NO: 214345 - DNA, 22 bp, Artificial Sequence
  Synthetic oligonucleotide; TTC chr2 60530005 60530026 60530010 60530005 -
ctgacatttttagctcttttaa

SEQ ID NO: 214346 - DNA, 22 bp, Artificial Sequence
  Synthetic oligonucleotide; CTG chr2 60530002 60530023 60530007 60530002 -
acatttttagctcttttaatgt

SEQ ID NO: 214347 - DNA, 22 bp, Artificial Sequence
  Synthetic oligonucleotide; TTT chr2 60529996 60530017 60530001 60529996 -
ttagctcttttaatgtgcagtc

SEQ ID NO: 214348 - DNA, 22 bp, Artificial Sequence
  Synthetic oligonucleotide; TTT chr2 60529995 60530016 60530000 60529995 -
tagctcttttaatgtgcagtct

SEQ ID NO: 214349 - DNA, 22 bp, Artificial Sequence
  Synthetic oligonucleotide; TTT chr2 60529994 60530015 60529999 60529994 -
agctcttttaatgtgcagtctt

SEQ ID NO: 214350 - DNA, 22 bp, Artificial Sequence
  Synthetic oligonucleotide; TTA chr2 60529993 60530014 60529998 60529993 -
gctcttttaatgtgcagtcttt

SEQ ID NO: 214351 - DNA, 22 bp, Artificial Sequence
  Synthetic oligonucleotide; CTC chr2 60529989 60530010 60529994 60529989 -
ttttaatgtgcagtctttgccc

SEQ ID NO: 214352 - DNA, 22 bp, Artificial Sequence
  Synthetic oligonucleotide; CTT chr2 60529987 60530008 60529992 60529987 -
ttaatgtgcagtctttgccctc

SEQ ID NO: 214353 - DNA, 22 bp, Artificial Sequence
  Synthetic oligonucleotide; TTT chr2 60529986 60530007 60529991 60529986 -
taatgtgcagtctttgccctcc

SEQ ID NO: 214354 - DNA, 22 bp, Artificial Sequence
  Synthetic oligonucleotide; TTT chr2 60529985 60530006 60529990 60529985 -
aatgtgcagtctttgccctcct

SEQ ID NO: 214355 - DNA, 22 bp, Artificial Sequence
  Synthetic oligonucleotide; TTA chr2 60529984 60530005 60529989 60529984 -
atgtgcagtctttgccctcctg

SEQ ID NO: 214356 - DNA, 22 bp, Artificial Sequence
  Synthetic oligonucleotide; CTT chr2 60529972 60529993 60529977 60529972 -
tgccctcctgccacaagtggcg

SEQ ID NO: 214357 - DNA, 22 bp, Artificial Sequence
  Synthetic oligonucleotide; TTT chr2 60529971 60529992 60529976 60529971 -
gccctcctgccacaagtggcga

SEQ ID NO: 214358 - DNA, 22 bp, Artificial Sequence
  Synthetic oligonucleotide; TTG chr2 60529970 60529991 60529975 60529970 -
ccctcctgccacaagtggcgaa

SEQ ID NO: 214359 - DNA, 22 bp, Artificial Sequence
  Synthetic oligonucleotide; CTC chr2 60529965 60529986 60529970 60529965 -
ctgccacaagtggcgaagtaat

SEQ ID NO: 214360 - DNA, 22 bp, Artificial Sequence
  Synthetic oligonucleotide; CTG chr2 60529962 60529983 60529967 60529962 -
ccacaagtggcgaagtaattga

SEQ ID NO: 214361 - DNA, 22 bp, Artificial Sequence
  Synthetic oligonucleotide; TTG chr2 60529941 60529962 60529946 60529941 -
aatttccctgttactaactggc

SEQ ID NO: 214362 - DNA, 22 bp, Artificial Sequence
  Synthetic oligonucleotide; TTT chr2 60529936 60529957 60529941 60529936 -
ccctgttactaactggcaggag

SEQ ID NO: 214363 - DNA, 22 bp, Artificial Sequence
  Synthetic oligonucleotide; TTC chr2 60529935 60529956 60529940 60529935 -
cctgttactaactggcaggagg

SEQ ID NO: 214364 - DNA, 22 bp, Artificial Sequence
  Synthetic oligonucleotide; CTG chr2 60529931 60529952 60529936 60529931 -
ttactaactggcaggaggcatg

SEQ ID NO: 214365 - DNA, 22 bp, Artificial Sequence
  Synthetic oligonucleotide; TTA chr2 60529928 60529949 60529933 60529928 -
ctaactggcaggaggcatgttc

SEQ ID NO: 214366 - DNA, 22 bp, Artificial Sequence
  Synthetic oligonucleotide; CTA chr2 60529925 60529946 60529930 60529925 -
actggcaggaggcatgttctag

SEQ ID NO: 214367 - DNA, 22 bp, Artificial Sequence
  Synthetic oligonucleotide; CTG chr2 60529921 60529942 60529926 60529921 -
gcaggaggcatgttctagttcc

SEQ ID NO: 214368 - DNA, 22 bp, Artificial Sequence
  Synthetic oligonucleotide; TTC chr2 60529906 60529927 60529911 60529906 -
tagttcccaccagaggagctgc

SEQ ID NO: 214369 - DNA, 22 bp, Artificial Sequence
  Synthetic oligonucleotide; CTA chr2 60529904 60529925 60529909 60529904 -
gttcccaccagaggagctgctg

SEQ ID NO: 214370 - DNA, 22 bp, Artificial Sequence
  Synthetic oligonucleotide; TTC chr2 60529900 60529921 60529905 60529900 -
ccaccagaggagctgctggggc

SEQ ID NO: 214371 - DNA, 22 bp, Artificial Sequence
  Synthetic oligonucleotide; CTG chr2 60529885 60529906 60529890 60529885 -
ctggggctaaagctgggttcat

SEQ ID NO: 214372 - DNA, 22 bp, Artificial Sequence
  Synthetic oligonucleotide; CTG chr2 60529882 60529903 60529887 60529882 -
gggctaaagctgggttcataga

SEQ ID NO: 214373 - DNA, 22 bp, Artificial Sequence
  Synthetic oligonucleotide; CTA chr2 60529876 60529897 60529881 60529876 -
aagctgggttcatagaatccca

SEQ ID NO: 214374 - DNA, 22 bp, Artificial Sequence
  Synthetic oligonucleotide; CTG chr2 60529870 60529891 60529875 60529870 -
ggttcatagaatcccacctagg

SEQ ID NO: 214375 - DNA, 22 bp, Artificial Sequence
  Synthetic oligonucleotide; TTC chr2 60529865 60529886 60529870 60529865 -
atagaatcccacctaggggaca

SEQ ID NO: 214376 - DNA, 22 bp, Artificial Sequence
  Synthetic oligonucleotide; CTA chr2 60529850 60529871 60529855 60529850 -
ggggacaccagggctttcaagt

SEQ ID NO: 214377 - DNA, 22 bp, Artificial Sequence
  Synthetic oligonucleotide; CTT chr2 60529834 60529855 60529839 60529834 -
tcaagtggtttggggacctgtc

SEQ ID NO: 214378 - DNA, 22 bp, Artificial Sequence
  Synthetic oligonucleotide; TTT chr2 60529833 60529854 60529838 60529833 -
caagtggtttggggacctgtct

SEQ ID NO: 214379 - DNA, 22 bp, Artificial Sequence
  Synthetic oligonucleotide; TTC chr2 60529832 60529853 60529837 60529832 -
aagtggtttggggacctgtctg

SEQ ID NO: 214380 - DNA, 22 bp, Artificial Sequence
  Synthetic oligonucleotide; TTT chr2 60529823 60529844 60529828 60529823 -
ggggacctgtctgaaatgatat

SEQ ID NO: 214381 - DNA, 22 bp, Artificial Sequence
  Synthetic oligonucleotide; TTG chr2 60529822 60529843 60529827 60529822 -
gggacctgtctgaaatgatatt

SEQ ID NO: 214382 - DNA, 22 bp, Artificial Sequence
  Synthetic oligonucleotide; CTG chr2 60529814 60529835 60529819 60529814 -
tctgaaatgatattcacacaat

SEQ ID NO: 214383 - DNA, 22 bp, Artificial Sequence
  Synthetic oligonucleotide; CTG chr2 60529810 60529831 60529815 60529810 -
aaatgatattcacacaataaaa

SEQ ID NO: 214384 - DNA, 22 bp, Artificial Sequence
  Synthetic oligonucleotide; TTC chr2 60529799 60529820 60529804 60529799 -
acacaataaaaaatatttttcc

SEQ ID NO: 214385 - DNA, 22 bp, Artificial Sequence
  Synthetic oligonucleotide; TTT chr2 60529781 60529802 60529786 60529781 -
ttcccatcatagacttgaaaag

SEQ ID NO: 214386 - DNA, 22 bp, Artificial Sequence
  Synthetic oligonucleotide; TTT chr2 60529780 60529801 60529785 60529780 -
tcccatcatagacttgaaaagg

SEQ ID NO: 214387 - DNA, 22 bp, Artificial Sequence
  Synthetic oligonucleotide; TTT chr2 60529779 60529800 60529784 60529779 -
cccatcatagacttgaaaaggc

SEQ ID NO: 214388 - DNA, 22 bp, Artificial Sequence
  Synthetic oligonucleotide; TTC chr2 60529778 60529799 60529783 60529778 -
ccatcatagacttgaaaaggca

SEQ ID NO: 214389 - DNA, 22 bp, Artificial Sequence
  Synthetic oligonucleotide; CTT chr2 60529765 60529786 60529770 60529765 -
gaaaaggcaccattgtgcacat

SEQ ID NO: 214390 - DNA, 22 bp, Artificial Sequence
  Synthetic oligonucleotide; TTG chr2 60529764 60529785 60529769 60529764 -
aaaaggcaccattgtgcacatc

SEQ ID NO: 214391 - DNA, 22 bp, Artificial Sequence
  Synthetic oligonucleotide; TTG chr2 60529750 60529771 60529755 60529750 -
tgcacatctatataaaatgtga

SEQ ID NO: 214392 - DNA, 22 bp, Artificial Sequence
  Synthetic oligonucleotide; CTA chr2 60529740 60529761 60529745 60529740 -
tataaaatgtgataaaatcaca

SEQ ID NO: 214393 - DNA, 22 bp, Artificial Sequence
  Synthetic oligonucleotide; TTT chr2 60529715 60529736 60529720 60529715 -
acttcccctggctaggcctcat

SEQ ID NO: 214394 - DNA, 22 bp, Artificial Sequence
  Synthetic oligonucleotide; TTA chr2 60529714 60529735 60529719 60529714 -
cttcccctggctaggcctcata

SEQ ID NO: 214395 - DNA, 22 bp, Artificial Sequence
  Synthetic oligonucleotide; CTT chr2 60529711 60529732 60529716 60529711 -
cccctggctaggcctcataagg

SEQ ID NO: 214396 - DNA, 22 bp, Artificial Sequence
  Synthetic oligonucleotide; TTC chr2 60529710 60529731 60529715 60529710 -
ccctggctaggcctcataaggg

SEQ ID NO: 214397 - DNA, 22 bp, Artificial Sequence
  Synthetic oligonucleotide; CTG chr2 60529705 60529726 60529710 60529705 -
gctaggcctcataagggaggca

SEQ ID NO: 214398 - DNA, 22 bp, Artificial Sequence
  Synthetic oligonucleotide; CTA chr2 60529701 60529722 60529706 60529701 -
ggcctcataagggaggcaggat

SEQ ID NO: 214399 - DNA, 22 bp, Artificial Sequence
  Synthetic oligonucleotide; CTC chr2 60529695 60529716 60529700 60529695 -
ataagggaggcaggatttcctt

SEQ ID NO: 214400 - DNA, 22 bp, Artificial Sequence
  Synthetic oligonucleotide; TTT chr2 60529677 60529698 60529682 60529677 -
ccttctccttttctagtagcaa

SEQ ID NO: 214401 - DNA, 22 bp, Artificial Sequence
  Synthetic oligonucleotide; TTC chr2 60529676 60529697 60529681 60529676 -
cttctccttttctagtagcaaa

SEQ ID NO: 214402 - DNA, 22 bp, Artificial Sequence
  Synthetic oligonucleotide; CTT chr2 60529673 60529694 60529678 60529673 -
ctccttttctagtagcaaataa

SEQ ID NO: 214403 - DNA, 22 bp, Artificial Sequence
  Synthetic oligonucleotide; TTC chr2 60529672 60529693 60529677 60529672 -
tccttttctagtagcaaataaa

SEQ ID NO: 214404 - DNA, 22 bp, Artificial Sequence
  Synthetic oligonucleotide; CTC chr2 60529670 60529691 60529675 60529670 -
cttttctagtagcaaataaaaa

SEQ ID NO: 214405 - DNA, 22 bp, Artificial Sequence
  Synthetic oligonucleotide; CTT chr2 60529667 60529688 60529672 60529667 -
ttctagtagcaaataaaaactg

SEQ ID NO: 214406 - DNA, 22 bp, Artificial Sequence
  Synthetic oligonucleotide; TTT chr2 60529666 60529687 60529671 60529666 -
tctagtagcaaataaaaactgg

SEQ ID NO: 214407 - DNA, 22 bp, Artificial Sequence
  Synthetic oligonucleotide; TTT chr2 60529665 60529686 60529670 60529665 -
ctagtagcaaataaaaactggg

SEQ ID NO: 214408 - DNA, 22 bp, Artificial Sequence
  Synthetic oligonucleotide; TTC chr2 60529664 60529685 60529669 60529664 -
tagtagcaaataaaaactggga

SEQ ID NO: 214409 - DNA, 22 bp, Artificial Sequence
  Synthetic oligonucleotide; CTA chr2 60529662 60529683 60529667 60529662 -
gtagcaaataaaaactgggaaa

SEQ ID NO: 214410 - DNA, 22 bp, Artificial Sequence
  Synthetic oligonucleotide; CTG chr2 60529645 60529666 60529650 60529645 -
ggaaaatttgggggcctctggg

SEQ ID NO: 214411 - DNA, 22 bp, Artificial Sequence
  Synthetic oligonucleotide; TTT chr2 60529636 60529657 60529641 60529636 -
gggggcctctgggtttatccca

SEQ ID NO: 214412 - DNA, 22 bp, Artificial Sequence
  Synthetic oligonucleotide; TTG chr2 60529635 60529656 60529640 60529635 -
ggggcctctgggtttatcccat

SEQ ID NO: 214413 - DNA, 22 bp, Artificial Sequence
  Synthetic oligonucleotide; CTC chr2 60529627 60529648 60529632 60529627 -
tgggtttatcccatggatacct

SEQ ID NO: 214414 - DNA, 22 bp, Artificial Sequence
  Synthetic oligonucleotide; CTG chr2 60529625 60529646 60529630 60529625 -
ggtttatcccatggatacctgc

SEQ ID NO: 214415 - DNA, 22 bp, Artificial Sequence
  Synthetic oligonucleotide; TTT chr2 60529620 60529641 60529625 60529620 -
atcccatggatacctgcccccg

SEQ ID NO: 214416 - DNA, 22 bp, Artificial Sequence
  Synthetic oligonucleotide; TTA chr2 60529619 60529640 60529624 60529619 -
tcccatggatacctgcccccgc

SEQ ID NO: 214417 - DNA, 22 bp, Artificial Sequence
  Synthetic oligonucleotide; CTG chr2 60529604 60529625 60529609 60529604 -
cccccgctcccgcccgccaact

SEQ ID NO: 214418 - DNA, 22 bp, Artificial Sequence
  Synthetic oligonucleotide; CTC chr2 60529595 60529616 60529600 60529595 -
ccgcccgccaactcagccaagc

SEQ ID NO: 214419 - DNA, 22 bp, Artificial Sequence
  Synthetic oligonucleotide; CTC chr2 60529581 60529602 60529586 60529581 -
agccaagcccttagaggcagtc

SEQ ID NO: 214420 - DNA, 22 bp, Artificial Sequence
  Synthetic oligonucleotide; CTT chr2 60529569 60529590 60529574 60529569 -
agaggcagtcttctctcccacc

SEQ ID NO: 214421 - DNA, 22 bp, Artificial Sequence
  Synthetic oligonucleotide; TTA chr2 60529568 60529589 60529573 60529568 -
gaggcagtcttctctcccacct

SEQ ID NO: 214422 - DNA, 22 bp, Artificial Sequence
  Synthetic oligonucleotide; CTT chr2 60529557 60529578 60529562 60529557 -
ctctcccacctagatgtctttg

SEQ ID NO: 214423 - DNA, 22 bp, Artificial Sequence
  Synthetic oligonucleotide; TTC chr2 60529556 60529577 60529561 60529556 -
tctcccacctagatgtctttgt

SEQ ID NO: 214424 - DNA, 22 bp, Artificial Sequence
  Synthetic oligonucleotide; CTC chr2 60529554 60529575 60529559 60529554 -
tcccacctagatgtctttgtaa

SEQ ID NO: 214425 - DNA, 22 bp, Artificial Sequence
  Synthetic oligonucleotide; CTC chr2 60529552 60529573 60529557 60529552 -
ccacctagatgtctttgtaacc

SEQ ID NO: 214426 - DNA, 22 bp, Artificial Sequence
  Synthetic oligonucleotide; CTA chr2 60529545 60529566 60529550 60529545 -
gatgtctttgtaacctgagctg

SEQ ID NO: 214427 - DNA, 22 bp, Artificial Sequence
  Synthetic oligonucleotide; CTT chr2 60529537 60529558 60529542 60529537 -
tgtaacctgagctggtaagaaa

SEQ ID NO: 214428 - DNA, 22 bp, Artificial Sequence
  Synthetic oligonucleotide; TTT chr2 60529536 60529557 60529541 60529536 -
gtaacctgagctggtaagaaag

SEQ ID NO: 214429 - DNA, 22 bp, Artificial Sequence
  Synthetic oligonucleotide; TTG chr2 60529535 60529556 60529540 60529535 -
taacctgagctggtaagaaagg

SEQ ID NO: 214430 - DNA, 22 bp, Artificial Sequence
  Synthetic oligonucleotide; CTG chr2 60529528 60529549 60529533 60529528 -
agctggtaagaaagggaggagg

SEQ ID NO: 214431 - DNA, 22 bp, Artificial Sequence
  Synthetic oligonucleotide; CTG chr2 60529523 60529544 60529528 60529523 -
gtaagaaagggaggagggacag

SEQ ID NO: 214432 - DNA, 22 bp, Artificial Sequence
  Synthetic oligonucleotide; CTT chr2 60529480 60529501 60529485 60529480 -
gacatatgatgtatcttctttc

SEQ ID NO: 214433 - DNA, 22 bp, Artificial Sequence
  Synthetic oligonucleotide; TTG chr2 60529479 60529500 60529484 60529479 -
acatatgatgtatcttctttct

SEQ ID NO: 214434 - DNA, 22 bp, Artificial Sequence
  Synthetic oligonucleotide; CTT chr2 60529463 60529484 60529468 60529463 -
ctttcttttcttcttctctttg

SEQ ID NO: 214435 - DNA, 22 bp, Artificial Sequence
  Synthetic oligonucleotide; TTC chr2 60529462 60529483 60529467 60529462 -
tttcttttcttcttctctttga

SEQ ID NO: 214436 - DNA, 22 bp, Artificial Sequence
  Synthetic oligonucleotide; CTT chr2 60529460 60529481 60529465 60529460 -
tcttttcttcttctctttgatt

SEQ ID NO: 214437 - DNA, 22 bp, Artificial Sequence
  Synthetic oligonucleotide; TTT chr2 60529459 60529480 60529464 60529459 -
cttttcttcttctctttgatta

SEQ ID NO: 214438 - DNA, 22 bp, Artificial Sequence
  Synthetic oligonucleotide; TTC chr2 60529458 60529479 60529463 60529458 -
ttttcttcttctctttgattac

SEQ ID NO: 214439 - DNA, 22 bp, Artificial Sequence
  Synthetic oligonucleotide; CTT chr2 60529456 60529477 60529461 60529456 -
ttcttcttctctttgattacac

SEQ ID NO: 214440 - DNA, 22 bp, Artificial Sequence
  Synthetic oligonucleotide; TTT chr2 60529455 60529476 60529460 60529455 -
tcttcttctctttgattacacg

SEQ ID NO: 214441 - DNA, 22 bp, Artificial Sequence
  Synthetic oligonucleotide; TTT chr2 60529454 60529475 60529459 60529454 -
cttcttctctttgattacacga

SEQ ID NO: 214442 - DNA, 22 bp, Artificial Sequence
  Synthetic oligonucleotide; TTC chr2 60529453 60529474 60529458 60529453 -
ttcttctctttgattacacgaa

SEQ ID NO: 214443 - DNA, 22 bp, Artificial Sequence
  Synthetic oligonucleotide; CTT chr2 60529451 60529472 60529456 60529451 -
cttctctttgattacacgaaat

SEQ ID NO: 214444 - DNA, 22 bp, Artificial Sequence
  Synthetic oligonucleotide; TTC chr2 60529450 60529471 60529455 60529450 -
ttctctttgattacacgaaata

SEQ ID NO: 214445 - DNA, 22 bp, Artificial Sequence
  Synthetic oligonucleotide; CTT chr2 60529448 60529469 60529453 60529448 -
ctctttgattacacgaaataaa

SEQ ID NO: 214446 - DNA, 22 bp, Artificial Sequence
  Synthetic oligonucleotide; TTC chr2 60529447 60529468 60529452 60529447 -
tctttgattacacgaaataaaa

SEQ ID NO: 214447 - DNA, 22 bp, Artificial Sequence
  Synthetic oligonucleotide; CTC chr2 60529445 60529466 60529450 60529445 -
tttgattacacgaaataaaatg

SEQ ID NO: 214448 - DNA, 22 bp, Artificial Sequence
  Synthetic oligonucleotide; CTT chr2 60529443 60529464 60529448 60529443 -
tgattacacgaaataaaatggt

SEQ ID NO: 214449 - DNA, 22 bp, Artificial Sequence
  Synthetic oligonucleotide; TTT chr2 60529442 60529463 60529447 60529442 -
gattacacgaaataaaatggtt

SEQ ID NO: 214450 - DNA, 22 bp, Artificial Sequence
  Synthetic oligonucleotide; TTG chr2 60529441 60529462 60529446 60529441 -
attacacgaaataaaatggttt

SEQ ID NO: 214451 - DNA, 22 bp, Artificial Sequence
  Synthetic oligonucleotide; TTA chr2 60529437 60529458 60529442 60529437 -
cacgaaataaaatggtttaggc

SEQ ID NO: 214452 - DNA, 22 bp, Artificial Sequence
  Synthetic oligonucleotide; TTT chr2 60529419 60529440 60529424 60529419 -
aggctgagggtaaagaagtaat

SEQ ID NO: 214453 - DNA, 22 bp, Artificial Sequence
  Synthetic oligonucleotide; TTA chr2 60529418 60529439 60529423 60529418 -
ggctgagggtaaagaagtaata

SEQ ID NO: 214454 - DNA, 22 bp, Artificial Sequence
  Synthetic oligonucleotide; CTG chr2 60529413 60529434 60529418 60529413 -
agggtaaagaagtaataccatt

SEQ ID NO: 214455 - DNA, 22 bp, Artificial Sequence
  Synthetic oligonucleotide; TTT chr2 60529390 60529411 60529395 60529390 -
ctagttgtgcaaccttgggcag

SEQ ID NO: 214456 - DNA, 22 bp, Artificial Sequence
  Synthetic oligonucleotide; TTC chr2 60529389 60529410 60529394 60529389 -
tagttgtgcaaccttgggcaga

SEQ ID NO: 214457 - DNA, 22 bp, Artificial Sequence
  Synthetic oligonucleotide; CTA chr2 60529387 60529408 60529392 60529387 -
gttgtgcaaccttgggcagatt

SEQ ID NO: 214458 - DNA, 22 bp, Artificial Sequence
  Synthetic oligonucleotide; TTG chr2 60529383 60529404 60529388 60529383 -
tgcaaccttgggcagatttcat

SEQ ID NO: 214459 - DNA, 22 bp, Artificial Sequence
  Synthetic oligonucleotide; CTT chr2 60529374 60529395 60529379 60529374 -
gggcagatttcattccctaagc

SEQ ID NO: 214460 - DNA, 22 bp, Artificial Sequence
  Synthetic oligonucleotide; TTG chr2 60529373 60529394 60529378 60529373 -
ggcagatttcattccctaagcc

SEQ ID NO: 214461 - DNA, 22 bp, Artificial Sequence
  Synthetic oligonucleotide; TTT chr2 60529364 60529385 60529369 60529364 -
cattccctaagcctccgcttcc

SEQ ID NO: 214462 - DNA, 22 bp, Artificial Sequence
  Synthetic oligonucleotide; TTC chr2 60529363 60529384 60529368 60529363 -
attccctaagcctccgcttcct

SEQ ID NO: 214463 - DNA, 22 bp, Artificial Sequence
  Synthetic oligonucleotide; TTC chr2 60529359 60529380 60529364 60529359 -
cctaagcctccgcttcctcaat

SEQ ID NO: 214464 - DNA, 22 bp, Artificial Sequence
  Synthetic oligonucleotide; CTA chr2 60529355 60529376 60529360 60529355 -
agcctccgcttcctcaatctgt

SEQ ID NO: 214465 - DNA, 22 bp, Artificial Sequence
  Synthetic oligonucleotide; CTC chr2 60529349 60529370 60529354 60529349 -
cgcttcctcaatctgtaaagtg

SEQ ID NO: 214466 - DNA, 22 bp, Artificial Sequence
  Synthetic oligonucleotide; CTT chr2 60529344 60529365 60529349 60529344 -
cctcaatctgtaaagtggggag

SEQ ID NO: 214467 - DNA, 22 bp, Artificial Sequence
  Synthetic oligonucleotide; TTC chr2 60529343 60529364 60529348 60529343 -
ctcaatctgtaaagtggggaga

SEQ ID NO: 214468 - DNA, 22 bp, Artificial Sequence
  Synthetic oligonucleotide; CTC chr2 60529340 60529361 60529345 60529340 -
aatctgtaaagtggggagaatc

SEQ ID NO: 214469 - DNA, 22 bp, Artificial Sequence
  Synthetic oligonucleotide; CTG chr2 60529334 60529355 60529339 60529334 -
taaagtggggagaatcacgggg

SEQ ID NO: 214470 - DNA, 22 bp, Artificial Sequence
  Synthetic oligonucleotide; CTT chr2 60529309 60529330 60529314 60529309 -
gcctcatagggcctttgagcat

SEQ ID NO: 214471 - DNA, 22 bp, Artificial Sequence
  Synthetic oligonucleotide; TTG chr2 60529308 60529329 60529313 60529308 -
cctcatagggcctttgagcatc

SEQ ID NO: 214472 - DNA, 22 bp, Artificial Sequence
  Synthetic oligonucleotide; CTC chr2 60529304 60529325 60529309 60529304 -
atagggcctttgagcatcctat

SEQ ID NO: 214473 - DNA, 22 bp, Artificial Sequence
  Synthetic oligonucleotide; CTT chr2 60529294 60529315 60529299 60529294 -
tgagcatcctatgagagcatgt

SEQ ID NO: 214474 - DNA, 22 bp, Artificial Sequence
  Synthetic oligonucleotide; TTT chr2 60529293 60529314 60529298 60529293 -
gagcatcctatgagagcatgtg

SEQ ID NO: 214475 - DNA, 22 bp, Artificial Sequence
  Synthetic oligonucleotide; TTG chr2 60529292 60529313 60529297 60529292 -
agcatcctatgagagcatgtgg

SEQ ID NO: 214476 - DNA, 22 bp, Artificial Sequence
  Synthetic oligonucleotide; CTA chr2 60529283 60529304 60529288 60529283 -
tgagagcatgtgggggcgctgg

SEQ ID NO: 214477 - DNA, 22 bp, Artificial Sequence
  Synthetic oligonucleotide; CTG chr2 60529262 60529283 60529267 60529262 -
ggctcagtgctgggcacatggt

SEQ ID NO: 214478 - DNA, 22 bp, Artificial Sequence
  Synthetic oligonucleotide; CTC chr2 60529257 60529278 60529262 60529257 -
agtgctgggcacatggtaaaac

SEQ ID NO: 214479 - DNA, 22 bp, Artificial Sequence
  Synthetic oligonucleotide; CTG chr2 60529250 60529271 60529255 60529250 -
ggcacatggtaaaacatgtcac

SEQ ID NO: 214480 - DNA, 22 bp, Artificial Sequence
  Synthetic oligonucleotide; CTC chr2 60529220 60529241 60529225 60529220 -
attactattacggttatgactc

SEQ ID NO: 214481 - DNA, 22 bp, Artificial Sequence
  Synthetic oligonucleotide; TTA chr2 60529216 60529237 60529221 60529216 -
ctattacggttatgactcatgg

SEQ ID NO: 214482 - DNA, 22 bp, Artificial Sequence
  Synthetic oligonucleotide; CTA chr2 60529213 60529234 60529218 60529213 -
ttacggttatgactcatggctt

SEQ ID NO: 214483 - DNA, 22 bp, Artificial Sequence
  Synthetic oligonucleotide; TTA chr2 60529210 60529231 60529215 60529210 -
cggttatgactcatggcttgga

SEQ ID NO: 214484 - DNA, 22 bp, Artificial Sequence
  Synthetic oligonucleotide; TTA chr2 60529204 60529225 60529209 60529204 -
tgactcatggcttggaactgtg

SEQ ID NO: 214485 - DNA, 22 bp, Artificial Sequence
  Synthetic oligonucleotide; CTC chr2 60529198 60529219 60529203 60529198 -
atggcttggaactgtgtgctcc

SEQ ID NO: 214486 - DNA, 22 bp, Artificial Sequence
  Synthetic oligonucleotide; CTT chr2 60529191 60529212 60529196 60529191 -
ggaactgtgtgctcctggggtc

SEQ ID NO: 214487 - DNA, 22 bp, Artificial Sequence
  Synthetic oligonucleotide; TTG chr2 60529190 60529211 60529195 60529190 -
gaactgtgtgctcctggggtct

SEQ ID NO: 214488 - DNA, 22 bp, Artificial Sequence
  Synthetic oligonucleotide; CTG chr2 60529184 60529205 60529189 60529184 -
tgtgctcctggggtctcaaagt

SEQ ID NO: 214489 - DNA, 22 bp, Artificial Sequence
  Synthetic oligonucleotide; CTC chr2 60529177 60529198 60529182 60529177 -
ctggggtctcaaagtagttccc

SEQ ID NO: 214490 - DNA, 22 bp, Artificial Sequence
  Synthetic oligonucleotide; CTG chr2 60529174 60529195 60529179 60529174 -
gggtctcaaagtagttccccca

SEQ ID NO: 214491 - DNA, 22 bp, Artificial Sequence
  Synthetic oligonucleotide; CTC chr2 60529167 60529188 60529172 60529167 -
aaagtagttcccccattatggg

SEQ ID NO: 214492 - DNA, 22 bp, Artificial Sequence
  Synthetic oligonucleotide; TTC chr2 60529157 60529178 60529162 60529157 -
ccccattatggggtgagcaggt

SEQ ID NO: 214493 - DNA, 22 bp, Artificial Sequence
  Synthetic oligonucleotide; TTA chr2 60529149 60529170 60529154 60529149 -
tggggtgagcaggttgggatga

SEQ ID NO: 214494 - DNA, 22 bp, Artificial Sequence
  Synthetic oligonucleotide; TTG chr2 60529133 60529154 60529138 60529133 -
ggatgagagaagagcagggcag

SEQ ID NO: 214495 - DNA, 22 bp, Artificial Sequence
  Synthetic oligonucleotide; CTA chr2 60529100 60529121 60529105 60529100 -
aagagctcagggtctcattatg

SEQ ID NO: 214496 - DNA, 22 bp, Artificial Sequence
  Synthetic oligonucleotide; CTC chr2 60529092 60529113 60529097 60529092 -
agggtctcattatgtttctggt

SEQ ID NO: 214497 - DNA, 22 bp, Artificial Sequence
  Synthetic oligonucleotide; CTC chr2 60529084 60529105 60529089 60529084 -
attatgtttctggtggcagctc

SEQ ID NO: 214498 - DNA, 22 bp, Artificial Sequence
  Synthetic oligonucleotide; TTA chr2 60529080 60529101 60529085 60529080 -
tgtttctggtggcagctccctc

SEQ ID NO: 214499 - DNA, 22 bp, Artificial Sequence
  Synthetic oligonucleotide; TTT chr2 60529075 60529096 60529080 60529075 -
ctggtggcagctccctcgtggg

SEQ ID NO: 214500 - DNA, 22 bp, Artificial Sequence
  Synthetic oligonucleotide; TTC chr2 60529074 60529095 60529079 60529074 -
tggtggcagctccctcgtgggt

SEQ ID NO: 214501 - DNA, 22 bp, Artificial Sequence
  Synthetic oligonucleotide; CTG chr2 60529072 60529093 60529077 60529072 -
gtggcagctccctcgtgggtgg

SEQ ID NO: 214502 - DNA, 22 bp, Artificial Sequence
  Synthetic oligonucleotide; CTC chr2 60529062 60529083 60529067 60529062 -
cctcgtgggtgggagtcccctc

SEQ ID NO: 214503 - DNA, 22 bp, Artificial Sequence
  Synthetic oligonucleotide; CTC chr2 60529058 60529079 60529063 60529058 -
gtgggtgggagtcccctctccc

SEQ ID NO: 214504 - DNA, 22 bp, Artificial Sequence
  Synthetic oligonucleotide; CTC chr2 60529040 60529061 60529045 60529040 -
tccccatagacgtgtgttgcct

SEQ ID NO: 214505 - DNA, 22 bp, Artificial Sequence
  Synthetic oligonucleotide; CTC chr2 60529038 60529059 60529043 60529038 -
cccatagacgtgtgttgcctta

SEQ ID NO: 214506 - DNA, 22 bp, Artificial Sequence
  Synthetic oligonucleotide; TTG chr2 60529021 60529042 60529026 60529021 -
ccttacgagaggcttgtgcctg

SEQ ID NO: 214507 - DNA, 22 bp, Artificial Sequence
  Synthetic oligonucleotide; CTT chr2 60529017 60529038 60529022 60529017 -
acgagaggcttgtgcctgcctg

SEQ ID NO: 214508 - DNA, 22 bp, Artificial Sequence
  Synthetic oligonucleotide; TTA chr2 60529016 60529037 60529021 60529016 -
cgagaggcttgtgcctgcctgg

SEQ ID NO: 214509 - DNA, 22 bp, Artificial Sequence
  Synthetic oligonucleotide; CTT chr2 60529006 60529027 60529011 60529006 -
gtgcctgcctgggtgtgtgaca

SEQ ID NO: 214510 - DNA, 22 bp, Artificial Sequence
  Synthetic oligonucleotide; TTG chr2 60529005 60529026 60529010 60529005 -
tgcctgcctgggtgtgtgacac

SEQ ID NO: 214511 - DNA, 22 bp, Artificial Sequence
  Synthetic oligonucleotide; CTG chr2 60528999 60529020 60529004 60528999 -
cctgggtgtgtgacacagttac

SEQ ID NO: 214512 - DNA, 22 bp, Artificial Sequence
  Synthetic oligonucleotide; CTG chr2 60528995 60529016 60529000 60528995 -
ggtgtgtgacacagttactctg

SEQ ID NO: 214513 - DNA, 22 bp, Artificial Sequence
  Synthetic oligonucleotide; TTA chr2 60528978 60528999 60528983 60528978 -
ctctgggttcagatttctatgt

SEQ ID NO: 214514 - DNA, 22 bp, Artificial Sequence
  Synthetic oligonucleotide; CTC chr2 60528975 60528996 60528980 60528975 -
tgggttcagatttctatgttac

SEQ ID NO: 214515 - DNA, 22 bp, Artificial Sequence
  Synthetic oligonucleotide; CTG chr2 60528973 60528994 60528978 60528973 -
ggttcagatttctatgttactg

SEQ ID NO: 214516 - DNA, 22 bp, Artificial Sequence
  Synthetic oligonucleotide; TTC chr2 60528968 60528989 60528973 60528968 -
agatttctatgttactgctagc

SEQ ID NO: 214517 - DNA, 22 bp, Artificial Sequence
  Synthetic oligonucleotide; TTT chr2 60528962 60528983 60528967 60528962 -
ctatgttactgctagctggttg

SEQ ID NO: 214518 - DNA, 22 bp, Artificial Sequence
  Synthetic oligonucleotide; TTC chr2 60528961 60528982 60528966 60528961 -
tatgttactgctagctggttgg

SEQ ID NO: 214519 - DNA, 22 bp, Artificial Sequence
  Synthetic oligonucleotide; CTA chr2 60528959 60528980 60528964 60528959 -
tgttactgctagctggttggga

SEQ ID NO: 214520 - DNA, 22 bp, Artificial Sequence
  Synthetic oligonucleotide; TTA chr2 60528954 60528975 60528959 60528954 -
ctgctagctggttgggagagtc

SEQ ID NO: 214521 - DNA, 22 bp, Artificial Sequence
  Synthetic oligonucleotide; CTG chr2 60528951 60528972 60528956 60528951 -
ctagctggttgggagagtctga

SEQ ID NO: 214522 - DNA, 22 bp, Artificial Sequence
  Synthetic oligonucleotide; CTA chr2 60528948 60528969 60528953 60528948 -
gctggttgggagagtctgaggg

SEQ ID NO: 214523 - DNA, 22 bp, Artificial Sequence
  Synthetic oligonucleotide; CTG chr2 60528944 60528965 60528949 60528944 -
gttgggagagtctgagggaatc

SEQ ID NO: 214524 - DNA, 22 bp, Artificial Sequence
  Synthetic oligonucleotide; TTG chr2 60528940 60528961 60528945 60528940 -
ggagagtctgagggaatcattt

SEQ ID NO: 214525 - DNA, 22 bp, Artificial Sequence
  Synthetic oligonucleotide; CTG chr2 60528930 60528951 60528935 60528930 -
agggaatcatttcacctctctg

SEQ ID NO: 214526 - DNA, 22 bp, Artificial Sequence
  Synthetic oligonucleotide; TTT chr2 60528918 60528939 60528923 60528918 -
cacctctctgtgaaatggagat

SEQ ID NO: 214527 - DNA, 22 bp, Artificial Sequence
  Synthetic oligonucleotide; TTC chr2 60528917 60528938 60528922 60528917 -
acctctctgtgaaatggagata

SEQ ID NO: 214528 - DNA, 22 bp, Artificial Sequence
  Synthetic oligonucleotide; CTC chr2 60528912 60528933 60528917 60528912 -
tctgtgaaatggagataactca

SEQ ID NO: 214529 - DNA, 22 bp, Artificial Sequence
  Synthetic oligonucleotide; CTC chr2 60528910 60528931 60528915 60528910 -
tgtgaaatggagataactcaag

SEQ ID NO: 214530 - DNA, 22 bp, Artificial Sequence
  Synthetic oligonucleotide; CTG chr2 60528908 60528929 60528913 60528908 -
tgaaatggagataactcaaggt

SEQ ID NO: 214531 - DNA, 22 bp, Artificial Sequence
  Synthetic oligonucleotide; CTC chr2 60528891 60528912 60528896 60528891 -
aaggtcccttacctcatagagt

SEQ ID NO: 214532 - DNA, 22 bp, Artificial Sequence
  Synthetic oligonucleotide; CTT chr2 60528881 60528902 60528886 60528881 -
acctcatagagtccatgtgaga

SEQ ID NO: 214533 - DNA, 22 bp, Artificial Sequence
  Synthetic oligonucleotide; TTA chr2 60528880 60528901 60528885 60528880 -
cctcatagagtccatgtgagaa

SEQ ID NO: 214534 - DNA, 22 bp, Artificial Sequence
  Synthetic oligonucleotide; CTC chr2 60528876 60528897 60528881 60528876 -
atagagtccatgtgagaagtaa

SEQ ID NO: 214535 - DNA, 22 bp, Artificial Sequence
  Synthetic oligonucleotide; TTA chr2 60528832 60528853 60528837 60528832 -
ctcgctccgggggctgcacctc

SEQ ID NO: 214536 - DNA, 22 bp, Artificial Sequence
  Synthetic oligonucleotide; CTC chr2 60528829 60528850 60528834 60528829 -
gctccgggggctgcacctccag

SEQ ID NO: 214537 - DNA, 22 bp, Artificial Sequence
  Synthetic oligonucleotide; CTC chr2 60528825 60528846 60528830 60528825 -
cgggggctgcacctccagaatt

SEQ ID NO: 214538 - DNA, 22 bp, Artificial Sequence
  Synthetic oligonucleotide; CTG chr2 60528816 60528837 60528821 60528816 -
cacctccagaattgctgttgtc

SEQ ID NO: 214539 - DNA, 22 bp, Artificial Sequence
  Synthetic oligonucleotide; CTC chr2 60528810 60528831 60528815 60528810 -
cagaattgctgttgtcattatt

SEQ ID NO: 214540 - DNA, 22 bp, Artificial Sequence
  Synthetic oligonucleotide; TTG chr2 60528802 60528823 60528807 60528802 -
ctgttgtcattattaccatgtg

SEQ ID NO: 214541 - DNA, 22 bp, Artificial Sequence
  Synthetic oligonucleotide; CTG chr2 60528799 60528820 60528804 60528799 -
ttgtcattattaccatgtgtct

SEQ ID NO: 214542 - DNA, 22 bp, Artificial Sequence
  Synthetic oligonucleotide; TTG chr2 60528796 60528817 60528801 60528796 -
tcattattaccatgtgtctgac

SEQ ID NO: 214543 - DNA, 22 bp, Artificial Sequence
  Synthetic oligonucleotide; TTA chr2 60528790 60528811 60528795 60528790 -
ttaccatgtgtctgacacattg

SEQ ID NO: 214544 - DNA, 22 bp, Artificial Sequence
  Synthetic oligonucleotide; TTA chr2 60528787 60528808 60528792 60528787 -
ccatgtgtctgacacattgata

SEQ ID NO: 214545 - DNA, 22 bp, Artificial Sequence
  Synthetic oligonucleotide; CTG chr2 60528776 60528797 60528781 60528776 -
acacattgatattccatcccac

SEQ ID NO: 214546 - DNA, 22 bp, Artificial Sequence
  Synthetic oligonucleotide; TTG chr2 60528768 60528789 60528773 60528768 -
atattccatcccacaacaacct

SEQ ID NO: 214547 - DNA, 22 bp, Artificial Sequence
  Synthetic oligonucleotide; TTC chr2 60528762 60528783 60528767 60528762 -
catcccacaacaacctcggaaa

SEQ ID NO: 214548 - DNA, 22 bp, Artificial Sequence
  Synthetic oligonucleotide; CTC chr2 60528745 60528766 60528750 60528745 -
ggaaaggaaacactcccattag

SEQ ID NO: 214549 - DNA, 22 bp, Artificial Sequence
  Synthetic oligonucleotide; CTC chr2 60528730 60528751 60528735 60528730 -
ccattagcctcatttggtagag

SEQ ID NO: 214550 - DNA, 22 bp, Artificial Sequence
  Synthetic oligonucleotide; TTA chr2 60528724 60528745 60528729 60528724 -
gcctcatttggtagaggaggaa

SEQ ID NO: 214551 - DNA, 22 bp, Artificial Sequence
  Synthetic oligonucleotide; CTC chr2 60528719 60528740 60528724 60528719 -
atttggtagaggaggaaattgg

SEQ ID NO: 214552 - DNA, 22 bp, Artificial Sequence
  Synthetic oligonucleotide; TTT chr2 60528715 60528736 60528720 60528715 -
ggtagaggaggaaattggggtt

SEQ ID NO: 214553 - DNA, 22 bp, Artificial Sequence
  Synthetic oligonucleotide; TTG chr2 60528714 60528735 60528719 60528714 -
gtagaggaggaaattggggttc

SEQ ID NO: 214554 - DNA, 22 bp, Artificial Sequence
  Synthetic oligonucleotide; TTG chr2 60528698 60528719 60528703 60528698 -
gggttcatcaagggttaaatga

SEQ ID NO: 214555 - DNA, 22 bp, Artificial Sequence
  Synthetic oligonucleotide; TTC chr2 60528692 60528713 60528697 60528692 -
atcaagggttaaatgacttccc

SEQ ID NO: 214556 - DNA, 22 bp, Artificial Sequence
  Synthetic oligonucleotide; TTA chr2 60528681 60528702 60528686 60528681 -
aatgacttccctgagggtccac

SEQ ID NO: 214557 - DNA, 22 bp, Artificial Sequence
  Synthetic oligonucleotide; CTT chr2 60528673 60528694 60528678 60528673 -
ccctgagggtccacagttgttc

SEQ ID NO: 214558 - DNA, 22 bp, Artificial Sequence
  Synthetic oligonucleotide; TTC chr2 60528672 60528693 60528677 60528672 -
cctgagggtccacagttgttca

SEQ ID NO: 214559 - DNA, 22 bp, Artificial Sequence
  Synthetic oligonucleotide; CTG chr2 60528668 60528689 60528673 60528668 -
agggtccacagttgttcaatcc

SEQ ID NO: 214560 - DNA, 22 bp, Artificial Sequence
  Synthetic oligonucleotide; TTG chr2 60528654 60528675 60528659 60528654 -
ttcaatcctttggcctgcggcc

SEQ ID NO: 214561 - DNA, 22 bp, Artificial Sequence
  Synthetic oligonucleotide; TTC chr2 60528651 60528672 60528656 60528651 -
aatcctttggcctgcggccgcc

SEQ ID NO: 214562 - DNA, 22 bp, Artificial Sequence
  Synthetic oligonucleotide; CTT chr2 60528644 60528665 60528649 60528644 -
tggcctgcggccgccaccctct

SEQ ID NO: 214563 - DNA, 22 bp, Artificial Sequence
  Synthetic oligonucleotide; TTT chr2 60528643 60528664 60528648 60528643 -
ggcctgcggccgccaccctctg

SEQ ID NO: 214564 - DNA, 22 bp, Artificial Sequence
  Synthetic oligonucleotide; TTG chr2 60528642 60528663 60528647 60528642 -
gcctgcggccgccaccctctgc

SEQ ID NO: 214565 - DNA, 22 bp, Artificial Sequence
  Synthetic oligonucleotide; CTG chr2 60528637 60528658 60528642 60528637 -
cggccgccaccctctgctacct

SEQ ID NO: 214566 - DNA, 22 bp, Artificial Sequence
  Synthetic oligonucleotide; CTC chr2 60528623 60528644 60528628 60528623 -
tgctacctcttcagtacgtttg

SEQ ID NO: 214567 - DNA, 22 bp, Artificial Sequence
  Synthetic oligonucleotide; CTG chr2 60528621 60528642 60528626 60528621 -
ctacctcttcagtacgtttgca

SEQ ID NO: 214568 - DNA, 22 bp, Artificial Sequence
  Synthetic oligonucleotide; CTA chr2 60528618 60528639 60528623 60528618 -
cctcttcagtacgtttgcagct

SEQ ID NO: 214569 - DNA, 22 bp, Artificial Sequence
  Synthetic oligonucleotide; CTC chr2 60528614 60528635 60528619 60528614 -
ttcagtacgtttgcagctttct

SEQ ID NO: 214570 - DNA, 22 bp, Artificial Sequence
  Synthetic oligonucleotide; CTT chr2 60528612 60528633 60528617 60528612 -
cagtacgtttgcagctttcttc

SEQ ID NO: 214571 - DNA, 22 bp, Artificial Sequence
  Synthetic oligonucleotide; TTC chr2 60528611 60528632 60528616 60528611 -
agtacgtttgcagctttcttca

SEQ ID NO: 214572 - DNA, 22 bp, Artificial Sequence
  Synthetic oligonucleotide; TTT chr2 60528602 60528623 60528607 60528602 -
gcagctttcttcagcggtgcca

SEQ ID NO: 214573 - DNA, 22 bp, Artificial Sequence
  Synthetic oligonucleotide; TTG chr2 60528601 60528622 60528606 60528601 -
cagctttcttcagcggtgccag

SEQ ID NO: 214574 - DNA, 22 bp, Artificial Sequence
  Synthetic oligonucleotide; CTT chr2 60528595 60528616 60528600 60528595 -
tcttcagcggtgccaggcaaca

SEQ ID NO: 214575 - DNA, 22 bp, Artificial Sequence
  Synthetic oligonucleotide; TTT chr2 60528594 60528615 60528599 60528594 -
cttcagcggtgccaggcaacaa

SEQ ID NO: 214576 - DNA, 22 bp, Artificial Sequence
  Synthetic oligonucleotide; TTC chr2 60528593 60528614 60528598 60528593 -
ttcagcggtgccaggcaacaac

SEQ ID NO: 214577 - DNA, 22 bp, Artificial Sequence
  Synthetic oligonucleotide; CTT chr2 60528591 60528612 60528596 60528591 -
cagcggtgccaggcaacaactg

SEQ ID NO: 214578 - DNA, 22 bp, Artificial Sequence
  Synthetic oligonucleotide; TTC chr2 60528590 60528611 60528595 60528590 -
agcggtgccaggcaacaactgg

SEQ ID NO: 214579 - DNA, 22 bp, Artificial Sequence
  Synthetic oligonucleotide; CTG chr2 60528569 60528590 60528574 60528569 -
ggcaggaagctctggtgctgga

SEQ ID NO: 214580 - DNA, 22 bp, Artificial Sequence
  Synthetic oligonucleotide; CTC chr2 60528557 60528578 60528562 60528557 -
tggtgctggacagttgtccctc

SEQ ID NO: 214581 - DNA, 22 bp, Artificial Sequence
  Synthetic oligonucleotide; CTG chr2 60528555 60528576 60528560 60528555 -
gtgctggacagttgtccctccc

SEQ ID NO: 214582 - DNA, 22 bp, Artificial Sequence
  Synthetic oligonucleotide; CTG chr2 60528549 60528570 60528554 60528549 -
gacagttgtccctcccatgggt

SEQ ID NO: 214583 - DNA, 22 bp, Artificial Sequence
  Synthetic oligonucleotide; TTG chr2 60528541 60528562 60528546 60528541 -
tccctcccatgggttctgtggt

SEQ ID NO: 214584 - DNA, 22 bp, Artificial Sequence
  Synthetic oligonucleotide; CTC chr2 60528535 60528556 60528540 60528535 -
ccatgggttctgtggtcaagtt

SEQ ID NO: 214585 - DNA, 22 bp, Artificial Sequence
  Synthetic oligonucleotide; TTC chr2 60528525 60528546 60528530 60528525 -
tgtggtcaagtttttcaatctt

SEQ ID NO: 214586 - DNA, 22 bp, Artificial Sequence
  Synthetic oligonucleotide; CTG chr2 60528523 60528544 60528528 60528523 -
tggtcaagtttttcaatcttct

SEQ ID NO: 214587 - DNA, 22 bp, Artificial Sequence
  Synthetic oligonucleotide; TTT chr2 60528512 60528533 60528517 60528512 -
ttcaatcttctgggaaagagaa

SEQ ID NO: 214588 - DNA, 22 bp, Artificial Sequence
  Synthetic oligonucleotide; TTT chr2 60528511 60528532 60528516 60528511 -
tcaatcttctgggaaagagaag

SEQ ID NO: 214589 - DNA, 22 bp, Artificial Sequence
  Synthetic oligonucleotide; TTT chr2 60528510 60528531 60528515 60528510 -
caatcttctgggaaagagaaga

SEQ ID NO: 214590 - DNA, 22 bp, Artificial Sequence
  Synthetic oligonucleotide; TTC chr2 60528509 60528530 60528514 60528509 -
aatcttctgggaaagagaagaa

SEQ ID NO: 214591 - DNA, 22 bp, Artificial Sequence
  Synthetic oligonucleotide; CTT chr2 60528503 60528524 60528508 60528503 -
ctgggaaagagaagaatgttcc

SEQ ID NO: 214592 - DNA, 22 bp, Artificial Sequence
  Synthetic oligonucleotide; TTC chr2 60528502 60528523 60528507 60528502 -
tgggaaagagaagaatgttccc

SEQ ID NO: 214593 - DNA, 22 bp, Artificial Sequence
  Synthetic oligonucleotide; CTG chr2 60528500 60528521 60528505 60528500 -
ggaaagagaagaatgttcccct

SEQ ID NO: 214594 - DNA, 22 bp, Artificial Sequence
  Synthetic oligonucleotide; TTC chr2 60528482 60528503 60528487 60528482 -
ccctccagttctgggcatattg

SEQ ID NO: 214595 - DNA, 22 bp, Artificial Sequence
  Synthetic oligonucleotide; CTC chr2 60528477 60528498 60528482 60528477 -
cagttctgggcatattgaagga

SEQ ID NO: 214596 - DNA, 22 bp, Artificial Sequence
  Synthetic oligonucleotide; TTC chr2 60528471 60528492 60528476 60528471 -
tgggcatattgaaggagcacgg

SEQ ID NO: 214597 - DNA, 22 bp, Artificial Sequence
  Synthetic oligonucleotide; CTG chr2 60528469 60528490 60528474 60528469 -
ggcatattgaaggagcacggag

SEQ ID NO: 214598 - DNA, 22 bp, Artificial Sequence
  Synthetic oligonucleotide; TTG chr2 60528460 60528481 60528465 60528460 -
aaggagcacggagctgttggga

SEQ ID NO: 214599 - DNA, 22 bp, Artificial Sequence
  Synthetic oligonucleotide; CTG chr2 60528444 60528465 60528449 60528444 -
ttgggaaaagttgcaatgtaag

SEQ ID NO: 214600 - DNA, 22 bp, Artificial Sequence
  Synthetic oligonucleotide; TTG chr2 60528441 60528462 60528446 60528441 -
ggaaaagttgcaatgtaaggaa

SEQ ID NO: 214601 - DNA, 22 bp, Artificial Sequence
  Synthetic oligonucleotide; TTG chr2 60528431 60528452 60528436 60528431 -
caatgtaaggaatcctgctttg

SEQ ID NO: 214602 - DNA, 22 bp, Artificial Sequence
  Synthetic oligonucleotide; CTG chr2 60528414 60528435 60528419 60528414 -
ctttgcaagtagtcatttcccc

SEQ ID NO: 214603 - DNA, 22 bp, Artificial Sequence
  Synthetic oligonucleotide; CTT chr2 60528411 60528432 60528416 60528411 -
tgcaagtagtcatttccccatc

SEQ ID NO: 214604 - DNA, 22 bp, Artificial Sequence
  Synthetic oligonucleotide; TTT chr2 60528410 60528431 60528415 60528410 -
gcaagtagtcatttccccatct

SEQ ID NO: 214605 - DNA, 22 bp, Artificial Sequence
  Synthetic oligonucleotide; TTG chr2 60528409 60528430 60528414 60528409 -
caagtagtcatttccccatctg

SEQ ID NO: 214606 - DNA, 22 bp, Artificial Sequence
  Synthetic oligonucleotide; TTT chr2 60528396 60528417 60528401 60528396 -
ccccatctgtccagaatgagcc

SEQ ID NO: 214607 - DNA, 22 bp, Artificial Sequence
  Synthetic oligonucleotide; TTC chr2 60528395 60528416 60528400 60528395 -
cccatctgtccagaatgagcct

SEQ ID NO: 214608 - DNA, 22 bp, Artificial Sequence
  Synthetic oligonucleotide; CTG chr2 60528387 60528408 60528392 60528387 -
tccagaatgagcctgaaatcaa

SEQ ID NO: 214609 - DNA, 22 bp, Artificial Sequence
  Synthetic oligonucleotide; CTG chr2 60528372 60528393 60528377 60528372 -
aaatcaagtgagggtcctgaga

SEQ ID NO: 214610 - DNA, 22 bp, Artificial Sequence
  Synthetic oligonucleotide; CTG chr2 60528353 60528374 60528358 60528353 -
agaaacagagggaggaggtttt

SEQ ID NO: 214611 - DNA, 22 bp, Artificial Sequence
  Synthetic oligonucleotide; TTT chr2 60528332 60528353 60528337 60528332 -
tactgtttgtgtgtggcttggt

SEQ ID NO: 214612 - DNA, 22 bp, Artificial Sequence
  Synthetic oligonucleotide; TTT chr2 60528331 60528352 60528336 60528331 -
actgtttgtgtgtggcttggtc

SEQ ID NO: 214613 - DNA, 22 bp, Artificial Sequence
  Synthetic oligonucleotide; TTA chr2 60528330 60528351 60528335 60528330 -
ctgtttgtgtgtggcttggtca

SEQ ID NO: 214614 - DNA, 22 bp, Artificial Sequence
  Synthetic oligonucleotide; CTG chr2 60528327 60528348 60528332 60528327 -
tttgtgtgtggcttggtcagga

SEQ ID NO: 214615 - DNA, 22 bp, Artificial Sequence
  Synthetic oligonucleotide; TTT chr2 60528324 60528345 60528329 60528324 -
gtgtgtggcttggtcaggagac

SEQ ID NO: 214616 - DNA, 22 bp, Artificial Sequence
  Synthetic oligonucleotide; TTG chr2 60528323 60528344 60528328 60528323 -
tgtgtggcttggtcaggagact

SEQ ID NO: 214617 - DNA, 22 bp, Artificial Sequence
  Synthetic oligonucleotide; CTT chr2 60528313 60528334 60528318 60528313 -
ggtcaggagactgcagtgggct

SEQ ID NO: 214618 - DNA, 22 bp, Artificial Sequence
  Synthetic oligonucleotide; TTG chr2 60528312 60528333 60528317 60528312 -
gtcaggagactgcagtgggctg

SEQ ID NO: 214619 - DNA, 22 bp, Artificial Sequence
  Synthetic oligonucleotide; CTG chr2 60528300 60528321 60528305 60528300 -
cagtgggctgaatgagaaacta

SEQ ID NO: 214620 - DNA, 22 bp, Artificial Sequence
  Synthetic oligonucleotide; CTG chr2 60528290 60528311 60528295 60528290 -
aatgagaaactaagctcggact

SEQ ID NO: 214621 - DNA, 22 bp, Artificial Sequence
  Synthetic oligonucleotide; CTA chr2 60528278 60528299 60528283 60528278 -
agctcggacttttaagaagtgg

SEQ ID NO: 214622 - DNA, 22 bp, Artificial Sequence
  Synthetic oligonucleotide; CTC chr2 60528273 60528294 60528278 60528273 -
ggacttttaagaagtggtgagg

SEQ ID NO: 214623 - DNA, 22 bp, Artificial Sequence
  Synthetic oligonucleotide; CTT chr2 60528267 60528288 60528272 60528267 -
ttaagaagtggtgaggcttggc

SEQ ID NO: 214624 - DNA, 22 bp, Artificial Sequence
  Synthetic oligonucleotide; TTT chr2 60528266 60528287 60528271 60528266 -
taagaagtggtgaggcttggcc

SEQ ID NO: 214625 - DNA, 22 bp, Artificial Sequence
  Synthetic oligonucleotide; TTT chr2 60528265 60528286 60528270 60528265 -
aagaagtggtgaggcttggcct

SEQ ID NO: 214626 - DNA, 22 bp, Artificial Sequence
  Synthetic oligonucleotide; TTA chr2 60528264 60528285 60528269 60528264 -
agaagtggtgaggcttggcctg

SEQ ID NO: 214627 - DNA, 22 bp, Artificial Sequence
  Synthetic oligonucleotide; CTT chr2 60528248 60528269 60528253 60528248 -
ggcctgcagcagttctgtgtgt

SEQ ID NO: 214628 - DNA, 22 bp, Artificial Sequence
  Synthetic oligonucleotide; TTG chr2 60528247 60528268 60528252 60528247 -
gcctgcagcagttctgtgtgtt

SEQ ID NO: 214629 - DNA, 22 bp, Artificial Sequence
  Synthetic oligonucleotide; CTG chr2 60528242 60528263 60528247 60528242 -
cagcagttctgtgtgttgtctc

SEQ ID NO: 214630 - DNA, 22 bp, Artificial Sequence
  Synthetic oligonucleotide; TTC chr2 60528233 60528254 60528238 60528233 -
tgtgtgttgtctctgtggcatt

SEQ ID NO: 214631 - DNA, 22 bp, Artificial Sequence
  Synthetic oligonucleotide; CTG chr2 60528231 60528252 60528236 60528231 -
tgtgttgtctctgtggcattta

SEQ ID NO: 214632 - DNA, 22 bp, Artificial Sequence
  Synthetic oligonucleotide; TTG chr2 60528224 60528245 60528229 60528224 -
tctctgtggcatttacttctcg

SEQ ID NO: 214633 - DNA, 22 bp, Artificial Sequence
  Synthetic oligonucleotide; CTC chr2 60528220 60528241 60528225 60528220 -
tgtggcatttacttctcggatc

SEQ ID NO: 214634 - DNA, 22 bp, Artificial Sequence
  Synthetic oligonucleotide; CTG chr2 60528218 60528239 60528223 60528218 -
tggcatttacttctcggatcgt

SEQ ID NO: 214635 - DNA, 22 bp, Artificial Sequence
  Synthetic oligonucleotide; TTT chr2 60528210 60528231 60528215 60528210 -
acttctcggatcgtaccttcaa

SEQ ID NO: 214636 - DNA, 22 bp, Artificial Sequence
  Synthetic oligonucleotide; TTA chr2 60528209 60528230 60528214 60528209 -
cttctcggatcgtaccttcaaa

SEQ ID NO: 214637 - DNA, 22 bp, Artificial Sequence
  Synthetic oligonucleotide; CTT chr2 60528206 60528227 60528211 60528206 -
ctcggatcgtaccttcaaaggc

SEQ ID NO: 214638 - DNA, 22 bp, Artificial Sequence
  Synthetic oligonucleotide; TTC chr2 60528205 60528226 60528210 60528205 -
tcggatcgtaccttcaaaggct

SEQ ID NO: 214639 - DNA, 22 bp, Artificial Sequence
  Synthetic oligonucleotide; CTC chr2 60528203 60528224 60528208 60528203 -
ggatcgtaccttcaaaggctgg

SEQ ID NO: 214640 - DNA, 22 bp, Artificial Sequence
  Synthetic oligonucleotide; CTT chr2 60528191 60528212 60528196 60528191 -
caaaggctggggagaatcagaa

SEQ ID NO: 214641 - DNA, 22 bp, Artificial Sequence
  Synthetic oligonucleotide; TTC chr2 60528190 60528211 60528195 60528190 -
aaaggctggggagaatcagaat

SEQ ID NO: 214642 - DNA, 22 bp, Artificial Sequence
  Synthetic oligonucleotide; CTG chr2 60528182 60528203 60528187 60528182 -
gggagaatcagaattatacagg

SEQ ID NO: 214643 - DNA, 22 bp, Artificial Sequence
  Synthetic oligonucleotide; TTA chr2 60528166 60528187 60528171 60528166 -
tacagggagggagagactgagt

SEQ ID NO: 214644 - DNA, 22 bp, Artificial Sequence
  Synthetic oligonucleotide; CTG chr2 60528147 60528168 60528152 60528147 -
agtgtgagtgagtgtgcgtggc

SEQ ID NO: 214645 - DNA, 22 bp, Artificial Sequence
  Synthetic oligonucleotide; TTT chr2 60528115 60528136 60528120 60528115 -
cttaggacgatgggttctgggg

SEQ ID NO: 214646 - DNA, 22 bp, Artificial Sequence
  Synthetic oligonucleotide; TTC chr2 60528114 60528135 60528119 60528114 -
ttaggacgatgggttctggggg

SEQ ID NO: 214647 - DNA, 22 bp, Artificial Sequence
  Synthetic oligonucleotide; CTT chr2 60528112 60528133 60528117 60528112 -
aggacgatgggttctggggggt

SEQ ID NO: 214648 - DNA, 22 bp, Artificial Sequence
  Synthetic oligonucleotide; TTA chr2 60528111 60528132 60528116 60528111 -
ggacgatgggttctggggggtc

SEQ ID NO: 214649 - DNA, 22 bp, Artificial Sequence
  Synthetic oligonucleotide; TTC chr2 60528098 60528119 60528103 60528098 -
tggggggtcataatctgcttcg

SEQ ID NO: 214650 - DNA, 22 bp, Artificial Sequence
  Synthetic oligonucleotide; CTG chr2 60528096 60528117 60528101 60528096 -
gggggtcataatctgcttcgag

SEQ ID NO: 214651 - DNA, 22 bp, Artificial Sequence
  Synthetic oligonucleotide; CTG chr2 60528081 60528102 60528086 60528081 -
cttcgaggaggttttcatttct

SEQ ID NO: 214652 - DNA, 22 bp, Artificial Sequence
  Synthetic oligonucleotide; CTT chr2 60528078 60528099 60528083 60528078 -
cgaggaggttttcatttctggc

SEQ ID NO: 214653 - DNA, 22 bp, Artificial Sequence
  Synthetic oligonucleotide; TTC chr2 60528077 60528098 60528082 60528077 -
gaggaggttttcatttctggct

SEQ ID NO: 214654 - DNA, 22 bp, Artificial Sequence
  Synthetic oligonucleotide; TTT chr2 60528067 60528088 60528072 60528067 -
tcatttctggctgaacaaggct

SEQ ID NO: 214655 - DNA, 22 bp, Artificial Sequence
  Synthetic oligonucleotide; TTT chr2 60528066 60528087 60528071 60528066 -
catttctggctgaacaaggctg

SEQ ID NO: 214656 - DNA, 22 bp, Artificial Sequence
  Synthetic oligonucleotide; TTC chr2 60528065 60528086 60528070 60528065 -
atttctggctgaacaaggctgt

SEQ ID NO: 214657 - DNA, 22 bp, Artificial Sequence
  Synthetic oligonucleotide; TTT chr2 60528061 60528082 60528066 60528061 -
ctggctgaacaaggctgtggta

SEQ ID NO: 214658 - DNA, 22 bp, Artificial Sequence
  Synthetic oligonucleotide; TTC chr2 60528060 60528081 60528065 60528060 -
tggctgaacaaggctgtggtaa

SEQ ID NO: 214659 - DNA, 22 bp, Artificial Sequence
  Synthetic oligonucleotide; CTG chr2 60528058 60528079 60528063 60528058 -
gctgaacaaggctgtggtaagg

SEQ ID NO: 214660 - DNA, 22 bp, Artificial Sequence
  Synthetic oligonucleotide; CTG chr2 60528054 60528075 60528059 60528054 -
aacaaggctgtggtaaggcaag

SEQ ID NO: 214661 - DNA, 22 bp, Artificial Sequence
  Synthetic oligonucleotide; CTG chr2 60528044 60528065 60528049 60528044 -
tggtaaggcaagtccggaaggc

SEQ ID NO: 214662 - DNA, 22 bp, Artificial Sequence
  Synthetic oligonucleotide; CTG chr2 60528016 60528037 60528021 60528016 -
gaaacttgagggaagttttgaa

SEQ ID NO: 214663 - DNA, 22 bp, Artificial Sequence
  Synthetic oligonucleotide; CTT chr2 60528009 60528030 60528014 60528009 -
gagggaagttttgaatggaaac

SEQ ID NO: 214664 - DNA, 22 bp, Artificial Sequence
  Synthetic oligonucleotide; TTG chr2 60528008 60528029 60528013 60528008 -
agggaagttttgaatggaaact

SEQ ID NO: 214665 - DNA, 22 bp, Artificial Sequence
  Synthetic oligonucleotide; TTT chr2 60527998 60528019 60528003 60527998 -
tgaatggaaactgcagtcaaca

SEQ ID NO: 214666 - DNA, 22 bp, Artificial Sequence
  Synthetic oligonucleotide; TTT chr2 60527997 60528018 60528002 60527997 -
gaatggaaactgcagtcaacag

SEQ ID NO: 214667 - DNA, 22 bp, Artificial Sequence
  Synthetic oligonucleotide; TTG chr2 60527996 60528017 60528001 60527996 -
aatggaaactgcagtcaacagc

SEQ ID NO: 214668 - DNA, 22 bp, Artificial Sequence
  Synthetic oligonucleotide; CTG chr2 60527985 60528006 60527990 60527985 -
cagtcaacagctccatatgatc

SEQ ID NO: 214669 - DNA, 22 bp, Artificial Sequence
  Synthetic oligonucleotide; CTC chr2 60527972 60527993 60527977 60527972 -
catatgatccgcatgtggcttc

SEQ ID NO: 214670 - DNA, 22 bp, Artificial Sequence
  Synthetic oligonucleotide; CTT chr2 60527951 60527972 60527956 60527951 -
ccccagaggcaagttttcagct

SEQ ID NO: 214671 - DNA, 22 bp, Artificial Sequence
  Synthetic oligonucleotide; TTC chr2 60527950 60527971 60527955 60527950 -
cccagaggcaagttttcagctg

SEQ ID NO: 214672 - DNA, 22 bp, Artificial Sequence
  Synthetic oligonucleotide; TTT chr2 60527935 60527956 60527940 60527935 -
tcagctgcgtggtggcctctcc

SEQ ID NO: 214673 - DNA, 22 bp, Artificial Sequence
  Synthetic oligonucleotide; TTT chr2 60527934 60527955 60527939 60527934 -
cagctgcgtggtggcctctccc

SEQ ID NO: 214674 - DNA, 22 bp, Artificial Sequence
  Synthetic oligonucleotide; TTC chr2 60527933 60527954 60527938 60527933 -
agctgcgtggtggcctctccca

SEQ ID NO: 214675 - DNA, 22 bp, Artificial Sequence
  Synthetic oligonucleotide; CTG chr2 60527928 60527949 60527933 60527928 -
cgtggtggcctctcccagtcac

SEQ ID NO: 214676 - DNA, 22 bp, Artificial Sequence
  Synthetic oligonucleotide; CTC chr2 60527916 60527937 60527921 60527916 -
tcccagtcactccacaggctgc

SEQ ID NO: 214677 - DNA, 22 bp, Artificial Sequence
  Synthetic oligonucleotide; CTC chr2 60527914 60527935 60527919 60527914 -
ccagtcactccacaggctgccc

SEQ ID NO: 214678 - DNA, 22 bp, Artificial Sequence
  Synthetic oligonucleotide; CTC chr2 60527904 60527925 60527909 60527904 -
cacaggctgccctgacgctatt

SEQ ID NO: 214679 - DNA, 22 bp, Artificial Sequence
  Synthetic oligonucleotide; CTG chr2 60527895 60527916 60527900 60527895 -
ccctgacgctattaatatttgc

SEQ ID NO: 214680 - DNA, 22 bp, Artificial Sequence
  Synthetic oligonucleotide; CTG chr2 60527890 60527911 60527895 60527890 -
acgctattaatatttgctgaag

SEQ ID NO: 214681 - DNA, 22 bp, Artificial Sequence
  Synthetic oligonucleotide; CTA chr2 60527884 60527905 60527889 60527884 -
ttaatatttgctgaagcaagac

SEQ ID NO: 214682 - DNA, 22 bp, Artificial Sequence
  Synthetic oligonucleotide; TTA chr2 60527881 60527902 60527886 60527881 -
atatttgctgaagcaagacctg

SEQ ID NO: 214683 - DNA, 22 bp, Artificial Sequence
  Synthetic oligonucleotide; TTT chr2 60527875 60527896 60527880 60527875 -
gctgaagcaagacctgaggttc

SEQ ID NO: 214684 - DNA, 22 bp, Artificial Sequence
  Synthetic oligonucleotide; TTG chr2 60527874 60527895 60527879 60527874 -
ctgaagcaagacctgaggttcg

SEQ ID NO: 214685 - DNA, 22 bp, Artificial Sequence
  Synthetic oligonucleotide; CTG chr2 60527871 60527892 60527876 60527871 -
aagcaagacctgaggttcgttg

SEQ ID NO: 214686 - DNA, 22 bp, Artificial Sequence
  Synthetic oligonucleotide; CTG chr2 60527859 60527880 60527864 60527859 -
aggttcgttgcagatggattac

SEQ ID NO: 214687 - DNA, 22 bp, Artificial Sequence
  Synthetic oligonucleotide; TTC chr2 60527853 60527874 60527858 60527853 -
gttgcagatggattacacaatg

SEQ ID NO: 214688 - DNA, 22 bp, Artificial Sequence
  Synthetic oligonucleotide; TTG chr2 60527849 60527870 60527854 60527849 -
cagatggattacacaatgtatt

SEQ ID NO: 214689 - DNA, 22 bp, Artificial Sequence
  Synthetic oligonucleotide; TTA chr2 60527838 60527859 60527843 60527838 -
cacaatgtattccaaaaccaaa

SEQ ID NO: 214690 - DNA, 22 bp, Artificial Sequence
  Synthetic oligonucleotide; TTC chr2 60527826 60527847 60527831 60527826 -
caaaaccaaatgttactgtttt

SEQ ID NO: 214691 - DNA, 22 bp, Artificial Sequence
  Synthetic oligonucleotide; TTA chr2 60527811 60527832 60527816 60527811 -
ctgttttcctgtattctccatc

SEQ ID NO: 214692 - DNA, 22 bp, Artificial Sequence
  Synthetic oligonucleotide; CTG chr2 60527808 60527829 60527813 60527808 -
ttttcctgtattctccatcctt

SEQ ID NO: 214693 - DNA, 22 bp, Artificial Sequence
  Synthetic oligonucleotide; TTT chr2 60527805 60527826 60527810 60527805 -
tcctgtattctccatcctttca

SEQ ID NO: 214694 - DNA, 22 bp, Artificial Sequence
  Synthetic oligonucleotide; TTT chr2 60527804 60527825 60527809 60527804 -
cctgtattctccatcctttcaa

SEQ ID NO: 214695 - DNA, 22 bp, Artificial Sequence
  Synthetic oligonucleotide; TTC chr2 60527803 60527824 60527808 60527803 -
ctgtattctccatcctttcaaa

SEQ ID NO: 214696 - DNA, 22 bp, Artificial Sequence
  Synthetic oligonucleotide; CTG chr2 60527800 60527821 60527805 60527800 -
tattctccatcctttcaaattg

SEQ ID NO: 214697 - DNA, 22 bp, Artificial Sequence
  Synthetic oligonucleotide; TTC chr2 60527795 60527816 60527800 60527795 -
tccatcctttcaaattggccag

SEQ ID NO: 214698 - DNA, 22 bp, Artificial Sequence
  Synthetic oligonucleotide; CTC chr2 60527793 60527814 60527798 60527793 -
catcctttcaaattggccaggc

SEQ ID NO: 214699 - DNA, 22 bp, Artificial Sequence
  Synthetic oligonucleotide; CTT chr2 60527786 60527807 60527791 60527786 -
tcaaattggccaggctaacata

SEQ ID NO: 214700 - DNA, 22 bp, Artificial Sequence
  Synthetic oligonucleotide; TTT chr2 60527785 60527806 60527790 60527785 -
caaattggccaggctaacatag

SEQ ID NO: 214701 - DNA, 22 bp, Artificial Sequence
  Synthetic oligonucleotide; TTC chr2 60527784 60527805 60527789 60527784 -
aaattggccaggctaacataga

SEQ ID NO: 214702 - DNA, 22 bp, Artificial Sequence
  Synthetic oligonucleotide; TTG chr2 60527778 60527799 60527783 60527778 -
gccaggctaacatagacctcca

SEQ ID NO: 214703 - DNA, 22 bp, Artificial Sequence
  Synthetic oligonucleotide; CTA chr2 60527769 60527790 60527774 60527769 -
acatagacctccactgagagaa

SEQ ID NO: 214704 - DNA, 22 bp, Artificial Sequence
  Synthetic oligonucleotide; CTC chr2 60527758 60527779 60527763 60527758 -
cactgagagaatttcagaatca

SEQ ID NO: 214705 - DNA, 22 bp, Artificial Sequence
  Synthetic oligonucleotide; CTG chr2 60527753 60527774 60527758 60527753 -
agagaatttcagaatcatttgg

SEQ ID NO: 214706 - DNA, 22 bp, Artificial Sequence
  Synthetic oligonucleotide; TTT chr2 60527744 60527765 60527749 60527744 -
cagaatcatttggtagttgaga

SEQ ID NO: 214707 - DNA, 22 bp, Artificial Sequence
  Synthetic oligonucleotide; TTC chr2 60527743 60527764 60527748 60527743 -
agaatcatttggtagttgagaa

SEQ ID NO: 214708 - DNA, 22 bp, Artificial Sequence
  Synthetic oligonucleotide; TTT chr2 60527733 60527754 60527738 60527733 -
ggtagttgagaagcgcctactt

SEQ ID NO: 214709 - DNA, 22 bp, Artificial Sequence
  Synthetic oligonucleotide; TTG chr2 60527732 60527753 60527737 60527732 -
gtagttgagaagcgcctacttc

SEQ ID NO: 214710 - DNA, 22 bp, Artificial Sequence
  Synthetic oligonucleotide; TTG chr2 60527725 60527746 60527730 60527725 -
agaagcgcctacttcatgcgga

SEQ ID NO: 214711 - DNA, 22 bp, Artificial Sequence
  Synthetic oligonucleotide; CTA chr2 60527714 60527735 60527719 60527714 -
cttcatgcggaggccccgtggg

SEQ ID NO: 214712 - DNA, 22 bp, Artificial Sequence
  Synthetic oligonucleotide; CTT chr2 60527711 60527732 60527716 60527711 -
catgcggaggccccgtgggagg

SEQ ID NO: 214713 - DNA, 22 bp, Artificial Sequence
  Synthetic oligonucleotide; TTC chr2 60527710 60527731 60527715 60527710 -
atgcggaggccccgtgggagga

SEQ ID NO: 214714 - DNA, 22 bp, Artificial Sequence
  Synthetic oligonucleotide; TTG chr2 60527676 60527697 60527681 60527676 -
gcctcagcactggcgagtatcg

SEQ ID NO: 214715 - DNA, 22 bp, Artificial Sequence
  Synthetic oligonucleotide; CTC chr2 60527671 60527692 60527676 60527671 -
agcactggcgagtatcggatgg

SEQ ID NO: 214716 - DNA, 22 bp, Artificial Sequence
  Synthetic oligonucleotide; CTG chr2 60527664 60527685 60527669 60527664 -
gcgagtatcggatgggagctct

SEQ ID NO: 214717 - DNA, 22 bp, Artificial Sequence
  Synthetic oligonucleotide; CTC chr2 60527643 60527664 60527648 60527643 -
tgctcacttggtaagtccttct

SEQ ID NO: 214718 - DNA, 22 bp, Artificial Sequence
  Synthetic oligonucleotide; CTG chr2 60527641 60527662 60527646 60527641 -
ctcacttggtaagtccttctgc

SEQ ID NO: 214719 - DNA, 22 bp, Artificial Sequence
  Synthetic oligonucleotide; CTC chr2 60527638 60527659 60527643 60527638 -
acttggtaagtccttctgctag

SEQ ID NO: 214720 - DNA, 22 bp, Artificial Sequence
  Synthetic oligonucleotide; CTT chr2 60527634 60527655 60527639 60527634 -
ggtaagtccttctgctagaacc

SEQ ID NO: 214721 - DNA, 22 bp, Artificial Sequence
  Synthetic oligonucleotide; TTG chr2 60527633 60527654 60527638 60527633 -
gtaagtccttctgctagaacca

SEQ ID NO: 214722 - DNA, 22 bp, Artificial Sequence
  Synthetic oligonucleotide; CTT chr2 60527623 60527644 60527628 60527623 -
ctgctagaaccaagggaggctg

SEQ ID NO: 214723 - DNA, 22 bp, Artificial Sequence
  Synthetic oligonucleotide; TTC chr2 60527622 60527643 60527627 60527622 -
tgctagaaccaagggaggctgt

SEQ ID NO: 214724 - DNA, 22 bp, Artificial Sequence
  Synthetic oligonucleotide; CTG chr2 60527620 60527641 60527625 60527620 -
ctagaaccaagggaggctgttc

SEQ ID NO: 214725 - DNA, 22 bp, Artificial Sequence
  Synthetic oligonucleotide; CTA chr2 60527617 60527638 60527622 60527617 -
gaaccaagggaggctgttcaga

SEQ ID NO: 214726 - DNA, 22 bp, Artificial Sequence
  Synthetic oligonucleotide; CTG chr2 60527601 60527622 60527606 60527601 -
ttcagatccatcacaaagaagt

SEQ ID NO: 214727 - DNA, 22 bp, Artificial Sequence
  Synthetic oligonucleotide; TTC chr2 60527598 60527619 60527603 60527598 -
agatccatcacaaagaagttgt

SEQ ID NO: 214728 - DNA, 22 bp, Artificial Sequence
  Synthetic oligonucleotide; TTG chr2 60527577 60527598 60527582 60527577 -
tcggtcacatccaggttgtctt

SEQ ID NO: 214729 - DNA, 22 bp, Artificial Sequence
  Synthetic oligonucleotide; TTG chr2 60527559 60527580 60527564 60527559 -
tcttctgagtttgaggtgggat

SEQ ID NO: 214730 - DNA, 22 bp, Artificial Sequence
  Synthetic oligonucleotide; CTT chr2 60527555 60527576 60527560 60527555 -
ctgagtttgaggtgggatggag

SEQ ID NO: 214731 - DNA, 22 bp, Artificial Sequence
  Synthetic oligonucleotide; TTC chr2 60527554 60527575 60527559 60527554 -
tgagtttgaggtgggatggagg

SEQ ID NO: 214732 - DNA, 22 bp, Artificial Sequence
  Synthetic oligonucleotide; CTG chr2 60527552 60527573 60527557 60527552 -
agtttgaggtgggatggaggtg

SEQ ID NO: 214733 - DNA, 22 bp, Artificial Sequence
  Synthetic oligonucleotide; TTT chr2 60527547 60527568 60527552 60527547 -
gaggtgggatggaggtggctgc

SEQ ID NO: 214734 - DNA, 22 bp, Artificial Sequence
  Synthetic oligonucleotide; TTG chr2 60527546 60527567 60527551 60527546 -
aggtgggatggaggtggctgct

SEQ ID NO: 214735 - DNA, 22 bp, Artificial Sequence
  Synthetic oligonucleotide; CTG chr2 60527526 60527547 60527531 60527526 -
ctgagaatccatgtgggtcaag

SEQ ID NO: 214736 - DNA, 22 bp, Artificial Sequence
  Synthetic oligonucleotide; CTG chr2 60527523 60527544 60527528 60527523 -
agaatccatgtgggtcaagagc

SEQ ID NO: 214737 - DNA, 22 bp, Artificial Sequence
  Synthetic oligonucleotide; CTC chr2 60527499 60527520 60527504 60527499 -
caaagcttcacttttacttcgc

SEQ ID NO: 214738 - DNA, 22 bp, Artificial Sequence
  Synthetic oligonucleotide; CTT chr2 60527491 60527512 60527496 60527491 -
cacttttacttcgcactctgtc

SEQ ID NO: 214739 - DNA, 22 bp, Artificial Sequence
  Synthetic oligonucleotide; TTC chr2 60527490 60527511 60527495 60527490 -
acttttacttcgcactctgtcc

SEQ ID NO: 214740 - DNA, 22 bp, Artificial Sequence
  Synthetic oligonucleotide; CTT chr2 60527486 60527507 60527491 60527486 -
ttacttcgcactctgtcccggg

SEQ ID NO: 214741 - DNA, 22 bp, Artificial Sequence
  Synthetic oligonucleotide; TTT chr2 60527485 60527506 60527490 60527485 -
tacttcgcactctgtcccgggg

SEQ ID NO: 214742 - DNA, 22 bp, Artificial Sequence
  Synthetic oligonucleotide; TTT chr2 60527484 60527505 60527489 60527484 -
acttcgcactctgtcccggggc

SEQ ID NO: 214743 - DNA, 22 bp, Artificial Sequence
  Synthetic oligonucleotide; TTA chr2 60527483 60527504 60527488 60527483 -
cttcgcactctgtcccggggca

SEQ ID NO: 214744 - DNA, 22 bp, Artificial Sequence
  Synthetic oligonucleotide; CTT chr2 60527480 60527501 60527485 60527480 -
cgcactctgtcccggggcatgg

SEQ ID NO: 214745 - DNA, 22 bp, Artificial Sequence
  Synthetic oligonucleotide; TTC chr2 60527479 60527500 60527484 60527479 -
gcactctgtcccggggcatgga

SEQ ID NO: 214746 - DNA, 22 bp, Artificial Sequence
  Synthetic oligonucleotide; CTC chr2 60527473 60527494 60527478 60527473 -
tgtcccggggcatggacgtcct

SEQ ID NO: 214747 - DNA, 22 bp, Artificial Sequence
  Synthetic oligonucleotide; CTG chr2 60527471 60527492 60527476 60527471 -
tcccggggcatggacgtcctca

SEQ ID NO: 214748 - DNA, 22 bp, Artificial Sequence
  Synthetic oligonucleotide; CTC chr2 60527450 60527471 60527455 60527450 -
aatggaggtcatgcaagccctt

SEQ ID NO: 214749 - DNA, 22 bp, Artificial Sequence
  Synthetic oligonucleotide; CTT chr2 60527428 60527449 60527433 60527428 -
ccccctcaccccttctcttggc

SEQ ID NO: 214750 - DNA, 22 bp, Artificial Sequence
  Synthetic oligonucleotide; TTC chr2 60527427 60527448 60527432 60527427 -
cccctcaccccttctcttggcc

SEQ ID NO: 214751 - DNA, 22 bp, Artificial Sequence
  Synthetic oligonucleotide; CTC chr2 60527421 60527442 60527426 60527421 -
accccttctcttggccctcttc

SEQ ID NO: 214752 - DNA, 22 bp, Artificial Sequence
  Synthetic oligonucleotide; CTT chr2 60527414 60527435 60527419 60527414 -
ctcttggccctcttcattgtct

SEQ ID NO: 214753 - DNA, 22 bp, Artificial Sequence
  Synthetic oligonucleotide; TTC chr2 60527413 60527434 60527418 60527413 -
tcttggccctcttcattgtctc

SEQ ID NO: 214754 - DNA, 22 bp, Artificial Sequence
  Synthetic oligonucleotide; CTC chr2 60527411 60527432 60527416 60527411 -
ttggccctcttcattgtctcta

SEQ ID NO: 214755 - DNA, 22 bp, Artificial Sequence
  Synthetic oligonucleotide; CTT chr2 60527409 60527430 60527414 60527409 -
ggccctcttcattgtctctaca

SEQ ID NO: 214756 - DNA, 22 bp, Artificial Sequence
  Synthetic oligonucleotide; TTG chr2 60527408 60527429 60527413 60527408 -
gccctcttcattgtctctacat

SEQ ID NO: 214757 - DNA, 22 bp, Artificial Sequence
  Synthetic oligonucleotide; CTC chr2 60527402 60527423 60527407 60527402 -
ttcattgtctctacataccctt

SEQ ID NO: 214758 - DNA, 22 bp, Artificial Sequence
  Synthetic oligonucleotide; CTT chr2 60527400 60527421 60527405 60527400 -
cattgtctctacatacccttgg

SEQ ID NO: 214759 - DNA, 22 bp, Artificial Sequence
  Synthetic oligonucleotide; TTC chr2 60527399 60527420 60527404 60527399 -
attgtctctacatacccttggg

SEQ ID NO: 214760 - DNA, 22 bp, Artificial Sequence
  Synthetic oligonucleotide; TTG chr2 60527395 60527416 60527400 60527395 -
tctctacatacccttgggtcaa

SEQ ID NO: 214761 - DNA, 22 bp, Artificial Sequence
  Synthetic oligonucleotide; CTC chr2 60527391 60527412 60527396 60527391 -
tacatacccttgggtcaagagt

SEQ ID NO: 214762 - DNA, 22 bp, Artificial Sequence
  Synthetic oligonucleotide; CTA chr2 60527389 60527410 60527394 60527389 -
catacccttgggtcaagagtgt

SEQ ID NO: 214763 - DNA, 22 bp, Artificial Sequence
  Synthetic oligonucleotide; CTT chr2 60527380 60527401 60527385 60527380 -
gggtcaagagtgtagtggttct

SEQ ID NO: 214764 - DNA, 22 bp, Artificial Sequence
  Synthetic oligonucleotide; TTG chr2 60527379 60527400 60527384 60527379 -
ggtcaagagtgtagtggttctc

SEQ ID NO: 214765 - DNA, 22 bp, Artificial Sequence
  Synthetic oligonucleotide; TTC chr2 60527359 60527380 60527364 60527359 -
tcccttgtcaccctggaagaga

SEQ ID NO: 214766 - DNA, 22 bp, Artificial Sequence
  Synthetic oligonucleotide; CTC chr2 60527357 60527378 60527362 60527357 -
ccttgtcaccctggaagagaag

SEQ ID NO: 214767 - DNA, 22 bp, Artificial Sequence
  Synthetic oligonucleotide; CTT chr2 60527353 60527374 60527358 60527353 -
gtcaccctggaagagaagctct

SEQ ID NO: 214768 - DNA, 22 bp, Artificial Sequence
  Synthetic oligonucleotide; TTG chr2 60527352 60527373 60527357 60527352 -
tcaccctggaagagaagctctt

SEQ ID NO: 214769 - DNA, 22 bp, Artificial Sequence
  Synthetic oligonucleotide; CTG chr2 60527344 60527365 60527349 60527344 -
gaagagaagctcttagttttat

SEQ ID NO: 214770 - DNA, 22 bp, Artificial Sequence
  Synthetic oligonucleotide; CTC chr2 60527332 60527353 60527337 60527332 -
ttagttttatttgctgggtctc

SEQ ID NO: 214771 - DNA, 22 bp, Artificial Sequence
  Synthetic oligonucleotide; CTT chr2 60527330 60527351 60527335 60527330 -
agttttatttgctgggtctcct

SEQ ID NO: 214772 - DNA, 22 bp, Artificial Sequence
  Synthetic oligonucleotide; TTA chr2 60527329 60527350 60527334 60527329 -
gttttatttgctgggtctccta

SEQ ID NO: 214773 - DNA, 22 bp, Artificial Sequence
  Synthetic oligonucleotide; TTT chr2 60527325 60527346 60527330 60527325 -
tatttgctgggtctcctagact

SEQ ID NO: 214774 - DNA, 22 bp, Artificial Sequence
  Synthetic oligonucleotide; TTT chr2 60527324 60527345 60527329 60527324 -
atttgctgggtctcctagactg

SEQ ID NO: 214775 - DNA, 22 bp, Artificial Sequence
  Synthetic oligonucleotide; TTA chr2 60527323 60527344 60527328 60527323 -
tttgctgggtctcctagactga

SEQ ID NO: 214776 - DNA, 22 bp, Artificial Sequence
  Synthetic oligonucleotide; TTT chr2 60527320 60527341 60527325 60527320 -
gctgggtctcctagactgaaat

SEQ ID NO: 214777 - DNA, 22 bp, Artificial Sequence
  Synthetic oligonucleotide; TTG chr2 60527319 60527340 60527324 60527319 -
ctgggtctcctagactgaaatg

SEQ ID NO: 214778 - DNA, 22 bp, Artificial Sequence
  Synthetic oligonucleotide; CTG chr2 60527316 60527337 60527321 60527316 -
ggtctcctagactgaaatgata

SEQ ID NO: 214779 - DNA, 22 bp, Artificial Sequence
  Synthetic oligonucleotide; CTC chr2 60527310 60527331 60527315 60527310 -
ctagactgaaatgataaagctg

SEQ ID NO: 214780 - DNA, 22 bp, Artificial Sequence
  Synthetic oligonucleotide; CTA chr2 60527307 60527328 60527312 60527307 -
gactgaaatgataaagctgaaa

SEQ ID NO: 214781 - DNA, 22 bp, Artificial Sequence
  Synthetic oligonucleotide; CTG chr2 60527302 60527323 60527307 60527302 -
aaatgataaagctgaaatgata

SEQ ID NO: 214782 - DNA, 22 bp, Artificial Sequence
  Synthetic oligonucleotide; CTG chr2 60527288 60527309 60527293 60527288 -
aaatgataaaaggcgtatcatg

SEQ ID NO: 214783 - DNA, 22 bp, Artificial Sequence
  Synthetic oligonucleotide; CTT chr2 60527262 60527283 60527267 60527262 -
tagaacccttcttatttccctc

SEQ ID NO: 214784 - DNA, 22 bp, Artificial Sequence
  Synthetic oligonucleotide; TTT chr2 60527261 60527282 60527266 60527261 -
agaacccttcttatttccctcg

SEQ ID NO: 214785 - DNA, 22 bp, Artificial Sequence
  Synthetic oligonucleotide; TTA chr2 60527260 60527281 60527265 60527260 -
gaacccttcttatttccctcgc

SEQ ID NO: 214786 - DNA, 22 bp, Artificial Sequence
  Synthetic oligonucleotide; CTT chr2 60527252 60527273 60527257 60527252 -
cttatttccctcgctcgcaccc

SEQ ID NO: 214787 - DNA, 22 bp, Artificial Sequence
  Synthetic oligonucleotide; TTC chr2 60527251 60527272 60527256 60527251 -
ttatttccctcgctcgcacccc

SEQ ID NO: 214788 - DNA, 22 bp, Artificial Sequence
  Synthetic oligonucleotide; CTT chr2 60527249 60527270 60527254 60527249 -
atttccctcgctcgcaccccct

SEQ ID NO: 214789 - DNA, 22 bp, Artificial Sequence
  Synthetic oligonucleotide; TTA chr2 60527248 60527269 60527253 60527248 -
tttccctcgctcgcacccccta

SEQ ID NO: 214790 - DNA, 22 bp, Artificial Sequence
  Synthetic oligonucleotide; TTT chr2 60527245 60527266 60527250 60527245 -
ccctcgctcgcaccccctagtt

SEQ ID NO: 214791 - DNA, 22 bp, Artificial Sequence
  Synthetic oligonucleotide; TTC chr2 60527244 60527265 60527249 60527244 -
cctcgctcgcaccccctagttt

SEQ ID NO: 214792 - DNA, 22 bp, Artificial Sequence
  Synthetic oligonucleotide; CTC chr2 60527240 60527261 60527245 60527240 -
gctcgcaccccctagttttcct

SEQ ID NO: 214793 - DNA, 22 bp, Artificial Sequence
  Synthetic oligonucleotide; CTC chr2 60527236 60527257 60527241 60527236 -
gcaccccctagttttccttctc

SEQ ID NO: 214794 - DNA, 22 bp, Artificial Sequence
  Synthetic oligonucleotide; CTA chr2 60527226 60527247 60527231 60527226 -
gttttccttctcttcccttgaa

SEQ ID NO: 214795 - DNA, 22 bp, Artificial Sequence
  Synthetic oligonucleotide; TTT chr2 60527222 60527243 60527227 60527222 -
tccttctcttcccttgaaaatc

SEQ ID NO: 214796 - DNA, 22 bp, Artificial Sequence
  Synthetic oligonucleotide; TTT chr2 60527221 60527242 60527226 60527221 -
ccttctcttcccttgaaaatca

SEQ ID NO: 214797 - DNA, 22 bp, Artificial Sequence
  Synthetic oligonucleotide; TTC chr2 60527220 60527241 60527225 60527220 -
cttctcttcccttgaaaatcag

SEQ ID NO: 214798 - DNA, 22 bp, Artificial Sequence
  Synthetic oligonucleotide; CTT chr2 60527217 60527238 60527222 60527217 -
ctcttcccttgaaaatcagtga

SEQ ID NO: 214799 - DNA, 22 bp, Artificial Sequence
  Synthetic oligonucleotide; TTC chr2 60527216 60527237 60527221 60527216 -
tcttcccttgaaaatcagtgaa

SEQ ID NO: 214800 - DNA, 22 bp, Artificial Sequence
  Synthetic oligonucleotide; CTC chr2 60527214 60527235 60527219 60527214 -
ttcccttgaaaatcagtgaaaa

SEQ ID NO: 214801 - DNA, 22 bp, Artificial Sequence
  Synthetic oligonucleotide; CTT chr2 60527212 60527233 60527217 60527212 -
cccttgaaaatcagtgaaaatc

SEQ ID NO: 214802 - DNA, 22 bp, Artificial Sequence
  Synthetic oligonucleotide; TTC chr2 60527211 60527232 60527216 60527211 -
ccttgaaaatcagtgaaaatca

SEQ ID NO: 214803 - DNA, 22 bp, Artificial Sequence
  Synthetic oligonucleotide; CTT chr2 60527207 60527228 60527212 60527207 -
gaaaatcagtgaaaatcaggcc

SEQ ID NO: 214804 - DNA, 22 bp, Artificial Sequence
  Synthetic oligonucleotide; TTG chr2 60527206 60527227 60527211 60527206 -
aaaatcagtgaaaatcaggcca

SEQ ID NO: 214805 - DNA, 22 bp, Artificial Sequence
  Synthetic oligonucleotide; CTC chr2 60527178 60527199 60527183 60527178 -
tgatgatggccttttgtttctt

SEQ ID NO: 214806 - DNA, 22 bp, Artificial Sequence
  Synthetic oligonucleotide; CTG chr2 60527176 60527197 60527181 60527176 -
atgatggccttttgtttctttt

SEQ ID NO: 214807 - DNA, 22 bp, Artificial Sequence
  Synthetic oligonucleotide; CTT chr2 60527165 60527186 60527170 60527165 -
ttgtttctttttctttttctgt

SEQ ID NO: 214808 - DNA, 22 bp, Artificial Sequence
  Synthetic oligonucleotide; TTT chr2 60527164 60527185 60527169 60527164 -
tgtttctttttctttttctgtt

SEQ ID NO: 214809 - DNA, 22 bp, Artificial Sequence
  Synthetic oligonucleotide; TTT chr2 60527163 60527184 60527168 60527163 -
gtttctttttctttttctgttt

SEQ ID NO: 214810 - DNA, 22 bp, Artificial Sequence
  Synthetic oligonucleotide; TTG chr2 60527162 60527183 60527167 60527162 -
tttctttttctttttctgtttc

SEQ ID NO: 214811 - DNA, 22 bp, Artificial Sequence
  Synthetic oligonucleotide; TTT chr2 60527159 60527180 60527164 60527159 -
ctttttctttttctgtttctgc

SEQ ID NO: 214812 - DNA, 22 bp, Artificial Sequence
  Synthetic oligonucleotide; TTC chr2 60527158 60527179 60527163 60527158 -
tttttctttttctgtttctgcc

SEQ ID NO: 214813 - DNA, 22 bp, Artificial Sequence
  Synthetic oligonucleotide; CTT chr2 60527156 60527177 60527161 60527156 -
tttctttttctgtttctgcctt

SEQ ID NO: 214814 - DNA, 22 bp, Artificial Sequence
  Synthetic oligonucleotide; TTT chr2 60527155 60527176 60527160 60527155 -
ttctttttctgtttctgccttc

SEQ ID NO: 214815 - DNA, 22 bp, Artificial Sequence
  Synthetic oligonucleotide; TTT chr2 60527154 60527175 60527159 60527154 -
tctttttctgtttctgccttcg

SEQ ID NO: 214816 - DNA, 22 bp, Artificial Sequence
  Synthetic oligonucleotide; TTT chr2 60527153 60527174 60527158 60527153 -
ctttttctgtttctgccttcgt

SEQ ID NO: 214817 - DNA, 22 bp, Artificial Sequence
  Synthetic oligonucleotide; TTC chr2 60527152 60527173 60527157 60527152 -
tttttctgtttctgccttcgtt

SEQ ID NO: 214818 - DNA, 22 bp, Artificial Sequence
  Synthetic oligonucleotide; CTT chr2 60527150 60527171 60527155 60527150 -
tttctgtttctgccttcgttag

SEQ ID NO: 214819 - DNA, 22 bp, Artificial Sequence
  Synthetic oligonucleotide; TTT chr2 60527149 60527170 60527154 60527149 -
ttctgtttctgccttcgttagg

SEQ ID NO: 214820 - DNA, 22 bp, Artificial Sequence
  Synthetic oligonucleotide; TTT chr2 60527148 60527169 60527153 60527148 -
tctgtttctgccttcgttaggt

SEQ ID NO: 214821 - DNA, 22 bp, Artificial Sequence
  Synthetic oligonucleotide; TTT chr2 60527147 60527168 60527152 60527147 -
ctgtttctgccttcgttaggta

SEQ ID NO: 214822 - DNA, 22 bp, Artificial Sequence
  Synthetic oligonucleotide; TTC chr2 60527146 60527167 60527151 60527146 -
tgtttctgccttcgttaggtaa

SEQ ID NO: 214823 - DNA, 22 bp, Artificial Sequence
  Synthetic oligonucleotide; CTG chr2 60527144 60527165 60527149 60527144 -
tttctgccttcgttaggtaagc

SEQ ID NO: 214824 - DNA, 22 bp, Artificial Sequence
  Synthetic oligonucleotide; TTT chr2 60527141 60527162 60527146 60527141 -
ctgccttcgttaggtaagcaca

SEQ ID NO: 214825 - DNA, 22 bp, Artificial Sequence
  Synthetic oligonucleotide; TTC chr2 60527140 60527161 60527145 60527140 -
tgccttcgttaggtaagcacaa

SEQ ID NO: 214826 - DNA, 22 bp, Artificial Sequence
  Synthetic oligonucleotide; CTG chr2 60527138 60527159 60527143 60527138 -
ccttcgttaggtaagcacaaat

SEQ ID NO: 214827 - DNA, 22 bp, Artificial Sequence
  Synthetic oligonucleotide; CTT chr2 60527134 60527155 60527139 60527134 -
cgttaggtaagcacaaatttga

SEQ ID NO: 214828 - DNA, 22 bp, Artificial Sequence
  Synthetic oligonucleotide; TTC chr2 60527133 60527154 60527138 60527133 -
gttaggtaagcacaaatttgat

SEQ ID NO: 214829 - DNA, 22 bp, Artificial Sequence
  Synthetic oligonucleotide; TTA chr2 60527129 60527150 60527134 60527129 -
ggtaagcacaaatttgatgtcc

SEQ ID NO: 214830 - DNA, 22 bp, Artificial Sequence
  Synthetic oligonucleotide; TTT chr2 60527114 60527135 60527119 60527114 -
gatgtcccaagaggcaggccgg

SEQ ID NO: 214831 - DNA, 22 bp, Artificial Sequence
  Synthetic oligonucleotide; TTG chr2 60527113 60527134 60527118 60527113 -
atgtcccaagaggcaggccggt

SEQ ID NO: 214832 - DNA, 22 bp, Artificial Sequence
  Synthetic oligonucleotide; CTT chr2 60527084 60527105 60527089 60527084 -
caggccaagtgcctggatgtgg

SEQ ID NO: 214833 - DNA, 22 bp, Artificial Sequence
  Synthetic oligonucleotide; TTC chr2 60527083 60527104 60527088 60527083 -
aggccaagtgcctggatgtggc

SEQ ID NO: 214834 - DNA, 22 bp, Artificial Sequence
  Synthetic oligonucleotide; CTG chr2 60527069 60527090 60527074 60527069 -
gatgtggcaaagctacaataaa

SEQ ID NO: 214835 - DNA, 22 bp, Artificial Sequence
  Synthetic oligonucleotide; CTA chr2 60527054 60527075 60527059 60527054 -
caataaatatcgaatggtgaga

SEQ ID NO: 214836 - DNA, 22 bp, Artificial Sequence
  Synthetic oligonucleotide; TTT chr2 60527019 60527040 60527024 60527019 -
agcaaagccataaccggggaga

SEQ ID NO: 214837 - DNA, 22 bp, Artificial Sequence
  Synthetic oligonucleotide; TTA chr2 60527018 60527039 60527023 60527018 -
gcaaagccataaccggggagac

SEQ ID NO: 214838 - DNA, 22 bp, Artificial Sequence
  Synthetic oligonucleotide; CTC chr2 60526993 60527014 60526998 60526993 -
agaggggcagtggactggttaa

SEQ ID NO: 214839 - DNA, 22 bp, Artificial Sequence
  Synthetic oligonucleotide; CTG chr2 60526976 60526997 60526981 60526976 -
gttaagaggctgttggatgagc

SEQ ID NO: 214840 - DNA, 22 bp, Artificial Sequence
  Synthetic oligonucleotide; TTA chr2 60526972 60526993 60526977 60526972 -
agaggctgttggatgagccggg

SEQ ID NO: 214841 - DNA, 22 bp, Artificial Sequence
  Synthetic oligonucleotide; CTG chr2 60526964 60526985 60526969 60526964 -
ttggatgagccgggtagtattt

SEQ ID NO: 214842 - DNA, 22 bp, Artificial Sequence
  Synthetic oligonucleotide; TTG chr2 60526961 60526982 60526966 60526961 -
gatgagccgggtagtatttcta

SEQ ID NO: 214843 - DNA, 22 bp, Artificial Sequence
  Synthetic oligonucleotide; TTT chr2 60526942 60526963 60526947 60526942 -
ctacttcaacctgattgaaatg

SEQ ID NO: 214844 - DNA, 22 bp, Artificial Sequence
  Synthetic oligonucleotide; TTC chr2 60526941 60526962 60526946 60526941 -
tacttcaacctgattgaaatgt

SEQ ID NO: 214845 - DNA, 22 bp, Artificial Sequence
  Synthetic oligonucleotide; CTA chr2 60526939 60526960 60526944 60526939 -
cttcaacctgattgaaatgtcg

SEQ ID NO: 214846 - DNA, 22 bp, Artificial Sequence
  Synthetic oligonucleotide; CTT chr2 60526936 60526957 60526941 60526936 -
caacctgattgaaatgtcgact

SEQ ID NO: 214847 - DNA, 22 bp, Artificial Sequence
  Synthetic oligonucleotide; TTC chr2 60526935 60526956 60526940 60526935 -
aacctgattgaaatgtcgacta

SEQ ID NO: 214848 - DNA, 22 bp, Artificial Sequence
  Synthetic oligonucleotide; CTG chr2 60526929 60526950 60526934 60526929 -
attgaaatgtcgactaaaaatc

SEQ ID NO: 214849 - DNA, 22 bp, Artificial Sequence
  Synthetic oligonucleotide; TTG chr2 60526925 60526946 60526930 60526925 -
aaatgtcgactaaaaatcaatg

SEQ ID NO: 214850 - DNA, 22 bp, Artificial Sequence
  Synthetic oligonucleotide; CTA chr2 60526913 60526934 60526918 60526913 -
aaaatcaatgctgttgactagt

SEQ ID NO: 214851 - DNA, 22 bp, Artificial Sequence
  Synthetic oligonucleotide; CTG chr2 60526900 60526921 60526905 60526900 -
ttgactagtgataatttacaac

SEQ ID NO: 214852 - DNA, 22 bp, Artificial Sequence
  Synthetic oligonucleotide; TTG chr2 60526897 60526918 60526902 60526897 -
actagtgataatttacaacgtt

SEQ ID NO: 214853 - DNA, 22 bp, Artificial Sequence
  Synthetic oligonucleotide; CTA chr2 60526893 60526914 60526898 60526893 -
gtgataatttacaacgttcctg

SEQ ID NO: 214854 - DNA, 22 bp, Artificial Sequence
  Synthetic oligonucleotide; TTT chr2 60526883 60526904 60526888 60526883 -
acaacgttcctggtgctaagta

SEQ ID NO: 214855 - DNA, 22 bp, Artificial Sequence
  Synthetic oligonucleotide; TTA chr2 60526882 60526903 60526887 60526882 -
caacgttcctggtgctaagtag

SEQ ID NO: 214856 - DNA, 22 bp, Artificial Sequence
  Synthetic oligonucleotide; TTC chr2 60526874 60526895 60526879 60526874 -
ctggtgctaagtagttccccgc

SEQ ID NO: 214857 - DNA, 22 bp, Artificial Sequence
  Synthetic oligonucleotide; CTG chr2 60526871 60526892 60526876 60526871 -
gtgctaagtagttccccgctta

SEQ ID NO: 214858 - DNA, 22 bp, Artificial Sequence
  Synthetic oligonucleotide; CTA chr2 60526865 60526886 60526870 60526865 -
agtagttccccgcttaagaatg

SEQ ID NO: 214859 - DNA, 22 bp, Artificial Sequence
  Synthetic oligonucleotide; TTC chr2 60526857 60526878 60526862 60526857 -
cccgcttaagaatgcgttggct

SEQ ID NO: 214860 - DNA, 22 bp, Artificial Sequence
  Synthetic oligonucleotide; CTT chr2 60526850 60526871 60526855 60526850 -
aagaatgcgttggctgggcaga

SEQ ID NO: 214861 - DNA, 22 bp, Artificial Sequence
  Synthetic oligonucleotide; TTA chr2 60526849 60526870 60526854 60526849 -
agaatgcgttggctgggcagag

SEQ ID NO: 214862 - DNA, 22 bp, Artificial Sequence
  Synthetic oligonucleotide; TTG chr2 60526838 60526859 60526843 60526838 -
gctgggcagagattagcgcagg

SEQ ID NO: 214863 - DNA, 22 bp, Artificial Sequence
  Synthetic oligonucleotide; CTG chr2 60526834 60526855 60526839 60526834 -
ggcagagattagcgcagggagt

SEQ ID NO: 214864 - DNA, 22 bp, Artificial Sequence
  Synthetic oligonucleotide; TTA chr2 60526823 60526844 60526828 60526823 -
gcgcagggagttgtgtgtgtca

SEQ ID NO: 214865 - DNA, 22 bp, Artificial Sequence
  Synthetic oligonucleotide; TTG chr2 60526810 60526831 60526815 60526810 -
tgtgtgtcacaatgaatcagac

SEQ ID NO: 214866 - DNA, 22 bp, Artificial Sequence
  Synthetic oligonucleotide; TTA chr2 60526782 60526803 60526787 60526782 -
taggtcagccctttatttgttt

SEQ ID NO: 214867 - DNA, 22 bp, Artificial Sequence
  Synthetic oligonucleotide; CTT chr2 60526769 60526790 60526774 60526769 -
tatttgtttcatcatgactttt

SEQ ID NO: 214868 - DNA, 22 bp, Artificial Sequence
  Synthetic oligonucleotide; TTT chr2 60526768 60526789 60526773 60526768 -
atttgtttcatcatgactttta

SEQ ID NO: 214869 - DNA, 22 bp, Artificial Sequence
  Synthetic oligonucleotide; TTA chr2 60526767 60526788 60526772 60526767 -
tttgtttcatcatgacttttac

SEQ ID NO: 214870 - DNA, 22 bp, Artificial Sequence
  Synthetic oligonucleotide; TTT chr2 60526764 60526785 60526769 60526764 -
gtttcatcatgacttttacaca

SEQ ID NO: 214871 - DNA, 22 bp, Artificial Sequence
  Synthetic oligonucleotide; TTG chr2 60526763 60526784 60526768 60526763 -
tttcatcatgacttttacacag

SEQ ID NO: 214872 - DNA, 22 bp, Artificial Sequence
  Synthetic oligonucleotide; TTT chr2 60526760 60526781 60526765 60526760 -
catcatgacttttacacagttg

SEQ ID NO: 214873 - DNA, 22 bp, Artificial Sequence
  Synthetic oligonucleotide; TTC chr2 60526759 60526780 60526764 60526759 -
atcatgacttttacacagttgt

SEQ ID NO: 214874 - DNA, 22 bp, Artificial Sequence
  Synthetic oligonucleotide; CTT chr2 60526749 60526770 60526754 60526749 -
ttacacagttgtcatgtaattt

SEQ ID NO: 214875 - DNA, 22 bp, Artificial Sequence
  Synthetic oligonucleotide; TTT chr2 60526748 60526769 60526753 60526748 -
tacacagttgtcatgtaattta

SEQ ID NO: 214876 - DNA, 22 bp, Artificial Sequence
  Synthetic oligonucleotide; TTT chr2 60526747 60526768 60526752 60526747 -
acacagttgtcatgtaatttat

SEQ ID NO: 214877 - DNA, 22 bp, Artificial Sequence
  Synthetic oligonucleotide; TTA chr2 60526746 60526767 60526751 60526746 -
cacagttgtcatgtaatttatg

SEQ ID NO: 214878 - DNA, 22 bp, Artificial Sequence
  Synthetic oligonucleotide; TTG chr2 60526738 60526759 60526743 60526738 -
tcatgtaatttatggctgcttt

SEQ ID NO: 214879 - DNA, 22 bp, Artificial Sequence
  Synthetic oligonucleotide; TTT chr2 60526727 60526748 60526732 60526727 -
atggctgctttcacgttgtcaa

SEQ ID NO: 214880 - DNA, 22 bp, Artificial Sequence
  Synthetic oligonucleotide; TTA chr2 60526726 60526747 60526731 60526726 -
tggctgctttcacgttgtcaaa

SEQ ID NO: 214881 - DNA, 22 bp, Artificial Sequence
  Synthetic oligonucleotide; CTG chr2 60526720 60526741 60526725 60526720 -
ctttcacgttgtcaaacatttt

SEQ ID NO: 214882 - DNA, 22 bp, Artificial Sequence
  Synthetic oligonucleotide; CTT chr2 60526717 60526738 60526722 60526717 -
tcacgttgtcaaacattttcat

SEQ ID NO: 214883 - DNA, 22 bp, Artificial Sequence
  Synthetic oligonucleotide; TTT chr2 60526716 60526737 60526721 60526716 -
cacgttgtcaaacattttcatt

SEQ ID NO: 214884 - DNA, 22 bp, Artificial Sequence
  Synthetic oligonucleotide; TTC chr2 60526715 60526736 60526720 60526715 -
acgttgtcaaacattttcattg

SEQ ID NO: 214885 - DNA, 22 bp, Artificial Sequence
  Synthetic oligonucleotide; TTG chr2 60526709 60526730 60526714 60526709 -
tcaaacattttcattgcatctt

SEQ ID NO: 214886 - DNA, 22 bp, Artificial Sequence
  Synthetic oligonucleotide; TTT chr2 60526699 60526720 60526704 60526699 -
tcattgcatcttcttctttaac

SEQ ID NO: 214887 - DNA, 22 bp, Artificial Sequence
  Synthetic oligonucleotide; TTT chr2 60526698 60526719 60526703 60526698 -
cattgcatcttcttctttaaca

SEQ ID NO: 214888 - DNA, 22 bp, Artificial Sequence
  Synthetic oligonucleotide; TTC chr2 60526697 60526718 60526702 60526697 -
attgcatcttcttctttaacac

SEQ ID NO: 214889 - DNA, 22 bp, Artificial Sequence
  Synthetic oligonucleotide; TTG chr2 60526693 60526714 60526698 60526693 -
catcttcttctttaacaccctc

SEQ ID NO: 214890 - DNA, 22 bp, Artificial Sequence
  Synthetic oligonucleotide; CTT chr2 60526687 60526708 60526692 60526687 -
cttctttaacaccctcctgaca

SEQ ID NO: 214891 - DNA, 22 bp, Artificial Sequence
  Synthetic oligonucleotide; TTC chr2 60526686 60526707 60526691 60526686 -
ttctttaacaccctcctgacat

SEQ ID NO: 214892 - DNA, 22 bp, Artificial Sequence
  Synthetic oligonucleotide; CTT chr2 60526684 60526705 60526689 60526684 -
ctttaacaccctcctgacatag

SEQ ID NO: 214893 - DNA, 22 bp, Artificial Sequence
  Synthetic oligonucleotide; TTC chr2 60526683 60526704 60526688 60526683 -
tttaacaccctcctgacataga

SEQ ID NO: 214894 - DNA, 22 bp, Artificial Sequence
  Synthetic oligonucleotide; CTT chr2 60526681 60526702 60526686 60526681 -
taacaccctcctgacatagaca

SEQ ID NO: 214895 - DNA, 22 bp, Artificial Sequence
  Synthetic oligonucleotide; TTT chr2 60526680 60526701 60526685 60526680 -
aacaccctcctgacatagacac

SEQ ID NO: 214896 - DNA, 22 bp, Artificial Sequence
  Synthetic oligonucleotide; TTA chr2 60526679 60526700 60526684 60526679 -
acaccctcctgacatagacaca

SEQ ID NO: 214897 - DNA, 22 bp, Artificial Sequence
  Synthetic oligonucleotide; CTC chr2 60526671 60526692 60526676 60526671 -
ctgacatagacacactgcactt

SEQ ID NO: 214898 - DNA, 22 bp, Artificial Sequence
  Synthetic oligonucleotide; CTG chr2 60526668 60526689 60526673 60526668 -
acatagacacactgcacttgaa

SEQ ID NO: 214899 - DNA, 22 bp, Artificial Sequence
  Synthetic oligonucleotide; CTG chr2 60526654 60526675 60526659 60526654 -
cacttgaaggcttggtattgtt

SEQ ID NO: 214900 - DNA, 22 bp, Artificial Sequence
  Synthetic oligonucleotide; CTT chr2 60526649 60526670 60526654 60526649 -
gaaggcttggtattgtttcata

SEQ ID NO: 214901 - DNA, 22 bp, Artificial Sequence
  Synthetic oligonucleotide; TTG chr2 60526648 60526669 60526653 60526648 -
aaggcttggtattgtttcataa

SEQ ID NO: 214902 - DNA, 22 bp, Artificial Sequence
  Synthetic oligonucleotide; CTT chr2 60526641 60526662 60526646 60526641 -
ggtattgtttcataatccgaga

SEQ ID NO: 214903 - DNA, 22 bp, Artificial Sequence
  Synthetic oligonucleotide; TTG chr2 60526640 60526661 60526645 60526640 -
gtattgtttcataatccgagag

SEQ ID NO: 214904 - DNA, 22 bp, Artificial Sequence
  Synthetic oligonucleotide; TTG chr2 60526634 60526655 60526639 60526634 -
tttcataatccgagaggaggcc

SEQ ID NO: 214905 - DNA, 22 bp, Artificial Sequence
  Synthetic oligonucleotide; TTT chr2 60526631 60526652 60526636 60526631 -
cataatccgagaggaggcctat

SEQ ID NO: 214906 - DNA, 22 bp, Artificial Sequence
  Synthetic oligonucleotide; TTC chr2 60526630 60526651 60526635 60526630 -
ataatccgagaggaggcctata

SEQ ID NO: 214907 - DNA, 22 bp, Artificial Sequence
  Synthetic oligonucleotide; CTA chr2 60526610 60526631 60526615 60526610 -
taaaccatcaaattacactatc

SEQ ID NO: 214908 - DNA, 22 bp, Artificial Sequence
  Synthetic oligonucleotide; TTA chr2 60526595 60526616 60526600 60526595 -
cactatctttgggctaatctaa

SEQ ID NO: 214909 - DNA, 22 bp, Artificial Sequence
  Synthetic oligonucleotide; CTA chr2 60526590 60526611 60526595 60526590 -
tctttgggctaatctaaatgcg

SEQ ID NO: 214910 - DNA, 22 bp, Artificial Sequence
  Synthetic oligonucleotide; CTT chr2 60526586 60526607 60526591 60526586 -
tgggctaatctaaatgcgctgc

SEQ ID NO: 214911 - DNA, 22 bp, Artificial Sequence
  Synthetic oligonucleotide; TTT chr2 60526585 60526606 60526590 60526585 -
gggctaatctaaatgcgctgca

SEQ ID NO: 214912 - DNA, 22 bp, Artificial Sequence
  Synthetic oligonucleotide; TTG chr2 60526584 60526605 60526589 60526584 -
ggctaatctaaatgcgctgcag

SEQ ID NO: 214913 - DNA, 22 bp, Artificial Sequence
  Synthetic oligonucleotide; CTA chr2 60526579 60526600 60526584 60526579 -
atctaaatgcgctgcagattaa

SEQ ID NO: 214914 - DNA, 22 bp, Artificial Sequence
  Synthetic oligonucleotide; CTA chr2 60526574 60526595 60526579 60526574 -
aatgcgctgcagattaaaatca

SEQ ID NO: 214915 - DNA, 22 bp, Artificial Sequence
  Synthetic oligonucleotide; CTG chr2 60526565 60526586 60526570 60526565 -
cagattaaaatcagagctcatt

SEQ ID NO: 214916 - DNA, 22 bp, Artificial Sequence
  Synthetic oligonucleotide; TTA chr2 60526558 60526579 60526563 60526558 -
aaatcagagctcatttgtccct

SEQ ID NO: 214917 - DNA, 22 bp, Artificial Sequence
  Synthetic oligonucleotide; CTC chr2 60526546 60526567 60526551 60526546 -
atttgtccctgatgcaaattat

SEQ ID NO: 214918 - DNA, 22 bp, Artificial Sequence
  Synthetic oligonucleotide; TTT chr2 60526542 60526563 60526547 60526542 -
gtccctgatgcaaattattaag

SEQ ID NO: 214919 - DNA, 22 bp, Artificial Sequence
  Synthetic oligonucleotide; TTG chr2 60526541 60526562 60526546 60526541 -
tccctgatgcaaattattaagt

SEQ ID NO: 214920 - DNA, 22 bp, Artificial Sequence
  Synthetic oligonucleotide; CTG chr2 60526535 60526556 60526540 60526535 -
atgcaaattattaagttctaat

SEQ ID NO: 214921 - DNA, 22 bp, Artificial Sequence
  Synthetic oligonucleotide; TTA chr2 60526525 60526546 60526530 60526525 -
ttaagttctaattataaatacc

SEQ ID NO: 214922 - DNA, 22 bp, Artificial Sequence
  Synthetic oligonucleotide; TTA chr2 60526522 60526543 60526527 60526522 -
agttctaattataaatacccat

SEQ ID NO: 214923 - DNA, 22 bp, Artificial Sequence
  Synthetic oligonucleotide; TTC chr2 60526517 60526538 60526522 60526517 -
taattataaatacccatttaat

SEQ ID NO: 214924 - DNA, 22 bp, Artificial Sequence
  Synthetic oligonucleotide; CTA chr2 60526515 60526536 60526520 60526515 -
attataaatacccatttaatta

SEQ ID NO: 214925 - DNA, 22 bp, Artificial Sequence
  Synthetic oligonucleotide; TTA chr2 60526511 60526532 60526516 60526511 -
taaatacccatttaattacccg

SEQ ID NO: 214926 - DNA, 22 bp, Artificial Sequence
  Synthetic oligonucleotide; TTT chr2 60526498 60526519 60526503 60526498 -
aattacccgacacatttttatt

SEQ ID NO: 214927 - DNA, 22 bp, Artificial Sequence
  Synthetic oligonucleotide; TTA chr2 60526497 60526518 60526502 60526497 -
attacccgacacatttttattt

SEQ ID NO: 214928 - DNA, 22 bp, Artificial Sequence
  Synthetic oligonucleotide; TTA chr2 60526493 60526514 60526498 60526493 -
cccgacacatttttattttgcg

SEQ ID NO: 214929 - DNA, 22 bp, Artificial Sequence
  Synthetic oligonucleotide; TTT chr2 60526481 60526502 60526486 60526481 -
ttattttgcggacccttttgag

SEQ ID NO: 214930 - DNA, 22 bp, Artificial Sequence
  Synthetic oligonucleotide; TTT chr2 60526480 60526501 60526485 60526480 -
tattttgcggacccttttgagc

SEQ ID NO: 214931 - DNA, 22 bp, Artificial Sequence
  Synthetic oligonucleotide; TTT chr2 60526479 60526500 60526484 60526479 -
attttgcggacccttttgagca

SEQ ID NO: 214932 - DNA, 22 bp, Artificial Sequence
  Synthetic oligonucleotide; TTA chr2 60526478 60526499 60526483 60526478 -
ttttgcggacccttttgagcac

SEQ ID NO: 214933 - DNA, 22 bp, Artificial Sequence
  Synthetic oligonucleotide; TTT chr2 60526475 60526496 60526480 60526475 -
tgcggacccttttgagcactgc

SEQ ID NO: 214934 - DNA, 22 bp, Artificial Sequence
  Synthetic oligonucleotide; TTT chr2 60526474 60526495 60526479 60526474 -
gcggacccttttgagcactgct

SEQ ID NO: 214935 - DNA, 22 bp, Artificial Sequence
  Synthetic oligonucleotide; TTG chr2 60526473 60526494 60526478 60526473 -
cggacccttttgagcactgctg

SEQ ID NO: 214936 - DNA, 22 bp, Artificial Sequence
  Synthetic oligonucleotide; CTT chr2 60526464 60526485 60526469 60526464 -
ttgagcactgctgtctgcgatg

SEQ ID NO: 214937 - DNA, 22 bp, Artificial Sequence
  Synthetic oligonucleotide; TTT chr2 60526463 60526484 60526468 60526463 -
tgagcactgctgtctgcgatgc

SEQ ID NO: 214938 - DNA, 22 bp, Artificial Sequence
  Synthetic oligonucleotide; TTT chr2 60526462 60526483 60526467 60526462 -
gagcactgctgtctgcgatgca

SEQ ID NO: 214939 - DNA, 22 bp, Artificial Sequence
  Synthetic oligonucleotide; TTG chr2 60526461 60526482 60526466 60526461 -
agcactgctgtctgcgatgcag

SEQ ID NO: 214940 - DNA, 22 bp, Artificial Sequence
  Synthetic oligonucleotide; CTG chr2 60526454 60526475 60526459 60526454 -
ctgtctgcgatgcagagggggt

SEQ ID NO: 214941 - DNA, 22 bp, Artificial Sequence
  Synthetic oligonucleotide; CTG chr2 60526451 60526472 60526456 60526451 -
tctgcgatgcagagggggtggg

SEQ ID NO: 214942 - DNA, 22 bp, Artificial Sequence
  Synthetic oligonucleotide; CTG chr2 60526447 60526468 60526452 60526447 -
cgatgcagagggggtgggggga

SEQ ID NO: 214943 - DNA, 22 bp, Artificial Sequence
  Synthetic oligonucleotide; CTG chr2 60526405 60526426 60526410 60526405 -
cagtaattaatgtacacttccc

SEQ ID NO: 214944 - DNA, 22 bp, Artificial Sequence
  Synthetic oligonucleotide; TTA chr2 60526396 60526417 60526401 60526396 -
atgtacacttcccaaatggtaa

SEQ ID NO: 214945 - DNA, 22 bp, Artificial Sequence
  Synthetic oligonucleotide; CTT chr2 60526386 60526407 60526391 60526386 -
cccaaatggtaaaggataaaca

SEQ ID NO: 214946 - DNA, 22 bp, Artificial Sequence
  Synthetic oligonucleotide; TTC chr2 60526385 60526406 60526390 60526385 -
ccaaatggtaaaggataaacat

SEQ ID NO: 214947 - DNA, 22 bp, Artificial Sequence
  Synthetic oligonucleotide; CTG chr2 60526357 60526378 60526362 60526357 -
ctttgtttgtcttatttattta

SEQ ID NO: 214948 - DNA, 22 bp, Artificial Sequence
  Synthetic oligonucleotide; CTT chr2 60526354 60526375 60526359 60526354 -
tgtttgtcttatttatttattg

SEQ ID NO: 214949 - DNA, 22 bp, Artificial Sequence
  Synthetic oligonucleotide; TTT chr2 60526353 60526374 60526358 60526353 -
gtttgtcttatttatttattga

SEQ ID NO: 214950 - DNA, 22 bp, Artificial Sequence
  Synthetic oligonucleotide; TTG chr2 60526352 60526373 60526357 60526352 -
tttgtcttatttatttattgat

SEQ ID NO: 214951 - DNA, 22 bp, Artificial Sequence
  Synthetic oligonucleotide; TTT chr2 60526349 60526370 60526354 60526349 -
gtcttatttatttattgattag

SEQ ID NO: 214952 - DNA, 22 bp, Artificial Sequence
  Synthetic oligonucleotide; TTG chr2 60526348 60526369 60526353 60526348 -
tcttatttatttattgattaga

SEQ ID NO: 214953 - DNA, 22 bp, Artificial Sequence
  Synthetic oligonucleotide; CTT chr2 60526344 60526365 60526349 60526344 -
atttatttattgattagatgta

SEQ ID NO: 214954 - DNA, 22 bp, Artificial Sequence
  Synthetic oligonucleotide; TTA chr2 60526343 60526364 60526348 60526343 -
tttatttattgattagatgtat

SEQ ID NO: 214955 - DNA, 22 bp, Artificial Sequence
  Synthetic oligonucleotide; TTT chr2 60526340 60526361 60526345 60526340 -
atttattgattagatgtataga

SEQ ID NO: 214956 - DNA, 22 bp, Artificial Sequence
  Synthetic oligonucleotide; TTA chr2 60526339 60526360 60526344 60526339 -
tttattgattagatgtatagag

SEQ ID NO: 214957 - DNA, 22 bp, Artificial Sequence
  Synthetic oligonucleotide; TTT chr2 60526336 60526357 60526341 60526336 -
attgattagatgtatagagact

SEQ ID NO: 214958 - DNA, 22 bp, Artificial Sequence
  Synthetic oligonucleotide; TTA chr2 60526335 60526356 60526340 60526335 -
ttgattagatgtatagagactt

SEQ ID NO: 214959 - DNA, 22 bp, Artificial Sequence
  Synthetic oligonucleotide; TTG chr2 60526332 60526353 60526337 60526332 -
attagatgtatagagactttgg

SEQ ID NO: 214960 - DNA, 22 bp, Artificial Sequence
  Synthetic oligonucleotide; TTA chr2 60526328 60526349 60526333 60526328 -
gatgtatagagactttggcgtg

SEQ ID NO: 214961 - DNA, 22 bp, Artificial Sequence
  Synthetic oligonucleotide; CTT chr2 60526313 60526334 60526318 60526313 -
tggcgtgggcacaatctgaagt

SEQ ID NO: 214962 - DNA, 22 bp, Artificial Sequence
  Synthetic oligonucleotide; TTT chr2 60526312 60526333 60526317 60526312 -
ggcgtgggcacaatctgaagtt

SEQ ID NO: 214963 - DNA, 22 bp, Artificial Sequence
  Synthetic oligonucleotide; TTG chr2 60526311 60526332 60526316 60526311 -
gcgtgggcacaatctgaagttg

SEQ ID NO: 214964 - DNA, 22 bp, Artificial Sequence
  Synthetic oligonucleotide; CTG chr2 60526295 60526316 60526300 60526295 -
aagttgaaatccttttaaagat

SEQ ID NO: 214965 - DNA, 22 bp, Artificial Sequence
  Synthetic oligonucleotide; TTG chr2 60526289 60526310 60526294 60526289 -
aaatccttttaaagatgaaaac

SEQ ID NO: 214966 - DNA, 22 bp, Artificial Sequence
  Synthetic oligonucleotide; CTT chr2 60526281 60526302 60526286 60526281 -
ttaaagatgaaaactatttaaa

SEQ ID NO: 214967 - DNA, 22 bp, Artificial Sequence
  Synthetic oligonucleotide; TTT chr2 60526280 60526301 60526285 60526280 -
taaagatgaaaactatttaaaa

SEQ ID NO: 214968 - DNA, 22 bp, Artificial Sequence
  Synthetic oligonucleotide; TTT chr2 60526279 60526300 60526284 60526279 -
aaagatgaaaactatttaaaaa

SEQ ID NO: 214969 - DNA, 22 bp, Artificial Sequence
  Synthetic oligonucleotide; TTA chr2 60526278 60526299 60526283 60526278 -
aagatgaaaactatttaaaaat

SEQ ID NO: 214970 - DNA, 22 bp, Artificial Sequence
  Synthetic oligonucleotide; CTA chr2 60526265 60526286 60526270 60526265 -
tttaaaaatcttttggggaaga

SEQ ID NO: 214971 - DNA, 22 bp, Artificial Sequence
  Synthetic oligonucleotide; TTT chr2 60526262 60526283 60526267 60526262 -
aaaaatcttttggggaagaaag

SEQ ID NO: 214972 - DNA, 22 bp, Artificial Sequence
  Synthetic oligonucleotide; TTA chr2 60526261 60526282 60526266 60526261 -
aaaatcttttggggaagaaaga

SEQ ID NO: 214973 - DNA, 22 bp, Artificial Sequence
  Synthetic oligonucleotide; CTT chr2 60526253 60526274 60526258 60526253 -
ttggggaagaaagagcaaaata

SEQ ID NO: 214974 - DNA, 22 bp, Artificial Sequence
  Synthetic oligonucleotide; TTT chr2 60526252 60526273 60526257 60526252 -
tggggaagaaagagcaaaatat

SEQ ID NO: 214975 - DNA, 22 bp, Artificial Sequence
  Synthetic oligonucleotide; TTT chr2 60526251 60526272 60526256 60526251 -
ggggaagaaagagcaaaatata

SEQ ID NO: 214976 - DNA, 22 bp, Artificial Sequence
  Synthetic oligonucleotide; TTG chr2 60526250 60526271 60526255 60526250 -
gggaagaaagagcaaaatatag

SEQ ID NO: 214977 - DNA, 22 bp, Artificial Sequence
  Synthetic oligonucleotide; CTT chr2 60526214 60526235 60526219 60526214 -
tctgctagaacacatcatccca

SEQ ID NO: 214978 - DNA, 22 bp, Artificial Sequence
  Synthetic oligonucleotide; TTT chr2 60526213 60526234 60526218 60526213 -
ctgctagaacacatcatcccaa

SEQ ID NO: 214979 - DNA, 22 bp, Artificial Sequence
  Synthetic oligonucleotide; TTC chr2 60526212 60526233 60526217 60526212 -
tgctagaacacatcatcccaaa

SEQ ID NO: 214980 - DNA, 22 bp, Artificial Sequence
  Synthetic oligonucleotide; CTG chr2 60526210 60526231 60526215 60526210 -
ctagaacacatcatcccaaaat

SEQ ID NO: 214981 - DNA, 22 bp, Artificial Sequence
  Synthetic oligonucleotide; CTA chr2 60526207 60526228 60526212 60526207 -
gaacacatcatcccaaaatatg

SEQ ID NO: 214982 - DNA, 22 bp, Artificial Sequence
  Synthetic oligonucleotide; TTC chr2 60526179 60526200 60526184 60526179 -
tgaatttgatcaaatcaccagt

SEQ ID NO: 214983 - DNA, 22 bp, Artificial Sequence
  Synthetic oligonucleotide; CTG chr2 60526177 60526198 60526182 60526177 -
aatttgatcaaatcaccagttt

SEQ ID NO: 214984 - DNA, 22 bp, Artificial Sequence
  Synthetic oligonucleotide; TTT chr2 60526172 60526193 60526177 60526172 -
gatcaaatcaccagtttctgaa

SEQ ID NO: 214985 - DNA, 22 bp, Artificial Sequence
  Synthetic oligonucleotide; TTG chr2 60526171 60526192 60526176 60526171 -
atcaaatcaccagtttctgaat

SEQ ID NO: 214986 - DNA, 22 bp, Artificial Sequence
  Synthetic oligonucleotide; TTT chr2 60526155 60526176 60526160 60526155 -
ctgaatttgatcaaatctagat

SEQ ID NO: 214987 - DNA, 22 bp, Artificial Sequence
  Synthetic oligonucleotide; TTC chr2 60526154 60526175 60526159 60526154 -
tgaatttgatcaaatctagatt

SEQ ID NO: 214988 - DNA, 22 bp, Artificial Sequence
  Synthetic oligonucleotide; CTG chr2 60526152 60526173 60526157 60526152 -
aatttgatcaaatctagatttt

SEQ ID NO: 214989 - DNA, 22 bp, Artificial Sequence
  Synthetic oligonucleotide; TTT chr2 60526147 60526168 60526152 60526147 -
gatcaaatctagattttgcaga

SEQ ID NO: 214990 - DNA, 22 bp, Artificial Sequence
  Synthetic oligonucleotide; TTG chr2 60526146 60526167 60526151 60526146 -
atcaaatctagattttgcagaa

SEQ ID NO: 214991 - DNA, 22 bp, Artificial Sequence
  Synthetic oligonucleotide; CTA chr2 60526136 60526157 60526141 60526136 -
gattttgcagaagttcagggtg

SEQ ID NO: 214992 - DNA, 22 bp, Artificial Sequence
  Synthetic oligonucleotide; TTT chr2 60526131 60526152 60526136 60526131 -
tgcagaagttcagggtgagaga

SEQ ID NO: 214993 - DNA, 22 bp, Artificial Sequence
  Synthetic oligonucleotide; TTT chr2 60526130 60526151 60526135 60526130 -
gcagaagttcagggtgagagaa

SEQ ID NO: 214994 - DNA, 22 bp, Artificial Sequence
  Synthetic oligonucleotide; TTG chr2 60526129 60526150 60526134 60526129 -
cagaagttcagggtgagagaaa

SEQ ID NO: 214995 - DNA, 22 bp, Artificial Sequence
  Synthetic oligonucleotide; TTC chr2 60526120 60526141 60526125 60526120 -
agggtgagagaaaccatgcctg

SEQ ID NO: 214996 - DNA, 22 bp, Artificial Sequence
  Synthetic oligonucleotide; CTG chr2 60526098 60526119 60526103 60526098 -
ttttatatctagaaagtgaaat

SEQ ID NO: 214997 - DNA, 22 bp, Artificial Sequence
  Synthetic oligonucleotide; TTT chr2 60526095 60526116 60526100 60526095 -
tatatctagaaagtgaaatcat

SEQ ID NO: 214998 - DNA, 22 bp, Artificial Sequence
  Synthetic oligonucleotide; TTT chr2 60526094 60526115 60526099 60526094 -
atatctagaaagtgaaatcatt

SEQ ID NO: 214999 - DNA, 22 bp, Artificial Sequence
  Synthetic oligonucleotide; TTA chr2 60526093 60526114 60526098 60526093 -
tatctagaaagtgaaatcattg

SEQ ID NO: 215000 - DNA, 22 bp, Artificial Sequence
  Synthetic oligonucleotide; CTA chr2 60526087 60526108 60526092 60526087 -
gaaagtgaaatcattgttatag

SEQ ID NO: 215001 - DNA, 22 bp, Artificial Sequence
  Synthetic oligonucleotide; TTG chr2 60526071 60526092 60526076 60526071 -
ttatagaaaaaacctactgtgg

SEQ ID NO: 215002 - DNA, 22 bp, Artificial Sequence
  Synthetic oligonucleotide; TTA chr2 60526068 60526089 60526073 60526068 -
tagaaaaaacctactgtggtta

SEQ ID NO: 215003 - DNA, 22 bp, Artificial Sequence
  Synthetic oligonucleotide; CTA chr2 60526055 60526076 60526060 60526055 -
ctgtggttagaaaaaaaccaca

SEQ ID NO: 215004 - DNA, 22 bp, Artificial Sequence
  Synthetic oligonucleotide; CTG chr2 60526052 60526073 60526057 60526052 -
tggttagaaaaaaaccacattc

SEQ ID NO: 215005 - DNA, 22 bp, Artificial Sequence
  Synthetic oligonucleotide; TTA chr2 60526046 60526067 60526051 60526046 -
gaaaaaaaccacattctttttt

SEQ ID NO: 215006 - DNA, 22 bp, Artificial Sequence
  Synthetic oligonucleotide; TTC chr2 60526030 60526051 60526035 60526030 -
ttttttcccagccctgctgcca

SEQ ID NO: 215007 - DNA, 22 bp, Artificial Sequence
  Synthetic oligonucleotide; CTT chr2 60526028 60526049 60526033 60526028 -
ttttcccagccctgctgccatc

SEQ ID NO: 215008 - DNA, 22 bp, Artificial Sequence
  Synthetic oligonucleotide; TTT chr2 60526027 60526048 60526032 60526027 -
tttcccagccctgctgccatcc

SEQ ID NO: 215009 - DNA, 22 bp, Artificial Sequence
  Synthetic oligonucleotide; TTT chr2 60526026 60526047 60526031 60526026 -
ttcccagccctgctgccatcct

SEQ ID NO: 215010 - DNA, 22 bp, Artificial Sequence
  Synthetic oligonucleotide; TTT chr2 60526025 60526046 60526030 60526025 -
tcccagccctgctgccatcctc

SEQ ID NO: 215011 - DNA, 22 bp, Artificial Sequence
  Synthetic oligonucleotide; TTT chr2 60526024 60526045 60526029 60526024 -
cccagccctgctgccatcctct

SEQ ID NO: 215012 - DNA, 22 bp, Artificial Sequence
  Synthetic oligonucleotide; TTC chr2 60526023 60526044 60526028 60526023 -
ccagccctgctgccatcctcta

SEQ ID NO: 215013 - DNA, 22 bp, Artificial Sequence
  Synthetic oligonucleotide; CTG chr2 60526014 60526035 60526019 60526014 -
ctgccatcctctaccagaaaat

SEQ ID NO: 215014 - DNA, 22 bp, Artificial Sequence
  Synthetic oligonucleotide; CTG chr2 60526011 60526032 60526016 60526011 -
ccatcctctaccagaaaataac

SEQ ID NO: 215015 - DNA, 22 bp, Artificial Sequence
  Synthetic oligonucleotide; CTC chr2 60526003 60526024 60526008 60526003 -
taccagaaaataacagtatctg

SEQ ID NO: 215016 - DNA, 22 bp, Artificial Sequence
  Synthetic oligonucleotide; CTA chr2 60526001 60526022 60526006 60526001 -
ccagaaaataacagtatctgcc

SEQ ID NO: 215017 - DNA, 22 bp, Artificial Sequence
  Synthetic oligonucleotide; CTG chr2 60525981 60526002 60525986 60525981 -
cctgtagtatgaagaccttcca

SEQ ID NO: 215018 - DNA, 22 bp, Artificial Sequence
  Synthetic oligonucleotide; CTG chr2 60525977 60525998 60525982 60525977 -
tagtatgaagaccttccaattg

SEQ ID NO: 215019 - DNA, 22 bp, Artificial Sequence
  Synthetic oligonucleotide; CTT chr2 60525962 60525983 60525967 60525962 -
ccaattgagagcattatgataa

SEQ ID NO: 215020 - DNA, 22 bp, Artificial Sequence
  Synthetic oligonucleotide; TTC chr2 60525961 60525982 60525966 60525961 -
caattgagagcattatgataaa

SEQ ID NO: 215021 - DNA, 22 bp, Artificial Sequence
  Synthetic oligonucleotide; TTG chr2 60525955 60525976 60525960 60525955 -
agagcattatgataaactattt

SEQ ID NO: 215022 - DNA, 22 bp, Artificial Sequence
  Synthetic oligonucleotide; TTA chr2 60525946 60525967 60525951 60525946 -
tgataaactatttttgattacc

SEQ ID NO: 215023 - DNA, 22 bp, Artificial Sequence
  Synthetic oligonucleotide; CTA chr2 60525936 60525957 60525941 60525936 -
tttttgattaccaaacacgaat

SEQ ID NO: 215024 - DNA, 22 bp, Artificial Sequence
  Synthetic oligonucleotide; TTT chr2 60525933 60525954 60525938 60525933 -
ttgattaccaaacacgaatgaa

SEQ ID NO: 215025 - DNA, 22 bp, Artificial Sequence
  Synthetic oligonucleotide; TTT chr2 60525932 60525953 60525937 60525932 -
tgattaccaaacacgaatgaag

SEQ ID NO: 215026 - DNA, 22 bp, Artificial Sequence
  Synthetic oligonucleotide; TTT chr2 60525931 60525952 60525936 60525931 -
gattaccaaacacgaatgaagg

SEQ ID NO: 215027 - DNA, 22 bp, Artificial Sequence
  Synthetic oligonucleotide; TTG chr2 60525930 60525951 60525935 60525930 -
attaccaaacacgaatgaagga

SEQ ID NO: 215028 - DNA, 22 bp, Artificial Sequence
  Synthetic oligonucleotide; TTA chr2 60525926 60525947 60525931 60525926 -
ccaaacacgaatgaaggaagaa

SEQ ID NO: 215029 - DNA, 22 bp, Artificial Sequence
  Synthetic oligonucleotide; TTA chr2 60525888 60525909 60525893 60525888 -
gtaaaggccttccaagtagaca

SEQ ID NO: 215030 - DNA, 22 bp, Artificial Sequence
  Synthetic oligonucleotide; CTT chr2 60525877 60525898 60525882 60525877 -
ccaagtagacatttacccttct

SEQ ID NO: 215031 - DNA, 22 bp, Artificial Sequence
  Synthetic oligonucleotide; TTC chr2 60525876 60525897 60525881 60525876 -
caagtagacatttacccttctg

SEQ ID NO: 215032 - DNA, 22 bp, Artificial Sequence
  Synthetic oligonucleotide; TTT chr2 60525863 60525884 60525868 60525863 -
acccttctgtgaaagccatgga

SEQ ID NO: 215033 - DNA, 22 bp, Artificial Sequence
  Synthetic oligonucleotide; TTA chr2 60525862 60525883 60525867 60525862 -
cccttctgtgaaagccatggag

SEQ ID NO: 215034 - DNA, 22 bp, Artificial Sequence
  Synthetic oligonucleotide; CTT chr2 60525857 60525878 60525862 60525857 -
ctgtgaaagccatggagaaatt

SEQ ID NO: 215035 - DNA, 22 bp, Artificial Sequence
  Synthetic oligonucleotide; TTC chr2 60525856 60525877 60525861 60525856 -
tgtgaaagccatggagaaatta

SEQ ID NO: 215036 - DNA, 22 bp, Artificial Sequence
  Synthetic oligonucleotide; CTG chr2 60525854 60525875 60525859 60525854 -
tgaaagccatggagaaattacc

SEQ ID NO: 215037 - DNA, 22 bp, Artificial Sequence
  Synthetic oligonucleotide; TTA chr2 60525834 60525855 60525839 60525834 -
ccaagactggtttggggggagg

SEQ ID NO: 215038 - DNA, 22 bp, Artificial Sequence
  Synthetic oligonucleotide; CTG chr2 60525825 60525846 60525830 60525825 -
gtttggggggagggcatttaag

SEQ ID NO: 215039 - DNA, 22 bp, Artificial Sequence
  Synthetic oligonucleotide; TTT chr2 60525821 60525842 60525826 60525821 -
ggggggagggcatttaaggtct

SEQ ID NO: 215040 - DNA, 22 bp, Artificial Sequence
  Synthetic oligonucleotide; TTG chr2 60525820 60525841 60525825 60525820 -
gggggagggcatttaaggtctt

SEQ ID NO: 215041 - DNA, 22 bp, Artificial Sequence
  Synthetic oligonucleotide; TTT chr2 60525806 60525827 60525811 60525806 -
aaggtcttttgggcattacaga

SEQ ID NO: 215042 - DNA, 22 bp, Artificial Sequence
  Synthetic oligonucleotide; TTA chr2 60525805 60525826 60525810 60525805 -
aggtcttttgggcattacagat

SEQ ID NO: 215043 - DNA, 22 bp, Artificial Sequence
  Synthetic oligonucleotide; CTT chr2 60525798 60525819 60525803 60525798 -
ttgggcattacagattttccag

SEQ ID NO: 215044 - DNA, 22 bp, Artificial Sequence
  Synthetic oligonucleotide; TTT chr2 60525797 60525818 60525802 60525797 -
tgggcattacagattttccaga

SEQ ID NO: 215045 - DNA, 22 bp, Artificial Sequence
  Synthetic oligonucleotide; TTT chr2 60525796 60525817 60525801 60525796 -
gggcattacagattttccagaa

SEQ ID NO: 215046 - DNA, 22 bp, Artificial Sequence
  Synthetic oligonucleotide; TTG chr2 60525795 60525816 60525800 60525795 -
ggcattacagattttccagaac

SEQ ID NO: 215047 - DNA, 22 bp, Artificial Sequence
  Synthetic oligonucleotide; TTA chr2 60525788 60525809 60525793 60525788 -
cagattttccagaaccaaactt

SEQ ID NO: 215048 - DNA, 22 bp, Artificial Sequence
  Synthetic oligonucleotide; TTT chr2 60525781 60525802 60525786 60525781 -
tccagaaccaaactttgacttt

SEQ ID NO: 215049 - DNA, 22 bp, Artificial Sequence
  Synthetic oligonucleotide; TTT chr2 60525780 60525801 60525785 60525780 -
ccagaaccaaactttgactttt

SEQ ID NO: 215050 - DNA, 22 bp, Artificial Sequence
  Synthetic oligonucleotide; TTC chr2 60525779 60525800 60525784 60525779 -
cagaaccaaactttgactttta

SEQ ID NO: 215051 - DNA, 22 bp, Artificial Sequence
  Synthetic oligonucleotide; CTT chr2 60525766 60525787 60525771 60525766 -
tgacttttagtgttaacagaga

SEQ ID NO: 215052 - DNA, 22 bp, Artificial Sequence
  Synthetic oligonucleotide; TTT chr2 60525765 60525786 60525770 60525765 -
gacttttagtgttaacagagag

SEQ ID NO: 215053 - DNA, 22 bp, Artificial Sequence
  Synthetic oligonucleotide; TTG chr2 60525764 60525785 60525769 60525764 -
acttttagtgttaacagagaga

SEQ ID NO: 215054 - DNA, 22 bp, Artificial Sequence
  Synthetic oligonucleotide; CTT chr2 60525760 60525781 60525765 60525760 -
ttagtgttaacagagagacact

SEQ ID NO: 215055 - DNA, 22 bp, Artificial Sequence
  Synthetic oligonucleotide; TTT chr2 60525759 60525780 60525764 60525759 -
tagtgttaacagagagacactg

SEQ ID NO: 215056 - DNA, 22 bp, Artificial Sequence
  Synthetic oligonucleotide; TTT chr2 60525758 60525779 60525763 60525758 -
agtgttaacagagagacactga

SEQ ID NO: 215057 - DNA, 22 bp, Artificial Sequence
  Synthetic oligonucleotide; TTA chr2 60525757 60525778 60525762 60525757 -
gtgttaacagagagacactgat

SEQ ID NO: 215058 - DNA, 22 bp, Artificial Sequence
  Synthetic oligonucleotide; TTA chr2 60525751 60525772 60525756 60525751 -
acagagagacactgatctgaaa

SEQ ID NO: 215059 - DNA, 22 bp, Artificial Sequence
  Synthetic oligonucleotide; CTG chr2 60525737 60525758 60525742 60525737 -
atctgaaaaccaggacacctgg

SEQ ID NO: 215060 - DNA, 22 bp, Artificial Sequence
  Synthetic oligonucleotide; CTG chr2 60525732 60525753 60525737 60525732 -
aaaaccaggacacctgggttct

SEQ ID NO: 215061 - DNA, 22 bp, Artificial Sequence
  Synthetic oligonucleotide; CTG chr2 60525716 60525737 60525721 60525716 -
ggttctgacccttattgtatca

SEQ ID NO: 215062 - DNA, 22 bp, Artificial Sequence
  Synthetic oligonucleotide; TTC chr2 60525711 60525732 60525716 60525711 -
tgacccttattgtatcatgctg

SEQ ID NO: 215063 - DNA, 22 bp, Artificial Sequence
  Synthetic oligonucleotide; CTG chr2 60525709 60525730 60525714 60525709 -
acccttattgtatcatgctgtg

SEQ ID NO: 215064 - DNA, 22 bp, Artificial Sequence
  Synthetic oligonucleotide; CTT chr2 60525703 60525724 60525708 60525703 -
attgtatcatgctgtgagattt

SEQ ID NO: 215065 - DNA, 22 bp, Artificial Sequence
  Synthetic oligonucleotide; TTA chr2 60525702 60525723 60525707 60525702 -
ttgtatcatgctgtgagatttt

SEQ ID NO: 215066 - DNA, 22 bp, Artificial Sequence
  Synthetic oligonucleotide; TTG chr2 60525699 60525720 60525704 60525699 -
tatcatgctgtgagattttggg

SEQ ID NO: 215067 - DNA, 22 bp, Artificial Sequence
  Synthetic oligonucleotide; CTG chr2 60525689 60525710 60525694 60525689 -
tgagattttgggctcccttcac

SEQ ID NO: 215068 - DNA, 22 bp, Artificial Sequence
  Synthetic oligonucleotide; TTT chr2 60525681 60525702 60525686 60525681 -
tgggctcccttcacctgttagc

SEQ ID NO: 215069 - DNA, 22 bp, Artificial Sequence
  Synthetic oligonucleotide; TTT chr2 60525680 60525701 60525685 60525680 -
gggctcccttcacctgttagca

SEQ ID NO: 215070 - DNA, 22 bp, Artificial Sequence
  Synthetic oligonucleotide; TTG chr2 60525679 60525700 60525684 60525679 -
ggctcccttcacctgttagcat

SEQ ID NO: 215071 - DNA, 22 bp, Artificial Sequence
  Synthetic oligonucleotide; CTC chr2 60525674 60525695 60525679 60525674 -
ccttcacctgttagcatttgtt

SEQ ID NO: 215072 - DNA, 22 bp, Artificial Sequence
  Synthetic oligonucleotide; CTT chr2 60525670 60525691 60525675 60525670 -
cacctgttagcatttgtttcct

SEQ ID NO: 215073 - DNA, 22 bp, Artificial Sequence
  Synthetic oligonucleotide; TTC chr2 60525669 60525690 60525674 60525669 -
acctgttagcatttgtttcctt

SEQ ID NO: 215074 - DNA, 22 bp, Artificial Sequence
  Synthetic oligonucleotide; CTG chr2 60525664 60525685 60525669 60525664 -
ttagcatttgtttccttgtctt

SEQ ID NO: 215075 - DNA, 22 bp, Artificial Sequence
  Synthetic oligonucleotide; TTA chr2 60525661 60525682 60525666 60525661 -
gcatttgtttccttgtcttgta

SEQ ID NO: 215076 - DNA, 22 bp, Artificial Sequence
  Synthetic oligonucleotide; TTT chr2 60525655 60525676 60525660 60525655 -
gtttccttgtcttgtaaagtag

SEQ ID NO: 215077 - DNA, 22 bp, Artificial Sequence
  Synthetic oligonucleotide; TTG chr2 60525654 60525675 60525659 60525654 -
tttccttgtcttgtaaagtagg

SEQ ID NO: 215078 - DNA, 22 bp, Artificial Sequence
  Synthetic oligonucleotide; TTT chr2 60525651 60525672 60525656 60525651 -
ccttgtcttgtaaagtaggtaa

SEQ ID NO: 215079 - DNA, 22 bp, Artificial Sequence
  Synthetic oligonucleotide; TTC chr2 60525650 60525671 60525655 60525650 -
cttgtcttgtaaagtaggtaaa

SEQ ID NO: 215080 - DNA, 22 bp, Artificial Sequence
  Synthetic oligonucleotide; CTT chr2 60525647 60525668 60525652 60525647 -
gtcttgtaaagtaggtaaaata

SEQ ID NO: 215081 - DNA, 22 bp, Artificial Sequence
  Synthetic oligonucleotide; TTG chr2 60525646 60525667 60525651 60525646 -
tcttgtaaagtaggtaaaatag

SEQ ID NO: 215082 - DNA, 22 bp, Artificial Sequence
  Synthetic oligonucleotide; CTT chr2 60525642 60525663 60525647 60525642 -
gtaaagtaggtaaaatagatag

SEQ ID NO: 215083 - DNA, 22 bp, Artificial Sequence
  Synthetic oligonucleotide; TTG chr2 60525641 60525662 60525646 60525641 -
taaagtaggtaaaatagatagt

SEQ ID NO: 215084 - DNA, 22 bp, Artificial Sequence
  Synthetic oligonucleotide; TTT chr2 60525617 60525638 60525622 60525617 -
ggactgggtgggtctctaagtc

SEQ ID NO: 215085 - DNA, 22 bp, Artificial Sequence
  Synthetic oligonucleotide; TTG chr2 60525616 60525637 60525621 60525616 -
gactgggtgggtctctaagtcc

SEQ ID NO: 215086 - DNA, 22 bp, Artificial Sequence
  Synthetic oligonucleotide; CTG chr2 60525611 60525632 60525616 60525611 -
ggtgggtctctaagtccccatg

SEQ ID NO: 215087 - DNA, 22 bp, Artificial Sequence
  Synthetic oligonucleotide; CTC chr2 60525601 60525622 60525606 60525601 -
taagtccccatgatgttctagc

SEQ ID NO: 215088 - DNA, 22 bp, Artificial Sequence
  Synthetic oligonucleotide; CTA chr2 60525599 60525620 60525604 60525599 -
agtccccatgatgttctagcat

SEQ ID NO: 215089 - DNA, 22 bp, Artificial Sequence
  Synthetic oligonucleotide; TTC chr2 60525583 60525604 60525588 60525583 -
tagcatagtatgaacaccactg

SEQ ID NO: 215090 - DNA, 22 bp, Artificial Sequence
  Synthetic oligonucleotide; CTA chr2 60525581 60525602 60525586 60525581 -
gcatagtatgaacaccactgac

SEQ ID NO: 215091 - DNA, 22 bp, Artificial Sequence
  Synthetic oligonucleotide; CTG chr2 60525561 60525582 60525566 60525561 -
accagttttctccctgctattt

SEQ ID NO: 215092 - DNA, 22 bp, Artificial Sequence
  Synthetic oligonucleotide; TTT chr2 60525553 60525574 60525558 60525553 -
tctccctgctattttttggaat

SEQ ID NO: 215093 - DNA, 22 bp, Artificial Sequence
  Synthetic oligonucleotide; TTT chr2 60525552 60525573 60525557 60525552 -
ctccctgctattttttggaatc

SEQ ID NO: 215094 - DNA, 22 bp, Artificial Sequence
  Synthetic oligonucleotide; TTC chr2 60525551 60525572 60525556 60525551 -
tccctgctattttttggaatct

SEQ ID NO: 215095 - DNA, 22 bp, Artificial Sequence
  Synthetic oligonucleotide; CTC chr2 60525549 60525570 60525554 60525549 -
cctgctattttttggaatctag

SEQ ID NO: 215096 - DNA, 22 bp, Artificial Sequence
  Synthetic oligonucleotide; CTG chr2 60525545 60525566 60525550 60525545 -
ctattttttggaatctagttgc

SEQ ID NO: 215097 - DNA, 22 bp, Artificial Sequence
  Synthetic oligonucleotide; CTA chr2 60525542 60525563 60525547 60525542 -
ttttttggaatctagttgctga

SEQ ID NO: 215098 - DNA, 22 bp, Artificial Sequence
  Synthetic oligonucleotide; TTT chr2 60525539 60525560 60525544 60525539 -
tttggaatctagttgctgaatg

SEQ ID NO: 215099 - DNA, 22 bp, Artificial Sequence
  Synthetic oligonucleotide; TTT chr2 60525538 60525559 60525543 60525538 -
ttggaatctagttgctgaatgg

SEQ ID NO: 215100 - DNA, 22 bp, Artificial Sequence
  Synthetic oligonucleotide; TTT chr2 60525537 60525558 60525542 60525537 -
tggaatctagttgctgaatggg

SEQ ID NO: 215101 - DNA, 22 bp, Artificial Sequence
  Synthetic oligonucleotide; TTT chr2 60525536 60525557 60525541 60525536 -
ggaatctagttgctgaatgggg

SEQ ID NO: 215102 - DNA, 22 bp, Artificial Sequence
  Synthetic oligonucleotide; TTG chr2 60525535 60525556 60525540 60525535 -
gaatctagttgctgaatggggc

SEQ ID NO: 215103 - DNA, 22 bp, Artificial Sequence
  Synthetic oligonucleotide; CTA chr2 60525528 60525549 60525533 60525528 -
gttgctgaatggggctcacctg

SEQ ID NO: 215104 - DNA, 22 bp, Artificial Sequence
  Synthetic oligonucleotide; TTG chr2 60525524 60525545 60525529 60525524 -
ctgaatggggctcacctgcaaa

SEQ ID NO: 215105 - DNA, 22 bp, Artificial Sequence
  Synthetic oligonucleotide; CTG chr2 60525521 60525542 60525526 60525521 -
aatggggctcacctgcaaagac

SEQ ID NO: 215106 - DNA, 22 bp, Artificial Sequence
  Synthetic oligonucleotide; CTC chr2 60525511 60525532 60525516 60525511 -
acctgcaaagacagcagaatat

SEQ ID NO: 215107 - DNA, 22 bp, Artificial Sequence
  Synthetic oligonucleotide; CTG chr2 60525506 60525527 60525511 60525506 -
caaagacagcagaatattattt

SEQ ID NO: 215108 - DNA, 22 bp, Artificial Sequence
  Synthetic oligonucleotide; TTA chr2 60525487 60525508 60525492 60525487 -
ttttcttgatttgcctcaaaga

SEQ ID NO: 215109 - DNA, 22 bp, Artificial Sequence
  Synthetic oligonucleotide; TTT chr2 60525484 60525505 60525489 60525484 -
tcttgatttgcctcaaagatgg

SEQ ID NO: 215110 - DNA, 22 bp, Artificial Sequence
  Synthetic oligonucleotide; TTT chr2 60525483 60525504 60525488 60525483 -
cttgatttgcctcaaagatgga

SEQ ID NO: 215111 - DNA, 22 bp, Artificial Sequence
  Synthetic oligonucleotide; TTC chr2 60525482 60525503 60525487 60525482 -
ttgatttgcctcaaagatggaa

SEQ ID NO: 215112 - DNA, 22 bp, Artificial Sequence
  Synthetic oligonucleotide; CTT chr2 60525480 60525501 60525485 60525480 -
gatttgcctcaaagatggaagc

SEQ ID NO: 215113 - DNA, 22 bp, Artificial Sequence
  Synthetic oligonucleotide; TTG chr2 60525479 60525500 60525484 60525479 -
atttgcctcaaagatggaagct

SEQ ID NO: 215114 - DNA, 22 bp, Artificial Sequence
  Synthetic oligonucleotide; TTT chr2 60525475 60525496 60525480 60525475 -
gcctcaaagatggaagctatgg

SEQ ID NO: 215115 - DNA, 22 bp, Artificial Sequence
  Synthetic oligonucleotide; TTG chr2 60525474 60525495 60525479 60525474 -
cctcaaagatggaagctatggt

SEQ ID NO: 215116 - DNA, 22 bp, Artificial Sequence
  Synthetic oligonucleotide; CTC chr2 60525470 60525491 60525475 60525470 -
aaagatggaagctatggtggag

SEQ ID NO: 215117 - DNA, 22 bp, Artificial Sequence
  Synthetic oligonucleotide; CTA chr2 60525456 60525477 60525461 60525456 -
tggtggagattaaggcttggat

SEQ ID NO: 215118 - DNA, 22 bp, Artificial Sequence
  Synthetic oligonucleotide; TTA chr2 60525444 60525465 60525449 60525444 -
aggcttggattcgtgattcccc

SEQ ID NO: 215119 - DNA, 22 bp, Artificial Sequence
  Synthetic oligonucleotide; CTT chr2 60525438 60525459 60525443 60525438 -
ggattcgtgattccccaacaga

SEQ ID NO: 215120 - DNA, 22 bp, Artificial Sequence
  Synthetic oligonucleotide; TTG chr2 60525437 60525458 60525442 60525437 -
gattcgtgattccccaacagaa

SEQ ID NO: 215121 - DNA, 22 bp, Artificial Sequence
  Synthetic oligonucleotide; TTC chr2 60525432 60525453 60525437 60525432 -
gtgattccccaacagaaagctt

SEQ ID NO: 215122 - DNA, 22 bp, Artificial Sequence
  Synthetic oligonucleotide; TTC chr2 60525425 60525446 60525430 60525425 -
cccaacagaaagcttaaaggca

SEQ ID NO: 215123 - DNA, 22 bp, Artificial Sequence
  Synthetic oligonucleotide; CTT chr2 60525410 60525431 60525415 60525410 -
aaaggcatctttcaaattgctg

SEQ ID NO: 215124 - DNA, 22 bp, Artificial Sequence
  Synthetic oligonucleotide; TTA chr2 60525409 60525430 60525414 60525409 -
aaggcatctttcaaattgctgg

SEQ ID NO: 215125 - DNA, 22 bp, Artificial Sequence
  Synthetic oligonucleotide; CTT chr2 60525399 60525420 60525404 60525399 -
tcaaattgctggaagcaaaatt

SEQ ID NO: 215126 - DNA, 22 bp, Artificial Sequence
  Synthetic oligonucleotide; TTT chr2 60525398 60525419 60525403 60525398 -
caaattgctggaagcaaaattg

SEQ ID NO: 215127 - DNA, 22 bp, Artificial Sequence
  Synthetic oligonucleotide; TTC chr2 60525397 60525418 60525402 60525397 -
aaattgctggaagcaaaattga

SEQ ID NO: 215128 - DNA, 22 bp, Artificial Sequence
  Synthetic oligonucleotide; TTG chr2 60525391 60525412 60525396 60525391 -
ctggaagcaaaattgaagtgca

SEQ ID NO: 215129 - DNA, 22 bp, Artificial Sequence
  Synthetic oligonucleotide; CTG chr2 60525388 60525409 60525393 60525388 -
gaagcaaaattgaagtgcagta

SEQ ID NO: 215130 - DNA, 22 bp, Artificial Sequence
  Synthetic oligonucleotide; TTG chr2 60525376 60525397 60525381 60525376 -
aagtgcagtataatggaatggt

SEQ ID NO: 215131 - DNA, 22 bp, Artificial Sequence
  Synthetic oligonucleotide; TTC chr2 60525346 60525367 60525351 60525346 -
acagaagtttccagccttataa

SEQ ID NO: 215132 - DNA, 22 bp, Artificial Sequence
  Synthetic oligonucleotide; TTT chr2 60525336 60525357 60525341 60525336 -
ccagccttataagatttctcca

SEQ ID NO: 215133 - DNA, 22 bp, Artificial Sequence
  Synthetic oligonucleotide; TTC chr2 60525335 60525356 60525340 60525335 -
cagccttataagatttctccat

SEQ ID NO: 215134 - DNA, 22 bp, Artificial Sequence
  Synthetic oligonucleotide; CTT chr2 60525328 60525349 60525333 60525328 -
ataagatttctccatcttttaa

SEQ ID NO: 215135 - DNA, 22 bp, Artificial Sequence
  Synthetic oligonucleotide; TTA chr2 60525327 60525348 60525332 60525327 -
taagatttctccatcttttaat

SEQ ID NO: 215136 - DNA, 22 bp, Artificial Sequence
  Synthetic oligonucleotide; TTT chr2 60525319 60525340 60525324 60525319 -
ctccatcttttaattgttgcaa

SEQ ID NO: 215137 - DNA, 22 bp, Artificial Sequence
  Synthetic oligonucleotide; TTC chr2 60525318 60525339 60525323 60525318 -
tccatcttttaattgttgcaag

SEQ ID NO: 215138 - DNA, 22 bp, Artificial Sequence
  Synthetic oligonucleotide; CTC chr2 60525316 60525337 60525321 60525316 -
catcttttaattgttgcaagct

SEQ ID NO: 215139 - DNA, 22 bp, Artificial Sequence
  Synthetic oligonucleotide; CTT chr2 60525310 60525331 60525315 60525310 -
ttaattgttgcaagctgttttt

SEQ ID NO: 215140 - DNA, 22 bp, Artificial Sequence
  Synthetic oligonucleotide; TTT chr2 60525309 60525330 60525314 60525309 -
taattgttgcaagctgtttttt

SEQ ID NO: 215141 - DNA, 22 bp, Artificial Sequence
  Synthetic oligonucleotide; TTT chr2 60525308 60525329 60525313 60525308 -
aattgttgcaagctgttttttt

SEQ ID NO: 215142 - DNA, 22 bp, Artificial Sequence
  Synthetic oligonucleotide; TTA chr2 60525307 60525328 60525312 60525307 -
attgttgcaagctgtttttttt

SEQ ID NO: 215143 - DNA, 22 bp, Artificial Sequence
  Synthetic oligonucleotide; TTG chr2 60525303 60525324 60525308 60525303 -
ttgcaagctgttttttttgaaa

SEQ ID NO: 215144 - DNA, 22 bp, Artificial Sequence
  Synthetic oligonucleotide; TTG chr2 60525300 60525321 60525305 60525300 -
caagctgttttttttgaaaaac

SEQ ID NO: 215145 - DNA, 22 bp, Artificial Sequence
  Synthetic oligonucleotide; CTG chr2 60525293 60525314 60525298 60525293 -
ttttttttgaaaaactccaaag

SEQ ID NO: 215146 - DNA, 22 bp, Artificial Sequence
  Synthetic oligonucleotide; TTT chr2 60525290 60525311 60525295 60525290 -
tttttgaaaaactccaaagaat

SEQ ID NO: 215147 - DNA, 22 bp, Artificial Sequence
  Synthetic oligonucleotide; TTT chr2 60525289 60525310 60525294 60525289 -
ttttgaaaaactccaaagaatg

SEQ ID NO: 215148 - DNA, 22 bp, Artificial Sequence
  Synthetic oligonucleotide; TTT chr2 60525288 60525309 60525293 60525288 -
tttgaaaaactccaaagaatgt

SEQ ID NO: 215149 - DNA, 22 bp, Artificial Sequence
  Synthetic oligonucleotide; TTT chr2 60525287 60525308 60525292 60525287 -
ttgaaaaactccaaagaatgta

SEQ ID NO: 215150 - DNA, 22 bp, Artificial Sequence
  Synthetic oligonucleotide; TTT chr2 60525286 60525307 60525291 60525286 -
tgaaaaactccaaagaatgtaa

SEQ ID NO: 215151 - DNA, 22 bp, Artificial Sequence
  Synthetic oligonucleotide; TTT chr2 60525285 60525306 60525290 60525285 -
gaaaaactccaaagaatgtaat

SEQ ID NO: 215152 - DNA, 22 bp, Artificial Sequence
  Synthetic oligonucleotide; TTG chr2 60525284 60525305 60525289 60525284 -
aaaaactccaaagaatgtaatg

SEQ ID NO: 215153 - DNA, 22 bp, Artificial Sequence
  Synthetic oligonucleotide; CTC chr2 60525276 60525297 60525281 60525276 -
caaagaatgtaatgtgtatttt

SEQ ID NO: 215154 - DNA, 22 bp, Artificial Sequence
  Synthetic oligonucleotide; TTT chr2 60525255 60525276 60525260 60525255 -
tctccaagtttgcttttttggg

SEQ ID NO: 215155 - DNA, 22 bp, Artificial Sequence
  Synthetic oligonucleotide; TTT chr2 60525254 60525275 60525259 60525254 -
ctccaagtttgcttttttgggc

SEQ ID NO: 215156 - DNA, 22 bp, Artificial Sequence
  Synthetic oligonucleotide; TTC chr2 60525253 60525274 60525258 60525253 -
tccaagtttgcttttttgggca

SEQ ID NO: 215157 - DNA, 22 bp, Artificial Sequence
  Synthetic oligonucleotide; CTC chr2 60525251 60525272 60525256 60525251 -
caagtttgcttttttgggcaaa

SEQ ID NO: 215158 - DNA, 22 bp, Artificial Sequence
  Synthetic oligonucleotide; TTT chr2 60525244 60525265 60525249 60525244 -
gcttttttgggcaaatgtaact

SEQ ID NO: 215159 - DNA, 22 bp, Artificial Sequence
  Synthetic oligonucleotide; TTG chr2 60525243 60525264 60525248 60525243 -
cttttttgggcaaatgtaacta

SEQ ID NO: 215160 - DNA, 22 bp, Artificial Sequence
  Synthetic oligonucleotide; CTT chr2 60525240 60525261 60525245 60525240 -
ttttgggcaaatgtaactacat

SEQ ID NO: 215161 - DNA, 22 bp, Artificial Sequence
  Synthetic oligonucleotide; TTT chr2 60525239 60525260 60525244 60525239 -
tttgggcaaatgtaactacatc

SEQ ID NO: 215162 - DNA, 22 bp, Artificial Sequence
  Synthetic oligonucleotide; TTT chr2 60525238 60525259 60525243 60525238 -
ttgggcaaatgtaactacatca

SEQ ID NO: 215163 - DNA, 22 bp, Artificial Sequence
  Synthetic oligonucleotide; TTT chr2 60525237 60525258 60525242 60525237 -
tgggcaaatgtaactacatcaa

SEQ ID NO: 215164 - DNA, 22 bp, Artificial Sequence
  Synthetic oligonucleotide; TTT chr2 60525236 60525257 60525241 60525236 -
gggcaaatgtaactacatcaaa

SEQ ID NO: 215165 - DNA, 22 bp, Artificial Sequence
  Synthetic oligonucleotide; TTG chr2 60525235 60525256 60525240 60525235 -
ggcaaatgtaactacatcaaaa

SEQ ID NO: 215166 - DNA, 22 bp, Artificial Sequence
  Synthetic oligonucleotide; CTA chr2 60525221 60525242 60525226 60525221 -
catcaaaatagaagtacgtttt

SEQ ID NO: 215167 - DNA, 22 bp, Artificial Sequence
  Synthetic oligonucleotide; TTT chr2 60525200 60525221 60525205 60525200 -
ttgaaaaagaaatagttgaatt

SEQ ID NO: 215168 - DNA, 22 bp, Artificial Sequence
  Synthetic oligonucleotide; TTT chr2 60525199 60525220 60525204 60525199 -
tgaaaaagaaatagttgaattc

SEQ ID NO: 215169 - DNA, 22 bp, Artificial Sequence
  Synthetic oligonucleotide; TTT chr2 60525198 60525219 60525203 60525198 -
gaaaaagaaatagttgaattca

SEQ ID NO: 215170 - DNA, 22 bp, Artificial Sequence
  Synthetic oligonucleotide; TTG chr2 60525197 60525218 60525202 60525197 -
aaaaagaaatagttgaattcaa

SEQ ID NO: 215171 - DNA, 22 bp, Artificial Sequence
  Synthetic oligonucleotide; TTG chr2 60525182 60525203 60525187 60525182 -
aattcaaacaaccaggtatttt

SEQ ID NO: 215172 - DNA, 22 bp, Artificial Sequence
  Synthetic oligonucleotide; TTC chr2 60525177 60525198 60525182 60525177 -
aaacaaccaggtattttaaatt

SEQ ID NO: 215173 - DNA, 22 bp, Artificial Sequence
  Synthetic oligonucleotide; TTT chr2 60525161 60525182 60525166 60525161 -
taaattcaattaactgactgaa

SEQ ID NO: 215174 - DNA, 22 bp, Artificial Sequence
  Synthetic oligonucleotide; TTT chr2 60525160 60525181 60525165 60525160 -
aaattcaattaactgactgaat

SEQ ID NO: 215175 - DNA, 22 bp, Artificial Sequence
  Synthetic oligonucleotide; TTA chr2 60525159 60525180 60525164 60525159 -
aattcaattaactgactgaatt

SEQ ID NO: 215176 - DNA, 22 bp, Artificial Sequence
  Synthetic oligonucleotide; TTC chr2 60525154 60525175 60525159 60525154 -
aattaactgactgaattcagtg

SEQ ID NO: 215177 - DNA, 22 bp, Artificial Sequence
  Synthetic oligonucleotide; TTA chr2 60525149 60525170 60525154 60525149 -
actgactgaattcagtgatatt

SEQ ID NO: 215178 - DNA, 22 bp, Artificial Sequence
  Synthetic oligonucleotide; CTG chr2 60525145 60525166 60525150 60525145 -
actgaattcagtgatattttcc

SEQ ID NO: 215179 - DNA, 22 bp, Artificial Sequence
  Synthetic oligonucleotide; CTG chr2 60525141 60525162 60525146 60525141 -
aattcagtgatattttcctcct

SEQ ID NO: 215180 - DNA, 22 bp, Artificial Sequence
  Synthetic oligonucleotide; TTC chr2 60525136 60525157 60525141 60525136 -
agtgatattttcctccttcctc

SEQ ID NO: 215181 - DNA, 22 bp, Artificial Sequence
  Synthetic oligonucleotide; TTT chr2 60525126 60525147 60525131 60525126 -
tcctccttcctcctcccaaaag

SEQ ID NO: 215182 - DNA, 22 bp, Artificial Sequence
  Synthetic oligonucleotide; TTT chr2 60525125 60525146 60525130 60525125 -
cctccttcctcctcccaaaagc

SEQ ID NO: 215183 - DNA, 22 bp, Artificial Sequence
  Synthetic oligonucleotide; TTC chr2 60525124 60525145 60525129 60525124 -
ctccttcctcctcccaaaagct

SEQ ID NO: 215184 - DNA, 22 bp, Artificial Sequence
  Synthetic oligonucleotide; CTC chr2 60525121 60525142 60525126 60525121 -
cttcctcctcccaaaagctggt

SEQ ID NO: 215185 - DNA, 22 bp, Artificial Sequence
  Synthetic oligonucleotide; CTT chr2 60525118 60525139 60525123 60525118 -
cctcctcccaaaagctggtttc

SEQ ID NO: 215186 - DNA, 22 bp, Artificial Sequence
  Synthetic oligonucleotide; TTC chr2 60525117 60525138 60525122 60525117 -
ctcctcccaaaagctggtttct

SEQ ID NO: 215187 - DNA, 22 bp, Artificial Sequence
  Synthetic oligonucleotide; CTC chr2 60525114 60525135 60525119 60525114 -
ctcccaaaagctggtttctctg

SEQ ID NO: 215188 - DNA, 22 bp, Artificial Sequence
  Synthetic oligonucleotide; CTC chr2 60525111 60525132 60525116 60525111 -
ccaaaagctggtttctctgtat

SEQ ID NO: 215189 - DNA, 22 bp, Artificial Sequence
  Synthetic oligonucleotide; CTG chr2 60525101 60525122 60525106 60525101 -
gtttctctgtatggacatagcc

SEQ ID NO: 215190 - DNA, 22 bp, Artificial Sequence
  Synthetic oligonucleotide; TTT chr2 60525097 60525118 60525102 60525097 -
ctctgtatggacatagcctaca

SEQ ID NO: 215191 - DNA, 22 bp, Artificial Sequence
  Synthetic oligonucleotide; TTC chr2 60525096 60525117 60525101 60525096 -
tctgtatggacatagcctacat

SEQ ID NO: 215192 - DNA, 22 bp, Artificial Sequence
  Synthetic oligonucleotide; CTC chr2 60525094 60525115 60525099 60525094 -
tgtatggacatagcctacatat

SEQ ID NO: 215193 - DNA, 22 bp, Artificial Sequence
  Synthetic oligonucleotide; CTG chr2 60525092 60525113 60525097 60525092 -
tatggacatagcctacatatgc

SEQ ID NO: 215194 - DNA, 22 bp, Artificial Sequence
  Synthetic oligonucleotide; CTA chr2 60525077 60525098 60525082 60525077 -
catatgctgagtccctggagtt

SEQ ID NO: 215195 - DNA, 22 bp, Artificial Sequence
  Synthetic oligonucleotide; CTG chr2 60525068 60525089 60525073 60525068 -
agtccctggagttaggaatttt

SEQ ID NO: 215196 - DNA, 22 bp, Artificial Sequence
  Synthetic oligonucleotide; CTG chr2 60525060 60525081 60525065 60525060 -
gagttaggaatttttgcttgtt

SEQ ID NO: 215197 - DNA, 22 bp, Artificial Sequence
  Synthetic oligonucleotide; TTA chr2 60525054 60525075 60525059 60525054 -
ggaatttttgcttgttaaaggc

SEQ ID NO: 215198 - DNA, 22 bp, Artificial Sequence
  Synthetic oligonucleotide; TTT chr2 60525047 60525068 60525052 60525047 -
ttgcttgttaaaggcatccgat

SEQ ID NO: 215199 - DNA, 22 bp, Artificial Sequence
  Synthetic oligonucleotide; TTT chr2 60525046 60525067 60525051 60525046 -
tgcttgttaaaggcatccgatg

SEQ ID NO: 215200 - DNA, 22 bp, Artificial Sequence
  Synthetic oligonucleotide; TTT chr2 60525045 60525066 60525050 60525045 -
gcttgttaaaggcatccgatgc

SEQ ID NO: 215201 - DNA, 22 bp, Artificial Sequence
  Synthetic oligonucleotide; TTG chr2 60525044 60525065 60525049 60525044 -
cttgttaaaggcatccgatgca

SEQ ID NO: 215202 - DNA, 22 bp, Artificial Sequence
  Synthetic oligonucleotide; CTT chr2 60525041 60525062 60525046 60525041 -
gttaaaggcatccgatgcaaca

SEQ ID NO: 215203 - DNA, 22 bp, Artificial Sequence
  Synthetic oligonucleotide; TTG chr2 60525040 60525061 60525045 60525040 -
ttaaaggcatccgatgcaacat

SEQ ID NO: 215204 - DNA, 22 bp, Artificial Sequence
  Synthetic oligonucleotide; TTA chr2 60525037 60525058 60525042 60525037 -
aaggcatccgatgcaacatgtt

SEQ ID NO: 215205 - DNA, 22 bp, Artificial Sequence
  Synthetic oligonucleotide; TTT chr2 60525014 60525035 60525019 60525014 -
agaagaactctccctctgttag

SEQ ID NO: 215206 - DNA, 22 bp, Artificial Sequence
  Synthetic oligonucleotide; TTA chr2 60525013 60525034 60525018 60525013 -
gaagaactctccctctgttagt

SEQ ID NO: 215207 - DNA, 22 bp, Artificial Sequence
  Synthetic oligonucleotide; CTC chr2 60525004 60525025 60525009 60525004 -
tccctctgttagtgttgaagac

SEQ ID NO: 215208 - DNA, 22 bp, Artificial Sequence
  Synthetic oligonucleotide; CTC chr2 60525002 60525023 60525007 60525002 -
cctctgttagtgttgaagacag

SEQ ID NO: 215209 - DNA, 22 bp, Artificial Sequence
  Synthetic oligonucleotide; CTC chr2 60524998 60525019 60525003 60524998 -
tgttagtgttgaagacagcata

SEQ ID NO: 215210 - DNA, 22 bp, Artificial Sequence
  Synthetic oligonucleotide; CTG chr2 60524996 60525017 60525001 60524996 -
ttagtgttgaagacagcataaa

SEQ ID NO: 215211 - DNA, 22 bp, Artificial Sequence
  Synthetic oligonucleotide; TTA chr2 60524993 60525014 60524998 60524993 -
gtgttgaagacagcataaattg

SEQ ID NO: 215212 - DNA, 22 bp, Artificial Sequence
  Synthetic oligonucleotide; TTG chr2 60524987 60525008 60524992 60524987 -
aagacagcataaattgagggaa

SEQ ID NO: 215213 - DNA, 22 bp, Artificial Sequence
  Synthetic oligonucleotide; TTG chr2 60524971 60524992 60524976 60524971 -
agggaaaatgttctttttttat

SEQ ID NO: 215214 - DNA, 22 bp, Artificial Sequence
  Synthetic oligonucleotide; TTC chr2 60524958 60524979 60524963 60524958 -
tttttttattcatcatgtaggt

SEQ ID NO: 215215 - DNA, 22 bp, Artificial Sequence
  Synthetic oligonucleotide; CTT chr2 60524956 60524977 60524961 60524956 -
tttttattcatcatgtaggtaa

SEQ ID NO: 215216 - DNA, 22 bp, Artificial Sequence
  Synthetic oligonucleotide; TTT chr2 60524955 60524976 60524960 60524955 -
ttttattcatcatgtaggtaaa

SEQ ID NO: 215217 - DNA, 22 bp, Artificial Sequence
  Synthetic oligonucleotide; TTT chr2 60524954 60524975 60524959 60524954 -
tttattcatcatgtaggtaaaa

SEQ ID NO: 215218 - DNA, 22 bp, Artificial Sequence
  Synthetic oligonucleotide; TTT chr2 60524953 60524974 60524958 60524953 -
ttattcatcatgtaggtaaaag

SEQ ID NO: 215219 - DNA, 22 bp, Artificial Sequence
  Synthetic oligonucleotide; TTT chr2 60524952 60524973 60524957 60524952 -
tattcatcatgtaggtaaaagc

SEQ ID NO: 215220 - DNA, 22 bp, Artificial Sequence
  Synthetic oligonucleotide; TTT chr2 60524951 60524972 60524956 60524951 -
attcatcatgtaggtaaaagca

SEQ ID NO: 215221 - DNA, 22 bp, Artificial Sequence
  Synthetic oligonucleotide; TTA chr2 60524950 60524971 60524955 60524950 -
ttcatcatgtaggtaaaagcat

SEQ ID NO: 215222 - DNA, 22 bp, Artificial Sequence
  Synthetic oligonucleotide; TTC chr2 60524947 60524968 60524952 60524947 -
atcatgtaggtaaaagcatatg

SEQ ID NO: 215223 - DNA, 22 bp, Artificial Sequence
  Synthetic oligonucleotide; CTG chr2 60524920 60524941 60524925 60524920 -
ttctgggacatgcgatctttgc

SEQ ID NO: 215224 - DNA, 22 bp, Artificial Sequence
  Synthetic oligonucleotide; TTC chr2 60524917 60524938 60524922 60524917 -
tgggacatgcgatctttgcaat

SEQ ID NO: 215225 - DNA, 22 bp, Artificial Sequence
  Synthetic oligonucleotide; CTG chr2 60524915 60524936 60524920 60524915 -
ggacatgcgatctttgcaatcc

SEQ ID NO: 215226 - DNA, 22 bp, Artificial Sequence
  Synthetic oligonucleotide; CTT chr2 60524901 60524922 60524906 60524901 -
tgcaatccattttttaaacttg

SEQ ID NO: 215227 - DNA, 22 bp, Artificial Sequence
  Synthetic oligonucleotide; TTT chr2 60524900 60524921 60524905 60524900 -
gcaatccattttttaaacttgg

SEQ ID NO: 215228 - DNA, 22 bp, Artificial Sequence
  Synthetic oligonucleotide; TTG chr2 60524899 60524920 60524904 60524899 -
caatccattttttaaacttggt

SEQ ID NO: 215229 - DNA, 22 bp, Artificial Sequence
  Synthetic oligonucleotide; TTT chr2 60524889 60524910 60524894 60524889 -
tttaaacttggtgtttaccatt

SEQ ID NO: 215230 - DNA, 22 bp, Artificial Sequence
  Synthetic oligonucleotide; TTT chr2 60524888 60524909 60524893 60524888 -
ttaaacttggtgtttaccattg

SEQ ID NO: 215231 - DNA, 22 bp, Artificial Sequence
  Synthetic oligonucleotide; TTT chr2 60524887 60524908 60524892 60524887 -
taaacttggtgtttaccattgg

SEQ ID NO: 215232 - DNA, 22 bp, Artificial Sequence
  Synthetic oligonucleotide; TTT chr2 60524886 60524907 60524891 60524886 -
aaacttggtgtttaccattggc

SEQ ID NO: 215233 - DNA, 22 bp, Artificial Sequence
  Synthetic oligonucleotide; TTA chr2 60524885 60524906 60524890 60524885 -
aacttggtgtttaccattggct

SEQ ID NO: 215234 - DNA, 22 bp, Artificial Sequence
  Synthetic oligonucleotide; CTT chr2 60524880 60524901 60524885 60524880 -
ggtgtttaccattggcttttag

SEQ ID NO: 215235 - DNA, 22 bp, Artificial Sequence
  Synthetic oligonucleotide; TTG chr2 60524879 60524900 60524884 60524879 -
gtgtttaccattggcttttagc

SEQ ID NO: 215236 - DNA, 22 bp, Artificial Sequence
  Synthetic oligonucleotide; TTT chr2 60524873 60524894 60524878 60524873 -
accattggcttttagcacggat

SEQ ID NO: 215237 - DNA, 22 bp, Artificial Sequence
  Synthetic oligonucleotide; TTA chr2 60524872 60524893 60524877 60524872 -
ccattggcttttagcacggatg

SEQ ID NO: 215238 - DNA, 22 bp, Artificial Sequence
  Synthetic oligonucleotide; TTG chr2 60524866 60524887 60524871 60524866 -
gcttttagcacggatgtttctg

SEQ ID NO: 215239 - DNA, 22 bp, Artificial Sequence
  Synthetic oligonucleotide; CTT chr2 60524862 60524883 60524867 60524862 -
ttagcacggatgtttctgtttt

SEQ ID NO: 215240 - DNA, 22 bp, Artificial Sequence
  Synthetic oligonucleotide; TTT chr2 60524861 60524882 60524866 60524861 -
tagcacggatgtttctgttttc

SEQ ID NO: 215241 - DNA, 22 bp, Artificial Sequence
  Synthetic oligonucleotide; TTT chr2 60524860 60524881 60524865 60524860 -
agcacggatgtttctgttttcc

SEQ ID NO: 215242 - DNA, 22 bp, Artificial Sequence
  Synthetic oligonucleotide; TTA chr2 60524859 60524880 60524864 60524859 -
gcacggatgtttctgttttcca

SEQ ID NO: 215243 - DNA, 22 bp, Artificial Sequence
  Synthetic oligonucleotide; TTT chr2 60524847 60524868 60524852 60524847 -
ctgttttccacactgtccagca

SEQ ID NO: 215244 - DNA, 22 bp, Artificial Sequence
  Synthetic oligonucleotide; TTC chr2 60524846 60524867 60524851 60524846 -
tgttttccacactgtccagcaa

SEQ ID NO: 215245 - DNA, 22 bp, Artificial Sequence
  Synthetic oligonucleotide; CTG chr2 60524844 60524865 60524849 60524844 -
ttttccacactgtccagcaaat

SEQ ID NO: 215246 - DNA, 22 bp, Artificial Sequence
  Synthetic oligonucleotide; TTT chr2 60524841 60524862 60524846 60524841 -
tccacactgtccagcaaatacc

SEQ ID NO: 215247 - DNA, 22 bp, Artificial Sequence
  Synthetic oligonucleotide; TTT chr2 60524840 60524861 60524845 60524840 -
ccacactgtccagcaaatacca

SEQ ID NO: 215248 - DNA, 22 bp, Artificial Sequence
  Synthetic oligonucleotide; TTC chr2 60524839 60524860 60524844 60524839 -
cacactgtccagcaaataccat

SEQ ID NO: 215249 - DNA, 22 bp, Artificial Sequence
  Synthetic oligonucleotide; CTG chr2 60524832 60524853 60524837 60524832 -
tccagcaaataccatttatatg

SEQ ID NO: 215250 - DNA, 22 bp, Artificial Sequence
  Synthetic oligonucleotide; TTT chr2 60524815 60524836 60524820 60524815 -
atatgtggcattgaatgagata

SEQ ID NO: 215251 - DNA, 22 bp, Artificial Sequence
  Synthetic oligonucleotide; TTA chr2 60524814 60524835 60524819 60524814 -
tatgtggcattgaatgagatat

SEQ ID NO: 215252 - DNA, 22 bp, Artificial Sequence
  Synthetic oligonucleotide; TTG chr2 60524802 60524823 60524807 60524802 -
aatgagatatgaaatgttttca

SEQ ID NO: 215253 - DNA, 22 bp, Artificial Sequence
  Synthetic oligonucleotide; TTT chr2 60524783 60524804 60524788 60524783 -
tcagaagcatgctgaaaaaggg

SEQ ID NO: 215254 - DNA, 22 bp, Artificial Sequence
  Synthetic oligonucleotide; TTT chr2 60524782 60524803 60524787 60524782 -
cagaagcatgctgaaaaagggc

SEQ ID NO: 215255 - DNA, 22 bp, Artificial Sequence
  Synthetic oligonucleotide; TTC chr2 60524781 60524802 60524786 60524781 -
agaagcatgctgaaaaagggca

SEQ ID NO: 215256 - DNA, 22 bp, Artificial Sequence
  Synthetic oligonucleotide; CTG chr2 60524769 60524790 60524774 60524769 -
aaaaagggcattcaaagttatc

SEQ ID NO: 215257 - DNA, 22 bp, Artificial Sequence
  Synthetic oligonucleotide; TTC chr2 60524756 60524777 60524761 60524756 -
aaagttatcctttggataatga

SEQ ID NO: 215258 - DNA, 22 bp, Artificial Sequence
  Synthetic oligonucleotide; TTA chr2 60524749 60524770 60524754 60524749 -
tcctttggataatgatgatcta

SEQ ID NO: 215259 - DNA, 22 bp, Artificial Sequence
  Synthetic oligonucleotide; CTT chr2 60524744 60524765 60524749 60524744 -
tggataatgatgatctaaaact

SEQ ID NO: 215260 - DNA, 22 bp, Artificial Sequence
  Synthetic oligonucleotide; TTT chr2 60524743 60524764 60524748 60524743 -
ggataatgatgatctaaaactt

SEQ ID NO: 215261 - DNA, 22 bp, Artificial Sequence
  Synthetic oligonucleotide; TTG chr2 60524742 60524763 60524747 60524742 -
gataatgatgatctaaaacttt

SEQ ID NO: 215262 - DNA, 22 bp, Artificial Sequence
  Synthetic oligonucleotide; CTA chr2 60524727 60524748 60524732 60524727 -
aaactttcttttattatcccat

SEQ ID NO: 215263 - DNA, 22 bp, Artificial Sequence
  Synthetic oligonucleotide; CTT chr2 60524721 60524742 60524726 60524721 -
tcttttattatcccatgtgctc

SEQ ID NO: 215264 - DNA, 22 bp, Artificial Sequence
  Synthetic oligonucleotide; TTT chr2 60524720 60524741 60524725 60524720 -
cttttattatcccatgtgctca

SEQ ID NO: 215265 - DNA, 22 bp, Artificial Sequence
  Synthetic oligonucleotide; TTC chr2 60524719 60524740 60524724 60524719 -
ttttattatcccatgtgctcag

SEQ ID NO: 215266 - DNA, 22 bp, Artificial Sequence
  Synthetic oligonucleotide; CTT chr2 60524717 60524738 60524722 60524717 -
ttattatcccatgtgctcagag

SEQ ID NO: 215267 - DNA, 22 bp, Artificial Sequence
  Synthetic oligonucleotide; TTT chr2 60524716 60524737 60524721 60524716 -
tattatcccatgtgctcagagt

SEQ ID NO: 215268 - DNA, 22 bp, Artificial Sequence
  Synthetic oligonucleotide; TTT chr2 60524715 60524736 60524720 60524715 -
attatcccatgtgctcagagta

SEQ ID NO: 215269 - DNA, 22 bp, Artificial Sequence
  Synthetic oligonucleotide; TTA chr2 60524714 60524735 60524719 60524714 -
ttatcccatgtgctcagagtaa

SEQ ID NO: 215270 - DNA, 22 bp, Artificial Sequence
  Synthetic oligonucleotide; TTA chr2 60524711 60524732 60524716 60524711 -
tcccatgtgctcagagtaaggg

SEQ ID NO: 215271 - DNA, 22 bp, Artificial Sequence
  Synthetic oligonucleotide; CTC chr2 60524699 60524720 60524704 60524699 -
agagtaaggggcaaatgaatca

SEQ ID NO: 215272 - DNA, 22 bp, Artificial Sequence
  Synthetic oligonucleotide; TTG chr2 60524673 60524694 60524678 60524673 -
tgaaatatgtgttccttgtagg

SEQ ID NO: 215273 - DNA, 22 bp, Artificial Sequence
  Synthetic oligonucleotide; TTC chr2 60524659 60524680 60524664 60524659 -
cttgtaggacacaggcactctt

SEQ ID NO: 215274 - DNA, 22 bp, Artificial Sequence
  Synthetic oligonucleotide; CTT chr2 60524656 60524677 60524661 60524656 -
gtaggacacaggcactcttgag

SEQ ID NO: 215275 - DNA, 22 bp, Artificial Sequence
  Synthetic oligonucleotide; TTG chr2 60524655 60524676 60524660 60524655 -
taggacacaggcactcttgaga

SEQ ID NO: 215276 - DNA, 22 bp, Artificial Sequence
  Synthetic oligonucleotide; CTC chr2 60524639 60524660 60524644 60524639 -
ttgagatctatagcttcaataa

SEQ ID NO: 215277 - DNA, 22 bp, Artificial Sequence
  Synthetic oligonucleotide; CTT chr2 60524637 60524658 60524642 60524637 -
gagatctatagcttcaataaaa

SEQ ID NO: 215278 - DNA, 22 bp, Artificial Sequence
  Synthetic oligonucleotide; TTG chr2 60524636 60524657 60524641 60524636 -
agatctatagcttcaataaaaa

SEQ ID NO: 215279 - DNA, 22 bp, Artificial Sequence
  Synthetic oligonucleotide; CTA chr2 60524629 60524650 60524634 60524629 -
tagcttcaataaaaaggtaatt

SEQ ID NO: 215280 - DNA, 22 bp, Artificial Sequence
  Synthetic oligonucleotide; CTT chr2 60524623 60524644 60524628 60524623 -
caataaaaaggtaatttattta

SEQ ID NO: 215281 - DNA, 22 bp, Artificial Sequence
  Synthetic oligonucleotide; TTC chr2 60524622 60524643 60524627 60524622 -
aataaaaaggtaatttatttaa

SEQ ID NO: 215282 - DNA, 22 bp, Artificial Sequence
  Synthetic oligonucleotide; TTT chr2 60524606 60524627 60524611 60524606 -
atttaaattactgcctctttaa

SEQ ID NO: 215283 - DNA, 22 bp, Artificial Sequence
  Synthetic oligonucleotide; TTA chr2 60524605 60524626 60524610 60524605 -
tttaaattactgcctctttaat

SEQ ID NO: 215284 - DNA, 22 bp, Artificial Sequence
  Synthetic oligonucleotide; TTT chr2 60524602 60524623 60524607 60524602 -
aaattactgcctctttaattta

SEQ ID NO: 215285 - DNA, 22 bp, Artificial Sequence
  Synthetic oligonucleotide; TTA chr2 60524601 60524622 60524606 60524601 -
aattactgcctctttaatttat

SEQ ID NO: 215286 - DNA, 22 bp, Artificial Sequence
  Synthetic oligonucleotide; TTA chr2 60524596 60524617 60524601 60524596 -
ctgcctctttaatttataatgt

SEQ ID NO: 215287 - DNA, 22 bp, Artificial Sequence
  Synthetic oligonucleotide; CTG chr2 60524593 60524614 60524598 60524593 -
cctctttaatttataatgtttt

SEQ ID NO: 215288 - DNA, 22 bp, Artificial Sequence
  Synthetic oligonucleotide; CTC chr2 60524589 60524610 60524594 60524589 -
tttaatttataatgttttgggg

SEQ ID NO: 215289 - DNA, 22 bp, Artificial Sequence
  Synthetic oligonucleotide; CTT chr2 60524587 60524608 60524592 60524587 -
taatttataatgttttggggat

SEQ ID NO: 215290 - DNA, 22 bp, Artificial Sequence
  Synthetic oligonucleotide; TTT chr2 60524586 60524607 60524591 60524586 -
aatttataatgttttggggatt

SEQ ID NO: 215291 - DNA, 22 bp, Artificial Sequence
  Synthetic oligonucleotide; TTA chr2 60524585 60524606 60524590 60524585 -
atttataatgttttggggattt

SEQ ID NO: 215292 - DNA, 22 bp, Artificial Sequence
  Synthetic oligonucleotide; TTT chr2 60524581 60524602 60524586 60524581 -
ataatgttttggggatttttaa

SEQ ID NO: 215293 - DNA, 22 bp, Artificial Sequence
  Synthetic oligonucleotide; TTA chr2 60524580 60524601 60524585 60524580 -
taatgttttggggatttttaat

SEQ ID NO: 215294 - DNA, 22 bp, Artificial Sequence
  Synthetic oligonucleotide; TTT chr2 60524572 60524593 60524577 60524572 -
tggggatttttaataggcatgc

SEQ ID NO: 215295 - DNA, 22 bp, Artificial Sequence
  Synthetic oligonucleotide; TTT chr2 60524571 60524592 60524576 60524571 -
ggggatttttaataggcatgct

SEQ ID NO: 215296 - DNA, 22 bp, Artificial Sequence
  Synthetic oligonucleotide; TTG chr2 60524570 60524591 60524575 60524570 -
gggatttttaataggcatgctc

SEQ ID NO: 215297 - DNA, 22 bp, Artificial Sequence
  Synthetic oligonucleotide; TTT chr2 60524563 60524584 60524568 60524563 -
ttaataggcatgctctgtaagg

SEQ ID NO: 215298 - DNA, 22 bp, Artificial Sequence
  Synthetic oligonucleotide; TTT chr2 60524562 60524583 60524567 60524562 -
taataggcatgctctgtaaggg

SEQ ID NO: 215299 - DNA, 22 bp, Artificial Sequence
  Synthetic oligonucleotide; TTT chr2 60524561 60524582 60524566 60524561 -
aataggcatgctctgtaagggc

SEQ ID NO: 215300 - DNA, 22 bp, Artificial Sequence
  Synthetic oligonucleotide; TTA chr2 60524560 60524581 60524565 60524560 -
ataggcatgctctgtaagggca

SEQ ID NO: 215301 - DNA, 22 bp, Artificial Sequence
  Synthetic oligonucleotide; CTC chr2 60524548 60524569 60524553 60524548 -
tgtaagggcactggtaatcagc

SEQ ID NO: 215302 - DNA, 22 bp, Artificial Sequence
  Synthetic oligonucleotide; CTG chr2 60524546 60524567 60524551 60524546 -
taagggcactggtaatcagctg

SEQ ID NO: 215303 - DNA, 22 bp, Artificial Sequence
  Synthetic oligonucleotide; CTG chr2 60524535 60524556 60524540 60524535 -
gtaatcagctgtttctgatttt

SEQ ID NO: 215304 - DNA, 22 bp, Artificial Sequence
  Synthetic oligonucleotide; CTG chr2 60524524 60524545 60524529 60524524 -
tttctgattttgcatgctcttc

SEQ ID NO: 215305 - DNA, 22 bp, Artificial Sequence
  Synthetic oligonucleotide; TTT chr2 60524521 60524542 60524526 60524521 -
ctgattttgcatgctcttctat

SEQ ID NO: 215306 - DNA, 22 bp, Artificial Sequence
  Synthetic oligonucleotide; TTC chr2 60524520 60524541 60524525 60524520 -
tgattttgcatgctcttctatc

SEQ ID NO: 215307 - DNA, 22 bp, Artificial Sequence
  Synthetic oligonucleotide; CTG chr2 60524518 60524539 60524523 60524518 -
attttgcatgctcttctatctc

SEQ ID NO: 215308 - DNA, 22 bp, Artificial Sequence
  Synthetic oligonucleotide; TTT chr2 60524514 60524535 60524519 60524514 -
tgcatgctcttctatctctggt

SEQ ID NO: 215309 - DNA, 22 bp, Artificial Sequence
  Synthetic oligonucleotide; TTT chr2 60524513 60524534 60524518 60524513 -
gcatgctcttctatctctggta

SEQ ID NO: 215310 - DNA, 22 bp, Artificial Sequence
  Synthetic oligonucleotide; TTG chr2 60524512 60524533 60524517 60524512 -
catgctcttctatctctggtaa

SEQ ID NO: 215311 - DNA, 22 bp, Artificial Sequence
  Synthetic oligonucleotide; CTC chr2 60524505 60524526 60524510 60524505 -
ttctatctctggtaacaaaata

SEQ ID NO: 215312 - DNA, 22 bp, Artificial Sequence
  Synthetic oligonucleotide; CTT chr2 60524503 60524524 60524508 60524503 -
ctatctctggtaacaaaataaa

SEQ ID NO: 215313 - DNA, 22 bp, Artificial Sequence
  Synthetic oligonucleotide; TTC chr2 60524502 60524523 60524507 60524502 -
tatctctggtaacaaaataaaa

SEQ ID NO: 215314 - DNA, 22 bp, Artificial Sequence
  Synthetic oligonucleotide; CTA chr2 60524500 60524521 60524505 60524500 -
tctctggtaacaaaataaaatc

SEQ ID NO: 215315 - DNA, 22 bp, Artificial Sequence
  Synthetic oligonucleotide; CTC chr2 60524496 60524517 60524501 60524496 -
tggtaacaaaataaaatcttaa

SEQ ID NO: 215316 - DNA, 22 bp, Artificial Sequence
  Synthetic oligonucleotide; CTG chr2 60524494 60524515 60524499 60524494 -
gtaacaaaataaaatcttaaaa

SEQ ID NO: 215317 - DNA, 22 bp, Artificial Sequence
  Synthetic oligonucleotide; CTT chr2 60524476 60524497 60524481 60524476 -
aaaaaacaagaaaaaagaaaaa

SEQ ID NO: 215318 - DNA, 22 bp, Artificial Sequence
  Synthetic oligonucleotide; TTA chr2 60524475 60524496 60524480 60524475 -
aaaaacaagaaaaaagaaaaaa

SEQ ID NO: 215319 - DNA, 22 bp, Artificial Sequence
  Synthetic oligonucleotide; TTT chr2 60524421 60524442 60524426 60524421 -
agccctaacccaacccaaaagc

SEQ ID NO: 215320 - DNA, 22 bp, Artificial Sequence
  Synthetic oligonucleotide; TTA chr2 60524420 60524441 60524425 60524420 -
gccctaacccaacccaaaagca

SEQ ID NO: 215321 - DNA, 22 bp, Artificial Sequence
  Synthetic oligonucleotide; CTA chr2 60524414 60524435 60524419 60524414 -
acccaacccaaaagcaaataac

SEQ ID NO: 215322 - DNA, 22 bp, Artificial Sequence
  Synthetic oligonucleotide; CTC chr2 60524360 60524381 60524365 60524360 -
tactttccccttccattattac

SEQ ID NO: 215323 - DNA, 22 bp, Artificial Sequence
  Synthetic oligonucleotide; CTA chr2 60524358 60524379 60524363 60524358 -
ctttccccttccattattacct

SEQ ID NO: 215324 - DNA, 22 bp, Artificial Sequence
  Synthetic oligonucleotide; CTT chr2 60524355 60524376 60524360 60524355 -
tccccttccattattacctgaa

SEQ ID NO: 215325 - DNA, 22 bp, Artificial Sequence
  Synthetic oligonucleotide; TTT chr2 60524354 60524375 60524359 60524354 -
ccccttccattattacctgaaa

SEQ ID NO: 215326 - DNA, 22 bp, Artificial Sequence
  Synthetic oligonucleotide; TTC chr2 60524353 60524374 60524358 60524353 -
cccttccattattacctgaaat

SEQ ID NO: 215327 - DNA, 22 bp, Artificial Sequence
  Synthetic oligonucleotide; CTT chr2 60524348 60524369 60524353 60524348 -
ccattattacctgaaataaaag

SEQ ID NO: 215328 - DNA, 22 bp, Artificial Sequence
  Synthetic oligonucleotide; TTC chr2 60524347 60524368 60524352 60524347 -
cattattacctgaaataaaagc

SEQ ID NO: 215329 - DNA, 22 bp, Artificial Sequence
  Synthetic oligonucleotide; TTA chr2 60524342 60524363 60524347 60524342 -
ttacctgaaataaaagcatgat

SEQ ID NO: 215330 - DNA, 22 bp, Artificial Sequence
  Synthetic oligonucleotide; TTA chr2 60524339 60524360 60524344 60524339 -
cctgaaataaaagcatgataac

SEQ ID NO: 215331 - DNA, 22 bp, Artificial Sequence
  Synthetic oligonucleotide; CTG chr2 60524335 60524356 60524340 60524335 -
aaataaaagcatgataacattc

SEQ ID NO: 215332 - DNA, 22 bp, Artificial Sequence
  Synthetic oligonucleotide; TTC chr2 60524313 60524334 60524318 60524313 -
atgccagagataggtgacaaaa

SEQ ID NO: 215333 - DNA, 22 bp, Artificial Sequence
  Synthetic oligonucleotide; TTA chr2 60524288 60524309 60524293 60524288 -
tgtattcagacatgaagtttag

SEQ ID NO: 215334 - DNA, 22 bp, Artificial Sequence
  Synthetic oligonucleotide; TTC chr2 60524281 60524302 60524286 60524281 -
agacatgaagtttaggatttca

SEQ ID NO: 215335 - DNA, 22 bp, Artificial Sequence
  Synthetic oligonucleotide; TTT chr2 60524268 60524289 60524273 60524268 -
aggatttcatagcccaatgttc

SEQ ID NO: 215336 - DNA, 22 bp, Artificial Sequence
  Synthetic oligonucleotide; TTA chr2 60524267 60524288 60524272 60524267 -
ggatttcatagcccaatgttct

SEQ ID NO: 215337 - DNA, 22 bp, Artificial Sequence
  Synthetic oligonucleotide; TTT chr2 60524261 60524282 60524266 60524261 -
catagcccaatgttctctcttc

SEQ ID NO: 215338 - DNA, 22 bp, Artificial Sequence
  Synthetic oligonucleotide; TTC chr2 60524260 60524281 60524265 60524260 -
atagcccaatgttctctcttct

SEQ ID NO: 215339 - DNA, 22 bp, Artificial Sequence
  Synthetic oligonucleotide; TTC chr2 60524246 60524267 60524251 60524246 -
tctcttctcccccacctcttat

SEQ ID NO: 215340 - DNA, 22 bp, Artificial Sequence
  Synthetic oligonucleotide; CTC chr2 60524244 60524265 60524249 60524244 -
tcttctcccccacctcttattg

SEQ ID NO: 215341 - DNA, 22 bp, Artificial Sequence
  Synthetic oligonucleotide; CTC chr2 60524242 60524263 60524247 60524242 -
ttctcccccacctcttattgtg

SEQ ID NO: 215342 - DNA, 22 bp, Artificial Sequence
  Synthetic oligonucleotide; CTT chr2 60524240 60524261 60524245 60524240 -
ctcccccacctcttattgtgtt

SEQ ID NO: 215343 - DNA, 22 bp, Artificial Sequence
  Synthetic oligonucleotide; TTC chr2 60524239 60524260 60524244 60524239 -
tcccccacctcttattgtgttg

SEQ ID NO: 215344 - DNA, 22 bp, Artificial Sequence
  Synthetic oligonucleotide; CTC chr2 60524237 60524258 60524242 60524237 -
ccccacctcttattgtgttgtg

SEQ ID NO: 215345 - DNA, 22 bp, Artificial Sequence
  Synthetic oligonucleotide; CTC chr2 60524228 60524249 60524233 60524228 -
ttattgtgttgtgcaaatgtat

SEQ ID NO: 215346 - DNA, 22 bp, Artificial Sequence
  Synthetic oligonucleotide; CTT chr2 60524226 60524247 60524231 60524226 -
attgtgttgtgcaaatgtatca

SEQ ID NO: 215347 - DNA, 22 bp, Artificial Sequence
  Synthetic oligonucleotide; TTA chr2 60524225 60524246 60524230 60524225 -
ttgtgttgtgcaaatgtatcag

SEQ ID NO: 215348 - DNA, 22 bp, Artificial Sequence
  Synthetic oligonucleotide; TTG chr2 60524222 60524243 60524227 60524222 -
tgttgtgcaaatgtatcagccg

SEQ ID NO: 215349 - DNA, 22 bp, Artificial Sequence
  Synthetic oligonucleotide; TTG chr2 60524217 60524238 60524222 60524217 -
tgcaaatgtatcagccgttgta

SEQ ID NO: 215350 - DNA, 22 bp, Artificial Sequence
  Synthetic oligonucleotide; TTG chr2 60524197 60524218 60524202 60524197 -
tattgttaatgcatgataggaa

SEQ ID NO: 215351 - DNA, 22 bp, Artificial Sequence
  Synthetic oligonucleotide; TTG chr2 60524192 60524213 60524197 60524192 -
ttaatgcatgataggaagctgc

SEQ ID NO: 215352 - DNA, 22 bp, Artificial Sequence
  Synthetic oligonucleotide; TTA chr2 60524189 60524210 60524194 60524189 -
atgcatgataggaagctgccgc

SEQ ID NO: 215353 - DNA, 22 bp, Artificial Sequence
  Synthetic oligonucleotide; CTG chr2 60524171 60524192 60524176 60524171 -
ccgctaggacagtcttggctca

SEQ ID NO: 215354 - DNA, 22 bp, Artificial Sequence
  Synthetic oligonucleotide; CTA chr2 60524165 60524186 60524170 60524165 -
ggacagtcttggctcactaatg

SEQ ID NO: 215355 - DNA, 22 bp, Artificial Sequence
  Synthetic oligonucleotide; CTT chr2 60524155 60524176 60524160 60524155 -
ggctcactaatgcggtcagctg

SEQ ID NO: 215356 - DNA, 22 bp, Artificial Sequence
  Synthetic oligonucleotide; TTG chr2 60524154 60524175 60524159 60524154 -
gctcactaatgcggtcagctgt

SEQ ID NO: 215357 - DNA, 22 bp, Artificial Sequence
  Synthetic oligonucleotide; CTC chr2 60524150 60524171 60524155 60524150 -
actaatgcggtcagctgtgtca

SEQ ID NO: 215358 - DNA, 22 bp, Artificial Sequence
  Synthetic oligonucleotide; CTA chr2 60524146 60524167 60524151 60524146 -
atgcggtcagctgtgtcacaat

SEQ ID NO: 215359 - DNA, 22 bp, Artificial Sequence
  Synthetic oligonucleotide; CTG chr2 60524133 60524154 60524138 60524133 -
tgtcacaatgtgatatatagat

SEQ ID NO: 215360 - DNA, 22 bp, Artificial Sequence
  Synthetic oligonucleotide; TTA chr2 60524109 60524130 60524114 60524109 -
tatttaccatggcatattttgt

SEQ ID NO: 215361 - DNA, 22 bp, Artificial Sequence
  Synthetic oligonucleotide; TTT chr2 60524104 60524125 60524109 60524104 -
accatggcatattttgtttgcg

SEQ ID NO: 215362 - DNA, 22 bp, Artificial Sequence
  Synthetic oligonucleotide; TTA chr2 60524103 60524124 60524108 60524103 -
ccatggcatattttgtttgcga

SEQ ID NO: 215363 - DNA, 22 bp, Artificial Sequence
  Synthetic oligonucleotide; TTT chr2 60524090 60524111 60524095 60524090 -
tgtttgcgaaatgggagcggat

SEQ ID NO: 215364 - DNA, 22 bp, Artificial Sequence
  Synthetic oligonucleotide; TTT chr2 60524089 60524110 60524094 60524089 -
gtttgcgaaatgggagcggatg

SEQ ID NO: 215365 - DNA, 22 bp, Artificial Sequence
  Synthetic oligonucleotide; TTG chr2 60524088 60524109 60524093 60524088 -
tttgcgaaatgggagcggatga

SEQ ID NO: 215366 - DNA, 22 bp, Artificial Sequence
  Synthetic oligonucleotide; TTT chr2 60524085 60524106 60524090 60524085 -
gcgaaatgggagcggatgataa

SEQ ID NO: 215367 - DNA, 22 bp, Artificial Sequence
  Synthetic oligonucleotide; TTG chr2 60524084 60524105 60524089 60524084 -
cgaaatgggagcggatgataaa

SEQ ID NO: 215368 - DNA, 22 bp, Artificial Sequence
  Synthetic oligonucleotide; CTC chr2 60524049 60524070 60524054 60524049 -
cagttttcacactagttcctgt

SEQ ID NO: 215369 - DNA, 22 bp, Artificial Sequence
  Synthetic oligonucleotide; TTT chr2 60524043 60524064 60524048 60524043 -
tcacactagttcctgtggtccg

SEQ ID NO: 215370 - DNA, 22 bp, Artificial Sequence
  Synthetic oligonucleotide; TTT chr2 60524042 60524063 60524047 60524042 -
cacactagttcctgtggtccgg

SEQ ID NO: 215371 - DNA, 22 bp, Artificial Sequence
  Synthetic oligonucleotide; TTC chr2 60524041 60524062 60524046 60524041 -
acactagttcctgtggtccgga

SEQ ID NO: 215372 - DNA, 22 bp, Artificial Sequence
  Synthetic oligonucleotide; CTA chr2 60524035 60524056 60524040 60524035 -
gttcctgtggtccggagtctct

SEQ ID NO: 215373 - DNA, 22 bp, Artificial Sequence
  Synthetic oligonucleotide; TTC chr2 60524031 60524052 60524036 60524031 -
ctgtggtccggagtctctcaaa

SEQ ID NO: 215374 - DNA, 22 bp, Artificial Sequence
  Synthetic oligonucleotide; CTG chr2 60524028 60524049 60524033 60524028 -
tggtccggagtctctcaaacaa

SEQ ID NO: 215375 - DNA, 22 bp, Artificial Sequence
  Synthetic oligonucleotide; CTC chr2 60524014 60524035 60524019 60524014 -
tcaaacaataaagcacccctga

SEQ ID NO: 215376 - DNA, 22 bp, Artificial Sequence
  Synthetic oligonucleotide; CTC chr2 60524012 60524033 60524017 60524012 -
aaacaataaagcacccctgata

SEQ ID NO: 215377 - DNA, 22 bp, Artificial Sequence
  Synthetic oligonucleotide; CTG chr2 60523993 60524014 60523998 60523993 -
ataatggagaggtatttatggg

SEQ ID NO: 215378 - DNA, 22 bp, Artificial Sequence
  Synthetic oligonucleotide; TTT chr2 60523976 60523997 60523981 60523976 -
atgggaacataattgacttcaa

SEQ ID NO: 215379 - DNA, 22 bp, Artificial Sequence
  Synthetic oligonucleotide; TTA chr2 60523975 60523996 60523980 60523975 -
tgggaacataattgacttcaaa

SEQ ID NO: 215380 - DNA, 22 bp, Artificial Sequence
  Synthetic oligonucleotide; TTG chr2 60523961 60523982 60523966 60523961 -
acttcaaagttttagatctctg

SEQ ID NO: 215381 - DNA, 22 bp, Artificial Sequence
  Synthetic oligonucleotide; CTT chr2 60523957 60523978 60523962 60523957 -
caaagttttagatctctggctg

SEQ ID NO: 215382 - DNA, 22 bp, Artificial Sequence
  Synthetic oligonucleotide; TTC chr2 60523956 60523977 60523961 60523956 -
aaagttttagatctctggctga

SEQ ID NO: 215383 - DNA, 22 bp, Artificial Sequence
  Synthetic oligonucleotide; TTT chr2 60523949 60523970 60523954 60523949 -
tagatctctggctgaagtttaa

SEQ ID NO: 215384 - DNA, 22 bp, Artificial Sequence
  Synthetic oligonucleotide; TTT chr2 60523948 60523969 60523953 60523948 -
agatctctggctgaagtttaag

SEQ ID NO: 215385 - DNA, 22 bp, Artificial Sequence
  Synthetic oligonucleotide; TTA chr2 60523947 60523968 60523952 60523947 -
gatctctggctgaagtttaaga

SEQ ID NO: 215386 - DNA, 22 bp, Artificial Sequence
  Synthetic oligonucleotide; CTC chr2 60523941 60523962 60523946 60523941 -
tggctgaagtttaagatgggat

SEQ ID NO: 215387 - DNA, 22 bp, Artificial Sequence
  Synthetic oligonucleotide; CTG chr2 60523939 60523960 60523944 60523939 -
gctgaagtttaagatgggatag

SEQ ID NO: 215388 - DNA, 22 bp, Artificial Sequence
  Synthetic oligonucleotide; CTG chr2 60523935 60523956 60523940 60523935 -
aagtttaagatgggatagtcca

SEQ ID NO: 215389 - DNA, 22 bp, Artificial Sequence
  Synthetic oligonucleotide; TTT chr2 60523929 60523950 60523934 60523929 -
aagatgggatagtccattacat

SEQ ID NO: 215390 - DNA, 22 bp, Artificial Sequence
  Synthetic oligonucleotide; TTA chr2 60523928 60523949 60523933 60523928 -
agatgggatagtccattacatt

SEQ ID NO: 215391 - DNA, 22 bp, Artificial Sequence
  Synthetic oligonucleotide; TTA chr2 60523910 60523931 60523915 60523910 -
cattaatgtctgtgcttaaagc

SEQ ID NO: 215392 - DNA, 22 bp, Artificial Sequence
  Synthetic oligonucleotide; TTA chr2 60523905 60523926 60523910 60523905 -
atgtctgtgcttaaagctccta

SEQ ID NO: 215393 - DNA, 22 bp, Artificial Sequence
  Synthetic oligonucleotide; CTG chr2 60523898 60523919 60523903 60523898 -
tgcttaaagctcctatttggct

SEQ ID NO: 215394 - DNA, 22 bp, Artificial Sequence
  Synthetic oligonucleotide; CTT chr2 60523893 60523914 60523898 60523893 -
aaagctcctatttggcttaaat

SEQ ID NO: 215395 - DNA, 22 bp, Artificial Sequence
  Synthetic oligonucleotide; TTA chr2 60523892 60523913 60523897 60523892 -
aagctcctatttggcttaaata

SEQ ID NO: 215396 - DNA, 22 bp, Artificial Sequence
  Synthetic oligonucleotide; CTC chr2 60523886 60523907 60523891 60523886 -
ctatttggcttaaataaattat

SEQ ID NO: 215397 - DNA, 22 bp, Artificial Sequence
  Synthetic oligonucleotide; CTA chr2 60523883 60523904 60523888 60523883 -
tttggcttaaataaattattta

SEQ ID NO: 215398 - DNA, 22 bp, Artificial Sequence
  Synthetic oligonucleotide; TTT chr2 60523880 60523901 60523885 60523880 -
ggcttaaataaattatttaggg

SEQ ID NO: 215399 - DNA, 22 bp, Artificial Sequence
  Synthetic oligonucleotide; TTG chr2 60523879 60523900 60523884 60523879 -
gcttaaataaattatttagggt

SEQ ID NO: 215400 - DNA, 22 bp, Artificial Sequence
  Synthetic oligonucleotide; CTT chr2 60523875 60523896 60523880 60523875 -
aaataaattatttagggtttac

SEQ ID NO: 215401 - DNA, 22 bp, Artificial Sequence
  Synthetic oligonucleotide; TTA chr2 60523874 60523895 60523879 60523874 -
aataaattatttagggtttact

SEQ ID NO: 215402 - DNA, 22 bp, Artificial Sequence
  Synthetic oligonucleotide; TTA chr2 60523865 60523886 60523870 60523865 -
tttagggtttactgcttaaacc

SEQ ID NO: 215403 - DNA, 22 bp, Artificial Sequence
  Synthetic oligonucleotide; TTT chr2 60523862 60523883 60523867 60523862 -
agggtttactgcttaaaccttg

SEQ ID NO: 215404 - DNA, 22 bp, Artificial Sequence
  Synthetic oligonucleotide; TTA chr2 60523861 60523882 60523866 60523861 -
gggtttactgcttaaaccttgg

SEQ ID NO: 215405 - DNA, 22 bp, Artificial Sequence
  Synthetic oligonucleotide; TTT chr2 60523855 60523876 60523860 60523855 -
actgcttaaaccttggtcaatt

SEQ ID NO: 215406 - DNA, 22 bp, Artificial Sequence
  Synthetic oligonucleotide; TTA chr2 60523854 60523875 60523859 60523854 -
ctgcttaaaccttggtcaattc

SEQ ID NO: 215407 - DNA, 22 bp, Artificial Sequence
  Synthetic oligonucleotide; CTG chr2 60523851 60523872 60523856 60523851 -
cttaaaccttggtcaattcttg

SEQ ID NO: 215408 - DNA, 22 bp, Artificial Sequence
  Synthetic oligonucleotide; CTT chr2 60523848 60523869 60523853 60523848 -
aaaccttggtcaattcttgaac

SEQ ID NO: 215409 - DNA, 22 bp, Artificial Sequence
  Synthetic oligonucleotide; TTA chr2 60523847 60523868 60523852 60523847 -
aaccttggtcaattcttgaacg

SEQ ID NO: 215410 - DNA, 22 bp, Artificial Sequence
  Synthetic oligonucleotide; CTT chr2 60523841 60523862 60523846 60523841 -
ggtcaattcttgaacgtttggg

SEQ ID NO: 215411 - DNA, 22 bp, Artificial Sequence
  Synthetic oligonucleotide; TTG chr2 60523840 60523861 60523845 60523840 -
gtcaattcttgaacgtttgggc

SEQ ID NO: 215412 - DNA, 22 bp, Artificial Sequence
  Synthetic oligonucleotide; TTC chr2 60523832 60523853 60523837 60523832 -
ttgaacgtttgggctagttaag

SEQ ID NO: 215413 - DNA, 22 bp, Artificial Sequence
  Synthetic oligonucleotide; CTT chr2 60523830 60523851 60523835 60523830 -
gaacgtttgggctagttaagta

SEQ ID NO: 215414 - DNA, 22 bp, Artificial Sequence
  Synthetic oligonucleotide; TTG chr2 60523829 60523850 60523834 60523829 -
aacgtttgggctagttaagtaa

SEQ ID NO: 215415 - DNA, 22 bp, Artificial Sequence
  Synthetic oligonucleotide; TTT chr2 60523822 60523843 60523827 60523822 -
gggctagttaagtaattttcca

SEQ ID NO: 215416 - DNA, 22 bp, Artificial Sequence
  Synthetic oligonucleotide; TTG chr2 60523821 60523842 60523826 60523821 -
ggctagttaagtaattttccag

SEQ ID NO: 215417 - DNA, 22 bp, Artificial Sequence
  Synthetic oligonucleotide; CTA chr2 60523816 60523837 60523821 60523816 -
gttaagtaattttccagtgact

SEQ ID NO: 215418 - DNA, 22 bp, Artificial Sequence
  Synthetic oligonucleotide; TTA chr2 60523812 60523833 60523817 60523812 -
agtaattttccagtgactttct

SEQ ID NO: 215419 - DNA, 22 bp, Artificial Sequence
  Synthetic oligonucleotide; TTT chr2 60523804 60523825 60523809 60523804 -
tccagtgactttctgtgccttg

SEQ ID NO: 215420 - DNA, 22 bp, Artificial Sequence
  Synthetic oligonucleotide; TTT chr2 60523803 60523824 60523808 60523803 -
ccagtgactttctgtgccttgg

SEQ ID NO: 215421 - DNA, 22 bp, Artificial Sequence
  Synthetic oligonucleotide; TTC chr2 60523802 60523823 60523807 60523802 -
cagtgactttctgtgccttggt

SEQ ID NO: 215422 - DNA, 22 bp, Artificial Sequence
  Synthetic oligonucleotide; CTT chr2 60523793 60523814 60523798 60523793 -
tctgtgccttggtgattcattt

SEQ ID NO: 215423 - DNA, 22 bp, Artificial Sequence
  Synthetic oligonucleotide; TTT chr2 60523792 60523813 60523797 60523792 -
ctgtgccttggtgattcattta

SEQ ID NO: 215424 - DNA, 22 bp, Artificial Sequence
  Synthetic oligonucleotide; TTC chr2 60523791 60523812 60523796 60523791 -
tgtgccttggtgattcatttac

SEQ ID NO: 215425 - DNA, 22 bp, Artificial Sequence
  Synthetic oligonucleotide; CTG chr2 60523789 60523810 60523794 60523789 -
tgccttggtgattcatttactt

SEQ ID NO: 215426 - DNA, 22 bp, Artificial Sequence
  Synthetic oligonucleotide; CTT chr2 60523783 60523804 60523788 60523783 -
ggtgattcatttacttgattga

SEQ ID NO: 215427 - DNA, 22 bp, Artificial Sequence
  Synthetic oligonucleotide; TTG chr2 60523782 60523803 60523787 60523782 -
gtgattcatttacttgattgag

SEQ ID NO: 215428 - DNA, 22 bp, Artificial Sequence
  Synthetic oligonucleotide; TTC chr2 60523775 60523796 60523780 60523775 -
atttacttgattgagctcctgt

SEQ ID NO: 215429 - DNA, 22 bp, Artificial Sequence
  Synthetic oligonucleotide; TTT chr2 60523771 60523792 60523776 60523771 -
acttgattgagctcctgtgtgc

SEQ ID NO: 215430 - DNA, 22 bp, Artificial Sequence
  Synthetic oligonucleotide; TTA chr2 60523770 60523791 60523775 60523770 -
cttgattgagctcctgtgtgct

SEQ ID NO: 215431 - DNA, 22 bp, Artificial Sequence
  Synthetic oligonucleotide; CTT chr2 60523767 60523788 60523772 60523767 -
gattgagctcctgtgtgctcgt

SEQ ID NO: 215432 - DNA, 22 bp, Artificial Sequence
  Synthetic oligonucleotide; TTG chr2 60523766 60523787 60523771 60523766 -
attgagctcctgtgtgctcgta

SEQ ID NO: 215433 - DNA, 22 bp, Artificial Sequence
  Synthetic oligonucleotide; TTG chr2 60523762 60523783 60523767 60523762 -
agctcctgtgtgctcgtatgat

SEQ ID NO: 215434 - DNA, 22 bp, Artificial Sequence
  Synthetic oligonucleotide; CTC chr2 60523757 60523778 60523762 60523757 -
ctgtgtgctcgtatgatttcta

SEQ ID NO: 215435 - DNA, 22 bp, Artificial Sequence
  Synthetic oligonucleotide; CTG chr2 60523754 60523775 60523759 60523754 -
tgtgctcgtatgatttctaaat

SEQ ID NO: 215436 - DNA, 22 bp, Artificial Sequence
  Synthetic oligonucleotide; CTC chr2 60523747 60523768 60523752 60523747 -
gtatgatttctaaatgtatttc

SEQ ID NO: 215437 - DNA, 22 bp, Artificial Sequence
  Synthetic oligonucleotide; TTT chr2 60523738 60523759 60523743 60523738 -
ctaaatgtatttctcaagtttt

SEQ ID NO: 215438 - DNA, 22 bp, Artificial Sequence
  Synthetic oligonucleotide; TTC chr2 60523737 60523758 60523742 60523737 -
taaatgtatttctcaagttttg

SEQ ID NO: 215439 - DNA, 22 bp, Artificial Sequence
  Synthetic oligonucleotide; CTA chr2 60523735 60523756 60523740 60523735 -
aatgtatttctcaagttttgcc

SEQ ID NO: 215440 - DNA, 22 bp, Artificial Sequence
  Synthetic oligonucleotide; TTT chr2 60523726 60523747 60523731 60523726 -
ctcaagttttgcctggcaatga

SEQ ID NO: 215441 - DNA, 22 bp, Artificial Sequence
  Synthetic oligonucleotide; TTC chr2 60523725 60523746 60523730 60523725 -
tcaagttttgcctggcaatgaa

SEQ ID NO: 215442 - DNA, 22 bp, Artificial Sequence
  Synthetic oligonucleotide; CTC chr2 60523723 60523744 60523728 60523723 -
aagttttgcctggcaatgaatg

SEQ ID NO: 215443 - DNA, 22 bp, Artificial Sequence
  Synthetic oligonucleotide; TTT chr2 60523717 60523738 60523722 60523717 -
tgcctggcaatgaatgattttg

SEQ ID NO: 215444 - DNA, 22 bp, Artificial Sequence
  Synthetic oligonucleotide; TTT chr2 60523716 60523737 60523721 60523716 -
gcctggcaatgaatgattttgc

SEQ ID NO: 215445 - DNA, 22 bp, Artificial Sequence
  Synthetic oligonucleotide; TTG chr2 60523715 60523736 60523720 60523715 -
cctggcaatgaatgattttgct

SEQ ID NO: 215446 - DNA, 22 bp, Artificial Sequence
  Synthetic oligonucleotide; CTG chr2 60523711 60523732 60523716 60523711 -
gcaatgaatgattttgcttact

SEQ ID NO: 215447 - DNA, 22 bp, Artificial Sequence
  Synthetic oligonucleotide; TTT chr2 60523697 60523718 60523702 60523697 -
tgcttactggagtcttgtgtgg

SEQ ID NO: 215448 - DNA, 22 bp, Artificial Sequence
  Synthetic oligonucleotide; TTT chr2 60523696 60523717 60523701 60523696 -
gcttactggagtcttgtgtggt

SEQ ID NO: 215449 - DNA, 22 bp, Artificial Sequence
  Synthetic oligonucleotide; TTG chr2 60523695 60523716 60523700 60523695 -
cttactggagtcttgtgtggta

SEQ ID NO: 215450 - DNA, 22 bp, Artificial Sequence
  Synthetic oligonucleotide; CTT chr2 60523692 60523713 60523697 60523692 -
actggagtcttgtgtggtacac

SEQ ID NO: 215451 - DNA, 22 bp, Artificial Sequence
  Synthetic oligonucleotide; TTA chr2 60523691 60523712 60523696 60523691 -
ctggagtcttgtgtggtacacc

SEQ ID NO: 215452 - DNA, 22 bp, Artificial Sequence
  Synthetic oligonucleotide; CTG chr2 60523688 60523709 60523693 60523688 -
gagtcttgtgtggtacacctat

SEQ ID NO: 215453 - DNA, 22 bp, Artificial Sequence
  Synthetic oligonucleotide; CTT chr2 60523681 60523702 60523686 60523681 -
gtgtggtacacctataaaaggc

SEQ ID NO: 215454 - DNA, 22 bp, Artificial Sequence
  Synthetic oligonucleotide; TTG chr2 60523680 60523701 60523685 60523680 -
tgtggtacacctataaaaggct

SEQ ID NO: 215455 - DNA, 22 bp, Artificial Sequence
  Synthetic oligonucleotide; CTA chr2 60523667 60523688 60523672 60523667 -
taaaaggcttattaactctttt

SEQ ID NO: 215456 - DNA, 22 bp, Artificial Sequence
  Synthetic oligonucleotide; CTT chr2 60523657 60523678 60523662 60523657 -
attaactctttttgaaaaaaaa

SEQ ID NO: 215457 - DNA, 22 bp, Artificial Sequence
  Synthetic oligonucleotide; TTA chr2 60523656 60523677 60523661 60523656 -
ttaactctttttgaaaaaaaaa

SEQ ID NO: 215458 - DNA, 22 bp, Artificial Sequence
  Synthetic oligonucleotide; TTA chr2 60523653 60523674 60523658 60523653 -
actctttttgaaaaaaaaaaaa

SEQ ID NO: 215459 - DNA, 22 bp, Artificial Sequence
  Synthetic oligonucleotide; CTC chr2 60523649 60523670 60523654 60523649 -
tttttgaaaaaaaaaaaaatcc

SEQ ID NO: 215460 - DNA, 22 bp, Artificial Sequence
  Synthetic oligonucleotide; CTT chr2 60523647 60523668 60523652 60523647 -
tttgaaaaaaaaaaaaatcccc

SEQ ID NO: 215461 - DNA, 22 bp, Artificial Sequence
  Synthetic oligonucleotide; TTT chr2 60523646 60523667 60523651 60523646 -
ttgaaaaaaaaaaaaatcccca

SEQ ID NO: 215462 - DNA, 22 bp, Artificial Sequence
  Synthetic oligonucleotide; TTT chr2 60523645 60523666 60523650 60523645 -
tgaaaaaaaaaaaaatccccaa

SEQ ID NO: 215463 - DNA, 22 bp, Artificial Sequence
  Synthetic oligonucleotide; TTT chr2 60523644 60523665 60523649 60523644 -
gaaaaaaaaaaaaatccccaaa

SEQ ID NO: 215464 - DNA, 22 bp, Artificial Sequence
  Synthetic oligonucleotide; TTG chr2 60523643 60523664 60523648 60523643 -
aaaaaaaaaaaaatccccaaac

SEQ ID NO: 215465 - DNA, 22 bp, Artificial Sequence
  Synthetic oligonucleotide; CTG chr2 60523609 60523630 60523614 60523609 -
tcatcataagataaagcatata

SEQ ID NO: 215466 - DNA, 22 bp, Artificial Sequence
  Synthetic oligonucleotide; CTA chr2 60523573 60523594 60523578 60523573 -
tatacacacatacatatgtaca

SEQ ID NO: 215467 - DNA, 22 bp, Artificial Sequence
  Synthetic oligonucleotide; CTA chr2 60523546 60523567 60523551 60523546 -
catatatacatacgtatatgca

SEQ ID NO: 215468 - DNA, 22 bp, Artificial Sequence
  Synthetic oligonucleotide; TTG chr2 60523502 60523523 60523507 60523502 -
tgtgcctgtgtgtgtgtagaaa

SEQ ID NO: 215469 - DNA, 22 bp, Artificial Sequence
  Synthetic oligonucleotide; CTG chr2 60523494 60523515 60523499 60523494 -
tgtgtgtgtagaaagggagaga

SEQ ID NO: 215470 - DNA, 22 bp, Artificial Sequence
  Synthetic oligonucleotide; CTT chr2 60523453 60523474 60523458 60523453 -
tagaattcaccatgattccatc

SEQ ID NO: 215471 - DNA, 22 bp, Artificial Sequence
  Synthetic oligonucleotide; TTT chr2 60523452 60523473 60523457 60523452 -
agaattcaccatgattccatca

SEQ ID NO: 215472 - DNA, 22 bp, Artificial Sequence
  Synthetic oligonucleotide; TTA chr2 60523451 60523472 60523456 60523451 -
gaattcaccatgattccatcaa

SEQ ID NO: 215473 - DNA, 22 bp, Artificial Sequence
  Synthetic oligonucleotide; TTC chr2 60523445 60523466 60523450 60523445 -
accatgattccatcaaatcaat

SEQ ID NO: 215474 - DNA, 22 bp, Artificial Sequence
  Synthetic oligonucleotide; TTC chr2 60523435 60523456 60523440 60523435 -
catcaaatcaatatagaagttt

SEQ ID NO: 215475 - DNA, 22 bp, Artificial Sequence
  Synthetic oligonucleotide; TTT chr2 60523413 60523434 60523418 60523413 -
ttgaaagctatccatgtagaaa

SEQ ID NO: 215476 - DNA, 22 bp, Artificial Sequence
  Synthetic oligonucleotide; TTT chr2 60523412 60523433 60523417 60523412 -
tgaaagctatccatgtagaaac

SEQ ID NO: 215477 - DNA, 22 bp, Artificial Sequence
  Synthetic oligonucleotide; TTT chr2 60523411 60523432 60523416 60523411 -
gaaagctatccatgtagaaacc

SEQ ID NO: 215478 - DNA, 22 bp, Artificial Sequence
  Synthetic oligonucleotide; TTG chr2 60523410 60523431 60523415 60523410 -
aaagctatccatgtagaaacca

SEQ ID NO: 215479 - DNA, 22 bp, Artificial Sequence
  Synthetic oligonucleotide; CTA chr2 60523403 60523424 60523408 60523403 -
tccatgtagaaaccacttttca

SEQ ID NO: 215480 - DNA, 22 bp, Artificial Sequence
  Synthetic oligonucleotide; CTT chr2 60523385 60523406 60523390 60523385 -
ttcatcaaaatctgacttaagc

SEQ ID NO: 215481 - DNA, 22 bp, Artificial Sequence
  Synthetic oligonucleotide; TTT chr2 60523384 60523405 60523389 60523384 -
tcatcaaaatctgacttaagca

SEQ ID NO: 215482 - DNA, 22 bp, Artificial Sequence
  Synthetic oligonucleotide; TTT chr2 60523383 60523404 60523388 60523383 -
catcaaaatctgacttaagcaa

SEQ ID NO: 215483 - DNA, 22 bp, Artificial Sequence
  Synthetic oligonucleotide; TTC chr2 60523382 60523403 60523387 60523382 -
atcaaaatctgacttaagcaaa

SEQ ID NO: 215484 - DNA, 22 bp, Artificial Sequence
  Synthetic oligonucleotide; CTG chr2 60523371 60523392 60523376 60523371 -
acttaagcaaattatctccata

SEQ ID NO: 215485 - DNA, 22 bp, Artificial Sequence
  Synthetic oligonucleotide; CTT chr2 60523367 60523388 60523372 60523367 -
aagcaaattatctccatactat

SEQ ID NO: 215486 - DNA, 22 bp, Artificial Sequence
  Synthetic oligonucleotide; TTA chr2 60523366 60523387 60523371 60523366 -
agcaaattatctccatactatt

SEQ ID NO: 215487 - DNA, 22 bp, Artificial Sequence
  Synthetic oligonucleotide; TTA chr2 60523357 60523378 60523362 60523357 -
tctccatactatttatctgaaa

SEQ ID NO: 215488 - DNA, 22 bp, Artificial Sequence
  Synthetic oligonucleotide; CTC chr2 60523353 60523374 60523358 60523353 -
catactatttatctgaaagtct

SEQ ID NO: 215489 - DNA, 22 bp, Artificial Sequence
  Synthetic oligonucleotide; CTA chr2 60523346 60523367 60523351 60523346 -
tttatctgaaagtctgttgttc

SEQ ID NO: 215490 - DNA, 22 bp, Artificial Sequence
  Synthetic oligonucleotide; TTT chr2 60523343 60523364 60523348 60523343 -
atctgaaagtctgttgttcaca

SEQ ID NO: 215491 - DNA, 22 bp, Artificial Sequence
  Synthetic oligonucleotide; TTA chr2 60523342 60523363 60523347 60523342 -
tctgaaagtctgttgttcacat

SEQ ID NO: 215492 - DNA, 22 bp, Artificial Sequence
  Synthetic oligonucleotide; CTG chr2 60523338 60523359 60523343 60523338 -
aaagtctgttgttcacatagcg

SEQ ID NO: 215493 - DNA, 22 bp, Artificial Sequence
  Synthetic oligonucleotide; CTG chr2 60523330 60523351 60523335 60523330 -
ttgttcacatagcgctggattg

SEQ ID NO: 215494 - DNA, 22 bp, Artificial Sequence
  Synthetic oligonucleotide; TTG chr2 60523327 60523348 60523332 60523327 -
ttcacatagcgctggattgagg

SEQ ID NO: 215495 - DNA, 22 bp, Artificial Sequence
  Synthetic oligonucleotide; TTC chr2 60523324 60523345 60523329 60523324 -
acatagcgctggattgaggatc

SEQ ID NO: 215496 - DNA, 22 bp, Artificial Sequence
  Synthetic oligonucleotide; CTG chr2 60523313 60523334 60523318 60523313 -
gattgaggatcatagtggcaaa

SEQ ID NO: 215497 - DNA, 22 bp, Artificial Sequence
  Synthetic oligonucleotide; TTG chr2 60523308 60523329 60523313 60523308 -
aggatcatagtggcaaatttag

SEQ ID NO: 215498 - DNA, 22 bp, Artificial Sequence
  Synthetic oligonucleotide; TTT chr2 60523288 60523309 60523293 60523288 -
aggagcaacagtcccaagcagg

SEQ ID NO: 215499 - DNA, 22 bp, Artificial Sequence
  Synthetic oligonucleotide; TTA chr2 60523287 60523308 60523292 60523287 -
ggagcaacagtcccaagcagga

SEQ ID NO: 215500 - DNA, 22 bp, Artificial Sequence
  Synthetic oligonucleotide; CTG chr2 60523259 60523280 60523264 60523259 -
gatggcaggctgtcctttgtgc

SEQ ID NO: 215501 - DNA, 22 bp, Artificial Sequence
  Synthetic oligonucleotide; CTG chr2 60523247 60523268 60523252 60523247 -
tcctttgtgcctcccctgagtt

SEQ ID NO: 215502 - DNA, 22 bp, Artificial Sequence
  Synthetic oligonucleotide; CTT chr2 60523242 60523263 60523247 60523242 -
tgtgcctcccctgagttgagaa

SEQ ID NO: 215503 - DNA, 22 bp, Artificial Sequence
  Synthetic oligonucleotide; TTT chr2 60523241 60523262 60523246 60523241 -
gtgcctcccctgagttgagaag

SEQ ID NO: 215504 - DNA, 22 bp, Artificial Sequence
  Synthetic oligonucleotide; TTG chr2 60523240 60523261 60523245 60523240 -
tgcctcccctgagttgagaaga

SEQ ID NO: 215505 - DNA, 22 bp, Artificial Sequence
  Synthetic oligonucleotide; CTC chr2 60523234 60523255 60523239 60523234 -
ccctgagttgagaagactggtg

SEQ ID NO: 215506 - DNA, 22 bp, Artificial Sequence
  Synthetic oligonucleotide; CTG chr2 60523229 60523250 60523234 60523229 -
agttgagaagactggtgtttat

SEQ ID NO: 215507 - DNA, 22 bp, Artificial Sequence
  Synthetic oligonucleotide; TTG chr2 60523224 60523245 60523229 60523224 -
agaagactggtgtttattcttt

SEQ ID NO: 215508 - DNA, 22 bp, Artificial Sequence
  Synthetic oligonucleotide; CTG chr2 60523215 60523236 60523220 60523215 -
gtgtttattctttctctaggtt

SEQ ID NO: 215509 - DNA, 22 bp, Artificial Sequence
  Synthetic oligonucleotide; TTT chr2 60523209 60523230 60523214 60523209 -
attctttctctaggttgcaaca

SEQ ID NO: 215510 - DNA, 22 bp, Artificial Sequence
  Synthetic oligonucleotide; TTA chr2 60523208 60523229 60523213 60523208 -
ttctttctctaggttgcaacac

SEQ ID NO: 215511 - DNA, 22 bp, Artificial Sequence
  Synthetic oligonucleotide; TTC chr2 60523205 60523226 60523210 60523205 -
tttctctaggttgcaacacgtg

SEQ ID NO: 215512 - DNA, 22 bp, Artificial Sequence
  Synthetic oligonucleotide; CTT chr2 60523203 60523224 60523208 60523203 -
tctctaggttgcaacacgtgtt

SEQ ID NO: 215513 - DNA, 22 bp, Artificial Sequence
  Synthetic oligonucleotide; TTT chr2 60523202 60523223 60523207 60523202 -
ctctaggttgcaacacgtgttg

SEQ ID NO: 215514 - DNA, 22 bp, Artificial Sequence
  Synthetic oligonucleotide; TTC chr2 60523201 60523222 60523206 60523201 -
tctaggttgcaacacgtgttgc

SEQ ID NO: 215515 - DNA, 22 bp, Artificial Sequence
  Synthetic oligonucleotide; CTC chr2 60523199 60523220 60523204 60523199 -
taggttgcaacacgtgttgcct

SEQ ID NO: 215516 - DNA, 22 bp, Artificial Sequence
  Synthetic oligonucleotide; CTA chr2 60523197 60523218 60523202 60523197 -
ggttgcaacacgtgttgccttg

SEQ ID NO: 215517 - DNA, 22 bp, Artificial Sequence
  Synthetic oligonucleotide; TTG chr2 60523192 60523213 60523197 60523192 -
caacacgtgttgccttgaaatc

SEQ ID NO: 215518 - DNA, 22 bp, Artificial Sequence
  Synthetic oligonucleotide; TTG chr2 60523180 60523201 60523185 60523180 -
ccttgaaatctcccttctttac

SEQ ID NO: 215519 - DNA, 22 bp, Artificial Sequence
  Synthetic oligonucleotide; CTT chr2 60523176 60523197 60523181 60523176 -
gaaatctcccttctttacggtt

SEQ ID NO: 215520 - DNA, 22 bp, Artificial Sequence
  Synthetic oligonucleotide; TTG chr2 60523175 60523196 60523180 60523175 -
aaatctcccttctttacggttc

SEQ ID NO: 215521 - DNA, 22 bp, Artificial Sequence
  Synthetic oligonucleotide; CTC chr2 60523168 60523189 60523173 60523168 -
ccttctttacggttctgccatg

SEQ ID NO: 215522 - DNA, 22 bp, Artificial Sequence
  Synthetic oligonucleotide; CTT chr2 60523164 60523185 60523169 60523164 -
ctttacggttctgccatgagtg

SEQ ID NO: 215523 - DNA, 22 bp, Artificial Sequence
  Synthetic oligonucleotide; TTC chr2 60523163 60523184 60523168 60523163 -
tttacggttctgccatgagtgt

SEQ ID NO: 215524 - DNA, 22 bp, Artificial Sequence
  Synthetic oligonucleotide; CTT chr2 60523161 60523182 60523166 60523161 -
tacggttctgccatgagtgtat

SEQ ID NO: 215525 - DNA, 22 bp, Artificial Sequence
  Synthetic oligonucleotide; TTT chr2 60523160 60523181 60523165 60523160 -
acggttctgccatgagtgtatt

SEQ ID NO: 215526 - DNA, 22 bp, Artificial Sequence
  Synthetic oligonucleotide; TTA chr2 60523159 60523180 60523164 60523159 -
cggttctgccatgagtgtattt

SEQ ID NO: 215527 - DNA, 22 bp, Artificial Sequence
  Synthetic oligonucleotide; TTC chr2 60523153 60523174 60523158 60523153 -
tgccatgagtgtattttctgtg

SEQ ID NO: 215528 - DNA, 22 bp, Artificial Sequence
  Synthetic oligonucleotide; CTG chr2 60523151 60523172 60523156 60523151 -
ccatgagtgtattttctgtgac

SEQ ID NO: 215529 - DNA, 22 bp, Artificial Sequence
  Synthetic oligonucleotide; TTT chr2 60523137 60523158 60523142 60523137 -
tctgtgacctgcctctgcatct

SEQ ID NO: 215530 - DNA, 22 bp, Artificial Sequence
  Synthetic oligonucleotide; TTT chr2 60523136 60523157 60523141 60523136 -
ctgtgacctgcctctgcatctg

SEQ ID NO: 215531 - DNA, 22 bp, Artificial Sequence
  Synthetic oligonucleotide; TTC chr2 60523135 60523156 60523140 60523135 -
tgtgacctgcctctgcatctgg

SEQ ID NO: 215532 - DNA, 22 bp, Artificial Sequence
  Synthetic oligonucleotide; CTG chr2 60523133 60523154 60523138 60523133 -
tgacctgcctctgcatctggtt

SEQ ID NO: 215533 - DNA, 22 bp, Artificial Sequence
  Synthetic oligonucleotide; CTG chr2 60523126 60523147 60523131 60523126 -
cctctgcatctggttaaatgga

SEQ ID NO: 215534 - DNA, 22 bp, Artificial Sequence
  Synthetic oligonucleotide; CTC chr2 60523122 60523143 60523127 60523122 -
tgcatctggttaaatggacttc

SEQ ID NO: 215535 - DNA, 22 bp, Artificial Sequence
  Synthetic oligonucleotide; CTG chr2 60523120 60523141 60523125 60523120 -
catctggttaaatggacttcag

SEQ ID NO: 215536 - DNA, 22 bp, Artificial Sequence
  Synthetic oligonucleotide; CTG chr2 60523114 60523135 60523119 60523114 -
gttaaatggacttcagtaatct

SEQ ID NO: 215537 - DNA, 22 bp, Artificial Sequence
  Synthetic oligonucleotide; TTA chr2 60523110 60523131 60523115 60523110 -
aatggacttcagtaatctgtac

SEQ ID NO: 215538 - DNA, 22 bp, Artificial Sequence
  Synthetic oligonucleotide; CTT chr2 60523101 60523122 60523106 60523101 -
cagtaatctgtacacagttact

SEQ ID NO: 215539 - DNA, 22 bp, Artificial Sequence
  Synthetic oligonucleotide; TTC chr2 60523100 60523121 60523105 60523100 -
agtaatctgtacacagttactt

SEQ ID NO: 215540 - DNA, 22 bp, Artificial Sequence
  Synthetic oligonucleotide; CTG chr2 60523091 60523112 60523096 60523091 -
tacacagttacttcttacttat

SEQ ID NO: 215541 - DNA, 22 bp, Artificial Sequence
  Synthetic oligonucleotide; TTA chr2 60523081 60523102 60523086 60523081 -
cttcttacttattttatatcct

SEQ ID NO: 215542 - DNA, 22 bp, Artificial Sequence
  Synthetic oligonucleotide; CTT chr2 60523078 60523099 60523083 60523078 -
cttacttattttatatcctgaa

SEQ ID NO: 215543 - DNA, 22 bp, Artificial Sequence
  Synthetic oligonucleotide; TTC chr2 60523077 60523098 60523082 60523077 -
ttacttattttatatcctgaaa

SEQ ID NO: 215544 - DNA, 22 bp, Artificial Sequence
  Synthetic oligonucleotide; CTT chr2 60523075 60523096 60523080 60523075 -
acttattttatatcctgaaaga

SEQ ID NO: 215545 - DNA, 22 bp, Artificial Sequence
  Synthetic oligonucleotide; TTA chr2 60523074 60523095 60523079 60523074 -
cttattttatatcctgaaagat

SEQ ID NO: 215546 - DNA, 22 bp, Artificial Sequence
  Synthetic oligonucleotide; CTT chr2 60523071 60523092 60523076 60523071 -
attttatatcctgaaagatatt

SEQ ID NO: 215547 - DNA, 22 bp, Artificial Sequence
  Synthetic oligonucleotide; TTA chr2 60523070 60523091 60523075 60523070 -
ttttatatcctgaaagatatta

SEQ ID NO: 215548 - DNA, 22 bp, Artificial Sequence
  Synthetic oligonucleotide; TTT chr2 60523067 60523088 60523072 60523067 -
tatatcctgaaagatattaagt

SEQ ID NO: 215549 - DNA, 22 bp, Artificial Sequence
  Synthetic oligonucleotide; TTT chr2 60523066 60523087 60523071 60523066 -
atatcctgaaagatattaagtc

SEQ ID NO: 215550 - DNA, 22 bp, Artificial Sequence
  Synthetic oligonucleotide; TTA chr2 60523065 60523086 60523070 60523065 -
tatcctgaaagatattaagtcc

SEQ ID NO: 215551 - DNA, 22 bp, Artificial Sequence
  Synthetic oligonucleotide; CTG chr2 60523058 60523079 60523063 60523058 -
aaagatattaagtccaacaagc

SEQ ID NO: 215552 - DNA, 22 bp, Artificial Sequence
  Synthetic oligonucleotide; TTA chr2 60523048 60523069 60523053 60523048 -
agtccaacaagcttttacccac

SEQ ID NO: 215553 - DNA, 22 bp, Artificial Sequence
  Synthetic oligonucleotide; CTT chr2 60523034 60523055 60523039 60523034 -
ttacccacagagtctacagaga

SEQ ID NO: 215554 - DNA, 22 bp, Artificial Sequence
  Synthetic oligonucleotide; TTT chr2 60523033 60523054 60523038 60523033 -
tacccacagagtctacagagaa

SEQ ID NO: 215555 - DNA, 22 bp, Artificial Sequence
  Synthetic oligonucleotide; TTT chr2 60523032 60523053 60523037 60523032 -
acccacagagtctacagagaaa

SEQ ID NO: 215556 - DNA, 22 bp, Artificial Sequence
  Synthetic oligonucleotide; TTA chr2 60523031 60523052 60523036 60523031 -
cccacagagtctacagagaaaa

SEQ ID NO: 215557 - DNA, 22 bp, Artificial Sequence
  Synthetic oligonucleotide; CTA chr2 60523018 60523039 60523023 60523018 -
cagagaaaacggccaggcaatt

SEQ ID NO: 215558 - DNA, 22 bp, Artificial Sequence
  Synthetic oligonucleotide; TTT chr2 60522995 60523016 60523000 60522995 -
ttgtttcaatctctgtgtctct

SEQ ID NO: 215559 - DNA, 22 bp, Artificial Sequence
  Synthetic oligonucleotide; TTT chr2 60522994 60523015 60522999 60522994 -
tgtttcaatctctgtgtctctc

SEQ ID NO: 215560 - DNA, 22 bp, Artificial Sequence
  Synthetic oligonucleotide; TTT chr2 60522993 60523014 60522998 60522993 -
gtttcaatctctgtgtctctct

SEQ ID NO: 215561 - DNA, 22 bp, Artificial Sequence
  Synthetic oligonucleotide; TTG chr2 60522992 60523013 60522997 60522992 -
tttcaatctctgtgtctctctg

SEQ ID NO: 215562 - DNA, 22 bp, Artificial Sequence
  Synthetic oligonucleotide; TTT chr2 60522989 60523010 60522994 60522989 -
caatctctgtgtctctctggag

SEQ ID NO: 215563 - DNA, 22 bp, Artificial Sequence
  Synthetic oligonucleotide; TTC chr2 60522988 60523009 60522993 60522988 -
aatctctgtgtctctctggagc

SEQ ID NO: 215564 - DNA, 22 bp, Artificial Sequence
  Synthetic oligonucleotide; CTC chr2 60522982 60523003 60522987 60522982 -
tgtgtctctctggagcactagt

SEQ ID NO: 215565 - DNA, 22 bp, Artificial Sequence
  Synthetic oligonucleotide; CTG chr2 60522980 60523001 60522985 60522980 -
tgtctctctggagcactagttc

SEQ ID NO: 215566 - DNA, 22 bp, Artificial Sequence
  Synthetic oligonucleotide; CTC chr2 60522974 60522995 60522979 60522974 -
tctggagcactagttccagagg

SEQ ID NO: 215567 - DNA, 22 bp, Artificial Sequence
  Synthetic oligonucleotide; CTC chr2 60522972 60522993 60522977 60522972 -
tggagcactagttccagaggct

SEQ ID NO: 215568 - DNA, 22 bp, Artificial Sequence
  Synthetic oligonucleotide; CTG chr2 60522970 60522991 60522975 60522970 -
gagcactagttccagaggctga

SEQ ID NO: 215569 - DNA, 22 bp, Artificial Sequence
  Synthetic oligonucleotide; CTA chr2 60522962 60522983 60522967 60522962 -
gttccagaggctgatcaatagg

SEQ ID NO: 215570 - DNA, 22 bp, Artificial Sequence
  Synthetic oligonucleotide; TTC chr2 60522958 60522979 60522963 60522958 -
cagaggctgatcaataggtttt

SEQ ID NO: 215571 - DNA, 22 bp, Artificial Sequence
  Synthetic oligonucleotide; CTG chr2 60522949 60522970 60522954 60522949 -
atcaataggttttattgtagac

SEQ ID NO: 215572 - DNA, 22 bp, Artificial Sequence
  Synthetic oligonucleotide; TTT chr2 60522937 60522958 60522942 60522937 -
tattgtagacctcactgtctct

SEQ ID NO: 215573 - DNA, 22 bp, Artificial Sequence
  Synthetic oligonucleotide; TTT chr2 60522936 60522957 60522941 60522936 -
attgtagacctcactgtctcta

SEQ ID NO: 215574 - DNA, 22 bp, Artificial Sequence
  Synthetic oligonucleotide; TTA chr2 60522935 60522956 60522940 60522935 -
ttgtagacctcactgtctctaa

SEQ ID NO: 215575 - DNA, 22 bp, Artificial Sequence
  Synthetic oligonucleotide; TTG chr2 60522932 60522953 60522937 60522932 -
tagacctcactgtctctaaaag

SEQ ID NO: 215576 - DNA, 22 bp, Artificial Sequence
  Synthetic oligonucleotide; CTC chr2 60522924 60522945 60522929 60522924 -
actgtctctaaaagcattttga

SEQ ID NO: 215577 - DNA, 22 bp, Artificial Sequence
  Synthetic oligonucleotide; CTG chr2 60522920 60522941 60522925 60522920 -
tctctaaaagcattttgacctt

SEQ ID NO: 215578 - DNA, 22 bp, Artificial Sequence
  Synthetic oligonucleotide; CTC chr2 60522916 60522937 60522921 60522916 -
taaaagcattttgaccttatcc

SEQ ID NO: 215579 - DNA, 22 bp, Artificial Sequence
  Synthetic oligonucleotide; CTA chr2 60522914 60522935 60522919 60522914 -
aaagcattttgaccttatcctg

SEQ ID NO: 215580 - DNA, 22 bp, Artificial Sequence
  Synthetic oligonucleotide; TTT chr2 60522905 60522926 60522910 60522905 -
tgaccttatcctgtctaaaaat

SEQ ID NO: 215581 - DNA, 22 bp, Artificial Sequence
  Synthetic oligonucleotide; TTT chr2 60522904 60522925 60522909 60522904 -
gaccttatcctgtctaaaaata

SEQ ID NO: 215582 - DNA, 22 bp, Artificial Sequence
  Synthetic oligonucleotide; TTG chr2 60522903 60522924 60522908 60522903 -
accttatcctgtctaaaaatag

SEQ ID NO: 215583 - DNA, 22 bp, Artificial Sequence
  Synthetic oligonucleotide; CTT chr2 60522898 60522919 60522903 60522898 -
atcctgtctaaaaatagtattt

SEQ ID NO: 215584 - DNA, 22 bp, Artificial Sequence
  Synthetic oligonucleotide; TTA chr2 60522897 60522918 60522902 60522897 -
tcctgtctaaaaatagtatttg

SEQ ID NO: 215585 - DNA, 22 bp, Artificial Sequence
  Synthetic oligonucleotide; CTG chr2 60522892 60522913 60522897 60522892 -
tctaaaaatagtatttgctctt

SEQ ID NO: 215586 - DNA, 22 bp, Artificial Sequence
  Synthetic oligonucleotide; CTA chr2 60522888 60522909 60522893 60522888 -
aaaatagtatttgctcttgcct

SEQ ID NO: 215587 - DNA, 22 bp, Artificial Sequence
  Synthetic oligonucleotide; TTT chr2 60522876 60522897 60522881 60522876 -
gctcttgcctgcagaaccttga

SEQ ID NO: 215588 - DNA, 22 bp, Artificial Sequence
  Synthetic oligonucleotide; TTG chr2 60522875 60522896 60522880 60522875 -
ctcttgcctgcagaaccttgac

SEQ ID NO: 215589 - DNA, 22 bp, Artificial Sequence
  Synthetic oligonucleotide; CTC chr2 60522872 60522893 60522877 60522872 -
ttgcctgcagaaccttgacctg

SEQ ID NO: 215590 - DNA, 22 bp, Artificial Sequence
  Synthetic oligonucleotide; CTT chr2 60522870 60522891 60522875 60522870 -
gcctgcagaaccttgacctgtg

SEQ ID NO: 215591 - DNA, 22 bp, Artificial Sequence
  Synthetic oligonucleotide; TTG chr2 60522869 60522890 60522874 60522869 -
cctgcagaaccttgacctgtga

SEQ ID NO: 215592 - DNA, 22 bp, Artificial Sequence
  Synthetic oligonucleotide; CTG chr2 60522865 60522886 60522870 60522865 -
cagaaccttgacctgtgaaaac

SEQ ID NO: 215593 - DNA, 22 bp, Artificial Sequence
  Synthetic oligonucleotide; CTT chr2 60522856 60522877 60522861 60522856 -
gacctgtgaaaacccatttgga

SEQ ID NO: 215594 - DNA, 22 bp, Artificial Sequence
  Synthetic oligonucleotide; TTG chr2 60522855 60522876 60522860 60522855 -
acctgtgaaaacccatttggaa

SEQ ID NO: 215595 - DNA, 22 bp, Artificial Sequence
  Synthetic oligonucleotide; CTG chr2 60522850 60522871 60522855 60522850 -
tgaaaacccatttggaacataa

SEQ ID NO: 215596 - DNA, 22 bp, Artificial Sequence
  Synthetic oligonucleotide; TTT chr2 60522837 60522858 60522842 60522837 -
ggaacataactgacatatctag

SEQ ID NO: 215597 - DNA, 22 bp, Artificial Sequence
  Synthetic oligonucleotide; TTG chr2 60522836 60522857 60522841 60522836 -
gaacataactgacatatctagt

SEQ ID NO: 215598 - DNA, 22 bp, Artificial Sequence
  Synthetic oligonucleotide; CTG chr2 60522825 60522846 60522830 60522825 -
acatatctagtcagctgtatat

SEQ ID NO: 215599 - DNA, 22 bp, Artificial Sequence
  Synthetic oligonucleotide; CTA chr2 60522816 60522837 60522821 60522816 -
gtcagctgtatatccaagacat

SEQ ID NO: 215600 - DNA, 22 bp, Artificial Sequence
  Synthetic oligonucleotide; CTG chr2 60522808 60522829 60522813 60522808 -
tatatccaagacatgctctgtg

SEQ ID NO: 215601 - DNA, 22 bp, Artificial Sequence
  Synthetic oligonucleotide; CTC chr2 60522790 60522811 60522795 60522790 -
tgtgaatgaattctgtgcagaa

SEQ ID NO: 215602 - DNA, 22 bp, Artificial Sequence
  Synthetic oligonucleotide; CTG chr2 60522788 60522809 60522793 60522788 -
tgaatgaattctgtgcagaacc

SEQ ID NO: 215603 - DNA, 22 bp, Artificial Sequence
  Synthetic oligonucleotide; TTC chr2 60522777 60522798 60522782 60522777 -
tgtgcagaaccgtccaggagaa

SEQ ID NO: 215604 - DNA, 22 bp, Artificial Sequence
  Synthetic oligonucleotide; CTG chr2 60522775 60522796 60522780 60522775 -
tgcagaaccgtccaggagaaca

SEQ ID NO: 215605 - DNA, 22 bp, Artificial Sequence
  Synthetic oligonucleotide; CTT chr2 60522750 60522771 60522755 60522750 -
tcttccaagacaaatgaattcc

SEQ ID NO: 215606 - DNA, 22 bp, Artificial Sequence
  Synthetic oligonucleotide; TTT chr2 60522749 60522770 60522754 60522749 -
cttccaagacaaatgaattcca

SEQ ID NO: 215607 - DNA, 22 bp, Artificial Sequence
  Synthetic oligonucleotide; TTC chr2 60522748 60522769 60522753 60522748 -
ttccaagacaaatgaattccag

SEQ ID NO: 215608 - DNA, 22 bp, Artificial Sequence
  Synthetic oligonucleotide; CTT chr2 60522746 60522767 60522751 60522746 -
ccaagacaaatgaattccagtt

SEQ ID NO: 215609 - DNA, 22 bp, Artificial Sequence
  Synthetic oligonucleotide; TTC chr2 60522745 60522766 60522750 60522745 -
caagacaaatgaattccagttc

SEQ ID NO: 215610 - DNA, 22 bp, Artificial Sequence
  Synthetic oligonucleotide; TTC chr2 60522729 60522750 60522734 60522729 -
cagttctgaacactgggagtgc

SEQ ID NO: 215611 - DNA, 22 bp, Artificial Sequence
  Synthetic oligonucleotide; TTC chr2 60522723 60522744 60522728 60522723 -
tgaacactgggagtgcacctgc

SEQ ID NO: 215612 - DNA, 22 bp, Artificial Sequence
  Synthetic oligonucleotide; CTG chr2 60522721 60522742 60522726 60522721 -
aacactgggagtgcacctgctt

SEQ ID NO: 215613 - DNA, 22 bp, Artificial Sequence
  Synthetic oligonucleotide; CTG chr2 60522714 60522735 60522719 60522714 -
ggagtgcacctgcttgtcggat

SEQ ID NO: 215614 - DNA, 22 bp, Artificial Sequence
  Synthetic oligonucleotide; CTG chr2 60522702 60522723 60522707 60522702 -
cttgtcggatgtggtgatgggc

SEQ ID NO: 215615 - DNA, 22 bp, Artificial Sequence
  Synthetic oligonucleotide; CTT chr2 60522699 60522720 60522704 60522699 -
gtcggatgtggtgatgggccac

SEQ ID NO: 215616 - DNA, 22 bp, Artificial Sequence
  Synthetic oligonucleotide; TTG chr2 60522698 60522719 60522703 60522698 -
tcggatgtggtgatgggccaca

SEQ ID NO: 215617 - DNA, 22 bp, Artificial Sequence
  Synthetic oligonucleotide; CTC chr2 60522654 60522675 60522659 60522654 -
agggcctgtggggcagtcgatg

SEQ ID NO: 215618 - DNA, 22 bp, Artificial Sequence
  Synthetic oligonucleotide; CTG chr2 60522646 60522667 60522651 60522646 -
tggggcagtcgatgtgggagga

SEQ ID NO: 215619 - DNA, 22 bp, Artificial Sequence
  Synthetic oligonucleotide; CTG chr2 60522621 60522642 60522626 60522621 -
tcacagagactctcagagggtg

SEQ ID NO: 215620 - DNA, 22 bp, Artificial Sequence
  Synthetic oligonucleotide; CTC chr2 60522609 60522630 60522614 60522609 -
tcagagggtgcattcagccctg

SEQ ID NO: 215621 - DNA, 22 bp, Artificial Sequence
  Synthetic oligonucleotide; CTC chr2 60522607 60522628 60522612 60522607 -
agagggtgcattcagccctgaa

SEQ ID NO: 215622 - DNA, 22 bp, Artificial Sequence
  Synthetic oligonucleotide; TTC chr2 60522594 60522615 60522599 60522594 -
agccctgaacagggcaaaggac

SEQ ID NO: 215623 - DNA, 22 bp, Artificial Sequence
  Synthetic oligonucleotide; CTG chr2 60522587 60522608 60522592 60522587 -
aacagggcaaaggactgcaagg

SEQ ID NO: 215624 - DNA, 22 bp, Artificial Sequence
  Synthetic oligonucleotide; CTG chr2 60522570 60522591 60522575 60522570 -
caaggggcaggagcttgggctg

SEQ ID NO: 215625 - DNA, 22 bp, Artificial Sequence
  Synthetic oligonucleotide; CTT chr2 60522554 60522575 60522559 60522554 -
gggctgacatgcaaggtggctt

SEQ ID NO: 215626 - DNA, 22 bp, Artificial Sequence
  Synthetic oligonucleotide; TTG chr2 60522553 60522574 60522558 60522553 -
ggctgacatgcaaggtggcttt

SEQ ID NO: 215627 - DNA, 22 bp, Artificial Sequence
  Synthetic oligonucleotide; CTG chr2 60522548 60522569 60522553 60522548 -
acatgcaaggtggctttacaca

SEQ ID NO: 215628 - DNA, 22 bp, Artificial Sequence
  Synthetic oligonucleotide; CTT chr2 60522532 60522553 60522537 60522532 -
tacacaaggccctttttagaga

SEQ ID NO: 215629 - DNA, 22 bp, Artificial Sequence
  Synthetic oligonucleotide; TTT chr2 60522531 60522552 60522536 60522531 -
acacaaggccctttttagagag

SEQ ID NO: 215630 - DNA, 22 bp, Artificial Sequence
  Synthetic oligonucleotide; TTA chr2 60522530 60522551 60522535 60522530 -
cacaaggccctttttagagagt

SEQ ID NO: 215631 - DNA, 22 bp, Artificial Sequence
  Synthetic oligonucleotide; CTT chr2 60522518 60522539 60522523 60522518 -
tttagagagtgtgattctctga

SEQ ID NO: 215632 - DNA, 22 bp, Artificial Sequence
  Synthetic oligonucleotide; TTT chr2 60522517 60522538 60522522 60522517 -
ttagagagtgtgattctctgaa

SEQ ID NO: 215633 - DNA, 22 bp, Artificial Sequence
  Synthetic oligonucleotide; TTT chr2 60522516 60522537 60522521 60522516 -
tagagagtgtgattctctgaag

SEQ ID NO: 215634 - DNA, 22 bp, Artificial Sequence
  Synthetic oligonucleotide; TTT chr2 60522515 60522536 60522520 60522515 -
agagagtgtgattctctgaagc

SEQ ID NO: 215635 - DNA, 22 bp, Artificial Sequence
  Synthetic oligonucleotide; TTA chr2 60522514 60522535 60522519 60522514 -
gagagtgtgattctctgaagct

SEQ ID NO: 215636 - DNA, 22 bp, Artificial Sequence
  Synthetic oligonucleotide; TTC chr2 60522501 60522522 60522506 60522501 -
tctgaagcttttcttggcagct

SEQ ID NO: 215637 - DNA, 22 bp, Artificial Sequence
  Synthetic oligonucleotide; CTC chr2 60522499 60522520 60522504 60522499 -
tgaagcttttcttggcagcttc

SEQ ID NO: 215638 - DNA, 22 bp, Artificial Sequence
  Synthetic oligonucleotide; CTG chr2 60522497 60522518 60522502 60522497 -
aagcttttcttggcagcttcag

SEQ ID NO: 215639 - DNA, 22 bp, Artificial Sequence
  Synthetic oligonucleotide; CTT chr2 60522491 60522512 60522496 60522491 -
ttcttggcagcttcagtcttga

SEQ ID NO: 215640 - DNA, 22 bp, Artificial Sequence
  Synthetic oligonucleotide; TTT chr2 60522490 60522511 60522495 60522490 -
tcttggcagcttcagtcttgaa

SEQ ID NO: 215641 - DNA, 22 bp, Artificial Sequence
  Synthetic oligonucleotide; TTT chr2 60522489 60522510 60522494 60522489 -
cttggcagcttcagtcttgaac

SEQ ID NO: 215642 - DNA, 22 bp, Artificial Sequence
  Synthetic oligonucleotide; TTC chr2 60522488 60522509 60522493 60522488 -
ttggcagcttcagtcttgaacc

SEQ ID NO: 215643 - DNA, 22 bp, Artificial Sequence
  Synthetic oligonucleotide; CTT chr2 60522486 60522507 60522491 60522486 -
ggcagcttcagtcttgaacctc

SEQ ID NO: 215644 - DNA, 22 bp, Artificial Sequence
  Synthetic oligonucleotide; TTG chr2 60522485 60522506 60522490 60522485 -
gcagcttcagtcttgaacctca

SEQ ID NO: 215645 - DNA, 22 bp, Artificial Sequence
  Synthetic oligonucleotide; CTT chr2 60522478 60522499 60522483 60522478 -
cagtcttgaacctcactggaag

SEQ ID NO: 215646 - DNA, 22 bp, Artificial Sequence
  Synthetic oligonucleotide; TTC chr2 60522477 60522498 60522482 60522477 -
agtcttgaacctcactggaagg

SEQ ID NO: 215647 - DNA, 22 bp, Artificial Sequence
  Synthetic oligonucleotide; CTT chr2 60522471 60522492 60522476 60522471 -
gaacctcactggaagggatcct

SEQ ID NO: 215648 - DNA, 22 bp, Artificial Sequence
  Synthetic oligonucleotide; TTG chr2 60522470 60522491 60522475 60522470 -
aacctcactggaagggatcctc

SEQ ID NO: 215649 - DNA, 22 bp, Artificial Sequence
  Synthetic oligonucleotide; CTC chr2 60522464 60522485 60522469 60522464 -
actggaagggatcctccaaaac

SEQ ID NO: 215650 - DNA, 22 bp, Artificial Sequence
  Synthetic oligonucleotide; CTG chr2 60522460 60522481 60522465 60522460 -
gaagggatcctccaaaacatga

SEQ ID NO: 215651 - DNA, 22 bp, Artificial Sequence
  Synthetic oligonucleotide; CTC chr2 60522448 60522469 60522453 60522448 -
caaaacatgacccagatggaaa

SEQ ID NO: 215652 - DNA, 22 bp, Artificial Sequence
  Synthetic oligonucleotide; TTT chr2 60522417 60522438 60522422 60522417 -
ctgagtttaaaataactcccct

SEQ ID NO: 215653 - DNA, 22 bp, Artificial Sequence
  Synthetic oligonucleotide; TTC chr2 60522416 60522437 60522421 60522416 -
tgagtttaaaataactccccta

SEQ ID NO: 215654 - DNA, 22 bp, Artificial Sequence
  Synthetic oligonucleotide; CTG chr2 60522414 60522435 60522419 60522414 -
agtttaaaataactcccctatt

SEQ ID NO: 215655 - DNA, 22 bp, Artificial Sequence
  Synthetic oligonucleotide; TTT chr2 60522409 60522430 60522414 60522409 -
aaaataactcccctatttggta

SEQ ID NO: 215656 - DNA, 22 bp, Artificial Sequence
  Synthetic oligonucleotide; TTA chr2 60522408 60522429 60522413 60522408 -
aaataactcccctatttggtaa

SEQ ID NO: 215657 - DNA, 22 bp, Artificial Sequence
  Synthetic oligonucleotide; CTC chr2 60522399 60522420 60522404 60522399 -
ccctatttggtaatacgggact

SEQ ID NO: 215658 - DNA, 22 bp, Artificial Sequence
  Synthetic oligonucleotide; CTA chr2 60522394 60522415 60522399 60522394 -
tttggtaatacgggactttatt

SEQ ID NO: 215659 - DNA, 22 bp, Artificial Sequence
  Synthetic oligonucleotide; TTT chr2 60522391 60522412 60522396 60522391 -
ggtaatacgggactttatttgt

SEQ ID NO: 215660 - DNA, 22 bp, Artificial Sequence
  Synthetic oligonucleotide; TTG chr2 60522390 60522411 60522395 60522390 -
gtaatacgggactttatttgtg

SEQ ID NO: 215661 - DNA, 22 bp, Artificial Sequence
  Synthetic oligonucleotide; CTT chr2 60522376 60522397 60522381 60522376 -
tatttgtgactttattattttt

SEQ ID NO: 215662 - DNA, 22 bp, Artificial Sequence
  Synthetic oligonucleotide; TTT chr2 60522375 60522396 60522380 60522375 -
atttgtgactttattattttta

SEQ ID NO: 215663 - DNA, 22 bp, Artificial Sequence
  Synthetic oligonucleotide; TTA chr2 60522374 60522395 60522379 60522374 -
tttgtgactttattatttttag

SEQ ID NO: 215664 - DNA, 22 bp, Artificial Sequence
  Synthetic oligonucleotide; TTT chr2 60522371 60522392 60522376 60522371 -
gtgactttattatttttaggtg

SEQ ID NO: 215665 - DNA, 22 bp, Artificial Sequence
  Synthetic oligonucleotide; TTG chr2 60522370 60522391 60522375 60522370 -
tgactttattatttttaggtgt

SEQ ID NO: 215666 - DNA, 22 bp, Artificial Sequence
  Synthetic oligonucleotide; CTT chr2 60522364 60522385 60522369 60522364 -
tattatttttaggtgtgataat

SEQ ID NO: 215667 - DNA, 22 bp, Artificial Sequence
  Synthetic oligonucleotide; TTT chr2 60522363 60522384 60522368 60522363 -
attatttttaggtgtgataatg

SEQ ID NO: 215668 - DNA, 22 bp, Artificial Sequence
  Synthetic oligonucleotide; TTA chr2 60522362 60522383 60522367 60522362 -
ttatttttaggtgtgataatgg

SEQ ID NO: 215669 - DNA, 22 bp, Artificial Sequence
  Synthetic oligonucleotide; TTA chr2 60522359 60522380 60522364 60522359 -
tttttaggtgtgataatggttt

SEQ ID NO: 215670 - DNA, 22 bp, Artificial Sequence
  Synthetic oligonucleotide; TTT chr2 60522356 60522377 60522361 60522356 -
ttaggtgtgataatggttttgc

SEQ ID NO: 215671 - DNA, 22 bp, Artificial Sequence
  Synthetic oligonucleotide; TTT chr2 60522355 60522376 60522360 60522355 -
taggtgtgataatggttttgca

SEQ ID NO: 215672 - DNA, 22 bp, Artificial Sequence
  Synthetic oligonucleotide; TTT chr2 60522354 60522375 60522359 60522354 -
aggtgtgataatggttttgcag

SEQ ID NO: 215673 - DNA, 22 bp, Artificial Sequence
  Synthetic oligonucleotide; TTA chr2 60522353 60522374 60522358 60522353 -
ggtgtgataatggttttgcagt

SEQ ID NO: 215674 - DNA, 22 bp, Artificial Sequence
  Synthetic oligonucleotide; TTT chr2 60522337 60522358 60522342 60522337 -
tgcagttgtatttaaaagaaaa

SEQ ID NO: 215675 - DNA, 22 bp, Artificial Sequence
  Synthetic oligonucleotide; TTT chr2 60522336 60522357 60522341 60522336 -
gcagttgtatttaaaagaaaaa

SEQ ID NO: 215676 - DNA, 22 bp, Artificial Sequence
  Synthetic oligonucleotide; TTG chr2 60522335 60522356 60522340 60522335 -
cagttgtatttaaaagaaaaaa

SEQ ID NO: 215677 - DNA, 22 bp, Artificial Sequence
  Synthetic oligonucleotide; TTG chr2 60522329 60522350 60522334 60522329 -
tatttaaaagaaaaaaaacgag

SEQ ID NO: 215678 - DNA, 22 bp, Artificial Sequence
  Synthetic oligonucleotide; TTT chr2 60522324 60522345 60522329 60522324 -
aaaagaaaaaaaacgagttcct

SEQ ID NO: 215679 - DNA, 22 bp, Artificial Sequence
  Synthetic oligonucleotide; TTA chr2 60522323 60522344 60522328 60522323 -
aaagaaaaaaaacgagttccta

SEQ ID NO: 215680 - DNA, 22 bp, Artificial Sequence
  Synthetic oligonucleotide; TTC chr2 60522304 60522325 60522309 60522304 -
ctatgtttaaaaaatacataca

SEQ ID NO: 215681 - DNA, 22 bp, Artificial Sequence
  Synthetic oligonucleotide; CTA chr2 60522301 60522322 60522306 60522301 -
tgtttaaaaaatacatacagag

SEQ ID NO: 215682 - DNA, 22 bp, Artificial Sequence
  Synthetic oligonucleotide; TTT chr2 60522296 60522317 60522301 60522296 -
aaaaaatacatacagaggtgtt

SEQ ID NO: 215683 - DNA, 22 bp, Artificial Sequence
  Synthetic oligonucleotide; TTA chr2 60522295 60522316 60522300 60522295 -
aaaaatacatacagaggtgttt

SEQ ID NO: 215684 - DNA, 22 bp, Artificial Sequence
  Synthetic oligonucleotide; TTT chr2 60522273 60522294 60522278 60522273 -
actgatgaaatgatatgacgtc

SEQ ID NO: 215685 - DNA, 22 bp, Artificial Sequence
  Synthetic oligonucleotide; TTA chr2 60522272 60522293 60522277 60522272 -
ctgatgaaatgatatgacgtct

SEQ ID NO: 215686 - DNA, 22 bp, Artificial Sequence
  Synthetic oligonucleotide; CTG chr2 60522269 60522290 60522274 60522269 -
atgaaatgatatgacgtctggg

SEQ ID NO: 215687 - DNA, 22 bp, Artificial Sequence
  Synthetic oligonucleotide; CTG chr2 60522249 60522270 60522254 60522249 -
ggatcaacttaaataataaaat

SEQ ID NO: 215688 - DNA, 22 bp, Artificial Sequence
  Synthetic oligonucleotide; CTT chr2 60522239 60522260 60522244 60522239 -
aaataataaaatgggctaggga

SEQ ID NO: 215689 - DNA, 22 bp, Artificial Sequence
  Synthetic oligonucleotide; TTA chr2 60522238 60522259 60522243 60522238 -
aataataaaatgggctagggag

SEQ ID NO: 215690 - DNA, 22 bp, Artificial Sequence
  Synthetic oligonucleotide; CTA chr2 60522221 60522242 60522226 60522221 -
gggaggcgatagggttacagaa

SEQ ID NO: 215691 - DNA, 22 bp, Artificial Sequence
  Synthetic oligonucleotide; TTA chr2 60522204 60522225 60522209 60522204 -
cagaagacaagaatgactgtga

SEQ ID NO: 215692 - DNA, 22 bp, Artificial Sequence
  Synthetic oligonucleotide; CTG chr2 60522185 60522206 60522190 60522185 -
tgagctgtggtggttggagctg

SEQ ID NO: 215693 - DNA, 22 bp, Artificial Sequence
  Synthetic oligonucleotide; CTG chr2 60522178 60522199 60522183 60522178 -
tggtggttggagctggaagatg

SEQ ID NO: 215694 - DNA, 22 bp, Artificial Sequence
  Synthetic oligonucleotide; TTG chr2 60522169 60522190 60522174 60522169 -
gagctggaagatgtggacttgg

SEQ ID NO: 215695 - DNA, 22 bp, Artificial Sequence
  Synthetic oligonucleotide; CTG chr2 60522163 60522184 60522168 60522163 -
gaagatgtggacttggggactg

SEQ ID NO: 215696 - DNA, 22 bp, Artificial Sequence
  Synthetic oligonucleotide; CTT chr2 60522149 60522170 60522154 60522149 -
ggggactgatttataacattct

SEQ ID NO: 215697 - DNA, 22 bp, Artificial Sequence
  Synthetic oligonucleotide; TTG chr2 60522148 60522169 60522153 60522148 -
gggactgatttataacattctc

SEQ ID NO: 215698 - DNA, 22 bp, Artificial Sequence
  Synthetic oligonucleotide; CTG chr2 60522141 60522162 60522146 60522141 -
atttataacattctctctactt

SEQ ID NO: 215699 - DNA, 22 bp, Artificial Sequence
  Synthetic oligonucleotide; TTT chr2 60522137 60522158 60522142 60522137 -
ataacattctctctacttttgt

SEQ ID NO: 215700 - DNA, 22 bp, Artificial Sequence
  Synthetic oligonucleotide; TTA chr2 60522136 60522157 60522141 60522136 -
taacattctctctacttttgta

SEQ ID NO: 215701 - DNA, 22 bp, Artificial Sequence
  Synthetic oligonucleotide; TTC chr2 60522128 60522149 60522133 60522128 -
tctctacttttgtagtatttga

SEQ ID NO: 215702 - DNA, 22 bp, Artificial Sequence
  Synthetic oligonucleotide; CTC chr2 60522126 60522147 60522131 60522126 -
tctacttttgtagtatttgaga

SEQ ID NO: 215703 - DNA, 22 bp, Artificial Sequence
  Synthetic oligonucleotide; CTC chr2 60522124 60522145 60522129 60522124 -
tacttttgtagtatttgagatt

SEQ ID NO: 215704 - DNA, 22 bp, Artificial Sequence
  Synthetic oligonucleotide; CTA chr2 60522122 60522143 60522127 60522122 -
cttttgtagtatttgagatttt

SEQ ID NO: 215705 - DNA, 22 bp, Artificial Sequence
  Synthetic oligonucleotide; CTT chr2 60522119 60522140 60522124 60522119 -
ttgtagtatttgagatttttcc

SEQ ID NO: 215706 - DNA, 22 bp, Artificial Sequence
  Synthetic oligonucleotide; TTT chr2 60522118 60522139 60522123 60522118 -
tgtagtatttgagatttttcca

SEQ ID NO: 215707 - DNA, 22 bp, Artificial Sequence
  Synthetic oligonucleotide; TTT chr2 60522117 60522138 60522122 60522117 -
gtagtatttgagatttttccag

SEQ ID NO: 215708 - DNA, 22 bp, Artificial Sequence
  Synthetic oligonucleotide; TTG chr2 60522116 60522137 60522121 60522116 -
tagtatttgagatttttccaga

SEQ ID NO: 215709 - DNA, 22 bp, Artificial Sequence
  Synthetic oligonucleotide; TTT chr2 60522108 60522129 60522113 60522108 -
gagatttttccagaaaataaag

SEQ ID NO: 215710 - DNA, 22 bp, Artificial Sequence
  Synthetic oligonucleotide; TTG chr2 60522107 60522128 60522112 60522107 -
agatttttccagaaaataaagg

SEQ ID NO: 215711 - DNA, 22 bp, Artificial Sequence
  Synthetic oligonucleotide; TTT chr2 60522101 60522122 60522106 60522101 -
ttccagaaaataaaggtattgc

SEQ ID NO: 215712 - DNA, 22 bp, Artificial Sequence
  Synthetic oligonucleotide; TTT chr2 60522100 60522121 60522105 60522100 -
tccagaaaataaaggtattgcc

SEQ ID NO: 215713 - DNA, 22 bp, Artificial Sequence
  Synthetic oligonucleotide; TTT chr2 60522099 60522120 60522104 60522099 -
ccagaaaataaaggtattgcct

SEQ ID NO: 215714 - DNA, 22 bp, Artificial Sequence
  Synthetic oligonucleotide; TTC chr2 60522098 60522119 60522103 60522098 -
cagaaaataaaggtattgcctg

SEQ ID NO: 215715 - DNA, 22 bp, Artificial Sequence
  Synthetic oligonucleotide; TTG chr2 60522080 60522101 60522085 60522080 -
cctgactggtggagagcagtat

SEQ ID NO: 215716 - DNA, 22 bp, Artificial Sequence
  Synthetic oligonucleotide; CTG chr2 60522076 60522097 60522081 60522076 -
actggtggagagcagtatggcc

SEQ ID NO: 215717 - DNA, 22 bp, Artificial Sequence
  Synthetic oligonucleotide; CTG chr2 60522072 60522093 60522077 60522072 -
gtggagagcagtatggccttgt

SEQ ID NO: 215718 - DNA, 22 bp, Artificial Sequence
  Synthetic oligonucleotide; CTT chr2 60522052 60522073 60522057 60522052 -
gtttagtcggtgttgtttcttc

SEQ ID NO: 215719 - DNA, 22 bp, Artificial Sequence
  Synthetic oligonucleotide; TTG chr2 60522051 60522072 60522056 60522051 -
tttagtcggtgttgtttcttca

SEQ ID NO: 215720 - DNA, 22 bp, Artificial Sequence
  Synthetic oligonucleotide; TTT chr2 60522048 60522069 60522053 60522048 -
agtcggtgttgtttcttcacca

SEQ ID NO: 215721 - DNA, 22 bp, Artificial Sequence
  Synthetic oligonucleotide; TTA chr2 60522047 60522068 60522052 60522047 -
gtcggtgttgtttcttcaccaa

SEQ ID NO: 215722 - DNA, 22 bp, Artificial Sequence
  Synthetic oligonucleotide; TTG chr2 60522037 60522058 60522042 60522037 -
tttcttcaccaagggtttggct

SEQ ID NO: 215723 - DNA, 22 bp, Artificial Sequence
  Synthetic oligonucleotide; TTT chr2 60522034 60522055 60522039 60522034 -
cttcaccaagggtttggctcag

SEQ ID NO: 215724 - DNA, 22 bp, Artificial Sequence
  Synthetic oligonucleotide; TTC chr2 60522033 60522054 60522038 60522033 -
ttcaccaagggtttggctcaga

SEQ ID NO: 215725 - DNA, 22 bp, Artificial Sequence
  Synthetic oligonucleotide; CTT chr2 60522031 60522052 60522036 60522031 -
caccaagggtttggctcagagg

SEQ ID NO: 215726 - DNA, 22 bp, Artificial Sequence
  Synthetic oligonucleotide; TTC chr2 60522030 60522051 60522035 60522030 -
accaagggtttggctcagaggt

SEQ ID NO: 215727 - DNA, 22 bp, Artificial Sequence
  Synthetic oligonucleotide; TTT chr2 60522019 60522040 60522024 60522019 -
ggctcagaggtagcaaggggac

SEQ ID NO: 215728 - DNA, 22 bp, Artificial Sequence
  Synthetic oligonucleotide; TTG chr2 60522018 60522039 60522023 60522018 -
gctcagaggtagcaaggggaca

SEQ ID NO: 215729 - DNA, 22 bp, Artificial Sequence
  Synthetic oligonucleotide; CTC chr2 60522014 60522035 60522019 60522014 -
agaggtagcaaggggacaagtg

SEQ ID NO: 215730 - DNA, 22 bp, Artificial Sequence
  Synthetic oligonucleotide; CTA chr2 60521987 60522008 60521992 60521987 -
tgggcaagaaagtacctgtgag

SEQ ID NO: 215731 - DNA, 22 bp, Artificial Sequence
  Synthetic oligonucleotide; CTG chr2 60521969 60521990 60521974 60521969 -
tgagctcaagtcttgtatctgg

SEQ ID NO: 215732 - DNA, 22 bp, Artificial Sequence
  Synthetic oligonucleotide; CTC chr2 60521962 60521983 60521967 60521962 -
aagtcttgtatctgggaagttc

SEQ ID NO: 215733 - DNA, 22 bp, Artificial Sequence
  Synthetic oligonucleotide; CTT chr2 60521955 60521976 60521960 60521955 -
gtatctgggaagttcattgtga

SEQ ID NO: 215734 - DNA, 22 bp, Artificial Sequence
  Synthetic oligonucleotide; TTG chr2 60521954 60521975 60521959 60521954 -
tatctgggaagttcattgtgaa

SEQ ID NO: 215735 - DNA, 22 bp, Artificial Sequence
  Synthetic oligonucleotide; CTG chr2 60521948 60521969 60521953 60521948 -
ggaagttcattgtgaaggggtc

SEQ ID NO: 215736 - DNA, 22 bp, Artificial Sequence
  Synthetic oligonucleotide; TTC chr2 60521940 60521961 60521945 60521940 -
attgtgaaggggtcatttaagg

SEQ ID NO: 215737 - DNA, 22 bp, Artificial Sequence
  Synthetic oligonucleotide; TTG chr2 60521936 60521957 60521941 60521936 -
tgaaggggtcatttaagggtct

SEQ ID NO: 215738 - DNA, 22 bp, Artificial Sequence
  Synthetic oligonucleotide; TTT chr2 60521922 60521943 60521927 60521922 -
aagggtctgtactgtgcactgt

SEQ ID NO: 215739 - DNA, 22 bp, Artificial Sequence
  Synthetic oligonucleotide; TTA chr2 60521921 60521942 60521926 60521921 -
agggtctgtactgtgcactgtc

SEQ ID NO: 215740 - DNA, 22 bp, Artificial Sequence
  Synthetic oligonucleotide; CTG chr2 60521913 60521934 60521918 60521913 -
tactgtgcactgtcccccattc

SEQ ID NO: 215741 - DNA, 22 bp, Artificial Sequence
  Synthetic oligonucleotide; CTG chr2 60521908 60521929 60521913 60521908 -
tgcactgtcccccattctcctg

SEQ ID NO: 215742 - DNA, 22 bp, Artificial Sequence
  Synthetic oligonucleotide; CTG chr2 60521901 60521922 60521906 60521901 -
tcccccattctcctggaagaac

SEQ ID NO: 215743 - DNA, 22 bp, Artificial Sequence
  Synthetic oligonucleotide; TTC chr2 60521891 60521912 60521896 60521891 -
tcctggaagaacagagatccct

SEQ ID NO: 215744 - DNA, 22 bp, Artificial Sequence
  Synthetic oligonucleotide; CTC chr2 60521889 60521910 60521894 60521889 -
ctggaagaacagagatcccttg

SEQ ID NO: 215745 - DNA, 22 bp, Artificial Sequence
  Synthetic oligonucleotide; CTG chr2 60521886 60521907 60521891 60521886 -
gaagaacagagatcccttgtct

SEQ ID NO: 215746 - DNA, 22 bp, Artificial Sequence
  Synthetic oligonucleotide; CTT chr2 60521868 60521889 60521873 60521868 -
gtctttttcagtgcatgaggca

SEQ ID NO: 215747 - DNA, 22 bp, Artificial Sequence
  Synthetic oligonucleotide; TTG chr2 60521867 60521888 60521872 60521867 -
tctttttcagtgcatgaggcag

SEQ ID NO: 215748 - DNA, 22 bp, Artificial Sequence
  Synthetic oligonucleotide; CTT chr2 60521863 60521884 60521868 60521863 -
tttcagtgcatgaggcagagtc

SEQ ID NO: 215749 - DNA, 22 bp, Artificial Sequence
  Synthetic oligonucleotide; TTT chr2 60521862 60521883 60521867 60521862 -
ttcagtgcatgaggcagagtca

SEQ ID NO: 215750 - DNA, 22 bp, Artificial Sequence
  Synthetic oligonucleotide; TTT chr2 60521861 60521882 60521866 60521861 -
tcagtgcatgaggcagagtcag

SEQ ID NO: 215751 - DNA, 22 bp, Artificial Sequence
  Synthetic oligonucleotide; TTT chr2 60521860 60521881 60521865 60521860 -
cagtgcatgaggcagagtcaga

SEQ ID NO: 215752 - DNA, 22 bp, Artificial Sequence
  Synthetic oligonucleotide; TTC chr2 60521859 60521880 60521864 60521859 -
agtgcatgaggcagagtcagat

SEQ ID NO: 215753 - DNA, 22 bp, Artificial Sequence
  Synthetic oligonucleotide; TTT chr2 60521828 60521849 60521833 60521828 -
gcttgagtttcagcacaggtgc

SEQ ID NO: 215754 - DNA, 22 bp, Artificial Sequence
  Synthetic oligonucleotide; TTG chr2 60521827 60521848 60521832 60521827 -
cttgagtttcagcacaggtgcc

SEQ ID NO: 215755 - DNA, 22 bp, Artificial Sequence
  Synthetic oligonucleotide; CTT chr2 60521824 60521845 60521829 60521824 -
gagtttcagcacaggtgcctct

SEQ ID NO: 215756 - DNA, 22 bp, Artificial Sequence
  Synthetic oligonucleotide; TTG chr2 60521823 60521844 60521828 60521823 -
agtttcagcacaggtgcctctg

SEQ ID NO: 215757 - DNA, 22 bp, Artificial Sequence
  Synthetic oligonucleotide; TTT chr2 60521818 60521839 60521823 60521818 -
cagcacaggtgcctctgtgcct

SEQ ID NO: 215758 - DNA, 22 bp, Artificial Sequence
  Synthetic oligonucleotide; TTC chr2 60521817 60521838 60521822 60521817 -
agcacaggtgcctctgtgcctc

SEQ ID NO: 215759 - DNA, 22 bp, Artificial Sequence
  Synthetic oligonucleotide; CTC chr2 60521803 60521824 60521808 60521803 -
tgtgcctcgtggtgagggtcag

SEQ ID NO: 215760 - DNA, 22 bp, Artificial Sequence
  Synthetic oligonucleotide; CTG chr2 60521801 60521822 60521806 60521801 -
tgcctcgtggtgagggtcagga

SEQ ID NO: 215761 - DNA, 22 bp, Artificial Sequence
  Synthetic oligonucleotide; CTC chr2 60521795 60521816 60521800 60521795 -
gtggtgagggtcaggaagaagc

SEQ ID NO: 215762 - DNA, 22 bp, Artificial Sequence
  Synthetic oligonucleotide; CTG chr2 60521768 60521789 60521773 60521768 -
ggacgtgctcacgtggctggta

SEQ ID NO: 215763 - DNA, 22 bp, Artificial Sequence
  Synthetic oligonucleotide; CTC chr2 60521758 60521779 60521763 60521758 -
acgtggctggtagtgttatgaa

SEQ ID NO: 215764 - DNA, 22 bp, Artificial Sequence
  Synthetic oligonucleotide; CTG chr2 60521749 60521770 60521754 60521749 -
gtagtgttatgaagacaaggct

SEQ ID NO: 215765 - DNA, 22 bp, Artificial Sequence
  Synthetic oligonucleotide; TTA chr2 60521740 60521761 60521745 60521740 -
tgaagacaaggctttgggacct

SEQ ID NO: 215766 - DNA, 22 bp, Artificial Sequence
  Synthetic oligonucleotide; CTT chr2 60521726 60521747 60521731 60521726 -
tgggacctttctttggccattt

SEQ ID NO: 215767 - DNA, 22 bp, Artificial Sequence
  Synthetic oligonucleotide; TTT chr2 60521725 60521746 60521730 60521725 -
gggacctttctttggccatttg

SEQ ID NO: 215768 - DNA, 22 bp, Artificial Sequence
  Synthetic oligonucleotide; TTG chr2 60521724 60521745 60521729 60521724 -
ggacctttctttggccatttga

SEQ ID NO: 215769 - DNA, 22 bp, Artificial Sequence
  Synthetic oligonucleotide; CTT chr2 60521717 60521738 60521722 60521717 -
tctttggccatttgagccctgg

SEQ ID NO: 215770 - DNA, 22 bp, Artificial Sequence
  Synthetic oligonucleotide; TTT chr2 60521716 60521737 60521721 60521716 -
ctttggccatttgagccctggc

SEQ ID NO: 215771 - DNA, 22 bp, Artificial Sequence
  Synthetic oligonucleotide; TTC chr2 60521715 60521736 60521720 60521715 -
tttggccatttgagccctggct

SEQ ID NO: 215772 - DNA, 22 bp, Artificial Sequence
  Synthetic oligonucleotide; CTT chr2 60521713 60521734 60521718 60521713 -
tggccatttgagccctggctat

SEQ ID NO: 215773 - DNA, 22 bp, Artificial Sequence
  Synthetic oligonucleotide; TTT chr2 60521712 60521733 60521717 60521712 -
ggccatttgagccctggctatt

SEQ ID NO: 215774 - DNA, 22 bp, Artificial Sequence
  Synthetic oligonucleotide; TTG chr2 60521711 60521732 60521716 60521711 -
gccatttgagccctggctatta

SEQ ID NO: 215775 - DNA, 22 bp, Artificial Sequence
  Synthetic oligonucleotide; TTT chr2 60521704 60521725 60521709 60521704 -
gagccctggctattagagaaag

SEQ ID NO: 215776 - DNA, 22 bp, Artificial Sequence
  Synthetic oligonucleotide; TTG chr2 60521703 60521724 60521708 60521703 -
agccctggctattagagaaaga

SEQ ID NO: 215777 - DNA, 22 bp, Artificial Sequence
  Synthetic oligonucleotide; CTG chr2 60521696 60521717 60521701 60521696 -
gctattagagaaagatgatttg

SEQ ID NO: 215778 - DNA, 22 bp, Artificial Sequence
  Synthetic oligonucleotide; CTA chr2 60521692 60521713 60521697 60521692 -
ttagagaaagatgatttgcctg

SEQ ID NO: 215779 - DNA, 22 bp, Artificial Sequence
  Synthetic oligonucleotide; TTA chr2 60521689 60521710 60521694 60521689 -
gagaaagatgatttgcctgaga

SEQ ID NO: 215780 - DNA, 22 bp, Artificial Sequence
  Synthetic oligonucleotide; TTT chr2 60521675 60521696 60521680 60521675 -
gcctgagaggagattgaccaca

SEQ ID NO: 215781 - DNA, 22 bp, Artificial Sequence
  Synthetic oligonucleotide; TTG chr2 60521674 60521695 60521679 60521674 -
cctgagaggagattgaccacac

SEQ ID NO: 215782 - DNA, 22 bp, Artificial Sequence
  Synthetic oligonucleotide; CTG chr2 60521670 60521691 60521675 60521670 -
agaggagattgaccacactctc

SEQ ID NO: 215783 - DNA, 22 bp, Artificial Sequence
  Synthetic oligonucleotide; TTG chr2 60521659 60521680 60521664 60521659 -
accacactctcagaaagaaggg

SEQ ID NO: 215784 - DNA, 22 bp, Artificial Sequence
  Synthetic oligonucleotide; CTC chr2 60521650 60521671 60521655 60521650 -
tcagaaagaaggggacaaagaa

SEQ ID NO: 215785 - DNA, 22 bp, Artificial Sequence
  Synthetic oligonucleotide; CTC chr2 60521648 60521669 60521653 60521648 -
agaaagaaggggacaaagaaca

SEQ ID NO: 215786 - DNA, 22 bp, Artificial Sequence
  Synthetic oligonucleotide; TTA chr2 60521614 60521635 60521619 60521614 -
agcagccttccctttaagggag

SEQ ID NO: 215787 - DNA, 22 bp, Artificial Sequence
  Synthetic oligonucleotide; CTT chr2 60521605 60521626 60521610 60521605 -
ccctttaagggaggactggggc

SEQ ID NO: 215788 - DNA, 22 bp, Artificial Sequence
  Synthetic oligonucleotide; TTC chr2 60521604 60521625 60521609 60521604 -
cctttaagggaggactggggca

SEQ ID NO: 215789 - DNA, 22 bp, Artificial Sequence
  Synthetic oligonucleotide; CTT chr2 60521600 60521621 60521605 60521600 -
taagggaggactggggcacaag

SEQ ID NO: 215790 - DNA, 22 bp, Artificial Sequence
  Synthetic oligonucleotide; TTT chr2 60521599 60521620 60521604 60521599 -
aagggaggactggggcacaaga

SEQ ID NO: 215791 - DNA, 22 bp, Artificial Sequence
  Synthetic oligonucleotide; TTA chr2 60521598 60521619 60521603 60521598 -
agggaggactggggcacaagat

SEQ ID NO: 215792 - DNA, 22 bp, Artificial Sequence
  Synthetic oligonucleotide; CTG chr2 60521587 60521608 60521592 60521587 -
gggcacaagatggaagatgaaa

SEQ ID NO: 215793 - DNA, 22 bp, Artificial Sequence
  Synthetic oligonucleotide; TTG chr2 60521546 60521567 60521551 60521546 -
cagagctggaaaggggaatttt

SEQ ID NO: 215794 - DNA, 22 bp, Artificial Sequence
  Synthetic oligonucleotide; CTG chr2 60521538 60521559 60521543 60521538 -
gaaaggggaattttgttcttct

SEQ ID NO: 215795 - DNA, 22 bp, Artificial Sequence
  Synthetic oligonucleotide; TTT chr2 60521525 60521546 60521530 60521525 -
tgttcttctagatagcaaaagc

SEQ ID NO: 215796 - DNA, 22 bp, Artificial Sequence
  Synthetic oligonucleotide; TTT chr2 60521524 60521545 60521529 60521524 -
gttcttctagatagcaaaagcc

SEQ ID NO: 215797 - DNA, 22 bp, Artificial Sequence
  Synthetic oligonucleotide; TTG chr2 60521523 60521544 60521528 60521523 -
ttcttctagatagcaaaagcca

SEQ ID NO: 215798 - DNA, 22 bp, Artificial Sequence
  Synthetic oligonucleotide; TTC chr2 60521520 60521541 60521525 60521520 -
ttctagatagcaaaagccagga

SEQ ID NO: 215799 - DNA, 22 bp, Artificial Sequence
  Synthetic oligonucleotide; CTT chr2 60521518 60521539 60521523 60521518 -
ctagatagcaaaagccaggact

SEQ ID NO: 215800 - DNA, 22 bp, Artificial Sequence
  Synthetic oligonucleotide; TTC chr2 60521517 60521538 60521522 60521517 -
tagatagcaaaagccaggactg

SEQ ID NO: 215801 - DNA, 22 bp, Artificial Sequence
  Synthetic oligonucleotide; CTA chr2 60521515 60521536 60521520 60521515 -
gatagcaaaagccaggactgtc

SEQ ID NO: 215802 - DNA, 22 bp, Artificial Sequence
  Synthetic oligonucleotide; CTG chr2 60521495 60521516 60521500 60521495 -
tcgctgtgtgacttgaaagcta

SEQ ID NO: 215803 - DNA, 22 bp, Artificial Sequence
  Synthetic oligonucleotide; CTG chr2 60521489 60521510 60521494 60521489 -
tgtgacttgaaagctaggtcac

SEQ ID NO: 215804 - DNA, 22 bp, Artificial Sequence
  Synthetic oligonucleotide; CTT chr2 60521481 60521502 60521486 60521481 -
gaaagctaggtcactggtgggc

SEQ ID NO: 215805 - DNA, 22 bp, Artificial Sequence
  Synthetic oligonucleotide; TTG chr2 60521480 60521501 60521485 60521480 -
aaagctaggtcactggtgggct

SEQ ID NO: 215806 - DNA, 22 bp, Artificial Sequence
  Synthetic oligonucleotide; CTA chr2 60521473 60521494 60521478 60521473 -
ggtcactggtgggcttcgtgca

SEQ ID NO: 215807 - DNA, 22 bp, Artificial Sequence
  Synthetic oligonucleotide; CTG chr2 60521465 60521486 60521470 60521465 -
gtgggcttcgtgcagcccgtca

SEQ ID NO: 215808 - DNA, 22 bp, Artificial Sequence
  Synthetic oligonucleotide; CTT chr2 60521457 60521478 60521462 60521457 -
cgtgcagcccgtcacaggggag

SEQ ID NO: 215809 - DNA, 22 bp, Artificial Sequence
  Synthetic oligonucleotide; TTC chr2 60521456 60521477 60521461 60521456 -
gtgcagcccgtcacaggggagc

SEQ ID NO: 215810 - DNA, 22 bp, Artificial Sequence
  Synthetic oligonucleotide; CTC chr2 60521421 60521442 60521426 60521421 -
gtctctgccgtatctgctgcct

SEQ ID NO: 215811 - DNA, 22 bp, Artificial Sequence
  Synthetic oligonucleotide; CTC chr2 60521416 60521437 60521421 60521416 -
tgccgtatctgctgcctggaag

SEQ ID NO: 215812 - DNA, 22 bp, Artificial Sequence
  Synthetic oligonucleotide; CTG chr2 60521414 60521435 60521419 60521414 -
ccgtatctgctgcctggaagct

SEQ ID NO: 215813 - DNA, 22 bp, Artificial Sequence
  Synthetic oligonucleotide; CTG chr2 60521405 60521426 60521410 60521405 -
ctgcctggaagctgagactggc

SEQ ID NO: 215814 - DNA, 22 bp, Artificial Sequence
  Synthetic oligonucleotide; CTG chr2 60521402 60521423 60521407 60521402 -
cctggaagctgagactggccta

SEQ ID NO: 215815 - DNA, 22 bp, Artificial Sequence
  Synthetic oligonucleotide; CTG chr2 60521398 60521419 60521403 60521398 -
gaagctgagactggcctaacca

SEQ ID NO: 215816 - DNA, 22 bp, Artificial Sequence
  Synthetic oligonucleotide; CTG chr2 60521391 60521412 60521396 60521391 -
agactggcctaaccacatcaca

SEQ ID NO: 215817 - DNA, 22 bp, Artificial Sequence
  Synthetic oligonucleotide; CTG chr2 60521385 60521406 60521390 60521385 -
gcctaaccacatcacaccattc

SEQ ID NO: 215818 - DNA, 22 bp, Artificial Sequence
  Synthetic oligonucleotide; CTA chr2 60521380 60521401 60521385 60521380 -
accacatcacaccattcccaga

SEQ ID NO: 215819 - DNA, 22 bp, Artificial Sequence
  Synthetic oligonucleotide; TTC chr2 60521363 60521384 60521368 60521363 -
ccagacccaggcccaggcccag

SEQ ID NO: 215820 - DNA, 22 bp, Artificial Sequence
  Synthetic oligonucleotide; CTC chr2 60521328 60521349 60521333 60521328 -
tggttttacaaaatgtccgctc

SEQ ID NO: 215821 - DNA, 22 bp, Artificial Sequence
  Synthetic oligonucleotide; CTG chr2 60521326 60521347 60521331 60521326 -
gttttacaaaatgtccgctctc

SEQ ID NO: 215822 - DNA, 22 bp, Artificial Sequence
  Synthetic oligonucleotide; TTT chr2 60521322 60521343 60521327 60521322 -
tacaaaatgtccgctctctctc

SEQ ID NO: 215823 - DNA, 22 bp, Artificial Sequence
  Synthetic oligonucleotide; TTT chr2 60521321 60521342 60521326 60521321 -
acaaaatgtccgctctctctcg

SEQ ID NO: 215824 - DNA, 22 bp, Artificial Sequence
  Synthetic oligonucleotide; TTA chr2 60521320 60521341 60521325 60521320 -
caaaatgtccgctctctctcgc

SEQ ID NO: 215825 - DNA, 22 bp, Artificial Sequence
  Synthetic oligonucleotide; CTC chr2 60521306 60521327 60521311 60521306 -
tctctcgcttcacacagaggct

SEQ ID NO: 215826 - DNA, 22 bp, Artificial Sequence
  Synthetic oligonucleotide; CTC chr2 60521304 60521325 60521309 60521304 -
tctcgcttcacacagaggctat

SEQ ID NO: 215827 - DNA, 22 bp, Artificial Sequence
  Synthetic oligonucleotide; CTC chr2 60521302 60521323 60521307 60521302 -
tcgcttcacacagaggctatta

SEQ ID NO: 215828 - DNA, 22 bp, Artificial Sequence
  Synthetic oligonucleotide; CTC chr2 60521300 60521321 60521305 60521300 -
gcttcacacagaggctattatt

SEQ ID NO: 215829 - DNA, 22 bp, Artificial Sequence
  Synthetic oligonucleotide; CTT chr2 60521296 60521317 60521301 60521296 -
cacacagaggctattattagca

SEQ ID NO: 215830 - DNA, 22 bp, Artificial Sequence
  Synthetic oligonucleotide; TTC chr2 60521295 60521316 60521300 60521295 -
acacagaggctattattagcaa

SEQ ID NO: 215831 - DNA, 22 bp, Artificial Sequence
  Synthetic oligonucleotide; CTA chr2 60521283 60521304 60521288 60521283 -
ttattagcaagtgtcactcagt

SEQ ID NO: 215832 - DNA, 22 bp, Artificial Sequence
  Synthetic oligonucleotide; TTA chr2 60521280 60521301 60521285 60521280 -
ttagcaagtgtcactcagttat

SEQ ID NO: 215833 - DNA, 22 bp, Artificial Sequence
  Synthetic oligonucleotide; TTA chr2 60521277 60521298 60521282 60521277 -
gcaagtgtcactcagttatctg

SEQ ID NO: 215834 - DNA, 22 bp, Artificial Sequence
  Synthetic oligonucleotide; CTC chr2 60521264 60521285 60521269 60521264 -
agttatctgagagtggcgcttt

SEQ ID NO: 215835 - DNA, 22 bp, Artificial Sequence
  Synthetic oligonucleotide; TTA chr2 60521259 60521280 60521264 60521259 -
tctgagagtggcgcttttagct

SEQ ID NO: 215836 - DNA, 22 bp, Artificial Sequence
  Synthetic oligonucleotide; CTG chr2 60521255 60521276 60521260 60521255 -
agagtggcgcttttagctgcca

SEQ ID NO: 215837 - DNA, 22 bp, Artificial Sequence
  Synthetic oligonucleotide; CTT chr2 60521243 60521264 60521248 60521243 -
ttagctgccatctaagtgcctg

SEQ ID NO: 215838 - DNA, 22 bp, Artificial Sequence
  Synthetic oligonucleotide; TTT chr2 60521242 60521263 60521247 60521242 -
tagctgccatctaagtgcctga

SEQ ID NO: 215839 - DNA, 22 bp, Artificial Sequence
  Synthetic oligonucleotide; TTT chr2 60521241 60521262 60521246 60521241 -
agctgccatctaagtgcctgat

SEQ ID NO: 215840 - DNA, 22 bp, Artificial Sequence
  Synthetic oligonucleotide; TTA chr2 60521240 60521261 60521245 60521240 -
gctgccatctaagtgcctgata

SEQ ID NO: 215841 - DNA, 22 bp, Artificial Sequence
  Synthetic oligonucleotide; CTG chr2 60521236 60521257 60521241 60521236 -
ccatctaagtgcctgatacttg

SEQ ID NO: 215842 - DNA, 22 bp, Artificial Sequence
  Synthetic oligonucleotide; CTA chr2 60521229 60521250 60521234 60521229 -
agtgcctgatacttgggtttac

SEQ ID NO: 215843 - DNA, 22 bp, Artificial Sequence
  Synthetic oligonucleotide; CTG chr2 60521221 60521242 60521226 60521221 -
atacttgggtttacagcagatt

SEQ ID NO: 215844 - DNA, 22 bp, Artificial Sequence
  Synthetic oligonucleotide; CTT chr2 60521215 60521236 60521220 60521215 -
gggtttacagcagattaaatta

SEQ ID NO: 215845 - DNA, 22 bp, Artificial Sequence
  Synthetic oligonucleotide; TTG chr2 60521214 60521235 60521219 60521214 -
ggtttacagcagattaaattaa

SEQ ID NO: 215846 - DNA, 22 bp, Artificial Sequence
  Synthetic oligonucleotide; TTT chr2 60521209 60521230 60521214 60521209 -
acagcagattaaattaaatttt

SEQ ID NO: 215847 - DNA, 22 bp, Artificial Sequence
  Synthetic oligonucleotide; TTA chr2 60521208 60521229 60521213 60521208 -
cagcagattaaattaaatttta

SEQ ID NO: 215848 - DNA, 22 bp, Artificial Sequence
  Synthetic oligonucleotide; TTA chr2 60521198 60521219 60521203 60521198 -
aattaaattttaggctggtttg

SEQ ID NO: 215849 - DNA, 22 bp, Artificial Sequence
  Synthetic oligonucleotide; TTA chr2 60521193 60521214 60521198 60521193 -
aattttaggctggtttggcttc

SEQ ID NO: 215850 - DNA, 22 bp, Artificial Sequence
  Synthetic oligonucleotide; TTT chr2 60521188 60521209 60521193 60521188 -
taggctggtttggcttcactgg

SEQ ID NO: 215851 - DNA, 22 bp, Artificial Sequence
  Synthetic oligonucleotide; TTT chr2 60521187 60521208 60521192 60521187 -
aggctggtttggcttcactggc

SEQ ID NO: 215852 - DNA, 22 bp, Artificial Sequence
  Synthetic oligonucleotide; TTA chr2 60521186 60521207 60521191 60521186 -
ggctggtttggcttcactggca

SEQ ID NO: 215853 - DNA, 22 bp, Artificial Sequence
  Synthetic oligonucleotide; CTG chr2 60521181 60521202 60521186 60521181 -
gtttggcttcactggcagtaga

SEQ ID NO: 215854 - DNA, 22 bp, Artificial Sequence
  Synthetic oligonucleotide; TTT chr2 60521177 60521198 60521182 60521177 -
ggcttcactggcagtagacaat

SEQ ID NO: 215855 - DNA, 22 bp, Artificial Sequence
  Synthetic oligonucleotide; TTG chr2 60521176 60521197 60521181 60521176 -
gcttcactggcagtagacaatg

SEQ ID NO: 215856 - DNA, 22 bp, Artificial Sequence
  Synthetic oligonucleotide; CTT chr2 60521172 60521193 60521177 60521172 -
cactggcagtagacaatggaag

SEQ ID NO: 215857 - DNA, 22 bp, Artificial Sequence
  Synthetic oligonucleotide; TTC chr2 60521171 60521192 60521176 60521171 -
actggcagtagacaatggaagg

SEQ ID NO: 215858 - DNA, 22 bp, Artificial Sequence
  Synthetic oligonucleotide; CTG chr2 60521167 60521188 60521172 60521167 -
gcagtagacaatggaaggcagc

SEQ ID NO: 215859 - DNA, 22 bp, Artificial Sequence
  Synthetic oligonucleotide; CTG chr2 60521143 60521164 60521148 60521143 -
ttgtagaaatgtaacctggcac

SEQ ID NO: 215860 - DNA, 22 bp, Artificial Sequence
  Synthetic oligonucleotide; TTG chr2 60521140 60521161 60521145 60521140 -
tagaaatgtaacctggcaccct

SEQ ID NO: 215861 - DNA, 22 bp, Artificial Sequence
  Synthetic oligonucleotide; CTG chr2 60521125 60521146 60521130 60521125 -
gcaccctcaaggatttgtgtga

SEQ ID NO: 215862 - DNA, 22 bp, Artificial Sequence
  Synthetic oligonucleotide; CTC chr2 60521117 60521138 60521122 60521117 -
aaggatttgtgtgagtgtgtgt

SEQ ID NO: 215863 - DNA, 22 bp, Artificial Sequence
  Synthetic oligonucleotide; TTT chr2 60521109 60521130 60521114 60521109 -
gtgtgagtgtgtgtgtgtgtgt

SEQ ID NO: 215864 - DNA, 22 bp, Artificial Sequence
  Synthetic oligonucleotide; TTG chr2 60521108 60521129 60521113 60521108 -
tgtgagtgtgtgtgtgtgtgtg

SEQ ID NO: 215865 - DNA, 22 bp, Artificial Sequence
  Synthetic oligonucleotide; CTG chr2 60521043 60521064 60521048 60521043 -
accactaggctacacttccttt

SEQ ID NO: 215866 - DNA, 22 bp, Artificial Sequence
  Synthetic oligonucleotide; CTA chr2 60521036 60521057 60521041 60521036 -
ggctacacttccttttcctttc

SEQ ID NO: 215867 - DNA, 22 bp, Artificial Sequence
  Synthetic oligonucleotide; CTA chr2 60521031 60521052 60521036 60521031 -
cacttccttttcctttcctctc

SEQ ID NO: 215868 - DNA, 22 bp, Artificial Sequence
  Synthetic oligonucleotide; CTT chr2 60521026 60521047 60521031 60521026 -
ccttttcctttcctctccattt

SEQ ID NO: 215869 - DNA, 22 bp, Artificial Sequence
  Synthetic oligonucleotide; TTC chr2 60521025 60521046 60521030 60521025 -
cttttcctttcctctccatttc

SEQ ID NO: 215870 - DNA, 22 bp, Artificial Sequence
  Synthetic oligonucleotide; CTT chr2 60521022 60521043 60521027 60521022 -
ttcctttcctctccatttcatc

SEQ ID NO: 215871 - DNA, 22 bp, Artificial Sequence
  Synthetic oligonucleotide; TTT chr2 60521021 60521042 60521026 60521021 -
tcctttcctctccatttcatcc

SEQ ID NO: 215872 - DNA, 22 bp, Artificial Sequence
  Synthetic oligonucleotide; TTT chr2 60521020 60521041 60521025 60521020 -
cctttcctctccatttcatccc

SEQ ID NO: 215873 - DNA, 22 bp, Artificial Sequence
  Synthetic oligonucleotide; TTC chr2 60521019 60521040 60521024 60521019 -
ctttcctctccatttcatccct

SEQ ID NO: 215874 - DNA, 22 bp, Artificial Sequence
  Synthetic oligonucleotide; CTT chr2 60521016 60521037 60521021 60521016 -
tcctctccatttcatccctttc

SEQ ID NO: 215875 - DNA, 22 bp, Artificial Sequence
  Synthetic oligonucleotide; TTT chr2 60521015 60521036 60521020 60521015 -
cctctccatttcatccctttcc

SEQ ID NO: 215876 - DNA, 22 bp, Artificial Sequence
  Synthetic oligonucleotide; TTC chr2 60521014 60521035 60521019 60521014 -
ctctccatttcatccctttcca

SEQ ID NO: 215877 - DNA, 22 bp, Artificial Sequence
  Synthetic oligonucleotide; CTC chr2 60521011 60521032 60521016 60521011 -
tccatttcatccctttccaaaa

SEQ ID NO: 215878 - DNA, 22 bp, Artificial Sequence
  Synthetic oligonucleotide; CTC chr2 60521009 60521030 60521014 60521009 -
catttcatccctttccaaaaag

SEQ ID NO: 215879 - DNA, 22 bp, Artificial Sequence
  Synthetic oligonucleotide; TTT chr2 60521004 60521025 60521009 60521004 -
catccctttccaaaaagtgttt

SEQ ID NO: 215880 - DNA, 22 bp, Artificial Sequence
  Synthetic oligonucleotide; TTC chr2 60521003 60521024 60521008 60521003 -
atccctttccaaaaagtgttta

SEQ ID NO: 215881 - DNA, 22 bp, Artificial Sequence
  Synthetic oligonucleotide; CTT chr2 60520996 60521017 60521001 60520996 -
tccaaaaagtgtttagacaaat

SEQ ID NO: 215882 - DNA, 22 bp, Artificial Sequence
  Synthetic oligonucleotide; TTT chr2 60520995 60521016 60521000 60520995 -
ccaaaaagtgtttagacaaata

SEQ ID NO: 215883 - DNA, 22 bp, Artificial Sequence
  Synthetic oligonucleotide; TTC chr2 60520994 60521015 60520999 60520994 -
caaaaagtgtttagacaaatag

SEQ ID NO: 215884 - DNA, 22 bp, Artificial Sequence
  Synthetic oligonucleotide; TTT chr2 60520982 60521003 60520987 60520982 -
agacaaatagtttcccagactt

SEQ ID NO: 215885 - DNA, 22 bp, Artificial Sequence
  Synthetic oligonucleotide; TTA chr2 60520981 60521002 60520986 60520981 -
gacaaatagtttcccagacttg

SEQ ID NO: 215886 - DNA, 22 bp, Artificial Sequence
  Synthetic oligonucleotide; TTT chr2 60520969 60520990 60520974 60520969 -
cccagacttggttttatcatgc

SEQ ID NO: 215887 - DNA, 22 bp, Artificial Sequence
  Synthetic oligonucleotide; TTC chr2 60520968 60520989 60520973 60520968 -
ccagacttggttttatcatgct

SEQ ID NO: 215888 - DNA, 22 bp, Artificial Sequence
  Synthetic oligonucleotide; CTT chr2 60520960 60520981 60520965 60520960 -
ggttttatcatgctgggttgac

SEQ ID NO: 215889 - DNA, 22 bp, Artificial Sequence
  Synthetic oligonucleotide; TTG chr2 60520959 60520980 60520964 60520959 -
gttttatcatgctgggttgaca

SEQ ID NO: 215890 - DNA, 22 bp, Artificial Sequence
  Synthetic oligonucleotide; TTT chr2 60520955 60520976 60520960 60520955 -
tatcatgctgggttgacaaagg

SEQ ID NO: 215891 - DNA, 22 bp, Artificial Sequence
  Synthetic oligonucleotide; TTT chr2 60520954 60520975 60520959 60520954 -
atcatgctgggttgacaaaggt

SEQ ID NO: 215892 - DNA, 22 bp, Artificial Sequence
  Synthetic oligonucleotide; TTA chr2 60520953 60520974 60520958 60520953 -
tcatgctgggttgacaaaggtt

SEQ ID NO: 215893 - DNA, 22 bp, Artificial Sequence
  Synthetic oligonucleotide; CTG chr2 60520945 60520966 60520950 60520945 -
ggttgacaaaggttgtgtacag

SEQ ID NO: 215894 - DNA, 22 bp, Artificial Sequence
  Synthetic oligonucleotide; TTG chr2 60520940 60520961 60520945 60520940 -
acaaaggttgtgtacagagctg

SEQ ID NO: 215895 - DNA, 22 bp, Artificial Sequence
  Synthetic oligonucleotide; TTG chr2 60520930 60520951 60520935 60520930 -
tgtacagagctggaataatttt

SEQ ID NO: 215896 - DNA, 22 bp, Artificial Sequence
  Synthetic oligonucleotide; CTG chr2 60520918 60520939 60520923 60520918 -
gaataattttttcttctttcta

SEQ ID NO: 215897 - DNA, 22 bp, Artificial Sequence
  Synthetic oligonucleotide; TTT chr2 60520909 60520930 60520914 60520909 -
tttcttctttctactgttggca

SEQ ID NO: 215898 - DNA, 22 bp, Artificial Sequence
  Synthetic oligonucleotide; TTT chr2 60520908 60520929 60520913 60520908 -
ttcttctttctactgttggcac

SEQ ID NO: 215899 - DNA, 22 bp, Artificial Sequence
  Synthetic oligonucleotide; TTT chr2 60520907 60520928 60520912 60520907 -
tcttctttctactgttggcaca

SEQ ID NO: 215900 - DNA, 22 bp, Artificial Sequence
  Synthetic oligonucleotide; TTT chr2 60520906 60520927 60520911 60520906 -
cttctttctactgttggcacat

SEQ ID NO: 215901 - DNA, 22 bp, Artificial Sequence
  Synthetic oligonucleotide; TTC chr2 60520905 60520926 60520910 60520905 -
ttctttctactgttggcacatc

SEQ ID NO: 215902 - DNA, 22 bp, Artificial Sequence
  Synthetic oligonucleotide; CTT chr2 60520903 60520924 60520908 60520903 -
ctttctactgttggcacatcaa

SEQ ID NO: 215903 - DNA, 22 bp, Artificial Sequence
  Synthetic oligonucleotide; TTC chr2 60520902 60520923 60520907 60520902 -
tttctactgttggcacatcaat

SEQ ID NO: 215904 - DNA, 22 bp, Artificial Sequence
  Synthetic oligonucleotide; CTT chr2 60520900 60520921 60520905 60520900 -
tctactgttggcacatcaatat

SEQ ID NO: 215905 - DNA, 22 bp, Artificial Sequence
  Synthetic oligonucleotide; TTT chr2 60520899 60520920 60520904 60520899 -
ctactgttggcacatcaatatc

SEQ ID NO: 215906 - DNA, 22 bp, Artificial Sequence
  Synthetic oligonucleotide; TTC chr2 60520898 60520919 60520903 60520898 -
tactgttggcacatcaatatct

SEQ ID NO: 215907 - DNA, 22 bp, Artificial Sequence
  Synthetic oligonucleotide; CTA chr2 60520896 60520917 60520901 60520896 -
ctgttggcacatcaatatcttt

SEQ ID NO: 215908 - DNA, 22 bp, Artificial Sequence
  Synthetic oligonucleotide; CTG chr2 60520893 60520914 60520898 60520893 -
ttggcacatcaatatctttttt

SEQ ID NO: 215909 - DNA, 22 bp, Artificial Sequence
  Synthetic oligonucleotide; TTG chr2 60520890 60520911 60520895 60520890 -
gcacatcaatatctttttttct

SEQ ID NO: 215910 - DNA, 22 bp, Artificial Sequence
  Synthetic oligonucleotide; CTT chr2 60520875 60520896 60520880 60520875 -
tttttctgcaaagaaggggcta

SEQ ID NO: 215911 - DNA, 22 bp, Artificial Sequence
  Synthetic oligonucleotide; TTT chr2 60520874 60520895 60520879 60520874 -
ttttctgcaaagaaggggctaa

SEQ ID NO: 215912 - DNA, 22 bp, Artificial Sequence
  Synthetic oligonucleotide; TTT chr2 60520873 60520894 60520878 60520873 -
tttctgcaaagaaggggctaag

SEQ ID NO: 215913 - DNA, 22 bp, Artificial Sequence
  Synthetic oligonucleotide; TTT chr2 60520872 60520893 60520877 60520872 -
ttctgcaaagaaggggctaagc

SEQ ID NO: 215914 - DNA, 22 bp, Artificial Sequence
  Synthetic oligonucleotide; TTT chr2 60520871 60520892 60520876 60520871 -
tctgcaaagaaggggctaagct

SEQ ID NO: 215915 - DNA, 22 bp, Artificial Sequence
  Synthetic oligonucleotide; TTT chr2 60520870 60520891 60520875 60520870 -
ctgcaaagaaggggctaagctt

SEQ ID NO: 215916 - DNA, 22 bp, Artificial Sequence
  Synthetic oligonucleotide; TTC chr2 60520869 60520890 60520874 60520869 -
tgcaaagaaggggctaagcttg

SEQ ID NO: 215917 - DNA, 22 bp, Artificial Sequence
  Synthetic oligonucleotide; CTG chr2 60520867 60520888 60520872 60520867 -
caaagaaggggctaagcttgca

SEQ ID NO: 215918 - DNA, 22 bp, Artificial Sequence
  Synthetic oligonucleotide; CTA chr2 60520853 60520874 60520858 60520853 -
agcttgcacgaaaacaccggtg

SEQ ID NO: 215919 - DNA, 22 bp, Artificial Sequence
  Synthetic oligonucleotide; CTT chr2 60520848 60520869 60520853 60520848 -
gcacgaaaacaccggtgggaac

SEQ ID NO: 215920 - DNA, 22 bp, Artificial Sequence
  Synthetic oligonucleotide; TTG chr2 60520847 60520868 60520852 60520847 -
cacgaaaacaccggtgggaacc

SEQ ID NO: 215921 - DNA, 22 bp, Artificial Sequence
  Synthetic oligonucleotide; CTG chr2 60520820 60520841 60520825 60520820 -
gagaagggcatgggtggttttt

SEQ ID NO: 215922 - DNA, 22 bp, Artificial Sequence
  Synthetic oligonucleotide; TTT chr2 60520800 60520821 60520805 60520800 -
ttggttcggttggtggctgatc

SEQ ID NO: 215923 - DNA, 22 bp, Artificial Sequence
  Synthetic oligonucleotide; TTT chr2 60520799 60520820 60520804 60520799 -
tggttcggttggtggctgatct

SEQ ID NO: 215924 - DNA, 22 bp, Artificial Sequence
  Synthetic oligonucleotide; TTT chr2 60520798 60520819 60520803 60520798 -
ggttcggttggtggctgatctg

SEQ ID NO: 215925 - DNA, 22 bp, Artificial Sequence
  Synthetic oligonucleotide; TTG chr2 60520797 60520818 60520802 60520797 -
gttcggttggtggctgatctga

SEQ ID NO: 215926 - DNA, 22 bp, Artificial Sequence
  Synthetic oligonucleotide; TTC chr2 60520793 60520814 60520798 60520793 -
ggttggtggctgatctgatggg

SEQ ID NO: 215927 - DNA, 22 bp, Artificial Sequence
  Synthetic oligonucleotide; TTG chr2 60520788 60520809 60520793 60520788 -
gtggctgatctgatgggtggta

SEQ ID NO: 215928 - DNA, 22 bp, Artificial Sequence
  Synthetic oligonucleotide; CTG chr2 60520781 60520802 60520786 60520781 -
atctgatgggtggtataggcag

SEQ ID NO: 215929 - DNA, 22 bp, Artificial Sequence
  Synthetic oligonucleotide; CTG chr2 60520776 60520797 60520781 60520776 -
atgggtggtataggcagaatgt

SEQ ID NO: 215930 - DNA, 22 bp, Artificial Sequence
  Synthetic oligonucleotide; CTG chr2 60520751 60520772 60520756 60520751 -
gctgccccttcagattcctgta

SEQ ID NO: 215931 - DNA, 22 bp, Artificial Sequence
  Synthetic oligonucleotide; CTG chr2 60520747 60520768 60520752 60520747 -
ccccttcagattcctgtagatt

SEQ ID NO: 215932 - DNA, 22 bp, Artificial Sequence
  Synthetic oligonucleotide; CTT chr2 60520741 60520762 60520746 60520741 -
cagattcctgtagattccgtag

SEQ ID NO: 215933 - DNA, 22 bp, Artificial Sequence
  Synthetic oligonucleotide; TTC chr2 60520740 60520761 60520745 60520740 -
agattcctgtagattccgtagg

SEQ ID NO: 215934 - DNA, 22 bp, Artificial Sequence
  Synthetic oligonucleotide; TTC chr2 60520734 60520755 60520739 60520734 -
ctgtagattccgtaggcgacca

SEQ ID NO: 215935 - DNA, 22 bp, Artificial Sequence
  Synthetic oligonucleotide; CTG chr2 60520731 60520752 60520736 60520731 -
tagattccgtaggcgaccaaca

SEQ ID NO: 215936 - DNA, 22 bp, Artificial Sequence
  Synthetic oligonucleotide; TTC chr2 60520724 60520745 60520729 60520724 -
cgtaggcgaccaacatggggtg

SEQ ID NO: 215937 - DNA, 22 bp, Artificial Sequence
  Synthetic oligonucleotide; CTG chr2 60520688 60520709 60520693 60520688 -
tctgctctttttgatgcaaata

SEQ ID NO: 215938 - DNA, 22 bp, Artificial Sequence
  Synthetic oligonucleotide; CTG chr2 60520684 60520705 60520689 60520684 -
ctctttttgatgcaaatatctt

SEQ ID NO: 215939 - DNA, 22 bp, Artificial Sequence
  Synthetic oligonucleotide; CTC chr2 60520681 60520702 60520686 60520681 -
tttttgatgcaaatatcttcac

SEQ ID NO: 215940 - DNA, 22 bp, Artificial Sequence
  Synthetic oligonucleotide; CTT chr2 60520679 60520700 60520684 60520679 -
tttgatgcaaatatcttcactc

SEQ ID NO: 215941 - DNA, 22 bp, Artificial Sequence
  Synthetic oligonucleotide; TTT chr2 60520678 60520699 60520683 60520678 -
ttgatgcaaatatcttcactct

SEQ ID NO: 215942 - DNA, 22 bp, Artificial Sequence
  Synthetic oligonucleotide; TTT chr2 60520677 60520698 60520682 60520677 -
tgatgcaaatatcttcactctc

SEQ ID NO: 215943 - DNA, 22 bp, Artificial Sequence
  Synthetic oligonucleotide; TTT chr2 60520676 60520697 60520681 60520676 -
gatgcaaatatcttcactctcc

SEQ ID NO: 215944 - DNA, 22 bp, Artificial Sequence
  Synthetic oligonucleotide; TTG chr2 60520675 60520696 60520680 60520675 -
atgcaaatatcttcactctcct

SEQ ID NO: 215945 - DNA, 22 bp, Artificial Sequence
  Synthetic oligonucleotide; CTT chr2 60520662 60520683 60520667 60520662 -
cactctccttggtgcttctgtg

SEQ ID NO: 215946 - DNA, 22 bp, Artificial Sequence
  Synthetic oligonucleotide; TTC chr2 60520661 60520682 60520666 60520661 -
actctccttggtgcttctgtgg

SEQ ID NO: 215947 - DNA, 22 bp, Artificial Sequence
  Synthetic oligonucleotide; CTC chr2 60520657 60520678 60520662 60520657 -
tccttggtgcttctgtggttgt

SEQ ID NO: 215948 - DNA, 22 bp, Artificial Sequence
  Synthetic oligonucleotide; CTC chr2 60520655 60520676 60520660 60520655 -
cttggtgcttctgtggttgtgc

SEQ ID NO: 215949 - DNA, 22 bp, Artificial Sequence
  Synthetic oligonucleotide; CTT chr2 60520652 60520673 60520657 60520652 -
ggtgcttctgtggttgtgccta

SEQ ID NO: 215950 - DNA, 22 bp, Artificial Sequence
  Synthetic oligonucleotide; TTG chr2 60520651 60520672 60520656 60520651 -
gtgcttctgtggttgtgcctat

SEQ ID NO: 215951 - DNA, 22 bp, Artificial Sequence
  Synthetic oligonucleotide; CTT chr2 60520645 60520666 60520650 60520645 -
ctgtggttgtgcctatgaattt

SEQ ID NO: 215952 - DNA, 22 bp, Artificial Sequence
  Synthetic oligonucleotide; TTC chr2 60520644 60520665 60520649 60520644 -
tgtggttgtgcctatgaattta

SEQ ID NO: 215953 - DNA, 22 bp, Artificial Sequence
  Synthetic oligonucleotide; CTG chr2 60520642 60520663 60520647 60520642 -
tggttgtgcctatgaatttagg

SEQ ID NO: 215954 - DNA, 22 bp, Artificial Sequence
  Synthetic oligonucleotide; TTG chr2 60520636 60520657 60520641 60520636 -
tgcctatgaatttaggacctta

SEQ ID NO: 215955 - DNA, 22 bp, Artificial Sequence
  Synthetic oligonucleotide; CTA chr2 60520630 60520651 60520635 60520630 -
tgaatttaggaccttatgcctc

SEQ ID NO: 215956 - DNA, 22 bp, Artificial Sequence
  Synthetic oligonucleotide; TTT chr2 60520623 60520644 60520628 60520623 -
aggaccttatgcctcatagtgt

SEQ ID NO: 215957 - DNA, 22 bp, Artificial Sequence
  Synthetic oligonucleotide; TTA chr2 60520622 60520643 60520627 60520622 -
ggaccttatgcctcatagtgtt

SEQ ID NO: 215958 - DNA, 22 bp, Artificial Sequence
  Synthetic oligonucleotide; CTT chr2 60520615 60520636 60520620 60520615 -
atgcctcatagtgttgagtcag

SEQ ID NO: 215959 - DNA, 22 bp, Artificial Sequence
  Synthetic oligonucleotide; TTA chr2 60520614 60520635 60520619 60520614 -
tgcctcatagtgttgagtcaga

SEQ ID NO: 215960 - DNA, 22 bp, Artificial Sequence
  Synthetic oligonucleotide; CTC chr2 60520608 60520629 60520613 60520608 -
atagtgttgagtcagagcaaaa

SEQ ID NO: 215961 - DNA, 22 bp, Artificial Sequence
  Synthetic oligonucleotide; TTG chr2 60520599 60520620 60520604 60520599 -
agtcagagcaaaacagtttaca

SEQ ID NO: 215962 - DNA, 22 bp, Artificial Sequence
  Synthetic oligonucleotide; TTT chr2 60520580 60520601 60520585 60520580 -
acatcaaaggccacttatttaa

SEQ ID NO: 215963 - DNA, 22 bp, Artificial Sequence
  Synthetic oligonucleotide; TTA chr2 60520579 60520600 60520584 60520579 -
catcaaaggccacttatttaat

SEQ ID NO: 215964 - DNA, 22 bp, Artificial Sequence
  Synthetic oligonucleotide; CTT chr2 60520564 60520585 60520569 60520564 -
atttaattttcctcagaaaact

SEQ ID NO: 215965 - DNA, 22 bp, Artificial Sequence
  Synthetic oligonucleotide; TTA chr2 60520563 60520584 60520568 60520563 -
tttaattttcctcagaaaactc

SEQ ID NO: 215966 - DNA, 22 bp, Artificial Sequence
  Synthetic oligonucleotide; TTT chr2 60520560 60520581 60520565 60520560 -
aattttcctcagaaaactctgt

SEQ ID NO: 215967 - DNA, 22 bp, Artificial Sequence
  Synthetic oligonucleotide; TTA chr2 60520559 60520580 60520564 60520559 -
attttcctcagaaaactctgtg

SEQ ID NO: 215968 - DNA, 22 bp, Artificial Sequence
  Synthetic oligonucleotide; TTT chr2 60520555 60520576 60520560 60520555 -
tcctcagaaaactctgtgagga

SEQ ID NO: 215969 - DNA, 22 bp, Artificial Sequence
  Synthetic oligonucleotide; TTT chr2 60520554 60520575 60520559 60520554 -
cctcagaaaactctgtgaggat

SEQ ID NO: 215970 - DNA, 22 bp, Artificial Sequence
  Synthetic oligonucleotide; TTC chr2 60520553 60520574 60520558 60520553 -
ctcagaaaactctgtgaggata

SEQ ID NO: 215971 - DNA, 22 bp, Artificial Sequence
  Synthetic oligonucleotide; CTC chr2 60520550 60520571 60520555 60520550 -
agaaaactctgtgaggataatt

SEQ ID NO: 215972 - DNA, 22 bp, Artificial Sequence
  Synthetic oligonucleotide; CTC chr2 60520541 60520562 60520546 60520541 -
tgtgaggataatttctccttct

SEQ ID NO: 215973 - DNA, 22 bp, Artificial Sequence
  Synthetic oligonucleotide; CTG chr2 60520539 60520560 60520544 60520539 -
tgaggataatttctccttctta

SEQ ID NO: 215974 - DNA, 22 bp, Artificial Sequence
  Synthetic oligonucleotide; TTT chr2 60520527 60520548 60520532 60520527 -
ctccttcttataaacggaatgc

SEQ ID NO: 215975 - DNA, 22 bp, Artificial Sequence
  Synthetic oligonucleotide; TTC chr2 60520526 60520547 60520531 60520526 -
tccttcttataaacggaatgcg

SEQ ID NO: 215976 - DNA, 22 bp, Artificial Sequence
  Synthetic oligonucleotide; CTC chr2 60520524 60520545 60520529 60520524 -
cttcttataaacggaatgcgaa

SEQ ID NO: 215977 - DNA, 22 bp, Artificial Sequence
  Synthetic oligonucleotide; CTT chr2 60520521 60520542 60520526 60520521 -
cttataaacggaatgcgaatgt

SEQ ID NO: 215978 - DNA, 22 bp, Artificial Sequence
  Synthetic oligonucleotide; TTC chr2 60520520 60520541 60520525 60520520 -
ttataaacggaatgcgaatgtg

SEQ ID NO: 215979 - DNA, 22 bp, Artificial Sequence
  Synthetic oligonucleotide; CTT chr2 60520518 60520539 60520523 60520518 -
ataaacggaatgcgaatgtgta

SEQ ID NO: 215980 - DNA, 22 bp, Artificial Sequence
  Synthetic oligonucleotide; TTA chr2 60520517 60520538 60520522 60520517 -
taaacggaatgcgaatgtgtac

SEQ ID NO: 215981 - DNA, 22 bp, Artificial Sequence
  Synthetic oligonucleotide; TTA chr2 60520479 60520500 60520484 60520479 -
tcccaccgaagggtgatgctct

SEQ ID NO: 215982 - DNA, 22 bp, Artificial Sequence
  Synthetic oligonucleotide; CTC chr2 60520458 60520479 60520463 60520458 -
tttacttttataatctagattt

SEQ ID NO: 215983 - DNA, 22 bp, Artificial Sequence
  Synthetic oligonucleotide; CTT chr2 60520456 60520477 60520461 60520456 -
tacttttataatctagatttta

SEQ ID NO: 215984 - DNA, 22 bp, Artificial Sequence
  Synthetic oligonucleotide; TTT chr2 60520455 60520476 60520460 60520455 -
acttttataatctagattttaa

SEQ ID NO: 215985 - DNA, 22 bp, Artificial Sequence
  Synthetic oligonucleotide; TTA chr2 60520454 60520475 60520459 60520454 -
cttttataatctagattttaaa

SEQ ID NO: 215986 - DNA, 22 bp, Artificial Sequence
  Synthetic oligonucleotide; CTT chr2 60520451 60520472 60520456 60520451 -
ttataatctagattttaaaaaa

SEQ ID NO: 215987 - DNA, 22 bp, Artificial Sequence
  Synthetic oligonucleotide; TTT chr2 60520450 60520471 60520455 60520450 -
tataatctagattttaaaaaat

SEQ ID NO: 215988 - DNA, 22 bp, Artificial Sequence
  Synthetic oligonucleotide; TTT chr2 60520449 60520470 60520454 60520449 -
ataatctagattttaaaaaatt

SEQ ID NO: 215989 - DNA, 22 bp, Artificial Sequence
  Synthetic oligonucleotide; TTA chr2 60520448 60520469 60520453 60520448 -
taatctagattttaaaaaattt

SEQ ID NO: 215990 - DNA, 22 bp, Artificial Sequence
  Synthetic oligonucleotide; CTA chr2 60520441 60520462 60520446 60520441 -
gattttaaaaaatttggtggca

SEQ ID NO: 215991 - DNA, 22 bp, Artificial Sequence
  Synthetic oligonucleotide; TTT chr2 60520436 60520457 60520441 60520436 -
taaaaaatttggtggcacttga

SEQ ID NO: 215992 - DNA, 22 bp, Artificial Sequence
  Synthetic oligonucleotide; TTT chr2 60520435 60520456 60520440 60520435 -
aaaaaatttggtggcacttgat

SEQ ID NO: 215993 - DNA, 22 bp, Artificial Sequence
  Synthetic oligonucleotide; TTA chr2 60520434 60520455 60520439 60520434 -
aaaaatttggtggcacttgatt

SEQ ID NO: 215994 - DNA, 22 bp, Artificial Sequence
  Synthetic oligonucleotide; TTT chr2 60520426 60520447 60520431 60520426 -
ggtggcacttgatttcaggtcc

SEQ ID NO: 215995 - DNA, 22 bp, Artificial Sequence
  Synthetic oligonucleotide; TTG chr2 60520425 60520446 60520430 60520425 -
gtggcacttgatttcaggtcct

SEQ ID NO: 215996 - DNA, 22 bp, Artificial Sequence
  Synthetic oligonucleotide; CTT chr2 60520416 60520437 60520421 60520416 -
gatttcaggtcctcagactcca

SEQ ID NO: 215997 - DNA, 22 bp, Artificial Sequence
  Synthetic oligonucleotide; TTG chr2 60520415 60520436 60520420 60520415 -
atttcaggtcctcagactccag

SEQ ID NO: 215998 - DNA, 22 bp, Artificial Sequence
  Synthetic oligonucleotide; TTT chr2 60520411 60520432 60520416 60520411 -
caggtcctcagactccagaatt

SEQ ID NO: 215999 - DNA, 22 bp, Artificial Sequence
  Synthetic oligonucleotide; TTC chr2 60520410 60520431 60520415 60520410 -
aggtcctcagactccagaattt

SEQ ID NO: 216000 - DNA, 22 bp, Artificial Sequence
  Synthetic oligonucleotide; CTC chr2 60520402 60520423 60520407 60520402 -
agactccagaatttatactcac

SEQ ID NO: 216001 - DNA, 22 bp, Artificial Sequence
  Synthetic oligonucleotide; CTC chr2 60520396 60520417 60520401 60520396 -
cagaatttatactcactgatta

SEQ ID NO: 216002 - DNA, 22 bp, Artificial Sequence
  Synthetic oligonucleotide; TTT chr2 60520388 60520409 60520393 60520388 -
atactcactgattagtaatgca

SEQ ID NO: 216003 - DNA, 22 bp, Artificial Sequence
  Synthetic oligonucleotide; TTA chr2 60520387 60520408 60520392 60520387 -
tactcactgattagtaatgcat

SEQ ID NO: 216004 - DNA, 22 bp, Artificial Sequence
  Synthetic oligonucleotide; CTC chr2 60520382 60520403 60520387 60520382 -
actgattagtaatgcattatgc

SEQ ID NO: 216005 - DNA, 22 bp, Artificial Sequence
  Synthetic oligonucleotide; CTG chr2 60520378 60520399 60520383 60520378 -
attagtaatgcattatgcaaat

SEQ ID NO: 216006 - DNA, 22 bp, Artificial Sequence
  Synthetic oligonucleotide; TTA chr2 60520374 60520395 60520379 60520374 -
gtaatgcattatgcaaataatt

SEQ ID NO: 216007 - DNA, 22 bp, Artificial Sequence
  Synthetic oligonucleotide; TTA chr2 60520363 60520384 60520368 60520363 -
tgcaaataattcagtttacata

SEQ ID NO: 216008 - DNA, 22 bp, Artificial Sequence
  Synthetic oligonucleotide; TTC chr2 60520351 60520372 60520356 60520351 -
agtttacatatccaaatactgt

SEQ ID NO: 216009 - DNA, 22 bp, Artificial Sequence
  Synthetic oligonucleotide; TTT chr2 60520346 60520367 60520351 60520346 -
acatatccaaatactgttttgc

SEQ ID NO: 216010 - DNA, 22 bp, Artificial Sequence
  Synthetic oligonucleotide; TTA chr2 60520345 60520366 60520350 60520345 -
catatccaaatactgttttgca

SEQ ID NO: 216011 - DNA, 22 bp, Artificial Sequence
  Synthetic oligonucleotide; CTG chr2 60520330 60520351 60520335 60520330 -
ttttgcatcattcacacctcat

SEQ ID NO: 216012 - DNA, 22 bp, Artificial Sequence
  Synthetic oligonucleotide; TTT chr2 60520327 60520348 60520332 60520327 -
tgcatcattcacacctcatgtc

SEQ ID NO: 216013 - DNA, 22 bp, Artificial Sequence
  Synthetic oligonucleotide; TTT chr2 60520326 60520347 60520331 60520326 -
gcatcattcacacctcatgtct

SEQ ID NO: 216014 - DNA, 22 bp, Artificial Sequence
  Synthetic oligonucleotide; TTG chr2 60520325 60520346 60520330 60520325 -
catcattcacacctcatgtctt

SEQ ID NO: 216015 - DNA, 22 bp, Artificial Sequence
  Synthetic oligonucleotide; TTC chr2 60520317 60520338 60520322 60520317 -
acacctcatgtcttgaaaaaaa

SEQ ID NO: 216016 - DNA, 22 bp, Artificial Sequence
  Synthetic oligonucleotide; CTC chr2 60520310 60520331 60520315 60520310 -
atgtcttgaaaaaaaaagtgaa

SEQ ID NO: 216017 - DNA, 22 bp, Artificial Sequence
  Synthetic oligonucleotide; CTT chr2 60520303 60520324 60520308 60520303 -
gaaaaaaaaagtgaaatgtttc

SEQ ID NO: 216018 - DNA, 22 bp, Artificial Sequence
  Synthetic oligonucleotide; TTG chr2 60520302 60520323 60520307 60520302 -
aaaaaaaaagtgaaatgtttcc

SEQ ID NO: 216019 - DNA, 22 bp, Artificial Sequence
  Synthetic oligonucleotide; TTT chr2 60520282 60520303 60520287 60520282 -
cctcaaaataaacaaaacctgc

SEQ ID NO: 216020 - DNA, 22 bp, Artificial Sequence
  Synthetic oligonucleotide; TTC chr2 60520281 60520302 60520286 60520281 -
ctcaaaataaacaaaacctgca

SEQ ID NO: 216021 - DNA, 22 bp, Artificial Sequence
  Synthetic oligonucleotide; CTC chr2 60520278 60520299 60520283 60520278 -
aaaataaacaaaacctgcagaa

SEQ ID NO: 216022 - DNA, 22 bp, Artificial Sequence
  Synthetic oligonucleotide; CTG chr2 60520261 60520282 60520266 60520261 -
cagaagagtttattgtaagggt

SEQ ID NO: 216023 - DNA, 22 bp, Artificial Sequence
  Synthetic oligonucleotide; TTT chr2 60520250 60520271 60520255 60520250 -
attgtaagggtgaaaattaaag

SEQ ID NO: 216024 - DNA, 22 bp, Artificial Sequence
  Synthetic oligonucleotide; TTA chr2 60520249 60520270 60520254 60520249 -
ttgtaagggtgaaaattaaaga

SEQ ID NO: 216025 - DNA, 22 bp, Artificial Sequence
  Synthetic oligonucleotide; TTG chr2 60520246 60520267 60520251 60520246 -
taagggtgaaaattaaagagga

SEQ ID NO: 216026 - DNA, 22 bp, Artificial Sequence
  Synthetic oligonucleotide; TTA chr2 60520231 60520252 60520236 60520231 -
aagaggaacccatttgcctggg

SEQ ID NO: 216027 - DNA, 22 bp, Artificial Sequence
  Synthetic oligonucleotide; TTT chr2 60520216 60520237 60520221 60520216 -
gcctgggaacttttgaggaaaa

SEQ ID NO: 216028 - DNA, 22 bp, Artificial Sequence
  Synthetic oligonucleotide; TTG chr2 60520215 60520236 60520220 60520215 -
cctgggaacttttgaggaaaat

SEQ ID NO: 216029 - DNA, 22 bp, Artificial Sequence
  Synthetic oligonucleotide; CTG chr2 60520211 60520232 60520216 60520211 -
ggaacttttgaggaaaatttta

SEQ ID NO: 216030 - DNA, 22 bp, Artificial Sequence
  Synthetic oligonucleotide; CTT chr2 60520204 60520225 60520209 60520204 -
ttgaggaaaattttaatactcc

SEQ ID NO: 216031 - DNA, 22 bp, Artificial Sequence
  Synthetic oligonucleotide; TTT chr2 60520203 60520224 60520208 60520203 -
tgaggaaaattttaatactcct

SEQ ID NO: 216032 - DNA, 22 bp, Artificial Sequence
  Synthetic oligonucleotide; TTT chr2 60520202 60520223 60520207 60520202 -
gaggaaaattttaatactcctg

SEQ ID NO: 216033 - DNA, 22 bp, Artificial Sequence
  Synthetic oligonucleotide; TTG chr2 60520201 60520222 60520206 60520201 -
aggaaaattttaatactcctgc

SEQ ID NO: 216034 - DNA, 22 bp, Artificial Sequence
  Synthetic oligonucleotide; TTT chr2 60520191 60520212 60520196 60520191 -
taatactcctgcataaataatt

SEQ ID NO: 216035 - DNA, 22 bp, Artificial Sequence
  Synthetic oligonucleotide; TTT chr2 60520190 60520211 60520195 60520190 -
aatactcctgcataaataattt

SEQ ID NO: 216036 - DNA, 22 bp, Artificial Sequence
  Synthetic oligonucleotide; TTA chr2 60520189 60520210 60520194 60520189 -
atactcctgcataaataatttt

SEQ ID NO: 216037 - DNA, 22 bp, Artificial Sequence
  Synthetic oligonucleotide; CTC chr2 60520183 60520204 60520188 60520183 -
ctgcataaataattttgcaatt

SEQ ID NO: 216038 - DNA, 22 bp, Artificial Sequence
  Synthetic oligonucleotide; CTG chr2 60520180 60520201 60520185 60520180 -
cataaataattttgcaattatt

SEQ ID NO: 216039 - DNA, 22 bp, Artificial Sequence
  Synthetic oligonucleotide; TTT chr2 60520168 60520189 60520173 60520168 -
tgcaattatttttgattcctac

SEQ ID NO: 216040 - DNA, 22 bp, Artificial Sequence
  Synthetic oligonucleotide; TTT chr2 60520167 60520188 60520172 60520167 -
gcaattatttttgattcctacc

SEQ ID NO: 216041 - DNA, 22 bp, Artificial Sequence
  Synthetic oligonucleotide; TTG chr2 60520166 60520187 60520171 60520166 -
caattatttttgattcctacct

SEQ ID NO: 216042 - DNA, 22 bp, Artificial Sequence
  Synthetic oligonucleotide; TTA chr2 60520160 60520181 60520165 60520160 -
tttttgattcctacctaatcaa

SEQ ID NO: 216043 - DNA, 22 bp, Artificial Sequence
  Synthetic oligonucleotide; TTT chr2 60520157 60520178 60520162 60520157 -
ttgattcctacctaatcaatat

SEQ ID NO: 216044 - DNA, 22 bp, Artificial Sequence
  Synthetic oligonucleotide; TTT chr2 60520156 60520177 60520161 60520156 -
tgattcctacctaatcaatata

SEQ ID NO: 216045 - DNA, 22 bp, Artificial Sequence
  Synthetic oligonucleotide; TTT chr2 60520155 60520176 60520160 60520155 -
gattcctacctaatcaatatac

SEQ ID NO: 216046 - DNA, 22 bp, Artificial Sequence
  Synthetic oligonucleotide; TTG chr2 60520154 60520175 60520159 60520154 -
attcctacctaatcaatatacc

SEQ ID NO: 216047 - DNA, 22 bp, Artificial Sequence
  Synthetic oligonucleotide; TTC chr2 60520150 60520171 60520155 60520150 -
ctacctaatcaatataccttgc

SEQ ID NO: 216048 - DNA, 22 bp, Artificial Sequence
  Synthetic oligonucleotide; CTA chr2 60520147 60520168 60520152 60520147 -
cctaatcaatataccttgccac

SEQ ID NO: 216049 - DNA, 22 bp, Artificial Sequence
  Synthetic oligonucleotide; CTA chr2 60520143 60520164 60520148 60520143 -
atcaatataccttgccacgcaa

SEQ ID NO: 216050 - DNA, 22 bp, Artificial Sequence
  Synthetic oligonucleotide; CTT chr2 60520130 60520151 60520135 60520130 -
gccacgcaaggtatattctatt

SEQ ID NO: 216051 - DNA, 22 bp, Artificial Sequence
  Synthetic oligonucleotide; TTG chr2 60520129 60520150 60520134 60520129 -
ccacgcaaggtatattctatta

SEQ ID NO: 216052 - DNA, 22 bp, Artificial Sequence
  Synthetic oligonucleotide; TTC chr2 60520112 60520133 60520117 60520112 -
tattatctttggctttctgaat

SEQ ID NO: 216053 - DNA, 22 bp, Artificial Sequence
  Synthetic oligonucleotide; CTA chr2 60520110 60520131 60520115 60520110 -
ttatctttggctttctgaattt

SEQ ID NO: 216054 - DNA, 22 bp, Artificial Sequence
  Synthetic oligonucleotide; TTA chr2 60520107 60520128 60520112 60520107 -
tctttggctttctgaatttttc

SEQ ID NO: 216055 - DNA, 22 bp, Artificial Sequence
  Synthetic oligonucleotide; CTT chr2 60520103 60520124 60520108 60520103 -
tggctttctgaatttttcaatt

SEQ ID NO: 216056 - DNA, 22 bp, Artificial Sequence
  Synthetic oligonucleotide; TTT chr2 60520102 60520123 60520107 60520102 -
ggctttctgaatttttcaattt

SEQ ID NO: 216057 - DNA, 22 bp, Artificial Sequence
  Synthetic oligonucleotide; TTG chr2 60520101 60520122 60520106 60520101 -
gctttctgaatttttcaatttt

SEQ ID NO: 216058 - DNA, 22 bp, Artificial Sequence
  Synthetic oligonucleotide; CTT chr2 60520097 60520118 60520102 60520097 -
tctgaatttttcaattttcaga

SEQ ID NO: 216059 - DNA, 22 bp, Artificial Sequence
  Synthetic oligonucleotide; TTT chr2 60520096 60520117 60520101 60520096 -
ctgaatttttcaattttcagaa

SEQ ID NO: 216060 - DNA, 22 bp, Artificial Sequence
  Synthetic oligonucleotide; TTC chr2 60520095 60520116 60520100 60520095 -
tgaatttttcaattttcagaaa

SEQ ID NO: 216061 - DNA, 22 bp, Artificial Sequence
  Synthetic oligonucleotide; CTG chr2 60520093 60520114 60520098 60520093 -
aatttttcaattttcagaaaaa

SEQ ID NO: 216062 - DNA, 22 bp, Artificial Sequence
  Synthetic oligonucleotide; TTT chr2 60520088 60520109 60520093 60520088 -
ttcaattttcagaaaaagaagc

SEQ ID NO: 216063 - DNA, 22 bp, Artificial Sequence
  Synthetic oligonucleotide; TTT chr2 60520087 60520108 60520092 60520087 -
tcaattttcagaaaaagaagcc

SEQ ID NO: 216064 - DNA, 22 bp, Artificial Sequence
  Synthetic oligonucleotide; TTT chr2 60520086 60520107 60520091 60520086 -
caattttcagaaaaagaagcca

SEQ ID NO: 216065 - DNA, 22 bp, Artificial Sequence
  Synthetic oligonucleotide; TTC chr2 60520085 60520106 60520090 60520085 -
aattttcagaaaaagaagccat

SEQ ID NO: 216066 - DNA, 22 bp, Artificial Sequence
  Synthetic oligonucleotide; TTT chr2 60520080 60520101 60520085 60520080 -
tcagaaaaagaagccataatac

SEQ ID NO: 216067 - DNA, 22 bp, Artificial Sequence
  Synthetic oligonucleotide; TTT chr2 60520079 60520100 60520084 60520079 -
cagaaaaagaagccataatact

SEQ ID NO: 216068 - DNA, 22 bp, Artificial Sequence
  Synthetic oligonucleotide; TTC chr2 60520078 60520099 60520083 60520078 -
agaaaaagaagccataatacta

SEQ ID NO: 216069 - DNA, 22 bp, Artificial Sequence
  Synthetic oligonucleotide; CTA chr2 60520056 60520077 60520061 60520056 -
tatcatacacacatttgtgcat

SEQ ID NO: 216070 - DNA, 22 bp, Artificial Sequence
  Synthetic oligonucleotide; TTT chr2 60520040 60520061 60520045 60520040 -
gtgcataaatacacaggcataa

SEQ ID NO: 216071 - DNA, 22 bp, Artificial Sequence
  Synthetic oligonucleotide; TTG chr2 60520039 60520060 60520044 60520039 -
tgcataaatacacaggcataaa

SEQ ID NO: 216072 - DNA, 22 bp, Artificial Sequence
  Synthetic oligonucleotide; TTT chr2 60520008 60520029 60520013 60520008 -
aggccgaattatttgaagagga

SEQ ID NO: 216073 - DNA, 22 bp, Artificial Sequence
  Synthetic oligonucleotide; TTA chr2 60520007 60520028 60520012 60520007 -
ggccgaattatttgaagaggat

SEQ ID NO: 216074 - DNA, 22 bp, Artificial Sequence
  Synthetic oligonucleotide; TTA chr2 60519997 60520018 60520002 60519997 -
tttgaagaggatacaataattg

SEQ ID NO: 216075 - DNA, 22 bp, Artificial Sequence
  Synthetic oligonucleotide; TTT chr2 60519994 60520015 60519999 60519994 -
gaagaggatacaataattgctt

SEQ ID NO: 216076 - DNA, 22 bp, Artificial Sequence
  Synthetic oligonucleotide; TTG chr2 60519993 60520014 60519998 60519993 -
aagaggatacaataattgcttg

SEQ ID NO: 216077 - DNA, 22 bp, Artificial Sequence
  Synthetic oligonucleotide; TTG chr2 60519975 60519996 60519980 60519975 -
cttgccagtgacatgattctcc

SEQ ID NO: 216078 - DNA, 22 bp, Artificial Sequence
  Synthetic oligonucleotide; CTT chr2 60519972 60519993 60519977 60519972 -
gccagtgacatgattctcctgc

SEQ ID NO: 216079 - DNA, 22 bp, Artificial Sequence
  Synthetic oligonucleotide; TTG chr2 60519971 60519992 60519976 60519971 -
ccagtgacatgattctcctgcc

SEQ ID NO: 216080 - DNA, 22 bp, Artificial Sequence
  Synthetic oligonucleotide; TTC chr2 60519956 60519977 60519961 60519956 -
tcctgccagagagaggggagaa

SEQ ID NO: 216081 - DNA, 22 bp, Artificial Sequence
  Synthetic oligonucleotide; CTC chr2 60519954 60519975 60519959 60519954 -
ctgccagagagaggggagaata

SEQ ID NO: 216082 - DNA, 22 bp, Artificial Sequence
  Synthetic oligonucleotide; CTG chr2 60519951 60519972 60519956 60519951 -
ccagagagaggggagaataact

SEQ ID NO: 216083 - DNA, 22 bp, Artificial Sequence
  Synthetic oligonucleotide; CTA chr2 60519928 60519949 60519933 60519928 -
ggtgcaaacttttaacactcca

SEQ ID NO: 216084 - DNA, 22 bp, Artificial Sequence
  Synthetic oligonucleotide; CTT chr2 60519917 60519938 60519922 60519917 -
ttaacactccaagtctagagag

SEQ ID NO: 216085 - DNA, 22 bp, Artificial Sequence
  Synthetic oligonucleotide; TTT chr2 60519916 60519937 60519921 60519916 -
taacactccaagtctagagaga

SEQ ID NO: 216086 - DNA, 22 bp, Artificial Sequence
  Synthetic oligonucleotide; TTT chr2 60519915 60519936 60519920 60519915 -
aacactccaagtctagagagaa

SEQ ID NO: 216087 - DNA, 22 bp, Artificial Sequence
  Synthetic oligonucleotide; TTA chr2 60519914 60519935 60519919 60519914 -
acactccaagtctagagagaat

SEQ ID NO: 216088 - DNA, 22 bp, Artificial Sequence
  Synthetic oligonucleotide; CTC chr2 60519908 60519929 60519913 60519908 -
caagtctagagagaattatcca

SEQ ID NO: 216089 - DNA, 22 bp, Artificial Sequence
  Synthetic oligonucleotide; CTA chr2 60519900 60519921 60519905 60519900 -
gagagaattatccaagcatagc

SEQ ID NO: 216090 - DNA, 22 bp, Artificial Sequence
  Synthetic oligonucleotide; TTA chr2 60519890 60519911 60519895 60519890 -
tccaagcatagccatgaattcc

SEQ ID NO: 216091 - DNA, 22 bp, Artificial Sequence
  Synthetic oligonucleotide; TTC chr2 60519869 60519890 60519874 60519869 -
ctgagttatggattggcaaatg

SEQ ID NO: 216092 - DNA, 22 bp, Artificial Sequence
  Synthetic oligonucleotide; CTG chr2 60519866 60519887 60519871 60519866 -
agttatggattggcaaatgaca

SEQ ID NO: 216093 - DNA, 22 bp, Artificial Sequence
  Synthetic oligonucleotide; TTA chr2 60519861 60519882 60519866 60519861 -
tggattggcaaatgacaatgcc

SEQ ID NO: 216094 - DNA, 22 bp, Artificial Sequence
  Synthetic oligonucleotide; TTG chr2 60519854 60519875 60519859 60519854 -
gcaaatgacaatgcctatgaaa

SEQ ID NO: 216095 - DNA, 22 bp, Artificial Sequence
  Synthetic oligonucleotide; CTA chr2 60519837 60519858 60519842 60519837 -
tgaaaacgatctctttgtcttc

SEQ ID NO: 216096 - DNA, 22 bp, Artificial Sequence
  Synthetic oligonucleotide; CTC chr2 60519824 60519845 60519829 60519824 -
tttgtcttcactgagttttctt

SEQ ID NO: 216097 - DNA, 22 bp, Artificial Sequence
  Synthetic oligonucleotide; CTT chr2 60519822 60519843 60519827 60519822 -
tgtcttcactgagttttctttg

SEQ ID NO: 216098 - DNA, 22 bp, Artificial Sequence
  Synthetic oligonucleotide; TTT chr2 60519821 60519842 60519826 60519821 -
gtcttcactgagttttctttgt

SEQ ID NO: 216099 - DNA, 22 bp, Artificial Sequence
  Synthetic oligonucleotide; TTG chr2 60519820 60519841 60519825 60519820 -
tcttcactgagttttctttgtc

SEQ ID NO: 216100 - DNA, 22 bp, Artificial Sequence
  Synthetic oligonucleotide; CTT chr2 60519816 60519837 60519821 60519816 -
cactgagttttctttgtcattg

SEQ ID NO: 216101 - DNA, 22 bp, Artificial Sequence
  Synthetic oligonucleotide; TTC chr2 60519815 60519836 60519820 60519815 -
actgagttttctttgtcattgg

SEQ ID NO: 216102 - DNA, 22 bp, Artificial Sequence
  Synthetic oligonucleotide; CTG chr2 60519811 60519832 60519816 60519811 -
agttttctttgtcattggagta

SEQ ID NO: 216103 - DNA, 22 bp, Artificial Sequence
  Synthetic oligonucleotide; TTT chr2 60519806 60519827 60519811 60519806 -
tctttgtcattggagtaattta

SEQ ID NO: 216104 - DNA, 22 bp, Artificial Sequence
  Synthetic oligonucleotide; TTT chr2 60519805 60519826 60519810 60519805 -
ctttgtcattggagtaatttag

SEQ ID NO: 216105 - DNA, 22 bp, Artificial Sequence
  Synthetic oligonucleotide; TTC chr2 60519804 60519825 60519809 60519804 -
tttgtcattggagtaatttagg

SEQ ID NO: 216106 - DNA, 22 bp, Artificial Sequence
  Synthetic oligonucleotide; CTT chr2 60519802 60519823 60519807 60519802 -
tgtcattggagtaatttaggag

SEQ ID NO: 216107 - DNA, 22 bp, Artificial Sequence
  Synthetic oligonucleotide; TTT chr2 60519801 60519822 60519806 60519801 -
gtcattggagtaatttaggaga

SEQ ID NO: 216108 - DNA, 22 bp, Artificial Sequence
  Synthetic oligonucleotide; TTG chr2 60519800 60519821 60519805 60519800 -
tcattggagtaatttaggagaa

SEQ ID NO: 216109 - DNA, 22 bp, Artificial Sequence
  Synthetic oligonucleotide; TTG chr2 60519794 60519815 60519799 60519794 -
gagtaatttaggagaatacagg

SEQ ID NO: 216110 - DNA, 22 bp, Artificial Sequence
  Synthetic oligonucleotide; TTT chr2 60519785 60519806 60519790 60519785 -
aggagaatacaggatgtgactg

SEQ ID NO: 216111 - DNA, 22 bp, Artificial Sequence
  Synthetic oligonucleotide; TTA chr2 60519784 60519805 60519789 60519784 -
ggagaatacaggatgtgactgg

SEQ ID NO: 216112 - DNA, 22 bp, Artificial Sequence
  Synthetic oligonucleotide; CTG chr2 60519763 60519784 60519768 60519763 -
ggagccctttctgaataagcac

SEQ ID NO: 216113 - DNA, 22 bp, Artificial Sequence
  Synthetic oligonucleotide; CTT chr2 60519754 60519775 60519759 60519754 -
tctgaataagcacagtcccatg

SEQ ID NO: 216114 - DNA, 22 bp, Artificial Sequence
  Synthetic oligonucleotide; TTT chr2 60519753 60519774 60519758 60519753 -
ctgaataagcacagtcccatgc

SEQ ID NO: 216115 - DNA, 22 bp, Artificial Sequence
  Synthetic oligonucleotide; TTC chr2 60519752 60519773 60519757 60519752 -
tgaataagcacagtcccatgcc

SEQ ID NO: 216116 - DNA, 22 bp, Artificial Sequence
  Synthetic oligonucleotide; CTG chr2 60519750 60519771 60519755 60519750 -
aataagcacagtcccatgccca

SEQ ID NO: 216117 - DNA, 22 bp, Artificial Sequence
  Synthetic oligonucleotide; TTC chr2 60519719 60519740 60519724 60519719 -
ctaaaccagtggctcccagctg

SEQ ID NO: 216118 - DNA, 22 bp, Artificial Sequence
  Synthetic oligonucleotide; CTA chr2 60519716 60519737 60519721 60519716 -
aaccagtggctcccagctgcat

SEQ ID NO: 216119 - DNA, 22 bp, Artificial Sequence
  Synthetic oligonucleotide; CTC chr2 60519704 60519725 60519709 60519704 -
ccagctgcatgtgtcagaacag

SEQ ID NO: 216120 - DNA, 22 bp, Artificial Sequence
  Synthetic oligonucleotide; CTG chr2 60519697 60519718 60519702 60519697 -
catgtgtcagaacagaactggc

SEQ ID NO: 216121 - DNA, 22 bp, Artificial Sequence
  Synthetic oligonucleotide; CTG chr2 60519677 60519698 60519682 60519677 -
gcctcagaaatctacaagattc

SEQ ID NO: 216122 - DNA, 22 bp, Artificial Sequence
  Synthetic oligonucleotide; CTC chr2 60519672 60519693 60519677 60519672 -
agaaatctacaagattccagtg

SEQ ID NO: 216123 - DNA, 22 bp, Artificial Sequence
  Synthetic oligonucleotide; CTA chr2 60519663 60519684 60519668 60519663 -
caagattccagtggttccagcc

SEQ ID NO: 216124 - DNA, 22 bp, Artificial Sequence
  Synthetic oligonucleotide; TTC chr2 60519655 60519676 60519660 60519655 -
cagtggttccagcctcactttc

SEQ ID NO: 216125 - DNA, 22 bp, Artificial Sequence
  Synthetic oligonucleotide; TTC chr2 60519646 60519667 60519651 60519646 -
cagcctcactttctccagtggt

SEQ ID NO: 216126 - DNA, 22 bp, Artificial Sequence
  Synthetic oligonucleotide; CTC chr2 60519639 60519660 60519644 60519639 -
actttctccagtggtcaactta

SEQ ID NO: 216127 - DNA, 22 bp, Artificial Sequence
  Synthetic oligonucleotide; CTT chr2 60519635 60519656 60519640 60519635 -
tctccagtggtcaacttactgc

SEQ ID NO: 216128 - DNA, 22 bp, Artificial Sequence
  Synthetic oligonucleotide; TTT chr2 60519634 60519655 60519639 60519634 -
ctccagtggtcaacttactgct

SEQ ID NO: 216129 - DNA, 22 bp, Artificial Sequence
  Synthetic oligonucleotide; TTC chr2 60519633 60519654 60519638 60519633 -
tccagtggtcaacttactgctg

SEQ ID NO: 216130 - DNA, 22 bp, Artificial Sequence
  Synthetic oligonucleotide; CTC chr2 60519631 60519652 60519636 60519631 -
cagtggtcaacttactgctgtt

SEQ ID NO: 216131 - DNA, 22 bp, Artificial Sequence
  Synthetic oligonucleotide; CTT chr2 60519618 60519639 60519623 60519618 -
actgctgttgcaaagcacgtca

SEQ ID NO: 216132 - DNA, 22 bp, Artificial Sequence
  Synthetic oligonucleotide; TTA chr2 60519617 60519638 60519622 60519617 -
ctgctgttgcaaagcacgtcag

SEQ ID NO: 216133 - DNA, 22 bp, Artificial Sequence
  Synthetic oligonucleotide; CTG chr2 60519614 60519635 60519619 60519614 -
ctgttgcaaagcacgtcagatt

SEQ ID NO: 216134 - DNA, 22 bp, Artificial Sequence
  Synthetic oligonucleotide; CTG chr2 60519611 60519632 60519616 60519611 -
ttgcaaagcacgtcagatttca

SEQ ID NO: 216135 - DNA, 22 bp, Artificial Sequence
  Synthetic oligonucleotide; TTG chr2 60519608 60519629 60519613 60519608 -
caaagcacgtcagatttcagga

SEQ ID NO: 216136 - DNA, 22 bp, Artificial Sequence
  Synthetic oligonucleotide; TTT chr2 60519591 60519612 60519596 60519591 -
caggagcgatttctcttgtaag

SEQ ID NO: 216137 - DNA, 22 bp, Artificial Sequence
  Synthetic oligonucleotide; TTC chr2 60519590 60519611 60519595 60519590 -
aggagcgatttctcttgtaagg

SEQ ID NO: 216138 - DNA, 22 bp, Artificial Sequence
  Synthetic oligonucleotide; TTT chr2 60519579 60519600 60519584 60519579 -
ctcttgtaaggaaagaaggcag

SEQ ID NO: 216139 - DNA, 22 bp, Artificial Sequence
  Synthetic oligonucleotide; TTC chr2 60519578 60519599 60519583 60519578 -
tcttgtaaggaaagaaggcagg

SEQ ID NO: 216140 - DNA, 22 bp, Artificial Sequence
  Synthetic oligonucleotide; CTC chr2 60519576 60519597 60519581 60519576 -
ttgtaaggaaagaaggcaggca

SEQ ID NO: 216141 - DNA, 22 bp, Artificial Sequence
  Synthetic oligonucleotide; CTT chr2 60519574 60519595 60519579 60519574 -
gtaaggaaagaaggcaggcagg

SEQ ID NO: 216142 - DNA, 22 bp, Artificial Sequence
  Synthetic oligonucleotide; TTG chr2 60519573 60519594 60519578 60519573 -
taaggaaagaaggcaggcaggc

SEQ ID NO: 216143 - DNA, 22 bp, Artificial Sequence
  Synthetic oligonucleotide; CTT chr2 60519506 60519527 60519511 60519506 -
attttttctctgcagcatgagt

SEQ ID NO: 216144 - DNA, 22 bp, Artificial Sequence
  Synthetic oligonucleotide; TTA chr2 60519505 60519526 60519510 60519505 -
ttttttctctgcagcatgagtg

SEQ ID NO: 216145 - DNA, 22 bp, Artificial Sequence
  Synthetic oligonucleotide; TTT chr2 60519502 60519523 60519507 60519502 -
tttctctgcagcatgagtgcag

SEQ ID NO: 216146 - DNA, 22 bp, Artificial Sequence
  Synthetic oligonucleotide; TTT chr2 60519501 60519522 60519506 60519501 -
ttctctgcagcatgagtgcagt

SEQ ID NO: 216147 - DNA, 22 bp, Artificial Sequence
  Synthetic oligonucleotide; TTT chr2 60519500 60519521 60519505 60519500 -
tctctgcagcatgagtgcagtc

SEQ ID NO: 216148 - DNA, 22 bp, Artificial Sequence
  Synthetic oligonucleotide; TTT chr2 60519499 60519520 60519504 60519499 -
ctctgcagcatgagtgcagtca

SEQ ID NO: 216149 - DNA, 22 bp, Artificial Sequence
  Synthetic oligonucleotide; TTC chr2 60519498 60519519 60519503 60519498 -
tctgcagcatgagtgcagtcac

SEQ ID NO: 216150 - DNA, 22 bp, Artificial Sequence
  Synthetic oligonucleotide; CTC chr2 60519496 60519517 60519501 60519496 -
tgcagcatgagtgcagtcacct

SEQ ID NO: 216151 - DNA, 22 bp, Artificial Sequence
  Synthetic oligonucleotide; CTG chr2 60519494 60519515 60519499 60519494 -
cagcatgagtgcagtcaccttt

SEQ ID NO: 216152 - DNA, 22 bp, Artificial Sequence
  Synthetic oligonucleotide; CTT chr2 60519473 60519494 60519478 60519473 -
tttcctacgatgttccacaccc

SEQ ID NO: 216153 - DNA, 22 bp, Artificial Sequence
  Synthetic oligonucleotide; TTT chr2 60519472 60519493 60519477 60519472 -
ttcctacgatgttccacaccca

SEQ ID NO: 216154 - DNA, 22 bp, Artificial Sequence
  Synthetic oligonucleotide; TTT chr2 60519471 60519492 60519476 60519471 -
tcctacgatgttccacacccat

SEQ ID NO: 216155 - DNA, 22 bp, Artificial Sequence
  Synthetic oligonucleotide; TTT chr2 60519470 60519491 60519475 60519470 -
cctacgatgttccacacccatc

SEQ ID NO: 216156 - DNA, 22 bp, Artificial Sequence
  Synthetic oligonucleotide; TTC chr2 60519469 60519490 60519474 60519469 -
ctacgatgttccacacccatct

SEQ ID NO: 216157 - DNA, 22 bp, Artificial Sequence
  Synthetic oligonucleotide; CTA chr2 60519466 60519487 60519471 60519466 -
cgatgttccacacccatctctc

SEQ ID NO: 216158 - DNA, 22 bp, Artificial Sequence
  Synthetic oligonucleotide; TTC chr2 60519458 60519479 60519463 60519458 -
cacacccatctctccttacagg

SEQ ID NO: 216159 - DNA, 22 bp, Artificial Sequence
  Synthetic oligonucleotide; CTC chr2 60519446 60519467 60519451 60519446 -
tccttacaggttatagacacat

SEQ ID NO: 216160 - DNA, 22 bp, Artificial Sequence
  Synthetic oligonucleotide; CTC chr2 60519444 60519465 60519449 60519444 -
cttacaggttatagacacattt

SEQ ID NO: 216161 - DNA, 22 bp, Artificial Sequence
  Synthetic oligonucleotide; CTT chr2 60519441 60519462 60519446 60519441 -
acaggttatagacacatttttg

SEQ ID NO: 216162 - DNA, 22 bp, Artificial Sequence
  Synthetic oligonucleotide; TTA chr2 60519440 60519461 60519445 60519440 -
caggttatagacacatttttgg

SEQ ID NO: 216163 - DNA, 22 bp, Artificial Sequence
  Synthetic oligonucleotide; TTA chr2 60519433 60519454 60519438 60519433 -
tagacacatttttggcactgca

SEQ ID NO: 216164 - DNA, 22 bp, Artificial Sequence
  Synthetic oligonucleotide; TTT chr2 60519422 60519443 60519427 60519422 -
ttggcactgcataaagtaagcg

SEQ ID NO: 216165 - DNA, 22 bp, Artificial Sequence
  Synthetic oligonucleotide; TTT chr2 60519421 60519442 60519426 60519421 -
tggcactgcataaagtaagcgt

SEQ ID NO: 216166 - DNA, 22 bp, Artificial Sequence
  Synthetic oligonucleotide; TTT chr2 60519420 60519441 60519425 60519420 -
ggcactgcataaagtaagcgtt

SEQ ID NO: 216167 - DNA, 22 bp, Artificial Sequence
  Synthetic oligonucleotide; TTG chr2 60519419 60519440 60519424 60519419 -
gcactgcataaagtaagcgttc

SEQ ID NO: 216168 - DNA, 22 bp, Artificial Sequence
  Synthetic oligonucleotide; CTG chr2 60519413 60519434 60519418 60519413 -
cataaagtaagcgttccaacat

SEQ ID NO: 216169 - DNA, 22 bp, Artificial Sequence
  Synthetic oligonucleotide; TTC chr2 60519397 60519418 60519402 60519397 -
caacatgtttttaatctttaac

SEQ ID NO: 216170 - DNA, 22 bp, Artificial Sequence
  Synthetic oligonucleotide; TTT chr2 60519387 60519408 60519392 60519387 -
ttaatctttaactttcacatca

SEQ ID NO: 216171 - DNA, 22 bp, Artificial Sequence
  Synthetic oligonucleotide; TTT chr2 60519386 60519407 60519391 60519386 -
taatctttaactttcacatcat

SEQ ID NO: 216172 - DNA, 22 bp, Artificial Sequence
  Synthetic oligonucleotide; TTT chr2 60519385 60519406 60519390 60519385 -
aatctttaactttcacatcatt

SEQ ID NO: 216173 - DNA, 22 bp, Artificial Sequence
  Synthetic oligonucleotide; TTA chr2 60519384 60519405 60519389 60519384 -
atctttaactttcacatcatta

SEQ ID NO: 216174 - DNA, 22 bp, Artificial Sequence
  Synthetic oligonucleotide; CTT chr2 60519379 60519400 60519384 60519379 -
taactttcacatcattaaaaag

SEQ ID NO: 216175 - DNA, 22 bp, Artificial Sequence
  Synthetic oligonucleotide; TTT chr2 60519378 60519399 60519383 60519378 -
aactttcacatcattaaaaagc

SEQ ID NO: 216176 - DNA, 22 bp, Artificial Sequence
  Synthetic oligonucleotide; TTA chr2 60519377 60519398 60519382 60519377 -
actttcacatcattaaaaagct

SEQ ID NO: 216177 - DNA, 22 bp, Artificial Sequence
  Synthetic oligonucleotide; CTT chr2 60519373 60519394 60519378 60519373 -
tcacatcattaaaaagctgatg

SEQ ID NO: 216178 - DNA, 22 bp, Artificial Sequence
  Synthetic oligonucleotide; TTT chr2 60519372 60519393 60519377 60519372 -
cacatcattaaaaagctgatgt

SEQ ID NO: 216179 - DNA, 22 bp, Artificial Sequence
  Synthetic oligonucleotide; TTC chr2 60519371 60519392 60519376 60519371 -
acatcattaaaaagctgatgta

SEQ ID NO: 216180 - DNA, 22 bp, Artificial Sequence
  Synthetic oligonucleotide; TTA chr2 60519362 60519383 60519367 60519362 -
aaaagctgatgtactgactttc

SEQ ID NO: 216181 - DNA, 22 bp, Artificial Sequence
  Synthetic oligonucleotide; CTG chr2 60519354 60519375 60519359 60519354 -
atgtactgactttcagctgcct

SEQ ID NO: 216182 - DNA, 22 bp, Artificial Sequence
  Synthetic oligonucleotide; CTG chr2 60519346 60519367 60519351 60519346 -
actttcagctgcctggagatag

SEQ ID NO: 216183 - DNA, 22 bp, Artificial Sequence
  Synthetic oligonucleotide; CTT chr2 60519342 60519363 60519347 60519342 -
tcagctgcctggagatagttca

SEQ ID NO: 216184 - DNA, 22 bp, Artificial Sequence
  Synthetic oligonucleotide; TTT chr2 60519341 60519362 60519346 60519341 -
cagctgcctggagatagttcag

SEQ ID NO: 216185 - DNA, 22 bp, Artificial Sequence
  Synthetic oligonucleotide; TTC chr2 60519340 60519361 60519345 60519340 -
agctgcctggagatagttcagg

SEQ ID NO: 216186 - DNA, 22 bp, Artificial Sequence
  Synthetic oligonucleotide; CTG chr2 60519335 60519356 60519340 60519335 -
cctggagatagttcagggccca

SEQ ID NO: 216187 - DNA, 22 bp, Artificial Sequence
  Synthetic oligonucleotide; CTG chr2 60519331 60519352 60519336 60519331 -
gagatagttcagggcccagcac

SEQ ID NO: 216188 - DNA, 22 bp, Artificial Sequence
  Synthetic oligonucleotide; TTC chr2 60519321 60519342 60519326 60519321 -
agggcccagcacctgacaggtg

SEQ ID NO: 216189 - DNA, 22 bp, Artificial Sequence
  Synthetic oligonucleotide; CTG chr2 60519306 60519327 60519311 60519306 -
acaggtgtaatgttctgtgttt

SEQ ID NO: 216190 - DNA, 22 bp, Artificial Sequence
  Synthetic oligonucleotide; TTC chr2 60519291 60519312 60519296 60519291 -
tgtgttttatgtctctcaatat

SEQ ID NO: 216191 - DNA, 22 bp, Artificial Sequence
  Synthetic oligonucleotide; CTG chr2 60519289 60519310 60519294 60519289 -
tgttttatgtctctcaatatgg

SEQ ID NO: 216192 - DNA, 22 bp, Artificial Sequence
  Synthetic oligonucleotide; TTT chr2 60519284 60519305 60519289 60519284 -
tatgtctctcaatatggaggtt

SEQ ID NO: 216193 - DNA, 22 bp, Artificial Sequence
  Synthetic oligonucleotide; TTT chr2 60519283 60519304 60519288 60519283 -
atgtctctcaatatggaggtta

SEQ ID NO: 216194 - DNA, 22 bp, Artificial Sequence
  Synthetic oligonucleotide; TTA chr2 60519282 60519303 60519287 60519282 -
tgtctctcaatatggaggttat

SEQ ID NO: 216195 - DNA, 22 bp, Artificial Sequence
  Synthetic oligonucleotide; CTC chr2 60519276 60519297 60519281 60519276 -
tcaatatggaggttatagaatc

SEQ ID NO: 216196 - DNA, 22 bp, Artificial Sequence
  Synthetic oligonucleotide; CTC chr2 60519274 60519295 60519279 60519274 -
aatatggaggttatagaatcaa

SEQ ID NO: 216197 - DNA, 22 bp, Artificial Sequence
  Synthetic oligonucleotide; TTA chr2 60519261 60519282 60519266 60519261 -
tagaatcaaaaagaccgcaaaa

SEQ ID NO: 216198 - DNA, 22 bp, Artificial Sequence
  Synthetic oligonucleotide; CTT chr2 60519233 60519254 60519238 60519233 -
aaaggtgttgatacccatagac

SEQ ID NO: 216199 - DNA, 22 bp, Artificial Sequence
  Synthetic oligonucleotide; TTA chr2 60519232 60519253 60519237 60519232 -
aaggtgttgatacccatagaca

SEQ ID NO: 216200 - DNA, 22 bp, Artificial Sequence
  Synthetic oligonucleotide; TTG chr2 60519223 60519244 60519228 60519223 -
atacccatagacagagcatgca

SEQ ID NO: 216201 - DNA, 22 bp, Artificial Sequence
  Synthetic oligonucleotide; CTC chr2 60519193 60519214 60519198 60519193 -
aggttccctttcttgccccgct

SEQ ID NO: 216202 - DNA, 22 bp, Artificial Sequence
  Synthetic oligonucleotide; TTC chr2 60519187 60519208 60519192 60519187 -
cctttcttgccccgctttcaca

SEQ ID NO: 216203 - DNA, 22 bp, Artificial Sequence
  Synthetic oligonucleotide; CTT chr2 60519183 60519204 60519188 60519183 -
tcttgccccgctttcacaccta

SEQ ID NO: 216204 - DNA, 22 bp, Artificial Sequence
  Synthetic oligonucleotide; TTT chr2 60519182 60519203 60519187 60519182 -
cttgccccgctttcacacctat

SEQ ID NO: 216205 - DNA, 22 bp, Artificial Sequence
  Synthetic oligonucleotide; TTC chr2 60519181 60519202 60519186 60519181 -
ttgccccgctttcacacctatt

SEQ ID NO: 216206 - DNA, 22 bp, Artificial Sequence
  Synthetic oligonucleotide; CTT chr2 60519179 60519200 60519184 60519179 -
gccccgctttcacacctatttc

SEQ ID NO: 216207 - DNA, 22 bp, Artificial Sequence
  Synthetic oligonucleotide; TTG chr2 60519178 60519199 60519183 60519178 -
ccccgctttcacacctatttct

SEQ ID NO: 216208 - DNA, 22 bp, Artificial Sequence
  Synthetic oligonucleotide; CTT chr2 60519170 60519191 60519175 60519170 -
tcacacctatttctttttttgt

SEQ ID NO: 216209 - DNA, 22 bp, Artificial Sequence
  Synthetic oligonucleotide; TTT chr2 60519169 60519190 60519174 60519169 -
cacacctatttctttttttgta

SEQ ID NO: 216210 - DNA, 22 bp, Artificial Sequence
  Synthetic oligonucleotide; TTC chr2 60519168 60519189 60519173 60519168 -
acacctatttctttttttgtag

SEQ ID NO: 216211 - DNA, 22 bp, Artificial Sequence
  Synthetic oligonucleotide; CTA chr2 60519161 60519182 60519166 60519161 -
tttctttttttgtagcgcctgt

SEQ ID NO: 216212 - DNA, 22 bp, Artificial Sequence
  Synthetic oligonucleotide; TTT chr2 60519158 60519179 60519163 60519158 -
ctttttttgtagcgcctgtatt

SEQ ID NO: 216213 - DNA, 22 bp, Artificial Sequence
  Synthetic oligonucleotide; TTC chr2 60519157 60519178 60519162 60519157 -
tttttttgtagcgcctgtattt

SEQ ID NO: 216214 - DNA, 22 bp, Artificial Sequence
  Synthetic oligonucleotide; CTT chr2 60519155 60519176 60519160 60519155 -
tttttgtagcgcctgtatttga

SEQ ID NO: 216215 - DNA, 22 bp, Artificial Sequence
  Synthetic oligonucleotide; TTT chr2 60519154 60519175 60519159 60519154 -
ttttgtagcgcctgtatttgaa

SEQ ID NO: 216216 - DNA, 22 bp, Artificial Sequence
  Synthetic oligonucleotide; TTT chr2 60519153 60519174 60519158 60519153 -
tttgtagcgcctgtatttgaaa

SEQ ID NO: 216217 - DNA, 22 bp, Artificial Sequence
  Synthetic oligonucleotide; TTT chr2 60519152 60519173 60519157 60519152 -
ttgtagcgcctgtatttgaaag

SEQ ID NO: 216218 - DNA, 22 bp, Artificial Sequence
  Synthetic oligonucleotide; TTT chr2 60519151 60519172 60519156 60519151 -
tgtagcgcctgtatttgaaagg

SEQ ID NO: 216219 - DNA, 22 bp, Artificial Sequence
  Synthetic oligonucleotide; TTT chr2 60519150 60519171 60519155 60519150 -
gtagcgcctgtatttgaaaggg

SEQ ID NO: 216220 - DNA, 22 bp, Artificial Sequence
  Synthetic oligonucleotide; TTG chr2 60519149 60519170 60519154 60519149 -
tagcgcctgtatttgaaagggg

SEQ ID NO: 216221 - DNA, 22 bp, Artificial Sequence
  Synthetic oligonucleotide; CTG chr2 60519140 60519161 60519145 60519140 -
tatttgaaaggggttcctggtg

SEQ ID NO: 216222 - DNA, 22 bp, Artificial Sequence
  Synthetic oligonucleotide; TTT chr2 60519135 60519156 60519140 60519135 -
gaaaggggttcctggtgtactt

SEQ ID NO: 216223 - DNA, 22 bp, Artificial Sequence
  Synthetic oligonucleotide; TTG chr2 60519134 60519155 60519139 60519134 -
aaaggggttcctggtgtacttg

SEQ ID NO: 216224 - DNA, 22 bp, Artificial Sequence
  Synthetic oligonucleotide; TTC chr2 60519124 60519145 60519129 60519124 -
ctggtgtacttgggagaaaaga

SEQ ID NO: 216225 - DNA, 22 bp, Artificial Sequence
  Synthetic oligonucleotide; CTG chr2 60519121 60519142 60519126 60519121 -
gtgtacttgggagaaaagaagc

SEQ ID NO: 216226 - DNA, 22 bp, Artificial Sequence
  Synthetic oligonucleotide; CTT chr2 60519113 60519134 60519118 60519113 -
gggagaaaagaagcttcttggt

SEQ ID NO: 216227 - DNA, 22 bp, Artificial Sequence
  Synthetic oligonucleotide; TTG chr2 60519112 60519133 60519117 60519112 -
ggagaaaagaagcttcttggtt

SEQ ID NO: 216228 - DNA, 22 bp, Artificial Sequence
  Synthetic oligonucleotide; CTT chr2 60519097 60519118 60519102 60519097 -
cttggtttggtagtacctacca

SEQ ID NO: 216229 - DNA, 22 bp, Artificial Sequence
  Synthetic oligonucleotide; TTC chr2 60519096 60519117 60519101 60519096 -
ttggtttggtagtacctaccag

SEQ ID NO: 216230 - DNA, 22 bp, Artificial Sequence
  Synthetic oligonucleotide; CTT chr2 60519094 60519115 60519099 60519094 -
ggtttggtagtacctaccagag

SEQ ID NO: 216231 - DNA, 22 bp, Artificial Sequence
  Synthetic oligonucleotide; TTG chr2 60519093 60519114 60519098 60519093 -
gtttggtagtacctaccagaga

SEQ ID NO: 216232 - DNA, 22 bp, Artificial Sequence
  Synthetic oligonucleotide; TTT chr2 60519089 60519110 60519094 60519089 -
ggtagtacctaccagagactcc

SEQ ID NO: 216233 - DNA, 22 bp, Artificial Sequence
  Synthetic oligonucleotide; TTG chr2 60519088 60519109 60519093 60519088 -
gtagtacctaccagagactccc

SEQ ID NO: 216234 - DNA, 22 bp, Artificial Sequence
  Synthetic oligonucleotide; CTA chr2 60519078 60519099 60519083 60519078 -
ccagagactccctgtttcctgc

SEQ ID NO: 216235 - DNA, 22 bp, Artificial Sequence
  Synthetic oligonucleotide; CTC chr2 60519068 60519089 60519073 60519068 -
cctgtttcctgctggtatcagg

SEQ ID NO: 216236 - DNA, 22 bp, Artificial Sequence
  Synthetic oligonucleotide; CTG chr2 60519064 60519085 60519069 60519064 -
tttcctgctggtatcaggattg

SEQ ID NO: 216237 - DNA, 22 bp, Artificial Sequence
  Synthetic oligonucleotide; TTT chr2 60519061 60519082 60519066 60519061 -
cctgctggtatcaggattgaaa

SEQ ID NO: 216238 - DNA, 22 bp, Artificial Sequence
  Synthetic oligonucleotide; TTC chr2 60519060 60519081 60519065 60519060 -
ctgctggtatcaggattgaaaa

SEQ ID NO: 216239 - DNA, 22 bp, Artificial Sequence
  Synthetic oligonucleotide; CTG chr2 60519057 60519078 60519062 60519057 -
ctggtatcaggattgaaaaatc

SEQ ID NO: 216240 - DNA, 22 bp, Artificial Sequence
  Synthetic oligonucleotide; CTG chr2 60519054 60519075 60519059 60519054 -
gtatcaggattgaaaaatccca

SEQ ID NO: 216241 - DNA, 22 bp, Artificial Sequence
  Synthetic oligonucleotide; TTG chr2 60519042 60519063 60519047 60519042 -
aaaaatcccacttctgtccatt

SEQ ID NO: 216242 - DNA, 22 bp, Artificial Sequence
  Synthetic oligonucleotide; CTT chr2 60519029 60519050 60519034 60519029 -
ctgtccattttctctcaagagt

SEQ ID NO: 216243 - DNA, 22 bp, Artificial Sequence
  Synthetic oligonucleotide; TTC chr2 60519028 60519049 60519033 60519028 -
tgtccattttctctcaagagtt

SEQ ID NO: 216244 - DNA, 22 bp, Artificial Sequence
  Synthetic oligonucleotide; CTG chr2 60519026 60519047 60519031 60519026 -
tccattttctctcaagagttga

SEQ ID NO: 216245 - DNA, 22 bp, Artificial Sequence
  Synthetic oligonucleotide; TTT chr2 60519019 60519040 60519024 60519019 -
tctctcaagagttgagagatgt

SEQ ID NO: 216246 - DNA, 22 bp, Artificial Sequence
  Synthetic oligonucleotide; TTT chr2 60519018 60519039 60519023 60519018 -
ctctcaagagttgagagatgtg

SEQ ID NO: 216247 - DNA, 22 bp, Artificial Sequence
  Synthetic oligonucleotide; TTC chr2 60519017 60519038 60519022 60519017 -
tctcaagagttgagagatgtgt

SEQ ID NO: 216248 - DNA, 22 bp, Artificial Sequence
  Synthetic oligonucleotide; CTC chr2 60519015 60519036 60519020 60519015 -
tcaagagttgagagatgtgtgc

SEQ ID NO: 216249 - DNA, 22 bp, Artificial Sequence
  Synthetic oligonucleotide; CTC chr2 60519013 60519034 60519018 60519013 -
aagagttgagagatgtgtgcca

SEQ ID NO: 216250 - DNA, 22 bp, Artificial Sequence
  Synthetic oligonucleotide; TTG chr2 60519005 60519026 60519010 60519005 -
agagatgtgtgccatcgctctt

SEQ ID NO: 216251 - DNA, 22 bp, Artificial Sequence
  Synthetic oligonucleotide; CTC chr2 60518985 60519006 60518990 60518985 -
tttaaaagaaggaactctcctt

SEQ ID NO: 216252 - DNA, 22 bp, Artificial Sequence
  Synthetic oligonucleotide; CTT chr2 60518983 60519004 60518988 60518983 -
taaaagaaggaactctcctttt

SEQ ID NO: 216253 - DNA, 22 bp, Artificial Sequence
  Synthetic oligonucleotide; TTT chr2 60518982 60519003 60518987 60518982 -
aaaagaaggaactctccttttg

SEQ ID NO: 216254 - DNA, 22 bp, Artificial Sequence
  Synthetic oligonucleotide; TTA chr2 60518981 60519002 60518986 60518981 -
aaagaaggaactctccttttgc

SEQ ID NO: 216255 - DNA, 22 bp, Artificial Sequence
  Synthetic oligonucleotide; CTC chr2 60518968 60518989 60518973 60518968 -
tccttttgctgtggattgtagg

SEQ ID NO: 216256 - DNA, 22 bp, Artificial Sequence
  Synthetic oligonucleotide; CTC chr2 60518966 60518987 60518971 60518966 -
cttttgctgtggattgtaggga

SEQ ID NO: 216257 - DNA, 22 bp, Artificial Sequence
  Synthetic oligonucleotide; CTT chr2 60518963 60518984 60518968 60518963 -
ttgctgtggattgtagggagca

SEQ ID NO: 216258 - DNA, 22 bp, Artificial Sequence
  Synthetic oligonucleotide; TTT chr2 60518962 60518983 60518967 60518962 -
tgctgtggattgtagggagcag

SEQ ID NO: 216259 - DNA, 22 bp, Artificial Sequence
  Synthetic oligonucleotide; TTT chr2 60518961 60518982 60518966 60518961 -
gctgtggattgtagggagcaga

SEQ ID NO: 216260 - DNA, 22 bp, Artificial Sequence
  Synthetic oligonucleotide; TTG chr2 60518960 60518981 60518965 60518960 -
ctgtggattgtagggagcagat

SEQ ID NO: 216261 - DNA, 22 bp, Artificial Sequence
  Synthetic oligonucleotide; CTG chr2 60518957 60518978 60518962 60518957 -
tggattgtagggagcagatttg

SEQ ID NO: 216262 - DNA, 22 bp, Artificial Sequence
  Synthetic oligonucleotide; TTG chr2 60518950 60518971 60518955 60518950 -
tagggagcagatttggtgctta

SEQ ID NO: 216263 - DNA, 22 bp, Artificial Sequence
  Synthetic oligonucleotide; TTT chr2 60518936 60518957 60518941 60518936 -
ggtgcttactgtggcttcagga

SEQ ID NO: 216264 - DNA, 22 bp, Artificial Sequence
  Synthetic oligonucleotide; TTG chr2 60518935 60518956 60518940 60518935 -
gtgcttactgtggcttcaggac

SEQ ID NO: 216265 - DNA, 22 bp, Artificial Sequence
  Synthetic oligonucleotide; CTT chr2 60518929 60518950 60518934 60518929 -
actgtggcttcaggacccacct

SEQ ID NO: 216266 - DNA, 22 bp, Artificial Sequence
  Synthetic oligonucleotide; TTA chr2 60518928 60518949 60518933 60518928 -
ctgtggcttcaggacccacctt

SEQ ID NO: 216267 - DNA, 22 bp, Artificial Sequence
  Synthetic oligonucleotide; CTG chr2 60518925 60518946 60518930 60518925 -
tggcttcaggacccaccttgaa

SEQ ID NO: 216268 - DNA, 22 bp, Artificial Sequence
  Synthetic oligonucleotide; CTT chr2 60518919 60518940 60518924 60518919 -
caggacccaccttgaatgacag

SEQ ID NO: 216269 - DNA, 22 bp, Artificial Sequence
  Synthetic oligonucleotide; TTC chr2 60518918 60518939 60518923 60518918 -
aggacccaccttgaatgacaga

SEQ ID NO: 216270 - DNA, 22 bp, Artificial Sequence
  Synthetic oligonucleotide; CTT chr2 60518906 60518927 60518911 60518906 -
gaatgacagaatgtcagtaaca

SEQ ID NO: 216271 - DNA, 22 bp, Artificial Sequence
  Synthetic oligonucleotide; TTG chr2 60518905 60518926 60518910 60518905 -
aatgacagaatgtcagtaacaa

SEQ ID NO: 216272 - DNA, 22 bp, Artificial Sequence
  Synthetic oligonucleotide; CTG chr2 60518861 60518882 60518866 60518861 -
gtggtgaacgactgcctcttga

SEQ ID NO: 216273 - DNA, 22 bp, Artificial Sequence
  Synthetic oligonucleotide; CTG chr2 60518847 60518868 60518852 60518847 -
cctcttgatctttgcccatcga

SEQ ID NO: 216274 - DNA, 22 bp, Artificial Sequence
  Synthetic oligonucleotide; CTC chr2 60518843 60518864 60518848 60518843 -
ttgatctttgcccatcgagcaa

SEQ ID NO: 216275 - DNA, 22 bp, Artificial Sequence
  Synthetic oligonucleotide; CTT chr2 60518841 60518862 60518846 60518841 -
gatctttgcccatcgagcaaca

SEQ ID NO: 216276 - DNA, 22 bp, Artificial Sequence
  Synthetic oligonucleotide; TTG chr2 60518840 60518861 60518845 60518840 -
atctttgcccatcgagcaacac

SEQ ID NO: 216277 - DNA, 22 bp, Artificial Sequence
  Synthetic oligonucleotide; CTT chr2 60518835 60518856 60518840 60518835 -
tgcccatcgagcaacaccatgt

SEQ ID NO: 216278 - DNA, 22 bp, Artificial Sequence
  Synthetic oligonucleotide; TTT chr2 60518834 60518855 60518839 60518834 -
gcccatcgagcaacaccatgtg

SEQ ID NO: 216279 - DNA, 22 bp, Artificial Sequence
  Synthetic oligonucleotide; TTG chr2 60518833 60518854 60518838 60518833 -
cccatcgagcaacaccatgtgg

SEQ ID NO: 216280 - DNA, 22 bp, Artificial Sequence
  Synthetic oligonucleotide; CTT chr2 60518793 60518814 60518798 60518793 -
gacctgaacttgaacagtaatt

SEQ ID NO: 216281 - DNA, 22 bp, Artificial Sequence
  Synthetic oligonucleotide; TTG chr2 60518792 60518813 60518797 60518792 -
acctgaacttgaacagtaattg

SEQ ID NO: 216282 - DNA, 22 bp, Artificial Sequence
  Synthetic oligonucleotide; CTG chr2 60518787 60518808 60518792 60518787 -
aacttgaacagtaattgatgag

SEQ ID NO: 216283 - DNA, 22 bp, Artificial Sequence
  Synthetic oligonucleotide; CTT chr2 60518782 60518803 60518787 60518782 -
gaacagtaattgatgagtcctt

SEQ ID NO: 216284 - DNA, 22 bp, Artificial Sequence
  Synthetic oligonucleotide; TTG chr2 60518781 60518802 60518786 60518781 -
aacagtaattgatgagtcctta

SEQ ID NO: 216285 - DNA, 22 bp, Artificial Sequence
  Synthetic oligonucleotide; TTG chr2 60518770 60518791 60518775 60518770 -
atgagtccttaaaatccacgcc

SEQ ID NO: 216286 - DNA, 22 bp, Artificial Sequence
  Synthetic oligonucleotide; CTT chr2 60518760 60518781 60518765 60518760 -
aaaatccacgcccggcccccag

SEQ ID NO: 216287 - DNA, 22 bp, Artificial Sequence
  Synthetic oligonucleotide; TTA chr2 60518759 60518780 60518764 60518759 -
aaatccacgcccggcccccagg

SEQ ID NO: 216288 - DNA, 22 bp, Artificial Sequence
  Synthetic oligonucleotide; CTT chr2 60518729 60518750 60518734 60518729 -
ggggcaccccatcccacgttct

SEQ ID NO: 216289 - DNA, 22 bp, Artificial Sequence
  Synthetic oligonucleotide; TTG chr2 60518728 60518749 60518733 60518728 -
gggcaccccatcccacgttctg

SEQ ID NO: 216290 - DNA, 22 bp, Artificial Sequence
  Synthetic oligonucleotide; TTC chr2 60518708 60518729 60518713 60518708 -
tgattctggatggacttttaag

SEQ ID NO: 216291 - DNA, 22 bp, Artificial Sequence
  Synthetic oligonucleotide; CTG chr2 60518706 60518727 60518711 60518706 -
attctggatggacttttaagtg

SEQ ID NO: 216292 - DNA, 22 bp, Artificial Sequence
  Synthetic oligonucleotide; TTC chr2 60518702 60518723 60518707 60518702 -
tggatggacttttaagtgaact

SEQ ID NO: 216293 - DNA, 22 bp, Artificial Sequence
  Synthetic oligonucleotide; CTG chr2 60518700 60518721 60518705 60518700 -
gatggacttttaagtgaactct

SEQ ID NO: 216294 - DNA, 22 bp, Artificial Sequence
  Synthetic oligonucleotide; CTT chr2 60518691 60518712 60518696 60518691 -
ttaagtgaactctgatgatgag

SEQ ID NO: 216295 - DNA, 22 bp, Artificial Sequence
  Synthetic oligonucleotide; TTT chr2 60518690 60518711 60518695 60518690 -
taagtgaactctgatgatgagt

SEQ ID NO: 216296 - DNA, 22 bp, Artificial Sequence
  Synthetic oligonucleotide; TTT chr2 60518689 60518710 60518694 60518689 -
aagtgaactctgatgatgagta

SEQ ID NO: 216297 - DNA, 22 bp, Artificial Sequence
  Synthetic oligonucleotide; TTA chr2 60518688 60518709 60518693 60518688 -
agtgaactctgatgatgagtag

SEQ ID NO: 216298 - DNA, 22 bp, Artificial Sequence
  Synthetic oligonucleotide; CTC chr2 60518679 60518700 60518684 60518679 -
tgatgatgagtaggctcttaaa

SEQ ID NO: 216299 - DNA, 22 bp, Artificial Sequence
  Synthetic oligonucleotide; CTG chr2 60518677 60518698 60518682 60518677 -
atgatgagtaggctcttaaaac

SEQ ID NO: 216300 - DNA, 22 bp, Artificial Sequence
  Synthetic oligonucleotide; CTC chr2 60518662 60518683 60518667 60518662 -
ttaaaactctttctcaacgttc

SEQ ID NO: 216301 - DNA, 22 bp, Artificial Sequence
  Synthetic oligonucleotide; CTT chr2 60518660 60518681 60518665 60518660 -
aaaactctttctcaacgttctc

SEQ ID NO: 216302 - DNA, 22 bp, Artificial Sequence
  Synthetic oligonucleotide; TTA chr2 60518659 60518680 60518664 60518659 -
aaactctttctcaacgttctct

SEQ ID NO: 216303 - DNA, 22 bp, Artificial Sequence
  Synthetic oligonucleotide; CTC chr2 60518653 60518674 60518658 60518653 -
tttctcaacgttctctgctggg

SEQ ID NO: 216304 - DNA, 22 bp, Artificial Sequence
  Synthetic oligonucleotide; CTT chr2 60518651 60518672 60518656 60518651 -
tctcaacgttctctgctgggtt

SEQ ID NO: 216305 - DNA, 22 bp, Artificial Sequence
  Synthetic oligonucleotide; TTT chr2 60518650 60518671 60518655 60518650 -
ctcaacgttctctgctgggttt

SEQ ID NO: 216306 - DNA, 22 bp, Artificial Sequence
  Synthetic oligonucleotide; TTC chr2 60518649 60518670 60518654 60518649 -
tcaacgttctctgctgggtttg

SEQ ID NO: 216307 - DNA, 22 bp, Artificial Sequence
  Synthetic oligonucleotide; CTC chr2 60518647 60518668 60518652 60518647 -
aacgttctctgctgggtttgtg

SEQ ID NO: 216308 - DNA, 22 bp, Artificial Sequence
  Synthetic oligonucleotide; TTC chr2 60518640 60518661 60518645 60518640 -
tctgctgggtttgtgtgtcacc

SEQ ID NO: 216309 - DNA, 22 bp, Artificial Sequence
  Synthetic oligonucleotide; CTC chr2 60518638 60518659 60518643 60518638 -
tgctgggtttgtgtgtcacctc

SEQ ID NO: 216310 - DNA, 22 bp, Artificial Sequence
  Synthetic oligonucleotide; CTG chr2 60518636 60518657 60518641 60518636 -
ctgggtttgtgtgtcacctccc

SEQ ID NO: 216311 - DNA, 22 bp, Artificial Sequence
  Synthetic oligonucleotide; CTG chr2 60518633 60518654 60518638 60518633 -
ggtttgtgtgtcacctcccatg

SEQ ID NO: 216312 - DNA, 22 bp, Artificial Sequence
  Synthetic oligonucleotide; TTT chr2 60518628 60518649 60518633 60518628 -
gtgtgtcacctcccatgccctc

SEQ ID NO: 216313 - DNA, 22 bp, Artificial Sequence
  Synthetic oligonucleotide; TTG chr2 60518627 60518648 60518632 60518627 -
tgtgtcacctcccatgccctct

SEQ ID NO: 216314 - DNA, 22 bp, Artificial Sequence
  Synthetic oligonucleotide; CTC chr2 60518616 60518637 60518621 60518616 -
ccatgccctctctggtgtgtgg

SEQ ID NO: 216315 - DNA, 22 bp, Artificial Sequence
  Synthetic oligonucleotide; CTC chr2 60518606 60518627 60518611 60518606 -
tctggtgtgtggtgattctcag

SEQ ID NO: 216316 - DNA, 22 bp, Artificial Sequence
  Synthetic oligonucleotide; CTC chr2 60518604 60518625 60518609 60518604 -
tggtgtgtggtgattctcagat

SEQ ID NO: 216317 - DNA, 22 bp, Artificial Sequence
  Synthetic oligonucleotide; CTG chr2 60518602 60518623 60518607 60518602 -
gtgtgtggtgattctcagatct

SEQ ID NO: 216318 - DNA, 22 bp, Artificial Sequence
  Synthetic oligonucleotide; TTC chr2 60518588 60518609 60518593 60518588 -
tcagatctagagcaatgcttcc

SEQ ID NO: 216319 - DNA, 22 bp, Artificial Sequence
  Synthetic oligonucleotide; CTC chr2 60518586 60518607 60518591 60518586 -
agatctagagcaatgcttcctg

SEQ ID NO: 216320 - DNA, 22 bp, Artificial Sequence
  Synthetic oligonucleotide; CTA chr2 60518579 60518600 60518584 60518579 -
gagcaatgcttcctgccttgtc

SEQ ID NO: 216321 - DNA, 22 bp, Artificial Sequence
  Synthetic oligonucleotide; CTT chr2 60518568 60518589 60518573 60518568 -
cctgccttgtccccccatgcct

SEQ ID NO: 216322 - DNA, 22 bp, Artificial Sequence
  Synthetic oligonucleotide; TTC chr2 60518567 60518588 60518572 60518567 -
ctgccttgtccccccatgcctt

SEQ ID NO: 216323 - DNA, 22 bp, Artificial Sequence
  Synthetic oligonucleotide; CTG chr2 60518564 60518585 60518569 60518564 -
ccttgtccccccatgcctttgc

SEQ ID NO: 216324 - DNA, 22 bp, Artificial Sequence
  Synthetic oligonucleotide; CTT chr2 60518560 60518581 60518565 60518560 -
gtccccccatgcctttgcgtgt

SEQ ID NO: 216325 - DNA, 22 bp, Artificial Sequence
  Synthetic oligonucleotide; TTG chr2 60518559 60518580 60518564 60518559 -
tccccccatgcctttgcgtgtg

SEQ ID NO: 216326 - DNA, 22 bp, Artificial Sequence
  Synthetic oligonucleotide; CTT chr2 60518545 60518566 60518550 60518545 -
tgcgtgtgggaagctaaaattc

SEQ ID NO: 216327 - DNA, 22 bp, Artificial Sequence
  Synthetic oligonucleotide; TTT chr2 60518544 60518565 60518549 60518544 -
gcgtgtgggaagctaaaattca

SEQ ID NO: 216328 - DNA, 22 bp, Artificial Sequence
  Synthetic oligonucleotide; TTG chr2 60518543 60518564 60518548 60518543 -
cgtgtgggaagctaaaattcac

SEQ ID NO: 216329 - DNA, 22 bp, Artificial Sequence
  Synthetic oligonucleotide; CTA chr2 60518529 60518550 60518534 60518529 -
aaattcacatgtgcgatgccct

SEQ ID NO: 216330 - DNA, 22 bp, Artificial Sequence
  Synthetic oligonucleotide; TTC chr2 60518523 60518544 60518528 60518523 -
acatgtgcgatgccctcccatg

SEQ ID NO: 216331 - DNA, 22 bp, Artificial Sequence
  Synthetic oligonucleotide; CTC chr2 60518506 60518527 60518511 60518506 -
ccatgtgccatttttacctggt

SEQ ID NO: 216332 - DNA, 22 bp, Artificial Sequence
  Synthetic oligonucleotide; TTT chr2 60518493 60518514 60518498 60518493 -
ttacctggtcccttctgctcac

SEQ ID NO: 216333 - DNA, 22 bp, Artificial Sequence
  Synthetic oligonucleotide; TTT chr2 60518492 60518513 60518497 60518492 -
tacctggtcccttctgctcact

SEQ ID NO: 216334 - DNA, 22 bp, Artificial Sequence
  Synthetic oligonucleotide; TTT chr2 60518491 60518512 60518496 60518491 -
acctggtcccttctgctcactc

SEQ ID NO: 216335 - DNA, 22 bp, Artificial Sequence
  Synthetic oligonucleotide; TTA chr2 60518490 60518511 60518495 60518490 -
cctggtcccttctgctcactct

SEQ ID NO: 216336 - DNA, 22 bp, Artificial Sequence
  Synthetic oligonucleotide; CTG chr2 60518486 60518507 60518491 60518486 -
gtcccttctgctcactctttat

SEQ ID NO: 216337 - DNA, 22 bp, Artificial Sequence
  Synthetic oligonucleotide; CTT chr2 60518479 60518500 60518484 60518479 -
ctgctcactctttattcatatt

SEQ ID NO: 216338 - DNA, 22 bp, Artificial Sequence
  Synthetic oligonucleotide; TTC chr2 60518478 60518499 60518483 60518478 -
tgctcactctttattcatattt

SEQ ID NO: 216339 - DNA, 22 bp, Artificial Sequence
  Synthetic oligonucleotide; CTG chr2 60518476 60518497 60518481 60518476 -
ctcactctttattcatatttaa

SEQ ID NO: 216340 - DNA, 22 bp, Artificial Sequence
  Synthetic oligonucleotide; CTC chr2 60518473 60518494 60518478 60518473 -
actctttattcatatttaaatg

SEQ ID NO: 216341 - DNA, 22 bp, Artificial Sequence
  Synthetic oligonucleotide; CTC chr2 60518469 60518490 60518474 60518469 -
tttattcatatttaaatgcagg

SEQ ID NO: 216342 - DNA, 22 bp, Artificial Sequence
  Synthetic oligonucleotide; CTT chr2 60518467 60518488 60518472 60518467 -
tattcatatttaaatgcaggtg

SEQ ID NO: 216343 - DNA, 22 bp, Artificial Sequence
  Synthetic oligonucleotide; TTT chr2 60518466 60518487 60518471 60518466 -
attcatatttaaatgcaggtga

SEQ ID NO: 216344 - DNA, 22 bp, Artificial Sequence
  Synthetic oligonucleotide; TTA chr2 60518465 60518486 60518470 60518465 -
ttcatatttaaatgcaggtgag

SEQ ID NO: 216345 - DNA, 22 bp, Artificial Sequence
  Synthetic oligonucleotide; TTC chr2 60518462 60518483 60518467 60518462 -
atatttaaatgcaggtgagttg

SEQ ID NO: 216346 - DNA, 22 bp, Artificial Sequence
  Synthetic oligonucleotide; TTT chr2 60518456 60518477 60518461 60518456 -
aaatgcaggtgagttggaatgt

SEQ ID NO: 216347 - DNA, 22 bp, Artificial Sequence
  Synthetic oligonucleotide; TTA chr2 60518455 60518476 60518460 60518455 -
aatgcaggtgagttggaatgtc

SEQ ID NO: 216348 - DNA, 22 bp, Artificial Sequence
  Synthetic oligonucleotide; TTG chr2 60518440 60518461 60518445 60518440 -
gaatgtcatcttacaggcataa

SEQ ID NO: 216349 - DNA, 22 bp, Artificial Sequence
  Synthetic oligonucleotide; CTT chr2 60518428 60518449 60518433 60518428 -
acaggcataatcctgaatctgc

SEQ ID NO: 216350 - DNA, 22 bp, Artificial Sequence
  Synthetic oligonucleotide; TTA chr2 60518427 60518448 60518432 60518427 -
caggcataatcctgaatctgct

SEQ ID NO: 216351 - DNA, 22 bp, Artificial Sequence
  Synthetic oligonucleotide; CTG chr2 60518413 60518434 60518418 60518413 -
aatctgctctatcgcagacatt

SEQ ID NO: 216352 - DNA, 22 bp, Artificial Sequence
  Synthetic oligonucleotide; CTG chr2 60518407 60518428 60518412 60518407 -
ctctatcgcagacattttaaaa

SEQ ID NO: 216353 - DNA, 22 bp, Artificial Sequence
  Synthetic oligonucleotide; CTC chr2 60518404 60518425 60518409 60518404 -
tatcgcagacattttaaaacta

SEQ ID NO: 216354 - DNA, 22 bp, Artificial Sequence
  Synthetic oligonucleotide; CTA chr2 60518402 60518423 60518407 60518402 -
tcgcagacattttaaaactaaa

SEQ ID NO: 216355 - DNA, 22 bp, Artificial Sequence
  Synthetic oligonucleotide; TTT chr2 60518390 60518411 60518395 60518390 -
taaaactaaattaaatgttagt

SEQ ID NO: 216356 - DNA, 22 bp, Artificial Sequence
  Synthetic oligonucleotide; TTT chr2 60518389 60518410 60518394 60518389 -
aaaactaaattaaatgttagta

SEQ ID NO: 216357 - DNA, 22 bp, Artificial Sequence
  Synthetic oligonucleotide; TTA chr2 60518388 60518409 60518393 60518388 -
aaactaaattaaatgttagtac

SEQ ID NO: 216358 - DNA, 22 bp, Artificial Sequence
  Synthetic oligonucleotide; CTA chr2 60518382 60518403 60518387 60518382 -
aattaaatgttagtactaagta

SEQ ID NO: 216359 - DNA, 22 bp, Artificial Sequence
  Synthetic oligonucleotide; TTA chr2 60518377 60518398 60518382 60518377 -
aatgttagtactaagtagtagc

SEQ ID NO: 216360 - DNA, 22 bp, Artificial Sequence
  Synthetic oligonucleotide; TTA chr2 60518370 60518391 60518375 60518370 -
gtactaagtagtagccaaattc

SEQ ID NO: 216361 - DNA, 22 bp, Artificial Sequence
  Synthetic oligonucleotide; CTA chr2 60518364 60518385 60518369 60518364 -
agtagtagccaaattctctgag

SEQ ID NO: 216362 - DNA, 22 bp, Artificial Sequence
  Synthetic oligonucleotide; TTC chr2 60518348 60518369 60518353 60518348 -
tctgagtctgcttcatgacagg

SEQ ID NO: 216363 - DNA, 22 bp, Artificial Sequence
  Synthetic oligonucleotide; CTC chr2 60518346 60518367 60518351 60518346 -
tgagtctgcttcatgacaggct

SEQ ID NO: 216364 - DNA, 22 bp, Artificial Sequence
  Synthetic oligonucleotide; CTG chr2 60518344 60518365 60518349 60518344 -
agtctgcttcatgacaggctgt

SEQ ID NO: 216365 - DNA, 22 bp, Artificial Sequence
  Synthetic oligonucleotide; CTG chr2 60518338 60518359 60518343 60518338 -
cttcatgacaggctgtaacaca

SEQ ID NO: 216366 - DNA, 22 bp, Artificial Sequence
  Synthetic oligonucleotide; CTT chr2 60518335 60518356 60518340 60518335 -
catgacaggctgtaacacactg

SEQ ID NO: 216367 - DNA, 22 bp, Artificial Sequence
  Synthetic oligonucleotide; TTC chr2 60518334 60518355 60518339 60518334 -
atgacaggctgtaacacactgg

SEQ ID NO: 216368 - DNA, 22 bp, Artificial Sequence
  Synthetic oligonucleotide; CTG chr2 60518323 60518344 60518328 60518323 -
taacacactggtatggaacggt

SEQ ID NO: 216369 - DNA, 22 bp, Artificial Sequence
  Synthetic oligonucleotide; CTG chr2 60518313 60518334 60518318 60518313 -
gtatggaacggtaggtctaatc

SEQ ID NO: 216370 - DNA, 22 bp, Artificial Sequence
  Synthetic oligonucleotide; CTA chr2 60518294 60518315 60518299 60518294 -
atcctgtgactcctttatctat

SEQ ID NO: 216371 - DNA, 22 bp, Artificial Sequence
  Synthetic oligonucleotide; CTG chr2 60518288 60518309 60518293 60518288 -
tgactcctttatctatgatgtt

SEQ ID NO: 216372 - DNA, 22 bp, Artificial Sequence
  Synthetic oligonucleotide; CTC chr2 60518282 60518303 60518287 60518282 -
ctttatctatgatgttttatgt

SEQ ID NO: 216373 - DNA, 22 bp, Artificial Sequence
  Synthetic oligonucleotide; CTT chr2 60518279 60518300 60518284 60518279 -
tatctatgatgttttatgtatt

SEQ ID NO: 216374 - DNA, 22 bp, Artificial Sequence
  Synthetic oligonucleotide; TTT chr2 60518278 60518299 60518283 60518278 -
atctatgatgttttatgtatta

SEQ ID NO: 216375 - DNA, 22 bp, Artificial Sequence
  Synthetic oligonucleotide; TTA chr2 60518277 60518298 60518282 60518277 -
tctatgatgttttatgtattat

SEQ ID NO: 216376 - DNA, 22 bp, Artificial Sequence
  Synthetic oligonucleotide; CTA chr2 60518273 60518294 60518278 60518273 -
tgatgttttatgtattatgaga

SEQ ID NO: 216377 - DNA, 22 bp, Artificial Sequence
  Synthetic oligonucleotide; TTT chr2 60518265 60518286 60518270 60518265 -
tatgtattatgagagctcagca

SEQ ID NO: 216378 - DNA, 22 bp, Artificial Sequence
  Synthetic oligonucleotide; TTT chr2 60518264 60518285 60518269 60518264 -
atgtattatgagagctcagcag

SEQ ID NO: 216379 - DNA, 22 bp, Artificial Sequence
  Synthetic oligonucleotide; TTA chr2 60518263 60518284 60518268 60518263 -
tgtattatgagagctcagcaga

SEQ ID NO: 216380 - DNA, 22 bp, Artificial Sequence
  Synthetic oligonucleotide; TTA chr2 60518256 60518277 60518261 60518256 -
tgagagctcagcagatgttgac

SEQ ID NO: 216381 - DNA, 22 bp, Artificial Sequence
  Synthetic oligonucleotide; CTC chr2 60518247 60518268 60518252 60518247 -
agcagatgttgacagagggaat

SEQ ID NO: 216382 - DNA, 22 bp, Artificial Sequence
  Synthetic oligonucleotide; TTG chr2 60518236 60518257 60518241 60518236 -
acagagggaatgagacaagatg

SEQ ID NO: 216383 - DNA, 22 bp, Artificial Sequence
  Synthetic oligonucleotide; TTT chr2 60518210 60518231 60518215 60518210 -
taggtctaggtttgatagataa

SEQ ID NO: 216384 - DNA, 22 bp, Artificial Sequence
  Synthetic oligonucleotide; TTT chr2 60518209 60518230 60518214 60518209 -
aggtctaggtttgatagataaa

SEQ ID NO: 216385 - DNA, 22 bp, Artificial Sequence
  Synthetic oligonucleotide; TTA chr2 60518208 60518229 60518213 60518208 -
ggtctaggtttgatagataaaa

SEQ ID NO: 216386 - DNA, 22 bp, Artificial Sequence
  Synthetic oligonucleotide; CTA chr2 60518202 60518223 60518207 60518202 -
ggtttgatagataaaaaactgg

SEQ ID NO: 216387 - DNA, 22 bp, Artificial Sequence
  Synthetic oligonucleotide; TTT chr2 60518197 60518218 60518202 60518197 -
gatagataaaaaactgggccaa

SEQ ID NO: 216388 - DNA, 22 bp, Artificial Sequence
  Synthetic oligonucleotide; TTG chr2 60518196 60518217 60518201 60518196 -
atagataaaaaactgggccaaa

SEQ ID NO: 216389 - DNA, 22 bp, Artificial Sequence
  Synthetic oligonucleotide; CTG chr2 60518181 60518202 60518186 60518181 -
ggccaaattttatattttcttt

SEQ ID NO: 216390 - DNA, 22 bp, Artificial Sequence
  Synthetic oligonucleotide; TTT chr2 60518171 60518192 60518176 60518171 -
tatattttctttgaaaagatag

SEQ ID NO: 216391 - DNA, 22 bp, Artificial Sequence
  Synthetic oligonucleotide; TTT chr2 60518170 60518191 60518175 60518170 -
atattttctttgaaaagatagc

SEQ ID NO: 216392 - DNA, 22 bp, Artificial Sequence
  Synthetic oligonucleotide; TTA chr2 60518169 60518190 60518174 60518169 -
tattttctttgaaaagatagct

SEQ ID NO: 216393 - DNA, 22 bp, Artificial Sequence
  Synthetic oligonucleotide; TTT chr2 60518164 60518185 60518169 60518164 -
tctttgaaaagatagctaaatc

SEQ ID NO: 216394 - DNA, 22 bp, Artificial Sequence
  Synthetic oligonucleotide; TTT chr2 60518163 60518184 60518168 60518163 -
ctttgaaaagatagctaaatct

SEQ ID NO: 216395 - DNA, 22 bp, Artificial Sequence
  Synthetic oligonucleotide; TTC chr2 60518162 60518183 60518167 60518162 -
tttgaaaagatagctaaatctc

SEQ ID NO: 216396 - DNA, 22 bp, Artificial Sequence
  Synthetic oligonucleotide; CTT chr2 60518160 60518181 60518165 60518160 -
tgaaaagatagctaaatctcag

SEQ ID NO: 216397 - DNA, 22 bp, Artificial Sequence
  Synthetic oligonucleotide; TTT chr2 60518159 60518180 60518164 60518159 -
gaaaagatagctaaatctcagc

SEQ ID NO: 216398 - DNA, 22 bp, Artificial Sequence
  Synthetic oligonucleotide; TTG chr2 60518158 60518179 60518163 60518158 -
aaaagatagctaaatctcagca

SEQ ID NO: 216399 - DNA, 22 bp, Artificial Sequence
  Synthetic oligonucleotide; CTA chr2 60518146 60518167 60518151 60518146 -
aatctcagcaattattttattt

SEQ ID NO: 216400 - DNA, 22 bp, Artificial Sequence
  Synthetic oligonucleotide; CTC chr2 60518140 60518161 60518145 60518140 -
agcaattattttattttattta

SEQ ID NO: 216401 - DNA, 22 bp, Artificial Sequence
  Synthetic oligonucleotide; TTA chr2 60518132 60518153 60518137 60518132 -
ttttattttatttattaagctt

SEQ ID NO: 216402 - DNA, 22 bp, Artificial Sequence
  Synthetic oligonucleotide; TTT chr2 60518129 60518150 60518134 60518129 -
tattttatttattaagcttttt

SEQ ID NO: 216403 - DNA, 22 bp, Artificial Sequence
  Synthetic oligonucleotide; TTT chr2 60518128 60518149 60518133 60518128 -
attttatttattaagctttttg

SEQ ID NO: 216404 - DNA, 22 bp, Artificial Sequence
  Synthetic oligonucleotide; TTA chr2 60518127 60518148 60518132 60518127 -
ttttatttattaagctttttgt

SEQ ID NO: 216405 - DNA, 22 bp, Artificial Sequence
  Synthetic oligonucleotide; TTT chr2 60518124 60518145 60518129 60518124 -
tatttattaagctttttgtaga

SEQ ID NO: 216406 - DNA, 22 bp, Artificial Sequence
  Synthetic oligonucleotide; TTT chr2 60518123 60518144 60518128 60518123 -
atttattaagctttttgtagag

SEQ ID NO: 216407 - DNA, 22 bp, Artificial Sequence
  Synthetic oligonucleotide; TTA chr2 60518122 60518143 60518127 60518122 -
tttattaagctttttgtagaga

SEQ ID NO: 216408 - DNA, 22 bp, Artificial Sequence
  Synthetic oligonucleotide; TTT chr2 60518119 60518140 60518124 60518119 -
attaagctttttgtagagacag

SEQ ID NO: 216409 - DNA, 22 bp, Artificial Sequence
  Synthetic oligonucleotide; TTA chr2 60518118 60518139 60518123 60518118 -
ttaagctttttgtagagacagg

SEQ ID NO: 216410 - DNA, 22 bp, Artificial Sequence
  Synthetic oligonucleotide; TTA chr2 60518115 60518136 60518120 60518115 -
agctttttgtagagacagggtt

SEQ ID NO: 216411 - DNA, 22 bp, Artificial Sequence
  Synthetic oligonucleotide; CTT chr2 60518110 60518131 60518115 60518110 -
tttgtagagacagggttttgct

SEQ ID NO: 216412 - DNA, 22 bp, Artificial Sequence
  Synthetic oligonucleotide; TTT chr2 60518109 60518130 60518114 60518109 -
ttgtagagacagggttttgcta

SEQ ID NO: 216413 - DNA, 22 bp, Artificial Sequence
  Synthetic oligonucleotide; TTT chr2 60518108 60518129 60518113 60518108 -
tgtagagacagggttttgctat

SEQ ID NO: 216414 - DNA, 22 bp, Artificial Sequence
  Synthetic oligonucleotide; TTT chr2 60518107 60518128 60518112 60518107 -
gtagagacagggttttgctatg

SEQ ID NO: 216415 - DNA, 22 bp, Artificial Sequence
  Synthetic oligonucleotide; TTG chr2 60518106 60518127 60518111 60518106 -
tagagacagggttttgctatgt

SEQ ID NO: 216416 - DNA, 22 bp, Artificial Sequence
  Synthetic oligonucleotide; TTT chr2 60518092 60518113 60518097 60518092 -
tgctatgttgcccaggctggtc

SEQ ID NO: 216417 - DNA, 22 bp, Artificial Sequence
  Synthetic oligonucleotide; TTT chr2 60518091 60518112 60518096 60518091 -
gctatgttgcccaggctggtct

SEQ ID NO: 216418 - DNA, 22 bp, Artificial Sequence
  Synthetic oligonucleotide; TTG chr2 60518090 60518111 60518095 60518090 -
ctatgttgcccaggctggtctt

SEQ ID NO: 216419 - DNA, 22 bp, Artificial Sequence
  Synthetic oligonucleotide; CTA chr2 60518087 60518108 60518092 60518087 -
tgttgcccaggctggtcttgaa

SEQ ID NO: 216420 - DNA, 22 bp, Artificial Sequence
  Synthetic oligonucleotide; TTG chr2 60518082 60518103 60518087 60518082 -
cccaggctggtcttgaactcct

SEQ ID NO: 216421 - DNA, 22 bp, Artificial Sequence
  Synthetic oligonucleotide; CTG chr2 60518073 60518094 60518078 60518073 -
gtcttgaactcctagcttcaag

SEQ ID NO: 216422 - DNA, 22 bp, Artificial Sequence
  Synthetic oligonucleotide; CTT chr2 60518068 60518089 60518073 60518068 -
gaactcctagcttcaagcaatc

SEQ ID NO: 216423 - DNA, 22 bp, Artificial Sequence
  Synthetic oligonucleotide; TTG chr2 60518067 60518088 60518072 60518067 -
aactcctagcttcaagcaatct

SEQ ID NO: 216424 - DNA, 22 bp, Artificial Sequence
  Synthetic oligonucleotide; CTC chr2 60518062 60518083 60518067 60518062 -
ctagcttcaagcaatcttccct

SEQ ID NO: 216425 - DNA, 22 bp, Artificial Sequence
  Synthetic oligonucleotide; CTA chr2 60518059 60518080 60518064 60518059 -
gcttcaagcaatcttccctctg

SEQ ID NO: 216426 - DNA, 22 bp, Artificial Sequence
  Synthetic oligonucleotide; CTT chr2 60518055 60518076 60518060 60518055 -
caagcaatcttccctctgtggc

SEQ ID NO: 216427 - DNA, 22 bp, Artificial Sequence
  Synthetic oligonucleotide; TTC chr2 60518054 60518075 60518059 60518054 -
aagcaatcttccctctgtggcc

SEQ ID NO: 216428 - DNA, 22 bp, Artificial Sequence
  Synthetic oligonucleotide; CTT chr2 60518044 60518065 60518049 60518044 -
ccctctgtggccttccaaattt

SEQ ID NO: 216429 - DNA, 22 bp, Artificial Sequence
  Synthetic oligonucleotide; TTC chr2 60518043 60518064 60518048 60518043 -
cctctgtggccttccaaatttc

SEQ ID NO: 216430 - DNA, 22 bp, Artificial Sequence
  Synthetic oligonucleotide; CTC chr2 60518039 60518060 60518044 60518039 -
tgtggccttccaaatttctgag

SEQ ID NO: 216431 - DNA, 22 bp, Artificial Sequence
  Synthetic oligonucleotide; CTG chr2 60518037 60518058 60518042 60518037 -
tggccttccaaatttctgagat

SEQ ID NO: 216432 - DNA, 22 bp, Artificial Sequence
  Synthetic oligonucleotide; CTT chr2 60518030 60518051 60518035 60518030 -
ccaaatttctgagattataggc

SEQ ID NO: 216433 - DNA, 22 bp, Artificial Sequence
  Synthetic oligonucleotide; TTC chr2 60518029 60518050 60518034 60518029 -
caaatttctgagattataggca

SEQ ID NO: 216434 - DNA, 22 bp, Artificial Sequence
  Synthetic oligonucleotide; TTT chr2 60518022 60518043 60518027 60518022 -
ctgagattataggcataagcaa

SEQ ID NO: 216435 - DNA, 22 bp, Artificial Sequence
  Synthetic oligonucleotide; TTC chr2 60518021 60518042 60518026 60518021 -
tgagattataggcataagcaaa

SEQ ID NO: 216436 - DNA, 22 bp, Artificial Sequence
  Synthetic oligonucleotide; CTG chr2 60518019 60518040 60518024 60518019 -
agattataggcataagcaaatg

SEQ ID NO: 216437 - DNA, 22 bp, Artificial Sequence
  Synthetic oligonucleotide; TTA chr2 60518013 60518034 60518018 60518013 -
taggcataagcaaatgcctctg

SEQ ID NO: 216438 - DNA, 22 bp, Artificial Sequence
  Synthetic oligonucleotide; CTC chr2 60517993 60518014 60517998 60517993 -
tggccttcaagtaattaattta

SEQ ID NO: 216439 - DNA, 22 bp, Artificial Sequence
  Synthetic oligonucleotide; CTG chr2 60517991 60518012 60517996 60517991 -
gccttcaagtaattaatttaaa

SEQ ID NO: 216440 - DNA, 22 bp, Artificial Sequence
  Synthetic oligonucleotide; CTT chr2 60517986 60518007 60517991 60517986 -
caagtaattaatttaaagtctt

SEQ ID NO: 216441 - DNA, 22 bp, Artificial Sequence
  Synthetic oligonucleotide; TTC chr2 60517985 60518006 60517990 60517985 -
aagtaattaatttaaagtcttt

SEQ ID NO: 216442 - DNA, 22 bp, Artificial Sequence
  Synthetic oligonucleotide; TTA chr2 60517976 60517997 60517981 60517976 -
atttaaagtcttttaaaaattt

SEQ ID NO: 216443 - DNA, 22 bp, Artificial Sequence
  Synthetic oligonucleotide; TTT chr2 60517972 60517993 60517977 60517972 -
aaagtcttttaaaaattttctc

SEQ ID NO: 216444 - DNA, 22 bp, Artificial Sequence
  Synthetic oligonucleotide; TTA chr2 60517971 60517992 60517976 60517971 -
aagtcttttaaaaattttctct

SEQ ID NO: 216445 - DNA, 22 bp, Artificial Sequence
  Synthetic oligonucleotide; CTT chr2 60517964 60517985 60517969 60517964 -
ttaaaaattttctctcctcccc

SEQ ID NO: 216446 - DNA, 22 bp, Artificial Sequence
  Synthetic oligonucleotide; TTT chr2 60517963 60517984 60517968 60517963 -
taaaaattttctctcctcccct

SEQ ID NO: 216447 - DNA, 22 bp, Artificial Sequence
  Synthetic oligonucleotide; TTT chr2 60517962 60517983 60517967 60517962 -
aaaaattttctctcctccccta

SEQ ID NO: 216448 - DNA, 22 bp, Artificial Sequence
  Synthetic oligonucleotide; TTA chr2 60517961 60517982 60517966 60517961 -
aaaattttctctcctcccctaa

SEQ ID NO: 216449 - DNA, 22 bp, Artificial Sequence
  Synthetic oligonucleotide; TTT chr2 60517954 60517975 60517959 60517954 -
tctctcctcccctaaaattggg

SEQ ID NO: 216450 - DNA, 22 bp, Artificial Sequence
  Synthetic oligonucleotide; TTT chr2 60517953 60517974 60517958 60517953 -
ctctcctcccctaaaattgggt

SEQ ID NO: 216451 - DNA, 22 bp, Artificial Sequence
  Synthetic oligonucleotide; TTC chr2 60517952 60517973 60517957 60517952 -
tctcctcccctaaaattgggtt

SEQ ID NO: 216452 - DNA, 22 bp, Artificial Sequence
  Synthetic oligonucleotide; CTC chr2 60517950 60517971 60517955 60517950 -
tcctcccctaaaattgggtttt

SEQ ID NO: 216453 - DNA, 22 bp, Artificial Sequence
  Synthetic oligonucleotide; CTC chr2 60517948 60517969 60517953 60517948 -
ctcccctaaaattgggttttag

SEQ ID NO: 216454 - DNA, 22 bp, Artificial Sequence
  Synthetic oligonucleotide; CTC chr2 60517945 60517966 60517950 60517945 -
ccctaaaattgggttttagagt

SEQ ID NO: 216455 - DNA, 22 bp, Artificial Sequence
  Synthetic oligonucleotide; CTA chr2 60517940 60517961 60517945 60517940 -
aaattgggttttagagtaaggt

SEQ ID NO: 216456 - DNA, 22 bp, Artificial Sequence
  Synthetic oligonucleotide; TTG chr2 60517934 60517955 60517939 60517934 -
ggttttagagtaaggttcttgt

SEQ ID NO: 216457 - DNA, 22 bp, Artificial Sequence
  Synthetic oligonucleotide; TTT chr2 60517929 60517950 60517934 60517929 -
tagagtaaggttcttgttcctc

SEQ ID NO: 216458 - DNA, 22 bp, Artificial Sequence
  Synthetic oligonucleotide; TTT chr2 60517928 60517949 60517933 60517928 -
agagtaaggttcttgttcctct

SEQ ID NO: 216459 - DNA, 22 bp, Artificial Sequence
  Synthetic oligonucleotide; TTA chr2 60517927 60517948 60517932 60517927 -
gagtaaggttcttgttcctcta

SEQ ID NO: 216460 - DNA, 22 bp, Artificial Sequence
  Synthetic oligonucleotide; TTC chr2 60517916 60517937 60517921 60517916 -
ttgttcctctagtcgacaagag

SEQ ID NO: 216461 - DNA, 22 bp, Artificial Sequence
  Synthetic oligonucleotide; CTT chr2 60517914 60517935 60517919 60517914 -
gttcctctagtcgacaagagtt

SEQ ID NO: 216462 - DNA, 22 bp, Artificial Sequence
  Synthetic oligonucleotide; TTG chr2 60517913 60517934 60517918 60517913 -
ttcctctagtcgacaagagttt

SEQ ID NO: 216463 - DNA, 22 bp, Artificial Sequence
  Synthetic oligonucleotide; TTC chr2 60517910 60517931 60517915 60517910 -
ctctagtcgacaagagtttctg

SEQ ID NO: 216464 - DNA, 22 bp, Artificial Sequence
  Synthetic oligonucleotide; CTC chr2 60517907 60517928 60517912 60517907 -
tagtcgacaagagtttctgagg

SEQ ID NO: 216465 - DNA, 22 bp, Artificial Sequence
  Synthetic oligonucleotide; CTA chr2 60517905 60517926 60517910 60517905 -
gtcgacaagagtttctgaggaa

SEQ ID NO: 216466 - DNA, 22 bp, Artificial Sequence
  Synthetic oligonucleotide; TTT chr2 60517891 60517912 60517896 60517891 -
ctgaggaatcatagaagaaagc

SEQ ID NO: 216467 - DNA, 22 bp, Artificial Sequence
  Synthetic oligonucleotide; TTC chr2 60517890 60517911 60517895 60517890 -
tgaggaatcatagaagaaagca

SEQ ID NO: 216468 - DNA, 22 bp, Artificial Sequence
  Synthetic oligonucleotide; CTG chr2 60517888 60517909 60517893 60517888 -
aggaatcatagaagaaagcaca

SEQ ID NO: 216469 - DNA, 22 bp, Artificial Sequence
  Synthetic oligonucleotide; CTC chr2 60517862 60517883 60517867 60517862 -
tttgagcatagatagtttcctt

SEQ ID NO: 216470 - DNA, 22 bp, Artificial Sequence
  Synthetic oligonucleotide; CTT chr2 60517860 60517881 60517865 60517860 -
tgagcatagatagtttccttcg

SEQ ID NO: 216471 - DNA, 22 bp, Artificial Sequence
  Synthetic oligonucleotide; TTT chr2 60517859 60517880 60517864 60517859 -
gagcatagatagtttccttcgt

SEQ ID NO: 216472 - DNA, 22 bp, Artificial Sequence
  Synthetic oligonucleotide; TTG chr2 60517858 60517879 60517863 60517858 -
agcatagatagtttccttcgtg

SEQ ID NO: 216473 - DNA, 22 bp, Artificial Sequence
  Synthetic oligonucleotide; TTT chr2 60517844 60517865 60517849 60517844 -
ccttcgtggaaagccaaagtga

SEQ ID NO: 216474 - DNA, 22 bp, Artificial Sequence
  Synthetic oligonucleotide; TTC chr2 60517843 60517864 60517848 60517843 -
cttcgtggaaagccaaagtgaa

SEQ ID NO: 216475 - DNA, 22 bp, Artificial Sequence
  Synthetic oligonucleotide; CTT chr2 60517840 60517861 60517845 60517840 -
cgtggaaagccaaagtgaatac

SEQ ID NO: 216476 - DNA, 22 bp, Artificial Sequence
  Synthetic oligonucleotide; TTC chr2 60517839 60517860 60517844 60517839 -
gtggaaagccaaagtgaatact

SEQ ID NO: 216477 - DNA, 22 bp, Artificial Sequence
  Synthetic oligonucleotide; CTT chr2 60517816 60517837 60517821 60517816 -
attgagcatcttctatgtagac

SEQ ID NO: 216478 - DNA, 22 bp, Artificial Sequence
  Synthetic oligonucleotide; TTA chr2 60517815 60517836 60517820 60517815 -
ttgagcatcttctatgtagaca

SEQ ID NO: 216479 - DNA, 22 bp, Artificial Sequence
  Synthetic oligonucleotide; TTG chr2 60517812 60517833 60517817 60517812 -
agcatcttctatgtagacatag

SEQ ID NO: 216480 - DNA, 22 bp, Artificial Sequence
  Synthetic oligonucleotide; CTT chr2 60517804 60517825 60517809 60517804 -
ctatgtagacatagacttgtga

SEQ ID NO: 216481 - DNA, 22 bp, Artificial Sequence
  Synthetic oligonucleotide; TTC chr2 60517803 60517824 60517808 60517803 -
tatgtagacatagacttgtgaa

SEQ ID NO: 216482 - DNA, 22 bp, Artificial Sequence
  Synthetic oligonucleotide; CTA chr2 60517801 60517822 60517806 60517801 -
tgtagacatagacttgtgaagt

SEQ ID NO: 216483 - DNA, 22 bp, Artificial Sequence
  Synthetic oligonucleotide; CTT chr2 60517786 60517807 60517791 60517786 -
gtgaagtcatatcattaaccct

SEQ ID NO: 216484 - DNA, 22 bp, Artificial Sequence
  Synthetic oligonucleotide; TTG chr2 60517785 60517806 60517790 60517785 -
tgaagtcatatcattaaccctg

SEQ ID NO: 216485 - DNA, 22 bp, Artificial Sequence
  Synthetic oligonucleotide; TTA chr2 60517769 60517790 60517774 60517769 -
accctgtcattttacagatgag

SEQ ID NO: 216486 - DNA, 22 bp, Artificial Sequence
  Synthetic oligonucleotide; CTG chr2 60517763 60517784 60517768 60517763 -
tcattttacagatgagaaaggt

SEQ ID NO: 216487 - DNA, 22 bp, Artificial Sequence
  Synthetic oligonucleotide; TTT chr2 60517757 60517778 60517762 60517757 -
tacagatgagaaaggttgaggc

SEQ ID NO: 216488 - DNA, 22 bp, Artificial Sequence
  Synthetic oligonucleotide; TTT chr2 60517756 60517777 60517761 60517756 -
acagatgagaaaggttgaggct

SEQ ID NO: 216489 - DNA, 22 bp, Artificial Sequence
  Synthetic oligonucleotide; TTA chr2 60517755 60517776 60517760 60517755 -
cagatgagaaaggttgaggcta

SEQ ID NO: 216490 - DNA, 22 bp, Artificial Sequence
  Synthetic oligonucleotide; TTG chr2 60517739 60517760 60517744 60517739 -
aggctaagaggggagtgagtgc

SEQ ID NO: 216491 - DNA, 22 bp, Artificial Sequence
  Synthetic oligonucleotide; CTA chr2 60517733 60517754 60517738 60517733 -
agaggggagtgagtgccagagt

SEQ ID NO: 216492 - DNA, 22 bp, Artificial Sequence
  Synthetic oligonucleotide; CTA chr2 60517708 60517729 60517713 60517708 -
cttgctaggcagtggtagactt

SEQ ID NO: 216493 - DNA, 22 bp, Artificial Sequence
  Synthetic oligonucleotide; CTT chr2 60517705 60517726 60517710 60517705 -
gctaggcagtggtagacttggc

SEQ ID NO: 216494 - DNA, 22 bp, Artificial Sequence
  Synthetic oligonucleotide; TTG chr2 60517704 60517725 60517709 60517704 -
ctaggcagtggtagacttggcc

SEQ ID NO: 216495 - DNA, 22 bp, Artificial Sequence
  Synthetic oligonucleotide; CTA chr2 60517701 60517722 60517706 60517701 -
ggcagtggtagacttggcccag

SEQ ID NO: 216496 - DNA, 22 bp, Artificial Sequence
  Synthetic oligonucleotide; CTT chr2 60517686 60517707 60517691 60517686 -
ggcccagagcctggggcttccc

SEQ ID NO: 216497 - DNA, 22 bp, Artificial Sequence
  Synthetic oligonucleotide; TTG chr2 60517685 60517706 60517690 60517685 -
gcccagagcctggggcttccca

SEQ ID NO: 216498 - DNA, 22 bp, Artificial Sequence
  Synthetic oligonucleotide; CTG chr2 60517673 60517694 60517678 60517673 -
gggcttcccactttcattcctg

SEQ ID NO: 216499 - DNA, 22 bp, Artificial Sequence
  Synthetic oligonucleotide; CTT chr2 60517667 60517688 60517672 60517667 -
cccactttcattcctggctgac

SEQ ID NO: 216500 - DNA, 22 bp, Artificial Sequence
  Synthetic oligonucleotide; TTC chr2 60517666 60517687 60517671 60517666 -
ccactttcattcctggctgact

SEQ ID NO: 216501 - DNA, 22 bp, Artificial Sequence
  Synthetic oligonucleotide; CTT chr2 60517660 60517681 60517665 60517660 -
tcattcctggctgactgtacca

SEQ ID NO: 216502 - DNA, 22 bp, Artificial Sequence
  Synthetic oligonucleotide; TTT chr2 60517659 60517680 60517664 60517659 -
cattcctggctgactgtaccaa

SEQ ID NO: 216503 - DNA, 22 bp, Artificial Sequence
  Synthetic oligonucleotide; TTC chr2 60517658 60517679 60517663 60517658 -
attcctggctgactgtaccaat

SEQ ID NO: 216504 - DNA, 22 bp, Artificial Sequence
  Synthetic oligonucleotide; TTC chr2 60517654 60517675 60517659 60517654 -
ctggctgactgtaccaatcgca

SEQ ID NO: 216505 - DNA, 22 bp, Artificial Sequence
  Synthetic oligonucleotide; CTG chr2 60517651 60517672 60517656 60517651 -
gctgactgtaccaatcgcacat

SEQ ID NO: 216506 - DNA, 22 bp, Artificial Sequence
  Synthetic oligonucleotide; CTG chr2 60517647 60517668 60517652 60517647 -
actgtaccaatcgcacatggcc

SEQ ID NO: 216507 - DNA, 22 bp, Artificial Sequence
  Synthetic oligonucleotide; CTG chr2 60517643 60517664 60517648 60517643 -
taccaatcgcacatggcctctc

SEQ ID NO: 216508 - DNA, 22 bp, Artificial Sequence
  Synthetic oligonucleotide; CTC chr2 60517623 60517644 60517628 60517623 -
tccatggccagcaggagccaga

SEQ ID NO: 216509 - DNA, 22 bp, Artificial Sequence
  Synthetic oligonucleotide; CTC chr2 60517621 60517642 60517626 60517621 -
catggccagcaggagccagagg

SEQ ID NO: 216510 - DNA, 22 bp, Artificial Sequence
  Synthetic oligonucleotide; CTT chr2 60517583 60517604 60517588 60517583 -
tgcagaggaacttgcacccacg

SEQ ID NO: 216511 - DNA, 22 bp, Artificial Sequence
  Synthetic oligonucleotide; TTT chr2 60517582 60517603 60517587 60517582 -
gcagaggaacttgcacccacgc

SEQ ID NO: 216512 - DNA, 22 bp, Artificial Sequence
  Synthetic oligonucleotide; TTG chr2 60517581 60517602 60517586 60517581 -
cagaggaacttgcacccacgct

SEQ ID NO: 216513 - DNA, 22 bp, Artificial Sequence
  Synthetic oligonucleotide; CTT chr2 60517570 60517591 60517575 60517570 -
gcacccacgcttttatcggtga

SEQ ID NO: 216514 - DNA, 22 bp, Artificial Sequence
  Synthetic oligonucleotide; TTG chr2 60517569 60517590 60517574 60517569 -
cacccacgcttttatcggtgat

SEQ ID NO: 216515 - DNA, 22 bp, Artificial Sequence
  Synthetic oligonucleotide; CTT chr2 60517558 60517579 60517563 60517558 -
ttatcggtgatggctggaatgc

SEQ ID NO: 216516 - DNA, 22 bp, Artificial Sequence
  Synthetic oligonucleotide; TTT chr2 60517557 60517578 60517562 60517557 -
tatcggtgatggctggaatgct

SEQ ID NO: 216517 - DNA, 22 bp, Artificial Sequence
  Synthetic oligonucleotide; TTT chr2 60517556 60517577 60517561 60517556 -
atcggtgatggctggaatgctt

SEQ ID NO: 216518 - DNA, 22 bp, Artificial Sequence
  Synthetic oligonucleotide; TTA chr2 60517555 60517576 60517560 60517555 -
tcggtgatggctggaatgcttt

SEQ ID NO: 216519 - DNA, 22 bp, Artificial Sequence
  Synthetic oligonucleotide; CTG chr2 60517542 60517563 60517547 60517542 -
gaatgcttttcttaactggagc

SEQ ID NO: 216520 - DNA, 22 bp, Artificial Sequence
  Synthetic oligonucleotide; CTT chr2 60517534 60517555 60517539 60517534 -
ttcttaactggagctttgttga

SEQ ID NO: 216521 - DNA, 22 bp, Artificial Sequence
  Synthetic oligonucleotide; TTT chr2 60517533 60517554 60517538 60517533 -
tcttaactggagctttgttgaa

SEQ ID NO: 216522 - DNA, 22 bp, Artificial Sequence
  Synthetic oligonucleotide; TTT chr2 60517532 60517553 60517537 60517532 -
cttaactggagctttgttgaag

SEQ ID NO: 216523 - DNA, 22 bp, Artificial Sequence
  Synthetic oligonucleotide; TTC chr2 60517531 60517552 60517536 60517531 -
ttaactggagctttgttgaaga

SEQ ID NO: 216524 - DNA, 22 bp, Artificial Sequence
  Synthetic oligonucleotide; CTT chr2 60517529 60517550 60517534 60517529 -
aactggagctttgttgaagagc

SEQ ID NO: 216525 - DNA, 22 bp, Artificial Sequence
  Synthetic oligonucleotide; TTA chr2 60517528 60517549 60517533 60517528 -
actggagctttgttgaagagcc

SEQ ID NO: 216526 - DNA, 22 bp, Artificial Sequence
  Synthetic oligonucleotide; CTG chr2 60517524 60517545 60517529 60517524 -
gagctttgttgaagagcctggt

SEQ ID NO: 216527 - DNA, 22 bp, Artificial Sequence
  Synthetic oligonucleotide; CTT chr2 60517518 60517539 60517523 60517518 -
tgttgaagagcctggtgctttt

SEQ ID NO: 216528 - DNA, 22 bp, Artificial Sequence
  Synthetic oligonucleotide; TTT chr2 60517517 60517538 60517522 60517517 -
gttgaagagcctggtgcttttg

SEQ ID NO: 216529 - DNA, 22 bp, Artificial Sequence
  Synthetic oligonucleotide; TTG chr2 60517516 60517537 60517521 60517516 -
ttgaagagcctggtgcttttgt

SEQ ID NO: 216530 - DNA, 22 bp, Artificial Sequence
  Synthetic oligonucleotide; TTG chr2 60517513 60517534 60517518 60517513 -
aagagcctggtgcttttgtggc

SEQ ID NO: 216531 - DNA, 22 bp, Artificial Sequence
  Synthetic oligonucleotide; CTG chr2 60517504 60517525 60517509 60517504 -
gtgcttttgtggcagtgctaac

SEQ ID NO: 216532 - DNA, 22 bp, Artificial Sequence
  Synthetic oligonucleotide; CTT chr2 60517498 60517519 60517503 60517498 -
ttgtggcagtgctaacctgggg

SEQ ID NO: 216533 - DNA, 22 bp, Artificial Sequence
  Synthetic oligonucleotide; TTT chr2 60517497 60517518 60517502 60517497 -
tgtggcagtgctaacctgggga

SEQ ID NO: 216534 - DNA, 22 bp, Artificial Sequence
  Synthetic oligonucleotide; TTT chr2 60517496 60517517 60517501 60517496 -
gtggcagtgctaacctggggag

SEQ ID NO: 216535 - DNA, 22 bp, Artificial Sequence
  Synthetic oligonucleotide; TTG chr2 60517495 60517516 60517500 60517495 -
tggcagtgctaacctggggagc

SEQ ID NO: 216536 - DNA, 22 bp, Artificial Sequence
  Synthetic oligonucleotide; CTA chr2 60517484 60517505 60517489 60517484 -
acctggggagcccatggtaaaa

SEQ ID NO: 216537 - DNA, 22 bp, Artificial Sequence
  Synthetic oligonucleotide; CTG chr2 60517479 60517500 60517484 60517479 -
gggagcccatggtaaaacccaa

SEQ ID NO: 216538 - DNA, 22 bp, Artificial Sequence
  Synthetic oligonucleotide; CTG chr2 60517430 60517451 60517435 60517430 -
tgctgttgcagagaatggtcct

SEQ ID NO: 216539 - DNA, 22 bp, Artificial Sequence
  Synthetic oligonucleotide; CTG chr2 60517425 60517446 60517430 60517425 -
ttgcagagaatggtcctttgcc

SEQ ID NO: 216540 - DNA, 22 bp, Artificial Sequence
  Synthetic oligonucleotide; TTG chr2 60517422 60517443 60517427 60517422 -
cagagaatggtcctttgccctt

SEQ ID NO: 216541 - DNA, 22 bp, Artificial Sequence
  Synthetic oligonucleotide; CTT chr2 60517407 60517428 60517412 60517407 -
tgccctttcttcttgccttgtt

SEQ ID NO: 216542 - DNA, 22 bp, Artificial Sequence
  Synthetic oligonucleotide; TTT chr2 60517406 60517427 60517411 60517406 -
gccctttcttcttgccttgttc

SEQ ID NO: 216543 - DNA, 22 bp, Artificial Sequence
  Synthetic oligonucleotide; TTG chr2 60517405 60517426 60517410 60517405 -
ccctttcttcttgccttgttcc

SEQ ID NO: 216544 - DNA, 22 bp, Artificial Sequence
  Synthetic oligonucleotide; CTT chr2 60517400 60517421 60517405 60517400 -
tcttcttgccttgttcctttcc

SEQ ID NO: 216545 - DNA, 22 bp, Artificial Sequence
  Synthetic oligonucleotide; TTT chr2 60517399 60517420 60517404 60517399 -
cttcttgccttgttcctttccc

SEQ ID NO: 216546 - DNA, 22 bp, Artificial Sequence
  Synthetic oligonucleotide; TTC chr2 60517398 60517419 60517403 60517398 -
ttcttgccttgttcctttccct

SEQ ID NO: 216547 - DNA, 22 bp, Artificial Sequence
  Synthetic oligonucleotide; CTT chr2 60517396 60517417 60517401 60517396 -
cttgccttgttcctttccctgt

SEQ ID NO: 216548 - DNA, 22 bp, Artificial Sequence
  Synthetic oligonucleotide; TTC chr2 60517395 60517416 60517400 60517395 -
ttgccttgttcctttccctgtt

SEQ ID NO: 216549 - DNA, 22 bp, Artificial Sequence
  Synthetic oligonucleotide; CTT chr2 60517393 60517414 60517398 60517393 -
gccttgttcctttccctgtttt

SEQ ID NO: 216550 - DNA, 22 bp, Artificial Sequence
  Synthetic oligonucleotide; TTG chr2 60517392 60517413 60517397 60517392 -
ccttgttcctttccctgttttc

SEQ ID NO: 216551 - DNA, 22 bp, Artificial Sequence
  Synthetic oligonucleotide; CTT chr2 60517388 60517409 60517393 60517388 -
gttcctttccctgttttctctg

SEQ ID NO: 216552 - DNA, 22 bp, Artificial Sequence
  Synthetic oligonucleotide; TTG chr2 60517387 60517408 60517392 60517387 -
ttcctttccctgttttctctgc

SEQ ID NO: 216553 - DNA, 22 bp, Artificial Sequence
  Synthetic oligonucleotide; TTC chr2 60517384 60517405 60517389 60517384 -
ctttccctgttttctctgccct

SEQ ID NO: 216554 - DNA, 22 bp, Artificial Sequence
  Synthetic oligonucleotide; CTT chr2 60517381 60517402 60517386 60517381 -
tccctgttttctctgccctttt

SEQ ID NO: 216555 - DNA, 22 bp, Artificial Sequence
  Synthetic oligonucleotide; TTT chr2 60517380 60517401 60517385 60517380 -
ccctgttttctctgcccttttt

SEQ ID NO: 216556 - DNA, 22 bp, Artificial Sequence
  Synthetic oligonucleotide; TTC chr2 60517379 60517400 60517384 60517379 -
cctgttttctctgccctttttc

SEQ ID NO: 216557 - DNA, 22 bp, Artificial Sequence
  Synthetic oligonucleotide; CTG chr2 60517375 60517396 60517380 60517375 -
ttttctctgccctttttcgggg

SEQ ID NO: 216558 - DNA, 22 bp, Artificial Sequence
  Synthetic oligonucleotide; TTT chr2 60517372 60517393 60517377 60517372 -
tctctgccctttttcggggctg

SEQ ID NO: 216559 - DNA, 22 bp, Artificial Sequence
  Synthetic oligonucleotide; TTT chr2 60517371 60517392 60517376 60517371 -
ctctgccctttttcggggctgg

SEQ ID NO: 216560 - DNA, 22 bp, Artificial Sequence
  Synthetic oligonucleotide; TTC chr2 60517370 60517391 60517375 60517370 -
tctgccctttttcggggctggt

SEQ ID NO: 216561 - DNA, 22 bp, Artificial Sequence
  Synthetic oligonucleotide; CTC chr2 60517368 60517389 60517373 60517368 -
tgccctttttcggggctggtct

SEQ ID NO: 216562 - DNA, 22 bp, Artificial Sequence
  Synthetic oligonucleotide; CTG chr2 60517366 60517387 60517371 60517366 -
ccctttttcggggctggtcttc

SEQ ID NO: 216563 - DNA, 22 bp, Artificial Sequence
  Synthetic oligonucleotide; CTT chr2 60517361 60517382 60517366 60517361 -
tttcggggctggtcttcctacc

SEQ ID NO: 216564 - DNA, 22 bp, Artificial Sequence
  Synthetic oligonucleotide; TTT chr2 60517360 60517381 60517365 60517360 -
ttcggggctggtcttcctacca

SEQ ID NO: 216565 - DNA, 22 bp, Artificial Sequence
  Synthetic oligonucleotide; TTT chr2 60517359 60517380 60517364 60517359 -
tcggggctggtcttcctaccac

SEQ ID NO: 216566 - DNA, 22 bp, Artificial Sequence
  Synthetic oligonucleotide; TTT chr2 60517358 60517379 60517363 60517358 -
cggggctggtcttcctaccacc

SEQ ID NO: 216567 - DNA, 22 bp, Artificial Sequence
  Synthetic oligonucleotide; TTC chr2 60517357 60517378 60517362 60517357 -
ggggctggtcttcctaccacct

SEQ ID NO: 216568 - DNA, 22 bp, Artificial Sequence
  Synthetic oligonucleotide; CTG chr2 60517350 60517371 60517355 60517350 -
gtcttcctaccacctttcctgc

SEQ ID NO: 216569 - DNA, 22 bp, Artificial Sequence
  Synthetic oligonucleotide; CTT chr2 60517345 60517366 60517350 60517345 -
cctaccacctttcctgctaggg

SEQ ID NO: 216570 - DNA, 22 bp, Artificial Sequence
  Synthetic oligonucleotide; TTC chr2 60517344 60517365 60517349 60517344 -
ctaccacctttcctgctagggc

SEQ ID NO: 216571 - DNA, 22 bp, Artificial Sequence
  Synthetic oligonucleotide; CTA chr2 60517341 60517362 60517346 60517341 -
ccacctttcctgctagggctcc

SEQ ID NO: 216572 - DNA, 22 bp, Artificial Sequence
  Synthetic oligonucleotide; CTT chr2 60517334 60517355 60517339 60517334 -
tcctgctagggctcccaaagtg

SEQ ID NO: 216573 - DNA, 22 bp, Artificial Sequence
  Synthetic oligonucleotide; TTT chr2 60517333 60517354 60517338 60517333 -
cctgctagggctcccaaagtgt

SEQ ID NO: 216574 - DNA, 22 bp, Artificial Sequence
  Synthetic oligonucleotide; TTC chr2 60517332 60517353 60517337 60517332 -
ctgctagggctcccaaagtgtg

SEQ ID NO: 216575 - DNA, 22 bp, Artificial Sequence
  Synthetic oligonucleotide; CTG chr2 60517329 60517350 60517334 60517329 -
ctagggctcccaaagtgtggcc

SEQ ID NO: 216576 - DNA, 22 bp, Artificial Sequence
  Synthetic oligonucleotide; CTA chr2 60517326 60517347 60517331 60517326 -
gggctcccaaagtgtggccctt

SEQ ID NO: 216577 - DNA, 22 bp, Artificial Sequence
  Synthetic oligonucleotide; CTC chr2 60517320 60517341 60517325 60517320 -
ccaaagtgtggcccttctgggg

SEQ ID NO: 216578 - DNA, 22 bp, Artificial Sequence
  Synthetic oligonucleotide; CTT chr2 60517304 60517325 60517309 60517304 -
ctggggtttacatggtgtgccc

SEQ ID NO: 216579 - DNA, 22 bp, Artificial Sequence
  Synthetic oligonucleotide; TTC chr2 60517303 60517324 60517308 60517303 -
tggggtttacatggtgtgccca

SEQ ID NO: 216580 - DNA, 22 bp, Artificial Sequence
  Synthetic oligonucleotide; CTG chr2 60517301 60517322 60517306 60517301 -
gggtttacatggtgtgcccagg

SEQ ID NO: 216581 - DNA, 22 bp, Artificial Sequence
  Synthetic oligonucleotide; TTT chr2 60517295 60517316 60517300 60517295 -
acatggtgtgcccagggaatag

SEQ ID NO: 216582 - DNA, 22 bp, Artificial Sequence
  Synthetic oligonucleotide; TTA chr2 60517294 60517315 60517299 60517294 -
catggtgtgcccagggaatagc

SEQ ID NO: 216583 - DNA, 22 bp, Artificial Sequence
  Synthetic oligonucleotide; CTT chr2 60517270 60517291 60517275 60517270 -
ggcttttttattcagataactg

SEQ ID NO: 216584 - DNA, 22 bp, Artificial Sequence
  Synthetic oligonucleotide; TTG chr2 60517269 60517290 60517274 60517269 -
gcttttttattcagataactgg

SEQ ID NO: 216585 - DNA, 22 bp, Artificial Sequence
  Synthetic oligonucleotide; CTT chr2 60517265 60517286 60517270 60517265 -
ttttattcagataactggagat

SEQ ID NO: 216586 - DNA, 22 bp, Artificial Sequence
  Synthetic oligonucleotide; TTT chr2 60517264 60517285 60517269 60517264 -
tttattcagataactggagata

SEQ ID NO: 216587 - DNA, 22 bp, Artificial Sequence
  Synthetic oligonucleotide; TTT chr2 60517263 60517284 60517268 60517263 -
ttattcagataactggagataa

SEQ ID NO: 216588 - DNA, 22 bp, Artificial Sequence
  Synthetic oligonucleotide; TTT chr2 60517262 60517283 60517267 60517262 -
tattcagataactggagataat

SEQ ID NO: 216589 - DNA, 22 bp, Artificial Sequence
  Synthetic oligonucleotide; TTT chr2 60517261 60517282 60517266 60517261 -
attcagataactggagataatg

SEQ ID NO: 216590 - DNA, 22 bp, Artificial Sequence
  Synthetic oligonucleotide; TTA chr2 60517260 60517281 60517265 60517260 -
ttcagataactggagataatgg

SEQ ID NO: 216591 - DNA, 22 bp, Artificial Sequence
  Synthetic oligonucleotide; TTC chr2 60517257 60517278 60517262 60517257 -
agataactggagataatggagt

SEQ ID NO: 216592 - DNA, 22 bp, Artificial Sequence
  Synthetic oligonucleotide; CTG chr2 60517248 60517269 60517253 60517248 -
gagataatggagtagatggagt

SEQ ID NO: 216593 - DNA, 22 bp, Artificial Sequence
  Synthetic oligonucleotide; TTG chr2 60517224 60517245 60517229 60517224 -
gggtggtgaaggaacgtgtacc

SEQ ID NO: 216594 - DNA, 22 bp, Artificial Sequence
  Synthetic oligonucleotide; CTC chr2 60517199 60517220 60517204 60517199 -
tcaggggcagatggccctccag

SEQ ID NO: 216595 - DNA, 22 bp, Artificial Sequence
  Synthetic oligonucleotide; CTC chr2 60517197 60517218 60517202 60517197 -
aggggcagatggccctccagaa

SEQ ID NO: 216596 - DNA, 22 bp, Artificial Sequence
  Synthetic oligonucleotide; CTC chr2 60517180 60517201 60517185 60517180 -
cagaattggccagcccaacctc

SEQ ID NO: 216597 - DNA, 22 bp, Artificial Sequence
  Synthetic oligonucleotide; TTG chr2 60517172 60517193 60517177 60517172 -
gccagcccaacctcttcctcac

SEQ ID NO: 216598 - DNA, 22 bp, Artificial Sequence
  Synthetic oligonucleotide; CTC chr2 60517158 60517179 60517163 60517158 -
ttcctcaccaccctagttctat

SEQ ID NO: 216599 - DNA, 22 bp, Artificial Sequence
  Synthetic oligonucleotide; CTT chr2 60517156 60517177 60517161 60517156 -
cctcaccaccctagttctattt

SEQ ID NO: 216600 - DNA, 22 bp, Artificial Sequence
  Synthetic oligonucleotide; TTC chr2 60517155 60517176 60517160 60517155 -
ctcaccaccctagttctatttt

SEQ ID NO: 216601 - DNA, 22 bp, Artificial Sequence
  Synthetic oligonucleotide; CTC chr2 60517152 60517173 60517157 60517152 -
accaccctagttctatttttaa

SEQ ID NO: 216602 - DNA, 22 bp, Artificial Sequence
  Synthetic oligonucleotide; CTA chr2 60517143 60517164 60517148 60517143 -
gttctatttttaaagacacctc

SEQ ID NO: 216603 - DNA, 22 bp, Artificial Sequence
  Synthetic oligonucleotide; TTC chr2 60517139 60517160 60517144 60517139 -
tatttttaaagacacctctcaa

SEQ ID NO: 216604 - DNA, 22 bp, Artificial Sequence
  Synthetic oligonucleotide; CTA chr2 60517137 60517158 60517142 60517137 -
tttttaaagacacctctcaatc

SEQ ID NO: 216605 - DNA, 22 bp, Artificial Sequence
  Synthetic oligonucleotide; TTT chr2 60517134 60517155 60517139 60517134 -
ttaaagacacctctcaatcgca

SEQ ID NO: 216606 - DNA, 22 bp, Artificial Sequence
  Synthetic oligonucleotide; TTT chr2 60517133 60517154 60517138 60517133 -
taaagacacctctcaatcgcag

SEQ ID NO: 216607 - DNA, 22 bp, Artificial Sequence
  Synthetic oligonucleotide; TTT chr2 60517132 60517153 60517137 60517132 -
aaagacacctctcaatcgcagg

SEQ ID NO: 216608 - DNA, 22 bp, Artificial Sequence
  Synthetic oligonucleotide; TTA chr2 60517131 60517152 60517136 60517131 -
aagacacctctcaatcgcagga

SEQ ID NO: 216609 - DNA, 22 bp, Artificial Sequence
  Synthetic oligonucleotide; CTC chr2 60517121 60517142 60517126 60517121 -
tcaatcgcaggaaatccttcct

SEQ ID NO: 216610 - DNA, 22 bp, Artificial Sequence
  Synthetic oligonucleotide; CTC chr2 60517119 60517140 60517124 60517119 -
aatcgcaggaaatccttccttt

SEQ ID NO: 216611 - DNA, 22 bp, Artificial Sequence
  Synthetic oligonucleotide; CTT chr2 60517102 60517123 60517107 60517102 -
ccttttgtctaccttcgatccc

SEQ ID NO: 216612 - DNA, 22 bp, Artificial Sequence
  Synthetic oligonucleotide; TTC chr2 60517101 60517122 60517106 60517101 -
cttttgtctaccttcgatccct

SEQ ID NO: 216613 - DNA, 22 bp, Artificial Sequence
  Synthetic oligonucleotide; CTT chr2 60517098 60517119 60517103 60517098 -
ttgtctaccttcgatcccttat

SEQ ID NO: 216614 - DNA, 22 bp, Artificial Sequence
  Synthetic oligonucleotide; TTT chr2 60517097 60517118 60517102 60517097 -
tgtctaccttcgatcccttatg

SEQ ID NO: 216615 - DNA, 22 bp, Artificial Sequence
  Synthetic oligonucleotide; TTT chr2 60517096 60517117 60517101 60517096 -
gtctaccttcgatcccttatgc

SEQ ID NO: 216616 - DNA, 22 bp, Artificial Sequence
  Synthetic oligonucleotide; TTG chr2 60517095 60517116 60517100 60517095 -
tctaccttcgatcccttatgct

SEQ ID NO: 216617 - DNA, 22 bp, Artificial Sequence
  Synthetic oligonucleotide; CTA chr2 60517091 60517112 60517096 60517091 -
ccttcgatcccttatgcttcat

SEQ ID NO: 216618 - DNA, 22 bp, Artificial Sequence
  Synthetic oligonucleotide; CTT chr2 60517087 60517108 60517092 60517087 -
cgatcccttatgcttcatttta

SEQ ID NO: 216619 - DNA, 22 bp, Artificial Sequence
  Synthetic oligonucleotide; TTC chr2 60517086 60517107 60517091 60517086 -
gatcccttatgcttcattttaa

SEQ ID NO: 216620 - DNA, 22 bp, Artificial Sequence
  Synthetic oligonucleotide; CTT chr2 60517078 60517099 60517083 60517078 -
atgcttcattttaaacccattt

SEQ ID NO: 216621 - DNA, 22 bp, Artificial Sequence
  Synthetic oligonucleotide; TTA chr2 60517077 60517098 60517082 60517077 -
tgcttcattttaaacccatttc

SEQ ID NO: 216622 - DNA, 22 bp, Artificial Sequence
  Synthetic oligonucleotide; CTT chr2 60517072 60517093 60517077 60517072 -
cattttaaacccatttcctctt

SEQ ID NO: 216623 - DNA, 22 bp, Artificial Sequence
  Synthetic oligonucleotide; TTC chr2 60517071 60517092 60517076 60517071 -
attttaaacccatttcctcttc

SEQ ID NO: 216624 - DNA, 22 bp, Artificial Sequence
  Synthetic oligonucleotide; TTT chr2 60517067 60517088 60517072 60517067 -
taaacccatttcctcttcattc

SEQ ID NO: 216625 - DNA, 22 bp, Artificial Sequence
  Synthetic oligonucleotide; TTT chr2 60517066 60517087 60517071 60517066 -
aaacccatttcctcttcattcc

SEQ ID NO: 216626 - DNA, 22 bp, Artificial Sequence
  Synthetic oligonucleotide; TTA chr2 60517065 60517086 60517070 60517065 -
aacccatttcctcttcattcca

SEQ ID NO: 216627 - DNA, 22 bp, Artificial Sequence
  Synthetic oligonucleotide; TTT chr2 60517056 60517077 60517061 60517056 -
cctcttcattccagagacgaca

SEQ ID NO: 216628 - DNA, 22 bp, Artificial Sequence
  Synthetic oligonucleotide; TTC chr2 60517055 60517076 60517060 60517055 -
ctcttcattccagagacgacaa

SEQ ID NO: 216629 - DNA, 22 bp, Artificial Sequence
  Synthetic oligonucleotide; CTC chr2 60517052 60517073 60517057 60517052 -
ttcattccagagacgacaaagt

SEQ ID NO: 216630 - DNA, 22 bp, Artificial Sequence
  Synthetic oligonucleotide; CTT chr2 60517050 60517071 60517055 60517050 -
cattccagagacgacaaagtat

SEQ ID NO: 216631 - DNA, 22 bp, Artificial Sequence
  Synthetic oligonucleotide; TTC chr2 60517049 60517070 60517054 60517049 -
attccagagacgacaaagtatc

SEQ ID NO: 216632 - DNA, 22 bp, Artificial Sequence
  Synthetic oligonucleotide; TTC chr2 60517045 60517066 60517050 60517045 -
cagagacgacaaagtatctcat

SEQ ID NO: 216633 - DNA, 22 bp, Artificial Sequence
  Synthetic oligonucleotide; CTC chr2 60517025 60517046 60517030 60517025 -
atcaccagctttgggctgaaat

SEQ ID NO: 216634 - DNA, 22 bp, Artificial Sequence
  Synthetic oligonucleotide; CTT chr2 60517014 60517035 60517019 60517014 -
tgggctgaaatgcttcatattt

SEQ ID NO: 216635 - DNA, 22 bp, Artificial Sequence
  Synthetic oligonucleotide; TTT chr2 60517013 60517034 60517018 60517013 -
gggctgaaatgcttcatatttt

SEQ ID NO: 216636 - DNA, 22 bp, Artificial Sequence
  Synthetic oligonucleotide; TTG chr2 60517012 60517033 60517017 60517012 -
ggctgaaatgcttcatatttta

SEQ ID NO: 216637 - DNA, 22 bp, Artificial Sequence
  Synthetic oligonucleotide; CTG chr2 60517007 60517028 60517012 60517007 -
aaatgcttcatattttacattc

SEQ ID NO: 216638 - DNA, 22 bp, Artificial Sequence
  Synthetic oligonucleotide; CTT chr2 60516999 60517020 60517004 60516999 -
catattttacattcttcattcc

SEQ ID NO: 216639 - DNA, 22 bp, Artificial Sequence
  Synthetic oligonucleotide; TTC chr2 60516998 60517019 60517003 60516998 -
atattttacattcttcattcca

SEQ ID NO: 216640 - DNA, 22 bp, Artificial Sequence
  Synthetic oligonucleotide; TTT chr2 60516992 60517013 60516997 60516992 -
tacattcttcattccattctcc

SEQ ID NO: 216641 - DNA, 22 bp, Artificial Sequence
  Synthetic oligonucleotide; TTT chr2 60516991 60517012 60516996 60516991 -
acattcttcattccattctccg

SEQ ID NO: 216642 - DNA, 22 bp, Artificial Sequence
  Synthetic oligonucleotide; TTA chr2 60516990 60517011 60516995 60516990 -
cattcttcattccattctccgc

SEQ ID NO: 216643 - DNA, 22 bp, Artificial Sequence
  Synthetic oligonucleotide; TTC chr2 60516985 60517006 60516990 60516985 -
ttcattccattctccgccactt

SEQ ID NO: 216644 - DNA, 22 bp, Artificial Sequence
  Synthetic oligonucleotide; CTT chr2 60516983 60517004 60516988 60516983 -
cattccattctccgccacttct

SEQ ID NO: 216645 - DNA, 22 bp, Artificial Sequence
  Synthetic oligonucleotide; TTC chr2 60516982 60517003 60516987 60516982 -
attccattctccgccacttctt

SEQ ID NO: 216646 - DNA, 22 bp, Artificial Sequence
  Synthetic oligonucleotide; TTC chr2 60516978 60516999 60516983 60516978 -
cattctccgccacttcttcttc

SEQ ID NO: 216647 - DNA, 22 bp, Artificial Sequence
  Synthetic oligonucleotide; TTC chr2 60516973 60516994 60516978 60516973 -
tccgccacttcttcttcctaaa

SEQ ID NO: 216648 - DNA, 22 bp, Artificial Sequence
  Synthetic oligonucleotide; CTC chr2 60516971 60516992 60516976 60516971 -
cgccacttcttcttcctaaata

SEQ ID NO: 216649 - DNA, 22 bp, Artificial Sequence
  Synthetic oligonucleotide; CTT chr2 60516963 60516984 60516968 60516963 -
cttcttcctaaataatctcttt

SEQ ID NO: 216650 - DNA, 22 bp, Artificial Sequence
  Synthetic oligonucleotide; TTC chr2 60516962 60516983 60516967 60516962 -
ttcttcctaaataatctctttc

SEQ ID NO: 216651 - DNA, 22 bp, Artificial Sequence
  Synthetic oligonucleotide; CTT chr2 60516960 60516981 60516965 60516960 -
cttcctaaataatctctttcct

SEQ ID NO: 216652 - DNA, 22 bp, Artificial Sequence
  Synthetic oligonucleotide; TTC chr2 60516959 60516980 60516964 60516959 -
ttcctaaataatctctttcctg

SEQ ID NO: 216653 - DNA, 22 bp, Artificial Sequence
  Synthetic oligonucleotide; CTT chr2 60516957 60516978 60516962 60516957 -
cctaaataatctctttcctgaa

SEQ ID NO: 216654 - DNA, 22 bp, Artificial Sequence
  Synthetic oligonucleotide; TTC chr2 60516956 60516977 60516961 60516956 -
ctaaataatctctttcctgaac

SEQ ID NO: 216655 - DNA, 22 bp, Artificial Sequence
  Synthetic oligonucleotide; CTA chr2 60516953 60516974 60516958 60516953 -
aataatctctttcctgaacctg

SEQ ID NO: 216656 - DNA, 22 bp, Artificial Sequence
  Synthetic oligonucleotide; CTC chr2 60516944 60516965 60516949 60516944 -
tttcctgaacctgaactcatgg

SEQ ID NO: 216657 - DNA, 22 bp, Artificial Sequence
  Synthetic oligonucleotide; CTT chr2 60516942 60516963 60516947 60516942 -
tcctgaacctgaactcatggat

SEQ ID NO: 216658 - DNA, 22 bp, Artificial Sequence
  Synthetic oligonucleotide; TTT chr2 60516941 60516962 60516946 60516941 -
cctgaacctgaactcatggatc

SEQ ID NO: 216659 - DNA, 22 bp, Artificial Sequence
  Synthetic oligonucleotide; TTC chr2 60516940 60516961 60516945 60516940 -
ctgaacctgaactcatggatct

SEQ ID NO: 216660 - DNA, 22 bp, Artificial Sequence
  Synthetic oligonucleotide; CTG chr2 60516937 60516958 60516942 60516937 -
aacctgaactcatggatctatt

SEQ ID NO: 216661 - DNA, 22 bp, Artificial Sequence
  Synthetic oligonucleotide; CTG chr2 60516931 60516952 60516936 60516931 -
aactcatggatctattatcttg

SEQ ID NO: 216662 - DNA, 22 bp, Artificial Sequence
  Synthetic oligonucleotide; CTC chr2 60516926 60516947 60516931 60516926 -
atggatctattatcttgtaacc

SEQ ID NO: 216663 - DNA, 22 bp, Artificial Sequence
  Synthetic oligonucleotide; CTA chr2 60516917 60516938 60516922 60516917 -
ttatcttgtaacccatttattg

SEQ ID NO: 216664 - DNA, 22 bp, Artificial Sequence
  Synthetic oligonucleotide; TTA chr2 60516914 60516935 60516919 60516914 -
tcttgtaacccatttattgttt

SEQ ID NO: 216665 - DNA, 22 bp, Artificial Sequence
  Synthetic oligonucleotide; CTT chr2 60516910 60516931 60516915 60516910 -
gtaacccatttattgtttctat

SEQ ID NO: 216666 - DNA, 22 bp, Artificial Sequence
  Synthetic oligonucleotide; TTG chr2 60516909 60516930 60516914 60516909 -
taacccatttattgtttctatg

SEQ ID NO: 216667 - DNA, 22 bp, Artificial Sequence
  Synthetic oligonucleotide; TTT chr2 60516899 60516920 60516904 60516899 -
attgtttctatgcctctcttta

SEQ ID NO: 216668 - DNA, 22 bp, Artificial Sequence
  Synthetic oligonucleotide; TTA chr2 60516898 60516919 60516903 60516898 -
ttgtttctatgcctctctttag

SEQ ID NO: 216669 - DNA, 22 bp, Artificial Sequence
  Synthetic oligonucleotide; TTG chr2 60516895 60516916 60516900 60516895 -
tttctatgcctctctttagaat

SEQ ID NO: 216670 - DNA, 22 bp, Artificial Sequence
  Synthetic oligonucleotide; TTT chr2 60516892 60516913 60516897 60516892 -
ctatgcctctctttagaatctg

SEQ ID NO: 216671 - DNA, 22 bp, Artificial Sequence
  Synthetic oligonucleotide; TTC chr2 60516891 60516912 60516896 60516891 -
tatgcctctctttagaatctgc

SEQ ID NO: 216672 - DNA, 22 bp, Artificial Sequence
  Synthetic oligonucleotide; CTA chr2 60516889 60516910 60516894 60516889 -
tgcctctctttagaatctgctg

SEQ ID NO: 216673 - DNA, 22 bp, Artificial Sequence
  Synthetic oligonucleotide; CTC chr2 60516883 60516904 60516888 60516883 -
tctttagaatctgctggttttc

SEQ ID NO: 216674 - DNA, 22 bp, Artificial Sequence
  Synthetic oligonucleotide; CTC chr2 60516881 60516902 60516886 60516881 -
tttagaatctgctggttttcca

SEQ ID NO: 216675 - DNA, 22 bp, Artificial Sequence
  Synthetic oligonucleotide; CTT chr2 60516879 60516900 60516884 60516879 -
tagaatctgctggttttccagc

SEQ ID NO: 216676 - DNA, 22 bp, Artificial Sequence
  Synthetic oligonucleotide; TTT chr2 60516878 60516899 60516883 60516878 -
agaatctgctggttttccagct

SEQ ID NO: 216677 - DNA, 22 bp, Artificial Sequence
  Synthetic oligonucleotide; TTA chr2 60516877 60516898 60516882 60516877 -
gaatctgctggttttccagctc

SEQ ID NO: 216678 - DNA, 22 bp, Artificial Sequence
  Synthetic oligonucleotide; CTG chr2 60516870 60516891 60516875 60516870 -
ctggttttccagctcttttact

SEQ ID NO: 216679 - DNA, 22 bp, Artificial Sequence
  Synthetic oligonucleotide; CTG chr2 60516867 60516888 60516872 60516867 -
gttttccagctcttttactcaa

SEQ ID NO: 216680 - DNA, 22 bp, Artificial Sequence
  Synthetic oligonucleotide; TTT chr2 60516863 60516884 60516868 60516863 -
tccagctcttttactcaaacat

SEQ ID NO: 216681 - DNA, 22 bp, Artificial Sequence
  Synthetic oligonucleotide; TTT chr2 60516862 60516883 60516867 60516862 -
ccagctcttttactcaaacatt

SEQ ID NO: 216682 - DNA, 22 bp, Artificial Sequence
  Synthetic oligonucleotide; TTC chr2 60516861 60516882 60516866 60516861 -
cagctcttttactcaaacatta

SEQ ID NO: 216683 - DNA, 22 bp, Artificial Sequence
  Synthetic oligonucleotide; CTC chr2 60516855 60516876 60516860 60516855 -
ttttactcaaacattagtctga

SEQ ID NO: 216684 - DNA, 22 bp, Artificial Sequence
  Synthetic oligonucleotide; CTT chr2 60516853 60516874 60516858 60516853 -
ttactcaaacattagtctgata

SEQ ID NO: 216685 - DNA, 22 bp, Artificial Sequence
  Synthetic oligonucleotide; TTT chr2 60516852 60516873 60516857 60516852 -
tactcaaacattagtctgataa

SEQ ID NO: 216686 - DNA, 22 bp, Artificial Sequence
  Synthetic oligonucleotide; TTT chr2 60516851 60516872 60516856 60516851 -
actcaaacattagtctgataac

SEQ ID NO: 216687 - DNA, 22 bp, Artificial Sequence
  Synthetic oligonucleotide; TTA chr2 60516850 60516871 60516855 60516850 -
ctcaaacattagtctgataact

SEQ ID NO: 216688 - DNA, 22 bp, Artificial Sequence
  Synthetic oligonucleotide; CTC chr2 60516847 60516868 60516852 60516847 -
aaacattagtctgataactaca

SEQ ID NO: 216689 - DNA, 22 bp, Artificial Sequence
  Synthetic oligonucleotide; TTA chr2 60516839 60516860 60516844 60516839 -
gtctgataactacagagtccaa

SEQ ID NO: 216690 - DNA, 22 bp, Artificial Sequence
  Synthetic oligonucleotide; CTG chr2 60516834 60516855 60516839 60516834 -
ataactacagagtccaatggca

SEQ ID NO: 216691 - DNA, 22 bp, Artificial Sequence
  Synthetic oligonucleotide; CTA chr2 60516827 60516848 60516832 60516827 -
cagagtccaatggcaagatatc

SEQ ID NO: 216692 - DNA, 22 bp, Artificial Sequence
  Synthetic oligonucleotide; CTT chr2 60516803 60516824 60516808 60516803 -
agtgttttccacattctttagt

SEQ ID NO: 216693 - DNA, 22 bp, Artificial Sequence
  Synthetic oligonucleotide; TTA chr2 60516802 60516823 60516807 60516802 -
gtgttttccacattctttagtc

SEQ ID NO: 216694 - DNA, 22 bp, Artificial Sequence
  Synthetic oligonucleotide; TTT chr2 60516796 60516817 60516801 60516796 -
tccacattctttagtcttatgt

SEQ ID NO: 216695 - DNA, 22 bp, Artificial Sequence
  Synthetic oligonucleotide; TTT chr2 60516795 60516816 60516800 60516795 -
ccacattctttagtcttatgtc

SEQ ID NO: 216696 - DNA, 22 bp, Artificial Sequence
  Synthetic oligonucleotide; TTC chr2 60516794 60516815 60516799 60516794 -
cacattctttagtcttatgtct

SEQ ID NO: 216697 - DNA, 22 bp, Artificial Sequence
  Synthetic oligonucleotide; TTC chr2 60516787 60516808 60516792 60516787 -
tttagtcttatgtctgcactct

SEQ ID NO: 216698 - DNA, 22 bp, Artificial Sequence
  Synthetic oligonucleotide; CTT chr2 60516785 60516806 60516790 60516785 -
tagtcttatgtctgcactctta

SEQ ID NO: 216699 - DNA, 22 bp, Artificial Sequence
  Synthetic oligonucleotide; TTT chr2 60516784 60516805 60516789 60516784 -
agtcttatgtctgcactcttat

SEQ ID NO: 216700 - DNA, 22 bp, Artificial Sequence
  Synthetic oligonucleotide; TTA chr2 60516783 60516804 60516788 60516783 -
gtcttatgtctgcactcttatg

SEQ ID NO: 216701 - DNA, 22 bp, Artificial Sequence
  Synthetic oligonucleotide; CTT chr2 60516778 60516799 60516783 60516778 -
atgtctgcactcttatgtcctg

SEQ ID NO: 216702 - DNA, 22 bp, Artificial Sequence
  Synthetic oligonucleotide; TTA chr2 60516777 60516798 60516782 60516777 -
tgtctgcactcttatgtcctgc

SEQ ID NO: 216703 - DNA, 22 bp, Artificial Sequence
  Synthetic oligonucleotide; CTG chr2 60516771 60516792 60516776 60516771 -
cactcttatgtcctgcttgctt

SEQ ID NO: 216704 - DNA, 22 bp, Artificial Sequence
  Synthetic oligonucleotide; CTC chr2 60516766 60516787 60516771 60516766 -
ttatgtcctgcttgctttttta

SEQ ID NO: 216705 - DNA, 22 bp, Artificial Sequence
  Synthetic oligonucleotide; CTT chr2 60516764 60516785 60516769 60516764 -
atgtcctgcttgcttttttaaa

SEQ ID NO: 216706 - DNA, 22 bp, Artificial Sequence
  Synthetic oligonucleotide; TTA chr2 60516763 60516784 60516768 60516763 -
tgtcctgcttgcttttttaaaa

SEQ ID NO: 216707 - DNA, 22 bp, Artificial Sequence
  Synthetic oligonucleotide; CTG chr2 60516756 60516777 60516761 60516756 -
cttgcttttttaaaaaccagtg

SEQ ID NO: 216708 - DNA, 22 bp, Artificial Sequence
  Synthetic oligonucleotide; CTT chr2 60516753 60516774 60516758 60516753 -
gcttttttaaaaaccagtgctt

SEQ ID NO: 216709 - DNA, 22 bp, Artificial Sequence
  Synthetic oligonucleotide; TTG chr2 60516752 60516773 60516757 60516752 -
cttttttaaaaaccagtgcttc

SEQ ID NO: 216710 - DNA, 22 bp, Artificial Sequence
  Synthetic oligonucleotide; CTT chr2 60516749 60516770 60516754 60516749 -
ttttaaaaaccagtgcttcatt

SEQ ID NO: 216711 - DNA, 22 bp, Artificial Sequence
  Synthetic oligonucleotide; TTT chr2 60516748 60516769 60516753 60516748 -
tttaaaaaccagtgcttcattg

SEQ ID NO: 216712 - DNA, 22 bp, Artificial Sequence
  Synthetic oligonucleotide; TTT chr2 60516747 60516768 60516752 60516747 -
ttaaaaaccagtgcttcattga

SEQ ID NO: 216713 - DNA, 22 bp, Artificial Sequence
  Synthetic oligonucleotide; TTT chr2 60516746 60516767 60516751 60516746 -
taaaaaccagtgcttcattgat

SEQ ID NO: 216714 - DNA, 22 bp, Artificial Sequence
  Synthetic oligonucleotide; TTT chr2 60516745 60516766 60516750 60516745 -
aaaaaccagtgcttcattgatg

SEQ ID NO: 216715 - DNA, 22 bp, Artificial Sequence
  Synthetic oligonucleotide; TTA chr2 60516744 60516765 60516749 60516744 -
aaaaccagtgcttcattgatga

SEQ ID NO: 216716 - DNA, 22 bp, Artificial Sequence
  Synthetic oligonucleotide; CTT chr2 60516731 60516752 60516736 60516731 -
cattgatgactcatgctcagct

SEQ ID NO: 216717 - DNA, 22 bp, Artificial Sequence
  Synthetic oligonucleotide; TTC chr2 60516730 60516751 60516735 60516730 -
attgatgactcatgctcagctt

SEQ ID NO: 216718 - DNA, 22 bp, Artificial Sequence
  Synthetic oligonucleotide; TTG chr2 60516726 60516747 60516731 60516726 -
atgactcatgctcagcttggtg

SEQ ID NO: 216719 - DNA, 22 bp, Artificial Sequence
  Synthetic oligonucleotide; CTC chr2 60516719 60516740 60516724 60516719 -
atgctcagcttggtgtccacta

SEQ ID NO: 216720 - DNA, 22 bp, Artificial Sequence
  Synthetic oligonucleotide; CTC chr2 60516713 60516734 60516718 60516713 -
agcttggtgtccactaggaatg

SEQ ID NO: 216721 - DNA, 22 bp, Artificial Sequence
  Synthetic oligonucleotide; CTT chr2 60516708 60516729 60516713 60516708 -
ggtgtccactaggaatgctaga

SEQ ID NO: 216722 - DNA, 22 bp, Artificial Sequence
  Synthetic oligonucleotide; TTG chr2 60516707 60516728 60516712 60516707 -
gtgtccactaggaatgctagat

SEQ ID NO: 216723 - DNA, 22 bp, Artificial Sequence
  Synthetic oligonucleotide; CTA chr2 60516697 60516718 60516702 60516697 -
ggaatgctagatctttgtcagc

SEQ ID NO: 216724 - DNA, 22 bp, Artificial Sequence
  Synthetic oligonucleotide; CTA chr2 60516688 60516709 60516693 60516688 -
gatctttgtcagccatctttga

SEQ ID NO: 216725 - DNA, 22 bp, Artificial Sequence
  Synthetic oligonucleotide; CTT chr2 60516682 60516703 60516687 60516682 -
tgtcagccatctttgagggcag

SEQ ID NO: 216726 - DNA, 22 bp, Artificial Sequence
  Synthetic oligonucleotide; TTT chr2 60516681 60516702 60516686 60516681 -
gtcagccatctttgagggcagt

SEQ ID NO: 216727 - DNA, 22 bp, Artificial Sequence
  Synthetic oligonucleotide; TTG chr2 60516680 60516701 60516685 60516680 -
tcagccatctttgagggcagtt

SEQ ID NO: 216728 - DNA, 22 bp, Artificial Sequence
  Synthetic oligonucleotide; CTT chr2 60516669 60516690 60516674 60516669 -
tgagggcagttaaactttcact

SEQ ID NO: 216729 - DNA, 22 bp, Artificial Sequence
  Synthetic oligonucleotide; TTT chr2 60516668 60516689 60516673 60516668 -
gagggcagttaaactttcactc

SEQ ID NO: 216730 - DNA, 22 bp, Artificial Sequence
  Synthetic oligonucleotide; TTG chr2 60516667 60516688 60516672 60516667 -
agggcagttaaactttcactcc

SEQ ID NO: 216731 - DNA, 22 bp, Artificial Sequence
  Synthetic oligonucleotide; TTA chr2 60516657 60516678 60516662 60516657 -
aactttcactcccagttgtcct

SEQ ID NO: 216732 - DNA, 22 bp, Artificial Sequence
  Synthetic oligonucleotide; CTT chr2 60516652 60516673 60516657 60516652 -
tcactcccagttgtcctgatgc

SEQ ID NO: 216733 - DNA, 22 bp, Artificial Sequence
  Synthetic oligonucleotide; TTT chr2 60516651 60516672 60516656 60516651 -
cactcccagttgtcctgatgcc

SEQ ID NO: 216734 - DNA, 22 bp, Artificial Sequence
  Synthetic oligonucleotide; TTC chr2 60516650 60516671 60516655 60516650 -
actcccagttgtcctgatgcca

SEQ ID NO: 216735 - DNA, 22 bp, Artificial Sequence
  Synthetic oligonucleotide; CTC chr2 60516646 60516667 60516651 60516646 -
ccagttgtcctgatgccacatt

SEQ ID NO: 216736 - DNA, 22 bp, Artificial Sequence
  Synthetic oligonucleotide; TTG chr2 60516639 60516660 60516644 60516639 -
tcctgatgccacatttctccca

SEQ ID NO: 216737 - DNA, 22 bp, Artificial Sequence
  Synthetic oligonucleotide; CTG chr2 60516634 60516655 60516639 60516634 -
atgccacatttctcccatccca

SEQ ID NO: 216738 - DNA, 22 bp, Artificial Sequence
  Synthetic oligonucleotide; TTT chr2 60516623 60516644 60516628 60516623 -
ctcccatcccaggtgcccctct

SEQ ID NO: 216739 - DNA, 22 bp, Artificial Sequence
  Synthetic oligonucleotide; TTC chr2 60516622 60516643 60516627 60516622 -
tcccatcccaggtgcccctctc

SEQ ID NO: 216740 - DNA, 22 bp, Artificial Sequence
  Synthetic oligonucleotide; CTC chr2 60516620 60516641 60516625 60516620 -
ccatcccaggtgcccctctctg

SEQ ID NO: 216741 - DNA, 22 bp, Artificial Sequence
  Synthetic oligonucleotide; CTC chr2 60516602 60516623 60516607 60516602 -
tctgtccttgtccatattgagc

SEQ ID NO: 216742 - DNA, 22 bp, Artificial Sequence
  Synthetic oligonucleotide; CTC chr2 60516600 60516621 60516605 60516600 -
tgtccttgtccatattgagctt

SEQ ID NO: 216743 - DNA, 22 bp, Artificial Sequence
  Synthetic oligonucleotide; CTG chr2 60516598 60516619 60516603 60516598 -
tccttgtccatattgagcttag

SEQ ID NO: 216744 - DNA, 22 bp, Artificial Sequence
  Synthetic oligonucleotide; CTT chr2 60516593 60516614 60516598 60516593 -
gtccatattgagcttagctctc

SEQ ID NO: 216745 - DNA, 22 bp, Artificial Sequence
  Synthetic oligonucleotide; TTG chr2 60516592 60516613 60516597 60516592 -
tccatattgagcttagctctcc

SEQ ID NO: 216746 - DNA, 22 bp, Artificial Sequence
  Synthetic oligonucleotide; TTG chr2 60516583 60516604 60516588 60516583 -
agcttagctctccactcctgac

SEQ ID NO: 216747 - DNA, 22 bp, Artificial Sequence
  Synthetic oligonucleotide; CTT chr2 60516578 60516599 60516583 60516578 -
agctctccactcctgacacgag

SEQ ID NO: 216748 - DNA, 22 bp, Artificial Sequence
  Synthetic oligonucleotide; TTA chr2 60516577 60516598 60516582 60516577 -
gctctccactcctgacacgagt

SEQ ID NO: 216749 - DNA, 22 bp, Artificial Sequence
  Synthetic oligonucleotide; CTC chr2 60516573 60516594 60516578 60516573 -
tccactcctgacacgagttccc

SEQ ID NO: 216750 - DNA, 22 bp, Artificial Sequence
  Synthetic oligonucleotide; CTC chr2 60516571 60516592 60516576 60516571 -
cactcctgacacgagttccctg

SEQ ID NO: 216751 - DNA, 22 bp, Artificial Sequence
  Synthetic oligonucleotide; CTC chr2 60516566 60516587 60516571 60516566 -
ctgacacgagttccctgacttc

SEQ ID NO: 216752 - DNA, 22 bp, Artificial Sequence
  Synthetic oligonucleotide; CTG chr2 60516563 60516584 60516568 60516563 -
acacgagttccctgacttcctc

SEQ ID NO: 216753 - DNA, 22 bp, Artificial Sequence
  Synthetic oligonucleotide; TTC chr2 60516553 60516574 60516558 60516553 -
cctgacttcctctccacttccc

SEQ ID NO: 216754 - DNA, 22 bp, Artificial Sequence
  Synthetic oligonucleotide; CTG chr2 60516549 60516570 60516554 60516549 -
acttcctctccacttccccgga

SEQ ID NO: 216755 - DNA, 22 bp, Artificial Sequence
  Synthetic oligonucleotide; CTT chr2 60516545 60516566 60516550 60516545 -
cctctccacttccccggatgac

SEQ ID NO: 216756 - DNA, 22 bp, Artificial Sequence
  Synthetic oligonucleotide; TTC chr2 60516544 60516565 60516549 60516544 -
ctctccacttccccggatgacg

SEQ ID NO: 216757 - DNA, 22 bp, Artificial Sequence
  Synthetic oligonucleotide; CTC chr2 60516541 60516562 60516546 60516541 -
tccacttccccggatgacggtg

SEQ ID NO: 216758 - DNA, 22 bp, Artificial Sequence
  Synthetic oligonucleotide; CTC chr2 60516539 60516560 60516544 60516539 -
cacttccccggatgacggtgag

SEQ ID NO: 216759 - DNA, 22 bp, Artificial Sequence
  Synthetic oligonucleotide; CTT chr2 60516534 60516555 60516539 60516534 -
ccccggatgacggtgagttacg

SEQ ID NO: 216760 - DNA, 22 bp, Artificial Sequence
  Synthetic oligonucleotide; TTC chr2 60516533 60516554 60516538 60516533 -
cccggatgacggtgagttacga

SEQ ID NO: 216761 - DNA, 22 bp, Artificial Sequence
  Synthetic oligonucleotide; TTA chr2 60516514 60516535 60516519 60516514 -
cgatcttgtctcctaaggtgcc

SEQ ID NO: 216762 - DNA, 22 bp, Artificial Sequence
  Synthetic oligonucleotide; CTT chr2 60516507 60516528 60516512 60516507 -
gtctcctaaggtgccccctccc

SEQ ID NO: 216763 - DNA, 22 bp, Artificial Sequence
  Synthetic oligonucleotide; TTG chr2 60516506 60516527 60516511 60516506 -
tctcctaaggtgccccctccct

SEQ ID NO: 216764 - DNA, 22 bp, Artificial Sequence
  Synthetic oligonucleotide; CTC chr2 60516502 60516523 60516507 60516502 -
ctaaggtgccccctccctcttg

SEQ ID NO: 216765 - DNA, 22 bp, Artificial Sequence
  Synthetic oligonucleotide; CTA chr2 60516499 60516520 60516504 60516499 -
aggtgccccctccctcttggct

SEQ ID NO: 216766 - DNA, 22 bp, Artificial Sequence
  Synthetic oligonucleotide; CTC chr2 60516487 60516508 60516492 60516487 -
cctcttggctcctctcccagtg

SEQ ID NO: 216767 - DNA, 22 bp, Artificial Sequence
  Synthetic oligonucleotide; CTC chr2 60516483 60516504 60516488 60516483 -
ttggctcctctcccagtgacga

SEQ ID NO: 216768 - DNA, 22 bp, Artificial Sequence
  Synthetic oligonucleotide; CTT chr2 60516481 60516502 60516486 60516481 -
ggctcctctcccagtgacgact

SEQ ID NO: 216769 - DNA, 22 bp, Artificial Sequence
  Synthetic oligonucleotide; TTG chr2 60516480 60516501 60516485 60516480 -
gctcctctcccagtgacgactt

SEQ ID NO: 216770 - DNA, 22 bp, Artificial Sequence
  Synthetic oligonucleotide; CTC chr2 60516476 60516497 60516481 60516476 -
ctctcccagtgacgacttcatg

SEQ ID NO: 216771 - DNA, 22 bp, Artificial Sequence
  Synthetic oligonucleotide; CTC chr2 60516473 60516494 60516478 60516473 -
tcccagtgacgacttcatggag

SEQ ID NO: 216772 - DNA, 22 bp, Artificial Sequence
  Synthetic oligonucleotide; CTC chr2 60516471 60516492 60516476 60516471 -
ccagtgacgacttcatggaggc

SEQ ID NO: 216773 - DNA, 22 bp, Artificial Sequence
  Synthetic oligonucleotide; CTT chr2 60516458 60516479 60516463 60516458 -
catggaggctgagaaatatagt

SEQ ID NO: 216774 - DNA, 22 bp, Artificial Sequence
  Synthetic oligonucleotide; TTC chr2 60516457 60516478 60516462 60516457 -
atggaggctgagaaatatagtg

SEQ ID NO: 216775 - DNA, 22 bp, Artificial Sequence
  Synthetic oligonucleotide; CTG chr2 60516447 60516468 60516452 60516447 -
agaaatatagtgagtggccttt

SEQ ID NO: 216776 - DNA, 22 bp, Artificial Sequence
  Synthetic oligonucleotide; CTT chr2 60516426 60516447 60516431 60516426 -
tcttgcctcacttactgctcgg

SEQ ID NO: 216777 - DNA, 22 bp, Artificial Sequence
  Synthetic oligonucleotide; TTT chr2 60516425 60516446 60516430 60516425 -
cttgcctcacttactgctcggt

SEQ ID NO: 216778 - DNA, 22 bp, Artificial Sequence
  Synthetic oligonucleotide; TTC chr2 60516424 60516445 60516429 60516424 -
ttgcctcacttactgctcggta

SEQ ID NO: 216779 - DNA, 22 bp, Artificial Sequence
  Synthetic oligonucleotide; CTT chr2 60516422 60516443 60516427 60516422 -
gcctcacttactgctcggtaag

SEQ ID NO: 216780 - DNA, 22 bp, Artificial Sequence
  Synthetic oligonucleotide; TTG chr2 60516421 60516442 60516426 60516421 -
cctcacttactgctcggtaagt

SEQ ID NO: 216781 - DNA, 22 bp, Artificial Sequence
  Synthetic oligonucleotide; CTC chr2 60516417 60516438 60516422 60516417 -
acttactgctcggtaagttagc

SEQ ID NO: 216782 - DNA, 22 bp, Artificial Sequence
  Synthetic oligonucleotide; CTT chr2 60516413 60516434 60516418 60516413 -
actgctcggtaagttagctcag

SEQ ID NO: 216783 - DNA, 22 bp, Artificial Sequence
  Synthetic oligonucleotide; TTA chr2 60516412 60516433 60516417 60516412 -
ctgctcggtaagttagctcagg

SEQ ID NO: 216784 - DNA, 22 bp, Artificial Sequence
  Synthetic oligonucleotide; CTG chr2 60516409 60516430 60516414 60516409 -
ctcggtaagttagctcaggggg

SEQ ID NO: 216785 - DNA, 22 bp, Artificial Sequence
  Synthetic oligonucleotide; CTC chr2 60516406 60516427 60516411 60516406 -
ggtaagttagctcagggggaga

SEQ ID NO: 216786 - DNA, 22 bp, Artificial Sequence
  Synthetic oligonucleotide; TTA chr2 60516397 60516418 60516402 60516397 -
gctcagggggagagctgttcat

SEQ ID NO: 216787 - DNA, 22 bp, Artificial Sequence
  Synthetic oligonucleotide; CTC chr2 60516393 60516414 60516398 60516393 -
agggggagagctgttcataact

SEQ ID NO: 216788 - DNA, 22 bp, Artificial Sequence
  Synthetic oligonucleotide; CTG chr2 60516380 60516401 60516385 60516380 -
ttcataactttgcactgacatc

SEQ ID NO: 216789 - DNA, 22 bp, Artificial Sequence
  Synthetic oligonucleotide; TTC chr2 60516377 60516398 60516382 60516377 -
ataactttgcactgacatctgg

SEQ ID NO: 216790 - DNA, 22 bp, Artificial Sequence
  Synthetic oligonucleotide; CTT chr2 60516370 60516391 60516375 60516370 -
tgcactgacatctggagaacaa

SEQ ID NO: 216791 - DNA, 22 bp, Artificial Sequence
  Synthetic oligonucleotide; TTT chr2 60516369 60516390 60516374 60516369 -
gcactgacatctggagaacaaa

SEQ ID NO: 216792 - DNA, 22 bp, Artificial Sequence
  Synthetic oligonucleotide; TTG chr2 60516368 60516389 60516373 60516368 -
cactgacatctggagaacaaag

SEQ ID NO: 216793 - DNA, 22 bp, Artificial Sequence
  Synthetic oligonucleotide; CTG chr2 60516363 60516384 60516368 60516363 -
acatctggagaacaaaggtttt

SEQ ID NO: 216794 - DNA, 22 bp, Artificial Sequence
  Synthetic oligonucleotide; CTG chr2 60516356 60516377 60516361 60516356 -
gagaacaaaggttttggaagag

SEQ ID NO: 216795 - DNA, 22 bp, Artificial Sequence
  Synthetic oligonucleotide; TTT chr2 60516342 60516363 60516347 60516342 -
tggaagagcggagcccagattc

SEQ ID NO: 216796 - DNA, 22 bp, Artificial Sequence
  Synthetic oligonucleotide; TTT chr2 60516341 60516362 60516346 60516341 -
ggaagagcggagcccagattcc

SEQ ID NO: 216797 - DNA, 22 bp, Artificial Sequence
  Synthetic oligonucleotide; TTG chr2 60516340 60516361 60516345 60516340 -
gaagagcggagcccagattccc

SEQ ID NO: 216798 - DNA, 22 bp, Artificial Sequence
  Synthetic oligonucleotide; TTC chr2 60516320 60516341 60516325 60516320 -
cctgtgagccagcagagccaag

SEQ ID NO: 216799 - DNA, 22 bp, Artificial Sequence
  Synthetic oligonucleotide; CTG chr2 60516316 60516337 60516321 60516316 -
tgagccagcagagccaagtctt

SEQ ID NO: 216800 - DNA, 22 bp, Artificial Sequence
  Synthetic oligonucleotide; CTT chr2 60516294 60516315 60516299 60516294 -
ttttgagtttccagcaaaacct

SEQ ID NO: 216801 - DNA, 22 bp, Artificial Sequence
  Synthetic oligonucleotide; TTT chr2 60516293 60516314 60516298 60516293 -
tttgagtttccagcaaaacctg

SEQ ID NO: 216802 - DNA, 22 bp, Artificial Sequence
  Synthetic oligonucleotide; TTT chr2 60516292 60516313 60516297 60516292 -
ttgagtttccagcaaaacctgt

SEQ ID NO: 216803 - DNA, 22 bp, Artificial Sequence
  Synthetic oligonucleotide; TTT chr2 60516291 60516312 60516296 60516291 -
tgagtttccagcaaaacctgtg

SEQ ID NO: 216804 - DNA, 22 bp, Artificial Sequence
  Synthetic oligonucleotide; TTT chr2 60516290 60516311 60516295 60516290 -
gagtttccagcaaaacctgtgt

SEQ ID NO: 216805 - DNA, 22 bp, Artificial Sequence
  Synthetic oligonucleotide; TTG chr2 60516289 60516310 60516294 60516289 -
agtttccagcaaaacctgtgtt

SEQ ID NO: 216806 - DNA, 22 bp, Artificial Sequence
  Synthetic oligonucleotide; TTT chr2 60516284 60516305 60516289 60516284 -
ccagcaaaacctgtgttttaat

SEQ ID NO: 216807 - DNA, 22 bp, Artificial Sequence
  Synthetic oligonucleotide; TTC chr2 60516283 60516304 60516288 60516283 -
cagcaaaacctgtgttttaata

SEQ ID NO: 216808 - DNA, 22 bp, Artificial Sequence
  Synthetic oligonucleotide; CTG chr2 60516271 60516292 60516276 60516271 -
tgttttaataataggagtgggt

SEQ ID NO: 216809 - DNA, 22 bp, Artificial Sequence
  Synthetic oligonucleotide; TTT chr2 60516266 60516287 60516271 60516266 -
taataataggagtgggtcattg

SEQ ID NO: 216810 - DNA, 22 bp, Artificial Sequence
  Synthetic oligonucleotide; TTT chr2 60516265 60516286 60516270 60516265 -
aataataggagtgggtcattgt

SEQ ID NO: 216811 - DNA, 22 bp, Artificial Sequence
  Synthetic oligonucleotide; TTA chr2 60516264 60516285 60516269 60516264 -
ataataggagtgggtcattgtg

SEQ ID NO: 216812 - DNA, 22 bp, Artificial Sequence
  Synthetic oligonucleotide; TTG chr2 60516244 60516265 60516249 60516244 -
tgtttaatagtacaacaaaacc

SEQ ID NO: 216813 - DNA, 22 bp, Artificial Sequence
  Synthetic oligonucleotide; TTT chr2 60516239 60516260 60516244 60516239 -
aatagtacaacaaaacctaagt

SEQ ID NO: 216814 - DNA, 22 bp, Artificial Sequence
  Synthetic oligonucleotide; TTA chr2 60516238 60516259 60516243 60516238 -
atagtacaacaaaacctaagtg

SEQ ID NO: 216815 - DNA, 22 bp, Artificial Sequence
  Synthetic oligonucleotide; CTA chr2 60516220 60516241 60516225 60516220 -
agtgcacataataagcacatct

SEQ ID NO: 216816 - DNA, 22 bp, Artificial Sequence
  Synthetic oligonucleotide; CTT chr2 60516197 60516218 60516202 60516197 -
ttctgtgtgctggggtgaggag

SEQ ID NO: 216817 - DNA, 22 bp, Artificial Sequence
  Synthetic oligonucleotide; TTT chr2 60516196 60516217 60516201 60516196 -
tctgtgtgctggggtgaggaga

SEQ ID NO: 216818 - DNA, 22 bp, Artificial Sequence
  Synthetic oligonucleotide; TTT chr2 60516195 60516216 60516200 60516195 -
ctgtgtgctggggtgaggagag

SEQ ID NO: 216819 - DNA, 22 bp, Artificial Sequence
  Synthetic oligonucleotide; TTC chr2 60516194 60516215 60516199 60516194 -
tgtgtgctggggtgaggagagg

SEQ ID NO: 216820 - DNA, 22 bp, Artificial Sequence
  Synthetic oligonucleotide; CTG chr2 60516192 60516213 60516197 60516192 -
tgtgctggggtgaggagaggtg

SEQ ID NO: 216821 - DNA, 22 bp, Artificial Sequence
  Synthetic oligonucleotide; CTG chr2 60516185 60516206 60516190 60516185 -
gggtgaggagaggtgacagtga

SEQ ID NO: 216822 - DNA, 22 bp, Artificial Sequence
  Synthetic oligonucleotide; TTA chr2 60516136 60516157 60516141 60516136 -
cagacatgggaaagcatcttag

SEQ ID NO: 216823 - DNA, 22 bp, Artificial Sequence
  Synthetic oligonucleotide; CTT chr2 60516116 60516137 60516121 60516116 -
agagcacccaaagctggcatga

SEQ ID NO: 216824 - DNA, 22 bp, Artificial Sequence
  Synthetic oligonucleotide; TTA chr2 60516115 60516136 60516120 60516115 -
gagcacccaaagctggcatgag

SEQ ID NO: 216825 - DNA, 22 bp, Artificial Sequence
  Synthetic oligonucleotide; CTG chr2 60516100 60516121 60516105 60516100 -
gcatgagtcatcacaggcttat

SEQ ID NO: 216826 - DNA, 22 bp, Artificial Sequence
  Synthetic oligonucleotide; CTT chr2 60516080 60516101 60516085 60516080 -
atggccacaaggctagattttc

SEQ ID NO: 216827 - DNA, 22 bp, Artificial Sequence
  Synthetic oligonucleotide; TTA chr2 60516079 60516100 60516084 60516079 -
tggccacaaggctagattttca

SEQ ID NO: 216828 - DNA, 22 bp, Artificial Sequence
  Synthetic oligonucleotide; CTA chr2 60516065 60516086 60516070 60516065 -
gattttcaatccctgcttccct

SEQ ID NO: 216829 - DNA, 22 bp, Artificial Sequence
  Synthetic oligonucleotide; TTT chr2 60516060 60516081 60516065 60516060 -
tcaatccctgcttccctttttc

SEQ ID NO: 216830 - DNA, 22 bp, Artificial Sequence
  Synthetic oligonucleotide; TTT chr2 60516059 60516080 60516064 60516059 -
caatccctgcttccctttttca

SEQ ID NO: 216831 - DNA, 22 bp, Artificial Sequence
  Synthetic oligonucleotide; TTC chr2 60516058 60516079 60516063 60516058 -
aatccctgcttccctttttcat

SEQ ID NO: 216832 - DNA, 22 bp, Artificial Sequence
  Synthetic oligonucleotide; CTG chr2 60516050 60516071 60516055 60516050 -
cttccctttttcataacccagt

SEQ ID NO: 216833 - DNA, 22 bp, Artificial Sequence
  Synthetic oligonucleotide; CTT chr2 60516047 60516068 60516052 60516047 -
ccctttttcataacccagttca

SEQ ID NO: 216834 - DNA, 22 bp, Artificial Sequence
  Synthetic oligonucleotide; TTC chr2 60516046 60516067 60516051 60516046 -
cctttttcataacccagttcaa

SEQ ID NO: 216835 - DNA, 22 bp, Artificial Sequence
  Synthetic oligonucleotide; CTT chr2 60516042 60516063 60516047 60516042 -
tttcataacccagttcaatgaa

SEQ ID NO: 216836 - DNA, 22 bp, Artificial Sequence
  Synthetic oligonucleotide; TTT chr2 60516041 60516062 60516046 60516041 -
ttcataacccagttcaatgaag

SEQ ID NO: 216837 - DNA, 22 bp, Artificial Sequence
  Synthetic oligonucleotide; TTT chr2 60516040 60516061 60516045 60516040 -
tcataacccagttcaatgaaga

SEQ ID NO: 216838 - DNA, 22 bp, Artificial Sequence
  Synthetic oligonucleotide; TTT chr2 60516039 60516060 60516044 60516039 -
cataacccagttcaatgaagac

SEQ ID NO: 216839 - DNA, 22 bp, Artificial Sequence
  Synthetic oligonucleotide; TTC chr2 60516038 60516059 60516043 60516038 -
ataacccagttcaatgaagaca

SEQ ID NO: 216840 - DNA, 22 bp, Artificial Sequence
  Synthetic oligonucleotide; TTC chr2 60516026 60516047 60516031 60516026 -
aatgaagacataattgaagtgg

SEQ ID NO: 216841 - DNA, 22 bp, Artificial Sequence
  Synthetic oligonucleotide; TTG chr2 60516010 60516031 60516015 60516010 -
aagtggtgagaagaggggccac

SEQ ID NO: 216842 - DNA, 22 bp, Artificial Sequence
  Synthetic oligonucleotide; CTT chr2 60515981 60516002 60515986 60515981 -
cagactccagggtatttgtatt

SEQ ID NO: 216843 - DNA, 22 bp, Artificial Sequence
  Synthetic oligonucleotide; TTC chr2 60515980 60516001 60515985 60515980 -
agactccagggtatttgtattc

SEQ ID NO: 216844 - DNA, 22 bp, Artificial Sequence
  Synthetic oligonucleotide; CTC chr2 60515974 60515995 60515979 60515974 -
cagggtatttgtattccaggac

SEQ ID NO: 216845 - DNA, 22 bp, Artificial Sequence
  Synthetic oligonucleotide; TTT chr2 60515964 60515985 60515969 60515964 -
gtattccaggacccctccgtgg

SEQ ID NO: 216846 - DNA, 22 bp, Artificial Sequence
  Synthetic oligonucleotide; TTG chr2 60515963 60515984 60515968 60515963 -
tattccaggacccctccgtggg

SEQ ID NO: 216847 - DNA, 22 bp, Artificial Sequence
  Synthetic oligonucleotide; TTC chr2 60515958 60515979 60515963 60515958 -
caggacccctccgtgggtgttg

SEQ ID NO: 216848 - DNA, 22 bp, Artificial Sequence
  Synthetic oligonucleotide; CTC chr2 60515947 60515968 60515952 60515947 -
cgtgggtgttggcccagcggtg

SEQ ID NO: 216849 - DNA, 22 bp, Artificial Sequence
  Synthetic oligonucleotide; TTG chr2 60515936 60515957 60515941 60515936 -
gcccagcggtgcccagagaata

SEQ ID NO: 216850 - DNA, 22 bp, Artificial Sequence
  Synthetic oligonucleotide; TTC chr2 60515911 60515932 60515916 60515911 -
ccttattggatctttctcgaat

SEQ ID NO: 216851 - DNA, 22 bp, Artificial Sequence
  Synthetic oligonucleotide; CTT chr2 60515907 60515928 60515912 60515907 -
attggatctttctcgaattgac

SEQ ID NO: 216852 - DNA, 22 bp, Artificial Sequence
  Synthetic oligonucleotide; TTA chr2 60515906 60515927 60515911 60515906 -
ttggatctttctcgaattgact

SEQ ID NO: 216853 - DNA, 22 bp, Artificial Sequence
  Synthetic oligonucleotide; TTG chr2 60515903 60515924 60515908 60515903 -
gatctttctcgaattgacttgt

SEQ ID NO: 216854 - DNA, 22 bp, Artificial Sequence
  Synthetic oligonucleotide; CTT chr2 60515897 60515918 60515902 60515897 -
tctcgaattgacttgttcactt

SEQ ID NO: 216855 - DNA, 22 bp, Artificial Sequence
  Synthetic oligonucleotide; TTT chr2 60515896 60515917 60515901 60515896 -
ctcgaattgacttgttcacttc

SEQ ID NO: 216856 - DNA, 22 bp, Artificial Sequence
  Synthetic oligonucleotide; TTC chr2 60515895 60515916 60515900 60515895 -
tcgaattgacttgttcacttcc

SEQ ID NO: 216857 - DNA, 22 bp, Artificial Sequence
  Synthetic oligonucleotide; CTC chr2 60515893 60515914 60515898 60515893 -
gaattgacttgttcacttcctg

SEQ ID NO: 216858 - DNA, 22 bp, Artificial Sequence
  Synthetic oligonucleotide; TTG chr2 60515887 60515908 60515892 60515887 -
acttgttcacttcctgttcagc

SEQ ID NO: 216859 - DNA, 22 bp, Artificial Sequence
  Synthetic oligonucleotide; CTT chr2 60515883 60515904 60515888 60515883 -
gttcacttcctgttcagcgcag

SEQ ID NO: 216860 - DNA, 22 bp, Artificial Sequence
  Synthetic oligonucleotide; TTG chr2 60515882 60515903 60515887 60515882 -
ttcacttcctgttcagcgcagc

SEQ ID NO: 216861 - DNA, 22 bp, Artificial Sequence
  Synthetic oligonucleotide; TTC chr2 60515879 60515900 60515884 60515879 -
acttcctgttcagcgcagcctg

SEQ ID NO: 216862 - DNA, 22 bp, Artificial Sequence
  Synthetic oligonucleotide; CTT chr2 60515875 60515896 60515880 60515875 -
cctgttcagcgcagcctggtgg

SEQ ID NO: 216863 - DNA, 22 bp, Artificial Sequence
  Synthetic oligonucleotide; TTC chr2 60515874 60515895 60515879 60515874 -
ctgttcagcgcagcctggtggt

SEQ ID NO: 216864 - DNA, 22 bp, Artificial Sequence
  Synthetic oligonucleotide; CTG chr2 60515871 60515892 60515876 60515871 -
ttcagcgcagcctggtggtgac

SEQ ID NO: 216865 - DNA, 22 bp, Artificial Sequence
  Synthetic oligonucleotide; TTC chr2 60515868 60515889 60515873 60515868 -
agcgcagcctggtggtgactcg

SEQ ID NO: 216866 - DNA, 22 bp, Artificial Sequence
  Synthetic oligonucleotide; CTG chr2 60515857 60515878 60515862 60515857 -
gtggtgactcggtaatccccac

SEQ ID NO: 216867 - DNA, 22 bp, Artificial Sequence
  Synthetic oligonucleotide; CTC chr2 60515847 60515868 60515852 60515847 -
ggtaatccccacagtaagacct

SEQ ID NO: 216868 - DNA, 22 bp, Artificial Sequence
  Synthetic oligonucleotide; CTC chr2 60515824 60515845 60515829 60515824 -
acagtgggttgagtggcctggg

SEQ ID NO: 216869 - DNA, 22 bp, Artificial Sequence
  Synthetic oligonucleotide; TTG chr2 60515813 60515834 60515818 60515813 -
agtggcctgggagctcaagtca

SEQ ID NO: 216870 - DNA, 22 bp, Artificial Sequence
  Synthetic oligonucleotide; CTG chr2 60515804 60515825 60515809 60515804 -
ggagctcaagtcaggggcagaa

SEQ ID NO: 216871 - DNA, 22 bp, Artificial Sequence
  Synthetic oligonucleotide; CTC chr2 60515797 60515818 60515802 60515797 -
aagtcaggggcagaaatgggga

SEQ ID NO: 216872 - DNA, 22 bp, Artificial Sequence
  Synthetic oligonucleotide; CTG chr2 60515770 60515791 60515775 60515770 -
gaaagttgggtgatcaagagtc

SEQ ID NO: 216873 - DNA, 22 bp, Artificial Sequence
  Synthetic oligonucleotide; TTG chr2 60515762 60515783 60515767 60515762 -
ggtgatcaagagtcatttggaa

SEQ ID NO: 216874 - DNA, 22 bp, Artificial Sequence
  Synthetic oligonucleotide; TTT chr2 60515744 60515765 60515749 60515744 -
ggaagcccccatgtctgtgtca

SEQ ID NO: 216875 - DNA, 22 bp, Artificial Sequence
  Synthetic oligonucleotide; TTG chr2 60515743 60515764 60515748 60515743 -
gaagcccccatgtctgtgtcag

SEQ ID NO: 216876 - DNA, 22 bp, Artificial Sequence
  Synthetic oligonucleotide; CTG chr2 60515727 60515748 60515732 60515727 -
tgtcagtccactcacatctctg

SEQ ID NO: 216877 - DNA, 22 bp, Artificial Sequence
  Synthetic oligonucleotide; CTC chr2 60515714 60515735 60515719 60515714 -
acatctctgtccgccacccacc

SEQ ID NO: 216878 - DNA, 22 bp, Artificial Sequence
  Synthetic oligonucleotide; CTC chr2 60515707 60515728 60515712 60515707 -
tgtccgccacccaccaccactt

SEQ ID NO: 216879 - DNA, 22 bp, Artificial Sequence
  Synthetic oligonucleotide; CTG chr2 60515705 60515726 60515710 60515705 -
tccgccacccaccaccactttc

SEQ ID NO: 216880 - DNA, 22 bp, Artificial Sequence
  Synthetic oligonucleotide; CTT chr2 60515685 60515706 60515690 60515685 -
tctccctgcctgaaagcactgg

SEQ ID NO: 216881 - DNA, 22 bp, Artificial Sequence
  Synthetic oligonucleotide; TTT chr2 60515684 60515705 60515689 60515684 -
ctccctgcctgaaagcactggg

SEQ ID NO: 216882 - DNA, 22 bp, Artificial Sequence
  Synthetic oligonucleotide; TTC chr2 60515683 60515704 60515688 60515683 -
tccctgcctgaaagcactgggc

SEQ ID NO: 216883 - DNA, 22 bp, Artificial Sequence
  Synthetic oligonucleotide; CTC chr2 60515681 60515702 60515686 60515681 -
cctgcctgaaagcactgggctg

SEQ ID NO: 216884 - DNA, 22 bp, Artificial Sequence
  Synthetic oligonucleotide; CTG chr2 60515677 60515698 60515682 60515677 -
cctgaaagcactgggctgtgtt

SEQ ID NO: 216885 - DNA, 22 bp, Artificial Sequence
  Synthetic oligonucleotide; CTG chr2 60515673 60515694 60515678 60515673 -
aaagcactgggctgtgtttcag

SEQ ID NO: 216886 - DNA, 22 bp, Artificial Sequence
  Synthetic oligonucleotide; CTG chr2 60515664 60515685 60515669 60515664 -
ggctgtgtttcagagaggtagc

SEQ ID NO: 216887 - DNA, 22 bp, Artificial Sequence
  Synthetic oligonucleotide; CTG chr2 60515659 60515680 60515664 60515659 -
tgtttcagagaggtagctgggt

SEQ ID NO: 216888 - DNA, 22 bp, Artificial Sequence
  Synthetic oligonucleotide; TTT chr2 60515654 60515675 60515659 60515654 -
cagagaggtagctgggtcccac

SEQ ID NO: 216889 - DNA, 22 bp, Artificial Sequence
  Synthetic oligonucleotide; TTC chr2 60515653 60515674 60515658 60515653 -
agagaggtagctgggtcccaca

SEQ ID NO: 216890 - DNA, 22 bp, Artificial Sequence
  Synthetic oligonucleotide; CTG chr2 60515640 60515661 60515645 60515640 -
ggtcccacagatatttatggag

SEQ ID NO: 216891 - DNA, 22 bp, Artificial Sequence
  Synthetic oligonucleotide; TTT chr2 60515624 60515645 60515629 60515624 -
atggagggcttgtttctgtatc

SEQ ID NO: 216892 - DNA, 22 bp, Artificial Sequence
  Synthetic oligonucleotide; TTA chr2 60515623 60515644 60515628 60515623 -
tggagggcttgtttctgtatct

SEQ ID NO: 216893 - DNA, 22 bp, Artificial Sequence
  Synthetic oligonucleotide; CTT chr2 60515613 60515634 60515618 60515613 -
gtttctgtatctccttctagtg

SEQ ID NO: 216894 - DNA, 22 bp, Artificial Sequence
  Synthetic oligonucleotide; TTG chr2 60515612 60515633 60515617 60515612 -
tttctgtatctccttctagtgg

SEQ ID NO: 216895 - DNA, 22 bp, Artificial Sequence
  Synthetic oligonucleotide; TTT chr2 60515609 60515630 60515614 60515609 -
ctgtatctccttctagtgggct

SEQ ID NO: 216896 - DNA, 22 bp, Artificial Sequence
  Synthetic oligonucleotide; TTC chr2 60515608 60515629 60515613 60515608 -
tgtatctccttctagtgggctg

SEQ ID NO: 216897 - DNA, 22 bp, Artificial Sequence
  Synthetic oligonucleotide; CTG chr2 60515606 60515627 60515611 60515606 -
tatctccttctagtgggctgga

SEQ ID NO: 216898 - DNA, 22 bp, Artificial Sequence
  Synthetic oligonucleotide; CTC chr2 60515600 60515621 60515605 60515600 -
cttctagtgggctggacctccc

SEQ ID NO: 216899 - DNA, 22 bp, Artificial Sequence
  Synthetic oligonucleotide; CTT chr2 60515597 60515618 60515602 60515597 -
ctagtgggctggacctccccag

SEQ ID NO: 216900 - DNA, 22 bp, Artificial Sequence
  Synthetic oligonucleotide; TTC chr2 60515596 60515617 60515601 60515596 -
tagtgggctggacctccccagg

SEQ ID NO: 216901 - DNA, 22 bp, Artificial Sequence
  Synthetic oligonucleotide; CTA chr2 60515594 60515615 60515599 60515594 -
gtgggctggacctccccaggcc

SEQ ID NO: 216902 - DNA, 22 bp, Artificial Sequence
  Synthetic oligonucleotide; CTG chr2 60515586 60515607 60515591 60515586 -
gacctccccaggccatttttct

SEQ ID NO: 216903 - DNA, 22 bp, Artificial Sequence
  Synthetic oligonucleotide; CTC chr2 60515580 60515601 60515585 60515580 -
cccaggccatttttctaggtaa

SEQ ID NO: 216904 - DNA, 22 bp, Artificial Sequence
  Synthetic oligonucleotide; TTT chr2 60515568 60515589 60515573 60515568 -
ttctaggtaactaggaaggcct

SEQ ID NO: 216905 - DNA, 22 bp, Artificial Sequence
  Synthetic oligonucleotide; TTT chr2 60515567 60515588 60515572 60515567 -
tctaggtaactaggaaggcctg

SEQ ID NO: 216906 - DNA, 22 bp, Artificial Sequence
  Synthetic oligonucleotide; TTT chr2 60515566 60515587 60515571 60515566 -
ctaggtaactaggaaggcctga

SEQ ID NO: 216907 - DNA, 22 bp, Artificial Sequence
  Synthetic oligonucleotide; TTC chr2 60515565 60515586 60515570 60515565 -
taggtaactaggaaggcctgac

SEQ ID NO: 216908 - DNA, 22 bp, Artificial Sequence
  Synthetic oligonucleotide; CTA chr2 60515563 60515584 60515568 60515563 -
ggtaactaggaaggcctgactc

SEQ ID NO: 216909 - DNA, 22 bp, Artificial Sequence
  Synthetic oligonucleotide; CTA chr2 60515555 60515576 60515560 60515555 -
ggaaggcctgactctgtcagca

SEQ ID NO: 216910 - DNA, 22 bp, Artificial Sequence
  Synthetic oligonucleotide; CTG chr2 60515545 60515566 60515550 60515545 -
actctgtcagcaacttggcttt

SEQ ID NO: 216911 - DNA, 22 bp, Artificial Sequence
  Synthetic oligonucleotide; CTC chr2 60515541 60515562 60515546 60515541 -
tgtcagcaacttggctttcttt

SEQ ID NO: 216912 - DNA, 22 bp, Artificial Sequence
  Synthetic oligonucleotide; CTG chr2 60515539 60515560 60515544 60515539 -
tcagcaacttggctttctttgg

SEQ ID NO: 216913 - DNA, 22 bp, Artificial Sequence
  Synthetic oligonucleotide; CTT chr2 60515529 60515550 60515534 60515529 -
ggctttctttggaggaggtgtc

SEQ ID NO: 216914 - DNA, 22 bp, Artificial Sequence
  Synthetic oligonucleotide; TTG chr2 60515528 60515549 60515533 60515528 -
gctttctttggaggaggtgtca

SEQ ID NO: 216915 - DNA, 22 bp, Artificial Sequence
  Synthetic oligonucleotide; CTT chr2 60515524 60515545 60515529 60515524 -
tctttggaggaggtgtcactct

SEQ ID NO: 216916 - DNA, 22 bp, Artificial Sequence
  Synthetic oligonucleotide; TTT chr2 60515523 60515544 60515528 60515523 -
ctttggaggaggtgtcactctg

SEQ ID NO: 216917 - DNA, 22 bp, Artificial Sequence
  Synthetic oligonucleotide; TTC chr2 60515522 60515543 60515527 60515522 -
tttggaggaggtgtcactctgg

SEQ ID NO: 216918 - DNA, 22 bp, Artificial Sequence
  Synthetic oligonucleotide; CTT chr2 60515520 60515541 60515525 60515520 -
tggaggaggtgtcactctggga

SEQ ID NO: 216919 - DNA, 22 bp, Artificial Sequence
  Synthetic oligonucleotide; TTT chr2 60515519 60515540 60515524 60515519 -
ggaggaggtgtcactctgggat

SEQ ID NO: 216920 - DNA, 22 bp, Artificial Sequence
  Synthetic oligonucleotide; TTG chr2 60515518 60515539 60515523 60515518 -
gaggaggtgtcactctgggatt

SEQ ID NO: 216921 - DNA, 22 bp, Artificial Sequence
  Synthetic oligonucleotide; CTC chr2 60515503 60515524 60515508 60515503 -
tgggattagttaaaaggggatc

SEQ ID NO: 216922 - DNA, 22 bp, Artificial Sequence
  Synthetic oligonucleotide; CTG chr2 60515501 60515522 60515506 60515501 -
ggattagttaaaaggggatcag

SEQ ID NO: 216923 - DNA, 22 bp, Artificial Sequence
  Synthetic oligonucleotide; TTA chr2 60515495 60515516 60515500 60515495 -
gttaaaaggggatcagtggtat

SEQ ID NO: 216924 - DNA, 22 bp, Artificial Sequence
  Synthetic oligonucleotide; TTA chr2 60515491 60515512 60515496 60515491 -
aaaggggatcagtggtattcac

SEQ ID NO: 216925 - DNA, 22 bp, Artificial Sequence
  Synthetic oligonucleotide; TTC chr2 60515471 60515492 60515476 60515471 -
acattggctcgtgggtgtattt

SEQ ID NO: 216926 - DNA, 22 bp, Artificial Sequence
  Synthetic oligonucleotide; TTG chr2 60515465 60515486 60515470 60515465 -
gctcgtgggtgtattttctcct

SEQ ID NO: 216927 - DNA, 22 bp, Artificial Sequence
  Synthetic oligonucleotide; CTC chr2 60515461 60515482 60515466 60515461 -
gtgggtgtattttctcctcctc

SEQ ID NO: 216928 - DNA, 22 bp, Artificial Sequence
  Synthetic oligonucleotide; TTT chr2 60515449 60515470 60515454 60515449 -
tctcctcctcaaattataacct

SEQ ID NO: 216929 - DNA, 22 bp, Artificial Sequence
  Synthetic oligonucleotide; TTT chr2 60515448 60515469 60515453 60515448 -
ctcctcctcaaattataacctt

SEQ ID NO: 216930 - DNA, 22 bp, Artificial Sequence
  Synthetic oligonucleotide; TTC chr2 60515447 60515468 60515452 60515447 -
tcctcctcaaattataaccttt

SEQ ID NO: 216931 - DNA, 22 bp, Artificial Sequence
  Synthetic oligonucleotide; CTC chr2 60515445 60515466 60515450 60515445 -
ctcctcaaattataaccttttg

SEQ ID NO: 216932 - DNA, 22 bp, Artificial Sequence
  Synthetic oligonucleotide; CTC chr2 60515442 60515463 60515447 60515442 -
ctcaaattataaccttttggag

SEQ ID NO: 216933 - DNA, 22 bp, Artificial Sequence
  Synthetic oligonucleotide; CTC chr2 60515439 60515460 60515444 60515439 -
aaattataaccttttggagggc

SEQ ID NO: 216934 - DNA, 22 bp, Artificial Sequence
  Synthetic oligonucleotide; TTA chr2 60515433 60515454 60515438 60515433 -
taaccttttggagggcaggagt

SEQ ID NO: 216935 - DNA, 22 bp, Artificial Sequence
  Synthetic oligonucleotide; CTT chr2 60515426 60515447 60515431 60515426 -
ttggagggcaggagtcatgttt

SEQ ID NO: 216936 - DNA, 22 bp, Artificial Sequence
  Synthetic oligonucleotide; TTT chr2 60515425 60515446 60515430 60515425 -
tggagggcaggagtcatgtttt

SEQ ID NO: 216937 - DNA, 22 bp, Artificial Sequence
  Synthetic oligonucleotide; TTT chr2 60515424 60515445 60515429 60515424 -
ggagggcaggagtcatgtttta

SEQ ID NO: 216938 - DNA, 22 bp, Artificial Sequence
  Synthetic oligonucleotide; TTG chr2 60515423 60515444 60515428 60515423 -
gagggcaggagtcatgttttat

SEQ ID NO: 216939 - DNA, 22 bp, Artificial Sequence
  Synthetic oligonucleotide; TTT chr2 60515404 60515425 60515409 60515404 -
tattttttgtgccttcttggtg

SEQ ID NO: 216940 - DNA, 22 bp, Artificial Sequence
  Synthetic oligonucleotide; TTT chr2 60515403 60515424 60515408 60515403 -
attttttgtgccttcttggtgc

SEQ ID NO: 216941 - DNA, 22 bp, Artificial Sequence
  Synthetic oligonucleotide; TTA chr2 60515402 60515423 60515407 60515402 -
ttttttgtgccttcttggtgcc

SEQ ID NO: 216942 - DNA, 22 bp, Artificial Sequence
  Synthetic oligonucleotide; TTT chr2 60515399 60515420 60515404 60515399 -
tttgtgccttcttggtgcctaa

SEQ ID NO: 216943 - DNA, 22 bp, Artificial Sequence
  Synthetic oligonucleotide; TTT chr2 60515398 60515419 60515403 60515398 -
ttgtgccttcttggtgcctaac

SEQ ID NO: 216944 - DNA, 22 bp, Artificial Sequence
  Synthetic oligonucleotide; TTT chr2 60515397 60515418 60515402 60515397 -
tgtgccttcttggtgcctaaca

SEQ ID NO: 216945 - DNA, 22 bp, Artificial Sequence
  Synthetic oligonucleotide; TTT chr2 60515396 60515417 60515401 60515396 -
gtgccttcttggtgcctaacat

SEQ ID NO: 216946 - DNA, 22 bp, Artificial Sequence
  Synthetic oligonucleotide; TTG chr2 60515395 60515416 60515400 60515395 -
tgccttcttggtgcctaacata

SEQ ID NO: 216947 - DNA, 22 bp, Artificial Sequence
  Synthetic oligonucleotide; CTT chr2 60515389 60515410 60515394 60515389 -
cttggtgcctaacataatgctg

SEQ ID NO: 216948 - DNA, 22 bp, Artificial Sequence
  Synthetic oligonucleotide; TTC chr2 60515388 60515409 60515393 60515388 -
ttggtgcctaacataatgctgg

SEQ ID NO: 216949 - DNA, 22 bp, Artificial Sequence
  Synthetic oligonucleotide; CTT chr2 60515386 60515407 60515391 60515386 -
ggtgcctaacataatgctggtt

SEQ ID NO: 216950 - DNA, 22 bp, Artificial Sequence
  Synthetic oligonucleotide; TTG chr2 60515385 60515406 60515390 60515385 -
gtgcctaacataatgctggttc

SEQ ID NO: 216951 - DNA, 22 bp, Artificial Sequence
  Synthetic oligonucleotide; CTA chr2 60515378 60515399 60515383 60515378 -
acataatgctggttcatatgta

SEQ ID NO: 216952 - DNA, 22 bp, Artificial Sequence
  Synthetic oligonucleotide; CTG chr2 60515367 60515388 60515372 60515367 -
gttcatatgtagtatttaatct

SEQ ID NO: 216953 - DNA, 22 bp, Artificial Sequence
  Synthetic oligonucleotide; TTC chr2 60515363 60515384 60515368 60515363 -
atatgtagtatttaatctgtac

SEQ ID NO: 216954 - DNA, 22 bp, Artificial Sequence
  Synthetic oligonucleotide; TTT chr2 60515350 60515371 60515355 60515350 -
aatctgtactttgctcacgctg

SEQ ID NO: 216955 - DNA, 22 bp, Artificial Sequence
  Synthetic oligonucleotide; TTA chr2 60515349 60515370 60515354 60515349 -
atctgtactttgctcacgctgc

SEQ ID NO: 216956 - DNA, 22 bp, Artificial Sequence
  Synthetic oligonucleotide; CTG chr2 60515344 60515365 60515349 60515344 -
tactttgctcacgctgcttgat

SEQ ID NO: 216957 - DNA, 22 bp, Artificial Sequence
  Synthetic oligonucleotide; CTT chr2 60515339 60515360 60515344 60515339 -
tgctcacgctgcttgattgaac

SEQ ID NO: 216958 - DNA, 22 bp, Artificial Sequence
  Synthetic oligonucleotide; TTT chr2 60515338 60515359 60515343 60515338 -
gctcacgctgcttgattgaaca

SEQ ID NO: 216959 - DNA, 22 bp, Artificial Sequence
  Synthetic oligonucleotide; TTG chr2 60515337 60515358 60515342 60515337 -
ctcacgctgcttgattgaacag

SEQ ID NO: 216960 - DNA, 22 bp, Artificial Sequence
  Synthetic oligonucleotide; CTC chr2 60515334 60515355 60515339 60515334 -
acgctgcttgattgaacagaga

SEQ ID NO: 216961 - DNA, 22 bp, Artificial Sequence
  Synthetic oligonucleotide; CTG chr2 60515328 60515349 60515333 60515328 -
cttgattgaacagagaaagacc

SEQ ID NO: 216962 - DNA, 22 bp, Artificial Sequence
  Synthetic oligonucleotide; CTT chr2 60515325 60515346 60515330 60515325 -
gattgaacagagaaagaccggg

SEQ ID NO: 216963 - DNA, 22 bp, Artificial Sequence
  Synthetic oligonucleotide; TTG chr2 60515324 60515345 60515329 60515324 -
attgaacagagaaagaccgggc

SEQ ID NO: 216964 - DNA, 22 bp, Artificial Sequence
  Synthetic oligonucleotide; TTG chr2 60515320 60515341 60515325 60515320 -
aacagagaaagaccgggctttg

SEQ ID NO: 216965 - DNA, 22 bp, Artificial Sequence
  Synthetic oligonucleotide; CTT chr2 60515300 60515321 60515305 60515300 -
tgaatggatccccagctccctg

SEQ ID NO: 216966 - DNA, 22 bp, Artificial Sequence
  Synthetic oligonucleotide; TTT chr2 60515299 60515320 60515304 60515299 -
gaatggatccccagctccctgt

SEQ ID NO: 216967 - DNA, 22 bp, Artificial Sequence
  Synthetic oligonucleotide; TTG chr2 60515298 60515319 60515303 60515298 -
aatggatccccagctccctgtc

SEQ ID NO: 216968 - DNA, 22 bp, Artificial Sequence
  Synthetic oligonucleotide; CTC chr2 60515282 60515303 60515287 60515282 -
cctgtccagggaaggtgtgagg

SEQ ID NO: 216969 - DNA, 22 bp, Artificial Sequence
  Synthetic oligonucleotide; CTG chr2 60515278 60515299 60515283 60515278 -
tccagggaaggtgtgaggctgg

SEQ ID NO: 216970 - DNA, 22 bp, Artificial Sequence
  Synthetic oligonucleotide; CTG chr2 60515257 60515278 60515262 60515257 -
ggcaagtttatttcccccttcc

SEQ ID NO: 216971 - DNA, 22 bp, Artificial Sequence
  Synthetic oligonucleotide; TTT chr2 60515248 60515269 60515253 60515248 -
atttcccccttcctccctgggg

SEQ ID NO: 216972 - DNA, 22 bp, Artificial Sequence
  Synthetic oligonucleotide; TTA chr2 60515247 60515268 60515252 60515247 -
tttcccccttcctccctgggga

SEQ ID NO: 216973 - DNA, 22 bp, Artificial Sequence
  Synthetic oligonucleotide; TTT chr2 60515244 60515265 60515249 60515244 -
cccccttcctccctggggagaa

SEQ ID NO: 216974 - DNA, 22 bp, Artificial Sequence
  Synthetic oligonucleotide; TTC chr2 60515243 60515264 60515248 60515243 -
ccccttcctccctggggagaaa

SEQ ID NO: 216975 - DNA, 22 bp, Artificial Sequence
  Synthetic oligonucleotide; CTT chr2 60515237 60515258 60515242 60515237 -
cctccctggggagaaagtgaaa

SEQ ID NO: 216976 - DNA, 22 bp, Artificial Sequence
  Synthetic oligonucleotide; TTC chr2 60515236 60515257 60515241 60515236 -
ctccctggggagaaagtgaaaa

SEQ ID NO: 216977 - DNA, 22 bp, Artificial Sequence
  Synthetic oligonucleotide; CTC chr2 60515233 60515254 60515238 60515233 -
cctggggagaaagtgaaaaagt

SEQ ID NO: 216978 - DNA, 22 bp, Artificial Sequence
  Synthetic oligonucleotide; CTG chr2 60515229 60515250 60515234 60515229 -
gggagaaagtgaaaaagtgaaa

SEQ ID NO: 216979 - DNA, 22 bp, Artificial Sequence
  Synthetic oligonucleotide; CTG chr2 60515201 60515222 60515206 60515201 -
gggttgggatagctggtggtgt

SEQ ID NO: 216980 - DNA, 22 bp, Artificial Sequence
  Synthetic oligonucleotide; TTG chr2 60515195 60515216 60515200 60515195 -
ggatagctggtggtgtctttgt

SEQ ID NO: 216981 - DNA, 22 bp, Artificial Sequence
  Synthetic oligonucleotide; CTG chr2 60515186 60515207 60515191 60515186 -
gtggtgtctttgtggctttcac

SEQ ID NO: 216982 - DNA, 22 bp, Artificial Sequence
  Synthetic oligonucleotide; CTT chr2 60515176 60515197 60515181 60515176 -
tgtggctttcaccccatggtca

SEQ ID NO: 216983 - DNA, 22 bp, Artificial Sequence
  Synthetic oligonucleotide; TTT chr2 60515175 60515196 60515180 60515175 -
gtggctttcaccccatggtcaa

SEQ ID NO: 216984 - DNA, 22 bp, Artificial Sequence
  Synthetic oligonucleotide; TTG chr2 60515174 60515195 60515179 60515174 -
tggctttcaccccatggtcaag

SEQ ID NO: 216985 - DNA, 22 bp, Artificial Sequence
  Synthetic oligonucleotide; CTT chr2 60515168 60515189 60515173 60515168 -
tcaccccatggtcaagcagtga

SEQ ID NO: 216986 - DNA, 22 bp, Artificial Sequence
  Synthetic oligonucleotide; TTT chr2 60515167 60515188 60515172 60515167 -
caccccatggtcaagcagtgaa

SEQ ID NO: 216987 - DNA, 22 bp, Artificial Sequence
  Synthetic oligonucleotide; TTC chr2 60515166 60515187 60515171 60515166 -
accccatggtcaagcagtgaac

SEQ ID NO: 216988 - DNA, 22 bp, Artificial Sequence
  Synthetic oligonucleotide; CTC chr2 60515142 60515163 60515147 60515142 -
tgcttgcagattctgtctcgct

SEQ ID NO: 216989 - DNA, 22 bp, Artificial Sequence
  Synthetic oligonucleotide; CTG chr2 60515140 60515161 60515145 60515140 -
cttgcagattctgtctcgctca

SEQ ID NO: 216990 - DNA, 22 bp, Artificial Sequence
  Synthetic oligonucleotide; CTT chr2 60515137 60515158 60515142 60515137 -
gcagattctgtctcgctcacct

SEQ ID NO: 216991 - DNA, 22 bp, Artificial Sequence
  Synthetic oligonucleotide; TTG chr2 60515136 60515157 60515141 60515136 -
cagattctgtctcgctcacctg

SEQ ID NO: 216992 - DNA, 22 bp, Artificial Sequence
  Synthetic oligonucleotide; TTC chr2 60515129 60515150 60515134 60515129 -
tgtctcgctcacctggaagcca

SEQ ID NO: 216993 - DNA, 22 bp, Artificial Sequence
  Synthetic oligonucleotide; CTG chr2 60515127 60515148 60515132 60515127 -
tctcgctcacctggaagccagt

SEQ ID NO: 216994 - DNA, 22 bp, Artificial Sequence
  Synthetic oligonucleotide; CTC chr2 60515123 60515144 60515128 60515123 -
gctcacctggaagccagtgttg

SEQ ID NO: 216995 - DNA, 22 bp, Artificial Sequence
  Synthetic oligonucleotide; CTC chr2 60515119 60515140 60515124 60515119 -
acctggaagccagtgttgggga

SEQ ID NO: 216996 - DNA, 22 bp, Artificial Sequence
  Synthetic oligonucleotide; CTG chr2 60515114 60515135 60515119 60515114 -
gaagccagtgttggggaaggag

SEQ ID NO: 216997 - DNA, 22 bp, Artificial Sequence
  Synthetic oligonucleotide; TTG chr2 60515101 60515122 60515106 60515101 -
gggaaggagcacgtgggggagg

SEQ ID NO: 216998 - DNA, 22 bp, Artificial Sequence
  Synthetic oligonucleotide; CTT chr2 60515073 60515094 60515078 60515073 -
aggtctgggcaacactttggag

SEQ ID NO: 216999 - DNA, 22 bp, Artificial Sequence
  Synthetic oligonucleotide; TTA chr2 60515072 60515093 60515077 60515072 -
ggtctgggcaacactttggagt

SEQ ID NO: 217000 - DNA, 22 bp, Artificial Sequence
  Synthetic oligonucleotide; CTG chr2 60515066 60515087 60515071 60515066 -
ggcaacactttggagttagggg

SEQ ID NO: 217001 - DNA, 22 bp, Artificial Sequence
  Synthetic oligonucleotide; CTT chr2 60515056 60515077 60515061 60515056 -
tggagttagggggtcccctgga

SEQ ID NO: 217002 - DNA, 22 bp, Artificial Sequence
  Synthetic oligonucleotide; TTT chr2 60515055 60515076 60515060 60515055 -
ggagttagggggtcccctggag

SEQ ID NO: 217003 - DNA, 22 bp, Artificial Sequence
  Synthetic oligonucleotide; TTG chr2 60515054 60515075 60515059 60515054 -
gagttagggggtcccctggagg

SEQ ID NO: 217004 - DNA, 22 bp, Artificial Sequence
  Synthetic oligonucleotide; TTA chr2 60515048 60515069 60515053 60515048 -
gggggtcccctggaggtgtggg

SEQ ID NO: 217005 - DNA, 22 bp, Artificial Sequence
  Synthetic oligonucleotide; CTG chr2 60515036 60515057 60515041 60515036 -
gaggtgtgggaagctggtagtg

SEQ ID NO: 217006 - DNA, 22 bp, Artificial Sequence
  Synthetic oligonucleotide; CTG chr2 60515020 60515041 60515025 60515020 -
gtagtggcattctggaaacaag

SEQ ID NO: 217007 - DNA, 22 bp, Artificial Sequence
  Synthetic oligonucleotide; TTC chr2 60515008 60515029 60515013 60515008 -
tggaaacaagctagagcctgtc

SEQ ID NO: 217008 - DNA, 22 bp, Artificial Sequence
  Synthetic oligonucleotide; CTG chr2 60515006 60515027 60515011 60515006 -
gaaacaagctagagcctgtctc

SEQ ID NO: 217009 - DNA, 22 bp, Artificial Sequence
  Synthetic oligonucleotide; CTA chr2 60514995 60515016 60515000 60514995 -
gagcctgtctcaccagagggag

SEQ ID NO: 217010 - DNA, 22 bp, Artificial Sequence
  Synthetic oligonucleotide; CTG chr2 60514988 60515009 60514993 60514988 -
tctcaccagagggagaacggct

SEQ ID NO: 217011 - DNA, 22 bp, Artificial Sequence
  Synthetic oligonucleotide; CTC chr2 60514984 60515005 60514989 60514984 -
accagagggagaacggctgagt

SEQ ID NO: 217012 - DNA, 22 bp, Artificial Sequence
  Synthetic oligonucleotide; CTG chr2 60514965 60514986 60514970 60514965 -
agttcggaagggactggggcct

SEQ ID NO: 217013 - DNA, 22 bp, Artificial Sequence
  Synthetic oligonucleotide; TTC chr2 60514960 60514981 60514965 60514960 -
ggaagggactggggcctgcttt

SEQ ID NO: 217014 - DNA, 22 bp, Artificial Sequence
  Synthetic oligonucleotide; CTG chr2 60514949 60514970 60514954 60514949 -
gggcctgctttcctttgggtgg

SEQ ID NO: 217015 - DNA, 22 bp, Artificial Sequence
  Synthetic oligonucleotide; CTG chr2 60514942 60514963 60514947 60514942 -
ctttcctttgggtggctttgac

SEQ ID NO: 217016 - DNA, 22 bp, Artificial Sequence
  Synthetic oligonucleotide; CTT chr2 60514939 60514960 60514944 60514939 -
tcctttgggtggctttgactgg

SEQ ID NO: 217017 - DNA, 22 bp, Artificial Sequence
  Synthetic oligonucleotide; TTT chr2 60514938 60514959 60514943 60514938 -
cctttgggtggctttgactggc

SEQ ID NO: 217018 - DNA, 22 bp, Artificial Sequence
  Synthetic oligonucleotide; TTC chr2 60514937 60514958 60514942 60514937 -
ctttgggtggctttgactggct

SEQ ID NO: 217019 - DNA, 22 bp, Artificial Sequence
  Synthetic oligonucleotide; CTT chr2 60514934 60514955 60514939 60514934 -
tgggtggctttgactggctctt

SEQ ID NO: 217020 - DNA, 22 bp, Artificial Sequence
  Synthetic oligonucleotide; TTT chr2 60514933 60514954 60514938 60514933 -
gggtggctttgactggctcttg

SEQ ID NO: 217021 - DNA, 22 bp, Artificial Sequence
  Synthetic oligonucleotide; TTG chr2 60514932 60514953 60514937 60514932 -
ggtggctttgactggctcttgg

SEQ ID NO: 217022 - DNA, 22 bp, Artificial Sequence
  Synthetic oligonucleotide; CTT chr2 60514924 60514945 60514929 60514924 -
tgactggctcttggatgagttt

SEQ ID NO: 217023 - DNA, 22 bp, Artificial Sequence
  Synthetic oligonucleotide; TTT chr2 60514923 60514944 60514928 60514923 -
gactggctcttggatgagttta

SEQ ID NO: 217024 - DNA, 22 bp, Artificial Sequence
  Synthetic oligonucleotide; TTG chr2 60514922 60514943 60514927 60514922 -
actggctcttggatgagtttaa

SEQ ID NO: 217025 - DNA, 22 bp, Artificial Sequence
  Synthetic oligonucleotide; CTG chr2 60514918 60514939 60514923 60514918 -
gctcttggatgagtttaaaagg

SEQ ID NO: 217026 - DNA, 22 bp, Artificial Sequence
  Synthetic oligonucleotide; CTC chr2 60514914 60514935 60514919 60514914 -
ttggatgagtttaaaaggtgat

SEQ ID NO: 217027 - DNA, 22 bp, Artificial Sequence
  Synthetic oligonucleotide; CTT chr2 60514912 60514933 60514917 60514912 -
ggatgagtttaaaaggtgattc

SEQ ID NO: 217028 - DNA, 22 bp, Artificial Sequence
  Synthetic oligonucleotide; TTG chr2 60514911 60514932 60514916 60514911 -
gatgagtttaaaaggtgattct

SEQ ID NO: 217029 - DNA, 22 bp, Artificial Sequence
  Synthetic oligonucleotide; TTT chr2 60514902 60514923 60514907 60514902 -
aaaaggtgattctctctctctc

SEQ ID NO: 217030 - DNA, 22 bp, Artificial Sequence
  Synthetic oligonucleotide; TTA chr2 60514901 60514922 60514906 60514901 -
aaaggtgattctctctctctct

SEQ ID NO: 217031 - DNA, 22 bp, Artificial Sequence
  Synthetic oligonucleotide; TTC chr2 60514890 60514911 60514895 60514890 -
tctctctctctctgtctctctt

SEQ ID NO: 217032 - DNA, 22 bp, Artificial Sequence
  Synthetic oligonucleotide; CTC chr2 60514888 60514909 60514893 60514888 -
tctctctctctgtctctctttt

SEQ ID NO: 217033 - DNA, 22 bp, Artificial Sequence
  Synthetic oligonucleotide; CTC chr2 60514886 60514907 60514891 60514886 -
tctctctctgtctctcttttct

SEQ ID NO: 217034 - DNA, 22 bp, Artificial Sequence
  Synthetic oligonucleotide; CTC chr2 60514884 60514905 60514889 60514884 -
tctctctgtctctcttttcttt

SEQ ID NO: 217035 - DNA, 22 bp, Artificial Sequence
  Synthetic oligonucleotide; CTC chr2 60514882 60514903 60514887 60514882 -
tctctgtctctcttttcttttt

SEQ ID NO: 217036 - DNA, 22 bp, Artificial Sequence
  Synthetic oligonucleotide; CTC chr2 60514880 60514901 60514885 60514880 -
tctgtctctcttttcttttttt

SEQ ID NO: 217037 - DNA, 22 bp, Artificial Sequence
  Synthetic oligonucleotide; CTC chr2 60514878 60514899 60514883 60514878 -
tgtctctcttttcttttttttt

SEQ ID NO: 217038 - DNA, 22 bp, Artificial Sequence
  Synthetic oligonucleotide; CTG chr2 60514876 60514897 60514881 60514876 -
tctctcttttcttttttttttt

SEQ ID NO: 217039 - DNA, 22 bp, Artificial Sequence
  Synthetic oligonucleotide; CTC chr2 60514872 60514893 60514877 60514872 -
tcttttctttttttttttttct

SEQ ID NO: 217040 - DNA, 22 bp, Artificial Sequence
  Synthetic oligonucleotide; CTC chr2 60514870 60514891 60514875 60514870 -
ttttctttttttttttttcttt

SEQ ID NO: 217041 - DNA, 22 bp, Artificial Sequence
  Synthetic oligonucleotide; CTT chr2 60514868 60514889 60514873 60514868 -
ttctttttttttttttcttttt

SEQ ID NO: 217042 - DNA, 22 bp, Artificial Sequence
  Synthetic oligonucleotide; TTT chr2 60514867 60514888 60514872 60514867 -
tctttttttttttttctttttt

SEQ ID NO: 217043 - DNA, 22 bp, Artificial Sequence
  Synthetic oligonucleotide; TTT chr2 60514866 60514887 60514871 60514866 -
ctttttttttttttcttttttc

SEQ ID NO: 217044 - DNA, 22 bp, Artificial Sequence
  Synthetic oligonucleotide; TTC chr2 60514865 60514886 60514870 60514865 -
tttttttttttttcttttttct

SEQ ID NO: 217045 - DNA, 22 bp, Artificial Sequence
  Synthetic oligonucleotide; CTT chr2 60514863 60514884 60514868 60514863 -
tttttttttttcttttttctgt

SEQ ID NO: 217046 - DNA, 22 bp, Artificial Sequence
  Synthetic oligonucleotide; TTT chr2 60514862 60514883 60514867 60514862 -
ttttttttttcttttttctgtt

SEQ ID NO: 217047 - DNA, 22 bp, Artificial Sequence
  Synthetic oligonucleotide; TTT chr2 60514861 60514882 60514866 60514861 -
tttttttttcttttttctgttt

SEQ ID NO: 217048 - DNA, 22 bp, Artificial Sequence
  Synthetic oligonucleotide; TTT chr2 60514860 60514881 60514865 60514860 -
ttttttttcttttttctgtttt

SEQ ID NO: 217049 - DNA, 22 bp, Artificial Sequence
  Synthetic oligonucleotide; TTT chr2 60514859 60514880 60514864 60514859 -
tttttttcttttttctgtttta

SEQ ID NO: 217050 - DNA, 22 bp, Artificial Sequence
  Synthetic oligonucleotide; TTT chr2 60514858 60514879 60514863 60514858 -
ttttttcttttttctgttttag

SEQ ID NO: 217051 - DNA, 22 bp, Artificial Sequence
  Synthetic oligonucleotide; TTT chr2 60514857 60514878 60514862 60514857 -
tttttcttttttctgttttagt

SEQ ID NO: 217052 - DNA, 22 bp, Artificial Sequence
  Synthetic oligonucleotide; TTT chr2 60514856 60514877 60514861 60514856 -
ttttcttttttctgttttagtg

SEQ ID NO: 217053 - DNA, 22 bp, Artificial Sequence
  Synthetic oligonucleotide; TTT chr2 60514855 60514876 60514860 60514855 -
tttcttttttctgttttagtgt

SEQ ID NO: 217054 - DNA, 22 bp, Artificial Sequence
  Synthetic oligonucleotide; TTT chr2 60514854 60514875 60514859 60514854 -
ttcttttttctgttttagtgta

SEQ ID NO: 217055 - DNA, 22 bp, Artificial Sequence
  Synthetic oligonucleotide; TTT chr2 60514853 60514874 60514858 60514853 -
tcttttttctgttttagtgtat

SEQ ID NO: 217056 - DNA, 22 bp, Artificial Sequence
  Synthetic oligonucleotide; TTT chr2 60514852 60514873 60514857 60514852 -
cttttttctgttttagtgtatg

SEQ ID NO: 217057 - DNA, 22 bp, Artificial Sequence
  Synthetic oligonucleotide; TTC chr2 60514851 60514872 60514856 60514851 -
ttttttctgttttagtgtatgt

SEQ ID NO: 217058 - DNA, 22 bp, Artificial Sequence
  Synthetic oligonucleotide; CTT chr2 60514849 60514870 60514854 60514849 -
ttttctgttttagtgtatgtgt

SEQ ID NO: 217059 - DNA, 22 bp, Artificial Sequence
  Synthetic oligonucleotide; TTT chr2 60514848 60514869 60514853 60514848 -
tttctgttttagtgtatgtgta

SEQ ID NO: 217060 - DNA, 22 bp, Artificial Sequence
  Synthetic oligonucleotide; TTT chr2 60514847 60514868 60514852 60514847 -
ttctgttttagtgtatgtgtat

SEQ ID NO: 217061 - DNA, 22 bp, Artificial Sequence
  Synthetic oligonucleotide; TTT chr2 60514846 60514867 60514851 60514846 -
tctgttttagtgtatgtgtatg

SEQ ID NO: 217062 - DNA, 22 bp, Artificial Sequence
  Synthetic oligonucleotide; TTT chr2 60514845 60514866 60514850 60514845 -
ctgttttagtgtatgtgtatgc

SEQ ID NO: 217063 - DNA, 22 bp, Artificial Sequence
  Synthetic oligonucleotide; TTC chr2 60514844 60514865 60514849 60514844 -
tgttttagtgtatgtgtatgca

SEQ ID NO: 217064 - DNA, 22 bp, Artificial Sequence
  Synthetic oligonucleotide; CTG chr2 60514842 60514863 60514847 60514842 -
ttttagtgtatgtgtatgcaag

SEQ ID NO: 217065 - DNA, 22 bp, Artificial Sequence
  Synthetic oligonucleotide; TTT chr2 60514839 60514860 60514844 60514839 -
tagtgtatgtgtatgcaagacc

SEQ ID NO: 217066 - DNA, 22 bp, Artificial Sequence
  Synthetic oligonucleotide; TTT chr2 60514838 60514859 60514843 60514838 -
agtgtatgtgtatgcaagacct

SEQ ID NO: 217067 - DNA, 22 bp, Artificial Sequence
  Synthetic oligonucleotide; TTA chr2 60514837 60514858 60514842 60514837 -
gtgtatgtgtatgcaagacctt

SEQ ID NO: 217068 - DNA, 22 bp, Artificial Sequence
  Synthetic oligonucleotide; CTT chr2 60514815 60514836 60514820 60514815 -
tgatatttgagtagggaaatcc

SEQ ID NO: 217069 - DNA, 22 bp, Artificial Sequence
  Synthetic oligonucleotide; TTT chr2 60514814 60514835 60514819 60514814 -
gatatttgagtagggaaatcct

SEQ ID NO: 217070 - DNA, 22 bp, Artificial Sequence
  Synthetic oligonucleotide; TTG chr2 60514813 60514834 60514818 60514813 -
atatttgagtagggaaatcctc

SEQ ID NO: 217071 - DNA, 22 bp, Artificial Sequence
  Synthetic oligonucleotide; TTT chr2 60514807 60514828 60514812 60514807 -
gagtagggaaatcctctcttat

SEQ ID NO: 217072 - DNA, 22 bp, Artificial Sequence
  Synthetic oligonucleotide; TTG chr2 60514806 60514827 60514811 60514806 -
agtagggaaatcctctcttatc

SEQ ID NO: 217073 - DNA, 22 bp, Artificial Sequence
  Synthetic oligonucleotide; CTC chr2 60514791 60514812 60514796 60514791 -
tcttatcaatggaattcacagc

SEQ ID NO: 217074 - DNA, 22 bp, Artificial Sequence
  Synthetic oligonucleotide; CTC chr2 60514789 60514810 60514794 60514789 -
ttatcaatggaattcacagcct

SEQ ID NO: 217075 - DNA, 22 bp, Artificial Sequence
  Synthetic oligonucleotide; CTT chr2 60514787 60514808 60514792 60514787 -
atcaatggaattcacagcctct

SEQ ID NO: 217076 - DNA, 22 bp, Artificial Sequence
  Synthetic oligonucleotide; TTA chr2 60514786 60514807 60514791 60514786 -
tcaatggaattcacagcctctt

SEQ ID NO: 217077 - DNA, 22 bp, Artificial Sequence
  Synthetic oligonucleotide; TTC chr2 60514774 60514795 60514779 60514774 -
acagcctcttatggtgccttac

SEQ ID NO: 217078 - DNA, 22 bp, Artificial Sequence
  Synthetic oligonucleotide; CTC chr2 60514766 60514787 60514771 60514766 -
ttatggtgccttaccctttcat

SEQ ID NO: 217079 - DNA, 22 bp, Artificial Sequence
  Synthetic oligonucleotide; CTT chr2 60514764 60514785 60514769 60514764 -
atggtgccttaccctttcattg

SEQ ID NO: 217080 - DNA, 22 bp, Artificial Sequence
  Synthetic oligonucleotide; TTA chr2 60514763 60514784 60514768 60514763 -
tggtgccttaccctttcattgt

SEQ ID NO: 217081 - DNA, 22 bp, Artificial Sequence
  Synthetic oligonucleotide; CTT chr2 60514754 60514775 60514759 60514754 -
accctttcattgtgttgtaaag

SEQ ID NO: 217082 - DNA, 22 bp, Artificial Sequence
  Synthetic oligonucleotide; TTA chr2 60514753 60514774 60514758 60514753 -
ccctttcattgtgttgtaaaga

SEQ ID NO: 217083 - DNA, 22 bp, Artificial Sequence
  Synthetic oligonucleotide; CTT chr2 60514748 60514769 60514753 60514748 -
tcattgtgttgtaaagacagtc

SEQ ID NO: 217084 - DNA, 22 bp, Artificial Sequence
  Synthetic oligonucleotide; TTT chr2 60514747 60514768 60514752 60514747 -
cattgtgttgtaaagacagtca

SEQ ID NO: 217085 - DNA, 22 bp, Artificial Sequence
  Synthetic oligonucleotide; TTC chr2 60514746 60514767 60514751 60514746 -
attgtgttgtaaagacagtcag

SEQ ID NO: 217086 - DNA, 22 bp, Artificial Sequence
  Synthetic oligonucleotide; TTG chr2 60514742 60514763 60514747 60514742 -
tgttgtaaagacagtcagacca

SEQ ID NO: 217087 - DNA, 22 bp, Artificial Sequence
  Synthetic oligonucleotide; TTG chr2 60514737 60514758 60514742 60514737 -
taaagacagtcagaccaactag

SEQ ID NO: 217088 - DNA, 22 bp, Artificial Sequence
  Synthetic oligonucleotide; CTA chr2 60514716 60514737 60514721 60514716 -
gatttatttgcacaactctgat

SEQ ID NO: 217089 - DNA, 22 bp, Artificial Sequence
  Synthetic oligonucleotide; TTT chr2 60514711 60514732 60514716 60514711 -
atttgcacaactctgatttttt

SEQ ID NO: 217090 - DNA, 22 bp, Artificial Sequence
  Synthetic oligonucleotide; TTA chr2 60514710 60514731 60514715 60514710 -
tttgcacaactctgattttttt

SEQ ID NO: 217091 - DNA, 22 bp, Artificial Sequence
  Synthetic oligonucleotide; TTT chr2 60514707 60514728 60514712 60514707 -
gcacaactctgatttttttcct

SEQ ID NO: 217092 - DNA, 22 bp, Artificial Sequence
  Synthetic oligonucleotide; TTG chr2 60514706 60514727 60514711 60514706 -
cacaactctgatttttttccta

SEQ ID NO: 217093 - DNA, 22 bp, Artificial Sequence
  Synthetic oligonucleotide; CTC chr2 60514698 60514719 60514703 60514698 -
tgatttttttcctaagaaactc

SEQ ID NO: 217094 - DNA, 22 bp, Artificial Sequence
  Synthetic oligonucleotide; CTG chr2 60514696 60514717 60514701 60514696 -
atttttttcctaagaaactccc

SEQ ID NO: 217095 - DNA, 22 bp, Artificial Sequence
  Synthetic oligonucleotide; TTT chr2 60514692 60514713 60514697 60514692 -
ttttcctaagaaactcccccac

SEQ ID NO: 217096 - DNA, 22 bp, Artificial Sequence
  Synthetic oligonucleotide; TTT chr2 60514691 60514712 60514696 60514691 -
tttcctaagaaactcccccacc

SEQ ID NO: 217097 - DNA, 22 bp, Artificial Sequence
  Synthetic oligonucleotide; TTT chr2 60514690 60514711 60514695 60514690 -
ttcctaagaaactcccccaccc

SEQ ID NO: 217098 - DNA, 22 bp, Artificial Sequence
  Synthetic oligonucleotide; TTT chr2 60514689 60514710 60514694 60514689 -
tcctaagaaactcccccaccca

SEQ ID NO: 217099 - DNA, 22 bp, Artificial Sequence
  Synthetic oligonucleotide; TTT chr2 60514688 60514709 60514693 60514688 -
cctaagaaactcccccacccaa

SEQ ID NO: 217100 - DNA, 22 bp, Artificial Sequence
  Synthetic oligonucleotide; TTC chr2 60514687 60514708 60514692 60514687 -
ctaagaaactcccccacccaat

SEQ ID NO: 217101 - DNA, 22 bp, Artificial Sequence
  Synthetic oligonucleotide; CTA chr2 60514684 60514705 60514689 60514684 -
agaaactcccccacccaattta

SEQ ID NO: 217102 - DNA, 22 bp, Artificial Sequence
  Synthetic oligonucleotide; CTC chr2 60514676 60514697 60514681 60514676 -
ccccacccaatttaattttttt

SEQ ID NO: 217103 - DNA, 22 bp, Artificial Sequence
  Synthetic oligonucleotide; TTT chr2 60514663 60514684 60514668 60514663 -
aatttttttttttttttgagat

SEQ ID NO: 217104 - DNA, 22 bp, Artificial Sequence
  Synthetic oligonucleotide; TTA chr2 60514662 60514683 60514667 60514662 -
atttttttttttttttgagatg

SEQ ID NO: 217105 - DNA, 22 bp, Artificial Sequence
  Synthetic oligonucleotide; TTT chr2 60514658 60514679 60514663 60514658 -
ttttttttttttgagatggagt

SEQ ID NO: 217106 - DNA, 22 bp, Artificial Sequence
  Synthetic oligonucleotide; TTT chr2 60514657 60514678 60514662 60514657 -
tttttttttttgagatggagtc

SEQ ID NO: 217107 - DNA, 22 bp, Artificial Sequence
  Synthetic oligonucleotide; TTT chr2 60514656 60514677 60514661 60514656 -
ttttttttttgagatggagtct

SEQ ID NO: 217108 - DNA, 22 bp, Artificial Sequence
  Synthetic oligonucleotide; TTT chr2 60514655 60514676 60514660 60514655 -
tttttttttgagatggagtctc

SEQ ID NO: 217109 - DNA, 22 bp, Artificial Sequence
  Synthetic oligonucleotide; TTT chr2 60514654 60514675 60514659 60514654 -
ttttttttgagatggagtctcg

SEQ ID NO: 217110 - DNA, 22 bp, Artificial Sequence
  Synthetic oligonucleotide; TTT chr2 60514653 60514674 60514658 60514653 -
tttttttgagatggagtctcgc

SEQ ID NO: 217111 - DNA, 22 bp, Artificial Sequence
  Synthetic oligonucleotide; TTT chr2 60514652 60514673 60514657 60514652 -
ttttttgagatggagtctcgct

SEQ ID NO: 217112 - DNA, 22 bp, Artificial Sequence
  Synthetic oligonucleotide; TTT chr2 60514651 60514672 60514656 60514651 -
tttttgagatggagtctcgctc

SEQ ID NO: 217113 - DNA, 22 bp, Artificial Sequence
  Synthetic oligonucleotide; TTT chr2 60514650 60514671 60514655 60514650 -
ttttgagatggagtctcgctct

SEQ ID NO: 217114 - DNA, 22 bp, Artificial Sequence
  Synthetic oligonucleotide; TTT chr2 60514649 60514670 60514654 60514649 -
tttgagatggagtctcgctctg

SEQ ID NO: 217115 - DNA, 22 bp, Artificial Sequence
  Synthetic oligonucleotide; TTT chr2 60514648 60514669 60514653 60514648 -
ttgagatggagtctcgctctgt

SEQ ID NO: 217116 - DNA, 22 bp, Artificial Sequence
  Synthetic oligonucleotide; TTT chr2 60514647 60514668 60514652 60514647 -
tgagatggagtctcgctctgtc

SEQ ID NO: 217117 - DNA, 22 bp, Artificial Sequence
  Synthetic oligonucleotide; TTT chr2 60514646 60514667 60514651 60514646 -
gagatggagtctcgctctgtcg

SEQ ID NO: 217118 - DNA, 22 bp, Artificial Sequence
  Synthetic oligonucleotide; TTG chr2 60514645 60514666 60514650 60514645 -
agatggagtctcgctctgtcgc

SEQ ID NO: 217119 - DNA, 22 bp, Artificial Sequence
  Synthetic oligonucleotide; CTC chr2 60514633 60514654 60514638 60514633 -
gctctgtcgcccaggctggagt

SEQ ID NO: 217120 - DNA, 22 bp, Artificial Sequence
  Synthetic oligonucleotide; CTC chr2 60514629 60514650 60514634 60514629 -
tgtcgcccaggctggagtgcag

SEQ ID NO: 217121 - DNA, 22 bp, Artificial Sequence
  Synthetic oligonucleotide; CTG chr2 60514627 60514648 60514632 60514627 -
tcgcccaggctggagtgcagtg

SEQ ID NO: 217122 - DNA, 22 bp, Artificial Sequence
  Synthetic oligonucleotide; CTG chr2 60514615 60514636 60514620 60514615 -
gagtgcagtgctacgatctcgg

SEQ ID NO: 217123 - DNA, 22 bp, Artificial Sequence
  Synthetic oligonucleotide; CTA chr2 60514602 60514623 60514607 60514602 -
cgatctcggctcattgcagcct

SEQ ID NO: 217124 - DNA, 22 bp, Artificial Sequence
  Synthetic oligonucleotide; CTC chr2 60514595 60514616 60514600 60514595 -
ggctcattgcagcctccgcctc

SEQ ID NO: 217125 - DNA, 22 bp, Artificial Sequence
  Synthetic oligonucleotide; CTC chr2 60514590 60514611 60514595 60514590 -
attgcagcctccgcctcccagg

SEQ ID NO: 217126 - DNA, 22 bp, Artificial Sequence
  Synthetic oligonucleotide; TTG chr2 60514586 60514607 60514591 60514586 -
cagcctccgcctcccaggttca

SEQ ID NO: 217127 - DNA, 22 bp, Artificial Sequence
  Synthetic oligonucleotide; CTC chr2 60514579 60514600 60514584 60514579 -
cgcctcccaggttcaagtgatt

SEQ ID NO: 217128 - DNA, 22 bp, Artificial Sequence
  Synthetic oligonucleotide; CTC chr2 60514573 60514594 60514578 60514573 -
ccaggttcaagtgattctcctg

SEQ ID NO: 217129 - DNA, 22 bp, Artificial Sequence
  Synthetic oligonucleotide; TTC chr2 60514565 60514586 60514570 60514565 -
aagtgattctcctgcctcagcc

SEQ ID NO: 217130 - DNA, 22 bp, Artificial Sequence
  Synthetic oligonucleotide; TTC chr2 60514556 60514577 60514561 60514556 -
tcctgcctcagcctcccaagta

SEQ ID NO: 217131 - DNA, 22 bp, Artificial Sequence
  Synthetic oligonucleotide; CTC chr2 60514554 60514575 60514559 60514554 -
ctgcctcagcctcccaagtagc

SEQ ID NO: 217132 - DNA, 22 bp, Artificial Sequence
  Synthetic oligonucleotide; CTG chr2 60514551 60514572 60514556 60514551 -
cctcagcctcccaagtagctgg

SEQ ID NO: 217133 - DNA, 22 bp, Artificial Sequence
  Synthetic oligonucleotide; CTC chr2 60514547 60514568 60514552 60514547 -
agcctcccaagtagctgggatt

SEQ ID NO: 217134 - DNA, 22 bp, Artificial Sequence
  Synthetic oligonucleotide; CTC chr2 60514541 60514562 60514546 60514541 -
ccaagtagctgggattataggt

SEQ ID NO: 217135 - DNA, 22 bp, Artificial Sequence
  Synthetic oligonucleotide; CTG chr2 60514530 60514551 60514535 60514530 -
ggattataggtgcatgccatca

SEQ ID NO: 217136 - DNA, 22 bp, Artificial Sequence
  Synthetic oligonucleotide; TTA chr2 60514524 60514545 60514529 60514524 -
taggtgcatgccatcacacctg

SEQ ID NO: 217137 - DNA, 22 bp, Artificial Sequence
  Synthetic oligonucleotide; CTG chr2 60514502 60514523 60514507 60514502 -
gctgattttttttttttttttt

SEQ ID NO: 217138 - DNA, 22 bp, Artificial Sequence
  Synthetic oligonucleotide; CTG chr2 60514498 60514519 60514503 60514498 -
attttttttttttttttttttt

SEQ ID NO: 217139 - DNA, 22 bp, Artificial Sequence
  Synthetic oligonucleotide; TTT chr2 60514494 60514515 60514499 60514494 -
ttttttttttttttttttttaa

SEQ ID NO: 217140 - DNA, 22 bp, Artificial Sequence
  Synthetic oligonucleotide; TTT chr2 60514493 60514514 60514498 60514493 -
tttttttttttttttttttaag

SEQ ID NO: 217141 - DNA, 22 bp, Artificial Sequence
  Synthetic oligonucleotide; TTT chr2 60514492 60514513 60514497 60514492 -
ttttttttttttttttttaagt

SEQ ID NO: 217142 - DNA, 22 bp, Artificial Sequence
  Synthetic oligonucleotide; TTT chr2 60514491 60514512 60514496 60514491 -
tttttttttttttttttaagta

SEQ ID NO: 217143 - DNA, 22 bp, Artificial Sequence
  Synthetic oligonucleotide; TTT chr2 60514490 60514511 60514495 60514490 -
ttttttttttttttttaagtag

SEQ ID NO: 217144 - DNA, 22 bp, Artificial Sequence
  Synthetic oligonucleotide; TTT chr2 60514489 60514510 60514494 60514489 -
tttttttttttttttaagtaga

SEQ ID NO: 217145 - DNA, 22 bp, Artificial Sequence
  Synthetic oligonucleotide; TTT chr2 60514488 60514509 60514493 60514488 -
ttttttttttttttaagtagag

SEQ ID NO: 217146 - DNA, 22 bp, Artificial Sequence
  Synthetic oligonucleotide; TTT chr2 60514487 60514508 60514492 60514487 -
tttttttttttttaagtagaga

SEQ ID NO: 217147 - DNA, 22 bp, Artificial Sequence
  Synthetic oligonucleotide; TTT chr2 60514486 60514507 60514491 60514486 -
ttttttttttttaagtagagat

SEQ ID NO: 217148 - DNA, 22 bp, Artificial Sequence
  Synthetic oligonucleotide; TTT chr2 60514485 60514506 60514490 60514485 -
tttttttttttaagtagagatg

SEQ ID NO: 217149 - DNA, 22 bp, Artificial Sequence
  Synthetic oligonucleotide; TTT chr2 60514484 60514505 60514489 60514484 -
ttttttttttaagtagagatgg

SEQ ID NO: 217150 - DNA, 22 bp, Artificial Sequence
  Synthetic oligonucleotide; TTT chr2 60514483 60514504 60514488 60514483 -
tttttttttaagtagagatggg

SEQ ID NO: 217151 - DNA, 22 bp, Artificial Sequence
  Synthetic oligonucleotide; TTT chr2 60514482 60514503 60514487 60514482 -
ttttttttaagtagagatgggg

SEQ ID NO: 217152 - DNA, 22 bp, Artificial Sequence
  Synthetic oligonucleotide; TTT chr2 60514481 60514502 60514486 60514481 -
tttttttaagtagagatggggt

SEQ ID NO: 217153 - DNA, 22 bp, Artificial Sequence
  Synthetic oligonucleotide; TTT chr2 60514480 60514501 60514485 60514480 -
ttttttaagtagagatggggtt

SEQ ID NO: 217154 - DNA, 22 bp, Artificial Sequence
  Synthetic oligonucleotide; TTT chr2 60514479 60514500 60514484 60514479 -
tttttaagtagagatggggttt

SEQ ID NO: 217155 - DNA, 22 bp, Artificial Sequence
  Synthetic oligonucleotide; TTT chr2 60514478 60514499 60514483 60514478 -
ttttaagtagagatggggtttc

SEQ ID NO: 217156 - DNA, 22 bp, Artificial Sequence
  Synthetic oligonucleotide; TTT chr2 60514477 60514498 60514482 60514477 -
tttaagtagagatggggtttca

SEQ ID NO: 217157 - DNA, 22 bp, Artificial Sequence
  Synthetic oligonucleotide; TTT chr2 60514476 60514497 60514481 60514476 -
ttaagtagagatggggtttcac

SEQ ID NO: 217158 - DNA, 22 bp, Artificial Sequence
  Synthetic oligonucleotide; TTT chr2 60514475 60514496 60514480 60514475 -
taagtagagatggggtttcacc

SEQ ID NO: 217159 - DNA, 22 bp, Artificial Sequence
  Synthetic oligonucleotide; TTT chr2 60514474 60514495 60514479 60514474 -
aagtagagatggggtttcacca

SEQ ID NO: 217160 - DNA, 22 bp, Artificial Sequence
  Synthetic oligonucleotide; TTA chr2 60514473 60514494 60514478 60514473 -
agtagagatggggtttcaccat

SEQ ID NO: 217161 - DNA, 22 bp, Artificial Sequence
  Synthetic oligonucleotide; TTT chr2 60514457 60514478 60514462 60514457 -
caccatgttggctaggctggtc

SEQ ID NO: 217162 - DNA, 22 bp, Artificial Sequence
  Synthetic oligonucleotide; TTC chr2 60514456 60514477 60514461 60514456 -
accatgttggctaggctggtct

SEQ ID NO: 217163 - DNA, 22 bp, Artificial Sequence
  Synthetic oligonucleotide; TTG chr2 60514447 60514468 60514452 60514447 -
gctaggctggtcttgaactcct

SEQ ID NO: 217164 - DNA, 22 bp, Artificial Sequence
  Synthetic oligonucleotide; CTA chr2 60514443 60514464 60514448 60514443 -
ggctggtcttgaactcctgacc

SEQ ID NO: 217165 - DNA, 22 bp, Artificial Sequence
  Synthetic oligonucleotide; CTG chr2 60514438 60514459 60514443 60514438 -
gtcttgaactcctgacctcagg

SEQ ID NO: 217166 - DNA, 22 bp, Artificial Sequence
  Synthetic oligonucleotide; CTT chr2 60514433 60514454 60514438 60514433 -
gaactcctgacctcaggtgacc

SEQ ID NO: 217167 - DNA, 22 bp, Artificial Sequence
  Synthetic oligonucleotide; TTG chr2 60514432 60514453 60514437 60514432 -
aactcctgacctcaggtgaccc

SEQ ID NO: 217168 - DNA, 22 bp, Artificial Sequence
  Synthetic oligonucleotide; CTC chr2 60514427 60514448 60514432 60514427 -
ctgacctcaggtgacccacacg

SEQ ID NO: 217169 - DNA, 22 bp, Artificial Sequence
  Synthetic oligonucleotide; CTG chr2 60514424 60514445 60514429 60514424 -
acctcaggtgacccacacgcct

SEQ ID NO: 217170 - DNA, 22 bp, Artificial Sequence
  Synthetic oligonucleotide; CTC chr2 60514419 60514440 60514424 60514419 -
aggtgacccacacgcctcggcc

SEQ ID NO: 217171 - DNA, 22 bp, Artificial Sequence
  Synthetic oligonucleotide; CTC chr2 60514401 60514422 60514406 60514401 -
ggcctcccaaaatgctgagatt

SEQ ID NO: 217172 - DNA, 22 bp, Artificial Sequence
  Synthetic oligonucleotide; CTC chr2 60514395 60514416 60514400 60514395 -
ccaaaatgctgagattacaggt

SEQ ID NO: 217173 - DNA, 22 bp, Artificial Sequence
  Synthetic oligonucleotide; CTG chr2 60514384 60514405 60514389 60514384 -
agattacaggtgtgagccaccg

SEQ ID NO: 217174 - DNA, 22 bp, Artificial Sequence
  Synthetic oligonucleotide; TTA chr2 60514378 60514399 60514383 60514378 -
caggtgtgagccaccgcacctg

SEQ ID NO: 217175 - DNA, 22 bp, Artificial Sequence
  Synthetic oligonucleotide; CTG chr2 60514356 60514377 60514361 60514356 -
gctatttaattctattttcaga

SEQ ID NO: 217176 - DNA, 22 bp, Artificial Sequence
  Synthetic oligonucleotide; CTA chr2 60514352 60514373 60514357 60514352 -
tttaattctattttcagatggc

SEQ ID NO: 217177 - DNA, 22 bp, Artificial Sequence
  Synthetic oligonucleotide; TTT chr2 60514349 60514370 60514354 60514349 -
aattctattttcagatggcttg

SEQ ID NO: 217178 - DNA, 22 bp, Artificial Sequence
  Synthetic oligonucleotide; TTA chr2 60514348 60514369 60514353 60514348 -
attctattttcagatggcttgt

SEQ ID NO: 217179 - DNA, 22 bp, Artificial Sequence
  Synthetic oligonucleotide; TTC chr2 60514344 60514365 60514349 60514344 -
tattttcagatggcttgttctc

SEQ ID NO: 217180 - DNA, 22 bp, Artificial Sequence
  Synthetic oligonucleotide; CTA chr2 60514342 60514363 60514347 60514342 -
ttttcagatggcttgttctcca

SEQ ID NO: 217181 - DNA, 22 bp, Artificial Sequence
  Synthetic oligonucleotide; TTT chr2 60514339 60514360 60514344 60514339 -
tcagatggcttgttctccaagt

SEQ ID NO: 217182 - DNA, 22 bp, Artificial Sequence
  Synthetic oligonucleotide; TTT chr2 60514338 60514359 60514343 60514338 -
cagatggcttgttctccaagtc

SEQ ID NO: 217183 - DNA, 22 bp, Artificial Sequence
  Synthetic oligonucleotide; TTC chr2 60514337 60514358 60514342 60514337 -
agatggcttgttctccaagtct

SEQ ID NO: 217184 - DNA, 22 bp, Artificial Sequence
  Synthetic oligonucleotide; CTT chr2 60514328 60514349 60514333 60514328 -
gttctccaagtcttgggactgc

SEQ ID NO: 217185 - DNA, 22 bp, Artificial Sequence
  Synthetic oligonucleotide; TTG chr2 60514327 60514348 60514332 60514327 -
ttctccaagtcttgggactgcc

SEQ ID NO: 217186 - DNA, 22 bp, Artificial Sequence
  Synthetic oligonucleotide; TTC chr2 60514324 60514345 60514329 60514324 -
tccaagtcttgggactgcccag

SEQ ID NO: 217187 - DNA, 22 bp, Artificial Sequence
  Synthetic oligonucleotide; CTC chr2 60514322 60514343 60514327 60514322 -
caagtcttgggactgcccagaa

SEQ ID NO: 217188 - DNA, 22 bp, Artificial Sequence
  Synthetic oligonucleotide; CTT chr2 60514314 60514335 60514319 60514314 -
gggactgcccagaaatgggttg

SEQ ID NO: 217189 - DNA, 22 bp, Artificial Sequence
  Synthetic oligonucleotide; TTG chr2 60514313 60514334 60514318 60514313 -
ggactgcccagaaatgggttgc

SEQ ID NO: 217190 - DNA, 22 bp, Artificial Sequence
  Synthetic oligonucleotide; CTG chr2 60514307 60514328 60514312 60514307 -
cccagaaatgggttgcctggta

SEQ ID NO: 217191 - DNA, 22 bp, Artificial Sequence
  Synthetic oligonucleotide; TTG chr2 60514292 60514313 60514297 60514292 -
cctggtagggctcatggctcag

SEQ ID NO: 217192 - DNA, 22 bp, Artificial Sequence
  Synthetic oligonucleotide; CTG chr2 60514288 60514309 60514293 60514288 -
gtagggctcatggctcagcact

SEQ ID NO: 217193 - DNA, 22 bp, Artificial Sequence
  Synthetic oligonucleotide; CTC chr2 60514279 60514300 60514284 60514279 -
atggctcagcactgcgatccca

SEQ ID NO: 217194 - DNA, 22 bp, Artificial Sequence
  Synthetic oligonucleotide; CTC chr2 60514272 60514293 60514277 60514272 -
agcactgcgatcccaccagtgg

SEQ ID NO: 217195 - DNA, 22 bp, Artificial Sequence
  Synthetic oligonucleotide; CTG chr2 60514265 60514286 60514270 60514265 -
cgatcccaccagtggccggggt

SEQ ID NO: 217196 - DNA, 22 bp, Artificial Sequence
  Synthetic oligonucleotide; TTC chr2 60514239 60514260 60514244 60514239 -
cttagccttctagttcagttgt

SEQ ID NO: 217197 - DNA, 22 bp, Artificial Sequence
  Synthetic oligonucleotide; CTT chr2 60514236 60514257 60514241 60514236 -
agccttctagttcagttgtggc

SEQ ID NO: 217198 - DNA, 22 bp, Artificial Sequence
  Synthetic oligonucleotide; TTA chr2 60514235 60514256 60514240 60514235 -
gccttctagttcagttgtggcc

SEQ ID NO: 217199 - DNA, 22 bp, Artificial Sequence
  Synthetic oligonucleotide; CTT chr2 60514230 60514251 60514235 60514230 -
ctagttcagttgtggcccttct

SEQ ID NO: 217200 - DNA, 22 bp, Artificial Sequence
  Synthetic oligonucleotide; TTC chr2 60514229 60514250 60514234 60514229 -
tagttcagttgtggcccttctg

SEQ ID NO: 217201 - DNA, 22 bp, Artificial Sequence
  Synthetic oligonucleotide; CTA chr2 60514227 60514248 60514232 60514227 -
gttcagttgtggcccttctggg

SEQ ID NO: 217202 - DNA, 22 bp, Artificial Sequence
  Synthetic oligonucleotide; TTC chr2 60514223 60514244 60514228 60514223 -
agttgtggcccttctgggcttc

SEQ ID NO: 217203 - DNA, 22 bp, Artificial Sequence
  Synthetic oligonucleotide; TTG chr2 60514218 60514239 60514223 60514218 -
tggcccttctgggcttcctttg

SEQ ID NO: 217204 - DNA, 22 bp, Artificial Sequence
  Synthetic oligonucleotide; CTT chr2 60514210 60514231 60514215 60514210 -
ctgggcttcctttgctaccagt

SEQ ID NO: 217205 - DNA, 22 bp, Artificial Sequence
  Synthetic oligonucleotide; TTC chr2 60514209 60514230 60514214 60514209 -
tgggcttcctttgctaccagtt

SEQ ID NO: 217206 - DNA, 22 bp, Artificial Sequence
  Synthetic oligonucleotide; CTG chr2 60514207 60514228 60514212 60514207 -
ggcttcctttgctaccagtttc

SEQ ID NO: 217207 - DNA, 22 bp, Artificial Sequence
  Synthetic oligonucleotide; CTT chr2 60514202 60514223 60514207 60514202 -
cctttgctaccagtttccacca

SEQ ID NO: 217208 - DNA, 22 bp, Artificial Sequence
  Synthetic oligonucleotide; TTC chr2 60514201 60514222 60514206 60514201 -
ctttgctaccagtttccaccac

SEQ ID NO: 217209 - DNA, 22 bp, Artificial Sequence
  Synthetic oligonucleotide; CTT chr2 60514198 60514219 60514203 60514198 -
tgctaccagtttccaccacatg

SEQ ID NO: 217210 - DNA, 22 bp, Artificial Sequence
  Synthetic oligonucleotide; TTT chr2 60514197 60514218 60514202 60514197 -
gctaccagtttccaccacatgg

SEQ ID NO: 217211 - DNA, 22 bp, Artificial Sequence
  Synthetic oligonucleotide; TTG chr2 60514196 60514217 60514201 60514196 -
ctaccagtttccaccacatggc

SEQ ID NO: 217212 - DNA, 22 bp, Artificial Sequence
  Synthetic oligonucleotide; CTA chr2 60514193 60514214 60514198 60514193 -
ccagtttccaccacatggctgg

SEQ ID NO: 217213 - DNA, 22 bp, Artificial Sequence
  Synthetic oligonucleotide; TTT chr2 60514186 60514207 60514191 60514186 -
ccaccacatggctggaggtagc

SEQ ID NO: 217214 - DNA, 22 bp, Artificial Sequence
  Synthetic oligonucleotide; TTC chr2 60514185 60514206 60514190 60514185 -
caccacatggctggaggtagcc

SEQ ID NO: 217215 - DNA, 22 bp, Artificial Sequence
  Synthetic oligonucleotide; CTG chr2 60514172 60514193 60514177 60514172 -
gaggtagcccagcctggaagcc

SEQ ID NO: 217216 - DNA, 22 bp, Artificial Sequence
  Synthetic oligonucleotide; CTG chr2 60514156 60514177 60514161 60514156 -
gaagcctctcagagctccagcc

SEQ ID NO: 217217 - DNA, 22 bp, Artificial Sequence
  Synthetic oligonucleotide; CTC chr2 60514148 60514169 60514153 60514148 -
tcagagctccagcctggaagcc

SEQ ID NO: 217218 - DNA, 22 bp, Artificial Sequence
  Synthetic oligonucleotide; CTC chr2 60514146 60514167 60514151 60514146 -
agagctccagcctggaagcctc

SEQ ID NO: 217219 - DNA, 22 bp, Artificial Sequence
  Synthetic oligonucleotide; CTC chr2 60514139 60514160 60514144 60514139 -
cagcctggaagcctctcagaga

SEQ ID NO: 217220 - DNA, 22 bp, Artificial Sequence
  Synthetic oligonucleotide; CTG chr2 60514132 60514153 60514137 60514132 -
gaagcctctcagagagtgcttg

SEQ ID NO: 217221 - DNA, 22 bp, Artificial Sequence
  Synthetic oligonucleotide; CTC chr2 60514124 60514145 60514129 60514124 -
tcagagagtgcttggagcactg

SEQ ID NO: 217222 - DNA, 22 bp, Artificial Sequence
  Synthetic oligonucleotide; CTC chr2 60514122 60514143 60514127 60514122 -
agagagtgcttggagcactgct

SEQ ID NO: 217223 - DNA, 22 bp, Artificial Sequence
  Synthetic oligonucleotide; CTT chr2 60514111 60514132 60514116 60514111 -
ggagcactgctagctgcacgtg

SEQ ID NO: 217224 - DNA, 22 bp, Artificial Sequence
  Synthetic oligonucleotide; TTG chr2 60514110 60514131 60514115 60514110 -
gagcactgctagctgcacgtgc

SEQ ID NO: 217225 - DNA, 22 bp, Artificial Sequence
  Synthetic oligonucleotide; CTG chr2 60514102 60514123 60514107 60514102 -
ctagctgcacgtgctctcagga

SEQ ID NO: 217226 - DNA, 22 bp, Artificial Sequence
  Synthetic oligonucleotide; CTA chr2 60514099 60514120 60514104 60514099 -
gctgcacgtgctctcaggaaag

SEQ ID NO: 217227 - DNA, 22 bp, Artificial Sequence
  Synthetic oligonucleotide; CTG chr2 60514095 60514116 60514100 60514095 -
cacgtgctctcaggaaagtcca

SEQ ID NO: 217228 - DNA, 22 bp, Artificial Sequence
  Synthetic oligonucleotide; CTC chr2 60514086 60514107 60514091 60514086 -
tcaggaaagtccacaaggagat

SEQ ID NO: 217229 - DNA, 22 bp, Artificial Sequence
  Synthetic oligonucleotide; CTC chr2 60514084 60514105 60514089 60514084 -
aggaaagtccacaaggagatgg

SEQ ID NO: 217230 - DNA, 22 bp, Artificial Sequence
  Synthetic oligonucleotide; CTG chr2 60514059 60514080 60514064 60514059 -
gtgtggctcagagtccttgtgt

SEQ ID NO: 217231 - DNA, 22 bp, Artificial Sequence
  Synthetic oligonucleotide; CTC chr2 60514050 60514071 60514055 60514050 -
agagtccttgtgtgctgcctca

SEQ ID NO: 217232 - DNA, 22 bp, Artificial Sequence
  Synthetic oligonucleotide; CTT chr2 60514041 60514062 60514046 60514041 -
gtgtgctgcctcagcccatgcc

SEQ ID NO: 217233 - DNA, 22 bp, Artificial Sequence
  Synthetic oligonucleotide; TTG chr2 60514040 60514061 60514045 60514040 -
tgtgctgcctcagcccatgcca

SEQ ID NO: 217234 - DNA, 22 bp, Artificial Sequence
  Synthetic oligonucleotide; CTG chr2 60514033 60514054 60514038 60514033 -
cctcagcccatgccaggccacc

SEQ ID NO: 217235 - DNA, 22 bp, Artificial Sequence
  Synthetic oligonucleotide; CTC chr2 60514029 60514050 60514034 60514029 -
agcccatgccaggccacctgtg

SEQ ID NO: 217236 - DNA, 22 bp, Artificial Sequence
  Synthetic oligonucleotide; CTG chr2 60514009 60514030 60514014 60514009 -
tggctgtctgccctcaagtctg

SEQ ID NO: 217237 - DNA, 22 bp, Artificial Sequence
  Synthetic oligonucleotide; CTG chr2 60514003 60514024 60514008 60514003 -
tctgccctcaagtctgtccttc

SEQ ID NO: 217238 - DNA, 22 bp, Artificial Sequence
  Synthetic oligonucleotide; CTG chr2 60513999 60514020 60514004 60513999 -
ccctcaagtctgtccttctctg

SEQ ID NO: 217239 - DNA, 22 bp, Artificial Sequence
  Synthetic oligonucleotide; CTC chr2 60513994 60514015 60513999 60513994 -
aagtctgtccttctctgaggat

SEQ ID NO: 217240 - DNA, 22 bp, Artificial Sequence
  Synthetic oligonucleotide; CTG chr2 60513987 60514008 60513992 60513987 -
tccttctctgaggatttaggac

SEQ ID NO: 217241 - DNA, 22 bp, Artificial Sequence
  Synthetic oligonucleotide; CTT chr2 60513982 60514003 60513987 60513982 -
ctctgaggatttaggactgtga

SEQ ID NO: 217242 - DNA, 22 bp, Artificial Sequence
  Synthetic oligonucleotide; TTC chr2 60513981 60514002 60513986 60513981 -
tctgaggatttaggactgtgaa

SEQ ID NO: 217243 - DNA, 22 bp, Artificial Sequence
  Synthetic oligonucleotide; CTC chr2 60513979 60514000 60513984 60513979 -
tgaggatttaggactgtgaacc

SEQ ID NO: 217244 - DNA, 22 bp, Artificial Sequence
  Synthetic oligonucleotide; CTG chr2 60513977 60513998 60513982 60513977 -
aggatttaggactgtgaaccta

SEQ ID NO: 217245 - DNA, 22 bp, Artificial Sequence
  Synthetic oligonucleotide; TTT chr2 60513970 60513991 60513975 60513970 -
aggactgtgaacctagagaatt

SEQ ID NO: 217246 - DNA, 22 bp, Artificial Sequence
  Synthetic oligonucleotide; TTA chr2 60513969 60513990 60513974 60513969 -
ggactgtgaacctagagaattc

SEQ ID NO: 217247 - DNA, 22 bp, Artificial Sequence
  Synthetic oligonucleotide; CTG chr2 60513963 60513984 60513968 60513963 -
tgaacctagagaattcaaagta

SEQ ID NO: 217248 - DNA, 22 bp, Artificial Sequence
  Synthetic oligonucleotide; CTA chr2 60513955 60513976 60513960 60513955 -
gagaattcaaagtagtggaact

SEQ ID NO: 217249 - DNA, 22 bp, Artificial Sequence
  Synthetic oligonucleotide; TTC chr2 60513947 60513968 60513952 60513947 -
aaagtagtggaactagaatcca

SEQ ID NO: 217250 - DNA, 22 bp, Artificial Sequence
  Synthetic oligonucleotide; CTA chr2 60513932 60513953 60513937 60513932 -
gaatccaggtctcgactcaatc

SEQ ID NO: 217251 - DNA, 22 bp, Artificial Sequence
  Synthetic oligonucleotide; CTC chr2 60513919 60513940 60513924 60513919 -
gactcaatccagggagttttgc

SEQ ID NO: 217252 - DNA, 22 bp, Artificial Sequence
  Synthetic oligonucleotide; CTC chr2 60513914 60513935 60513919 60513914 -
aatccagggagttttgctcacc

SEQ ID NO: 217253 - DNA, 22 bp, Artificial Sequence
  Synthetic oligonucleotide; TTT chr2 60513900 60513921 60513905 60513900 -
tgctcaccacaagccaggaaca

SEQ ID NO: 217254 - DNA, 22 bp, Artificial Sequence
  Synthetic oligonucleotide; TTT chr2 60513899 60513920 60513904 60513899 -
gctcaccacaagccaggaacag

SEQ ID NO: 217255 - DNA, 22 bp, Artificial Sequence
  Synthetic oligonucleotide; TTG chr2 60513898 60513919 60513903 60513898 -
ctcaccacaagccaggaacagc

SEQ ID NO: 217256 - DNA, 22 bp, Artificial Sequence
  Synthetic oligonucleotide; CTC chr2 60513895 60513916 60513900 60513895 -
accacaagccaggaacagcttc

SEQ ID NO: 217257 - DNA, 22 bp, Artificial Sequence
  Synthetic oligonucleotide; CTT chr2 60513874 60513895 60513879 60513874 -
ctcttcatggaggtgcctgtct

SEQ ID NO: 217258 - DNA, 22 bp, Artificial Sequence
  Synthetic oligonucleotide; TTC chr2 60513873 60513894 60513878 60513873 -
tcttcatggaggtgcctgtctg

SEQ ID NO: 217259 - DNA, 22 bp, Artificial Sequence
  Synthetic oligonucleotide; CTC chr2 60513871 60513892 60513876 60513871 -
ttcatggaggtgcctgtctgga

SEQ ID NO: 217260 - DNA, 22 bp, Artificial Sequence
  Synthetic oligonucleotide; CTT chr2 60513869 60513890 60513874 60513869 -
catggaggtgcctgtctggaag

SEQ ID NO: 217261 - DNA, 22 bp, Artificial Sequence
  Synthetic oligonucleotide; TTC chr2 60513868 60513889 60513873 60513868 -
atggaggtgcctgtctggaagg

SEQ ID NO: 217262 - DNA, 22 bp, Artificial Sequence
  Synthetic oligonucleotide; CTG chr2 60513855 60513876 60513860 60513855 -
tctggaaggcagagaatctctg

SEQ ID NO: 217263 - DNA, 22 bp, Artificial Sequence
  Synthetic oligonucleotide; CTG chr2 60513851 60513872 60513856 60513851 -
gaaggcagagaatctctggctt

SEQ ID NO: 217264 - DNA, 22 bp, Artificial Sequence
  Synthetic oligonucleotide; CTC chr2 60513835 60513856 60513840 60513835 -
tggcttgttgagaagagagagt

SEQ ID NO: 217265 - DNA, 22 bp, Artificial Sequence
  Synthetic oligonucleotide; CTG chr2 60513833 60513854 60513838 60513833 -
gcttgttgagaagagagagtct

SEQ ID NO: 217266 - DNA, 22 bp, Artificial Sequence
  Synthetic oligonucleotide; CTT chr2 60513829 60513850 60513834 60513829 -
gttgagaagagagagtctgccc

SEQ ID NO: 217267 - DNA, 22 bp, Artificial Sequence
  Synthetic oligonucleotide; TTG chr2 60513828 60513849 60513833 60513828 -
ttgagaagagagagtctgccct

SEQ ID NO: 217268 - DNA, 22 bp, Artificial Sequence
  Synthetic oligonucleotide; TTG chr2 60513825 60513846 60513830 60513825 -
agaagagagagtctgcccttca

SEQ ID NO: 217269 - DNA, 22 bp, Artificial Sequence
  Synthetic oligonucleotide; CTG chr2 60513810 60513831 60513815 60513810 -
cccttcagactgcaaggtgttc

SEQ ID NO: 217270 - DNA, 22 bp, Artificial Sequence
  Synthetic oligonucleotide; CTT chr2 60513805 60513826 60513810 60513805 -
cagactgcaaggtgttcactgc

SEQ ID NO: 217271 - DNA, 22 bp, Artificial Sequence
  Synthetic oligonucleotide; TTC chr2 60513804 60513825 60513809 60513804 -
agactgcaaggtgttcactgca

SEQ ID NO: 217272 - DNA, 22 bp, Artificial Sequence
  Synthetic oligonucleotide; CTG chr2 60513798 60513819 60513803 60513798 -
caaggtgttcactgcataggac

SEQ ID NO: 217273 - DNA, 22 bp, Artificial Sequence
  Synthetic oligonucleotide; TTC chr2 60513788 60513809 60513793 60513788 -
actgcataggacccttcgtagg

SEQ ID NO: 217274 - DNA, 22 bp, Artificial Sequence
  Synthetic oligonucleotide; CTG chr2 60513784 60513805 60513789 60513784 -
cataggacccttcgtaggtgct

SEQ ID NO: 217275 - DNA, 22 bp, Artificial Sequence
  Synthetic oligonucleotide; CTT chr2 60513772 60513793 60513777 60513772 -
cgtaggtgctgacccagctgtg

SEQ ID NO: 217276 - DNA, 22 bp, Artificial Sequence
  Synthetic oligonucleotide; TTC chr2 60513771 60513792 60513776 60513771 -
gtaggtgctgacccagctgtgc

SEQ ID NO: 217277 - DNA, 22 bp, Artificial Sequence
  Synthetic oligonucleotide; CTG chr2 60513761 60513782 60513766 60513761 -
acccagctgtgcccagtgctag

SEQ ID NO: 217278 - DNA, 22 bp, Artificial Sequence
  Synthetic oligonucleotide; CTG chr2 60513752 60513773 60513757 60513752 -
tgcccagtgctagagctaggac

SEQ ID NO: 217279 - DNA, 22 bp, Artificial Sequence
  Synthetic oligonucleotide; CTA chr2 60513740 60513761 60513745 60513740 -
gagctaggactcagttctattt

SEQ ID NO: 217280 - DNA, 22 bp, Artificial Sequence
  Synthetic oligonucleotide; CTA chr2 60513734 60513755 60513739 60513734 -
ggactcagttctattttcccag

SEQ ID NO: 217281 - DNA, 22 bp, Artificial Sequence
  Synthetic oligonucleotide; CTC chr2 60513728 60513749 60513733 60513728 -
agttctattttcccagagagtg

SEQ ID NO: 217282 - DNA, 22 bp, Artificial Sequence
  Synthetic oligonucleotide; TTC chr2 60513723 60513744 60513728 60513723 -
tattttcccagagagtggtgtg

SEQ ID NO: 217283 - DNA, 22 bp, Artificial Sequence
  Synthetic oligonucleotide; CTA chr2 60513721 60513742 60513726 60513721 -
ttttcccagagagtggtgtgat

SEQ ID NO: 217284 - DNA, 22 bp, Artificial Sequence
  Synthetic oligonucleotide; TTT chr2 60513718 60513739 60513723 60513718 -
tcccagagagtggtgtgatggg

SEQ ID NO: 217285 - DNA, 22 bp, Artificial Sequence
  Synthetic oligonucleotide; TTT chr2 60513717 60513738 60513722 60513717 -
cccagagagtggtgtgatggga

SEQ ID NO: 217286 - DNA, 22 bp, Artificial Sequence
  Synthetic oligonucleotide; TTC chr2 60513716 60513737 60513721 60513716 -
ccagagagtggtgtgatgggag

SEQ ID NO: 217287 - DNA, 22 bp, Artificial Sequence
  Synthetic oligonucleotide; CTA chr2 60513690 60513711 60513695 60513690 -
tttctttttcttttttcagtcc

SEQ ID NO: 217288 - DNA, 22 bp, Artificial Sequence
  Synthetic oligonucleotide; TTT chr2 60513687 60513708 60513692 60513687 -
ctttttcttttttcagtcctga

SEQ ID NO: 217289 - DNA, 22 bp, Artificial Sequence
  Synthetic oligonucleotide; TTC chr2 60513686 60513707 60513691 60513686 -
tttttcttttttcagtcctgat

SEQ ID NO: 217290 - DNA, 22 bp, Artificial Sequence
  Synthetic oligonucleotide; CTT chr2 60513684 60513705 60513689 60513684 -
tttcttttttcagtcctgatca

SEQ ID NO: 217291 - DNA, 22 bp, Artificial Sequence
  Synthetic oligonucleotide; TTT chr2 60513683 60513704 60513688 60513683 -
ttcttttttcagtcctgatcag

SEQ ID NO: 217292 - DNA, 22 bp, Artificial Sequence
  Synthetic oligonucleotide; TTT chr2 60513682 60513703 60513687 60513682 -
tcttttttcagtcctgatcagg

SEQ ID NO: 217293 - DNA, 22 bp, Artificial Sequence
  Synthetic oligonucleotide; TTT chr2 60513681 60513702 60513686 60513681 -
cttttttcagtcctgatcaggg

SEQ ID NO: 217294 - DNA, 22 bp, Artificial Sequence
  Synthetic oligonucleotide; TTC chr2 60513680 60513701 60513685 60513680 -
ttttttcagtcctgatcaggga

SEQ ID NO: 217295 - DNA, 22 bp, Artificial Sequence
  Synthetic oligonucleotide; CTT chr2 60513678 60513699 60513683 60513678 -
ttttcagtcctgatcagggatg

SEQ ID NO: 217296 - DNA, 22 bp, Artificial Sequence
  Synthetic oligonucleotide; TTT chr2 60513677 60513698 60513682 60513677 -
tttcagtcctgatcagggatga

SEQ ID NO: 217297 - DNA, 22 bp, Artificial Sequence
  Synthetic oligonucleotide; TTT chr2 60513676 60513697 60513681 60513676 -
ttcagtcctgatcagggatgag

SEQ ID NO: 217298 - DNA, 22 bp, Artificial Sequence
  Synthetic oligonucleotide; TTT chr2 60513675 60513696 60513680 60513675 -
tcagtcctgatcagggatgagt

SEQ ID NO: 217299 - DNA, 22 bp, Artificial Sequence
  Synthetic oligonucleotide; TTT chr2 60513674 60513695 60513679 60513674 -
cagtcctgatcagggatgagtc

SEQ ID NO: 217300 - DNA, 22 bp, Artificial Sequence
  Synthetic oligonucleotide; TTC chr2 60513673 60513694 60513678 60513673 -
agtcctgatcagggatgagtcc

SEQ ID NO: 217301 - DNA, 22 bp, Artificial Sequence
  Synthetic oligonucleotide; CTG chr2 60513666 60513687 60513671 60513666 -
atcagggatgagtccgtgctgt

SEQ ID NO: 217302 - DNA, 22 bp, Artificial Sequence
  Synthetic oligonucleotide; CTG chr2 60513645 60513666 60513650 60513645 -
ttgggtttattcatttacttta

SEQ ID NO: 217303 - DNA, 22 bp, Artificial Sequence
  Synthetic oligonucleotide; TTG chr2 60513642 60513663 60513647 60513642 -
ggtttattcatttactttagcg

SEQ ID NO: 217304 - DNA, 22 bp, Artificial Sequence
  Synthetic oligonucleotide; TTT chr2 60513637 60513658 60513642 60513637 -
attcatttactttagcgtgtga

SEQ ID NO: 217305 - DNA, 22 bp, Artificial Sequence
  Synthetic oligonucleotide; TTA chr2 60513636 60513657 60513641 60513636 -
ttcatttactttagcgtgtgag

SEQ ID NO: 217306 - DNA, 22 bp, Artificial Sequence
  Synthetic oligonucleotide; TTC chr2 60513633 60513654 60513638 60513633 -
atttactttagcgtgtgagtgg

SEQ ID NO: 217307 - DNA, 22 bp, Artificial Sequence
  Synthetic oligonucleotide; TTT chr2 60513629 60513650 60513634 60513629 -
actttagcgtgtgagtggggag

SEQ ID NO: 217308 - DNA, 22 bp, Artificial Sequence
  Synthetic oligonucleotide; TTA chr2 60513628 60513649 60513633 60513628 -
ctttagcgtgtgagtggggaga

SEQ ID NO: 217309 - DNA, 22 bp, Artificial Sequence
  Synthetic oligonucleotide; CTT chr2 60513625 60513646 60513630 60513625 -
tagcgtgtgagtggggagatgg

SEQ ID NO: 217310 - DNA, 22 bp, Artificial Sequence
  Synthetic oligonucleotide; TTT chr2 60513624 60513645 60513629 60513624 -
agcgtgtgagtggggagatgga

SEQ ID NO: 217311 - DNA, 22 bp, Artificial Sequence
  Synthetic oligonucleotide; TTA chr2 60513623 60513644 60513628 60513623 -
gcgtgtgagtggggagatggat

SEQ ID NO: 217312 - DNA, 22 bp, Artificial Sequence
  Synthetic oligonucleotide; TTA chr2 60513599 60513620 60513604 60513599 -
ggcagcaggcccttggaagggt

SEQ ID NO: 217313 - DNA, 22 bp, Artificial Sequence
  Synthetic oligonucleotide; CTT chr2 60513585 60513606 60513590 60513585 -
ggaagggtgggaagattcagaa

SEQ ID NO: 217314 - DNA, 22 bp, Artificial Sequence
  Synthetic oligonucleotide; TTG chr2 60513584 60513605 60513589 60513584 -
gaagggtgggaagattcagaag

SEQ ID NO: 217315 - DNA, 22 bp, Artificial Sequence
  Synthetic oligonucleotide; TTC chr2 60513567 60513588 60513572 60513567 -
agaagagagagggcaggactgg

SEQ ID NO: 217316 - DNA, 22 bp, Artificial Sequence
  Synthetic oligonucleotide; CTG chr2 60513546 60513567 60513551 60513546 -
ggaagatccagacaggacatga

SEQ ID NO: 217317 - DNA, 22 bp, Artificial Sequence
  Synthetic oligonucleotide; TTT chr2 60513518 60513539 60513523 60513518 -
gctccacaaagagagaagcagc

SEQ ID NO: 217318 - DNA, 22 bp, Artificial Sequence
  Synthetic oligonucleotide; TTG chr2 60513517 60513538 60513522 60513517 -
ctccacaaagagagaagcagca

SEQ ID NO: 217319 - DNA, 22 bp, Artificial Sequence
  Synthetic oligonucleotide; CTC chr2 60513514 60513535 60513519 60513514 -
cacaaagagagaagcagcagga

SEQ ID NO: 217320 - DNA, 22 bp, Artificial Sequence
  Synthetic oligonucleotide; TTC chr2 60513488 60513509 60513493 60513488 -
tggctagaggctaacccaacac

SEQ ID NO: 217321 - DNA, 22 bp, Artificial Sequence
  Synthetic oligonucleotide; CTG chr2 60513486 60513507 60513491 60513486 -
gctagaggctaacccaacaccc

SEQ ID NO: 217322 - DNA, 22 bp, Artificial Sequence
  Synthetic oligonucleotide; CTA chr2 60513482 60513503 60513487 60513482 -
gaggctaacccaacacccacac

SEQ ID NO: 217323 - DNA, 22 bp, Artificial Sequence
  Synthetic oligonucleotide; CTA chr2 60513475 60513496 60513480 60513475 -
acccaacacccacacctgccaa

SEQ ID NO: 217324 - DNA, 22 bp, Artificial Sequence
  Synthetic oligonucleotide; CTG chr2 60513457 60513478 60513462 60513457 -
ccaaaggggttcccatggggtg

SEQ ID NO: 217325 - DNA, 22 bp, Artificial Sequence
  Synthetic oligonucleotide; TTC chr2 60513445 60513466 60513450 60513445 -
ccatggggtggctggcttgagg

SEQ ID NO: 217326 - DNA, 22 bp, Artificial Sequence
  Synthetic oligonucleotide; CTG chr2 60513431 60513452 60513436 60513431 -
gcttgaggggatctgggcgctg

SEQ ID NO: 217327 - DNA, 22 bp, Artificial Sequence
  Synthetic oligonucleotide; CTT chr2 60513427 60513448 60513432 60513427 -
gaggggatctgggcgctggttt

SEQ ID NO: 217328 - DNA, 22 bp, Artificial Sequence
  Synthetic oligonucleotide; TTG chr2 60513426 60513447 60513431 60513426 -
aggggatctgggcgctggtttc

SEQ ID NO: 217329 - DNA, 22 bp, Artificial Sequence
  Synthetic oligonucleotide; CTG chr2 60513416 60513437 60513421 60513416 -
ggcgctggtttctgctgtggac

SEQ ID NO: 217330 - DNA, 22 bp, Artificial Sequence
  Synthetic oligonucleotide; CTG chr2 60513409 60513430 60513414 60513409 -
gtttctgctgtggacagcctca

SEQ ID NO: 217331 - DNA, 22 bp, Artificial Sequence
  Synthetic oligonucleotide; TTT chr2 60513405 60513426 60513410 60513405 -
ctgctgtggacagcctcaagtg

SEQ ID NO: 217332 - DNA, 22 bp, Artificial Sequence
  Synthetic oligonucleotide; TTC chr2 60513404 60513425 60513409 60513404 -
tgctgtggacagcctcaagtgg

SEQ ID NO: 217333 - DNA, 22 bp, Artificial Sequence
  Synthetic oligonucleotide; CTG chr2 60513402 60513423 60513407 60513402 -
ctgtggacagcctcaagtgggg

SEQ ID NO: 217334 - DNA, 22 bp, Artificial Sequence
  Synthetic oligonucleotide; CTG chr2 60513399 60513420 60513404 60513399 -
tggacagcctcaagtggggcgt

SEQ ID NO: 217335 - DNA, 22 bp, Artificial Sequence
  Synthetic oligonucleotide; CTC chr2 60513388 60513409 60513393 60513388 -
aagtggggcgtggaggcagcat

SEQ ID NO: 217336 - DNA, 22 bp, Artificial Sequence
  Synthetic oligonucleotide; CTC chr2 60513363 60513384 60513368 60513363 -
cagaagcacccggcagatggct

SEQ ID NO: 217337 - DNA, 22 bp, Artificial Sequence
  Synthetic oligonucleotide; CTC chr2 60513340 60513361 60513345 60513340 -
ctgagggagcagggactccttc

SEQ ID NO: 217338 - DNA, 22 bp, Artificial Sequence
  Synthetic oligonucleotide; CTG chr2 60513337 60513358 60513342 60513337 -
agggagcagggactccttctag

SEQ ID NO: 217339 - DNA, 22 bp, Artificial Sequence
  Synthetic oligonucleotide; CTC chr2 60513322 60513343 60513327 60513322 -
cttctagtgccactcctgggac

SEQ ID NO: 217340 - DNA, 22 bp, Artificial Sequence
  Synthetic oligonucleotide; CTT chr2 60513319 60513340 60513324 60513319 -
ctagtgccactcctgggactaa

SEQ ID NO: 217341 - DNA, 22 bp, Artificial Sequence
  Synthetic oligonucleotide; TTC chr2 60513318 60513339 60513323 60513318 -
tagtgccactcctgggactaaa

SEQ ID NO: 217342 - DNA, 22 bp, Artificial Sequence
  Synthetic oligonucleotide; CTA chr2 60513316 60513337 60513321 60513316 -
gtgccactcctgggactaaatt

SEQ ID NO: 217343 - DNA, 22 bp, Artificial Sequence
  Synthetic oligonucleotide; CTC chr2 60513307 60513328 60513312 60513307 -
ctgggactaaattccttgtccc

SEQ ID NO: 217344 - DNA, 22 bp, Artificial Sequence
  Synthetic oligonucleotide; CTG chr2 60513304 60513325 60513309 60513304 -
ggactaaattccttgtcccctc

SEQ ID NO: 217345 - DNA, 22 bp, Artificial Sequence
  Synthetic oligonucleotide; CTA chr2 60513298 60513319 60513303 60513298 -
aattccttgtcccctccttgtc

SEQ ID NO: 217346 - DNA, 22 bp, Artificial Sequence
  Synthetic oligonucleotide; TTC chr2 60513293 60513314 60513298 60513293 -
cttgtcccctccttgtctcata

SEQ ID NO: 217347 - DNA, 22 bp, Artificial Sequence
  Synthetic oligonucleotide; CTT chr2 60513290 60513311 60513295 60513290 -
gtcccctccttgtctcatattt

SEQ ID NO: 217348 - DNA, 22 bp, Artificial Sequence
  Synthetic oligonucleotide; TTG chr2 60513289 60513310 60513294 60513289 -
tcccctccttgtctcatattta

SEQ ID NO: 217349 - DNA, 22 bp, Artificial Sequence
  Synthetic oligonucleotide; CTC chr2 60513282 60513303 60513287 60513282 -
cttgtctcatatttagcatctt

SEQ ID NO: 217350 - DNA, 22 bp, Artificial Sequence
  Synthetic oligonucleotide; CTT chr2 60513279 60513300 60513284 60513279 -
gtctcatatttagcatcttgga

SEQ ID NO: 217351 - DNA, 22 bp, Artificial Sequence
  Synthetic oligonucleotide; TTG chr2 60513278 60513299 60513283 60513278 -
tctcatatttagcatcttggag

SEQ ID NO: 217352 - DNA, 22 bp, Artificial Sequence
  Synthetic oligonucleotide; CTC chr2 60513274 60513295 60513279 60513274 -
atatttagcatcttggagccgt

SEQ ID NO: 217353 - DNA, 22 bp, Artificial Sequence
  Synthetic oligonucleotide; TTT chr2 60513268 60513289 60513273 60513268 -
agcatcttggagccgtgtcagc

SEQ ID NO: 217354 - DNA, 22 bp, Artificial Sequence
  Synthetic oligonucleotide; TTA chr2 60513267 60513288 60513272 60513267 -
gcatcttggagccgtgtcagct

SEQ ID NO: 217355 - DNA, 22 bp, Artificial Sequence
  Synthetic oligonucleotide; CTT chr2 60513260 60513281 60513265 60513260 -
ggagccgtgtcagctgcagaga

SEQ ID NO: 217356 - DNA, 22 bp, Artificial Sequence
  Synthetic oligonucleotide; TTG chr2 60513259 60513280 60513264 60513259 -
gagccgtgtcagctgcagagac

SEQ ID NO: 217357 - DNA, 22 bp, Artificial Sequence
  Synthetic oligonucleotide; CTG chr2 60513244 60513265 60513249 60513244 -
cagagactggagtccggggcat

SEQ ID NO: 217358 - DNA, 22 bp, Artificial Sequence
  Synthetic oligonucleotide; CTG chr2 60513235 60513256 60513240 60513235 -
gagtccggggcatgatggggat

SEQ ID NO: 217359 - DNA, 22 bp, Artificial Sequence
  Synthetic oligonucleotide; CTG chr2 60513206 60513227 60513211 60513206 -
aaacctagtgagagtcatcctg

SEQ ID NO: 217360 - DNA, 22 bp, Artificial Sequence
  Synthetic oligonucleotide; CTA chr2 60513199 60513220 60513204 60513199 -
gtgagagtcatcctgactctgg

SEQ ID NO: 217361 - DNA, 22 bp, Artificial Sequence
  Synthetic oligonucleotide; CTG chr2 60513184 60513205 60513189 60513184 -
actctggggaagagccgctcaa

SEQ ID NO: 217362 - DNA, 22 bp, Artificial Sequence
  Synthetic oligonucleotide; CTC chr2 60513180 60513201 60513185 60513180 -
tggggaagagccgctcaaagat

SEQ ID NO: 217363 - DNA, 22 bp, Artificial Sequence
  Synthetic oligonucleotide; CTG chr2 60513178 60513199 60513183 60513178 -
gggaagagccgctcaaagatga

SEQ ID NO: 217364 - DNA, 22 bp, Artificial Sequence
  Synthetic oligonucleotide; CTC chr2 60513164 60513185 60513169 60513164 -
aaagatgagaaagataaagtaa

SEQ ID NO: 217365 - DNA, 22 bp, Artificial Sequence
  Synthetic oligonucleotide; TTT chr2 60513139 60513160 60513144 60513139 -
gccacccccaacccctcacagg

SEQ ID NO: 217366 - DNA, 22 bp, Artificial Sequence
  Synthetic oligonucleotide; TTG chr2 60513138 60513159 60513143 60513138 -
ccacccccaacccctcacaggc

SEQ ID NO: 217367 - DNA, 22 bp, Artificial Sequence
  Synthetic oligonucleotide; CTC chr2 60513122 60513143 60513127 60513122 -
acaggctagactatccatggat

SEQ ID NO: 217368 - DNA, 22 bp, Artificial Sequence
  Synthetic oligonucleotide; CTA chr2 60513114 60513135 60513119 60513114 -
gactatccatggatttcagtgg

SEQ ID NO: 217369 - DNA, 22 bp, Artificial Sequence
  Synthetic oligonucleotide; CTA chr2 60513109 60513130 60513114 60513109 -
tccatggatttcagtggggtgg

SEQ ID NO: 217370 - DNA, 22 bp, Artificial Sequence
  Synthetic oligonucleotide; TTT chr2 60513098 60513119 60513103 60513098 -
cagtggggtggtgagtcctcat

SEQ ID NO: 217371 - DNA, 22 bp, Artificial Sequence
  Synthetic oligonucleotide; TTC chr2 60513097 60513118 60513102 60513097 -
agtggggtggtgagtcctcatg

SEQ ID NO: 217372 - DNA, 22 bp, Artificial Sequence
  Synthetic oligonucleotide; CTC chr2 60513078 60513099 60513083 60513078 -
atgatccctgaacctctcctca

SEQ ID NO: 217373 - DNA, 22 bp, Artificial Sequence
  Synthetic oligonucleotide; CTG chr2 60513068 60513089 60513073 60513068 -
aacctctcctcaaatggtgact

SEQ ID NO: 217374 - DNA, 22 bp, Artificial Sequence
  Synthetic oligonucleotide; CTC chr2 60513062 60513083 60513067 60513062 -
tcctcaaatggtgactgttctg

SEQ ID NO: 217375 - DNA, 22 bp, Artificial Sequence
  Synthetic oligonucleotide; CTC chr2 60513060 60513081 60513065 60513060 -
ctcaaatggtgactgttctggg

SEQ ID NO: 217376 - DNA, 22 bp, Artificial Sequence
  Synthetic oligonucleotide; CTC chr2 60513057 60513078 60513062 60513057 -
aaatggtgactgttctgggggt

SEQ ID NO: 217377 - DNA, 22 bp, Artificial Sequence
  Synthetic oligonucleotide; CTG chr2 60513045 60513066 60513050 60513045 -
ttctgggggtcctttctctgcc

SEQ ID NO: 217378 - DNA, 22 bp, Artificial Sequence
  Synthetic oligonucleotide; TTC chr2 60513042 60513063 60513047 60513042 -
tgggggtcctttctctgccttt

SEQ ID NO: 217379 - DNA, 22 bp, Artificial Sequence
  Synthetic oligonucleotide; CTG chr2 60513040 60513061 60513045 60513040 -
ggggtcctttctctgcctttct

SEQ ID NO: 217380 - DNA, 22 bp, Artificial Sequence
  Synthetic oligonucleotide; CTT chr2 60513031 60513052 60513036 60513031 -
tctctgcctttctcagggggta

SEQ ID NO: 217381 - DNA, 22 bp, Artificial Sequence
  Synthetic oligonucleotide; TTT chr2 60513030 60513051 60513035 60513030 -
ctctgcctttctcagggggtaa

SEQ ID NO: 217382 - DNA, 22 bp, Artificial Sequence
  Synthetic oligonucleotide; TTC chr2 60513029 60513050 60513034 60513029 -
tctgcctttctcagggggtaac

SEQ ID NO: 217383 - DNA, 22 bp, Artificial Sequence
  Synthetic oligonucleotide; CTC chr2 60513027 60513048 60513032 60513027 -
tgcctttctcagggggtaacca

SEQ ID NO: 217384 - DNA, 22 bp, Artificial Sequence
  Synthetic oligonucleotide; CTG chr2 60513025 60513046 60513030 60513025 -
cctttctcagggggtaaccaga

SEQ ID NO: 217385 - DNA, 22 bp, Artificial Sequence
  Synthetic oligonucleotide; CTT chr2 60513021 60513042 60513026 60513021 -
tctcagggggtaaccagaggtg

SEQ ID NO: 217386 - DNA, 22 bp, Artificial Sequence
  Synthetic oligonucleotide; TTT chr2 60513020 60513041 60513025 60513020 -
ctcagggggtaaccagaggtgg

SEQ ID NO: 217387 - DNA, 22 bp, Artificial Sequence
  Synthetic oligonucleotide; TTC chr2 60513019 60513040 60513024 60513019 -
tcagggggtaaccagaggtggt

SEQ ID NO: 217388 - DNA, 22 bp, Artificial Sequence
  Synthetic oligonucleotide; CTC chr2 60513017 60513038 60513022 60513017 -
agggggtaaccagaggtggtgg

SEQ ID NO: 217389 - DNA, 22 bp, Artificial Sequence
  Synthetic oligonucleotide; CTG chr2 60512983 60513004 60512988 60512983 -
tgactcgtcagctgttgctctg

SEQ ID NO: 217390 - DNA, 22 bp, Artificial Sequence
  Synthetic oligonucleotide; CTC chr2 60512977 60512998 60512982 60512977 -
gtcagctgttgctctgtgtgtt

SEQ ID NO: 217391 - DNA, 22 bp, Artificial Sequence
  Synthetic oligonucleotide; CTG chr2 60512969 60512990 60512974 60512969 -
ttgctctgtgtgttcatttttg

SEQ ID NO: 217392 - DNA, 22 bp, Artificial Sequence
  Synthetic oligonucleotide; TTG chr2 60512966 60512987 60512971 60512966 -
ctctgtgtgttcatttttgaga

SEQ ID NO: 217393 - DNA, 22 bp, Artificial Sequence
  Synthetic oligonucleotide; CTC chr2 60512963 60512984 60512968 60512963 -
tgtgtgttcatttttgagaaaa

SEQ ID NO: 217394 - DNA, 22 bp, Artificial Sequence
  Synthetic oligonucleotide; CTG chr2 60512961 60512982 60512966 60512961 -
tgtgttcatttttgagaaaatg

SEQ ID NO: 217395 - DNA, 22 bp, Artificial Sequence
  Synthetic oligonucleotide; TTC chr2 60512954 60512975 60512959 60512954 -
atttttgagaaaatgttaatct

SEQ ID NO: 217396 - DNA, 22 bp, Artificial Sequence
  Synthetic oligonucleotide; TTT chr2 60512950 60512971 60512955 60512950 -
ttgagaaaatgttaatctctga

SEQ ID NO: 217397 - DNA, 22 bp, Artificial Sequence
  Synthetic oligonucleotide; TTT chr2 60512949 60512970 60512954 60512949 -
tgagaaaatgttaatctctgag

SEQ ID NO: 217398 - DNA, 22 bp, Artificial Sequence
  Synthetic oligonucleotide; TTT chr2 60512948 60512969 60512953 60512948 -
gagaaaatgttaatctctgaga

SEQ ID NO: 217399 - DNA, 22 bp, Artificial Sequence
  Synthetic oligonucleotide; TTG chr2 60512947 60512968 60512952 60512947 -
agaaaatgttaatctctgagac

SEQ ID NO: 217400 - DNA, 22 bp, Artificial Sequence
  Synthetic oligonucleotide; TTA chr2 60512936 60512957 60512941 60512936 -
atctctgagacgtctaagaggt

SEQ ID NO: 217401 - DNA, 22 bp, Artificial Sequence
  Synthetic oligonucleotide; CTC chr2 60512931 60512952 60512936 60512931 -
tgagacgtctaagaggtgaaac

SEQ ID NO: 217402 - DNA, 22 bp, Artificial Sequence
  Synthetic oligonucleotide; CTG chr2 60512929 60512950 60512934 60512929 -
agacgtctaagaggtgaaactc

SEQ ID NO: 217403 - DNA, 22 bp, Artificial Sequence
  Synthetic oligonucleotide; CTA chr2 60512920 60512941 60512925 60512920 -
agaggtgaaactcctttctctg

SEQ ID NO: 217404 - DNA, 22 bp, Artificial Sequence
  Synthetic oligonucleotide; CTC chr2 60512907 60512928 60512912 60512907 -
ctttctctgtgtctcctccaaa

SEQ ID NO: 217405 - DNA, 22 bp, Artificial Sequence
  Synthetic oligonucleotide; CTT chr2 60512904 60512925 60512909 60512904 -
tctctgtgtctcctccaaatgg

SEQ ID NO: 217406 - DNA, 22 bp, Artificial Sequence
  Synthetic oligonucleotide; TTT chr2 60512903 60512924 60512908 60512903 -
ctctgtgtctcctccaaatgga

SEQ ID NO: 217407 - DNA, 22 bp, Artificial Sequence
  Synthetic oligonucleotide; TTC chr2 60512902 60512923 60512907 60512902 -
tctgtgtctcctccaaatggat

SEQ ID NO: 217408 - DNA, 22 bp, Artificial Sequence
  Synthetic oligonucleotide; CTC chr2 60512900 60512921 60512905 60512900 -
tgtgtctcctccaaatggatgc

SEQ ID NO: 217409 - DNA, 22 bp, Artificial Sequence
  Synthetic oligonucleotide; CTG chr2 60512898 60512919 60512903 60512898 -
tgtctcctccaaatggatgcca

SEQ ID NO: 217410 - DNA, 22 bp, Artificial Sequence
  Synthetic oligonucleotide; CTC chr2 60512892 60512913 60512897 60512892 -
ctccaaatggatgccatgtggg

SEQ ID NO: 217411 - DNA, 22 bp, Artificial Sequence
  Synthetic oligonucleotide; CTC chr2 60512889 60512910 60512894 60512889 -
caaatggatgccatgtgggtgg

SEQ ID NO: 217412 - DNA, 22 bp, Artificial Sequence
  Synthetic oligonucleotide; TTG chr2 60512855 60512876 60512860 60512855 -
ggtttattcatttactttaggt

SEQ ID NO: 217413 - DNA, 22 bp, Artificial Sequence
  Synthetic oligonucleotide; TTT chr2 60512850 60512871 60512855 60512850 -
attcatttactttaggtgtgta

SEQ ID NO: 217414 - DNA, 22 bp, Artificial Sequence
  Synthetic oligonucleotide; TTA chr2 60512849 60512870 60512854 60512849 -
ttcatttactttaggtgtgtat

SEQ ID NO: 217415 - DNA, 22 bp, Artificial Sequence
  Synthetic oligonucleotide; TTC chr2 60512846 60512867 60512851 60512846 -
atttactttaggtgtgtattgt

SEQ ID NO: 217416 - DNA, 22 bp, Artificial Sequence
  Synthetic oligonucleotide; TTT chr2 60512842 60512863 60512847 60512842 -
actttaggtgtgtattgtagta

SEQ ID NO: 217417 - DNA, 22 bp, Artificial Sequence
  Synthetic oligonucleotide; TTA chr2 60512841 60512862 60512846 60512841 -
ctttaggtgtgtattgtagtaa

SEQ ID NO: 217418 - DNA, 22 bp, Artificial Sequence
  Synthetic oligonucleotide; CTT chr2 60512838 60512859 60512843 60512838 -
taggtgtgtattgtagtaaaac

SEQ ID NO: 217419 - DNA, 22 bp, Artificial Sequence
  Synthetic oligonucleotide; TTT chr2 60512837 60512858 60512842 60512837 -
aggtgtgtattgtagtaaaacc

SEQ ID NO: 217420 - DNA, 22 bp, Artificial Sequence
  Synthetic oligonucleotide; TTA chr2 60512836 60512857 60512841 60512836 -
ggtgtgtattgtagtaaaacct

SEQ ID NO: 217421 - DNA, 22 bp, Artificial Sequence
  Synthetic oligonucleotide; TTG chr2 60512825 60512846 60512830 60512825 -
tagtaaaacctgcttgttctcc

SEQ ID NO: 217422 - DNA, 22 bp, Artificial Sequence
  Synthetic oligonucleotide; CTG chr2 60512813 60512834 60512818 60512813 -
cttgttctcctatccgtcatca

SEQ ID NO: 217423 - DNA, 22 bp, Artificial Sequence
  Synthetic oligonucleotide; CTT chr2 60512810 60512831 60512815 60512810 -
gttctcctatccgtcatcagag

SEQ ID NO: 217424 - DNA, 22 bp, Artificial Sequence
  Synthetic oligonucleotide; TTG chr2 60512809 60512830 60512814 60512809 -
ttctcctatccgtcatcagagg

SEQ ID NO: 217425 - DNA, 22 bp, Artificial Sequence
  Synthetic oligonucleotide; TTC chr2 60512806 60512827 60512811 60512806 -
tcctatccgtcatcagaggtga

SEQ ID NO: 217426 - DNA, 22 bp, Artificial Sequence
  Synthetic oligonucleotide; CTC chr2 60512804 60512825 60512809 60512804 -
ctatccgtcatcagaggtgact

SEQ ID NO: 217427 - DNA, 22 bp, Artificial Sequence
  Synthetic oligonucleotide; CTA chr2 60512801 60512822 60512806 60512801 -
tccgtcatcagaggtgactcat

SEQ ID NO: 217428 - DNA, 22 bp, Artificial Sequence
  Synthetic oligonucleotide; CTC chr2 60512781 60512802 60512786 60512781 -
atacttgagacactaaaagaga

SEQ ID NO: 217429 - DNA, 22 bp, Artificial Sequence
  Synthetic oligonucleotide; CTT chr2 60512775 60512796 60512780 60512775 -
gagacactaaaagagaataaac

SEQ ID NO: 217430 - DNA, 22 bp, Artificial Sequence
  Synthetic oligonucleotide; TTG chr2 60512774 60512795 60512779 60512774 -
agacactaaaagagaataaact

SEQ ID NO: 217431 - DNA, 22 bp, Artificial Sequence
  Synthetic oligonucleotide; CTA chr2 60512766 60512787 60512771 60512766 -
aaagagaataaactgtcttcat

SEQ ID NO: 217432 - DNA, 22 bp, Artificial Sequence
  Synthetic oligonucleotide; CTG chr2 60512751 60512772 60512756 60512751 -
tcttcataaggctgtgaacgtc

SEQ ID NO: 217433 - DNA, 22 bp, Artificial Sequence
  Synthetic oligonucleotide; CTT chr2 60512747 60512768 60512752 60512747 -
cataaggctgtgaacgtcgcca

SEQ ID NO: 217434 - DNA, 22 bp, Artificial Sequence
  Synthetic oligonucleotide; TTC chr2 60512746 60512767 60512751 60512746 -
ataaggctgtgaacgtcgccag

SEQ ID NO: 217435 - DNA, 22 bp, Artificial Sequence
  Synthetic oligonucleotide; CTG chr2 60512737 60512758 60512742 60512737 -
tgaacgtcgccagattatgaac

SEQ ID NO: 217436 - DNA, 22 bp, Artificial Sequence
  Synthetic oligonucleotide; TTA chr2 60512720 60512741 60512725 60512720 -
tgaaccaacttcaagtaacgta

SEQ ID NO: 217437 - DNA, 22 bp, Artificial Sequence
  Synthetic oligonucleotide; CTT chr2 60512709 60512730 60512714 60512709 -
caagtaacgtagggatgccttg

SEQ ID NO: 217438 - DNA, 22 bp, Artificial Sequence
  Synthetic oligonucleotide; TTC chr2 60512708 60512729 60512713 60512708 -
aagtaacgtagggatgccttga

SEQ ID NO: 217439 - DNA, 22 bp, Artificial Sequence
  Synthetic oligonucleotide; CTT chr2 60512688 60512709 60512693 60512688 -
gataattatattattgaaacca

SEQ ID NO: 217440 - DNA, 22 bp, Artificial Sequence
  Synthetic oligonucleotide; TTG chr2 60512687 60512708 60512692 60512687 -
ataattatattattgaaaccat

SEQ ID NO: 217441 - DNA, 22 bp, Artificial Sequence
  Synthetic oligonucleotide; TTA chr2 60512680 60512701 60512685 60512680 -
tattattgaaaccatctccaat

SEQ ID NO: 217442 - DNA, 22 bp, Artificial Sequence
  Synthetic oligonucleotide; TTA chr2 60512675 60512696 60512680 60512675 -
ttgaaaccatctccaattagat

SEQ ID NO: 217443 - DNA, 22 bp, Artificial Sequence
  Synthetic oligonucleotide; TTG chr2 60512672 60512693 60512677 60512672 -
aaaccatctccaattagatatg

SEQ ID NO: 217444 - DNA, 22 bp, Artificial Sequence
  Synthetic oligonucleotide; CTC chr2 60512662 60512683 60512667 60512662 -
caattagatatgcaaaatggag

SEQ ID NO: 217445 - DNA, 22 bp, Artificial Sequence
  Synthetic oligonucleotide; TTA chr2 60512656 60512677 60512661 60512656 -
gatatgcaaaatggagttgctg

SEQ ID NO: 217446 - DNA, 22 bp, Artificial Sequence
  Synthetic oligonucleotide; TTG chr2 60512637 60512658 60512642 60512637 -
ctgggggcttcagttttcttta

SEQ ID NO: 217447 - DNA, 22 bp, Artificial Sequence
  Synthetic oligonucleotide; CTG chr2 60512634 60512655 60512639 60512634 -
ggggcttcagttttctttagac

SEQ ID NO: 217448 - DNA, 22 bp, Artificial Sequence
  Synthetic oligonucleotide; CTT chr2 60512627 60512648 60512632 60512627 -
cagttttctttagaccaaataa

SEQ ID NO: 217449 - DNA, 22 bp, Artificial Sequence
  Synthetic oligonucleotide; TTC chr2 60512626 60512647 60512631 60512626 -
agttttctttagaccaaataat

SEQ ID NO: 217450 - DNA, 22 bp, Artificial Sequence
  Synthetic oligonucleotide; TTT chr2 60512621 60512642 60512626 60512621 -
tctttagaccaaataatttaga

SEQ ID NO: 217451 - DNA, 22 bp, Artificial Sequence
  Synthetic oligonucleotide; TTT chr2 60512620 60512641 60512625 60512620 -
ctttagaccaaataatttagag

SEQ ID NO: 217452 - DNA, 22 bp, Artificial Sequence
  Synthetic oligonucleotide; TTC chr2 60512619 60512640 60512624 60512619 -
tttagaccaaataatttagagc

SEQ ID NO: 217453 - DNA, 22 bp, Artificial Sequence
  Synthetic oligonucleotide; CTT chr2 60512617 60512638 60512622 60512617 -
tagaccaaataatttagagctg

SEQ ID NO: 217454 - DNA, 22 bp, Artificial Sequence
  Synthetic oligonucleotide; TTT chr2 60512616 60512637 60512621 60512616 -
agaccaaataatttagagctga

SEQ ID NO: 217455 - DNA, 22 bp, Artificial Sequence
  Synthetic oligonucleotide; TTA chr2 60512615 60512636 60512620 60512615 -
gaccaaataatttagagctgag

SEQ ID NO: 217456 - DNA, 22 bp, Artificial Sequence
  Synthetic oligonucleotide; TTT chr2 60512602 60512623 60512607 60512602 -
agagctgagaggagaggcagat

SEQ ID NO: 217457 - DNA, 22 bp, Artificial Sequence
  Synthetic oligonucleotide; TTA chr2 60512601 60512622 60512606 60512601 -
gagctgagaggagaggcagata

SEQ ID NO: 217458 - DNA, 22 bp, Artificial Sequence
  Synthetic oligonucleotide; CTG chr2 60512595 60512616 60512600 60512595 -
agaggagaggcagataccatct

SEQ ID NO: 217459 - DNA, 22 bp, Artificial Sequence
  Synthetic oligonucleotide; CTA chr2 60512572 60512593 60512577 60512572 -
gtctcactttttacaatttagc

SEQ ID NO: 217460 - DNA, 22 bp, Artificial Sequence
  Synthetic oligonucleotide; CTC chr2 60512567 60512588 60512572 60512567 -
actttttacaatttagcattgg

SEQ ID NO: 217461 - DNA, 22 bp, Artificial Sequence
  Synthetic oligonucleotide; CTT chr2 60512563 60512584 60512568 60512563 -
tttacaatttagcattggattt

SEQ ID NO: 217462 - DNA, 22 bp, Artificial Sequence
  Synthetic oligonucleotide; TTT chr2 60512562 60512583 60512567 60512562 -
ttacaatttagcattggatttg

SEQ ID NO: 217463 - DNA, 22 bp, Artificial Sequence
  Synthetic oligonucleotide; TTT chr2 60512561 60512582 60512566 60512561 -
tacaatttagcattggatttgt

SEQ ID NO: 217464 - DNA, 22 bp, Artificial Sequence
  Synthetic oligonucleotide; TTT chr2 60512560 60512581 60512565 60512560 -
acaatttagcattggatttgtt

SEQ ID NO: 217465 - DNA, 22 bp, Artificial Sequence
  Synthetic oligonucleotide; TTA chr2 60512559 60512580 60512564 60512559 -
caatttagcattggatttgttg

SEQ ID NO: 217466 - DNA, 22 bp, Artificial Sequence
  Synthetic oligonucleotide; TTT chr2 60512553 60512574 60512558 60512553 -
agcattggatttgttgagcatg

SEQ ID NO: 217467 - DNA, 22 bp, Artificial Sequence
  Synthetic oligonucleotide; TTA chr2 60512552 60512573 60512557 60512552 -
gcattggatttgttgagcatgt

SEQ ID NO: 217468 - DNA, 22 bp, Artificial Sequence
  Synthetic oligonucleotide; TTG chr2 60512546 60512567 60512551 60512546 -
gatttgttgagcatgtactctc

SEQ ID NO: 217469 - DNA, 22 bp, Artificial Sequence
  Synthetic oligonucleotide; TTT chr2 60512541 60512562 60512546 60512541 -
gttgagcatgtactctctgcag

SEQ ID NO: 217470 - DNA, 22 bp, Artificial Sequence
  Synthetic oligonucleotide; TTG chr2 60512540 60512561 60512545 60512540 -
ttgagcatgtactctctgcaga

SEQ ID NO: 217471 - DNA, 22 bp, Artificial Sequence
  Synthetic oligonucleotide; TTG chr2 60512537 60512558 60512542 60512537 -
agcatgtactctctgcagagca

SEQ ID NO: 217472 - DNA, 22 bp, Artificial Sequence
  Synthetic oligonucleotide; CTC chr2 60512526 60512547 60512531 60512526 -
tctgcagagcattgtgataggt

SEQ ID NO: 217473 - DNA, 22 bp, Artificial Sequence
  Synthetic oligonucleotide; CTC chr2 60512524 60512545 60512529 60512524 -
tgcagagcattgtgataggttc

SEQ ID NO: 217474 - DNA, 22 bp, Artificial Sequence
  Synthetic oligonucleotide; CTG chr2 60512522 60512543 60512527 60512522 -
cagagcattgtgataggttctg

SEQ ID NO: 217475 - DNA, 22 bp, Artificial Sequence
  Synthetic oligonucleotide; TTG chr2 60512512 60512533 60512517 60512512 -
tgataggttctgggttgggagg

SEQ ID NO: 217476 - DNA, 22 bp, Artificial Sequence
  Synthetic oligonucleotide; TTC chr2 60512502 60512523 60512507 60512502 -
tgggttgggaggggagccggga

SEQ ID NO: 217477 - DNA, 22 bp, Artificial Sequence
  Synthetic oligonucleotide; CTG chr2 60512500 60512521 60512505 60512500 -
ggttgggaggggagccgggaag

SEQ ID NO: 217478 - DNA, 22 bp, Artificial Sequence
  Synthetic oligonucleotide; TTG chr2 60512495 60512516 60512500 60512495 -
ggaggggagccgggaaggcaag

SEQ ID NO: 217479 - DNA, 22 bp, Artificial Sequence
  Synthetic oligonucleotide; CTC chr2 60512466 60512487 60512471 60512466 -
tctcaaagctgcctttctcatt

SEQ ID NO: 217480 - DNA, 22 bp, Artificial Sequence
  Synthetic oligonucleotide; CTC chr2 60512464 60512485 60512469 60512464 -
tcaaagctgcctttctcatttg

SEQ ID NO: 217481 - DNA, 22 bp, Artificial Sequence
  Synthetic oligonucleotide; CTC chr2 60512462 60512483 60512467 60512462 -
aaagctgcctttctcatttgag

SEQ ID NO: 217482 - DNA, 22 bp, Artificial Sequence
  Synthetic oligonucleotide; CTG chr2 60512455 60512476 60512460 60512455 -
cctttctcatttgagaggcgag

SEQ ID NO: 217483 - DNA, 22 bp, Artificial Sequence
  Synthetic oligonucleotide; CTT chr2 60512451 60512472 60512456 60512451 -
tctcatttgagaggcgagtgtg

SEQ ID NO: 217484 - DNA, 22 bp, Artificial Sequence
  Synthetic oligonucleotide; TTT chr2 60512450 60512471 60512455 60512450 -
ctcatttgagaggcgagtgtgt

SEQ ID NO: 217485 - DNA, 22 bp, Artificial Sequence
  Synthetic oligonucleotide; TTC chr2 60512449 60512470 60512454 60512449 -
tcatttgagaggcgagtgtgtg

SEQ ID NO: 217486 - DNA, 22 bp, Artificial Sequence
  Synthetic oligonucleotide; CTC chr2 60512447 60512468 60512452 60512447 -
atttgagaggcgagtgtgtgtg

SEQ ID NO: 217487 - DNA, 22 bp, Artificial Sequence
  Synthetic oligonucleotide; TTT chr2 60512443 60512464 60512448 60512443 -
gagaggcgagtgtgtgtggcac

SEQ ID NO: 217488 - DNA, 22 bp, Artificial Sequence
  Synthetic oligonucleotide; TTG chr2 60512442 60512463 60512447 60512442 -
agaggcgagtgtgtgtggcaca

SEQ ID NO: 217489 - DNA, 22 bp, Artificial Sequence
  Synthetic oligonucleotide; CTT chr2 60512393 60512414 60512398 60512393 -
tatacctgagagcaagatgtgc

SEQ ID NO: 217490 - DNA, 22 bp, Artificial Sequence
  Synthetic oligonucleotide; TTT chr2 60512392 60512413 60512397 60512392 -
atacctgagagcaagatgtgca

SEQ ID NO: 217491 - DNA, 22 bp, Artificial Sequence
  Synthetic oligonucleotide; TTA chr2 60512391 60512412 60512396 60512391 -
tacctgagagcaagatgtgcag

SEQ ID NO: 217492 - DNA, 22 bp, Artificial Sequence
  Synthetic oligonucleotide; CTG chr2 60512385 60512406 60512390 60512385 -
agagcaagatgtgcagccagga

SEQ ID NO: 217493 - DNA, 22 bp, Artificial Sequence
  Synthetic oligonucleotide; CTC chr2 60512357 60512378 60512362 60512357 -
aaggacacaggccaagggaggt

SEQ ID NO: 217494 - DNA, 22 bp, Artificial Sequence
  Synthetic oligonucleotide; CTT chr2 60512325 60512346 60512330 60512325 -
gcccaggccacccagttaccta

SEQ ID NO: 217495 - DNA, 22 bp, Artificial Sequence
  Synthetic oligonucleotide; TTG chr2 60512324 60512345 60512329 60512324 -
cccaggccacccagttacctag

SEQ ID NO: 217496 - DNA, 22 bp, Artificial Sequence
  Synthetic oligonucleotide; TTA chr2 60512307 60512328 60512312 60512307 -
cctagcacagctcagccacaag

SEQ ID NO: 217497 - DNA, 22 bp, Artificial Sequence
  Synthetic oligonucleotide; CTA chr2 60512303 60512324 60512308 60512303 -
gcacagctcagccacaagccca

SEQ ID NO: 217498 - DNA, 22 bp, Artificial Sequence
  Synthetic oligonucleotide; CTC chr2 60512294 60512315 60512299 60512294 -
agccacaagcccaaatgaatga

SEQ ID NO: 217499 - DNA, 22 bp, Artificial Sequence
  Synthetic oligonucleotide; TTC chr2 60512269 60512290 60512274 60512269 -
tgagttccacatcagcgcatcg

SEQ ID NO: 217500 - DNA, 22 bp, Artificial Sequence
  Synthetic oligonucleotide; CTG chr2 60512267 60512288 60512272 60512267 -
agttccacatcagcgcatcggg

SEQ ID NO: 217501 - DNA, 22 bp, Artificial Sequence
  Synthetic oligonucleotide; TTC chr2 60512262 60512283 60512267 60512262 -
cacatcagcgcatcgggcagcc

SEQ ID NO: 217502 - DNA, 22 bp, Artificial Sequence
  Synthetic oligonucleotide; TTC chr2 60512226 60512247 60512231 60512226 -
cacagtgacaggtggggctcta

SEQ ID NO: 217503 - DNA, 22 bp, Artificial Sequence
  Synthetic oligonucleotide; CTC chr2 60512206 60512227 60512211 60512206 -
taggtggcttcctttaaaacat

SEQ ID NO: 217504 - DNA, 22 bp, Artificial Sequence
  Synthetic oligonucleotide; CTA chr2 60512204 60512225 60512209 60512204 -
ggtggcttcctttaaaacatct

SEQ ID NO: 217505 - DNA, 22 bp, Artificial Sequence
  Synthetic oligonucleotide; CTT chr2 60512196 60512217 60512201 60512196 -
cctttaaaacatctgaggaaag

SEQ ID NO: 217506 - DNA, 22 bp, Artificial Sequence
  Synthetic oligonucleotide; TTC chr2 60512195 60512216 60512200 60512195 -
ctttaaaacatctgaggaaagc

SEQ ID NO: 217507 - DNA, 22 bp, Artificial Sequence
  Synthetic oligonucleotide; CTT chr2 60512192 60512213 60512197 60512192 -
taaaacatctgaggaaagcagg

SEQ ID NO: 217508 - DNA, 22 bp, Artificial Sequence
  Synthetic oligonucleotide; TTT chr2 60512191 60512212 60512196 60512191 -
aaaacatctgaggaaagcaggc

SEQ ID NO: 217509 - DNA, 22 bp, Artificial Sequence
  Synthetic oligonucleotide; TTA chr2 60512190 60512211 60512195 60512190 -
aaacatctgaggaaagcaggct

SEQ ID NO: 217510 - DNA, 22 bp, Artificial Sequence
  Synthetic oligonucleotide; CTG chr2 60512181 60512202 60512186 60512181 -
aggaaagcaggcttcctctctg

SEQ ID NO: 217511 - DNA, 22 bp, Artificial Sequence
  Synthetic oligonucleotide; CTT chr2 60512167 60512188 60512172 60512167 -
cctctctgactgctctccaggg

SEQ ID NO: 217512 - DNA, 22 bp, Artificial Sequence
  Synthetic oligonucleotide; TTC chr2 60512166 60512187 60512171 60512166 -
ctctctgactgctctccagggg

SEQ ID NO: 217513 - DNA, 22 bp, Artificial Sequence
  Synthetic oligonucleotide; CTC chr2 60512163 60512184 60512168 60512163 -
tctgactgctctccaggggtgg

SEQ ID NO: 217514 - DNA, 22 bp, Artificial Sequence
  Synthetic oligonucleotide; CTC chr2 60512161 60512182 60512166 60512161 -
tgactgctctccaggggtggtg

SEQ ID NO: 217515 - DNA, 22 bp, Artificial Sequence
  Synthetic oligonucleotide; CTG chr2 60512159 60512180 60512164 60512159 -
actgctctccaggggtggtgag

SEQ ID NO: 217516 - DNA, 22 bp, Artificial Sequence
  Synthetic oligonucleotide; CTG chr2 60512155 60512176 60512160 60512155 -
ctctccaggggtggtgagcaca

SEQ ID NO: 217517 - DNA, 22 bp, Artificial Sequence
  Synthetic oligonucleotide; CTC chr2 60512152 60512173 60512157 60512152 -
tccaggggtggtgagcacaggg

SEQ ID NO: 217518 - DNA, 22 bp, Artificial Sequence
  Synthetic oligonucleotide; CTC chr2 60512150 60512171 60512155 60512150 -
caggggtggtgagcacaggggt

SEQ ID NO: 217519 - DNA, 22 bp, Artificial Sequence
  Synthetic oligonucleotide; TTC chr2 60512126 60512147 60512131 60512126 -
atctgcagctccccagctccag

SEQ ID NO: 217520 - DNA, 22 bp, Artificial Sequence
  Synthetic oligonucleotide; CTG chr2 60512121 60512142 60512126 60512121 -
cagctccccagctccagtgctc

SEQ ID NO: 217521 - DNA, 22 bp, Artificial Sequence
  Synthetic oligonucleotide; CTC chr2 60512115 60512136 60512120 60512115 -
cccagctccagtgctccttagc

SEQ ID NO: 217522 - DNA, 22 bp, Artificial Sequence
  Synthetic oligonucleotide; CTC chr2 60512107 60512128 60512112 60512107 -
cagtgctccttagccttccaag

SEQ ID NO: 217523 - DNA, 22 bp, Artificial Sequence
  Synthetic oligonucleotide; CTC chr2 60512099 60512120 60512104 60512099 -
cttagccttccaagttgtttga

SEQ ID NO: 217524 - DNA, 22 bp, Artificial Sequence
  Synthetic oligonucleotide; CTT chr2 60512096 60512117 60512101 60512096 -
agccttccaagttgtttgaatt

SEQ ID NO: 217525 - DNA, 22 bp, Artificial Sequence
  Synthetic oligonucleotide; TTA chr2 60512095 60512116 60512100 60512095 -
gccttccaagttgtttgaatta

SEQ ID NO: 217526 - DNA, 22 bp, Artificial Sequence
  Synthetic oligonucleotide; CTT chr2 60512090 60512111 60512095 60512090 -
ccaagttgtttgaattaagttg

SEQ ID NO: 217527 - DNA, 22 bp, Artificial Sequence
  Synthetic oligonucleotide; TTC chr2 60512089 60512110 60512094 60512089 -
caagttgtttgaattaagttgc

SEQ ID NO: 217528 - DNA, 22 bp, Artificial Sequence
  Synthetic oligonucleotide; TTG chr2 60512082 60512103 60512087 60512082 -
tttgaattaagttgcaagccca

SEQ ID NO: 217529 - DNA, 22 bp, Artificial Sequence
  Synthetic oligonucleotide; TTT chr2 60512079 60512100 60512084 60512079 -
gaattaagttgcaagcccaggt

SEQ ID NO: 217530 - DNA, 22 bp, Artificial Sequence
  Synthetic oligonucleotide; TTG chr2 60512078 60512099 60512083 60512078 -
aattaagttgcaagcccaggtg

SEQ ID NO: 217531 - DNA, 22 bp, Artificial Sequence
  Synthetic oligonucleotide; TTA chr2 60512073 60512094 60512078 60512073 -
agttgcaagcccaggtggctgc

SEQ ID NO: 217532 - DNA, 22 bp, Artificial Sequence
  Synthetic oligonucleotide; TTG chr2 60512068 60512089 60512073 60512068 -
caagcccaggtggctgcacaca

SEQ ID NO: 217533 - DNA, 22 bp, Artificial Sequence
  Synthetic oligonucleotide; CTG chr2 60512052 60512073 60512057 60512052 -
cacacatattcattttggagtg

SEQ ID NO: 217534 - DNA, 22 bp, Artificial Sequence
  Synthetic oligonucleotide; TTC chr2 60512041 60512062 60512046 60512041 -
attttggagtgactgtgacact

SEQ ID NO: 217535 - DNA, 22 bp, Artificial Sequence
  Synthetic oligonucleotide; TTT chr2 60512037 60512058 60512042 60512037 -
tggagtgactgtgacacttgta

SEQ ID NO: 217536 - DNA, 22 bp, Artificial Sequence
  Synthetic oligonucleotide; TTT chr2 60512036 60512057 60512041 60512036 -
ggagtgactgtgacacttgtat

SEQ ID NO: 217537 - DNA, 22 bp, Artificial Sequence
  Synthetic oligonucleotide; TTG chr2 60512035 60512056 60512040 60512035 -
gagtgactgtgacacttgtatt

SEQ ID NO: 217538 - DNA, 22 bp, Artificial Sequence
  Synthetic oligonucleotide; CTG chr2 60512026 60512047 60512031 60512026 -
tgacacttgtatttcctgggaa

SEQ ID NO: 217539 - DNA, 22 bp, Artificial Sequence
  Synthetic oligonucleotide; CTT chr2 60512018 60512039 60512023 60512018 -
gtatttcctgggaagcgttact

SEQ ID NO: 217540 - DNA, 22 bp, Artificial Sequence
  Synthetic oligonucleotide; TTG chr2 60512017 60512038 60512022 60512017 -
tatttcctgggaagcgttacta

SEQ ID NO: 217541 - DNA, 22 bp, Artificial Sequence
  Synthetic oligonucleotide; TTT chr2 60512012 60512033 60512017 60512012 -
cctgggaagcgttactatgtct

SEQ ID NO: 217542 - DNA, 22 bp, Artificial Sequence
  Synthetic oligonucleotide; TTC chr2 60512011 60512032 60512016 60512011 -
ctgggaagcgttactatgtctt

SEQ ID NO: 217543 - DNA, 22 bp, Artificial Sequence
  Synthetic oligonucleotide; CTG chr2 60512008 60512029 60512013 60512008 -
ggaagcgttactatgtctttgg

SEQ ID NO: 217544 - DNA, 22 bp, Artificial Sequence
  Synthetic oligonucleotide; TTA chr2 60511998 60512019 60512003 60511998 -
ctatgtctttggccgagcaagt

SEQ ID NO: 217545 - DNA, 22 bp, Artificial Sequence
  Synthetic oligonucleotide; CTA chr2 60511995 60512016 60512000 60511995 -
tgtctttggccgagcaagtatt

SEQ ID NO: 217546 - DNA, 22 bp, Artificial Sequence
  Synthetic oligonucleotide; CTT chr2 60511989 60512010 60511994 60511989 -
tggccgagcaagtattacgcca

SEQ ID NO: 217547 - DNA, 22 bp, Artificial Sequence
  Synthetic oligonucleotide; TTT chr2 60511988 60512009 60511993 60511988 -
ggccgagcaagtattacgccat

SEQ ID NO: 217548 - DNA, 22 bp, Artificial Sequence
  Synthetic oligonucleotide; TTG chr2 60511987 60512008 60511992 60511987 -
gccgagcaagtattacgccatg

SEQ ID NO: 217549 - DNA, 22 bp, Artificial Sequence
  Synthetic oligonucleotide; TTA chr2 60511972 60511993 60511977 60511972 -
cgccatgagctggttccctttc

SEQ ID NO: 217550 - DNA, 22 bp, Artificial Sequence
  Synthetic oligonucleotide; CTG chr2 60511960 60511981 60511965 60511960 -
gttccctttcttttgcctttga

SEQ ID NO: 217551 - DNA, 22 bp, Artificial Sequence
  Synthetic oligonucleotide; TTC chr2 60511956 60511977 60511961 60511956 -
cctttcttttgcctttgaacac

SEQ ID NO: 217552 - DNA, 22 bp, Artificial Sequence
  Synthetic oligonucleotide; CTT chr2 60511952 60511973 60511957 60511952 -
tcttttgcctttgaacacctac

SEQ ID NO: 217553 - DNA, 22 bp, Artificial Sequence
  Synthetic oligonucleotide; TTT chr2 60511951 60511972 60511956 60511951 -
cttttgcctttgaacacctaca

SEQ ID NO: 217554 - DNA, 22 bp, Artificial Sequence
  Synthetic oligonucleotide; TTC chr2 60511950 60511971 60511955 60511950 -
ttttgcctttgaacacctacat

SEQ ID NO: 217555 - DNA, 22 bp, Artificial Sequence
  Synthetic oligonucleotide; CTT chr2 60511948 60511969 60511953 60511948 -
ttgcctttgaacacctacattg

SEQ ID NO: 217556 - DNA, 22 bp, Artificial Sequence
  Synthetic oligonucleotide; TTT chr2 60511947 60511968 60511952 60511947 -
tgcctttgaacacctacattgc

SEQ ID NO: 217557 - DNA, 22 bp, Artificial Sequence
  Synthetic oligonucleotide; TTT chr2 60511946 60511967 60511951 60511946 -
gcctttgaacacctacattgct

SEQ ID NO: 217558 - DNA, 22 bp, Artificial Sequence
  Synthetic oligonucleotide; TTG chr2 60511945 60511966 60511950 60511945 -
cctttgaacacctacattgctg

SEQ ID NO: 217559 - DNA, 22 bp, Artificial Sequence
  Synthetic oligonucleotide; CTT chr2 60511941 60511962 60511946 60511941 -
tgaacacctacattgctgggag

SEQ ID NO: 217560 - DNA, 22 bp, Artificial Sequence
  Synthetic oligonucleotide; TTT chr2 60511940 60511961 60511945 60511940 -
gaacacctacattgctgggagg

SEQ ID NO: 217561 - DNA, 22 bp, Artificial Sequence
  Synthetic oligonucleotide; TTG chr2 60511939 60511960 60511944 60511939 -
aacacctacattgctgggagga

SEQ ID NO: 217562 - DNA, 22 bp, Artificial Sequence
  Synthetic oligonucleotide; CTA chr2 60511931 60511952 60511936 60511931 -
cattgctgggaggataccttag

SEQ ID NO: 217563 - DNA, 22 bp, Artificial Sequence
  Synthetic oligonucleotide; TTG chr2 60511926 60511947 60511931 60511926 -
ctgggaggataccttagtgaga

SEQ ID NO: 217564 - DNA, 22 bp, Artificial Sequence
  Synthetic oligonucleotide; CTG chr2 60511923 60511944 60511928 60511923 -
ggaggataccttagtgagagtg

SEQ ID NO: 217565 - DNA, 22 bp, Artificial Sequence
  Synthetic oligonucleotide; CTT chr2 60511911 60511932 60511916 60511911 -
agtgagagtgcctgggccactg

SEQ ID NO: 217566 - DNA, 22 bp, Artificial Sequence
  Synthetic oligonucleotide; TTA chr2 60511910 60511931 60511915 60511910 -
gtgagagtgcctgggccactgg

SEQ ID NO: 217567 - DNA, 22 bp, Artificial Sequence
  Synthetic oligonucleotide; CTG chr2 60511897 60511918 60511902 60511897 -
ggccactgggcgtagcagagga

SEQ ID NO: 217568 - DNA, 22 bp, Artificial Sequence
  Synthetic oligonucleotide; CTG chr2 60511889 60511910 60511894 60511889 -
ggcgtagcagaggaagcacctc

SEQ ID NO: 217569 - DNA, 22 bp, Artificial Sequence
  Synthetic oligonucleotide; CTC chr2 60511867 60511888 60511872 60511867 -
atcattttactgatttatttga

SEQ ID NO: 217570 - DNA, 22 bp, Artificial Sequence
  Synthetic oligonucleotide; TTT chr2 60511860 60511881 60511865 60511860 -
tactgatttatttgaaagaaaa

SEQ ID NO: 217571 - DNA, 22 bp, Artificial Sequence
  Synthetic oligonucleotide; TTT chr2 60511859 60511880 60511864 60511859 -
actgatttatttgaaagaaaaa

SEQ ID NO: 217572 - DNA, 22 bp, Artificial Sequence
  Synthetic oligonucleotide; TTA chr2 60511858 60511879 60511863 60511858 -
ctgatttatttgaaagaaaaaa

SEQ ID NO: 217573 - DNA, 22 bp, Artificial Sequence
  Synthetic oligonucleotide; CTG chr2 60511855 60511876 60511860 60511855 -
atttatttgaaagaaaaaagct

SEQ ID NO: 217574 - DNA, 22 bp, Artificial Sequence
  Synthetic oligonucleotide; TTT chr2 60511851 60511872 60511856 60511851 -
atttgaaagaaaaaagctccct

SEQ ID NO: 217575 - DNA, 22 bp, Artificial Sequence
  Synthetic oligonucleotide; TTA chr2 60511850 60511871 60511855 60511850 -
tttgaaagaaaaaagctccctc

SEQ ID NO: 217576 - DNA, 22 bp, Artificial Sequence
  Synthetic oligonucleotide; TTT chr2 60511847 60511868 60511852 60511847 -
gaaagaaaaaagctccctccaa

SEQ ID NO: 217577 - DNA, 22 bp, Artificial Sequence
  Synthetic oligonucleotide; TTG chr2 60511846 60511867 60511851 60511846 -
aaagaaaaaagctccctccaac

SEQ ID NO: 217578 - DNA, 22 bp, Artificial Sequence
  Synthetic oligonucleotide; CTC chr2 60511832 60511853 60511837 60511832 -
cctccaacccttgccttcatag

SEQ ID NO: 217579 - DNA, 22 bp, Artificial Sequence
  Synthetic oligonucleotide; CTC chr2 60511828 60511849 60511833 60511828 -
caacccttgccttcatagaaac

SEQ ID NO: 217580 - DNA, 22 bp, Artificial Sequence
  Synthetic oligonucleotide; CTT chr2 60511820 60511841 60511825 60511820 -
gccttcatagaaacagagtgtt

SEQ ID NO: 217581 - DNA, 22 bp, Artificial Sequence
  Synthetic oligonucleotide; TTG chr2 60511819 60511840 60511824 60511819 -
ccttcatagaaacagagtgttg

SEQ ID NO: 217582 - DNA, 22 bp, Artificial Sequence
  Synthetic oligonucleotide; CTT chr2 60511815 60511836 60511820 60511815 -
catagaaacagagtgttgaaag

SEQ ID NO: 217583 - DNA, 22 bp, Artificial Sequence
  Synthetic oligonucleotide; TTC chr2 60511814 60511835 60511819 60511814 -
atagaaacagagtgttgaaagc

SEQ ID NO: 217584 - DNA, 22 bp, Artificial Sequence
  Synthetic oligonucleotide; TTG chr2 60511797 60511818 60511802 60511797 -
aaagcttggagaagaattaatg

SEQ ID NO: 217585 - DNA, 22 bp, Artificial Sequence
  Synthetic oligonucleotide; CTT chr2 60511790 60511811 60511795 60511790 -
ggagaagaattaatgactcccc

SEQ ID NO: 217586 - DNA, 22 bp, Artificial Sequence
  Synthetic oligonucleotide; TTG chr2 60511789 60511810 60511794 60511789 -
gagaagaattaatgactcccct

SEQ ID NO: 217587 - DNA, 22 bp, Artificial Sequence
  Synthetic oligonucleotide; TTA chr2 60511778 60511799 60511783 60511778 -
atgactcccctgccccttagtg

SEQ ID NO: 217588 - DNA, 22 bp, Artificial Sequence
  Synthetic oligonucleotide; CTC chr2 60511771 60511792 60511776 60511771 -
ccctgccccttagtgtcttaca

SEQ ID NO: 217589 - DNA, 22 bp, Artificial Sequence
  Synthetic oligonucleotide; CTG chr2 60511766 60511787 60511771 60511766 -
ccccttagtgtcttacatgact

SEQ ID NO: 217590 - DNA, 22 bp, Artificial Sequence
  Synthetic oligonucleotide; CTT chr2 60511760 60511781 60511765 60511760 -
agtgtcttacatgactagctgc

SEQ ID NO: 217591 - DNA, 22 bp, Artificial Sequence
  Synthetic oligonucleotide; TTA chr2 60511759 60511780 60511764 60511759 -
gtgtcttacatgactagctgct

SEQ ID NO: 217592 - DNA, 22 bp, Artificial Sequence
  Synthetic oligonucleotide; CTT chr2 60511752 60511773 60511757 60511752 -
acatgactagctgcttctttgc

SEQ ID NO: 217593 - DNA, 22 bp, Artificial Sequence
  Synthetic oligonucleotide; TTA chr2 60511751 60511772 60511756 60511751 -
catgactagctgcttctttgcc

SEQ ID NO: 217594 - DNA, 22 bp, Artificial Sequence
  Synthetic oligonucleotide; CTA chr2 60511743 60511764 60511748 60511743 -
gctgcttctttgcctactgcat

SEQ ID NO: 217595 - DNA, 22 bp, Artificial Sequence
  Synthetic oligonucleotide; CTG chr2 60511739 60511760 60511744 60511739 -
cttctttgcctactgcattttc

SEQ ID NO: 217596 - DNA, 22 bp, Artificial Sequence
  Synthetic oligonucleotide; CTT chr2 60511736 60511757 60511741 60511736 -
ctttgcctactgcattttcaac

SEQ ID NO: 217597 - DNA, 22 bp, Artificial Sequence
  Synthetic oligonucleotide; TTC chr2 60511735 60511756 60511740 60511735 -
tttgcctactgcattttcaact

SEQ ID NO: 217598 - DNA, 22 bp, Artificial Sequence
  Synthetic oligonucleotide; CTT chr2 60511733 60511754 60511738 60511733 -
tgcctactgcattttcaactta

SEQ ID NO: 217599 - DNA, 22 bp, Artificial Sequence
  Synthetic oligonucleotide; TTT chr2 60511732 60511753 60511737 60511732 -
gcctactgcattttcaacttat

SEQ ID NO: 217600 - DNA, 22 bp, Artificial Sequence
  Synthetic oligonucleotide; TTG chr2 60511731 60511752 60511736 60511731 -
cctactgcattttcaacttatt

SEQ ID NO: 217601 - DNA, 22 bp, Artificial Sequence
  Synthetic oligonucleotide; CTA chr2 60511727 60511748 60511732 60511727 -
ctgcattttcaacttatttcaa

SEQ ID NO: 217602 - DNA, 22 bp, Artificial Sequence
  Synthetic oligonucleotide; CTG chr2 60511724 60511745 60511729 60511724 -
cattttcaacttatttcaactt

SEQ ID NO: 217603 - DNA, 22 bp, Artificial Sequence
  Synthetic oligonucleotide; TTT chr2 60511719 60511740 60511724 60511719 -
tcaacttatttcaacttatttt

SEQ ID NO: 217604 - DNA, 22 bp, Artificial Sequence
  Synthetic oligonucleotide; TTT chr2 60511718 60511739 60511723 60511718 -
caacttatttcaacttattttc

SEQ ID NO: 217605 - DNA, 22 bp, Artificial Sequence
  Synthetic oligonucleotide; TTC chr2 60511717 60511738 60511722 60511717 -
aacttatttcaacttattttct

SEQ ID NO: 217606 - DNA, 22 bp, Artificial Sequence
  Synthetic oligonucleotide; CTT chr2 60511712 60511733 60511717 60511712 -
atttcaacttattttctgtggc

SEQ ID NO: 217607 - DNA, 22 bp, Artificial Sequence
  Synthetic oligonucleotide; TTA chr2 60511711 60511732 60511716 60511711 -
tttcaacttattttctgtggct

SEQ ID NO: 217608 - DNA, 22 bp, Artificial Sequence
  Synthetic oligonucleotide; TTT chr2 60511708 60511729 60511713 60511708 -
caacttattttctgtggcttgg

SEQ ID NO: 217609 - DNA, 22 bp, Artificial Sequence
  Synthetic oligonucleotide; TTC chr2 60511707 60511728 60511712 60511707 -
aacttattttctgtggcttgga

SEQ ID NO: 217610 - DNA, 22 bp, Artificial Sequence
  Synthetic oligonucleotide; CTT chr2 60511702 60511723 60511707 60511702 -
attttctgtggcttggaaaata

SEQ ID NO: 217611 - DNA, 22 bp, Artificial Sequence
  Synthetic oligonucleotide; TTA chr2 60511701 60511722 60511706 60511701 -
ttttctgtggcttggaaaatac

SEQ ID NO: 217612 - DNA, 22 bp, Artificial Sequence
  Synthetic oligonucleotide; TTT chr2 60511698 60511719 60511703 60511698 -
tctgtggcttggaaaatacgtt

SEQ ID NO: 217613 - DNA, 22 bp, Artificial Sequence
  Synthetic oligonucleotide; TTT chr2 60511697 60511718 60511702 60511697 -
ctgtggcttggaaaatacgttg

SEQ ID NO: 217614 - DNA, 22 bp, Artificial Sequence
  Synthetic oligonucleotide; TTC chr2 60511696 60511717 60511701 60511696 -
tgtggcttggaaaatacgttga

SEQ ID NO: 217615 - DNA, 22 bp, Artificial Sequence
  Synthetic oligonucleotide; CTG chr2 60511694 60511715 60511699 60511694 -
tggcttggaaaatacgttgact

SEQ ID NO: 217616 - DNA, 22 bp, Artificial Sequence
  Synthetic oligonucleotide; CTT chr2 60511688 60511709 60511693 60511688 -
ggaaaatacgttgactgagtga

SEQ ID NO: 217617 - DNA, 22 bp, Artificial Sequence
  Synthetic oligonucleotide; TTG chr2 60511687 60511708 60511692 60511687 -
gaaaatacgttgactgagtgat

SEQ ID NO: 217618 - DNA, 22 bp, Artificial Sequence
  Synthetic oligonucleotide; TTG chr2 60511675 60511696 60511680 60511675 -
actgagtgatgattgttttcat

SEQ ID NO: 217619 - DNA, 22 bp, Artificial Sequence
  Synthetic oligonucleotide; CTG chr2 60511671 60511692 60511676 60511671 -
agtgatgattgttttcatgaaa

SEQ ID NO: 217620 - DNA, 22 bp, Artificial Sequence
  Synthetic oligonucleotide; TTG chr2 60511660 60511681 60511665 60511660 -
ttttcatgaaatggtgcaacat

SEQ ID NO: 217621 - DNA, 22 bp, Artificial Sequence
  Synthetic oligonucleotide; TTT chr2 60511657 60511678 60511662 60511657 -
tcatgaaatggtgcaacatgta

SEQ ID NO: 217622 - DNA, 22 bp, Artificial Sequence
  Synthetic oligonucleotide; TTT chr2 60511656 60511677 60511661 60511656 -
catgaaatggtgcaacatgtaa

SEQ ID NO: 217623 - DNA, 22 bp, Artificial Sequence
  Synthetic oligonucleotide; TTC chr2 60511655 60511676 60511660 60511655 -
atgaaatggtgcaacatgtaaa

SEQ ID NO: 217624 - DNA, 22 bp, Artificial Sequence
  Synthetic oligonucleotide; TTG chr2 60511623 60511644 60511628 60511623 -
tcattaatagtgcagttatgta

SEQ ID NO: 217625 - DNA, 22 bp, Artificial Sequence
  Synthetic oligonucleotide; TTA chr2 60511617 60511638 60511622 60511617 -
atagtgcagttatgtagagtgt

SEQ ID NO: 217626 - DNA, 22 bp, Artificial Sequence
  Synthetic oligonucleotide; TTA chr2 60511605 60511626 60511610 60511605 -
tgtagagtgtagctctttgagt

SEQ ID NO: 217627 - DNA, 22 bp, Artificial Sequence
  Synthetic oligonucleotide; CTC chr2 60511590 60511611 60511595 60511590 -
tttgagtcttcagttttgaatc

SEQ ID NO: 217628 - DNA, 22 bp, Artificial Sequence
  Synthetic oligonucleotide; CTT chr2 60511588 60511609 60511593 60511588 -
tgagtcttcagttttgaatcag

SEQ ID NO: 217629 - DNA, 22 bp, Artificial Sequence
  Synthetic oligonucleotide; TTT chr2 60511587 60511608 60511592 60511587 -
gagtcttcagttttgaatcaga

SEQ ID NO: 217630 - DNA, 22 bp, Artificial Sequence
  Synthetic oligonucleotide; TTG chr2 60511586 60511607 60511591 60511586 -
agtcttcagttttgaatcagat

SEQ ID NO: 217631 - DNA, 22 bp, Artificial Sequence
  Synthetic oligonucleotide; CTT chr2 60511580 60511601 60511585 60511580 -
cagttttgaatcagattagcgc

SEQ ID NO: 217632 - DNA, 22 bp, Artificial Sequence
  Synthetic oligonucleotide; TTC chr2 60511579 60511600 60511584 60511579 -
agttttgaatcagattagcgct

SEQ ID NO: 217633 - DNA, 22 bp, Artificial Sequence
  Synthetic oligonucleotide; TTT chr2 60511574 60511595 60511579 60511574 -
tgaatcagattagcgctctgtt

SEQ ID NO: 217634 - DNA, 22 bp, Artificial Sequence
  Synthetic oligonucleotide; TTT chr2 60511573 60511594 60511578 60511573 -
gaatcagattagcgctctgtta

SEQ ID NO: 217635 - DNA, 22 bp, Artificial Sequence
  Synthetic oligonucleotide; TTG chr2 60511572 60511593 60511577 60511572 -
aatcagattagcgctctgttaa

SEQ ID NO: 217636 - DNA, 22 bp, Artificial Sequence
  Synthetic oligonucleotide; TTA chr2 60511562 60511583 60511567 60511562 -
gcgctctgttaacttaaaatag

SEQ ID NO: 217637 - DNA, 22 bp, Artificial Sequence
  Synthetic oligonucleotide; CTC chr2 60511556 60511577 60511561 60511556 -
tgttaacttaaaatagccccaa

SEQ ID NO: 217638 - DNA, 22 bp, Artificial Sequence
  Synthetic oligonucleotide; CTG chr2 60511554 60511575 60511559 60511554 -
ttaacttaaaatagccccaaaa

SEQ ID NO: 217639 - DNA, 22 bp, Artificial Sequence
  Synthetic oligonucleotide; TTA chr2 60511551 60511572 60511556 60511551 -
acttaaaatagccccaaaaaag

SEQ ID NO: 217640 - DNA, 22 bp, Artificial Sequence
  Synthetic oligonucleotide; CTT chr2 60511547 60511568 60511552 60511547 -
aaaatagccccaaaaaagaaga

SEQ ID NO: 217641 - DNA, 22 bp, Artificial Sequence
  Synthetic oligonucleotide; TTA chr2 60511546 60511567 60511551 60511546 -
aaatagccccaaaaaagaagaa

SEQ ID NO: 217642 - DNA, 22 bp, Artificial Sequence
  Synthetic oligonucleotide; CTG chr2 60511507 60511528 60511512 60511507 -
tcagaaatcagagggaaatatt

SEQ ID NO: 217643 - DNA, 22 bp, Artificial Sequence
  Synthetic oligonucleotide; TTA chr2 60511484 60511505 60511489 60511484 -
gcattatgaaacatggtaacaa

SEQ ID NO: 217644 - DNA, 22 bp, Artificial Sequence
  Synthetic oligonucleotide; TTA chr2 60511478 60511499 60511483 60511478 -
tgaaacatggtaacaagtggcc

SEQ ID NO: 217645 - DNA, 22 bp, Artificial Sequence
  Synthetic oligonucleotide; TTA chr2 60511452 60511473 60511457 60511452 -
gcactttatgtctgcatgaata

SEQ ID NO: 217646 - DNA, 22 bp, Artificial Sequence
  Synthetic oligonucleotide; CTT chr2 60511446 60511467 60511451 60511446 -
tatgtctgcatgaatagcatct

SEQ ID NO: 217647 - DNA, 22 bp, Artificial Sequence
  Synthetic oligonucleotide; TTT chr2 60511445 60511466 60511450 60511445 -
atgtctgcatgaatagcatctt

SEQ ID NO: 217648 - DNA, 22 bp, Artificial Sequence
  Synthetic oligonucleotide; TTA chr2 60511444 60511465 60511449 60511444 -
tgtctgcatgaatagcatcttt

SEQ ID NO: 217649 - DNA, 22 bp, Artificial Sequence
  Synthetic oligonucleotide; CTG chr2 60511438 60511459 60511443 60511438 -
catgaatagcatctttaagtgt

SEQ ID NO: 217650 - DNA, 22 bp, Artificial Sequence
  Synthetic oligonucleotide; CTT chr2 60511423 60511444 60511428 60511423 -
taagtgttttattggtaacgga

SEQ ID NO: 217651 - DNA, 22 bp, Artificial Sequence
  Synthetic oligonucleotide; TTT chr2 60511422 60511443 60511427 60511422 -
aagtgttttattggtaacggaa

SEQ ID NO: 217652 - DNA, 22 bp, Artificial Sequence
  Synthetic oligonucleotide; TTA chr2 60511421 60511442 60511426 60511421 -
agtgttttattggtaacggaaa

SEQ ID NO: 217653 - DNA, 22 bp, Artificial Sequence
  Synthetic oligonucleotide; TTT chr2 60511414 60511435 60511419 60511414 -
tattggtaacggaaaagagtgg

SEQ ID NO: 217654 - DNA, 22 bp, Artificial Sequence
  Synthetic oligonucleotide; TTT chr2 60511413 60511434 60511418 60511413 -
attggtaacggaaaagagtgga

SEQ ID NO: 217655 - DNA, 22 bp, Artificial Sequence
  Synthetic oligonucleotide; TTA chr2 60511412 60511433 60511417 60511412 -
ttggtaacggaaaagagtggag

SEQ ID NO: 217656 - DNA, 22 bp, Artificial Sequence
  Synthetic oligonucleotide; TTG chr2 60511409 60511430 60511414 60511409 -
gtaacggaaaagagtggagtca

SEQ ID NO: 217657 - DNA, 22 bp, Artificial Sequence
  Synthetic oligonucleotide; TTA chr2 60511372 60511393 60511377 60511372 -
cttcccaaattggcgagttctt

SEQ ID NO: 217658 - DNA, 22 bp, Artificial Sequence
  Synthetic oligonucleotide; CTT chr2 60511369 60511390 60511374 60511369 -
cccaaattggcgagttctttta

SEQ ID NO: 217659 - DNA, 22 bp, Artificial Sequence
  Synthetic oligonucleotide; TTC chr2 60511368 60511389 60511373 60511368 -
ccaaattggcgagttcttttaa

SEQ ID NO: 217660 - DNA, 22 bp, Artificial Sequence
  Synthetic oligonucleotide; TTG chr2 60511360 60511381 60511365 60511360 -
gcgagttcttttaattcagact

SEQ ID NO: 217661 - DNA, 22 bp, Artificial Sequence
  Synthetic oligonucleotide; TTC chr2 60511352 60511373 60511357 60511352 -
ttttaattcagacttctccttg

SEQ ID NO: 217662 - DNA, 22 bp, Artificial Sequence
  Synthetic oligonucleotide; CTT chr2 60511350 60511371 60511355 60511350 -
ttaattcagacttctccttgtt

SEQ ID NO: 217663 - DNA, 22 bp, Artificial Sequence
  Synthetic oligonucleotide; TTT chr2 60511349 60511370 60511354 60511349 -
taattcagacttctccttgtta

SEQ ID NO: 217664 - DNA, 22 bp, Artificial Sequence
  Synthetic oligonucleotide; TTT chr2 60511348 60511369 60511353 60511348 -
aattcagacttctccttgttat

SEQ ID NO: 217665 - DNA, 22 bp, Artificial Sequence
  Synthetic oligonucleotide; TTA chr2 60511347 60511368 60511352 60511347 -
attcagacttctccttgttatt

SEQ ID NO: 217666 - DNA, 22 bp, Artificial Sequence
  Synthetic oligonucleotide; TTC chr2 60511343 60511364 60511348 60511343 -
agacttctccttgttattgcct

SEQ ID NO: 217667 - DNA, 22 bp, Artificial Sequence
  Synthetic oligonucleotide; CTT chr2 60511337 60511358 60511342 60511337 -
ctccttgttattgcctactggg

SEQ ID NO: 217668 - DNA, 22 bp, Artificial Sequence
  Synthetic oligonucleotide; TTC chr2 60511336 60511357 60511341 60511336 -
tccttgttattgcctactgggg

SEQ ID NO: 217669 - DNA, 22 bp, Artificial Sequence
  Synthetic oligonucleotide; CTC chr2 60511334 60511355 60511339 60511334 -
cttgttattgcctactggggag

SEQ ID NO: 217670 - DNA, 22 bp, Artificial Sequence
  Synthetic oligonucleotide; CTT chr2 60511331 60511352 60511336 60511331 -
gttattgcctactggggagcac

SEQ ID NO: 217671 - DNA, 22 bp, Artificial Sequence
  Synthetic oligonucleotide; TTG chr2 60511330 60511351 60511335 60511330 -
ttattgcctactggggagcact

SEQ ID NO: 217672 - DNA, 22 bp, Artificial Sequence
  Synthetic oligonucleotide; TTA chr2 60511327 60511348 60511332 60511327 -
ttgcctactggggagcacttat

SEQ ID NO: 217673 - DNA, 22 bp, Artificial Sequence
  Synthetic oligonucleotide; TTG chr2 60511324 60511345 60511329 60511324 -
cctactggggagcacttattca

SEQ ID NO: 217674 - DNA, 22 bp, Artificial Sequence
  Synthetic oligonucleotide; CTA chr2 60511320 60511341 60511325 60511320 -
ctggggagcacttattcacctg

SEQ ID NO: 217675 - DNA, 22 bp, Artificial Sequence
  Synthetic oligonucleotide; CTG chr2 60511317 60511338 60511322 60511317 -
gggagcacttattcacctgtca

SEQ ID NO: 217676 - DNA, 22 bp, Artificial Sequence
  Synthetic oligonucleotide; CTT chr2 60511307 60511328 60511312 60511307 -
attcacctgtcaaattgtatgc

SEQ ID NO: 217677 - DNA, 22 bp, Artificial Sequence
  Synthetic oligonucleotide; TTA chr2 60511306 60511327 60511311 60511306 -
ttcacctgtcaaattgtatgct

SEQ ID NO: 217678 - DNA, 22 bp, Artificial Sequence
  Synthetic oligonucleotide; TTC chr2 60511303 60511324 60511308 60511303 -
acctgtcaaattgtatgctagg

SEQ ID NO: 217679 - DNA, 22 bp, Artificial Sequence
  Synthetic oligonucleotide; CTG chr2 60511298 60511319 60511303 60511298 -
tcaaattgtatgctagggtggg

SEQ ID NO: 217680 - DNA, 22 bp, Artificial Sequence
  Synthetic oligonucleotide; TTG chr2 60511290 60511311 60511295 60511290 -
tatgctagggtgggaaagggta

SEQ ID NO: 217681 - DNA, 22 bp, Artificial Sequence
  Synthetic oligonucleotide; CTA chr2 60511283 60511304 60511288 60511283 -
gggtgggaaagggtattttagc

SEQ ID NO: 217682 - DNA, 22 bp, Artificial Sequence
  Synthetic oligonucleotide; TTT chr2 60511265 60511286 60511270 60511265 -
tagcttttctggctgcatcccg

SEQ ID NO: 217683 - DNA, 22 bp, Artificial Sequence
  Synthetic oligonucleotide; TTT chr2 60511264 60511285 60511269 60511264 -
agcttttctggctgcatcccgg

SEQ ID NO: 217684 - DNA, 22 bp, Artificial Sequence
  Synthetic oligonucleotide; TTA chr2 60511263 60511284 60511268 60511263 -
gcttttctggctgcatcccggg

SEQ ID NO: 217685 - DNA, 22 bp, Artificial Sequence
  Synthetic oligonucleotide; CTT chr2 60511259 60511280 60511264 60511259 -
ttctggctgcatcccgggctct

SEQ ID NO: 217686 - DNA, 22 bp, Artificial Sequence
  Synthetic oligonucleotide; TTT chr2 60511258 60511279 60511263 60511258 -
tctggctgcatcccgggctctc

SEQ ID NO: 217687 - DNA, 22 bp, Artificial Sequence
  Synthetic oligonucleotide; TTT chr2 60511257 60511278 60511262 60511257 -
ctggctgcatcccgggctctca

SEQ ID NO: 217688 - DNA, 22 bp, Artificial Sequence
  Synthetic oligonucleotide; TTC chr2 60511256 60511277 60511261 60511256 -
tggctgcatcccgggctctcag

SEQ ID NO: 217689 - DNA, 22 bp, Artificial Sequence
  Synthetic oligonucleotide; CTG chr2 60511254 60511275 60511259 60511254 -
gctgcatcccgggctctcaggt

SEQ ID NO: 217690 - DNA, 22 bp, Artificial Sequence
  Synthetic oligonucleotide; CTG chr2 60511250 60511271 60511255 60511250 -
catcccgggctctcaggtagaa

SEQ ID NO: 217691 - DNA, 22 bp, Artificial Sequence
  Synthetic oligonucleotide; CTC chr2 60511238 60511259 60511243 60511238 -
tcaggtagaagggatttgtccc

SEQ ID NO: 217692 - DNA, 22 bp, Artificial Sequence
  Synthetic oligonucleotide; CTC chr2 60511236 60511257 60511241 60511236 -
aggtagaagggatttgtccctt

SEQ ID NO: 217693 - DNA, 22 bp, Artificial Sequence
  Synthetic oligonucleotide; TTT chr2 60511221 60511242 60511226 60511221 -
gtccctttgccatggcctcctt

SEQ ID NO: 217694 - DNA, 22 bp, Artificial Sequence
  Synthetic oligonucleotide; TTG chr2 60511220 60511241 60511225 60511220 -
tccctttgccatggcctccttc

SEQ ID NO: 217695 - DNA, 22 bp, Artificial Sequence
  Synthetic oligonucleotide; CTT chr2 60511214 60511235 60511219 60511214 -
tgccatggcctccttctctcct

SEQ ID NO: 217696 - DNA, 22 bp, Artificial Sequence
  Synthetic oligonucleotide; TTT chr2 60511213 60511234 60511218 60511213 -
gccatggcctccttctctcctg

SEQ ID NO: 217697 - DNA, 22 bp, Artificial Sequence
  Synthetic oligonucleotide; TTG chr2 60511212 60511233 60511217 60511212 -
ccatggcctccttctctcctgc

SEQ ID NO: 217698 - DNA, 22 bp, Artificial Sequence
  Synthetic oligonucleotide; CTC chr2 60511202 60511223 60511207 60511202 -
cttctctcctgccctccccagt

SEQ ID NO: 217699 - DNA, 22 bp, Artificial Sequence
  Synthetic oligonucleotide; CTT chr2 60511199 60511220 60511204 60511199 -
ctctcctgccctccccagtgcc

SEQ ID NO: 217700 - DNA, 22 bp, Artificial Sequence
  Synthetic oligonucleotide; TTC chr2 60511198 60511219 60511203 60511198 -
tctcctgccctccccagtgccc

SEQ ID NO: 217701 - DNA, 22 bp, Artificial Sequence
  Synthetic oligonucleotide; CTC chr2 60511196 60511217 60511201 60511196 -
tcctgccctccccagtgcccct

SEQ ID NO: 217702 - DNA, 22 bp, Artificial Sequence
  Synthetic oligonucleotide; CTC chr2 60511194 60511215 60511199 60511194 -
ctgccctccccagtgcccctgc

SEQ ID NO: 217703 - DNA, 22 bp, Artificial Sequence
  Synthetic oligonucleotide; CTG chr2 60511191 60511212 60511196 60511191 -
ccctccccagtgcccctgccag

SEQ ID NO: 217704 - DNA, 22 bp, Artificial Sequence
  Synthetic oligonucleotide; CTC chr2 60511186 60511207 60511191 60511186 -
cccagtgcccctgccaggagga

SEQ ID NO: 217705 - DNA, 22 bp, Artificial Sequence
  Synthetic oligonucleotide; CTG chr2 60511173 60511194 60511178 60511173 -
ccaggaggagggagaatctgaa

SEQ ID NO: 217706 - DNA, 22 bp, Artificial Sequence
  Synthetic oligonucleotide; CTG chr2 60511153 60511174 60511158 60511153 -
aaagcaagaatggagggagagt

SEQ ID NO: 217707 - DNA, 22 bp, Artificial Sequence
  Synthetic oligonucleotide; CTG chr2 60511112 60511133 60511117 60511112 -
ggatttgtgcctggccagtgcc

SEQ ID NO: 217708 - DNA, 22 bp, Artificial Sequence
  Synthetic oligonucleotide; TTT chr2 60511106 60511127 60511111 60511106 -
gtgcctggccagtgcccctgca

SEQ ID NO: 217709 - DNA, 22 bp, Artificial Sequence
  Synthetic oligonucleotide; TTG chr2 60511105 60511126 60511110 60511105 -
tgcctggccagtgcccctgcac

SEQ ID NO: 217710 - DNA, 22 bp, Artificial Sequence
  Synthetic oligonucleotide; CTG chr2 60511099 60511120 60511104 60511099 -
gccagtgcccctgcacagtatt

SEQ ID NO: 217711 - DNA, 22 bp, Artificial Sequence
  Synthetic oligonucleotide; CTG chr2 60511086 60511107 60511091 60511086 -
cacagtattggatatgagtatg

SEQ ID NO: 217712 - DNA, 22 bp, Artificial Sequence
  Synthetic oligonucleotide; TTG chr2 60511076 60511097 60511081 60511076 -
gatatgagtatgggcatctcag

SEQ ID NO: 217713 - DNA, 22 bp, Artificial Sequence
  Synthetic oligonucleotide; CTC chr2 60511056 60511077 60511061 60511056 -
agtgtgcctggaaacgcagttg

SEQ ID NO: 217714 - DNA, 22 bp, Artificial Sequence
  Synthetic oligonucleotide; CTG chr2 60511046 60511067 60511051 60511046 -
gaaacgcagttggctgcacagc

SEQ ID NO: 217715 - DNA, 22 bp, Artificial Sequence
  Synthetic oligonucleotide; TTG chr2 60511034 60511055 60511039 60511034 -
gctgcacagccccagtgggaag

SEQ ID NO: 217716 - DNA, 22 bp, Artificial Sequence
  Synthetic oligonucleotide; CTG chr2 60511030 60511051 60511035 60511030 -
cacagccccagtgggaagaact

SEQ ID NO: 217717 - DNA, 22 bp, Artificial Sequence
  Synthetic oligonucleotide; CTC chr2 60511007 60511028 60511012 60511007 -
tgaggaactgctggtggttggc

SEQ ID NO: 217718 - DNA, 22 bp, Artificial Sequence
  Synthetic oligonucleotide; CTG chr2 60511005 60511026 60511010 60511005 -
aggaactgctggtggttggctc

SEQ ID NO: 217719 - DNA, 22 bp, Artificial Sequence
  Synthetic oligonucleotide; CTG chr2 60510997 60511018 60511002 60510997 -
ctggtggttggctcttccccag

SEQ ID NO: 217720 - DNA, 22 bp, Artificial Sequence
  Synthetic oligonucleotide; CTG chr2 60510994 60511015 60510999 60510994 -
gtggttggctcttccccaggct

SEQ ID NO: 217721 - DNA, 22 bp, Artificial Sequence
  Synthetic oligonucleotide; TTG chr2 60510987 60511008 60510992 60510987 -
gctcttccccaggctctcagcc

SEQ ID NO: 217722 - DNA, 22 bp, Artificial Sequence
  Synthetic oligonucleotide; CTC chr2 60510983 60511004 60510988 60510983 -
ttccccaggctctcagcccctc

SEQ ID NO: 217723 - DNA, 22 bp, Artificial Sequence
  Synthetic oligonucleotide; CTT chr2 60510981 60511002 60510986 60510981 -
ccccaggctctcagcccctctt

SEQ ID NO: 217724 - DNA, 22 bp, Artificial Sequence
  Synthetic oligonucleotide; TTC chr2 60510980 60511001 60510985 60510980 -
cccaggctctcagcccctcttt

SEQ ID NO: 217725 - DNA, 22 bp, Artificial Sequence
  Synthetic oligonucleotide; CTC chr2 60510971 60510992 60510976 60510971 -
tcagcccctctttctagaggct

SEQ ID NO: 217726 - DNA, 22 bp, Artificial Sequence
  Synthetic oligonucleotide; CTC chr2 60510969 60510990 60510974 60510969 -
agcccctctttctagaggctcc

SEQ ID NO: 217727 - DNA, 22 bp, Artificial Sequence
  Synthetic oligonucleotide; CTC chr2 60510961 60510982 60510966 60510961 -
tttctagaggctccacctaagc

SEQ ID NO: 217728 - DNA, 22 bp, Artificial Sequence
  Synthetic oligonucleotide; CTT chr2 60510959 60510980 60510964 60510959 -
tctagaggctccacctaagcct

SEQ ID NO: 217729 - DNA, 22 bp, Artificial Sequence
  Synthetic oligonucleotide; TTT chr2 60510958 60510979 60510963 60510958 -
ctagaggctccacctaagcctt

SEQ ID NO: 217730 - DNA, 22 bp, Artificial Sequence
  Synthetic oligonucleotide; TTC chr2 60510957 60510978 60510962 60510957 -
tagaggctccacctaagcctta

SEQ ID NO: 217731 - DNA, 22 bp, Artificial Sequence
  Synthetic oligonucleotide; CTA chr2 60510955 60510976 60510960 60510955 -
gaggctccacctaagccttagg

SEQ ID NO: 217732 - DNA, 22 bp, Artificial Sequence
  Synthetic oligonucleotide; CTC chr2 60510948 60510969 60510953 60510948 -
cacctaagccttaggaaagact

SEQ ID NO: 217733 - DNA, 22 bp, Artificial Sequence
  Synthetic oligonucleotide; CTA chr2 60510942 60510963 60510947 60510942 -
agccttaggaaagactttcgtt

SEQ ID NO: 217734 - DNA, 22 bp, Artificial Sequence
  Synthetic oligonucleotide; CTT chr2 60510936 60510957 60510941 60510936 -
aggaaagactttcgtttggttt

SEQ ID NO: 217735 - DNA, 22 bp, Artificial Sequence
  Synthetic oligonucleotide; TTA chr2 60510935 60510956 60510940 60510935 -
ggaaagactttcgtttggtttt

SEQ ID NO: 217736 - DNA, 22 bp, Artificial Sequence
  Synthetic oligonucleotide; CTT chr2 60510925 60510946 60510930 60510925 -
tcgtttggttttaactggctcc

SEQ ID NO: 217737 - DNA, 22 bp, Artificial Sequence
  Synthetic oligonucleotide; TTT chr2 60510924 60510945 60510929 60510924 -
cgtttggttttaactggctcct

SEQ ID NO: 217738 - DNA, 22 bp, Artificial Sequence
  Synthetic oligonucleotide; TTC chr2 60510923 60510944 60510928 60510923 -
gtttggttttaactggctcctg

SEQ ID NO: 217739 - DNA, 22 bp, Artificial Sequence
  Synthetic oligonucleotide; TTT chr2 60510919 60510940 60510924 60510919 -
ggttttaactggctcctgtcaa

SEQ ID NO: 217740 - DNA, 22 bp, Artificial Sequence
  Synthetic oligonucleotide; TTG chr2 60510918 60510939 60510923 60510918 -
gttttaactggctcctgtcaag

SEQ ID NO: 217741 - DNA, 22 bp, Artificial Sequence
  Synthetic oligonucleotide; TTT chr2 60510914 60510935 60510919 60510914 -
taactggctcctgtcaagggtt

SEQ ID NO: 217742 - DNA, 22 bp, Artificial Sequence
  Synthetic oligonucleotide; TTT chr2 60510913 60510934 60510918 60510913 -
aactggctcctgtcaagggttc

SEQ ID NO: 217743 - DNA, 22 bp, Artificial Sequence
  Synthetic oligonucleotide; TTA chr2 60510912 60510933 60510917 60510912 -
actggctcctgtcaagggttcc

SEQ ID NO: 217744 - DNA, 22 bp, Artificial Sequence
  Synthetic oligonucleotide; CTG chr2 60510908 60510929 60510913 60510908 -
gctcctgtcaagggttccccca

SEQ ID NO: 217745 - DNA, 22 bp, Artificial Sequence
  Synthetic oligonucleotide; CTC chr2 60510904 60510925 60510909 60510904 -
ctgtcaagggttcccccaaacc

SEQ ID NO: 217746 - DNA, 22 bp, Artificial Sequence
  Synthetic oligonucleotide; CTG chr2 60510901 60510922 60510906 60510901 -
tcaagggttcccccaaaccagc

SEQ ID NO: 217747 - DNA, 22 bp, Artificial Sequence
  Synthetic oligonucleotide; TTC chr2 60510891 60510912 60510896 60510891 -
ccccaaaccagctcaacccctc

SEQ ID NO: 217748 - DNA, 22 bp, Artificial Sequence
  Synthetic oligonucleotide; CTC chr2 60510877 60510898 60510882 60510877 -
aacccctccatttacattataa

SEQ ID NO: 217749 - DNA, 22 bp, Artificial Sequence
  Synthetic oligonucleotide; CTC chr2 60510869 60510890 60510874 60510869 -
catttacattataatgcaaaag

SEQ ID NO: 217750 - DNA, 22 bp, Artificial Sequence
  Synthetic oligonucleotide; TTT chr2 60510864 60510885 60510869 60510864 -
acattataatgcaaaagctctt

SEQ ID NO: 217751 - DNA, 22 bp, Artificial Sequence
  Synthetic oligonucleotide; TTA chr2 60510863 60510884 60510868 60510863 -
cattataatgcaaaagctcttc

SEQ ID NO: 217752 - DNA, 22 bp, Artificial Sequence
  Synthetic oligonucleotide; TTA chr2 60510858 60510879 60510863 60510858 -
taatgcaaaagctcttccctgt

SEQ ID NO: 217753 - DNA, 22 bp, Artificial Sequence
  Synthetic oligonucleotide; CTC chr2 60510844 60510865 60510849 60510844 -
ttccctgtgggtctcagggcct

SEQ ID NO: 217754 - DNA, 22 bp, Artificial Sequence
  Synthetic oligonucleotide; CTT chr2 60510842 60510863 60510847 60510842 -
ccctgtgggtctcagggcctgt

SEQ ID NO: 217755 - DNA, 22 bp, Artificial Sequence
  Synthetic oligonucleotide; TTC chr2 60510841 60510862 60510846 60510841 -
cctgtgggtctcagggcctgtg

SEQ ID NO: 217756 - DNA, 22 bp, Artificial Sequence
  Synthetic oligonucleotide; CTG chr2 60510837 60510858 60510842 60510837 -
tgggtctcagggcctgtgggga

SEQ ID NO: 217757 - DNA, 22 bp, Artificial Sequence
  Synthetic oligonucleotide; CTC chr2 60510829 60510850 60510834 60510829 -
agggcctgtggggaaaatggaa

SEQ ID NO: 217758 - DNA, 22 bp, Artificial Sequence
  Synthetic oligonucleotide; CTG chr2 60510821 60510842 60510826 60510821 -
tggggaaaatggaatctggctc

SEQ ID NO: 217759 - DNA, 22 bp, Artificial Sequence
  Synthetic oligonucleotide; CTG chr2 60510803 60510824 60510808 60510803 -
gctcaaacccaagatccaaagc

SEQ ID NO: 217760 - DNA, 22 bp, Artificial Sequence
  Synthetic oligonucleotide; CTC chr2 60510799 60510820 60510804 60510799 -
aaacccaagatccaaagctaaa

SEQ ID NO: 217761 - DNA, 22 bp, Artificial Sequence
  Synthetic oligonucleotide; CTA chr2 60510779 60510800 60510784 60510779 -
aagtgcccccaggttgggctgc

SEQ ID NO: 217762 - DNA, 22 bp, Artificial Sequence
  Synthetic oligonucleotide; TTG chr2 60510763 60510784 60510768 60510763 -
ggctgcctgacagttttataga

SEQ ID NO: 217763 - DNA, 22 bp, Artificial Sequence
  Synthetic oligonucleotide; CTG chr2 60510758 60510779 60510763 60510758 -
cctgacagttttatagatatgg

SEQ ID NO: 217764 - DNA, 22 bp, Artificial Sequence
  Synthetic oligonucleotide; CTG chr2 60510754 60510775 60510759 60510754 -
acagttttatagatatggcatt

SEQ ID NO: 217765 - DNA, 22 bp, Artificial Sequence
  Synthetic oligonucleotide; TTT chr2 60510747 60510768 60510752 60510747 -
tatagatatggcattgagtggc

SEQ ID NO: 217766 - DNA, 22 bp, Artificial Sequence
  Synthetic oligonucleotide; TTT chr2 60510746 60510767 60510751 60510746 -
atagatatggcattgagtggcc

SEQ ID NO: 217767 - DNA, 22 bp, Artificial Sequence
  Synthetic oligonucleotide; TTA chr2 60510745 60510766 60510750 60510745 -
tagatatggcattgagtggcct

SEQ ID NO: 217768 - DNA, 22 bp, Artificial Sequence
  Synthetic oligonucleotide; TTG chr2 60510731 60510752 60510736 60510731 -
agtggcctcctggcagtttgga

SEQ ID NO: 217769 - DNA, 22 bp, Artificial Sequence
  Synthetic oligonucleotide; CTC chr2 60510722 60510743 60510727 60510722 -
ctggcagtttggaattgtgaag

SEQ ID NO: 217770 - DNA, 22 bp, Artificial Sequence
  Synthetic oligonucleotide; CTG chr2 60510719 60510740 60510724 60510719 -
gcagtttggaattgtgaaggtt

SEQ ID NO: 217771 - DNA, 22 bp, Artificial Sequence
  Synthetic oligonucleotide; TTT chr2 60510712 60510733 60510717 60510712 -
ggaattgtgaaggttcactcat

SEQ ID NO: 217772 - DNA, 22 bp, Artificial Sequence
  Synthetic oligonucleotide; TTG chr2 60510711 60510732 60510716 60510711 -
gaattgtgaaggttcactcatt

SEQ ID NO: 217773 - DNA, 22 bp, Artificial Sequence
  Synthetic oligonucleotide; TTG chr2 60510705 60510726 60510710 60510705 -
tgaaggttcactcattcatttt

SEQ ID NO: 217774 - DNA, 22 bp, Artificial Sequence
  Synthetic oligonucleotide; TTC chr2 60510696 60510717 60510701 60510696 -
actcattcatttttcaacaaat

SEQ ID NO: 217775 - DNA, 22 bp, Artificial Sequence
  Synthetic oligonucleotide; CTC chr2 60510692 60510713 60510697 60510692 -
attcatttttcaacaaatattt

SEQ ID NO: 217776 - DNA, 22 bp, Artificial Sequence
  Synthetic oligonucleotide; TTC chr2 60510688 60510709 60510693 60510688 -
atttttcaacaaatattttgaa

SEQ ID NO: 217777 - DNA, 22 bp, Artificial Sequence
  Synthetic oligonucleotide; TTT chr2 60510684 60510705 60510689 60510684 -
ttcaacaaatattttgaacacc

SEQ ID NO: 217778 - DNA, 22 bp, Artificial Sequence
  Synthetic oligonucleotide; TTT chr2 60510683 60510704 60510688 60510683 -
tcaacaaatattttgaacacct

SEQ ID NO: 217779 - DNA, 22 bp, Artificial Sequence
  Synthetic oligonucleotide; TTT chr2 60510682 60510703 60510687 60510682 -
caacaaatattttgaacacctg

SEQ ID NO: 217780 - DNA, 22 bp, Artificial Sequence
  Synthetic oligonucleotide; TTC chr2 60510681 60510702 60510686 60510681 -
aacaaatattttgaacacctgc

SEQ ID NO: 217781 - DNA, 22 bp, Artificial Sequence
  Synthetic oligonucleotide; TTT chr2 60510670 60510691 60510675 60510670 -
tgaacacctgccacatgctggg

SEQ ID NO: 217782 - DNA, 22 bp, Artificial Sequence
  Synthetic oligonucleotide; TTT chr2 60510669 60510690 60510674 60510669 -
gaacacctgccacatgctggga

SEQ ID NO: 217783 - DNA, 22 bp, Artificial Sequence
  Synthetic oligonucleotide; TTG chr2 60510668 60510689 60510673 60510668 -
aacacctgccacatgctgggaa

SEQ ID NO: 217784 - DNA, 22 bp, Artificial Sequence
  Synthetic oligonucleotide; CTG chr2 60510660 60510681 60510665 60510660 -
ccacatgctgggaacggttctt

SEQ ID NO: 217785 - DNA, 22 bp, Artificial Sequence
  Synthetic oligonucleotide; CTG chr2 60510650 60510671 60510655 60510650 -
ggaacggttcttggtgttgggc

SEQ ID NO: 217786 - DNA, 22 bp, Artificial Sequence
  Synthetic oligonucleotide; TTC chr2 60510640 60510661 60510645 60510640 -
ttggtgttgggcatagaaagcc

SEQ ID NO: 217787 - DNA, 22 bp, Artificial Sequence
  Synthetic oligonucleotide; CTT chr2 60510638 60510659 60510643 60510638 -
ggtgttgggcatagaaagcctt

SEQ ID NO: 217788 - DNA, 22 bp, Artificial Sequence
  Synthetic oligonucleotide; TTG chr2 60510637 60510658 60510642 60510637 -
gtgttgggcatagaaagcctta

SEQ ID NO: 217789 - DNA, 22 bp, Artificial Sequence
  Synthetic oligonucleotide; TTG chr2 60510631 60510652 60510636 60510631 -
ggcatagaaagccttaaaaact

SEQ ID NO: 217790 - DNA, 22 bp, Artificial Sequence
  Synthetic oligonucleotide; CTT chr2 60510616 60510637 60510621 60510616 -
aaaaactccctgctcttgtggc

SEQ ID NO: 217791 - DNA, 22 bp, Artificial Sequence
  Synthetic oligonucleotide; TTA chr2 60510615 60510636 60510620 60510615 -
aaaactccctgctcttgtggca

SEQ ID NO: 217792 - DNA, 22 bp, Artificial Sequence
  Synthetic oligonucleotide; CTC chr2 60510608 60510629 60510613 60510608 -
cctgctcttgtggcaccccctt

SEQ ID NO: 217793 - DNA, 22 bp, Artificial Sequence
  Synthetic oligonucleotide; CTG chr2 60510604 60510625 60510609 60510604 -
ctcttgtggcaccccctttcta

SEQ ID NO: 217794 - DNA, 22 bp, Artificial Sequence
  Synthetic oligonucleotide; CTC chr2 60510601 60510622 60510606 60510601 -
ttgtggcaccccctttctagct

SEQ ID NO: 217795 - DNA, 22 bp, Artificial Sequence
  Synthetic oligonucleotide; CTT chr2 60510599 60510620 60510604 60510599 -
gtggcaccccctttctagctgg

SEQ ID NO: 217796 - DNA, 22 bp, Artificial Sequence
  Synthetic oligonucleotide; TTG chr2 60510598 60510619 60510603 60510598 -
tggcaccccctttctagctggg

SEQ ID NO: 217797 - DNA, 22 bp, Artificial Sequence
  Synthetic oligonucleotide; CTT chr2 60510586 60510607 60510591 60510586 -
tctagctggggagagacagaag

SEQ ID NO: 217798 - DNA, 22 bp, Artificial Sequence
  Synthetic oligonucleotide; TTT chr2 60510585 60510606 60510590 60510585 -
ctagctggggagagacagaaga

SEQ ID NO: 217799 - DNA, 22 bp, Artificial Sequence
  Synthetic oligonucleotide; TTC chr2 60510584 60510605 60510589 60510584 -
tagctggggagagacagaagat

SEQ ID NO: 217800 - DNA, 22 bp, Artificial Sequence
  Synthetic oligonucleotide; CTA chr2 60510582 60510603 60510587 60510582 -
gctggggagagacagaagatgc

SEQ ID NO: 217801 - DNA, 22 bp, Artificial Sequence
  Synthetic oligonucleotide; CTG chr2 60510578 60510599 60510583 60510578 -
gggagagacagaagatgcacca

SEQ ID NO: 217802 - DNA, 22 bp, Artificial Sequence
  Synthetic oligonucleotide; TTA chr2 60510540 60510561 60510545 60510540 -
tatagtatggcaagagaagatc

SEQ ID NO: 217803 - DNA, 22 bp, Artificial Sequence
  Synthetic oligonucleotide; CTG chr2 60510512 60510533 60510517 60510512 -
cctgcacgaaaataaggtgggg

SEQ ID NO: 217804 - DNA, 22 bp, Artificial Sequence
  Synthetic oligonucleotide; CTG chr2 60510508 60510529 60510513 60510508 -
cacgaaaataaggtggggaaga

SEQ ID NO: 217805 - DNA, 22 bp, Artificial Sequence
  Synthetic oligonucleotide; CTT chr2 60510457 60510478 60510462 60510457 -
ttaaataggataattagggaag

SEQ ID NO: 217806 - DNA, 22 bp, Artificial Sequence
  Synthetic oligonucleotide; TTT chr2 60510456 60510477 60510461 60510456 -
taaataggataattagggaagg

SEQ ID NO: 217807 - DNA, 22 bp, Artificial Sequence
  Synthetic oligonucleotide; TTT chr2 60510455 60510476 60510460 60510455 -
aaataggataattagggaaggc

SEQ ID NO: 217808 - DNA, 22 bp, Artificial Sequence
  Synthetic oligonucleotide; TTA chr2 60510454 60510475 60510459 60510454 -
aataggataattagggaaggcc

SEQ ID NO: 217809 - DNA, 22 bp, Artificial Sequence
  Synthetic oligonucleotide; TTA chr2 60510441 60510462 60510446 60510441 -
gggaaggcccaatgagaagcaa

SEQ ID NO: 217810 - DNA, 22 bp, Artificial Sequence
  Synthetic oligonucleotide; CTC chr2 60510413 60510434 60510418 60510413 -
caaagaggtgaggaagttggcc

SEQ ID NO: 217811 - DNA, 22 bp, Artificial Sequence
  Synthetic oligonucleotide; TTG chr2 60510394 60510415 60510399 60510394 -
gccatgagaattttgagaagat

SEQ ID NO: 217812 - DNA, 22 bp, Artificial Sequence
  Synthetic oligonucleotide; TTT chr2 60510381 60510402 60510386 60510381 -
tgagaagatggttccaggaaga

SEQ ID NO: 217813 - DNA, 22 bp, Artificial Sequence
  Synthetic oligonucleotide; TTT chr2 60510380 60510401 60510385 60510380 -
gagaagatggttccaggaagag

SEQ ID NO: 217814 - DNA, 22 bp, Artificial Sequence
  Synthetic oligonucleotide; TTG chr2 60510379 60510400 60510384 60510379 -
agaagatggttccaggaagagt

SEQ ID NO: 217815 - DNA, 22 bp, Artificial Sequence
  Synthetic oligonucleotide; TTC chr2 60510367 60510388 60510372 60510367 -
caggaagagtgtgtagagagca

SEQ ID NO: 217816 - DNA, 22 bp, Artificial Sequence
  Synthetic oligonucleotide; CTT chr2 60510337 60510358 60510342 60510337 -
gtgtgtaatacgcctggctact

SEQ ID NO: 217817 - DNA, 22 bp, Artificial Sequence
  Synthetic oligonucleotide; TTG chr2 60510336 60510357 60510341 60510336 -
tgtgtaatacgcctggctactg

SEQ ID NO: 217818 - DNA, 22 bp, Artificial Sequence
  Synthetic oligonucleotide; CTG chr2 60510321 60510342 60510326 60510321 -
gctactggaggaggagcaaggg

SEQ ID NO: 217819 - DNA, 22 bp, Artificial Sequence
  Synthetic oligonucleotide; CTA chr2 60510317 60510338 60510322 60510317 -
ctggaggaggagcaaggggccc

SEQ ID NO: 217820 - DNA, 22 bp, Artificial Sequence
  Synthetic oligonucleotide; CTG chr2 60510314 60510335 60510319 60510314 -
gaggaggagcaaggggccctga

SEQ ID NO: 217821 - DNA, 22 bp, Artificial Sequence
  Synthetic oligonucleotide; CTG chr2 60510293 60510314 60510298 60510293 -
aggtcagagtggaaagagtgca

SEQ ID NO: 217822 - DNA, 22 bp, Artificial Sequence
  Synthetic oligonucleotide; CTG chr2 60510245 60510266 60510250 60510245 -
gctccttgaaggacgtagagca

SEQ ID NO: 217823 - DNA, 22 bp, Artificial Sequence
  Synthetic oligonucleotide; CTC chr2 60510241 60510262 60510246 60510241 -
cttgaaggacgtagagcaggga

SEQ ID NO: 217824 - DNA, 22 bp, Artificial Sequence
  Synthetic oligonucleotide; CTT chr2 60510238 60510259 60510243 60510238 -
gaaggacgtagagcagggattt

SEQ ID NO: 217825 - DNA, 22 bp, Artificial Sequence
  Synthetic oligonucleotide; TTG chr2 60510237 60510258 60510242 60510237 -
aaggacgtagagcagggatttt

SEQ ID NO: 217826 - DNA, 22 bp, Artificial Sequence
  Synthetic oligonucleotide; TTT chr2 60510216 60510237 60510221 60510216 -
ttggctctgactccaagggaga

SEQ ID NO: 217827 - DNA, 22 bp, Artificial Sequence
  Synthetic oligonucleotide; TTT chr2 60510215 60510236 60510220 60510215 -
tggctctgactccaagggagat

SEQ ID NO: 217828 - DNA, 22 bp, Artificial Sequence
  Synthetic oligonucleotide; TTT chr2 60510214 60510235 60510219 60510214 -
ggctctgactccaagggagatg

SEQ ID NO: 217829 - DNA, 22 bp, Artificial Sequence
  Synthetic oligonucleotide; TTG chr2 60510213 60510234 60510218 60510213 -
gctctgactccaagggagatgg

SEQ ID NO: 217830 - DNA, 22 bp, Artificial Sequence
  Synthetic oligonucleotide; CTC chr2 60510209 60510230 60510214 60510209 -
tgactccaagggagatggaagc

SEQ ID NO: 217831 - DNA, 22 bp, Artificial Sequence
  Synthetic oligonucleotide; CTG chr2 60510207 60510228 60510212 60510207 -
actccaagggagatggaagcca

SEQ ID NO: 217832 - DNA, 22 bp, Artificial Sequence
  Synthetic oligonucleotide; CTC chr2 60510203 60510224 60510208 60510203 -
caagggagatggaagccactgg

SEQ ID NO: 217833 - DNA, 22 bp, Artificial Sequence
  Synthetic oligonucleotide; CTG chr2 60510182 60510203 60510187 60510182 -
gaggagtgatgtcatatgactt

SEQ ID NO: 217834 - DNA, 22 bp, Artificial Sequence
  Synthetic oligonucleotide; CTT chr2 60510160 60510181 60510165 60510160 -
gcgcttccagagagtctcttgg

SEQ ID NO: 217835 - DNA, 22 bp, Artificial Sequence
  Synthetic oligonucleotide; TTG chr2 60510159 60510180 60510164 60510159 -
cgcttccagagagtctcttggg

SEQ ID NO: 217836 - DNA, 22 bp, Artificial Sequence
  Synthetic oligonucleotide; CTT chr2 60510154 60510175 60510159 60510154 -
ccagagagtctcttgggccgca

SEQ ID NO: 217837 - DNA, 22 bp, Artificial Sequence
  Synthetic oligonucleotide; TTC chr2 60510153 60510174 60510158 60510153 -
cagagagtctcttgggccgcat

SEQ ID NO: 217838 - DNA, 22 bp, Artificial Sequence
  Synthetic oligonucleotide; CTC chr2 60510142 60510163 60510147 60510142 -
ttgggccgcattttgagactca

SEQ ID NO: 217839 - DNA, 22 bp, Artificial Sequence
  Synthetic oligonucleotide; CTT chr2 60510140 60510161 60510145 60510140 -
gggccgcattttgagactcaag

SEQ ID NO: 217840 - DNA, 22 bp, Artificial Sequence
  Synthetic oligonucleotide; TTG chr2 60510139 60510160 60510144 60510139 -
ggccgcattttgagactcaagc

SEQ ID NO: 217841 - DNA, 22 bp, Artificial Sequence
  Synthetic oligonucleotide; TTT chr2 60510129 60510150 60510134 60510129 -
tgagactcaagcatgggaaagt

SEQ ID NO: 217842 - DNA, 22 bp, Artificial Sequence
  Synthetic oligonucleotide; TTT chr2 60510128 60510149 60510133 60510128 -
gagactcaagcatgggaaagtg

SEQ ID NO: 217843 - DNA, 22 bp, Artificial Sequence
  Synthetic oligonucleotide; TTG chr2 60510127 60510148 60510132 60510127 -
agactcaagcatgggaaagtga

SEQ ID NO: 217844 - DNA, 22 bp, Artificial Sequence
  Synthetic oligonucleotide; CTC chr2 60510121 60510142 60510126 60510121 -
aagcatgggaaagtgaggcaga

SEQ ID NO: 217845 - DNA, 22 bp, Artificial Sequence
  Synthetic oligonucleotide; TTT chr2 60510079 60510100 60510084 60510079 -
taggcaagtgatggtggcgtgg

SEQ ID NO: 217846 - DNA, 22 bp, Artificial Sequence
  Synthetic oligonucleotide; TTT chr2 60510078 60510099 60510083 60510078 -
aggcaagtgatggtggcgtgga

SEQ ID NO: 217847 - DNA, 22 bp, Artificial Sequence
  Synthetic oligonucleotide; TTA chr2 60510077 60510098 60510082 60510077 -
ggcaagtgatggtggcgtggac

SEQ ID NO: 217848 - DNA, 22 bp, Artificial Sequence
  Synthetic oligonucleotide; CTG chr2 60510026 60510047 60510031 60510026 -
gattctggacatacttcgaagg

SEQ ID NO: 217849 - DNA, 22 bp, Artificial Sequence
  Synthetic oligonucleotide; TTC chr2 60510021 60510042 60510026 60510021 -
tggacatacttcgaagggaaaa

SEQ ID NO: 217850 - DNA, 22 bp, Artificial Sequence
  Synthetic oligonucleotide; CTG chr2 60510019 60510040 60510024 60510019 -
gacatacttcgaagggaaaacc

SEQ ID NO: 217851 - DNA, 22 bp, Artificial Sequence
  Synthetic oligonucleotide; CTT chr2 60510010 60510031 60510015 60510010 -
cgaagggaaaaccggcaggatt

SEQ ID NO: 217852 - DNA, 22 bp, Artificial Sequence
  Synthetic oligonucleotide; TTC chr2 60510009 60510030 60510014 60510009 -
gaagggaaaaccggcaggattt

SEQ ID NO: 217853 - DNA, 22 bp, Artificial Sequence
  Synthetic oligonucleotide; TTT chr2 60509987 60510008 60509992 60509987 -
gctgactggtgggatgggttgt

SEQ ID NO: 217854 - DNA, 22 bp, Artificial Sequence
  Synthetic oligonucleotide; TTG chr2 60509986 60510007 60509991 60509986 -
ctgactggtgggatgggttgta

SEQ ID NO: 217855 - DNA, 22 bp, Artificial Sequence
  Synthetic oligonucleotide; CTG chr2 60509983 60510004 60509988 60509983 -
actggtgggatgggttgtatga

SEQ ID NO: 217856 - DNA, 22 bp, Artificial Sequence
  Synthetic oligonucleotide; CTG chr2 60509979 60510000 60509984 60509979 -
gtgggatgggttgtatgaaagg

SEQ ID NO: 217857 - DNA, 22 bp, Artificial Sequence
  Synthetic oligonucleotide; TTG chr2 60509966 60509987 60509971 60509966 -
tatgaaaggaagggaggagtca

SEQ ID NO: 217858 - DNA, 22 bp, Artificial Sequence
  Synthetic oligonucleotide; CTC chr2 60509919 60509940 60509924 60509919 -
ggtgactgggagaatagaattg

SEQ ID NO: 217859 - DNA, 22 bp, Artificial Sequence
  Synthetic oligonucleotide; CTG chr2 60509911 60509932 60509916 60509911 -
ggagaatagaattgctgtttat

SEQ ID NO: 217860 - DNA, 22 bp, Artificial Sequence
  Synthetic oligonucleotide; TTG chr2 60509897 60509918 60509902 60509897 -
ctgtttattgggatgggccaga

SEQ ID NO: 217861 - DNA, 22 bp, Artificial Sequence
  Synthetic oligonucleotide; CTG chr2 60509894 60509915 60509899 60509894 -
tttattgggatgggccagaaag

SEQ ID NO: 217862 - DNA, 22 bp, Artificial Sequence
  Synthetic oligonucleotide; TTT chr2 60509891 60509912 60509896 60509891 -
attgggatgggccagaaaggct

SEQ ID NO: 217863 - DNA, 22 bp, Artificial Sequence
  Synthetic oligonucleotide; TTA chr2 60509890 60509911 60509895 60509890 -
ttgggatgggccagaaaggctg

SEQ ID NO: 217864 - DNA, 22 bp, Artificial Sequence
  Synthetic oligonucleotide; TTG chr2 60509887 60509908 60509892 60509887 -
ggatgggccagaaaggctgtgg

SEQ ID NO: 217865 - DNA, 22 bp, Artificial Sequence
  Synthetic oligonucleotide; CTG chr2 60509868 60509889 60509873 60509868 -
tggaggtgctcagaggatgggt

SEQ ID NO: 217866 - DNA, 22 bp, Artificial Sequence
  Synthetic oligonucleotide; CTC chr2 60509857 60509878 60509862 60509857 -
agaggatgggtgtgtctggggc

SEQ ID NO: 217867 - DNA, 22 bp, Artificial Sequence
  Synthetic oligonucleotide; CTG chr2 60509839 60509860 60509844 60509839 -
gggctccttcaccacttcagga

SEQ ID NO: 217868 - DNA, 22 bp, Artificial Sequence
  Synthetic oligonucleotide; CTC chr2 60509833 60509854 60509838 60509833 -
cttcaccacttcaggacttcag

SEQ ID NO: 217869 - DNA, 22 bp, Artificial Sequence
  Synthetic oligonucleotide; CTT chr2 60509830 60509851 60509835 60509830 -
caccacttcaggacttcagtgg

SEQ ID NO: 217870 - DNA, 22 bp, Artificial Sequence
  Synthetic oligonucleotide; TTC chr2 60509829 60509850 60509834 60509829 -
accacttcaggacttcagtgga

SEQ ID NO: 217871 - DNA, 22 bp, Artificial Sequence
  Synthetic oligonucleotide; CTT chr2 60509822 60509843 60509827 60509822 -
caggacttcagtggatgctaga

SEQ ID NO: 217872 - DNA, 22 bp, Artificial Sequence
  Synthetic oligonucleotide; TTC chr2 60509821 60509842 60509826 60509821 -
aggacttcagtggatgctagac

SEQ ID NO: 217873 - DNA, 22 bp, Artificial Sequence
  Synthetic oligonucleotide; CTT chr2 60509814 60509835 60509819 60509814 -
cagtggatgctagactactgcc

SEQ ID NO: 217874 - DNA, 22 bp, Artificial Sequence
  Synthetic oligonucleotide; TTC chr2 60509813 60509834 60509818 60509813 -
agtggatgctagactactgccc

SEQ ID NO: 217875 - DNA, 22 bp, Artificial Sequence
  Synthetic oligonucleotide; CTA chr2 60509802 60509823 60509807 60509802 -
gactactgccctgttcaggaag

SEQ ID NO: 217876 - DNA, 22 bp, Artificial Sequence
  Synthetic oligonucleotide; CTA chr2 60509797 60509818 60509802 60509797 -
ctgccctgttcaggaagatcgt

SEQ ID NO: 217877 - DNA, 22 bp, Artificial Sequence
  Synthetic oligonucleotide; CTG chr2 60509794 60509815 60509799 60509794 -
ccctgttcaggaagatcgtgag

SEQ ID NO: 217878 - DNA, 22 bp, Artificial Sequence
  Synthetic oligonucleotide; CTG chr2 60509789 60509810 60509794 60509789 -
ttcaggaagatcgtgaggggaa

SEQ ID NO: 217879 - DNA, 22 bp, Artificial Sequence
  Synthetic oligonucleotide; TTC chr2 60509786 60509807 60509791 60509786 -
aggaagatcgtgaggggaaaga

SEQ ID NO: 217880 - DNA, 22 bp, Artificial Sequence
  Synthetic oligonucleotide; TTG chr2 60509747 60509768 60509752 60509747 -
tggctgttcggagagccccagt

SEQ ID NO: 217881 - DNA, 22 bp, Artificial Sequence
  Synthetic oligonucleotide; CTG chr2 60509741 60509762 60509746 60509741 -
ttcggagagccccagttgactg

SEQ ID NO: 217882 - DNA, 22 bp, Artificial Sequence
  Synthetic oligonucleotide; TTC chr2 60509738 60509759 60509743 60509738 -
ggagagccccagttgactgcct

SEQ ID NO: 217883 - DNA, 22 bp, Artificial Sequence
  Synthetic oligonucleotide; TTG chr2 60509723 60509744 60509728 60509723 -
actgcctatagctgagatgatt

SEQ ID NO: 217884 - DNA, 22 bp, Artificial Sequence
  Synthetic oligonucleotide; CTG chr2 60509719 60509740 60509724 60509719 -
cctatagctgagatgatttaag

SEQ ID NO: 217885 - DNA, 22 bp, Artificial Sequence
  Synthetic oligonucleotide; CTA chr2 60509715 60509736 60509720 60509715 -
tagctgagatgatttaagtcga

SEQ ID NO: 217886 - DNA, 22 bp, Artificial Sequence
  Synthetic oligonucleotide; CTG chr2 60509709 60509730 60509714 60509709 -
agatgatttaagtcgagttctt

SEQ ID NO: 217887 - DNA, 22 bp, Artificial Sequence
  Synthetic oligonucleotide; TTT chr2 60509700 60509721 60509705 60509700 -
aagtcgagttctttggggaggg

SEQ ID NO: 217888 - DNA, 22 bp, Artificial Sequence
  Synthetic oligonucleotide; TTA chr2 60509699 60509720 60509704 60509699 -
agtcgagttctttggggagggc

SEQ ID NO: 217889 - DNA, 22 bp, Artificial Sequence
  Synthetic oligonucleotide; TTC chr2 60509689 60509710 60509694 60509689 -
tttggggagggccaggtgtttt

SEQ ID NO: 217890 - DNA, 22 bp, Artificial Sequence
  Synthetic oligonucleotide; CTT chr2 60509687 60509708 60509692 60509687 -
tggggagggccaggtgtttttc

SEQ ID NO: 217891 - DNA, 22 bp, Artificial Sequence
  Synthetic oligonucleotide; TTT chr2 60509686 60509707 60509691 60509686 -
ggggagggccaggtgtttttct

SEQ ID NO: 217892 - DNA, 22 bp, Artificial Sequence
  Synthetic oligonucleotide; TTG chr2 60509685 60509706 60509690 60509685 -
gggagggccaggtgtttttctc

SEQ ID NO: 217893 - DNA, 22 bp, Artificial Sequence
  Synthetic oligonucleotide; TTT chr2 60509668 60509689 60509673 60509668 -
ttctcctcctcctaatcttttt

SEQ ID NO: 217894 - DNA, 22 bp, Artificial Sequence
  Synthetic oligonucleotide; TTT chr2 60509667 60509688 60509672 60509667 -
tctcctcctcctaatctttttg

SEQ ID NO: 217895 - DNA, 22 bp, Artificial Sequence
  Synthetic oligonucleotide; TTT chr2 60509666 60509687 60509671 60509666 -
ctcctcctcctaatctttttgt

SEQ ID NO: 217896 - DNA, 22 bp, Artificial Sequence
  Synthetic oligonucleotide; TTC chr2 60509665 60509686 60509670 60509665 -
tcctcctcctaatctttttgtt

SEQ ID NO: 217897 - DNA, 22 bp, Artificial Sequence
  Synthetic oligonucleotide; CTC chr2 60509663 60509684 60509668 60509663 -
ctcctcctaatctttttgttct

SEQ ID NO: 217898 - DNA, 22 bp, Artificial Sequence
  Synthetic oligonucleotide; CTC chr2 60509660 60509681 60509665 60509660 -
ctcctaatctttttgttctttt

SEQ ID NO: 217899 - DNA, 22 bp, Artificial Sequence
  Synthetic oligonucleotide; CTC chr2 60509657 60509678 60509662 60509657 -
ctaatctttttgttctttttcc

SEQ ID NO: 217900 - DNA, 22 bp, Artificial Sequence
  Synthetic oligonucleotide; CTA chr2 60509654 60509675 60509659 60509654 -
atctttttgttctttttccttc

SEQ ID NO: 217901 - DNA, 22 bp, Artificial Sequence
  Synthetic oligonucleotide; CTT chr2 60509649 60509670 60509654 60509649 -
tttgttctttttccttctctgt

SEQ ID NO: 217902 - DNA, 22 bp, Artificial Sequence
  Synthetic oligonucleotide; TTT chr2 60509648 60509669 60509653 60509648 -
ttgttctttttccttctctgtt

SEQ ID NO: 217903 - DNA, 22 bp, Artificial Sequence
  Synthetic oligonucleotide; TTT chr2 60509647 60509668 60509652 60509647 -
tgttctttttccttctctgttg

SEQ ID NO: 217904 - DNA, 22 bp, Artificial Sequence
  Synthetic oligonucleotide; TTT chr2 60509646 60509667 60509651 60509646 -
gttctttttccttctctgttgt

SEQ ID NO: 217905 - DNA, 22 bp, Artificial Sequence
  Synthetic oligonucleotide; TTG chr2 60509645 60509666 60509650 60509645 -
ttctttttccttctctgttgtt

SEQ ID NO: 217906 - DNA, 22 bp, Artificial Sequence
  Synthetic oligonucleotide; TTC chr2 60509642 60509663 60509647 60509642 -
tttttccttctctgttgttctt

SEQ ID NO: 217907 - DNA, 22 bp, Artificial Sequence
  Synthetic oligonucleotide; CTT chr2 60509640 60509661 60509645 60509640 -
tttccttctctgttgttcttta

SEQ ID NO: 217908 - DNA, 22 bp, Artificial Sequence
  Synthetic oligonucleotide; TTT chr2 60509639 60509660 60509644 60509639 -
ttccttctctgttgttctttag

SEQ ID NO: 217909 - DNA, 22 bp, Artificial Sequence
  Synthetic oligonucleotide; TTT chr2 60509638 60509659 60509643 60509638 -
tccttctctgttgttctttagc

SEQ ID NO: 217910 - DNA, 22 bp, Artificial Sequence
  Synthetic oligonucleotide; TTT chr2 60509637 60509658 60509642 60509637 -
ccttctctgttgttctttagct

SEQ ID NO: 217911 - DNA, 22 bp, Artificial Sequence
  Synthetic oligonucleotide; TTC chr2 60509636 60509657 60509641 60509636 -
cttctctgttgttctttagcta

SEQ ID NO: 217912 - DNA, 22 bp, Artificial Sequence
  Synthetic oligonucleotide; CTT chr2 60509633 60509654 60509638 60509633 -
ctctgttgttctttagctacca

SEQ ID NO: 217913 - DNA, 22 bp, Artificial Sequence
  Synthetic oligonucleotide; TTC chr2 60509632 60509653 60509637 60509632 -
tctgttgttctttagctaccaa

SEQ ID NO: 217914 - DNA, 22 bp, Artificial Sequence
  Synthetic oligonucleotide; CTC chr2 60509630 60509651 60509635 60509630 -
tgttgttctttagctaccaaag

SEQ ID NO: 217915 - DNA, 22 bp, Artificial Sequence
  Synthetic oligonucleotide; CTG chr2 60509628 60509649 60509633 60509628 -
ttgttctttagctaccaaagac

SEQ ID NO: 217916 - DNA, 22 bp, Artificial Sequence
  Synthetic oligonucleotide; TTG chr2 60509625 60509646 60509630 60509625 -
ttctttagctaccaaagacaac

SEQ ID NO: 217917 - DNA, 22 bp, Artificial Sequence
  Synthetic oligonucleotide; TTC chr2 60509622 60509643 60509627 60509622 -
tttagctaccaaagacaacttg

SEQ ID NO: 217918 - DNA, 22 bp, Artificial Sequence
  Synthetic oligonucleotide; CTT chr2 60509620 60509641 60509625 60509620 -
tagctaccaaagacaacttgat

SEQ ID NO: 217919 - DNA, 22 bp, Artificial Sequence
  Synthetic oligonucleotide; TTT chr2 60509619 60509640 60509624 60509619 -
agctaccaaagacaacttgatc

SEQ ID NO: 217920 - DNA, 22 bp, Artificial Sequence
  Synthetic oligonucleotide; TTA chr2 60509618 60509639 60509623 60509618 -
gctaccaaagacaacttgatct

SEQ ID NO: 217921 - DNA, 22 bp, Artificial Sequence
  Synthetic oligonucleotide; CTA chr2 60509614 60509635 60509619 60509614 -
ccaaagacaacttgatcttttg

SEQ ID NO: 217922 - DNA, 22 bp, Artificial Sequence
  Synthetic oligonucleotide; CTT chr2 60509601 60509622 60509606 60509601 -
gatcttttgatccagaaagatg

SEQ ID NO: 217923 - DNA, 22 bp, Artificial Sequence
  Synthetic oligonucleotide; TTG chr2 60509600 60509621 60509605 60509600 -
atcttttgatccagaaagatgc

SEQ ID NO: 217924 - DNA, 22 bp, Artificial Sequence
  Synthetic oligonucleotide; CTT chr2 60509595 60509616 60509600 60509595 -
ttgatccagaaagatgcgcttt

SEQ ID NO: 217925 - DNA, 22 bp, Artificial Sequence
  Synthetic oligonucleotide; TTT chr2 60509594 60509615 60509599 60509594 -
tgatccagaaagatgcgctttg

SEQ ID NO: 217926 - DNA, 22 bp, Artificial Sequence
  Synthetic oligonucleotide; TTT chr2 60509593 60509614 60509598 60509593 -
gatccagaaagatgcgctttgt

SEQ ID NO: 217927 - DNA, 22 bp, Artificial Sequence
  Synthetic oligonucleotide; TTG chr2 60509592 60509613 60509597 60509592 -
atccagaaagatgcgctttgtt

SEQ ID NO: 217928 - DNA, 22 bp, Artificial Sequence
  Synthetic oligonucleotide; CTT chr2 60509574 60509595 60509579 60509574 -
tgtttcttgcatttctttccct

SEQ ID NO: 217929 - DNA, 22 bp, Artificial Sequence
  Synthetic oligonucleotide; TTT chr2 60509573 60509594 60509578 60509573 -
gtttcttgcatttctttccctt

SEQ ID NO: 217930 - DNA, 22 bp, Artificial Sequence
  Synthetic oligonucleotide; TTG chr2 60509572 60509593 60509577 60509572 -
tttcttgcatttctttcccttc

SEQ ID NO: 217931 - DNA, 22 bp, Artificial Sequence
  Synthetic oligonucleotide; TTT chr2 60509569 60509590 60509574 60509569 -
cttgcatttctttcccttcgtt

SEQ ID NO: 217932 - DNA, 22 bp, Artificial Sequence
  Synthetic oligonucleotide; TTC chr2 60509568 60509589 60509573 60509568 -
ttgcatttctttcccttcgttt

SEQ ID NO: 217933 - DNA, 22 bp, Artificial Sequence
  Synthetic oligonucleotide; CTT chr2 60509566 60509587 60509571 60509566 -
gcatttctttcccttcgtttgt

SEQ ID NO: 217934 - DNA, 22 bp, Artificial Sequence
  Synthetic oligonucleotide; TTG chr2 60509565 60509586 60509570 60509565 -
catttctttcccttcgtttgtt

SEQ ID NO: 217935 - DNA, 22 bp, Artificial Sequence
  Synthetic oligonucleotide; TTT chr2 60509560 60509581 60509565 60509560 -
ctttcccttcgtttgttttctc

SEQ ID NO: 217936 - DNA, 22 bp, Artificial Sequence
  Synthetic oligonucleotide; TTC chr2 60509559 60509580 60509564 60509559 -
tttcccttcgtttgttttctca

SEQ ID NO: 217937 - DNA, 22 bp, Artificial Sequence
  Synthetic oligonucleotide; CTT chr2 60509557 60509578 60509562 60509557 -
tcccttcgtttgttttctcagg

SEQ ID NO: 217938 - DNA, 22 bp, Artificial Sequence
  Synthetic oligonucleotide; TTT chr2 60509556 60509577 60509561 60509556 -
cccttcgtttgttttctcaggt

SEQ ID NO: 217939 - DNA, 22 bp, Artificial Sequence
  Synthetic oligonucleotide; TTC chr2 60509555 60509576 60509560 60509555 -
ccttcgtttgttttctcaggtc

SEQ ID NO: 217940 - DNA, 22 bp, Artificial Sequence
  Synthetic oligonucleotide; CTT chr2 60509551 60509572 60509556 60509551 -
cgtttgttttctcaggtctcag

SEQ ID NO: 217941 - DNA, 22 bp, Artificial Sequence
  Synthetic oligonucleotide; TTC chr2 60509550 60509571 60509555 60509550 -
gtttgttttctcaggtctcagg

SEQ ID NO: 217942 - DNA, 22 bp, Artificial Sequence
  Synthetic oligonucleotide; TTT chr2 60509546 60509567 60509551 60509546 -
gttttctcaggtctcaggtaga

SEQ ID NO: 217943 - DNA, 22 bp, Artificial Sequence
  Synthetic oligonucleotide; TTG chr2 60509545 60509566 60509550 60509545 -
ttttctcaggtctcaggtagac

SEQ ID NO: 217944 - DNA, 22 bp, Artificial Sequence
  Synthetic oligonucleotide; TTT chr2 60509542 60509563 60509547 60509542 -
tctcaggtctcaggtagaccat

SEQ ID NO: 217945 - DNA, 22 bp, Artificial Sequence
  Synthetic oligonucleotide; TTT chr2 60509541 60509562 60509546 60509541 -
ctcaggtctcaggtagaccatc

SEQ ID NO: 217946 - DNA, 22 bp, Artificial Sequence
  Synthetic oligonucleotide; TTC chr2 60509540 60509561 60509545 60509540 -
tcaggtctcaggtagaccatcg

SEQ ID NO: 217947 - DNA, 22 bp, Artificial Sequence
  Synthetic oligonucleotide; CTC chr2 60509538 60509559 60509543 60509538 -
aggtctcaggtagaccatcgag

SEQ ID NO: 217948 - DNA, 22 bp, Artificial Sequence
  Synthetic oligonucleotide; CTC chr2 60509531 60509552 60509536 60509531 -
aggtagaccatcgagctgctgt

SEQ ID NO: 217949 - DNA, 22 bp, Artificial Sequence
  Synthetic oligonucleotide; CTG chr2 60509513 60509534 60509518 60509513 -
ctgttaattggtgatatttagg

SEQ ID NO: 217950 - DNA, 22 bp, Artificial Sequence
  Synthetic oligonucleotide; CTG chr2 60509510 60509531 60509515 60509510 -
ttaattggtgatatttaggaat

SEQ ID NO: 217951 - DNA, 22 bp, Artificial Sequence
  Synthetic oligonucleotide; TTA chr2 60509507 60509528 60509512 60509507 -
attggtgatatttaggaatggg

SEQ ID NO: 217952 - DNA, 22 bp, Artificial Sequence
  Synthetic oligonucleotide; TTG chr2 60509503 60509524 60509508 60509503 -
gtgatatttaggaatgggttgg

SEQ ID NO: 217953 - DNA, 22 bp, Artificial Sequence
  Synthetic oligonucleotide; TTT chr2 60509494 60509515 60509499 60509494 -
aggaatgggttggaagctgcat

SEQ ID NO: 217954 - DNA, 22 bp, Artificial Sequence
  Synthetic oligonucleotide; TTA chr2 60509493 60509514 60509498 60509493 -
ggaatgggttggaagctgcatc

SEQ ID NO: 217955 - DNA, 22 bp, Artificial Sequence
  Synthetic oligonucleotide; TTG chr2 60509482 60509503 60509487 60509482 -
gaagctgcatcttttcctggac

SEQ ID NO: 217956 - DNA, 22 bp, Artificial Sequence
  Synthetic oligonucleotide; CTG chr2 60509475 60509496 60509480 60509475 -
catcttttcctggacttctcag

SEQ ID NO: 217957 - DNA, 22 bp, Artificial Sequence
  Synthetic oligonucleotide; CTT chr2 60509469 60509490 60509474 60509469 -
ttcctggacttctcaggactct

SEQ ID NO: 217958 - DNA, 22 bp, Artificial Sequence
  Synthetic oligonucleotide; TTT chr2 60509468 60509489 60509473 60509468 -
tcctggacttctcaggactctc

SEQ ID NO: 217959 - DNA, 22 bp, Artificial Sequence
  Synthetic oligonucleotide; TTT chr2 60509467 60509488 60509472 60509467 -
cctggacttctcaggactctca

SEQ ID NO: 217960 - DNA, 22 bp, Artificial Sequence
  Synthetic oligonucleotide; TTC chr2 60509466 60509487 60509471 60509466 -
ctggacttctcaggactctcac

SEQ ID NO: 217961 - DNA, 22 bp, Artificial Sequence
  Synthetic oligonucleotide; CTG chr2 60509463 60509484 60509468 60509463 -
gacttctcaggactctcactgc

SEQ ID NO: 217962 - DNA, 22 bp, Artificial Sequence
  Synthetic oligonucleotide; CTT chr2 60509458 60509479 60509463 60509458 -
ctcaggactctcactgccacgt

SEQ ID NO: 217963 - DNA, 22 bp, Artificial Sequence
  Synthetic oligonucleotide; TTC chr2 60509457 60509478 60509462 60509457 -
tcaggactctcactgccacgtg

SEQ ID NO: 217964 - DNA, 22 bp, Artificial Sequence
  Synthetic oligonucleotide; CTC chr2 60509455 60509476 60509460 60509455 -
aggactctcactgccacgtgtc

SEQ ID NO: 217965 - DNA, 22 bp, Artificial Sequence
  Synthetic oligonucleotide; CTC chr2 60509448 60509469 60509453 60509448 -
tcactgccacgtgtcttgtgct

SEQ ID NO: 217966 - DNA, 22 bp, Artificial Sequence
  Synthetic oligonucleotide; CTC chr2 60509446 60509467 60509451 60509446 -
actgccacgtgtcttgtgcttc

SEQ ID NO: 217967 - DNA, 22 bp, Artificial Sequence
  Synthetic oligonucleotide; CTG chr2 60509442 60509463 60509447 60509442 -
ccacgtgtcttgtgcttccaca

SEQ ID NO: 217968 - DNA, 22 bp, Artificial Sequence
  Synthetic oligonucleotide; CTT chr2 60509431 60509452 60509436 60509431 -
gtgcttccacagaaccgttttc

SEQ ID NO: 217969 - DNA, 22 bp, Artificial Sequence
  Synthetic oligonucleotide; TTG chr2 60509430 60509451 60509435 60509430 -
tgcttccacagaaccgttttct

SEQ ID NO: 217970 - DNA, 22 bp, Artificial Sequence
  Synthetic oligonucleotide; CTT chr2 60509425 60509446 60509430 60509425 -
ccacagaaccgttttctgagac

SEQ ID NO: 217971 - DNA, 22 bp, Artificial Sequence
  Synthetic oligonucleotide; TTC chr2 60509424 60509445 60509429 60509424 -
cacagaaccgttttctgagacg

SEQ ID NO: 217972 - DNA, 22 bp, Artificial Sequence
  Synthetic oligonucleotide; TTT chr2 60509411 60509432 60509416 60509411 -
tctgagacgtccgtgtggctct

SEQ ID NO: 217973 - DNA, 22 bp, Artificial Sequence
  Synthetic oligonucleotide; TTT chr2 60509410 60509431 60509415 60509410 -
ctgagacgtccgtgtggctctg

SEQ ID NO: 217974 - DNA, 22 bp, Artificial Sequence
  Synthetic oligonucleotide; TTC chr2 60509409 60509430 60509414 60509409 -
tgagacgtccgtgtggctctgc

SEQ ID NO: 217975 - DNA, 22 bp, Artificial Sequence
  Synthetic oligonucleotide; CTG chr2 60509407 60509428 60509412 60509407 -
agacgtccgtgtggctctgctg

SEQ ID NO: 217976 - DNA, 22 bp, Artificial Sequence
  Synthetic oligonucleotide; CTC chr2 60509390 60509411 60509395 60509390 -
tgctgtgctcaggtccacggtt

SEQ ID NO: 217977 - DNA, 22 bp, Artificial Sequence
  Synthetic oligonucleotide; CTG chr2 60509388 60509409 60509393 60509388 -
ctgtgctcaggtccacggttag

SEQ ID NO: 217978 - DNA, 22 bp, Artificial Sequence
  Synthetic oligonucleotide; CTG chr2 60509385 60509406 60509390 60509385 -
tgctcaggtccacggttagccc

SEQ ID NO: 217979 - DNA, 22 bp, Artificial Sequence
  Synthetic oligonucleotide; CTC chr2 60509380 60509401 60509385 60509380 -
aggtccacggttagcccctggc

SEQ ID NO: 217980 - DNA, 22 bp, Artificial Sequence
  Synthetic oligonucleotide; TTA chr2 60509367 60509388 60509372 60509367 -
gcccctggcttggaatttcttc

SEQ ID NO: 217981 - DNA, 22 bp, Artificial Sequence
  Synthetic oligonucleotide; CTG chr2 60509360 60509381 60509365 60509360 -
gcttggaatttcttccggaaat

SEQ ID NO: 217982 - DNA, 22 bp, Artificial Sequence
  Synthetic oligonucleotide; CTT chr2 60509356 60509377 60509361 60509356 -
ggaatttcttccggaaatccgt

SEQ ID NO: 217983 - DNA, 22 bp, Artificial Sequence
  Synthetic oligonucleotide; TTG chr2 60509355 60509376 60509360 60509355 -
gaatttcttccggaaatccgtt

SEQ ID NO: 217984 - DNA, 22 bp, Artificial Sequence
  Synthetic oligonucleotide; TTT chr2 60509349 60509370 60509354 60509349 -
cttccggaaatccgttgtcctc

SEQ ID NO: 217985 - DNA, 22 bp, Artificial Sequence
  Synthetic oligonucleotide; TTC chr2 60509348 60509369 60509353 60509348 -
ttccggaaatccgttgtcctct

SEQ ID NO: 217986 - DNA, 22 bp, Artificial Sequence
  Synthetic oligonucleotide; CTT chr2 60509346 60509367 60509351 60509346 -
ccggaaatccgttgtcctcttt

SEQ ID NO: 217987 - DNA, 22 bp, Artificial Sequence
  Synthetic oligonucleotide; TTC chr2 60509345 60509366 60509350 60509345 -
cggaaatccgttgtcctctttt

SEQ ID NO: 217988 - DNA, 22 bp, Artificial Sequence
  Synthetic oligonucleotide; TTG chr2 60509332 60509353 60509337 60509332 -
tcctcttttccacaggttctcc

SEQ ID NO: 217989 - DNA, 22 bp, Artificial Sequence
  Synthetic oligonucleotide; CTC chr2 60509327 60509348 60509332 60509327 -
ttttccacaggttctcctcctc

SEQ ID NO: 217990 - DNA, 22 bp, Artificial Sequence
  Synthetic oligonucleotide; CTT chr2 60509325 60509346 60509330 60509325 -
ttccacaggttctcctcctccc

SEQ ID NO: 217991 - DNA, 22 bp, Artificial Sequence
  Synthetic oligonucleotide; TTT chr2 60509324 60509345 60509329 60509324 -
tccacaggttctcctcctccct

SEQ ID NO: 217992 - DNA, 22 bp, Artificial Sequence
  Synthetic oligonucleotide; TTT chr2 60509323 60509344 60509328 60509323 -
ccacaggttctcctcctccctt

SEQ ID NO: 217993 - DNA, 22 bp, Artificial Sequence
  Synthetic oligonucleotide; TTC chr2 60509322 60509343 60509327 60509322 -
cacaggttctcctcctcccttt

SEQ ID NO: 217994 - DNA, 22 bp, Artificial Sequence
  Synthetic oligonucleotide; TTC chr2 60509313 60509334 60509318 60509313 -
tcctcctccctttccccatttc

SEQ ID NO: 217995 - DNA, 22 bp, Artificial Sequence
  Synthetic oligonucleotide; CTC chr2 60509311 60509332 60509316 60509311 -
ctcctccctttccccatttctg

SEQ ID NO: 217996 - DNA, 22 bp, Artificial Sequence
  Synthetic oligonucleotide; CTC chr2 60509308 60509329 60509313 60509308 -
ctccctttccccatttctggaa

SEQ ID NO: 217997 - DNA, 22 bp, Artificial Sequence
  Synthetic oligonucleotide; CTC chr2 60509305 60509326 60509310 60509305 -
cctttccccatttctggaaaga

SEQ ID NO: 217998 - DNA, 22 bp, Artificial Sequence
  Synthetic oligonucleotide; CTT chr2 60509301 60509322 60509306 60509301 -
tccccatttctggaaagaagtg

SEQ ID NO: 217999 - DNA, 22 bp, Artificial Sequence
  Synthetic oligonucleotide; TTT chr2 60509300 60509321 60509305 60509300 -
ccccatttctggaaagaagtgg

SEQ ID NO: 218000 - DNA, 22 bp, Artificial Sequence
  Synthetic oligonucleotide; TTC chr2 60509299 60509320 60509304 60509299 -
cccatttctggaaagaagtggg

SEQ ID NO: 218001 - DNA, 22 bp, Artificial Sequence
  Synthetic oligonucleotide; TTT chr2 60509292 60509313 60509297 60509292 -
ctggaaagaagtgggctggcac

SEQ ID NO: 218002 - DNA, 22 bp, Artificial Sequence
  Synthetic oligonucleotide; TTC chr2 60509291 60509312 60509296 60509291 -
tggaaagaagtgggctggcaca

SEQ ID NO: 218003 - DNA, 22 bp, Artificial Sequence
  Synthetic oligonucleotide; CTG chr2 60509289 60509310 60509294 60509289 -
gaaagaagtgggctggcacata

SEQ ID NO: 218004 - DNA, 22 bp, Artificial Sequence
  Synthetic oligonucleotide; CTG chr2 60509274 60509295 60509279 60509274 -
gcacatagagcctttttccttg

SEQ ID NO: 218005 - DNA, 22 bp, Artificial Sequence
  Synthetic oligonucleotide; CTT chr2 60509260 60509281 60509265 60509260 -
tttccttgaaaggagagtgcag

SEQ ID NO: 218006 - DNA, 22 bp, Artificial Sequence
  Synthetic oligonucleotide; TTT chr2 60509259 60509280 60509264 60509259 -
ttccttgaaaggagagtgcaga

SEQ ID NO: 218007 - DNA, 22 bp, Artificial Sequence
  Synthetic oligonucleotide; TTT chr2 60509258 60509279 60509263 60509258 -
tccttgaaaggagagtgcagag

SEQ ID NO: 218008 - DNA, 22 bp, Artificial Sequence
  Synthetic oligonucleotide; TTT chr2 60509257 60509278 60509262 60509257 -
ccttgaaaggagagtgcagagc

SEQ ID NO: 218009 - DNA, 22 bp, Artificial Sequence
  Synthetic oligonucleotide; TTC chr2 60509256 60509277 60509261 60509256 -
cttgaaaggagagtgcagagcc

SEQ ID NO: 218010 - DNA, 22 bp, Artificial Sequence
  Synthetic oligonucleotide; CTT chr2 60509253 60509274 60509258 60509253 -
gaaaggagagtgcagagccctc

SEQ ID NO: 218011 - DNA, 22 bp, Artificial Sequence
  Synthetic oligonucleotide; TTG chr2 60509252 60509273 60509257 60509252 -
aaaggagagtgcagagccctct

SEQ ID NO: 218012 - DNA, 22 bp, Artificial Sequence
  Synthetic oligonucleotide; CTC chr2 60509231 60509252 60509236 60509231 -
taatggaaaagtaaaaaaattc

SEQ ID NO: 218013 - DNA, 22 bp, Artificial Sequence
  Synthetic oligonucleotide; CTA chr2 60509229 60509250 60509234 60509229 -
atggaaaagtaaaaaaattctt

SEQ ID NO: 218014 - DNA, 22 bp, Artificial Sequence
  Synthetic oligonucleotide; TTC chr2 60509209 60509230 60509214 60509209 -
ttggaatcctcataacatccaa

SEQ ID NO: 218015 - DNA, 22 bp, Artificial Sequence
  Synthetic oligonucleotide; CTT chr2 60509207 60509228 60509212 60509207 -
ggaatcctcataacatccaagc

SEQ ID NO: 218016 - DNA, 22 bp, Artificial Sequence
  Synthetic oligonucleotide; TTG chr2 60509206 60509227 60509211 60509206 -
gaatcctcataacatccaagcc

SEQ ID NO: 218017 - DNA, 22 bp, Artificial Sequence
  Synthetic oligonucleotide; CTC chr2 60509198 60509219 60509203 60509198 -
ataacatccaagccagccaaag

SEQ ID NO: 218018 - DNA, 22 bp, Artificial Sequence
  Synthetic oligonucleotide; CTG chr2 60509173 60509194 60509178 60509173 -
agaccaagtaaattattggggg

SEQ ID NO: 218019 - DNA, 22 bp, Artificial Sequence
  Synthetic oligonucleotide; TTA chr2 60509158 60509179 60509163 60509158 -
ttggggggtaatttgcaagggc

SEQ ID NO: 218020 - DNA, 22 bp, Artificial Sequence
  Synthetic oligonucleotide; TTG chr2 60509155 60509176 60509160 60509155 -
gggggtaatttgcaagggcctg

SEQ ID NO: 218021 - DNA, 22 bp, Artificial Sequence
  Synthetic oligonucleotide; TTT chr2 60509144 60509165 60509149 60509144 -
gcaagggcctgaatcaaacaaa

SEQ ID NO: 218022 - DNA, 22 bp, Artificial Sequence
  Synthetic oligonucleotide; TTG chr2 60509143 60509164 60509148 60509143 -
caagggcctgaatcaaacaaat

SEQ ID NO: 218023 - DNA, 22 bp, Artificial Sequence
  Synthetic oligonucleotide; CTG chr2 60509133 60509154 60509138 60509133 -
aatcaaacaaattgctttcttg

SEQ ID NO: 218024 - DNA, 22 bp, Artificial Sequence
  Synthetic oligonucleotide; TTG chr2 60509119 60509140 60509124 60509119 -
ctttcttgtttctcagcttgaa

SEQ ID NO: 218025 - DNA, 22 bp, Artificial Sequence
  Synthetic oligonucleotide; CTT chr2 60509116 60509137 60509121 60509116 -
tcttgtttctcagcttgaatct

SEQ ID NO: 218026 - DNA, 22 bp, Artificial Sequence
  Synthetic oligonucleotide; TTT chr2 60509115 60509136 60509120 60509115 -
cttgtttctcagcttgaatctt

SEQ ID NO: 218027 - DNA, 22 bp, Artificial Sequence
  Synthetic oligonucleotide; TTC chr2 60509114 60509135 60509119 60509114 -
ttgtttctcagcttgaatcttt

SEQ ID NO: 218028 - DNA, 22 bp, Artificial Sequence
  Synthetic oligonucleotide; CTT chr2 60509112 60509133 60509117 60509112 -
gtttctcagcttgaatctttag

SEQ ID NO: 218029 - DNA, 22 bp, Artificial Sequence
  Synthetic oligonucleotide; TTG chr2 60509111 60509132 60509116 60509111 -
tttctcagcttgaatctttaga

SEQ ID NO: 218030 - DNA, 22 bp, Artificial Sequence
  Synthetic oligonucleotide; TTT chr2 60509108 60509129 60509113 60509108 -
ctcagcttgaatctttagacca

SEQ ID NO: 218031 - DNA, 22 bp, Artificial Sequence
  Synthetic oligonucleotide; TTC chr2 60509107 60509128 60509112 60509107 -
tcagcttgaatctttagaccag

SEQ ID NO: 218032 - DNA, 22 bp, Artificial Sequence
  Synthetic oligonucleotide; CTC chr2 60509105 60509126 60509110 60509105 -
agcttgaatctttagaccagaa

SEQ ID NO: 218033 - DNA, 22 bp, Artificial Sequence
  Synthetic oligonucleotide; CTT chr2 60509100 60509121 60509105 60509100 -
gaatctttagaccagaagcctg

SEQ ID NO: 218034 - DNA, 22 bp, Artificial Sequence
  Synthetic oligonucleotide; TTG chr2 60509099 60509120 60509104 60509099 -
aatctttagaccagaagcctgt

SEQ ID NO: 218035 - DNA, 22 bp, Artificial Sequence
  Synthetic oligonucleotide; CTT chr2 60509093 60509114 60509098 60509093 -
tagaccagaagcctgtgatttc

SEQ ID NO: 218036 - DNA, 22 bp, Artificial Sequence
  Synthetic oligonucleotide; TTT chr2 60509092 60509113 60509097 60509092 -
agaccagaagcctgtgatttcg

SEQ ID NO: 218037 - DNA, 22 bp, Artificial Sequence
  Synthetic oligonucleotide; TTA chr2 60509091 60509112 60509096 60509091 -
gaccagaagcctgtgatttcgg

SEQ ID NO: 218038 - DNA, 22 bp, Artificial Sequence
  Synthetic oligonucleotide; CTG chr2 60509078 60509099 60509083 60509078 -
tgatttcggagtctgatgagaa

SEQ ID NO: 218039 - DNA, 22 bp, Artificial Sequence
  Synthetic oligonucleotide; TTT chr2 60509072 60509093 60509077 60509072 -
cggagtctgatgagaaataaga

SEQ ID NO: 218040 - DNA, 22 bp, Artificial Sequence
  Synthetic oligonucleotide; TTC chr2 60509071 60509092 60509076 60509071 -
ggagtctgatgagaaataagag

SEQ ID NO: 218041 - DNA, 22 bp, Artificial Sequence
  Synthetic oligonucleotide; CTG chr2 60509063 60509084 60509068 60509063 -
atgagaaataagagtcagtgtt

SEQ ID NO: 218042 - DNA, 22 bp, Artificial Sequence
  Synthetic oligonucleotide; TTT chr2 60509040 60509061 60509045 60509040 -
ctgtctgagccacttttctttg

SEQ ID NO: 218043 - DNA, 22 bp, Artificial Sequence
  Synthetic oligonucleotide; TTC chr2 60509039 60509060 60509044 60509039 -
tgtctgagccacttttctttgg

SEQ ID NO: 218044 - DNA, 22 bp, Artificial Sequence
  Synthetic oligonucleotide; CTG chr2 60509037 60509058 60509042 60509037 -
tctgagccacttttctttggag

SEQ ID NO: 218045 - DNA, 22 bp, Artificial Sequence
  Synthetic oligonucleotide; CTG chr2 60509033 60509054 60509038 60509033 -
agccacttttctttggaggagg

SEQ ID NO: 218046 - DNA, 22 bp, Artificial Sequence
  Synthetic oligonucleotide; CTT chr2 60509025 60509046 60509030 60509025 -
ttctttggaggaggtcctctag

SEQ ID NO: 218047 - DNA, 22 bp, Artificial Sequence
  Synthetic oligonucleotide; TTT chr2 60509024 60509045 60509029 60509024 -
tctttggaggaggtcctctagg

SEQ ID NO: 218048 - DNA, 22 bp, Artificial Sequence
  Synthetic oligonucleotide; TTT chr2 60509023 60509044 60509028 60509023 -
ctttggaggaggtcctctaggc

SEQ ID NO: 218049 - DNA, 22 bp, Artificial Sequence
  Synthetic oligonucleotide; TTC chr2 60509022 60509043 60509027 60509022 -
tttggaggaggtcctctaggct

SEQ ID NO: 218050 - DNA, 22 bp, Artificial Sequence
  Synthetic oligonucleotide; CTT chr2 60509020 60509041 60509025 60509020 -
tggaggaggtcctctaggcttt

SEQ ID NO: 218051 - DNA, 22 bp, Artificial Sequence
  Synthetic oligonucleotide; TTT chr2 60509019 60509040 60509024 60509019 -
ggaggaggtcctctaggcttta

SEQ ID NO: 218052 - DNA, 22 bp, Artificial Sequence
  Synthetic oligonucleotide; TTG chr2 60509018 60509039 60509023 60509018 -
gaggaggtcctctaggctttag

SEQ ID NO: 218053 - DNA, 22 bp, Artificial Sequence
  Synthetic oligonucleotide; CTC chr2 60509006 60509027 60509011 60509006 -
taggctttagcaatcacagaag

SEQ ID NO: 218054 - DNA, 22 bp, Artificial Sequence
  Synthetic oligonucleotide; CTA chr2 60509004 60509025 60509009 60509004 -
ggctttagcaatcacagaagaa

SEQ ID NO: 218055 - DNA, 22 bp, Artificial Sequence
  Synthetic oligonucleotide; CTT chr2 60508999 60509020 60509004 60508999 -
tagcaatcacagaagaaccagt

SEQ ID NO: 218056 - DNA, 22 bp, Artificial Sequence
  Synthetic oligonucleotide; TTT chr2 60508998 60509019 60509003 60508998 -
agcaatcacagaagaaccagtg

SEQ ID NO: 218057 - DNA, 22 bp, Artificial Sequence
  Synthetic oligonucleotide; TTA chr2 60508997 60509018 60509002 60508997 -
gcaatcacagaagaaccagtga

SEQ ID NO: 218058 - DNA, 22 bp, Artificial Sequence
  Synthetic oligonucleotide; TTC chr2 60508968 60508989 60508973 60508968 -
cttgtcataggagagctccttg

SEQ ID NO: 218059 - DNA, 22 bp, Artificial Sequence
  Synthetic oligonucleotide; CTT chr2 60508965 60508986 60508970 60508965 -
gtcataggagagctccttggtc

SEQ ID NO: 218060 - DNA, 22 bp, Artificial Sequence
  Synthetic oligonucleotide; TTG chr2 60508964 60508985 60508969 60508964 -
tcataggagagctccttggtcc

SEQ ID NO: 218061 - DNA, 22 bp, Artificial Sequence
  Synthetic oligonucleotide; CTC chr2 60508950 60508971 60508955 60508950 -
cttggtcctcaggattcaaaag

SEQ ID NO: 218062 - DNA, 22 bp, Artificial Sequence
  Synthetic oligonucleotide; CTT chr2 60508947 60508968 60508952 60508947 -
ggtcctcaggattcaaaagaca

SEQ ID NO: 218063 - DNA, 22 bp, Artificial Sequence
  Synthetic oligonucleotide; TTG chr2 60508946 60508967 60508951 60508946 -
gtcctcaggattcaaaagacac

SEQ ID NO: 218064 - DNA, 22 bp, Artificial Sequence
  Synthetic oligonucleotide; CTC chr2 60508940 60508961 60508945 60508940 -
aggattcaaaagacaccttaag

SEQ ID NO: 218065 - DNA, 22 bp, Artificial Sequence
  Synthetic oligonucleotide; TTC chr2 60508933 60508954 60508938 60508933 -
aaaagacaccttaagtagcagt

SEQ ID NO: 218066 - DNA, 22 bp, Artificial Sequence
  Synthetic oligonucleotide; CTT chr2 60508921 60508942 60508926 60508921 -
aagtagcagtgggtagggcgta

SEQ ID NO: 218067 - DNA, 22 bp, Artificial Sequence
  Synthetic oligonucleotide; TTA chr2 60508920 60508941 60508925 60508920 -
agtagcagtgggtagggcgtaa

SEQ ID NO: 218068 - DNA, 22 bp, Artificial Sequence
  Synthetic oligonucleotide; TTT chr2 60508894 60508915 60508899 60508894 -
aacatccctcaaggtaggcctt

SEQ ID NO: 218069 - DNA, 22 bp, Artificial Sequence
  Synthetic oligonucleotide; TTA chr2 60508893 60508914 60508898 60508893 -
acatccctcaaggtaggcctta

SEQ ID NO: 218070 - DNA, 22 bp, Artificial Sequence
  Synthetic oligonucleotide; CTC chr2 60508884 60508905 60508889 60508884 -
aaggtaggccttaggtttccct

SEQ ID NO: 218071 - DNA, 22 bp, Artificial Sequence
  Synthetic oligonucleotide; CTT chr2 60508872 60508893 60508877 60508872 -
aggtttccctctgtcccctcta

SEQ ID NO: 218072 - DNA, 22 bp, Artificial Sequence
  Synthetic oligonucleotide; TTA chr2 60508871 60508892 60508876 60508871 -
ggtttccctctgtcccctctat

SEQ ID NO: 218073 - DNA, 22 bp, Artificial Sequence
  Synthetic oligonucleotide; TTT chr2 60508866 60508887 60508871 60508866 -
ccctctgtcccctctatggtgc

SEQ ID NO: 218074 - DNA, 22 bp, Artificial Sequence
  Synthetic oligonucleotide; TTC chr2 60508865 60508886 60508870 60508865 -
cctctgtcccctctatggtgct

SEQ ID NO: 218075 - DNA, 22 bp, Artificial Sequence
  Synthetic oligonucleotide; CTC chr2 60508861 60508882 60508866 60508861 -
tgtcccctctatggtgctggct

SEQ ID NO: 218076 - DNA, 22 bp, Artificial Sequence
  Synthetic oligonucleotide; CTG chr2 60508859 60508880 60508864 60508859 -
tcccctctatggtgctggcttt

SEQ ID NO: 218077 - DNA, 22 bp, Artificial Sequence
  Synthetic oligonucleotide; CTC chr2 60508852 60508873 60508857 60508852 -
tatggtgctggctttgccacat

SEQ ID NO: 218078 - DNA, 22 bp, Artificial Sequence
  Synthetic oligonucleotide; CTA chr2 60508850 60508871 60508855 60508850 -
tggtgctggctttgccacatgt

SEQ ID NO: 218079 - DNA, 22 bp, Artificial Sequence
  Synthetic oligonucleotide; CTG chr2 60508842 60508863 60508847 60508842 -
gctttgccacatgtagaacaaa

SEQ ID NO: 218080 - DNA, 22 bp, Artificial Sequence
  Synthetic oligonucleotide; CTT chr2 60508838 60508859 60508843 60508838 -
tgccacatgtagaacaaactct

SEQ ID NO: 218081 - DNA, 22 bp, Artificial Sequence
  Synthetic oligonucleotide; TTT chr2 60508837 60508858 60508842 60508837 -
gccacatgtagaacaaactctt

SEQ ID NO: 218082 - DNA, 22 bp, Artificial Sequence
  Synthetic oligonucleotide; TTG chr2 60508836 60508857 60508841 60508836 -
ccacatgtagaacaaactcttc

SEQ ID NO: 218083 - DNA, 22 bp, Artificial Sequence
  Synthetic oligonucleotide; CTC chr2 60508817 60508838 60508822 60508817 -
ttctggaatcataggtaaccca

SEQ ID NO: 218084 - DNA, 22 bp, Artificial Sequence
  Synthetic oligonucleotide; CTT chr2 60508815 60508836 60508820 60508815 -
ctggaatcataggtaacccaag

SEQ ID NO: 218085 - DNA, 22 bp, Artificial Sequence
  Synthetic oligonucleotide; TTC chr2 60508814 60508835 60508819 60508814 -
tggaatcataggtaacccaagg

SEQ ID NO: 218086 - DNA, 22 bp, Artificial Sequence
  Synthetic oligonucleotide; CTG chr2 60508812 60508833 60508817 60508812 -
gaatcataggtaacccaagggg

SEQ ID NO: 218087 - DNA, 22 bp, Artificial Sequence
  Synthetic oligonucleotide; CTC chr2 60508784 60508805 60508789 60508784 -
agagaagagtccaggctgccag

SEQ ID NO: 218088 - DNA, 22 bp, Artificial Sequence
  Synthetic oligonucleotide; CTG chr2 60508766 60508787 60508771 60508766 -
ccagtgcaaaggtccagccctg

SEQ ID NO: 218089 - DNA, 22 bp, Artificial Sequence
  Synthetic oligonucleotide; CTG chr2 60508744 60508765 60508749 60508744 -
tcgccaaggagaccctcaggga

SEQ ID NO: 218090 - DNA, 22 bp, Artificial Sequence
  Synthetic oligonucleotide; CTC chr2 60508727 60508748 60508732 60508727 -
agggaaatgcacaggcctccag

SEQ ID NO: 218091 - DNA, 22 bp, Artificial Sequence
  Synthetic oligonucleotide; CTC chr2 60508708 60508729 60508713 60508708 -
cagctattcccacggcccctgt

SEQ ID NO: 218092 - DNA, 22 bp, Artificial Sequence
  Synthetic oligonucleotide; CTA chr2 60508702 60508723 60508707 60508702 -
ttcccacggcccctgtagctga

SEQ ID NO: 218093 - DNA, 22 bp, Artificial Sequence
  Synthetic oligonucleotide; TTC chr2 60508699 60508720 60508704 60508699 -
ccacggcccctgtagctgagcg

SEQ ID NO: 218094 - DNA, 22 bp, Artificial Sequence
  Synthetic oligonucleotide; CTG chr2 60508687 60508708 60508692 60508687 -
tagctgagcgccagcttcttcc

SEQ ID NO: 218095 - DNA, 22 bp, Artificial Sequence
  Synthetic oligonucleotide; CTG chr2 60508681 60508702 60508686 60508681 -
agcgccagcttcttcctgggcc

SEQ ID NO: 218096 - DNA, 22 bp, Artificial Sequence
  Synthetic oligonucleotide; CTT chr2 60508670 60508691 60508675 60508670 -
cttcctgggccaagctgaggct

SEQ ID NO: 218097 - DNA, 22 bp, Artificial Sequence
  Synthetic oligonucleotide; TTC chr2 60508669 60508690 60508674 60508669 -
ttcctgggccaagctgaggctg

SEQ ID NO: 218098 - DNA, 22 bp, Artificial Sequence
  Synthetic oligonucleotide; CTT chr2 60508667 60508688 60508672 60508667 -
cctgggccaagctgaggctgtt

SEQ ID NO: 218099 - DNA, 22 bp, Artificial Sequence
  Synthetic oligonucleotide; TTC chr2 60508666 60508687 60508671 60508666 -
ctgggccaagctgaggctgttt

SEQ ID NO: 218100 - DNA, 22 bp, Artificial Sequence
  Synthetic oligonucleotide; CTG chr2 60508663 60508684 60508668 60508663 -
ggccaagctgaggctgtttcct

SEQ ID NO: 218101 - DNA, 22 bp, Artificial Sequence
  Synthetic oligonucleotide; CTG chr2 60508653 60508674 60508658 60508653 -
aggctgtttcctgccgtgtcca

SEQ ID NO: 218102 - DNA, 22 bp, Artificial Sequence
  Synthetic oligonucleotide; CTG chr2 60508647 60508668 60508652 60508647 -
tttcctgccgtgtccattctcc

SEQ ID NO: 218103 - DNA, 22 bp, Artificial Sequence
  Synthetic oligonucleotide; TTT chr2 60508644 60508665 60508649 60508644 -
cctgccgtgtccattctcctag

SEQ ID NO: 218104 - DNA, 22 bp, Artificial Sequence
  Synthetic oligonucleotide; TTC chr2 60508643 60508664 60508648 60508643 -
ctgccgtgtccattctcctagc

SEQ ID NO: 218105 - DNA, 22 bp, Artificial Sequence
  Synthetic oligonucleotide; CTG chr2 60508640 60508661 60508645 60508640 -
ccgtgtccattctcctagcaac

SEQ ID NO: 218106 - DNA, 22 bp, Artificial Sequence
  Synthetic oligonucleotide; TTC chr2 60508628 60508649 60508633 60508628 -
tcctagcaacgcttctctttgg

SEQ ID NO: 218107 - DNA, 22 bp, Artificial Sequence
  Synthetic oligonucleotide; CTC chr2 60508626 60508647 60508631 60508626 -
ctagcaacgcttctctttggcc

SEQ ID NO: 218108 - DNA, 22 bp, Artificial Sequence
  Synthetic oligonucleotide; CTA chr2 60508623 60508644 60508628 60508623 -
gcaacgcttctctttggccagt

SEQ ID NO: 218109 - DNA, 22 bp, Artificial Sequence
  Synthetic oligonucleotide; CTT chr2 60508614 60508635 60508619 60508614 -
ctctttggccagtttgccatag

SEQ ID NO: 218110 - DNA, 22 bp, Artificial Sequence
  Synthetic oligonucleotide; TTC chr2 60508613 60508634 60508618 60508613 -
tctttggccagtttgccatagt

SEQ ID NO: 218111 - DNA, 22 bp, Artificial Sequence
  Synthetic oligonucleotide; CTC chr2 60508611 60508632 60508616 60508611 -
tttggccagtttgccatagtac

SEQ ID NO: 218112 - DNA, 22 bp, Artificial Sequence
  Synthetic oligonucleotide; CTT chr2 60508609 60508630 60508614 60508609 -
tggccagtttgccatagtacct

SEQ ID NO: 218113 - DNA, 22 bp, Artificial Sequence
  Synthetic oligonucleotide; TTT chr2 60508608 60508629 60508613 60508608 -
ggccagtttgccatagtacctg

SEQ ID NO: 218114 - DNA, 22 bp, Artificial Sequence
  Synthetic oligonucleotide; TTG chr2 60508607 60508628 60508612 60508607 -
gccagtttgccatagtacctga

SEQ ID NO: 218115 - DNA, 22 bp, Artificial Sequence
  Synthetic oligonucleotide; TTT chr2 60508599 60508620 60508604 60508599 -
gccatagtacctgaggtaagtt

SEQ ID NO: 218116 - DNA, 22 bp, Artificial Sequence
  Synthetic oligonucleotide; TTG chr2 60508598 60508619 60508603 60508598 -
ccatagtacctgaggtaagttt

SEQ ID NO: 218117 - DNA, 22 bp, Artificial Sequence
  Synthetic oligonucleotide; CTG chr2 60508586 60508607 60508591 60508586 -
aggtaagttttgtcctttgcct

SEQ ID NO: 218118 - DNA, 22 bp, Artificial Sequence
  Synthetic oligonucleotide; TTT chr2 60508576 60508597 60508581 60508576 -
tgtcctttgcctgccaaatgct

SEQ ID NO: 218119 - DNA, 22 bp, Artificial Sequence
  Synthetic oligonucleotide; TTT chr2 60508575 60508596 60508580 60508575 -
gtcctttgcctgccaaatgctt

SEQ ID NO: 218120 - DNA, 22 bp, Artificial Sequence
  Synthetic oligonucleotide; TTG chr2 60508574 60508595 60508579 60508574 -
tcctttgcctgccaaatgcttt

SEQ ID NO: 218121 - DNA, 22 bp, Artificial Sequence
  Synthetic oligonucleotide; CTT chr2 60508569 60508590 60508574 60508569 -
tgcctgccaaatgctttacatc

SEQ ID NO: 218122 - DNA, 22 bp, Artificial Sequence
  Synthetic oligonucleotide; TTT chr2 60508568 60508589 60508573 60508568 -
gcctgccaaatgctttacatcc

SEQ ID NO: 218123 - DNA, 22 bp, Artificial Sequence
  Synthetic oligonucleotide; TTG chr2 60508567 60508588 60508572 60508567 -
cctgccaaatgctttacatccc

SEQ ID NO: 218124 - DNA, 22 bp, Artificial Sequence
  Synthetic oligonucleotide; CTG chr2 60508563 60508584 60508568 60508563 -
ccaaatgctttacatcccggag

SEQ ID NO: 218125 - DNA, 22 bp, Artificial Sequence
  Synthetic oligonucleotide; CTT chr2 60508553 60508574 60508558 60508553 -
tacatcccggaggaaagcaaag

SEQ ID NO: 218126 - DNA, 22 bp, Artificial Sequence
  Synthetic oligonucleotide; TTT chr2 60508552 60508573 60508557 60508552 -
acatcccggaggaaagcaaagt

SEQ ID NO: 218127 - DNA, 22 bp, Artificial Sequence
  Synthetic oligonucleotide; TTA chr2 60508551 60508572 60508556 60508551 -
catcccggaggaaagcaaagtc

SEQ ID NO: 218128 - DNA, 22 bp, Artificial Sequence
  Synthetic oligonucleotide; CTC chr2 60508526 60508547 60508531 60508526 -
ttcagaacaggaaaagtccagt

SEQ ID NO: 218129 - DNA, 22 bp, Artificial Sequence
  Synthetic oligonucleotide; CTT chr2 60508524 60508545 60508529 60508524 -
cagaacaggaaaagtccagtgc

SEQ ID NO: 218130 - DNA, 22 bp, Artificial Sequence
  Synthetic oligonucleotide; TTC chr2 60508523 60508544 60508528 60508523 -
agaacaggaaaagtccagtgca

SEQ ID NO: 218131 - DNA, 22 bp, Artificial Sequence
  Synthetic oligonucleotide; TTC chr2 60508497 60508518 60508502 60508497 -
cacactgtgctattccagaacc

SEQ ID NO: 218132 - DNA, 22 bp, Artificial Sequence
  Synthetic oligonucleotide; CTG chr2 60508490 60508511 60508495 60508490 -
tgctattccagaacctcccagt

SEQ ID NO: 218133 - DNA, 22 bp, Artificial Sequence
  Synthetic oligonucleotide; CTA chr2 60508485 60508506 60508490 60508485 -
ttccagaacctcccagttgcat

SEQ ID NO: 218134 - DNA, 22 bp, Artificial Sequence
  Synthetic oligonucleotide; TTC chr2 60508482 60508503 60508487 60508482 -
cagaacctcccagttgcattcc

SEQ ID NO: 218135 - DNA, 22 bp, Artificial Sequence
  Synthetic oligonucleotide; CTC chr2 60508473 60508494 60508478 60508473 -
ccagttgcattcctttgccaac

SEQ ID NO: 218136 - DNA, 22 bp, Artificial Sequence
  Synthetic oligonucleotide; TTG chr2 60508466 60508487 60508471 60508466 -
cattcctttgccaactaggtaa

SEQ ID NO: 218137 - DNA, 22 bp, Artificial Sequence
  Synthetic oligonucleotide; TTC chr2 60508461 60508482 60508466 60508461 -
ctttgccaactaggtaatgtgc

SEQ ID NO: 218138 - DNA, 22 bp, Artificial Sequence
  Synthetic oligonucleotide; CTT chr2 60508458 60508479 60508463 60508458 -
tgccaactaggtaatgtgctag

SEQ ID NO: 218139 - DNA, 22 bp, Artificial Sequence
  Synthetic oligonucleotide; TTT chr2 60508457 60508478 60508462 60508457 -
gccaactaggtaatgtgctagg

SEQ ID NO: 218140 - DNA, 22 bp, Artificial Sequence
  Synthetic oligonucleotide; TTG chr2 60508456 60508477 60508461 60508456 -
ccaactaggtaatgtgctaggg

SEQ ID NO: 218141 - DNA, 22 bp, Artificial Sequence
  Synthetic oligonucleotide; CTA chr2 60508449 60508470 60508454 60508449 -
ggtaatgtgctagggatatttg

SEQ ID NO: 218142 - DNA, 22 bp, Artificial Sequence
  Synthetic oligonucleotide; CTA chr2 60508437 60508458 60508442 60508437 -
gggatatttgtctcgcagcaac

SEQ ID NO: 218143 - DNA, 22 bp, Artificial Sequence
  Synthetic oligonucleotide; TTT chr2 60508428 60508449 60508433 60508428 -
gtctcgcagcaactggcaaccc

SEQ ID NO: 218144 - DNA, 22 bp, Artificial Sequence
  Synthetic oligonucleotide; TTG chr2 60508427 60508448 60508432 60508427 -
tctcgcagcaactggcaacccc

SEQ ID NO: 218145 - DNA, 22 bp, Artificial Sequence
  Synthetic oligonucleotide; CTC chr2 60508423 60508444 60508428 60508423 -
gcagcaactggcaaccccctgt

SEQ ID NO: 218146 - DNA, 22 bp, Artificial Sequence
  Synthetic oligonucleotide; CTG chr2 60508413 60508434 60508418 60508413 -
gcaaccccctgtttgggtaaaa

SEQ ID NO: 218147 - DNA, 22 bp, Artificial Sequence
  Synthetic oligonucleotide; CTG chr2 60508402 60508423 60508407 60508402 -
tttgggtaaaagtcagactcag

SEQ ID NO: 218148 - DNA, 22 bp, Artificial Sequence
  Synthetic oligonucleotide; TTT chr2 60508399 60508420 60508404 60508399 -
gggtaaaagtcagactcaggga

SEQ ID NO: 218149 - DNA, 22 bp, Artificial Sequence
  Synthetic oligonucleotide; TTG chr2 60508398 60508419 60508403 60508398 -
ggtaaaagtcagactcagggac

SEQ ID NO: 218150 - DNA, 22 bp, Artificial Sequence
  Synthetic oligonucleotide; CTC chr2 60508382 60508403 60508387 60508382 -
agggacccggctgcagtgcttg

SEQ ID NO: 218151 - DNA, 22 bp, Artificial Sequence
  Synthetic oligonucleotide; CTG chr2 60508369 60508390 60508374 60508369 -
cagtgcttgctcctgtggcccc

SEQ ID NO: 218152 - DNA, 22 bp, Artificial Sequence
  Synthetic oligonucleotide; CTT chr2 60508361 60508382 60508366 60508361 -
gctcctgtggcccctgcaggga

SEQ ID NO: 218153 - DNA, 22 bp, Artificial Sequence
  Synthetic oligonucleotide; TTG chr2 60508360 60508381 60508365 60508360 -
ctcctgtggcccctgcagggag

SEQ ID NO: 218154 - DNA, 22 bp, Artificial Sequence
  Synthetic oligonucleotide; CTC chr2 60508357 60508378 60508362 60508357 -
ctgtggcccctgcagggagtgt

SEQ ID NO: 218155 - DNA, 22 bp, Artificial Sequence
  Synthetic oligonucleotide; CTG chr2 60508354 60508375 60508359 60508354 -
tggcccctgcagggagtgtggc

SEQ ID NO: 218156 - DNA, 22 bp, Artificial Sequence
  Synthetic oligonucleotide; CTG chr2 60508345 60508366 60508350 60508345 -
cagggagtgtggcctggggtgt

SEQ ID NO: 218157 - DNA, 22 bp, Artificial Sequence
  Synthetic oligonucleotide; CTG chr2 60508329 60508350 60508334 60508329 -
gggtgtaattctgcacacccag

SEQ ID NO: 218158 - DNA, 22 bp, Artificial Sequence
  Synthetic oligonucleotide; TTC chr2 60508318 60508339 60508323 60508318 -
tgcacacccaggaagcttctct

SEQ ID NO: 218159 - DNA, 22 bp, Artificial Sequence
  Synthetic oligonucleotide; CTG chr2 60508316 60508337 60508321 60508316 -
cacacccaggaagcttctctgt

SEQ ID NO: 218160 - DNA, 22 bp, Artificial Sequence
  Synthetic oligonucleotide; CTT chr2 60508300 60508321 60508305 60508300 -
ctctgtctcctctttcacatca

SEQ ID NO: 218161 - DNA, 22 bp, Artificial Sequence
  Synthetic oligonucleotide; TTC chr2 60508299 60508320 60508304 60508299 -
tctgtctcctctttcacatcag

SEQ ID NO: 218162 - DNA, 22 bp, Artificial Sequence
  Synthetic oligonucleotide; CTC chr2 60508297 60508318 60508302 60508297 -
tgtctcctctttcacatcaggc

SEQ ID NO: 218163 - DNA, 22 bp, Artificial Sequence
  Synthetic oligonucleotide; CTG chr2 60508295 60508316 60508300 60508295 -
tctcctctttcacatcaggcct

SEQ ID NO: 218164 - DNA, 22 bp, Artificial Sequence
  Synthetic oligonucleotide; CTC chr2 60508291 60508312 60508296 60508291 -
ctctttcacatcaggccttccc

SEQ ID NO: 218165 - DNA, 22 bp, Artificial Sequence
  Synthetic oligonucleotide; CTC chr2 60508288 60508309 60508293 60508288 -
tttcacatcaggccttccctgt

SEQ ID NO: 218166 - DNA, 22 bp, Artificial Sequence
  Synthetic oligonucleotide; CTT chr2 60508286 60508307 60508291 60508286 -
tcacatcaggccttccctgtgt

SEQ ID NO: 218167 - DNA, 22 bp, Artificial Sequence
  Synthetic oligonucleotide; TTT chr2 60508285 60508306 60508290 60508285 -
cacatcaggccttccctgtgtc

SEQ ID NO: 218168 - DNA, 22 bp, Artificial Sequence
  Synthetic oligonucleotide; TTC chr2 60508284 60508305 60508289 60508284 -
acatcaggccttccctgtgtcc

SEQ ID NO: 218169 - DNA, 22 bp, Artificial Sequence
  Synthetic oligonucleotide; CTT chr2 60508272 60508293 60508277 60508272 -
ccctgtgtcctgaaccaagtgt

SEQ ID NO: 218170 - DNA, 22 bp, Artificial Sequence
  Synthetic oligonucleotide; TTC chr2 60508271 60508292 60508276 60508271 -
cctgtgtcctgaaccaagtgtg

SEQ ID NO: 218171 - DNA, 22 bp, Artificial Sequence
  Synthetic oligonucleotide; CTG chr2 60508267 60508288 60508272 60508267 -
tgtcctgaaccaagtgtggatg

SEQ ID NO: 218172 - DNA, 22 bp, Artificial Sequence
  Synthetic oligonucleotide; CTG chr2 60508260 60508281 60508265 60508260 -
aaccaagtgtggatgagtttga

SEQ ID NO: 218173 - DNA, 22 bp, Artificial Sequence
  Synthetic oligonucleotide; TTT chr2 60508240 60508261 60508245 60508240 -
gagcttcctcctagtttttatt

SEQ ID NO: 218174 - DNA, 22 bp, Artificial Sequence
  Synthetic oligonucleotide; TTG chr2 60508239 60508260 60508244 60508239 -
agcttcctcctagtttttattt

SEQ ID NO: 218175 - DNA, 22 bp, Artificial Sequence
  Synthetic oligonucleotide; CTT chr2 60508234 60508255 60508239 60508234 -
cctcctagtttttatttgtgta

SEQ ID NO: 218176 - DNA, 22 bp, Artificial Sequence
  Synthetic oligonucleotide; TTC chr2 60508233 60508254 60508238 60508233 -
ctcctagtttttatttgtgtaa

SEQ ID NO: 218177 - DNA, 22 bp, Artificial Sequence
  Synthetic oligonucleotide; CTC chr2 60508230 60508251 60508235 60508230 -
ctagtttttatttgtgtaattt

SEQ ID NO: 218178 - DNA, 22 bp, Artificial Sequence
  Synthetic oligonucleotide; CTA chr2 60508227 60508248 60508232 60508227 -
gtttttatttgtgtaatttgtt

SEQ ID NO: 218179 - DNA, 22 bp, Artificial Sequence
  Synthetic oligonucleotide; TTT chr2 60508223 60508244 60508228 60508223 -
ttatttgtgtaatttgttgttg

SEQ ID NO: 218180 - DNA, 22 bp, Artificial Sequence
  Synthetic oligonucleotide; TTT chr2 60508222 60508243 60508227 60508222 -
tatttgtgtaatttgttgttgt

SEQ ID NO: 218181 - DNA, 22 bp, Artificial Sequence
  Synthetic oligonucleotide; TTT chr2 60508221 60508242 60508226 60508221 -
atttgtgtaatttgttgttgtt

SEQ ID NO: 218182 - DNA, 22 bp, Artificial Sequence
  Synthetic oligonucleotide; TTA chr2 60508220 60508241 60508225 60508220 -
tttgtgtaatttgttgttgttg

SEQ ID NO: 218183 - DNA, 22 bp, Artificial Sequence
  Synthetic oligonucleotide; TTT chr2 60508217 60508238 60508222 60508217 -
gtgtaatttgttgttgttgttg

SEQ ID NO: 218184 - DNA, 22 bp, Artificial Sequence
  Synthetic oligonucleotide; TTG chr2 60508216 60508237 60508221 60508216 -
tgtaatttgttgttgttgttgt

SEQ ID NO: 218185 - DNA, 22 bp, Artificial Sequence
  Synthetic oligonucleotide; TTT chr2 60508208 60508229 60508213 60508208 -
gttgttgttgttgttgtttggg

SEQ ID NO: 218186 - DNA, 22 bp, Artificial Sequence
  Synthetic oligonucleotide; TTG chr2 60508207 60508228 60508212 60508207 -
ttgttgttgttgttgtttgggg

SEQ ID NO: 218187 - DNA, 22 bp, Artificial Sequence
  Synthetic oligonucleotide; TTG chr2 60508204 60508225 60508209 60508204 -
ttgttgttgttgtttgggggtg

SEQ ID NO: 218188 - DNA, 22 bp, Artificial Sequence
  Synthetic oligonucleotide; TTG chr2 60508201 60508222 60508206 60508201 -
ttgttgttgtttgggggtgggg

SEQ ID NO: 218189 - DNA, 22 bp, Artificial Sequence
  Synthetic oligonucleotide; TTG chr2 60508198 60508219 60508203 60508198 -
ttgttgtttgggggtgggggta

SEQ ID NO: 218190 - DNA, 22 bp, Artificial Sequence
  Synthetic oligonucleotide; TTG chr2 60508195 60508216 60508200 60508195 -
ttgtttgggggtgggggtagac

SEQ ID NO: 218191 - DNA, 22 bp, Artificial Sequence
  Synthetic oligonucleotide; TTG chr2 60508192 60508213 60508197 60508192 -
tttgggggtgggggtagacagt

SEQ ID NO: 218192 - DNA, 22 bp, Artificial Sequence
  Synthetic oligonucleotide; TTT chr2 60508189 60508210 60508194 60508189 -
gggggtgggggtagacagtgct

SEQ ID NO: 218193 - DNA, 22 bp, Artificial Sequence
  Synthetic oligonucleotide; TTG chr2 60508188 60508209 60508193 60508188 -
ggggtgggggtagacagtgctg

SEQ ID NO: 218194 - DNA, 22 bp, Artificial Sequence
  Synthetic oligonucleotide; CTG chr2 60508166 60508187 60508171 60508166 -
ggcctgtcagaattttaggttg

SEQ ID NO: 218195 - DNA, 22 bp, Artificial Sequence
  Synthetic oligonucleotide; CTG chr2 60508160 60508181 60508165 60508160 -
tcagaattttaggttggttctt

SEQ ID NO: 218196 - DNA, 22 bp, Artificial Sequence
  Synthetic oligonucleotide; TTT chr2 60508151 60508172 60508156 60508151 -
taggttggttctttgagatgaa

SEQ ID NO: 218197 - DNA, 22 bp, Artificial Sequence
  Synthetic oligonucleotide; TTT chr2 60508150 60508171 60508155 60508150 -
aggttggttctttgagatgaat

SEQ ID NO: 218198 - DNA, 22 bp, Artificial Sequence
  Synthetic oligonucleotide; TTA chr2 60508149 60508170 60508154 60508149 -
ggttggttctttgagatgaata

SEQ ID NO: 218199 - DNA, 22 bp, Artificial Sequence
  Synthetic oligonucleotide; TTG chr2 60508144 60508165 60508149 60508144 -
gttctttgagatgaataactac

SEQ ID NO: 218200 - DNA, 22 bp, Artificial Sequence
  Synthetic oligonucleotide; TTC chr2 60508140 60508161 60508145 60508140 -
tttgagatgaataactacttag

SEQ ID NO: 218201 - DNA, 22 bp, Artificial Sequence
  Synthetic oligonucleotide; CTT chr2 60508138 60508159 60508143 60508138 -
tgagatgaataactacttagct

SEQ ID NO: 218202 - DNA, 22 bp, Artificial Sequence
  Synthetic oligonucleotide; TTT chr2 60508137 60508158 60508142 60508137 -
gagatgaataactacttagctg

SEQ ID NO: 218203 - DNA, 22 bp, Artificial Sequence
  Synthetic oligonucleotide; TTG chr2 60508136 60508157 60508141 60508136 -
agatgaataactacttagctgt

SEQ ID NO: 218204 - DNA, 22 bp, Artificial Sequence
  Synthetic oligonucleotide; CTA chr2 60508123 60508144 60508128 60508123 -
cttagctgttgctcaactactt

SEQ ID NO: 218205 - DNA, 22 bp, Artificial Sequence
  Synthetic oligonucleotide; CTT chr2 60508120 60508141 60508125 60508120 -
agctgttgctcaactacttttg

SEQ ID NO: 218206 - DNA, 22 bp, Artificial Sequence
  Synthetic oligonucleotide; TTA chr2 60508119 60508140 60508124 60508119 -
gctgttgctcaactacttttgt

SEQ ID NO: 218207 - DNA, 22 bp, Artificial Sequence
  Synthetic oligonucleotide; CTG chr2 60508115 60508136 60508120 60508115 -
ttgctcaactacttttgtttgt

SEQ ID NO: 218208 - DNA, 22 bp, Artificial Sequence
  Synthetic oligonucleotide; TTG chr2 60508112 60508133 60508117 60508112 -
ctcaactacttttgtttgtgaa

SEQ ID NO: 218209 - DNA, 22 bp, Artificial Sequence
  Synthetic oligonucleotide; CTC chr2 60508109 60508130 60508114 60508109 -
aactacttttgtttgtgaaaga

SEQ ID NO: 218210 - DNA, 22 bp, Artificial Sequence
  Synthetic oligonucleotide; CTA chr2 60508104 60508125 60508109 60508104 -
cttttgtttgtgaaagaaaggg

SEQ ID NO: 218211 - DNA, 22 bp, Artificial Sequence
  Synthetic oligonucleotide; CTT chr2 60508101 60508122 60508106 60508101 -
ttgtttgtgaaagaaagggcag

SEQ ID NO: 218212 - DNA, 22 bp, Artificial Sequence
  Synthetic oligonucleotide; TTT chr2 60508100 60508121 60508105 60508100 -
tgtttgtgaaagaaagggcagt

SEQ ID NO: 218213 - DNA, 22 bp, Artificial Sequence
  Synthetic oligonucleotide; TTT chr2 60508099 60508120 60508104 60508099 -
gtttgtgaaagaaagggcagta

SEQ ID NO: 218214 - DNA, 22 bp, Artificial Sequence
  Synthetic oligonucleotide; TTG chr2 60508098 60508119 60508103 60508098 -
tttgtgaaagaaagggcagtaa

SEQ ID NO: 218215 - DNA, 22 bp, Artificial Sequence
  Synthetic oligonucleotide; TTT chr2 60508095 60508116 60508100 60508095 -
gtgaaagaaagggcagtaagca

SEQ ID NO: 218216 - DNA, 22 bp, Artificial Sequence
  Synthetic oligonucleotide; TTG chr2 60508094 60508115 60508099 60508094 -
tgaaagaaagggcagtaagcac

SEQ ID NO: 218217 - DNA, 22 bp, Artificial Sequence
  Synthetic oligonucleotide; TTT chr2 60508054 60508075 60508059 60508054 -
caggtttattgtgatttctttt

SEQ ID NO: 218218 - DNA, 22 bp, Artificial Sequence
  Synthetic oligonucleotide; TTC chr2 60508053 60508074 60508058 60508053 -
aggtttattgtgatttcttttt

SEQ ID NO: 218219 - DNA, 22 bp, Artificial Sequence
  Synthetic oligonucleotide; TTT chr2 60508047 60508068 60508052 60508047 -
attgtgatttcttttttgtgtt

SEQ ID NO: 218220 - DNA, 22 bp, Artificial Sequence
  Synthetic oligonucleotide; TTA chr2 60508046 60508067 60508051 60508046 -
ttgtgatttcttttttgtgttt

SEQ ID NO: 218221 - DNA, 22 bp, Artificial Sequence
  Synthetic oligonucleotide; TTG chr2 60508043 60508064 60508048 60508043 -
tgatttcttttttgtgtttgca

SEQ ID NO: 218222 - DNA, 22 bp, Artificial Sequence
  Synthetic oligonucleotide; TTT chr2 60508037 60508058 60508042 60508037 -
cttttttgtgtttgcatctgtc

SEQ ID NO: 218223 - DNA, 22 bp, Artificial Sequence
  Synthetic oligonucleotide; TTC chr2 60508036 60508057 60508041 60508036 -
ttttttgtgtttgcatctgtcg

SEQ ID NO: 218224 - DNA, 22 bp, Artificial Sequence
  Synthetic oligonucleotide; CTT chr2 60508034 60508055 60508039 60508034 -
ttttgtgtttgcatctgtcgtg

SEQ ID NO: 218225 - DNA, 22 bp, Artificial Sequence
  Synthetic oligonucleotide; TTT chr2 60508033 60508054 60508038 60508033 -
tttgtgtttgcatctgtcgtgc

SEQ ID NO: 218226 - DNA, 22 bp, Artificial Sequence
  Synthetic oligonucleotide; TTT chr2 60508032 60508053 60508037 60508032 -
ttgtgtttgcatctgtcgtgct

SEQ ID NO: 218227 - DNA, 22 bp, Artificial Sequence
  Synthetic oligonucleotide; TTT chr2 60508031 60508052 60508036 60508031 -
tgtgtttgcatctgtcgtgctc

SEQ ID NO: 218228 - DNA, 22 bp, Artificial Sequence
  Synthetic oligonucleotide; TTT chr2 60508030 60508051 60508035 60508030 -
gtgtttgcatctgtcgtgctca

SEQ ID NO: 218229 - DNA, 22 bp, Artificial Sequence
  Synthetic oligonucleotide; TTG chr2 60508029 60508050 60508034 60508029 -
tgtttgcatctgtcgtgctcag

SEQ ID NO: 218230 - DNA, 22 bp, Artificial Sequence
  Synthetic oligonucleotide; TTT chr2 60508024 60508045 60508029 60508024 -
gcatctgtcgtgctcagttagg

SEQ ID NO: 218231 - DNA, 22 bp, Artificial Sequence
  Synthetic oligonucleotide; TTG chr2 60508023 60508044 60508028 60508023 -
catctgtcgtgctcagttaggg

SEQ ID NO: 218232 - DNA, 22 bp, Artificial Sequence
  Synthetic oligonucleotide; CTG chr2 60508017 60508038 60508022 60508017 -
tcgtgctcagttagggcattat

SEQ ID NO: 218233 - DNA, 22 bp, Artificial Sequence
  Synthetic oligonucleotide; CTC chr2 60508009 60508030 60508014 60508009 -
agttagggcattatccgtaacc

SEQ ID NO: 218234 - DNA, 22 bp, Artificial Sequence
  Synthetic oligonucleotide; TTA chr2 60508004 60508025 60508009 60508004 -
gggcattatccgtaaccccata

SEQ ID NO: 218235 - DNA, 22 bp, Artificial Sequence
  Synthetic oligonucleotide; TTA chr2 60507996 60508017 60508001 60507996 -
tccgtaaccccataggaaccaa

SEQ ID NO: 218236 - DNA, 22 bp, Artificial Sequence
  Synthetic oligonucleotide; TTT chr2 60507954 60507975 60507959 60507954 -
taaagctttagaaatctgcgtg

SEQ ID NO: 218237 - DNA, 22 bp, Artificial Sequence
  Synthetic oligonucleotide; TTT chr2 60507953 60507974 60507958 60507953 -
aaagctttagaaatctgcgtgt

SEQ ID NO: 218238 - DNA, 22 bp, Artificial Sequence
  Synthetic oligonucleotide; TTA chr2 60507952 60507973 60507957 60507952 -
aagctttagaaatctgcgtgtg

SEQ ID NO: 218239 - DNA, 22 bp, Artificial Sequence
  Synthetic oligonucleotide; CTT chr2 60507946 60507967 60507951 60507946 -
tagaaatctgcgtgtgtaatat

SEQ ID NO: 218240 - DNA, 22 bp, Artificial Sequence
  Synthetic oligonucleotide; TTT chr2 60507945 60507966 60507950 60507945 -
agaaatctgcgtgtgtaatatg

SEQ ID NO: 218241 - DNA, 22 bp, Artificial Sequence
  Synthetic oligonucleotide; TTA chr2 60507944 60507965 60507949 60507944 -
gaaatctgcgtgtgtaatatgt

SEQ ID NO: 218242 - DNA, 22 bp, Artificial Sequence
  Synthetic oligonucleotide; CTG chr2 60507936 60507957 60507941 60507936 -
cgtgtgtaatatgtcttttgtg

SEQ ID NO: 218243 - DNA, 22 bp, Artificial Sequence
  Synthetic oligonucleotide; CTT chr2 60507919 60507940 60507924 60507919 -
ttgtgaatttttttttgttctt

SEQ ID NO: 218244 - DNA, 22 bp, Artificial Sequence
  Synthetic oligonucleotide; TTT chr2 60507918 60507939 60507923 60507918 -
tgtgaatttttttttgttcttt

SEQ ID NO: 218245 - DNA, 22 bp, Artificial Sequence
  Synthetic oligonucleotide; TTT chr2 60507917 60507938 60507922 60507917 -
gtgaatttttttttgttctttt

SEQ ID NO: 218246 - DNA, 22 bp, Artificial Sequence
  Synthetic oligonucleotide; TTG chr2 60507916 60507937 60507921 60507916 -
tgaatttttttttgttcttttg

SEQ ID NO: 218247 - DNA, 22 bp, Artificial Sequence
  Synthetic oligonucleotide; TTT chr2 60507909 60507930 60507914 60507909 -
ttttttgttcttttgctttaga

SEQ ID NO: 218248 - DNA, 22 bp, Artificial Sequence
  Synthetic oligonucleotide; TTT chr2 60507908 60507929 60507913 60507908 -
tttttgttcttttgctttagaa

SEQ ID NO: 218249 - DNA, 22 bp, Artificial Sequence
  Synthetic oligonucleotide; TTT chr2 60507907 60507928 60507912 60507907 -
ttttgttcttttgctttagaaa

SEQ ID NO: 218250 - DNA, 22 bp, Artificial Sequence
  Synthetic oligonucleotide; TTT chr2 60507906 60507927 60507911 60507906 -
tttgttcttttgctttagaaac

SEQ ID NO: 218251 - DNA, 22 bp, Artificial Sequence
  Synthetic oligonucleotide; TTT chr2 60507905 60507926 60507910 60507905 -
ttgttcttttgctttagaaact

SEQ ID NO: 218252 - DNA, 22 bp, Artificial Sequence
  Synthetic oligonucleotide; TTT chr2 60507904 60507925 60507909 60507904 -
tgttcttttgctttagaaactg

SEQ ID NO: 218253 - DNA, 22 bp, Artificial Sequence
  Synthetic oligonucleotide; TTT chr2 60507903 60507924 60507908 60507903 -
gttcttttgctttagaaactgt

SEQ ID NO: 218254 - DNA, 22 bp, Artificial Sequence
  Synthetic oligonucleotide; TTG chr2 60507902 60507923 60507907 60507902 -
ttcttttgctttagaaactgta

SEQ ID NO: 218255 - DNA, 22 bp, Artificial Sequence
  Synthetic oligonucleotide; TTC chr2 60507899 60507920 60507904 60507899 -
ttttgctttagaaactgtaata

SEQ ID NO: 218256 - DNA, 22 bp, Artificial Sequence
  Synthetic oligonucleotide; CTT chr2 60507897 60507918 60507902 60507897 -
ttgctttagaaactgtaataat

SEQ ID NO: 218257 - DNA, 22 bp, Artificial Sequence
  Synthetic oligonucleotide; TTT chr2 60507896 60507917 60507901 60507896 -
tgctttagaaactgtaataata

SEQ ID NO: 218258 - DNA, 22 bp, Artificial Sequence
  Synthetic oligonucleotide; TTT chr2 60507895 60507916 60507900 60507895 -
gctttagaaactgtaataataa

SEQ ID NO: 218259 - DNA, 22 bp, Artificial Sequence
  Synthetic oligonucleotide; TTG chr2 60507894 60507915 60507899 60507894 -
ctttagaaactgtaataataat

SEQ ID NO: 218260 - DNA, 22 bp, Artificial Sequence
  Synthetic oligonucleotide; CTT chr2 60507891 60507912 60507896 60507891 -
tagaaactgtaataataatcca

SEQ ID NO: 218261 - DNA, 22 bp, Artificial Sequence
  Synthetic oligonucleotide; TTT chr2 60507890 60507911 60507895 60507890 -
agaaactgtaataataatccat

SEQ ID NO: 218262 - DNA, 22 bp, Artificial Sequence
  Synthetic oligonucleotide; TTA chr2 60507889 60507910 60507894 60507889 -
gaaactgtaataataatccata

SEQ ID NO: 218263 - DNA, 22 bp, Artificial Sequence
  Synthetic oligonucleotide; CTG chr2 60507882 60507903 60507887 60507882 -
taataataatccatagtaatta

SEQ ID NO: 218264 - DNA, 22 bp, Artificial Sequence
  Synthetic oligonucleotide; TTA chr2 60507860 60507881 60507865 60507860 -
tcccatagtatgctgtcctttg

SEQ ID NO: 218265 - DNA, 22 bp, Artificial Sequence
  Synthetic oligonucleotide; CTG chr2 60507845 60507866 60507850 60507845 -
tcctttgttacaggagcattgg

SEQ ID NO: 218266 - DNA, 22 bp, Artificial Sequence
  Synthetic oligonucleotide; CTT chr2 60507840 60507861 60507845 60507840 -
tgttacaggagcattggattac

SEQ ID NO: 218267 - DNA, 22 bp, Artificial Sequence
  Synthetic oligonucleotide; TTT chr2 60507839 60507860 60507844 60507839 -
gttacaggagcattggattact

SEQ ID NO: 218268 - DNA, 22 bp, Artificial Sequence
  Synthetic oligonucleotide; TTG chr2 60507838 60507859 60507843 60507838 -
ttacaggagcattggattactg

SEQ ID NO: 218269 - DNA, 22 bp, Artificial Sequence
  Synthetic oligonucleotide; TTA chr2 60507835 60507856 60507840 60507835 -
caggagcattggattactgtga

SEQ ID NO: 218270 - DNA, 22 bp, Artificial Sequence
  Synthetic oligonucleotide; TTG chr2 60507824 60507845 60507829 60507824 -
gattactgtgaagacgtgtcct

SEQ ID NO: 218271 - DNA, 22 bp, Artificial Sequence
  Synthetic oligonucleotide; TTA chr2 60507819 60507840 60507824 60507819 -
ctgtgaagacgtgtcctgtata

SEQ ID NO: 218272 - DNA, 22 bp, Artificial Sequence
  Synthetic oligonucleotide; CTG chr2 60507816 60507837 60507821 60507816 -
tgaagacgtgtcctgtatacag

SEQ ID NO: 218273 - DNA, 22 bp, Artificial Sequence
  Synthetic oligonucleotide; CTG chr2 60507801 60507822 60507806 60507801 -
tatacagtttcaacagcttgtt

SEQ ID NO: 218274 - DNA, 22 bp, Artificial Sequence
  Synthetic oligonucleotide; TTT chr2 60507791 60507812 60507796 60507791 -
caacagcttgtttttacttctt

SEQ ID NO: 218275 - DNA, 22 bp, Artificial Sequence
  Synthetic oligonucleotide; TTC chr2 60507790 60507811 60507795 60507790 -
aacagcttgtttttacttcttc

SEQ ID NO: 218276 - DNA, 22 bp, Artificial Sequence
  Synthetic oligonucleotide; CTT chr2 60507782 60507803 60507787 60507782 -
gtttttacttcttcccttctcc

SEQ ID NO: 218277 - DNA, 22 bp, Artificial Sequence
  Synthetic oligonucleotide; TTG chr2 60507781 60507802 60507786 60507781 -
tttttacttcttcccttctccc

SEQ ID NO: 218278 - DNA, 22 bp, Artificial Sequence
  Synthetic oligonucleotide; TTT chr2 60507778 60507799 60507783 60507778 -
ttacttcttcccttctccccgc

SEQ ID NO: 218279 - DNA, 22 bp, Artificial Sequence
  Synthetic oligonucleotide; TTT chr2 60507777 60507798 60507782 60507777 -
tacttcttcccttctccccgca

SEQ ID NO: 218280 - DNA, 22 bp, Artificial Sequence
  Synthetic oligonucleotide; TTT chr2 60507776 60507797 60507781 60507776 -
acttcttcccttctccccgcac

SEQ ID NO: 218281 - DNA, 22 bp, Artificial Sequence
  Synthetic oligonucleotide; TTA chr2 60507775 60507796 60507780 60507775 -
cttcttcccttctccccgcacc

SEQ ID NO: 218282 - DNA, 22 bp, Artificial Sequence
  Synthetic oligonucleotide; CTT chr2 60507772 60507793 60507777 60507772 -
cttcccttctccccgcacccgt

SEQ ID NO: 218283 - DNA, 22 bp, Artificial Sequence
  Synthetic oligonucleotide; TTC chr2 60507771 60507792 60507776 60507771 -
ttcccttctccccgcacccgtc

SEQ ID NO: 218284 - DNA, 22 bp, Artificial Sequence
  Synthetic oligonucleotide; CTT chr2 60507769 60507790 60507774 60507769 -
cccttctccccgcacccgtcgc

SEQ ID NO: 218285 - DNA, 22 bp, Artificial Sequence
  Synthetic oligonucleotide; TTC chr2 60507768 60507789 60507773 60507768 -
ccttctccccgcacccgtcgcc

SEQ ID NO: 218286 - DNA, 22 bp, Artificial Sequence
  Synthetic oligonucleotide; CTT chr2 60507764 60507785 60507769 60507764 -
ctccccgcacccgtcgcccccc

SEQ ID NO: 218287 - DNA, 22 bp, Artificial Sequence
  Synthetic oligonucleotide; TTC chr2 60507763 60507784 60507768 60507763 -
tccccgcacccgtcgcccccca

SEQ ID NO: 218288 - DNA, 22 bp, Artificial Sequence
  Synthetic oligonucleotide; CTC chr2 60507761 60507782 60507766 60507761 -
cccgcacccgtcgccccccacc

SEQ ID NO: 218289 - DNA, 22 bp, Artificial Sequence
  Synthetic oligonucleotide; CTT chr2 60507729 60507750 60507734 60507729 -
tctgtcttgtgctgtttggaag

SEQ ID NO: 218290 - DNA, 22 bp, Artificial Sequence
  Synthetic oligonucleotide; TTT chr2 60507728 60507749 60507733 60507728 -
ctgtcttgtgctgtttggaaga

SEQ ID NO: 218291 - DNA, 22 bp, Artificial Sequence
  Synthetic oligonucleotide; TTC chr2 60507727 60507748 60507732 60507727 -
tgtcttgtgctgtttggaagac

SEQ ID NO: 218292 - DNA, 22 bp, Artificial Sequence
  Synthetic oligonucleotide; CTG chr2 60507725 60507746 60507730 60507725 -
tcttgtgctgtttggaagacaa

SEQ ID NO: 218293 - DNA, 22 bp, Artificial Sequence
  Synthetic oligonucleotide; CTT chr2 60507721 60507742 60507726 60507721 -
gtgctgtttggaagacaatttc

SEQ ID NO: 218294 - DNA, 22 bp, Artificial Sequence
  Synthetic oligonucleotide; TTG chr2 60507720 60507741 60507725 60507720 -
tgctgtttggaagacaatttcc

SEQ ID NO: 218295 - DNA, 22 bp, Artificial Sequence
  Synthetic oligonucleotide; CTG chr2 60507715 60507736 60507720 60507715 -
tttggaagacaatttccacatt

SEQ ID NO: 218296 - DNA, 22 bp, Artificial Sequence
  Synthetic oligonucleotide; TTT chr2 60507712 60507733 60507717 60507712 -
ggaagacaatttccacatttct

SEQ ID NO: 218297 - DNA, 22 bp, Artificial Sequence
  Synthetic oligonucleotide; TTG chr2 60507711 60507732 60507716 60507711 -
gaagacaatttccacatttctg

SEQ ID NO: 218298 - DNA, 22 bp, Artificial Sequence
  Synthetic oligonucleotide; TTT chr2 60507700 60507721 60507705 60507700 -
ccacatttctgccatatgtctt

SEQ ID NO: 218299 - DNA, 22 bp, Artificial Sequence
  Synthetic oligonucleotide; TTC chr2 60507699 60507720 60507704 60507699 -
cacatttctgccatatgtctta

SEQ ID NO: 218300 - DNA, 22 bp, Artificial Sequence
  Synthetic oligonucleotide; TTT chr2 60507692 60507713 60507697 60507692 -
ctgccatatgtcttagaaaagc

SEQ ID NO: 218301 - DNA, 22 bp, Artificial Sequence
  Synthetic oligonucleotide; TTC chr2 60507691 60507712 60507696 60507691 -
tgccatatgtcttagaaaagct

SEQ ID NO: 218302 - DNA, 22 bp, Artificial Sequence
  Synthetic oligonucleotide; CTG chr2 60507689 60507710 60507694 60507689 -
ccatatgtcttagaaaagctgg

SEQ ID NO: 218303 - DNA, 22 bp, Artificial Sequence
  Synthetic oligonucleotide; CTT chr2 60507678 60507699 60507683 60507678 -
agaaaagctggggacttagaag

SEQ ID NO: 218304 - DNA, 22 bp, Artificial Sequence
  Synthetic oligonucleotide; TTA chr2 60507677 60507698 60507682 60507677 -
gaaaagctggggacttagaagc

SEQ ID NO: 218305 - DNA, 22 bp, Artificial Sequence
  Synthetic oligonucleotide; CTG chr2 60507668 60507689 60507673 60507668 -
gggacttagaagcagtagccga

SEQ ID NO: 218306 - DNA, 22 bp, Artificial Sequence
  Synthetic oligonucleotide; CTT chr2 60507661 60507682 60507666 60507661 -
agaagcagtagccgacttagga

SEQ ID NO: 218307 - DNA, 22 bp, Artificial Sequence
  Synthetic oligonucleotide; TTA chr2 60507660 60507681 60507665 60507660 -
gaagcagtagccgacttaggac

SEQ ID NO: 218308 - DNA, 22 bp, Artificial Sequence
  Synthetic oligonucleotide; CTT chr2 60507643 60507664 60507648 60507643 -
aggacagcaagctcagctcagg

SEQ ID NO: 218309 - DNA, 22 bp, Artificial Sequence
  Synthetic oligonucleotide; TTA chr2 60507642 60507663 60507647 60507642 -
ggacagcaagctcagctcaggt

SEQ ID NO: 218310 - DNA, 22 bp, Artificial Sequence
  Synthetic oligonucleotide; CTC chr2 60507629 60507650 60507634 60507629 -
agctcaggtgcggaggcagccc

SEQ ID NO: 218311 - DNA, 22 bp, Artificial Sequence
  Synthetic oligonucleotide; CTC chr2 60507624 60507645 60507629 60507624 -
aggtgcggaggcagccctgtgt

SEQ ID NO: 218312 - DNA, 22 bp, Artificial Sequence
  Synthetic oligonucleotide; CTG chr2 60507605 60507626 60507610 60507605 -
tgtaagagactctgttatgcag

SEQ ID NO: 218313 - DNA, 22 bp, Artificial Sequence
  Synthetic oligonucleotide; CTC chr2 60507593 60507614 60507598 60507593 -
tgttatgcagtgagctgttgaa

SEQ ID NO: 218314 - DNA, 22 bp, Artificial Sequence
  Synthetic oligonucleotide; CTG chr2 60507591 60507612 60507596 60507591 -
ttatgcagtgagctgttgaaac

SEQ ID NO: 218315 - DNA, 22 bp, Artificial Sequence
  Synthetic oligonucleotide; TTA chr2 60507588 60507609 60507593 60507588 -
tgcagtgagctgttgaaacagc

SEQ ID NO: 218316 - DNA, 22 bp, Artificial Sequence
  Synthetic oligonucleotide; CTG chr2 60507576 60507597 60507581 60507576 -
ttgaaacagctgcatgtggaaa

SEQ ID NO: 218317 - DNA, 22 bp, Artificial Sequence
  Synthetic oligonucleotide; TTG chr2 60507573 60507594 60507578 60507573 -
aaacagctgcatgtggaaacag

SEQ ID NO: 218318 - DNA, 22 bp, Artificial Sequence
  Synthetic oligonucleotide; CTG chr2 60507564 60507585 60507569 60507564 -
catgtggaaacagttcttcccc

SEQ ID NO: 218319 - DNA, 22 bp, Artificial Sequence
  Synthetic oligonucleotide; TTC chr2 60507548 60507569 60507553 60507548 -
ttccccttgcctgtcctcattt

SEQ ID NO: 218320 - DNA, 22 bp, Artificial Sequence
  Synthetic oligonucleotide; CTT chr2 60507546 60507567 60507551 60507546 -
ccccttgcctgtcctcatttct

SEQ ID NO: 218321 - DNA, 22 bp, Artificial Sequence
  Synthetic oligonucleotide; TTC chr2 60507545 60507566 60507550 60507545 -
cccttgcctgtcctcatttctt

SEQ ID NO: 218322 - DNA, 22 bp, Artificial Sequence
  Synthetic oligonucleotide; CTT chr2 60507540 60507561 60507545 60507540 -
gcctgtcctcatttcttgagag

SEQ ID NO: 218323 - DNA, 22 bp, Artificial Sequence
  Synthetic oligonucleotide; TTG chr2 60507539 60507560 60507544 60507539 -
cctgtcctcatttcttgagaga

SEQ ID NO: 218324 - DNA, 22 bp, Artificial Sequence
  Synthetic oligonucleotide; CTG chr2 60507535 60507556 60507540 60507535 -
tcctcatttcttgagagactcc

SEQ ID NO: 218325 - DNA, 22 bp, Artificial Sequence
  Synthetic oligonucleotide; CTC chr2 60507530 60507551 60507535 60507530 -
atttcttgagagactccaaaac

SEQ ID NO: 218326 - DNA, 22 bp, Artificial Sequence
  Synthetic oligonucleotide; TTT chr2 60507526 60507547 60507531 60507526 -
cttgagagactccaaaacatct

SEQ ID NO: 218327 - DNA, 22 bp, Artificial Sequence
  Synthetic oligonucleotide; TTC chr2 60507525 60507546 60507530 60507525 -
ttgagagactccaaaacatctg

SEQ ID NO: 218328 - DNA, 22 bp, Artificial Sequence
  Synthetic oligonucleotide; CTT chr2 60507523 60507544 60507528 60507523 -
gagagactccaaaacatctgaa

SEQ ID NO: 218329 - DNA, 22 bp, Artificial Sequence
  Synthetic oligonucleotide; TTG chr2 60507522 60507543 60507527 60507522 -
agagactccaaaacatctgaaa

SEQ ID NO: 218330 - DNA, 22 bp, Artificial Sequence
  Synthetic oligonucleotide; CTC chr2 60507514 60507535 60507519 60507514 -
caaaacatctgaaaatgtaaaa

SEQ ID NO: 218331 - DNA, 22 bp, Artificial Sequence
  Synthetic oligonucleotide; CTG chr2 60507503 60507524 60507508 60507503 -
aaaatgtaaaagcacttcacaa

SEQ ID NO: 218332 - DNA, 22 bp, Artificial Sequence
  Synthetic oligonucleotide; CTT chr2 60507486 60507507 60507491 60507486 -
cacaaggttttaacttttctgg

SEQ ID NO: 218333 - DNA, 22 bp, Artificial Sequence
  Synthetic oligonucleotide; TTC chr2 60507485 60507506 60507490 60507485 -
acaaggttttaacttttctggc

SEQ ID NO: 218334 - DNA, 22 bp, Artificial Sequence
  Synthetic oligonucleotide; TTT chr2 60507476 60507497 60507481 60507476 -
taacttttctggcttgaacgga

SEQ ID NO: 218335 - DNA, 22 bp, Artificial Sequence
  Synthetic oligonucleotide; TTT chr2 60507475 60507496 60507480 60507475 -
aacttttctggcttgaacggaa

SEQ ID NO: 218336 - DNA, 22 bp, Artificial Sequence
  Synthetic oligonucleotide; TTA chr2 60507474 60507495 60507479 60507474 -
acttttctggcttgaacggaag

SEQ ID NO: 218337 - DNA, 22 bp, Artificial Sequence
  Synthetic oligonucleotide; CTT chr2 60507470 60507491 60507475 60507470 -
ttctggcttgaacggaagcagc

SEQ ID NO: 218338 - DNA, 22 bp, Artificial Sequence
  Synthetic oligonucleotide; TTT chr2 60507469 60507490 60507474 60507469 -
tctggcttgaacggaagcagct

SEQ ID NO: 218339 - DNA, 22 bp, Artificial Sequence
  Synthetic oligonucleotide; TTT chr2 60507468 60507489 60507473 60507468 -
ctggcttgaacggaagcagctt

SEQ ID NO: 218340 - DNA, 22 bp, Artificial Sequence
  Synthetic oligonucleotide; TTC chr2 60507467 60507488 60507472 60507467 -
tggcttgaacggaagcagcttc

SEQ ID NO: 218341 - DNA, 22 bp, Artificial Sequence
  Synthetic oligonucleotide; CTG chr2 60507465 60507486 60507470 60507465 -
gcttgaacggaagcagcttcaa

SEQ ID NO: 218342 - DNA, 22 bp, Artificial Sequence
  Synthetic oligonucleotide; CTT chr2 60507461 60507482 60507466 60507461 -
gaacggaagcagcttcaagtca

SEQ ID NO: 218343 - DNA, 22 bp, Artificial Sequence
  Synthetic oligonucleotide; TTG chr2 60507460 60507481 60507465 60507460 -
aacggaagcagcttcaagtcaa

SEQ ID NO: 218344 - DNA, 22 bp, Artificial Sequence
  Synthetic oligonucleotide; CTT chr2 60507446 60507467 60507451 60507446 -
caagtcaacaagagcacaatag

SEQ ID NO: 218345 - DNA, 22 bp, Artificial Sequence
  Synthetic oligonucleotide; TTC chr2 60507445 60507466 60507450 60507445 -
aagtcaacaagagcacaatagt

SEQ ID NO: 218346 - DNA, 22 bp, Artificial Sequence
  Synthetic oligonucleotide; CTT chr2 60507420 60507441 60507425 60507420 -
tgtaggttttggacacagtttt

SEQ ID NO: 218347 - DNA, 22 bp, Artificial Sequence
  Synthetic oligonucleotide; TTT chr2 60507419 60507440 60507424 60507419 -
gtaggttttggacacagttttc

SEQ ID NO: 218348 - DNA, 22 bp, Artificial Sequence
  Synthetic oligonucleotide; TTG chr2 60507418 60507439 60507423 60507418 -
taggttttggacacagttttct

SEQ ID NO: 218349 - DNA, 22 bp, Artificial Sequence
  Synthetic oligonucleotide; TTT chr2 60507411 60507432 60507416 60507411 -
tggacacagttttctagctttt

SEQ ID NO: 218350 - DNA, 22 bp, Artificial Sequence
  Synthetic oligonucleotide; TTT chr2 60507410 60507431 60507415 60507410 -
ggacacagttttctagcttttc

SEQ ID NO: 218351 - DNA, 22 bp, Artificial Sequence
  Synthetic oligonucleotide; TTG chr2 60507409 60507430 60507414 60507409 -
gacacagttttctagcttttca

SEQ ID NO: 218352 - DNA, 22 bp, Artificial Sequence
  Synthetic oligonucleotide; TTT chr2 60507399 60507420 60507404 60507399 -
tctagcttttcaagaaaggcaa

SEQ ID NO: 218353 - DNA, 22 bp, Artificial Sequence
  Synthetic oligonucleotide; TTT chr2 60507398 60507419 60507403 60507398 -
ctagcttttcaagaaaggcaag

SEQ ID NO: 218354 - DNA, 22 bp, Artificial Sequence
  Synthetic oligonucleotide; TTC chr2 60507397 60507418 60507402 60507397 -
tagcttttcaagaaaggcaagg

SEQ ID NO: 218355 - DNA, 22 bp, Artificial Sequence
  Synthetic oligonucleotide; CTA chr2 60507395 60507416 60507400 60507395 -
gcttttcaagaaaggcaagggc

SEQ ID NO: 218356 - DNA, 22 bp, Artificial Sequence
  Synthetic oligonucleotide; CTT chr2 60507391 60507412 60507396 60507391 -
ttcaagaaaggcaagggccctc

SEQ ID NO: 218357 - DNA, 22 bp, Artificial Sequence
  Synthetic oligonucleotide; TTT chr2 60507390 60507411 60507395 60507390 -
tcaagaaaggcaagggccctcc

SEQ ID NO: 218358 - DNA, 22 bp, Artificial Sequence
  Synthetic oligonucleotide; TTT chr2 60507389 60507410 60507394 60507389 -
caagaaaggcaagggccctcct

SEQ ID NO: 218359 - DNA, 22 bp, Artificial Sequence
  Synthetic oligonucleotide; TTC chr2 60507388 60507409 60507393 60507388 -
aagaaaggcaagggccctcctt

SEQ ID NO: 218360 - DNA, 22 bp, Artificial Sequence
  Synthetic oligonucleotide; CTC chr2 60507369 60507390 60507374 60507369 -
cttccctccctcccttcccttc

SEQ ID NO: 218361 - DNA, 22 bp, Artificial Sequence
  Synthetic oligonucleotide; CTT chr2 60507366 60507387 60507371 60507366 -
ccctccctcccttcccttccct

SEQ ID NO: 218362 - DNA, 22 bp, Artificial Sequence
  Synthetic oligonucleotide; TTC chr2 60507365 60507386 60507370 60507365 -
cctccctcccttcccttccctt

SEQ ID NO: 218363 - DNA, 22 bp, Artificial Sequence
  Synthetic oligonucleotide; CTC chr2 60507361 60507382 60507366 60507361 -
cctcccttcccttcccttccct

SEQ ID NO: 218364 - DNA, 22 bp, Artificial Sequence
  Synthetic oligonucleotide; CTC chr2 60507357 60507378 60507362 60507357 -
ccttcccttcccttcccttccc

SEQ ID NO: 218365 - DNA, 22 bp, Artificial Sequence
  Synthetic oligonucleotide; CTT chr2 60507353 60507374 60507358 60507353 -
cccttcccttcccttcccttcc

SEQ ID NO: 218366 - DNA, 22 bp, Artificial Sequence
  Synthetic oligonucleotide; TTC chr2 60507352 60507373 60507357 60507352 -
ccttcccttcccttcccttccc

SEQ ID NO: 218367 - DNA, 22 bp, Artificial Sequence
  Synthetic oligonucleotide; CTT chr2 60507348 60507369 60507353 60507348 -
cccttcccttcccttcccttcc

SEQ ID NO: 218368 - DNA, 22 bp, Artificial Sequence
  Synthetic oligonucleotide; TTC chr2 60507347 60507368 60507352 60507347 -
ccttcccttcccttcccttccc

SEQ ID NO: 218369 - DNA, 22 bp, Artificial Sequence
  Synthetic oligonucleotide; CTT chr2 60507343 60507364 60507348 60507343 -
cccttcccttcccttcccttcc

SEQ ID NO: 218370 - DNA, 22 bp, Artificial Sequence
  Synthetic oligonucleotide; TTC chr2 60507342 60507363 60507347 60507342 -
ccttcccttcccttcccttccc

SEQ ID NO: 218371 - DNA, 22 bp, Artificial Sequence
  Synthetic oligonucleotide; CTT chr2 60507338 60507359 60507343 60507338 -
cccttcccttcccttcccttcc

SEQ ID NO: 218372 - DNA, 22 bp, Artificial Sequence
  Synthetic oligonucleotide; TTC chr2 60507337 60507358 60507342 60507337 -
ccttcccttcccttcccttccc

SEQ ID NO: 218373 - DNA, 22 bp, Artificial Sequence
  Synthetic oligonucleotide; CTT chr2 60507333 60507354 60507338 60507333 -
cccttcccttcccttcccttcc

SEQ ID NO: 218374 - DNA, 22 bp, Artificial Sequence
  Synthetic oligonucleotide; TTC chr2 60507332 60507353 60507337 60507332 -
ccttcccttcccttcccttccc

SEQ ID NO: 218375 - DNA, 22 bp, Artificial Sequence
  Synthetic oligonucleotide; CTT chr2 60507328 60507349 60507333 60507328 -
cccttcccttcccttcccttcc

SEQ ID NO: 218376 - DNA, 22 bp, Artificial Sequence
  Synthetic oligonucleotide; TTC chr2 60507327 60507348 60507332 60507327 -
ccttcccttcccttcccttccc

SEQ ID NO: 218377 - DNA, 22 bp, Artificial Sequence
  Synthetic oligonucleotide; CTT chr2 60507323 60507344 60507328 60507323 -
cccttcccttcccttcccttcc

SEQ ID NO: 218378 - DNA, 22 bp, Artificial Sequence
  Synthetic oligonucleotide; TTC chr2 60507322 60507343 60507327 60507322 -
ccttcccttcccttcccttccc

SEQ ID NO: 218379 - DNA, 22 bp, Artificial Sequence
  Synthetic oligonucleotide; CTT chr2 60507318 60507339 60507323 60507318 -
cccttcccttcccttcccttcc

SEQ ID NO: 218380 - DNA, 22 bp, Artificial Sequence
  Synthetic oligonucleotide; TTC chr2 60507317 60507338 60507322 60507317 -
ccttcccttcccttcccttccc

SEQ ID NO: 218381 - DNA, 22 bp, Artificial Sequence
  Synthetic oligonucleotide; CTT chr2 60507313 60507334 60507318 60507313 -
cccttcccttcccttcccctcc

SEQ ID NO: 218382 - DNA, 22 bp, Artificial Sequence
  Synthetic oligonucleotide; TTC chr2 60507312 60507333 60507317 60507312 -
ccttcccttcccttcccctccc

SEQ ID NO: 218383 - DNA, 22 bp, Artificial Sequence
  Synthetic oligonucleotide; CTT chr2 60507308 60507329 60507313 60507308 -
cccttcccttcccctcccctcc

SEQ ID NO: 218384 - DNA, 22 bp, Artificial Sequence
  Synthetic oligonucleotide; TTC chr2 60507307 60507328 60507312 60507307 -
ccttcccttcccctcccctccc

SEQ ID NO: 218385 - DNA, 22 bp, Artificial Sequence
  Synthetic oligonucleotide; CTT chr2 60507303 60507324 60507308 60507303 -
cccttcccctcccctcccctcc

SEQ ID NO: 218386 - DNA, 22 bp, Artificial Sequence
  Synthetic oligonucleotide; TTC chr2 60507302 60507323 60507307 60507302 -
ccttcccctcccctcccctccc

SEQ ID NO: 218387 - DNA, 22 bp, Artificial Sequence
  Synthetic oligonucleotide; CTT chr2 60507298 60507319 60507303 60507298 -
cccctcccctcccctcccctcc

SEQ ID NO: 218388 - DNA, 22 bp, Artificial Sequence
  Synthetic oligonucleotide; TTC chr2 60507297 60507318 60507302 60507297 -
ccctcccctcccctcccctccc

SEQ ID NO: 218389 - DNA, 22 bp, Artificial Sequence
  Synthetic oligonucleotide; CTC chr2 60507292 60507313 60507297 60507292 -
ccctcccctcccctcccctccc

SEQ ID NO: 218390 - DNA, 22 bp, Artificial Sequence
  Synthetic oligonucleotide; CTC chr2 60507287 60507308 60507292 60507287 -
ccctcccctcccctcccctccc

SEQ ID NO: 218391 - DNA, 22 bp, Artificial Sequence
  Synthetic oligonucleotide; CTC chr2 60507282 60507303 60507287 60507282 -
ccctcccctcccctcccctccc

SEQ ID NO: 218392 - DNA, 22 bp, Artificial Sequence
  Synthetic oligonucleotide; CTC chr2 60507277 60507298 60507282 60507277 -
ccctcccctcccctcccctccc

SEQ ID NO: 218393 - DNA, 22 bp, Artificial Sequence
  Synthetic oligonucleotide; CTC chr2 60507272 60507293 60507277 60507272 -
ccctcccctcccctcccctccc

SEQ ID NO: 218394 - DNA, 22 bp, Artificial Sequence
  Synthetic oligonucleotide; CTC chr2 60507267 60507288 60507272 60507267 -
ccctcccctcccctcccctccc

SEQ ID NO: 218395 - DNA, 22 bp, Artificial Sequence
  Synthetic oligonucleotide; CTC chr2 60507262 60507283 60507267 60507262 -
ccctcccctcccctcccctccc

SEQ ID NO: 218396 - DNA, 22 bp, Artificial Sequence
  Synthetic oligonucleotide; CTC chr2 60507257 60507278 60507262 60507257 -
ccctcccctcccctcccctccc

SEQ ID NO: 218397 - DNA, 22 bp, Artificial Sequence
  Synthetic oligonucleotide; CTC chr2 60507252 60507273 60507257 60507252 -
ccctcccctcccctcccctccc

SEQ ID NO: 218398 - DNA, 22 bp, Artificial Sequence
  Synthetic oligonucleotide; CTC chr2 60507247 60507268 60507252 60507247 -
ccctcccctcccctcccctccc

SEQ ID NO: 218399 - DNA, 22 bp, Artificial Sequence
  Synthetic oligonucleotide; CTC chr2 60507242 60507263 60507247 60507242 -
ccctcccctcccctcccctccc

SEQ ID NO: 218400 - DNA, 22 bp, Artificial Sequence
  Synthetic oligonucleotide; CTC chr2 60507237 60507258 60507242 60507237 -
ccctcccctcccctccctccct

SEQ ID NO: 218401 - DNA, 22 bp, Artificial Sequence
  Synthetic oligonucleotide; CTC chr2 60507232 60507253 60507237 60507232 -
ccctcccctccctccctccctt

SEQ ID NO: 218402 - DNA, 22 bp, Artificial Sequence
  Synthetic oligonucleotide; CTC chr2 60507227 60507248 60507232 60507227 -
ccctccctccctcccttccttc

SEQ ID NO: 218403 - DNA, 22 bp, Artificial Sequence
  Synthetic oligonucleotide; CTC chr2 60507222 60507243 60507227 60507222 -
cctccctcccttccttccttcc

SEQ ID NO: 218404 - DNA, 22 bp, Artificial Sequence
  Synthetic oligonucleotide; CTC chr2 60507218 60507239 60507223 60507218 -
cctcccttccttccttccttcc

SEQ ID NO: 218405 - DNA, 22 bp, Artificial Sequence
  Synthetic oligonucleotide; CTC chr2 60507214 60507235 60507219 60507214 -
ccttccttccttccttccttcc

SEQ ID NO: 218406 - DNA, 22 bp, Artificial Sequence
  Synthetic oligonucleotide; CTT chr2 60507210 60507231 60507215 60507210 -
ccttccttccttccttccttcc

SEQ ID NO: 218407 - DNA, 22 bp, Artificial Sequence
  Synthetic oligonucleotide; TTC chr2 60507209 60507230 60507214 60507209 -
cttccttccttccttccttcct

SEQ ID NO: 218408 - DNA, 22 bp, Artificial Sequence
  Synthetic oligonucleotide; CTT chr2 60507206 60507227 60507211 60507206 -
ccttccttccttccttcctttc

SEQ ID NO: 218409 - DNA, 22 bp, Artificial Sequence
  Synthetic oligonucleotide; TTC chr2 60507205 60507226 60507210 60507205 -
cttccttccttccttcctttct

SEQ ID NO: 218410 - DNA, 22 bp, Artificial Sequence
  Synthetic oligonucleotide; CTT chr2 60507202 60507223 60507207 60507202 -
ccttccttccttcctttcttcc

SEQ ID NO: 218411 - DNA, 22 bp, Artificial Sequence
  Synthetic oligonucleotide; TTC chr2 60507201 60507222 60507206 60507201 -
cttccttccttcctttcttcct

SEQ ID NO: 218412 - DNA, 22 bp, Artificial Sequence
  Synthetic oligonucleotide; CTT chr2 60507198 60507219 60507203 60507198 -
ccttccttcctttcttccttgt

SEQ ID NO: 218413 - DNA, 22 bp, Artificial Sequence
  Synthetic oligonucleotide; TTC chr2 60507197 60507218 60507202 60507197 -
cttccttcctttcttccttgtc

SEQ ID NO: 218414 - DNA, 22 bp, Artificial Sequence
  Synthetic oligonucleotide; CTT chr2 60507194 60507215 60507199 60507194 -
ccttcctttcttccttgtcttg

SEQ ID NO: 218415 - DNA, 22 bp, Artificial Sequence
  Synthetic oligonucleotide; TTC chr2 60507193 60507214 60507198 60507193 -
cttcctttcttccttgtcttgc

SEQ ID NO: 218416 - DNA, 22 bp, Artificial Sequence
  Synthetic oligonucleotide; CTT chr2 60507190 60507211 60507195 60507190 -
cctttcttccttgtcttgcttt

SEQ ID NO: 218417 - DNA, 22 bp, Artificial Sequence
  Synthetic oligonucleotide; TTC chr2 60507189 60507210 60507194 60507189 -
ctttcttccttgtcttgctttg

SEQ ID NO: 218418 - DNA, 22 bp, Artificial Sequence
  Synthetic oligonucleotide; CTT chr2 60507186 60507207 60507191 60507186 -
tcttccttgtcttgctttgcat

SEQ ID NO: 218419 - DNA, 22 bp, Artificial Sequence
  Synthetic oligonucleotide; TTT chr2 60507185 60507206 60507190 60507185 -
cttccttgtcttgctttgcatt

SEQ ID NO: 218420 - DNA, 22 bp, Artificial Sequence
  Synthetic oligonucleotide; TTC chr2 60507184 60507205 60507189 60507184 -
ttccttgtcttgctttgcattc

SEQ ID NO: 218421 - DNA, 22 bp, Artificial Sequence
  Synthetic oligonucleotide; CTT chr2 60507182 60507203 60507187 60507182 -
ccttgtcttgctttgcattctg

SEQ ID NO: 218422 - DNA, 22 bp, Artificial Sequence
  Synthetic oligonucleotide; TTC chr2 60507181 60507202 60507186 60507181 -
cttgtcttgctttgcattctgc

SEQ ID NO: 218423 - DNA, 22 bp, Artificial Sequence
  Synthetic oligonucleotide; CTT chr2 60507178 60507199 60507183 60507178 -
gtcttgctttgcattctgcaga

SEQ ID NO: 218424 - DNA, 22 bp, Artificial Sequence
  Synthetic oligonucleotide; TTG chr2 60507177 60507198 60507182 60507177 -
tcttgctttgcattctgcagag

SEQ ID NO: 218425 - DNA, 22 bp, Artificial Sequence
  Synthetic oligonucleotide; CTT chr2 60507173 60507194 60507178 60507173 -
gctttgcattctgcagagctag

SEQ ID NO: 218426 - DNA, 22 bp, Artificial Sequence
  Synthetic oligonucleotide; TTG chr2 60507172 60507193 60507177 60507172 -
ctttgcattctgcagagctaga

SEQ ID NO: 218427 - DNA, 22 bp, Artificial Sequence
  Synthetic oligonucleotide; CTT chr2 60507169 60507190 60507174 60507169 -
tgcattctgcagagctagaaga

SEQ ID NO: 218428 - DNA, 22 bp, Artificial Sequence
  Synthetic oligonucleotide; TTT chr2 60507168 60507189 60507173 60507168 -
gcattctgcagagctagaagag

SEQ ID NO: 218429 - DNA, 22 bp, Artificial Sequence
  Synthetic oligonucleotide; TTG chr2 60507167 60507188 60507172 60507167 -
cattctgcagagctagaagagc

SEQ ID NO: 218430 - DNA, 22 bp, Artificial Sequence
  Synthetic oligonucleotide; TTC chr2 60507162 60507183 60507167 60507162 -
tgcagagctagaagagcattta

SEQ ID NO: 218431 - DNA, 22 bp, Artificial Sequence
  Synthetic oligonucleotide; CTG chr2 60507160 60507181 60507165 60507160 -
cagagctagaagagcatttaat

SEQ ID NO: 218432 - DNA, 22 bp, Artificial Sequence
  Synthetic oligonucleotide; CTA chr2 60507152 60507173 60507157 60507152 -
gaagagcatttaatccttggcc

SEQ ID NO: 218433 - DNA, 22 bp, Artificial Sequence
  Synthetic oligonucleotide; TTT chr2 60507141 60507162 60507146 60507141 -
aatccttggccctctgtctgtt

SEQ ID NO: 218434 - DNA, 22 bp, Artificial Sequence
  Synthetic oligonucleotide; TTA chr2 60507140 60507161 60507145 60507140 -
atccttggccctctgtctgttg

SEQ ID NO: 218435 - DNA, 22 bp, Artificial Sequence
  Synthetic oligonucleotide; CTT chr2 60507134 60507155 60507139 60507134 -
ggccctctgtctgttgggatat

SEQ ID NO: 218436 - DNA, 22 bp, Artificial Sequence
  Synthetic oligonucleotide; TTG chr2 60507133 60507154 60507138 60507133 -
gccctctgtctgttgggatatt

SEQ ID NO: 218437 - DNA, 22 bp, Artificial Sequence
  Synthetic oligonucleotide; CTC chr2 60507127 60507148 60507132 60507127 -
tgtctgttgggatattatgttt

SEQ ID NO: 218438 - DNA, 22 bp, Artificial Sequence
  Synthetic oligonucleotide; CTG chr2 60507125 60507146 60507130 60507125 -
tctgttgggatattatgttttt

SEQ ID NO: 218439 - DNA, 22 bp, Artificial Sequence
  Synthetic oligonucleotide; CTG chr2 60507121 60507142 60507126 60507121 -
ttgggatattatgtttttttaa

SEQ ID NO: 218440 - DNA, 22 bp, Artificial Sequence
  Synthetic oligonucleotide; TTG chr2 60507118 60507139 60507123 60507118 -
ggatattatgtttttttaatag

SEQ ID NO: 218441 - DNA, 22 bp, Artificial Sequence
  Synthetic oligonucleotide; TTA chr2 60507110 60507131 60507115 60507110 -
tgtttttttaatagtgcttgtt

SEQ ID NO: 218442 - DNA, 22 bp, Artificial Sequence
  Synthetic oligonucleotide; TTT chr2 60507105 60507126 60507110 60507105 -
ttttaatagtgcttgtttatga

SEQ ID NO: 218443 - DNA, 22 bp, Artificial Sequence
  Synthetic oligonucleotide; TTT chr2 60507104 60507125 60507109 60507104 -
tttaatagtgcttgtttatgac

SEQ ID NO: 218444 - DNA, 22 bp, Artificial Sequence
  Synthetic oligonucleotide; TTT chr2 60507103 60507124 60507108 60507103 -
ttaatagtgcttgtttatgact

SEQ ID NO: 218445 - DNA, 22 bp, Artificial Sequence
  Synthetic oligonucleotide; TTT chr2 60507102 60507123 60507107 60507102 -
taatagtgcttgtttatgacta

SEQ ID NO: 218446 - DNA, 22 bp, Artificial Sequence
  Synthetic oligonucleotide; TTT chr2 60507101 60507122 60507106 60507101 -
aatagtgcttgtttatgactaa

SEQ ID NO: 218447 - DNA, 22 bp, Artificial Sequence
  Synthetic oligonucleotide; TTA chr2 60507100 60507121 60507105 60507100 -
atagtgcttgtttatgactaag

SEQ ID NO: 218448 - DNA, 22 bp, Artificial Sequence
  Synthetic oligonucleotide; CTT chr2 60507091 60507112 60507096 60507091 -
gtttatgactaaggtcaaagac

SEQ ID NO: 218449 - DNA, 22 bp, Artificial Sequence
  Synthetic oligonucleotide; TTG chr2 60507090 60507111 60507095 60507090 -
tttatgactaaggtcaaagaca

SEQ ID NO: 218450 - DNA, 22 bp, Artificial Sequence
  Synthetic oligonucleotide; TTT chr2 60507087 60507108 60507092 60507087 -
atgactaaggtcaaagacagta

SEQ ID NO: 218451 - DNA, 22 bp, Artificial Sequence
  Synthetic oligonucleotide; TTA chr2 60507086 60507107 60507091 60507086 -
tgactaaggtcaaagacagtat

SEQ ID NO: 218452 - DNA, 22 bp, Artificial Sequence
  Synthetic oligonucleotide; CTA chr2 60507080 60507101 60507085 60507080 -
aggtcaaagacagtatttcaga

SEQ ID NO: 218453 - DNA, 22 bp, Artificial Sequence
  Synthetic oligonucleotide; TTT chr2 60507062 60507083 60507067 60507062 -
cagaacaaaaattagagttagt

SEQ ID NO: 218454 - DNA, 22 bp, Artificial Sequence
  Synthetic oligonucleotide; TTC chr2 60507061 60507082 60507066 60507061 -
agaacaaaaattagagttagtt

SEQ ID NO: 218455 - DNA, 22 bp, Artificial Sequence
  Synthetic oligonucleotide; TTA chr2 60507048 60507069 60507053 60507048 -
gagttagttcataattgagtac

SEQ ID NO: 218456 - DNA, 22 bp, Artificial Sequence
  Synthetic oligonucleotide; TTA chr2 60507042 60507063 60507047 60507042 -
gttcataattgagtacatatgt

SEQ ID NO: 218457 - DNA, 22 bp, Artificial Sequence
  Synthetic oligonucleotide; TTC chr2 60507038 60507059 60507043 60507038 -
ataattgagtacatatgtacgt

SEQ ID NO: 218458 - DNA, 22 bp, Artificial Sequence
  Synthetic oligonucleotide; TTG chr2 60507031 60507052 60507036 60507031 -
agtacatatgtacgttactgtt

SEQ ID NO: 218459 - DNA, 22 bp, Artificial Sequence
  Synthetic oligonucleotide; TTA chr2 60507014 60507035 60507019 60507014 -
ctgtttatttttatagtttgct

SEQ ID NO: 218460 - DNA, 22 bp, Artificial Sequence
  Synthetic oligonucleotide; CTG chr2 60507011 60507032 60507016 60507011 -
tttatttttatagtttgctaat

SEQ ID NO: 218461 - DNA, 22 bp, Artificial Sequence
  Synthetic oligonucleotide; TTT chr2 60507008 60507029 60507013 60507008 -
atttttatagtttgctaattta

SEQ ID NO: 218462 - DNA, 22 bp, Artificial Sequence
  Synthetic oligonucleotide; TTA chr2 60507007 60507028 60507012 60507007 -
tttttatagtttgctaatttat

SEQ ID NO: 218463 - DNA, 22 bp, Artificial Sequence
  Synthetic oligonucleotide; TTT chr2 60507004 60507025 60507009 60507004 -
ttatagtttgctaatttatttt

SEQ ID NO: 218464 - DNA, 22 bp, Artificial Sequence
  Synthetic oligonucleotide; TTT chr2 60507003 60507024 60507008 60507003 -
tatagtttgctaatttattttt

SEQ ID NO: 218465 - DNA, 22 bp, Artificial Sequence
  Synthetic oligonucleotide; TTT chr2 60507002 60507023 60507007 60507002 -
atagtttgctaatttattttta

SEQ ID NO: 218466 - DNA, 22 bp, Artificial Sequence
  Synthetic oligonucleotide; TTA chr2 60507001 60507022 60507006 60507001 -
tagtttgctaatttatttttaa

SEQ ID NO: 218467 - DNA, 22 bp, Artificial Sequence
  Synthetic oligonucleotide; TTT chr2 60506995 60507016 60507000 60506995 -
gctaatttatttttaaacagct

SEQ ID NO: 218468 - DNA, 22 bp, Artificial Sequence
  Synthetic oligonucleotide; TTG chr2 60506994 60507015 60506999 60506994 -
ctaatttatttttaaacagctc

SEQ ID NO: 218469 - DNA, 22 bp, Artificial Sequence
  Synthetic oligonucleotide; CTA chr2 60506991 60507012 60506996 60506991 -
atttatttttaaacagctcagt

SEQ ID NO: 218470 - DNA, 22 bp, Artificial Sequence
  Synthetic oligonucleotide; TTT chr2 60506987 60507008 60506992 60506987 -
atttttaaacagctcagttacg

SEQ ID NO: 218471 - DNA, 22 bp, Artificial Sequence
  Synthetic oligonucleotide; TTA chr2 60506986 60507007 60506991 60506986 -
tttttaaacagctcagttacgc

SEQ ID NO: 218472 - DNA, 22 bp, Artificial Sequence
  Synthetic oligonucleotide; TTT chr2 60506983 60507004 60506988 60506983 -
ttaaacagctcagttacgccaa

SEQ ID NO: 218473 - DNA, 22 bp, Artificial Sequence
  Synthetic oligonucleotide; TTT chr2 60506982 60507003 60506987 60506982 -
taaacagctcagttacgccaac

SEQ ID NO: 218474 - DNA, 22 bp, Artificial Sequence
  Synthetic oligonucleotide; TTT chr2 60506981 60507002 60506986 60506981 -
aaacagctcagttacgccaaca

SEQ ID NO: 218475 - DNA, 22 bp, Artificial Sequence
  Synthetic oligonucleotide; TTA chr2 60506980 60507001 60506985 60506980 -
aacagctcagttacgccaacat

SEQ ID NO: 218476 - DNA, 22 bp, Artificial Sequence
  Synthetic oligonucleotide; CTC chr2 60506972 60506993 60506977 60506972 -
agttacgccaacatgtttatag

SEQ ID NO: 218477 - DNA, 22 bp, Artificial Sequence
  Synthetic oligonucleotide; TTA chr2 60506967 60506988 60506972 60506967 -
cgccaacatgtttatagctctg

SEQ ID NO: 218478 - DNA, 22 bp, Artificial Sequence
  Synthetic oligonucleotide; TTT chr2 60506954 60506975 60506959 60506954 -
atagctctgttcatcacatgcc

SEQ ID NO: 218479 - DNA, 22 bp, Artificial Sequence
  Synthetic oligonucleotide; TTA chr2 60506953 60506974 60506958 60506953 -
tagctctgttcatcacatgcct

SEQ ID NO: 218480 - DNA, 22 bp, Artificial Sequence
  Synthetic oligonucleotide; CTC chr2 60506947 60506968 60506952 60506947 -
tgttcatcacatgccttaccag

SEQ ID NO: 218481 - DNA, 22 bp, Artificial Sequence
  Synthetic oligonucleotide; CTG chr2 60506945 60506966 60506950 60506945 -
ttcatcacatgccttaccagtc

SEQ ID NO: 218482 - DNA, 22 bp, Artificial Sequence
  Synthetic oligonucleotide; TTC chr2 60506942 60506963 60506947 60506942 -
atcacatgccttaccagtcagg

SEQ ID NO: 218483 - DNA, 22 bp, Artificial Sequence
  Synthetic oligonucleotide; CTT chr2 60506930 60506951 60506935 60506930 -
accagtcagggtgttaaaaggc

SEQ ID NO: 218484 - DNA, 22 bp, Artificial Sequence
  Synthetic oligonucleotide; TTA chr2 60506929 60506950 60506934 60506929 -
ccagtcagggtgttaaaaggca

SEQ ID NO: 218485 - DNA, 22 bp, Artificial Sequence
  Synthetic oligonucleotide; TTA chr2 60506914 60506935 60506919 60506914 -
aaaggcacatgcttttcaatag

SEQ ID NO: 218486 - DNA, 22 bp, Artificial Sequence
  Synthetic oligonucleotide; CTT chr2 60506900 60506921 60506905 60506900 -
ttcaatagtttggatcccaagt

SEQ ID NO: 218487 - DNA, 22 bp, Artificial Sequence
  Synthetic oligonucleotide; TTT chr2 60506899 60506920 60506904 60506899 -
tcaatagtttggatcccaagtt

SEQ ID NO: 218488 - DNA, 22 bp, Artificial Sequence
  Synthetic oligonucleotide; TTT chr2 60506898 60506919 60506903 60506898 -
caatagtttggatcccaagtta

SEQ ID NO: 218489 - DNA, 22 bp, Artificial Sequence
  Synthetic oligonucleotide; TTC chr2 60506897 60506918 60506902 60506897 -
aatagtttggatcccaagttaa

SEQ ID NO: 218490 - DNA, 22 bp, Artificial Sequence
  Synthetic oligonucleotide; TTT chr2 60506889 60506910 60506894 60506889 -
ggatcccaagttaaattagata

SEQ ID NO: 218491 - DNA, 22 bp, Artificial Sequence
  Synthetic oligonucleotide; TTG chr2 60506888 60506909 60506893 60506888 -
gatcccaagttaaattagataa

SEQ ID NO: 218492 - DNA, 22 bp, Artificial Sequence
  Synthetic oligonucleotide; TTA chr2 60506876 60506897 60506881 60506876 -
aattagataatgccatcaggta

SEQ ID NO: 218493 - DNA, 22 bp, Artificial Sequence
  Synthetic oligonucleotide; TTA chr2 60506871 60506892 60506876 60506871 -
gataatgccatcaggtagcaat

SEQ ID NO: 218494 - DNA, 22 bp, Artificial Sequence
  Synthetic oligonucleotide; TTT chr2 60506847 60506868 60506852 60506847 -
aattacattaattgaatgttta

SEQ ID NO: 218495 - DNA, 22 bp, Artificial Sequence
  Synthetic oligonucleotide; TTA chr2 60506846 60506867 60506851 60506846 -
attacattaattgaatgtttag

SEQ ID NO: 218496 - DNA, 22 bp, Artificial Sequence
  Synthetic oligonucleotide; TTA chr2 60506842 60506863 60506847 60506842 -
cattaattgaatgtttaggcgg

SEQ ID NO: 218497 - DNA, 22 bp, Artificial Sequence
  Synthetic oligonucleotide; TTA chr2 60506837 60506858 60506842 60506837 -
attgaatgtttaggcggaaagg

SEQ ID NO: 218498 - DNA, 22 bp, Artificial Sequence
  Synthetic oligonucleotide; TTG chr2 60506833 60506854 60506838 60506833 -
aatgtttaggcggaaaggtagt

SEQ ID NO: 218499 - DNA, 22 bp, Artificial Sequence
  Synthetic oligonucleotide; TTT chr2 60506826 60506847 60506831 60506826 -
aggcggaaaggtagttttgcag

SEQ ID NO: 218500 - DNA, 22 bp, Artificial Sequence
  Synthetic oligonucleotide; TTA chr2 60506825 60506846 60506830 60506825 -
ggcggaaaggtagttttgcaga

SEQ ID NO: 218501 - DNA, 22 bp, Artificial Sequence
  Synthetic oligonucleotide; TTT chr2 60506809 60506830 60506814 60506809 -
tgcagaggctataatgaaatca

SEQ ID NO: 218502 - DNA, 22 bp, Artificial Sequence
  Synthetic oligonucleotide; TTT chr2 60506808 60506829 60506813 60506808 -
gcagaggctataatgaaatcac

SEQ ID NO: 218503 - DNA, 22 bp, Artificial Sequence
  Synthetic oligonucleotide; TTG chr2 60506807 60506828 60506812 60506807 -
cagaggctataatgaaatcaca

SEQ ID NO: 218504 - DNA, 22 bp, Artificial Sequence
  Synthetic oligonucleotide; CTA chr2 60506798 60506819 60506803 60506798 -
taatgaaatcacatttataagt

SEQ ID NO: 218505 - DNA, 22 bp, Artificial Sequence
  Synthetic oligonucleotide; TTT chr2 60506782 60506803 60506787 60506782 -
ataagtacccatgtataaatct

SEQ ID NO: 218506 - DNA, 22 bp, Artificial Sequence
  Synthetic oligonucleotide; TTA chr2 60506781 60506802 60506786 60506781 -
taagtacccatgtataaatctc

SEQ ID NO: 218507 - DNA, 22 bp, Artificial Sequence
  Synthetic oligonucleotide; CTC chr2 60506759 60506780 60506764 60506759 -
agcattatagacattatttgag

SEQ ID NO: 218508 - DNA, 22 bp, Artificial Sequence
  Synthetic oligonucleotide; TTA chr2 60506752 60506773 60506757 60506752 -
tagacattatttgaggttgctg

SEQ ID NO: 218509 - DNA, 22 bp, Artificial Sequence
  Synthetic oligonucleotide; TTA chr2 60506743 60506764 60506748 60506743 -
tttgaggttgctgacagaaaaa

SEQ ID NO: 218510 - DNA, 22 bp, Artificial Sequence
  Synthetic oligonucleotide; TTT chr2 60506740 60506761 60506745 60506740 -
gaggttgctgacagaaaaatgg

SEQ ID NO: 218511 - DNA, 22 bp, Artificial Sequence
  Synthetic oligonucleotide; TTG chr2 60506739 60506760 60506744 60506739 -
aggttgctgacagaaaaatgga

SEQ ID NO: 218512 - DNA, 22 bp, Artificial Sequence
  Synthetic oligonucleotide; TTG chr2 60506733 60506754 60506738 60506733 -
ctgacagaaaaatggatatata

SEQ ID NO: 218513 - DNA, 22 bp, Artificial Sequence
  Synthetic oligonucleotide; CTG chr2 60506730 60506751 60506735 60506730 -
acagaaaaatggatatatatca

SEQ ID NO: 218514 - DNA, 22 bp, Artificial Sequence
  Synthetic oligonucleotide; TTT chr2 60506701 60506722 60506706 60506701 -
aggaggaaacatgcggggggct

SEQ ID NO: 218515 - DNA, 22 bp, Artificial Sequence
  Synthetic oligonucleotide; TTA chr2 60506700 60506721 60506705 60506700 -
ggaggaaacatgcggggggctg

SEQ ID NO: 218516 - DNA, 22 bp, Artificial Sequence
  Synthetic oligonucleotide; CTG chr2 60506678 60506699 60506683 60506678 -
tcatcagtggtaaatgctgcct

SEQ ID NO: 218517 - DNA, 22 bp, Artificial Sequence
  Synthetic oligonucleotide; CTG chr2 60506659 60506680 60506664 60506659 -
ccttcgccatttaggagactgc

SEQ ID NO: 218518 - DNA, 22 bp, Artificial Sequence
  Synthetic oligonucleotide; CTT chr2 60506655 60506676 60506660 60506655 -
cgccatttaggagactgctggg

SEQ ID NO: 218519 - DNA, 22 bp, Artificial Sequence
  Synthetic oligonucleotide; TTC chr2 60506654 60506675 60506659 60506654 -
gccatttaggagactgctgggc

SEQ ID NO: 218520 - DNA, 22 bp, Artificial Sequence
  Synthetic oligonucleotide; TTT chr2 60506647 60506668 60506652 60506647 -
aggagactgctgggcacggtcg

SEQ ID NO: 218521 - DNA, 22 bp, Artificial Sequence
  Synthetic oligonucleotide; TTA chr2 60506646 60506667 60506651 60506646 -
ggagactgctgggcacggtcgt

SEQ ID NO: 218522 - DNA, 22 bp, Artificial Sequence
  Synthetic oligonucleotide; CTG chr2 60506638 60506659 60506643 60506638 -
ctgggcacggtcgttttcttag

SEQ ID NO: 218523 - DNA, 22 bp, Artificial Sequence
  Synthetic oligonucleotide; CTG chr2 60506635 60506656 60506640 60506635 -
ggcacggtcgttttcttagtga

SEQ ID NO: 218524 - DNA, 22 bp, Artificial Sequence
  Synthetic oligonucleotide; TTT chr2 60506622 60506643 60506627 60506622 -
tcttagtgagctgcctttatca

SEQ ID NO: 218525 - DNA, 22 bp, Artificial Sequence
  Synthetic oligonucleotide; TTT chr2 60506621 60506642 60506626 60506621 -
cttagtgagctgcctttatcat

SEQ ID NO: 218526 - DNA, 22 bp, Artificial Sequence
  Synthetic oligonucleotide; TTC chr2 60506620 60506641 60506625 60506620 -
ttagtgagctgcctttatcatt

SEQ ID NO: 218527 - DNA, 22 bp, Artificial Sequence
  Synthetic oligonucleotide; CTT chr2 60506618 60506639 60506623 60506618 -
agtgagctgcctttatcattag

SEQ ID NO: 218528 - DNA, 22 bp, Artificial Sequence
  Synthetic oligonucleotide; TTA chr2 60506617 60506638 60506622 60506617 -
gtgagctgcctttatcattagc

SEQ ID NO: 218529 - DNA, 22 bp, Artificial Sequence
  Synthetic oligonucleotide; CTG chr2 60506609 60506630 60506614 60506609 -
cctttatcattagccctctaag

SEQ ID NO: 218530 - DNA, 22 bp, Artificial Sequence
  Synthetic oligonucleotide; CTT chr2 60506605 60506626 60506610 60506605 -
tatcattagccctctaagcagc

SEQ ID NO: 218531 - DNA, 22 bp, Artificial Sequence
  Synthetic oligonucleotide; TTT chr2 60506604 60506625 60506609 60506604 -
atcattagccctctaagcagcc

SEQ ID NO: 218532 - DNA, 22 bp, Artificial Sequence
  Synthetic oligonucleotide; TTA chr2 60506603 60506624 60506608 60506603 -
tcattagccctctaagcagcca

SEQ ID NO: 218533 - DNA, 22 bp, Artificial Sequence
  Synthetic oligonucleotide; TTA chr2 60506597 60506618 60506602 60506597 -
gccctctaagcagccatgcaca

SEQ ID NO: 218534 - DNA, 22 bp, Artificial Sequence
  Synthetic oligonucleotide; CTC chr2 60506591 60506612 60506596 60506591 -
taagcagccatgcacaaaggca

SEQ ID NO: 218535 - DNA, 22 bp, Artificial Sequence
  Synthetic oligonucleotide; CTA chr2 60506589 60506610 60506594 60506589 -
agcagccatgcacaaaggcacg

SEQ ID NO: 218536 - DNA, 22 bp, Artificial Sequence
  Synthetic oligonucleotide; CTG chr2 60506558 60506579 60506563 60506558 -
tgttttgtatagccagggcttt

SEQ ID NO: 218537 - DNA, 22 bp, Artificial Sequence
  Synthetic oligonucleotide; TTT chr2 60506553 60506574 60506558 60506553 -
tgtatagccagggctttcctgg

SEQ ID NO: 218538 - DNA, 22 bp, Artificial Sequence
  Synthetic oligonucleotide; TTT chr2 60506552 60506573 60506557 60506552 -
gtatagccagggctttcctgga

SEQ ID NO: 218539 - DNA, 22 bp, Artificial Sequence
  Synthetic oligonucleotide; TTG chr2 60506551 60506572 60506556 60506551 -
tatagccagggctttcctggac

SEQ ID NO: 218540 - DNA, 22 bp, Artificial Sequence
  Synthetic oligonucleotide; CTT chr2 60506537 60506558 60506542 60506537 -
tcctggactcagcatgccagct

SEQ ID NO: 218541 - DNA, 22 bp, Artificial Sequence
  Synthetic oligonucleotide; TTT chr2 60506536 60506557 60506541 60506536 -
cctggactcagcatgccagctg

SEQ ID NO: 218542 - DNA, 22 bp, Artificial Sequence
  Synthetic oligonucleotide; TTC chr2 60506535 60506556 60506540 60506535 -
ctggactcagcatgccagctgg

SEQ ID NO: 218543 - DNA, 22 bp, Artificial Sequence
  Synthetic oligonucleotide; CTG chr2 60506532 60506553 60506537 60506532 -
gactcagcatgccagctggggc

SEQ ID NO: 218544 - DNA, 22 bp, Artificial Sequence
  Synthetic oligonucleotide; CTC chr2 60506527 60506548 60506532 60506527 -
agcatgccagctggggccggct

SEQ ID NO: 218545 - DNA, 22 bp, Artificial Sequence
  Synthetic oligonucleotide; CTG chr2 60506514 60506535 60506519 60506514 -
gggccggctcactgaggctgga

SEQ ID NO: 218546 - DNA, 22 bp, Artificial Sequence
  Synthetic oligonucleotide; CTC chr2 60506504 60506525 60506509 60506504 -
actgaggctggaaaaatgagat

SEQ ID NO: 218547 - DNA, 22 bp, Artificial Sequence
  Synthetic oligonucleotide; CTG chr2 60506500 60506521 60506505 60506500 -
aggctggaaaaatgagatacag

SEQ ID NO: 218548 - DNA, 22 bp, Artificial Sequence
  Synthetic oligonucleotide; CTG chr2 60506494 60506515 60506499 60506494 -
gaaaaatgagatacagtctagt

SEQ ID NO: 218549 - DNA, 22 bp, Artificial Sequence
  Synthetic oligonucleotide; CTA chr2 60506474 60506495 60506479 60506474 -
gtgaggtctttgtcaccttgga

SEQ ID NO: 218550 - DNA, 22 bp, Artificial Sequence
  Synthetic oligonucleotide; CTT chr2 60506464 60506485 60506469 60506464 -
tgtcaccttggagggtctgagg

SEQ ID NO: 218551 - DNA, 22 bp, Artificial Sequence
  Synthetic oligonucleotide; TTT chr2 60506463 60506484 60506468 60506463 -
gtcaccttggagggtctgagga

SEQ ID NO: 218552 - DNA, 22 bp, Artificial Sequence
  Synthetic oligonucleotide; TTG chr2 60506462 60506483 60506467 60506462 -
tcaccttggagggtctgaggac

SEQ ID NO: 218553 - DNA, 22 bp, Artificial Sequence
  Synthetic oligonucleotide; CTT chr2 60506455 60506476 60506460 60506455 -
ggagggtctgaggactggtgcg

SEQ ID NO: 218554 - DNA, 22 bp, Artificial Sequence
  Synthetic oligonucleotide; TTG chr2 60506454 60506475 60506459 60506454 -
gagggtctgaggactggtgcgc

SEQ ID NO: 218555 - DNA, 22 bp, Artificial Sequence
  Synthetic oligonucleotide; CTG chr2 60506445 60506466 60506450 60506445 -
aggactggtgcgctcgggttga

SEQ ID NO: 218556 - DNA, 22 bp, Artificial Sequence
  Synthetic oligonucleotide; CTG chr2 60506438 60506459 60506443 60506438 -
gtgcgctcgggttgacccatgt

SEQ ID NO: 218557 - DNA, 22 bp, Artificial Sequence
  Synthetic oligonucleotide; CTC chr2 60506430 60506451 60506435 60506430 -
gggttgacccatgtggcgtcct

SEQ ID NO: 218558 - DNA, 22 bp, Artificial Sequence
  Synthetic oligonucleotide; TTG chr2 60506424 60506445 60506429 60506424 -
acccatgtggcgtcctgagcca

SEQ ID NO: 218559 - DNA, 22 bp, Artificial Sequence
  Synthetic oligonucleotide; CTG chr2 60506407 60506428 60506412 60506407 -
agccagctctgtcctggatctg

SEQ ID NO: 218560 - DNA, 22 bp, Artificial Sequence
  Synthetic oligonucleotide; CTC chr2 60506398 60506419 60506403 60506398 -
tgtcctggatctgaggaacact

SEQ ID NO: 218561 - DNA, 22 bp, Artificial Sequence
  Synthetic oligonucleotide; CTG chr2 60506396 60506417 60506401 60506396 -
tcctggatctgaggaacactgt

SEQ ID NO: 218562 - DNA, 22 bp, Artificial Sequence
  Synthetic oligonucleotide; CTG chr2 60506391 60506412 60506396 60506391 -
gatctgaggaacactgtctgaa

SEQ ID NO: 218563 - DNA, 22 bp, Artificial Sequence
  Synthetic oligonucleotide; CTG chr2 60506385 60506406 60506390 60506385 -
aggaacactgtctgaagttttc

SEQ ID NO: 218564 - DNA, 22 bp, Artificial Sequence
  Synthetic oligonucleotide; CTG chr2 60506375 60506396 60506380 60506375 -
tctgaagttttccaggggtttg

SEQ ID NO: 218565 - DNA, 22 bp, Artificial Sequence
  Synthetic oligonucleotide; CTG chr2 60506371 60506392 60506376 60506371 -
aagttttccaggggtttgacag

SEQ ID NO: 218566 - DNA, 22 bp, Artificial Sequence
  Synthetic oligonucleotide; TTT chr2 60506365 60506386 60506370 60506365 -
tccaggggtttgacagaccaga

SEQ ID NO: 218567 - DNA, 22 bp, Artificial Sequence
  Synthetic oligonucleotide; TTT chr2 60506364 60506385 60506369 60506364 -
ccaggggtttgacagaccagaa

SEQ ID NO: 218568 - DNA, 22 bp, Artificial Sequence
  Synthetic oligonucleotide; TTC chr2 60506363 60506384 60506368 60506363 -
caggggtttgacagaccagaat

SEQ ID NO: 218569 - DNA, 22 bp, Artificial Sequence
  Synthetic oligonucleotide; TTT chr2 60506354 60506375 60506359 60506354 -
gacagaccagaatgggggccgc

SEQ ID NO: 218570 - DNA, 22 bp, Artificial Sequence
  Synthetic oligonucleotide; TTG chr2 60506353 60506374 60506358 60506353 -
acagaccagaatgggggccgct

SEQ ID NO: 218571 - DNA, 22 bp, Artificial Sequence
  Synthetic oligonucleotide; CTG chr2 60506330 60506351 60506335 60506330 -
gcagggcctggtggcattagat

SEQ ID NO: 218572 - DNA, 22 bp, Artificial Sequence
  Synthetic oligonucleotide; CTG chr2 60506320 60506341 60506325 60506320 -
gtggcattagatgtggcaagtc

SEQ ID NO: 218573 - DNA, 22 bp, Artificial Sequence
  Synthetic oligonucleotide; TTA chr2 60506311 60506332 60506316 60506311 -
gatgtggcaagtcagaccacag

SEQ ID NO: 218574 - DNA, 22 bp, Artificial Sequence
  Synthetic oligonucleotide; CTG chr2 60506286 60506307 60506291 60506286 -
gcctgtgaaggtgactcttcct

SEQ ID NO: 218575 - DNA, 22 bp, Artificial Sequence
  Synthetic oligonucleotide; CTG chr2 60506281 60506302 60506286 60506281 -
tgaaggtgactcttcctctgat

SEQ ID NO: 218576 - DNA, 22 bp, Artificial Sequence
  Synthetic oligonucleotide; CTC chr2 60506269 60506290 60506274 60506269 -
ttcctctgatgcagagagaatt

SEQ ID NO: 218577 - DNA, 22 bp, Artificial Sequence
  Synthetic oligonucleotide; CTT chr2 60506267 60506288 60506272 60506267 -
cctctgatgcagagagaattaa

SEQ ID NO: 218578 - DNA, 22 bp, Artificial Sequence
  Synthetic oligonucleotide; TTC chr2 60506266 60506287 60506271 60506266 -
ctctgatgcagagagaattaaa

SEQ ID NO: 218579 - DNA, 22 bp, Artificial Sequence
  Synthetic oligonucleotide; CTC chr2 60506263 60506284 60506268 60506263 -
tgatgcagagagaattaaatga

SEQ ID NO: 218580 - DNA, 22 bp, Artificial Sequence
  Synthetic oligonucleotide; CTG chr2 60506261 60506282 60506266 60506261 -
atgcagagagaattaaatgagg

SEQ ID NO: 218581 - DNA, 22 bp, Artificial Sequence
  Synthetic oligonucleotide; TTA chr2 60506246 60506267 60506251 60506246 -
aatgaggaggccagagccctag

SEQ ID NO: 218582 - DNA, 22 bp, Artificial Sequence
  Synthetic oligonucleotide; CTA chr2 60506225 60506246 60506230 60506225 -
gctgctgcctcccctccatgcc

SEQ ID NO: 218583 - DNA, 22 bp, Artificial Sequence
  Synthetic oligonucleotide; CTG chr2 60506221 60506242 60506226 60506221 -
ctgcctcccctccatgccctca

SEQ ID NO: 218584 - DNA, 22 bp, Artificial Sequence
  Synthetic oligonucleotide; CTG chr2 60506218 60506239 60506223 60506218 -
cctcccctccatgccctcagag

SEQ ID NO: 218585 - DNA, 22 bp, Artificial Sequence
  Synthetic oligonucleotide; CTC chr2 60506214 60506235 60506219 60506214 -
ccctccatgccctcagagaaag

SEQ ID NO: 218586 - DNA, 22 bp, Artificial Sequence
  Synthetic oligonucleotide; CTC chr2 60506209 60506230 60506214 60506209 -
catgccctcagagaaagtggga

SEQ ID NO: 218587 - DNA, 22 bp, Artificial Sequence
  Synthetic oligonucleotide; CTC chr2 60506200 60506221 60506205 60506200 -
agagaaagtgggagtgctggca

SEQ ID NO: 218588 - DNA, 22 bp, Artificial Sequence
  Synthetic oligonucleotide; CTG chr2 60506181 60506202 60506186 60506181 -
gcatttggctaacaggacaggc

SEQ ID NO: 218589 - DNA, 22 bp, Artificial Sequence
  Synthetic oligonucleotide; TTT chr2 60506175 60506196 60506180 60506175 -
ggctaacaggacaggctatttt

SEQ ID NO: 218590 - DNA, 22 bp, Artificial Sequence
  Synthetic oligonucleotide; TTG chr2 60506174 60506195 60506179 60506174 -
gctaacaggacaggctattttg

SEQ ID NO: 218591 - DNA, 22 bp, Artificial Sequence
  Synthetic oligonucleotide; CTA chr2 60506170 60506191 60506175 60506170 -
acaggacaggctattttgggcc

SEQ ID NO: 218592 - DNA, 22 bp, Artificial Sequence
  Synthetic oligonucleotide; CTA chr2 60506157 60506178 60506162 60506157 -
ttttgggcccaggtgttctttc

SEQ ID NO: 218593 - DNA, 22 bp, Artificial Sequence
  Synthetic oligonucleotide; TTT chr2 60506154 60506175 60506159 60506154 -
tgggcccaggtgttctttctga

SEQ ID NO: 218594 - DNA, 22 bp, Artificial Sequence
  Synthetic oligonucleotide; TTT chr2 60506153 60506174 60506158 60506153 -
gggcccaggtgttctttctgac

SEQ ID NO: 218595 - DNA, 22 bp, Artificial Sequence
  Synthetic oligonucleotide; TTG chr2 60506152 60506173 60506157 60506152 -
ggcccaggtgttctttctgacc

SEQ ID NO: 218596 - DNA, 22 bp, Artificial Sequence
  Synthetic oligonucleotide; TTC chr2 60506139 60506160 60506144 60506139 -
tttctgacctctctgtgatttc

SEQ ID NO: 218597 - DNA, 22 bp, Artificial Sequence
  Synthetic oligonucleotide; CTT chr2 60506137 60506158 60506142 60506137 -
tctgacctctctgtgatttcta

SEQ ID NO: 218598 - DNA, 22 bp, Artificial Sequence
  Synthetic oligonucleotide; TTT chr2 60506136 60506157 60506141 60506136 -
ctgacctctctgtgatttctat

SEQ ID NO: 218599 - DNA, 22 bp, Artificial Sequence
  Synthetic oligonucleotide; TTC chr2 60506135 60506156 60506140 60506135 -
tgacctctctgtgatttctatg

SEQ ID NO: 218600 - DNA, 22 bp, Artificial Sequence
  Synthetic oligonucleotide; CTG chr2 60506133 60506154 60506138 60506133 -
acctctctgtgatttctatggt

SEQ ID NO: 218601 - DNA, 22 bp, Artificial Sequence
  Synthetic oligonucleotide; CTC chr2 60506128 60506149 60506133 60506128 -
tctgtgatttctatggtgggtg

SEQ ID NO: 218602 - DNA, 22 bp, Artificial Sequence
  Synthetic oligonucleotide; CTC chr2 60506126 60506147 60506131 60506126 -
tgtgatttctatggtgggtgtc

SEQ ID NO: 218603 - DNA, 22 bp, Artificial Sequence
  Synthetic oligonucleotide; CTG chr2 60506124 60506145 60506129 60506124 -
tgatttctatggtgggtgtcaa

SEQ ID NO: 218604 - DNA, 22 bp, Artificial Sequence
  Synthetic oligonucleotide; TTT chr2 60506118 60506139 60506123 60506118 -
ctatggtgggtgtcaaaggatg

SEQ ID NO: 218605 - DNA, 22 bp, Artificial Sequence
  Synthetic oligonucleotide; TTC chr2 60506117 60506138 60506122 60506117 -
tatggtgggtgtcaaaggatgg

SEQ ID NO: 218606 - DNA, 22 bp, Artificial Sequence
  Synthetic oligonucleotide; CTA chr2 60506115 60506136 60506120 60506115 -
tggtgggtgtcaaaggatggct

SEQ ID NO: 218607 - DNA, 22 bp, Artificial Sequence
  Synthetic oligonucleotide; CTG chr2 60506092 60506113 60506097 60506092 -
ggaaaggggatttttaggtgtg

SEQ ID NO: 218608 - DNA, 22 bp, Artificial Sequence
  Synthetic oligonucleotide; TTT chr2 60506079 60506100 60506084 60506079 -
ttaggtgtgctaacatcccttg

SEQ ID NO: 218609 - DNA, 22 bp, Artificial Sequence
  Synthetic oligonucleotide; TTT chr2 60506078 60506099 60506083 60506078 -
taggtgtgctaacatcccttgc

SEQ ID NO: 218610 - DNA, 22 bp, Artificial Sequence
  Synthetic oligonucleotide; TTT chr2 60506077 60506098 60506082 60506077 -
aggtgtgctaacatcccttgcc

SEQ ID NO: 218611 - DNA, 22 bp, Artificial Sequence
  Synthetic oligonucleotide; TTA chr2 60506076 60506097 60506081 60506076 -
ggtgtgctaacatcccttgcct

SEQ ID NO: 218612 - DNA, 22 bp, Artificial Sequence
  Synthetic oligonucleotide; CTA chr2 60506067 60506088 60506072 60506067 -
acatcccttgcctatgagtgat

SEQ ID NO: 218613 - DNA, 22 bp, Artificial Sequence
  Synthetic oligonucleotide; CTT chr2 60506058 60506079 60506063 60506058 -
gcctatgagtgattcactatct

SEQ ID NO: 218614 - DNA, 22 bp, Artificial Sequence
  Synthetic oligonucleotide; TTG chr2 60506057 60506078 60506062 60506057 -
cctatgagtgattcactatctt

SEQ ID NO: 218615 - DNA, 22 bp, Artificial Sequence
  Synthetic oligonucleotide; CTA chr2 60506053 60506074 60506058 60506053 -
tgagtgattcactatcttctcg

SEQ ID NO: 218616 - DNA, 22 bp, Artificial Sequence
  Synthetic oligonucleotide; TTC chr2 60506043 60506064 60506048 60506043 -
actatcttctcgcaccatctgg

SEQ ID NO: 218617 - DNA, 22 bp, Artificial Sequence
  Synthetic oligonucleotide; CTA chr2 60506039 60506060 60506044 60506039 -
tcttctcgcaccatctggtttc

SEQ ID NO: 218618 - DNA, 22 bp, Artificial Sequence
  Synthetic oligonucleotide; CTT chr2 60506035 60506056 60506040 60506035 -
ctcgcaccatctggtttcaccc

SEQ ID NO: 218619 - DNA, 22 bp, Artificial Sequence
  Synthetic oligonucleotide; TTC chr2 60506034 60506055 60506039 60506034 -
tcgcaccatctggtttcacccg

SEQ ID NO: 218620 - DNA, 22 bp, Artificial Sequence
  Synthetic oligonucleotide; CTC chr2 60506032 60506053 60506037 60506032 -
gcaccatctggtttcacccggg

SEQ ID NO: 218621 - DNA, 22 bp, Artificial Sequence
  Synthetic oligonucleotide; CTG chr2 60506022 60506043 60506027 60506022 -
gtttcacccgggctgcaaagcc

SEQ ID NO: 218622 - DNA, 22 bp, Artificial Sequence
  Synthetic oligonucleotide; TTT chr2 60506018 60506039 60506023 60506018 -
cacccgggctgcaaagcctagt

SEQ ID NO: 218623 - DNA, 22 bp, Artificial Sequence
  Synthetic oligonucleotide; TTC chr2 60506017 60506038 60506022 60506017 -
acccgggctgcaaagcctagtg

SEQ ID NO: 218624 - DNA, 22 bp, Artificial Sequence
  Synthetic oligonucleotide; CTG chr2 60506007 60506028 60506012 60506007 -
caaagcctagtgtggtgtccca

SEQ ID NO: 218625 - DNA, 22 bp, Artificial Sequence
  Synthetic oligonucleotide; CTA chr2 60505998 60506019 60506003 60505998 -
gtgtggtgtcccataccctgca

SEQ ID NO: 218626 - DNA, 22 bp, Artificial Sequence
  Synthetic oligonucleotide; CTG chr2 60505978 60505999 60505983 60505978 -
caaagccctatttgggttattt

SEQ ID NO: 218627 - DNA, 22 bp, Artificial Sequence
  Synthetic oligonucleotide; CTA chr2 60505968 60505989 60505973 60505968 -
tttgggttatttaccaaatgcc

SEQ ID NO: 218628 - DNA, 22 bp, Artificial Sequence
  Synthetic oligonucleotide; TTT chr2 60505965 60505986 60505970 60505965 -
gggttatttaccaaatgccacc

SEQ ID NO: 218629 - DNA, 22 bp, Artificial Sequence
  Synthetic oligonucleotide; TTG chr2 60505964 60505985 60505969 60505964 -
ggttatttaccaaatgccacca

SEQ ID NO: 218630 - DNA, 22 bp, Artificial Sequence
  Synthetic oligonucleotide; TTA chr2 60505959 60505980 60505964 60505959 -
tttaccaaatgccaccatgcca

SEQ ID NO: 218631 - DNA, 22 bp, Artificial Sequence
  Synthetic oligonucleotide; TTT chr2 60505956 60505977 60505961 60505956 -
accaaatgccaccatgccatct

SEQ ID NO: 218632 - DNA, 22 bp, Artificial Sequence
  Synthetic oligonucleotide; TTA chr2 60505955 60505976 60505960 60505955 -
ccaaatgccaccatgccatctc

SEQ ID NO: 218633 - DNA, 22 bp, Artificial Sequence
  Synthetic oligonucleotide; CTC chr2 60505933 60505954 60505938 60505933 -
cacagcatctggcagacgaacc

SEQ ID NO: 218634 - DNA, 22 bp, Artificial Sequence
  Synthetic oligonucleotide; CTG chr2 60505922 60505943 60505927 60505922 -
gcagacgaaccaggtggggctg

SEQ ID NO: 218635 - DNA, 22 bp, Artificial Sequence
  Synthetic oligonucleotide; CTG chr2 60505900 60505921 60505905 60505900 -
ctattgcttctgggtatttacg

SEQ ID NO: 218636 - DNA, 22 bp, Artificial Sequence
  Synthetic oligonucleotide; CTA chr2 60505897 60505918 60505902 60505897 -
ttgcttctgggtatttacggga

SEQ ID NO: 218637 - DNA, 22 bp, Artificial Sequence
  Synthetic oligonucleotide; TTG chr2 60505894 60505915 60505899 60505894 -
cttctgggtatttacgggatgc

SEQ ID NO: 218638 - DNA, 22 bp, Artificial Sequence
  Synthetic oligonucleotide; CTT chr2 60505891 60505912 60505896 60505891 -
ctgggtatttacgggatgcaga

SEQ ID NO: 218639 - DNA, 22 bp, Artificial Sequence
  Synthetic oligonucleotide; TTC chr2 60505890 60505911 60505895 60505890 -
tgggtatttacgggatgcagat

SEQ ID NO: 218640 - DNA, 22 bp, Artificial Sequence
  Synthetic oligonucleotide; CTG chr2 60505888 60505909 60505893 60505888 -
ggtatttacgggatgcagattt

SEQ ID NO: 218641 - DNA, 22 bp, Artificial Sequence
  Synthetic oligonucleotide; TTT chr2 60505881 60505902 60505886 60505881 -
acgggatgcagatttttctgcc

SEQ ID NO: 218642 - DNA, 22 bp, Artificial Sequence
  Synthetic oligonucleotide; TTA chr2 60505880 60505901 60505885 60505880 -
cgggatgcagatttttctgccc

SEQ ID NO: 218643 - DNA, 22 bp, Artificial Sequence
  Synthetic oligonucleotide; TTT chr2 60505866 60505887 60505871 60505866 -
ttctgcccaccgttgttttggg

SEQ ID NO: 218644 - DNA, 22 bp, Artificial Sequence
  Synthetic oligonucleotide; TTT chr2 60505865 60505886 60505870 60505865 -
tctgcccaccgttgttttggga

SEQ ID NO: 218645 - DNA, 22 bp, Artificial Sequence
  Synthetic oligonucleotide; TTT chr2 60505864 60505885 60505869 60505864 -
ctgcccaccgttgttttgggag

SEQ ID NO: 218646 - DNA, 22 bp, Artificial Sequence
  Synthetic oligonucleotide; TTC chr2 60505863 60505884 60505868 60505863 -
tgcccaccgttgttttgggagg

SEQ ID NO: 218647 - DNA, 22 bp, Artificial Sequence
  Synthetic oligonucleotide; CTG chr2 60505861 60505882 60505866 60505861 -
cccaccgttgttttgggaggga

SEQ ID NO: 218648 - DNA, 22 bp, Artificial Sequence
  Synthetic oligonucleotide; TTG chr2 60505851 60505872 60505856 60505851 -
ttttgggagggatttccccctc

SEQ ID NO: 218649 - DNA, 22 bp, Artificial Sequence
  Synthetic oligonucleotide; TTT chr2 60505848 60505869 60505853 60505848 -
tgggagggatttccccctccct

SEQ ID NO: 218650 - DNA, 22 bp, Artificial Sequence
  Synthetic oligonucleotide; TTT chr2 60505847 60505868 60505852 60505847 -
gggagggatttccccctccctc

SEQ ID NO: 218651 - DNA, 22 bp, Artificial Sequence
  Synthetic oligonucleotide; TTG chr2 60505846 60505867 60505851 60505846 -
ggagggatttccccctccctca

SEQ ID NO: 218652 - DNA, 22 bp, Artificial Sequence
  Synthetic oligonucleotide; TTT chr2 60505836 60505857 60505841 60505836 -
ccccctccctcaggtagagttg

SEQ ID NO: 218653 - DNA, 22 bp, Artificial Sequence
  Synthetic oligonucleotide; TTC chr2 60505835 60505856 60505840 60505835 -
cccctccctcaggtagagttgt

SEQ ID NO: 218654 - DNA, 22 bp, Artificial Sequence
  Synthetic oligonucleotide; CTC chr2 60505829 60505850 60505834 60505829 -
cctcaggtagagttgttctcag

SEQ ID NO: 218655 - DNA, 22 bp, Artificial Sequence
  Synthetic oligonucleotide; CTC chr2 60505825 60505846 60505830 60505825 -
aggtagagttgttctcagagat

SEQ ID NO: 218656 - DNA, 22 bp, Artificial Sequence
  Synthetic oligonucleotide; TTG chr2 60505814 60505835 60505819 60505814 -
ttctcagagatatctgtaattg

SEQ ID NO: 218657 - DNA, 22 bp, Artificial Sequence
  Synthetic oligonucleotide; TTC chr2 60505811 60505832 60505816 60505811 -
tcagagatatctgtaattggcc

SEQ ID NO: 218658 - DNA, 22 bp, Artificial Sequence
  Synthetic oligonucleotide; CTC chr2 60505809 60505830 60505814 60505809 -
agagatatctgtaattggccct

SEQ ID NO: 218659 - DNA, 22 bp, Artificial Sequence
  Synthetic oligonucleotide; CTG chr2 60505798 60505819 60505803 60505798 -
taattggcccttcccatttaag

SEQ ID NO: 218660 - DNA, 22 bp, Artificial Sequence
  Synthetic oligonucleotide; TTG chr2 60505792 60505813 60505797 60505792 -
gcccttcccatttaagagtcag

SEQ ID NO: 218661 - DNA, 22 bp, Artificial Sequence
  Synthetic oligonucleotide; CTT chr2 60505786 60505807 60505791 60505786 -
cccatttaagagtcagccacga

SEQ ID NO: 218662 - DNA, 22 bp, Artificial Sequence
  Synthetic oligonucleotide; TTC chr2 60505785 60505806 60505790 60505785 -
ccatttaagagtcagccacgaa

SEQ ID NO: 218663 - DNA, 22 bp, Artificial Sequence
  Synthetic oligonucleotide; TTT chr2 60505779 60505800 60505784 60505779 -
aagagtcagccacgaatgattt

SEQ ID NO: 218664 - DNA, 22 bp, Artificial Sequence
  Synthetic oligonucleotide; TTA chr2 60505778 60505799 60505783 60505778 -
agagtcagccacgaatgattta

SEQ ID NO: 218665 - DNA, 22 bp, Artificial Sequence
  Synthetic oligonucleotide; TTT chr2 60505757 60505778 60505762 60505757 -
attctaaaatgatagacccagg

SEQ ID NO: 218666 - DNA, 22 bp, Artificial Sequence
  Synthetic oligonucleotide; TTA chr2 60505756 60505777 60505761 60505756 -
ttctaaaatgatagacccaggt

SEQ ID NO: 218667 - DNA, 22 bp, Artificial Sequence
  Synthetic oligonucleotide; TTC chr2 60505753 60505774 60505758 60505753 -
taaaatgatagacccaggtaga

SEQ ID NO: 218668 - DNA, 22 bp, Artificial Sequence
  Synthetic oligonucleotide; CTA chr2 60505751 60505772 60505756 60505751 -
aaatgatagacccaggtagaga

SEQ ID NO: 218669 - DNA, 22 bp, Artificial Sequence
  Synthetic oligonucleotide; TTA chr2 60505724 60505745 60505729 60505724 -
cccaccctccgtcacagagtgg

SEQ ID NO: 218670 - DNA, 22 bp, Artificial Sequence
  Synthetic oligonucleotide; CTC chr2 60505715 60505736 60505720 60505715 -
cgtcacagagtggccagctgtg

SEQ ID NO: 218671 - DNA, 22 bp, Artificial Sequence
  Synthetic oligonucleotide; CTG chr2 60505695 60505716 60505700 60505695 -
tgtcccctgcttccgggaggtg

SEQ ID NO: 218672 - DNA, 22 bp, Artificial Sequence
  Synthetic oligonucleotide; CTG chr2 60505686 60505707 60505691 60505686 -
cttccgggaggtgggaatgcat

SEQ ID NO: 218673 - DNA, 22 bp, Artificial Sequence
  Synthetic oligonucleotide; CTT chr2 60505683 60505704 60505688 60505683 -
ccgggaggtgggaatgcatgtg

SEQ ID NO: 218674 - DNA, 22 bp, Artificial Sequence
  Synthetic oligonucleotide; TTC chr2 60505682 60505703 60505687 60505682 -
cgggaggtgggaatgcatgtgg

SEQ ID NO: 218675 - DNA, 22 bp, Artificial Sequence
  Synthetic oligonucleotide; TTA chr2 60505649 60505670 60505654 60505649 -
tttcctaactctcttgctctgg

SEQ ID NO: 218676 - DNA, 22 bp, Artificial Sequence
  Synthetic oligonucleotide; TTT chr2 60505646 60505667 60505651 60505646 -
cctaactctcttgctctggcag

SEQ ID NO: 218677 - DNA, 22 bp, Artificial Sequence
  Synthetic oligonucleotide; TTC chr2 60505645 60505666 60505650 60505645 -
ctaactctcttgctctggcagc

SEQ ID NO: 218678 - DNA, 22 bp, Artificial Sequence
  Synthetic oligonucleotide; CTA chr2 60505642 60505663 60505647 60505642 -
actctcttgctctggcagcctg

SEQ ID NO: 218679 - DNA, 22 bp, Artificial Sequence
  Synthetic oligonucleotide; CTC chr2 60505638 60505659 60505643 60505638 -
tcttgctctggcagcctgaaga

SEQ ID NO: 218680 - DNA, 22 bp, Artificial Sequence
  Synthetic oligonucleotide; CTC chr2 60505636 60505657 60505641 60505636 -
ttgctctggcagcctgaagagc

SEQ ID NO: 218681 - DNA, 22 bp, Artificial Sequence
  Synthetic oligonucleotide; CTT chr2 60505634 60505655 60505639 60505634 -
gctctggcagcctgaagagctg

SEQ ID NO: 218682 - DNA, 22 bp, Artificial Sequence
  Synthetic oligonucleotide; TTG chr2 60505633 60505654 60505638 60505633 -
ctctggcagcctgaagagctgt

SEQ ID NO: 218683 - DNA, 22 bp, Artificial Sequence
  Synthetic oligonucleotide; CTC chr2 60505630 60505651 60505635 60505630 -
tggcagcctgaagagctgtctg

SEQ ID NO: 218684 - DNA, 22 bp, Artificial Sequence
  Synthetic oligonucleotide; CTG chr2 60505628 60505649 60505633 60505628 -
gcagcctgaagagctgtctgtg

SEQ ID NO: 218685 - DNA, 22 bp, Artificial Sequence
  Synthetic oligonucleotide; CTG chr2 60505620 60505641 60505625 60505620 -
aagagctgtctgtgccctgaac

SEQ ID NO: 218686 - DNA, 22 bp, Artificial Sequence
  Synthetic oligonucleotide; CTG chr2 60505612 60505633 60505617 60505612 -
tctgtgccctgaacaacagctt

SEQ ID NO: 218687 - DNA, 22 bp, Artificial Sequence
  Synthetic oligonucleotide; CTG chr2 60505608 60505629 60505613 60505608 -
tgccctgaacaacagcttaggg

SEQ ID NO: 218688 - DNA, 22 bp, Artificial Sequence
  Synthetic oligonucleotide; CTG chr2 60505601 60505622 60505606 60505601 -
aacaacagcttagggagctgga

SEQ ID NO: 218689 - DNA, 22 bp, Artificial Sequence
  Synthetic oligonucleotide; CTT chr2 60505590 60505611 60505595 60505590 -
agggagctggaggaaagagaag

SEQ ID NO: 218690 - DNA, 22 bp, Artificial Sequence
  Synthetic oligonucleotide; TTA chr2 60505589 60505610 60505594 60505589 -
gggagctggaggaaagagaagg

SEQ ID NO: 218691 - DNA, 22 bp, Artificial Sequence
  Synthetic oligonucleotide; CTG chr2 60505581 60505602 60505586 60505581 -
gaggaaagagaaggaggtatgc

SEQ ID NO: 218692 - DNA, 22 bp, Artificial Sequence
  Synthetic oligonucleotide; TTT chr2 60505555 60505576 60505560 60505555 -
gagggagagaggcccactgggt

SEQ ID NO: 218693 - DNA, 22 bp, Artificial Sequence
  Synthetic oligonucleotide; TTG chr2 60505554 60505575 60505559 60505554 -
agggagagaggcccactgggtt

SEQ ID NO: 218694 - DNA, 22 bp, Artificial Sequence
  Synthetic oligonucleotide; CTG chr2 60505536 60505557 60505541 60505536 -
ggttggacaagaaggtaaaaga

SEQ ID NO: 218695 - DNA, 22 bp, Artificial Sequence
  Synthetic oligonucleotide; TTG chr2 60505531 60505552 60505536 60505531 -
gacaagaaggtaaaagagggct

SEQ ID NO: 218696 - DNA, 22 bp, Artificial Sequence
  Synthetic oligonucleotide; CTG chr2 60505508 60505529 60505513 60505508 -
gtttggcccctaagggaaggac

SEQ ID NO: 218697 - DNA, 22 bp, Artificial Sequence
  Synthetic oligonucleotide; TTT chr2 60505504 60505525 60505509 60505504 -
ggcccctaagggaaggacagga

SEQ ID NO: 218698 - DNA, 22 bp, Artificial Sequence
  Synthetic oligonucleotide; TTG chr2 60505503 60505524 60505508 60505503 -
gcccctaagggaaggacaggaa

SEQ ID NO: 218699 - DNA, 22 bp, Artificial Sequence
  Synthetic oligonucleotide; CTA chr2 60505496 60505517 60505501 60505496 -
agggaaggacaggaaagcaccc

SEQ ID NO: 218700 - DNA, 22 bp, Artificial Sequence
  Synthetic oligonucleotide; CTT chr2 60505470 60505491 60505475 60505470 -
gttccctgtgtggatgcagtgt

SEQ ID NO: 218701 - DNA, 22 bp, Artificial Sequence
  Synthetic oligonucleotide; TTG chr2 60505469 60505490 60505474 60505469 -
ttccctgtgtggatgcagtgtt

SEQ ID NO: 218702 - DNA, 22 bp, Artificial Sequence
  Synthetic oligonucleotide; TTC chr2 60505466 60505487 60505471 60505466 -
cctgtgtggatgcagtgtttgt

SEQ ID NO: 218703 - DNA, 22 bp, Artificial Sequence
  Synthetic oligonucleotide; CTG chr2 60505462 60505483 60505467 60505462 -
tgtggatgcagtgtttgtccag

SEQ ID NO: 218704 - DNA, 22 bp, Artificial Sequence
  Synthetic oligonucleotide; TTT chr2 60505446 60505467 60505451 60505446 -
gtccagctgaaggcagcctcac

SEQ ID NO: 218705 - DNA, 22 bp, Artificial Sequence
  Synthetic oligonucleotide; TTG chr2 60505445 60505466 60505450 60505445 -
tccagctgaaggcagcctcact

SEQ ID NO: 218706 - DNA, 22 bp, Artificial Sequence
  Synthetic oligonucleotide; CTG chr2 60505437 60505458 60505442 60505437 -
aaggcagcctcactcggctgac

SEQ ID NO: 218707 - DNA, 22 bp, Artificial Sequence
  Synthetic oligonucleotide; CTC chr2 60505426 60505447 60505431 60505426 -
actcggctgactacctgatgag

SEQ ID NO: 218708 - DNA, 22 bp, Artificial Sequence
  Synthetic oligonucleotide; CTC chr2 60505422 60505443 60505427 60505422 -
ggctgactacctgatgagtgat

SEQ ID NO: 218709 - DNA, 22 bp, Artificial Sequence
  Synthetic oligonucleotide; CTG chr2 60505417 60505438 60505422 60505417 -
actacctgatgagtgattttcc

SEQ ID NO: 218710 - DNA, 22 bp, Artificial Sequence
  Synthetic oligonucleotide; CTA chr2 60505413 60505434 60505418 60505413 -
cctgatgagtgattttccccaa

SEQ ID NO: 218711 - DNA, 22 bp, Artificial Sequence
  Synthetic oligonucleotide; CTG chr2 60505409 60505430 60505414 60505409 -
atgagtgattttccccaagctg

SEQ ID NO: 218712 - DNA, 22 bp, Artificial Sequence
  Synthetic oligonucleotide; TTT chr2 60505398 60505419 60505403 60505398 -
tccccaagctgacagctgctcc

SEQ ID NO: 218713 - DNA, 22 bp, Artificial Sequence
  Synthetic oligonucleotide; TTT chr2 60505397 60505418 60505402 60505397 -
ccccaagctgacagctgctcca

SEQ ID NO: 218714 - DNA, 22 bp, Artificial Sequence
  Synthetic oligonucleotide; TTC chr2 60505396 60505417 60505401 60505396 -
cccaagctgacagctgctccaa

SEQ ID NO: 218715 - DNA, 22 bp, Artificial Sequence
  Synthetic oligonucleotide; CTG chr2 60505387 60505408 60505392 60505387 -
acagctgctccaacacatttca

SEQ ID NO: 218716 - DNA, 22 bp, Artificial Sequence
  Synthetic oligonucleotide; CTG chr2 60505380 60505401 60505385 60505380 -
ctccaacacatttcacctacaa

SEQ ID NO: 218717 - DNA, 22 bp, Artificial Sequence
  Synthetic oligonucleotide; CTC chr2 60505377 60505398 60505382 60505377 -
caacacatttcacctacaagtc

SEQ ID NO: 218718 - DNA, 22 bp, Artificial Sequence
  Synthetic oligonucleotide; TTT chr2 60505367 60505388 60505372 60505367 -
cacctacaagtcctgacaaagt

SEQ ID NO: 218719 - DNA, 22 bp, Artificial Sequence
  Synthetic oligonucleotide; TTC chr2 60505366 60505387 60505371 60505366 -
acctacaagtcctgacaaagtg

SEQ ID NO: 218720 - DNA, 22 bp, Artificial Sequence
  Synthetic oligonucleotide; CTA chr2 60505361 60505382 60505366 60505361 -
caagtcctgacaaagtggtgtg

SEQ ID NO: 218721 - DNA, 22 bp, Artificial Sequence
  Synthetic oligonucleotide; CTG chr2 60505352 60505373 60505357 60505352 -
acaaagtggtgtgttcttttgg

SEQ ID NO: 218722 - DNA, 22 bp, Artificial Sequence
  Synthetic oligonucleotide; TTC chr2 60505336 60505357 60505341 60505336 -
ttttggggctgttattactgca

SEQ ID NO: 218723 - DNA, 22 bp, Artificial Sequence
  Synthetic oligonucleotide; CTT chr2 60505334 60505355 60505339 60505334 -
ttggggctgttattactgcagc

SEQ ID NO: 218724 - DNA, 22 bp, Artificial Sequence
  Synthetic oligonucleotide; TTT chr2 60505333 60505354 60505338 60505333 -
tggggctgttattactgcagca

SEQ ID NO: 218725 - DNA, 22 bp, Artificial Sequence
  Synthetic oligonucleotide; TTT chr2 60505332 60505353 60505337 60505332 -
ggggctgttattactgcagcag

SEQ ID NO: 218726 - DNA, 22 bp, Artificial Sequence
  Synthetic oligonucleotide; TTG chr2 60505331 60505352 60505336 60505331 -
gggctgttattactgcagcagg

SEQ ID NO: 218727 - DNA, 22 bp, Artificial Sequence
  Synthetic oligonucleotide; CTG chr2 60505325 60505346 60505330 60505325 -
ttattactgcagcaggcatttg

SEQ ID NO: 218728 - DNA, 22 bp, Artificial Sequence
  Synthetic oligonucleotide; TTA chr2 60505322 60505343 60505327 60505322 -
ttactgcagcaggcatttggaa

SEQ ID NO: 218729 - DNA, 22 bp, Artificial Sequence
  Synthetic oligonucleotide; TTA chr2 60505319 60505340 60505324 60505319 -
ctgcagcaggcatttggaacaa

SEQ ID NO: 218730 - DNA, 22 bp, Artificial Sequence
  Synthetic oligonucleotide; CTG chr2 60505316 60505337 60505321 60505316 -
cagcaggcatttggaacaatct

SEQ ID NO: 218731 - DNA, 22 bp, Artificial Sequence
  Synthetic oligonucleotide; TTT chr2 60505304 60505325 60505309 60505304 -
ggaacaatctggaagaatgggg

SEQ ID NO: 218732 - DNA, 22 bp, Artificial Sequence
  Synthetic oligonucleotide; TTG chr2 60505303 60505324 60505308 60505303 -
gaacaatctggaagaatggggt

SEQ ID NO: 218733 - DNA, 22 bp, Artificial Sequence
  Synthetic oligonucleotide; CTG chr2 60505293 60505314 60505298 60505293 -
gaagaatggggtgccaaaggac

SEQ ID NO: 218734 - DNA, 22 bp, Artificial Sequence
  Synthetic oligonucleotide; CTT chr2 60505265 60505286 60505270 60505265 -
gaagccgtttctgagtatccgt

SEQ ID NO: 218735 - DNA, 22 bp, Artificial Sequence
  Synthetic oligonucleotide; TTG chr2 60505264 60505285 60505269 60505264 -
aagccgtttctgagtatccgtc

SEQ ID NO: 218736 - DNA, 22 bp, Artificial Sequence
  Synthetic oligonucleotide; TTT chr2 60505255 60505276 60505260 60505255 -
ctgagtatccgtcccttctttt

SEQ ID NO: 218737 - DNA, 22 bp, Artificial Sequence
  Synthetic oligonucleotide; TTC chr2 60505254 60505275 60505259 60505254 -
tgagtatccgtcccttcttttc

SEQ ID NO: 218738 - DNA, 22 bp, Artificial Sequence
  Synthetic oligonucleotide; CTG chr2 60505252 60505273 60505257 60505252 -
agtatccgtcccttcttttctc

SEQ ID NO: 218739 - DNA, 22 bp, Artificial Sequence
  Synthetic oligonucleotide; CTT chr2 60505238 60505259 60505243 60505238 -
cttttctctccgatcctctagc

SEQ ID NO: 218740 - DNA, 22 bp, Artificial Sequence
  Synthetic oligonucleotide; TTC chr2 60505237 60505258 60505242 60505237 -
ttttctctccgatcctctagct

SEQ ID NO: 218741 - DNA, 22 bp, Artificial Sequence
  Synthetic oligonucleotide; CTT chr2 60505235 60505256 60505240 60505235 -
ttctctccgatcctctagcttt

SEQ ID NO: 218742 - DNA, 22 bp, Artificial Sequence
  Synthetic oligonucleotide; TTT chr2 60505234 60505255 60505239 60505234 -
tctctccgatcctctagctttt

SEQ ID NO: 218743 - DNA, 22 bp, Artificial Sequence
  Synthetic oligonucleotide; TTT chr2 60505233 60505254 60505238 60505233 -
ctctccgatcctctagcttttt

SEQ ID NO: 218744 - DNA, 22 bp, Artificial Sequence
  Synthetic oligonucleotide; TTC chr2 60505232 60505253 60505237 60505232 -
tctccgatcctctagctttttt

SEQ ID NO: 218745 - DNA, 22 bp, Artificial Sequence
  Synthetic oligonucleotide; CTC chr2 60505230 60505251 60505235 60505230 -
tccgatcctctagcttttttgg

SEQ ID NO: 218746 - DNA, 22 bp, Artificial Sequence
  Synthetic oligonucleotide; CTC chr2 60505228 60505249 60505233 60505228 -
cgatcctctagcttttttggct

SEQ ID NO: 218747 - DNA, 22 bp, Artificial Sequence
  Synthetic oligonucleotide; CTC chr2 60505220 60505241 60505225 60505220 -
tagcttttttggcttatgaaaa

SEQ ID NO: 218748 - DNA, 22 bp, Artificial Sequence
  Synthetic oligonucleotide; CTA chr2 60505218 60505239 60505223 60505218 -
gcttttttggcttatgaaaaat

SEQ ID NO: 218749 - DNA, 22 bp, Artificial Sequence
  Synthetic oligonucleotide; CTT chr2 60505214 60505235 60505219 60505214 -
ttttggcttatgaaaaattggg

SEQ ID NO: 218750 - DNA, 22 bp, Artificial Sequence
  Synthetic oligonucleotide; TTT chr2 60505213 60505234 60505218 60505213 -
tttggcttatgaaaaattgggc

SEQ ID NO: 218751 - DNA, 22 bp, Artificial Sequence
  Synthetic oligonucleotide; TTT chr2 60505212 60505233 60505217 60505212 -
ttggcttatgaaaaattgggcc

SEQ ID NO: 218752 - DNA, 22 bp, Artificial Sequence
  Synthetic oligonucleotide; TTT chr2 60505211 60505232 60505216 60505211 -
tggcttatgaaaaattgggccc

SEQ ID NO: 218753 - DNA, 22 bp, Artificial Sequence
  Synthetic oligonucleotide; TTT chr2 60505210 60505231 60505215 60505210 -
ggcttatgaaaaattgggccca

SEQ ID NO: 218754 - DNA, 22 bp, Artificial Sequence
  Synthetic oligonucleotide; TTG chr2 60505209 60505230 60505214 60505209 -
gcttatgaaaaattgggcccat

SEQ ID NO: 218755 - DNA, 22 bp, Artificial Sequence
  Synthetic oligonucleotide; CTT chr2 60505205 60505226 60505210 60505205 -
atgaaaaattgggcccatccct

SEQ ID NO: 218756 - DNA, 22 bp, Artificial Sequence
  Synthetic oligonucleotide; TTA chr2 60505204 60505225 60505209 60505204 -
tgaaaaattgggcccatccctt

SEQ ID NO: 218757 - DNA, 22 bp, Artificial Sequence
  Synthetic oligonucleotide; TTG chr2 60505194 60505215 60505199 60505194 -
ggcccatccctttcgaatgtcc

SEQ ID NO: 218758 - DNA, 22 bp, Artificial Sequence
  Synthetic oligonucleotide; CTT chr2 60505182 60505203 60505187 60505182 -
tcgaatgtccattgtgctgtta

SEQ ID NO: 218759 - DNA, 22 bp, Artificial Sequence
  Synthetic oligonucleotide; TTT chr2 60505181 60505202 60505186 60505181 -
cgaatgtccattgtgctgttag

SEQ ID NO: 218760 - DNA, 22 bp, Artificial Sequence
  Synthetic oligonucleotide; TTC chr2 60505180 60505201 60505185 60505180 -
gaatgtccattgtgctgttagt

SEQ ID NO: 218761 - DNA, 22 bp, Artificial Sequence
  Synthetic oligonucleotide; TTG chr2 60505168 60505189 60505173 60505168 -
tgctgttagtaatgaggatacg

SEQ ID NO: 218762 - DNA, 22 bp, Artificial Sequence
  Synthetic oligonucleotide; CTG chr2 60505163 60505184 60505168 60505163 -
ttagtaatgaggatacggataa

SEQ ID NO: 218763 - DNA, 22 bp, Artificial Sequence
  Synthetic oligonucleotide; TTA chr2 60505160 60505181 60505165 60505160 -
gtaatgaggatacggataaaat

SEQ ID NO: 218764 - DNA, 22 bp, Artificial Sequence
  Synthetic oligonucleotide; TTT chr2 60505131 60505152 60505136 60505131 -
tttttttgagtaagccctttga

SEQ ID NO: 218765 - DNA, 22 bp, Artificial Sequence
  Synthetic oligonucleotide; TTT chr2 60505130 60505151 60505135 60505130 -
ttttttgagtaagccctttgag

SEQ ID NO: 218766 - DNA, 22 bp, Artificial Sequence
  Synthetic oligonucleotide; TTT chr2 60505129 60505150 60505134 60505129 -
tttttgagtaagccctttgagg

SEQ ID NO: 218767 - DNA, 22 bp, Artificial Sequence
  Synthetic oligonucleotide; TTT chr2 60505128 60505149 60505133 60505128 -
ttttgagtaagccctttgagga

SEQ ID NO: 218768 - DNA, 22 bp, Artificial Sequence
  Synthetic oligonucleotide; TTT chr2 60505127 60505148 60505132 60505127 -
tttgagtaagccctttgaggag

SEQ ID NO: 218769 - DNA, 22 bp, Artificial Sequence
  Synthetic oligonucleotide; TTT chr2 60505126 60505147 60505131 60505126 -
ttgagtaagccctttgaggagt

SEQ ID NO: 218770 - DNA, 22 bp, Artificial Sequence
  Synthetic oligonucleotide; TTT chr2 60505125 60505146 60505130 60505125 -
tgagtaagccctttgaggagta

SEQ ID NO: 218771 - DNA, 22 bp, Artificial Sequence
  Synthetic oligonucleotide; TTT chr2 60505124 60505145 60505129 60505124 -
gagtaagccctttgaggagtat

SEQ ID NO: 218772 - DNA, 22 bp, Artificial Sequence
  Synthetic oligonucleotide; TTG chr2 60505123 60505144 60505128 60505123 -
agtaagccctttgaggagtatt

SEQ ID NO: 218773 - DNA, 22 bp, Artificial Sequence
  Synthetic oligonucleotide; CTT chr2 60505112 60505133 60505117 60505112 -
tgaggagtattgtcaaattgag

SEQ ID NO: 218774 - DNA, 22 bp, Artificial Sequence
  Synthetic oligonucleotide; TTT chr2 60505111 60505132 60505116 60505111 -
gaggagtattgtcaaattgaga

SEQ ID NO: 218775 - DNA, 22 bp, Artificial Sequence
  Synthetic oligonucleotide; TTG chr2 60505110 60505131 60505115 60505110 -
aggagtattgtcaaattgagac

SEQ ID NO: 218776 - DNA, 22 bp, Artificial Sequence
  Synthetic oligonucleotide; TTG chr2 60505100 60505121 60505105 60505100 -
tcaaattgagactcacctcatg

SEQ ID NO: 218777 - DNA, 22 bp, Artificial Sequence
  Synthetic oligonucleotide; TTG chr2 60505092 60505113 60505097 60505092 -
agactcacctcatgagtaaccc

SEQ ID NO: 218778 - DNA, 22 bp, Artificial Sequence
  Synthetic oligonucleotide; CTC chr2 60505086 60505107 60505091 60505086 -
acctcatgagtaaccctgtgaa

SEQ ID NO: 218779 - DNA, 22 bp, Artificial Sequence
  Synthetic oligonucleotide; CTC chr2 60505081 60505102 60505086 60505081 -
atgagtaaccctgtgaagaggc

SEQ ID NO: 218780 - DNA, 22 bp, Artificial Sequence
  Synthetic oligonucleotide; CTG chr2 60505068 60505089 60505073 60505068 -
tgaagaggcaggagaaagggta

SEQ ID NO: 218781 - DNA, 22 bp, Artificial Sequence
  Synthetic oligonucleotide; TTG chr2 60505042 60505063 60505047 60505042 -
aagcttagagaggttaaatggc

SEQ ID NO: 218782 - DNA, 22 bp, Artificial Sequence
  Synthetic oligonucleotide; CTT chr2 60505036 60505057 60505041 60505036 -
agagaggttaaatggcaggtct

SEQ ID NO: 218783 - DNA, 22 bp, Artificial Sequence
  Synthetic oligonucleotide; TTA chr2 60505035 60505056 60505040 60505035 -
gagaggttaaatggcaggtctg

SEQ ID NO: 218784 - DNA, 22 bp, Artificial Sequence
  Synthetic oligonucleotide; TTA chr2 60505026 60505047 60505031 60505026 -
aatggcaggtctggtctcatgc

SEQ ID NO: 218785 - DNA, 22 bp, Artificial Sequence
  Synthetic oligonucleotide; CTG chr2 60505013 60505034 60505018 60505013 -
gtctcatgcagccgcaggggta

SEQ ID NO: 218786 - DNA, 22 bp, Artificial Sequence
  Synthetic oligonucleotide; CTC chr2 60505008 60505029 60505013 60505008 -
atgcagccgcaggggtagacta

SEQ ID NO: 218787 - DNA, 22 bp, Artificial Sequence
  Synthetic oligonucleotide; CTA chr2 60504986 60505007 60504991 60504986 -
gggattctgatccagaactcct

SEQ ID NO: 218788 - DNA, 22 bp, Artificial Sequence
  Synthetic oligonucleotide; TTC chr2 60504979 60505000 60504984 60504979 -
tgatccagaactccttatactt

SEQ ID NO: 218789 - DNA, 22 bp, Artificial Sequence
  Synthetic oligonucleotide; CTG chr2 60504977 60504998 60504982 60504977 -
atccagaactccttatacttct

SEQ ID NO: 218790 - DNA, 22 bp, Artificial Sequence
  Synthetic oligonucleotide; CTC chr2 60504966 60504987 60504971 60504966 -
cttatacttctgggtccacccc

SEQ ID NO: 218791 - DNA, 22 bp, Artificial Sequence
  Synthetic oligonucleotide; CTT chr2 60504963 60504984 60504968 60504963 -
atacttctgggtccaccccacg

SEQ ID NO: 218792 - DNA, 22 bp, Artificial Sequence
  Synthetic oligonucleotide; TTA chr2 60504962 60504983 60504967 60504962 -
tacttctgggtccaccccacgc

SEQ ID NO: 218793 - DNA, 22 bp, Artificial Sequence
  Synthetic oligonucleotide; CTT chr2 60504957 60504978 60504962 60504957 -
ctgggtccaccccacgcttcca

SEQ ID NO: 218794 - DNA, 22 bp, Artificial Sequence
  Synthetic oligonucleotide; TTC chr2 60504956 60504977 60504961 60504956 -
tgggtccaccccacgcttccac

SEQ ID NO: 218795 - DNA, 22 bp, Artificial Sequence
  Synthetic oligonucleotide; CTG chr2 60504954 60504975 60504959 60504954 -
ggtccaccccacgcttccacag

SEQ ID NO: 218796 - DNA, 22 bp, Artificial Sequence
  Synthetic oligonucleotide; CTT chr2 60504938 60504959 60504943 60504938 -
ccacagcctgcacacagggtag

SEQ ID NO: 218797 - DNA, 22 bp, Artificial Sequence
  Synthetic oligonucleotide; TTC chr2 60504937 60504958 60504942 60504937 -
cacagcctgcacacagggtagg

SEQ ID NO: 218798 - DNA, 22 bp, Artificial Sequence
  Synthetic oligonucleotide; CTG chr2 60504928 60504949 60504933 60504928 -
cacacagggtagggaagttgtg

SEQ ID NO: 218799 - DNA, 22 bp, Artificial Sequence
  Synthetic oligonucleotide; TTG chr2 60504908 60504929 60504913 60504908 -
tggcttgcagaaggctgttttt

SEQ ID NO: 218800 - DNA, 22 bp, Artificial Sequence
  Synthetic oligonucleotide; CTT chr2 60504902 60504923 60504907 60504902 -
gcagaaggctgtttttttgggg

SEQ ID NO: 218801 - DNA, 22 bp, Artificial Sequence
  Synthetic oligonucleotide; TTG chr2 60504901 60504922 60504906 60504901 -
cagaaggctgtttttttggggg

SEQ ID NO: 218802 - DNA, 22 bp, Artificial Sequence
  Synthetic oligonucleotide; CTG chr2 60504891 60504912 60504896 60504891 -
tttttttggggggacgctctgt

SEQ ID NO: 218803 - DNA, 22 bp, Artificial Sequence
  Synthetic oligonucleotide; TTT chr2 60504888 60504909 60504893 60504888 -
ttttggggggacgctctgtttt

SEQ ID NO: 218804 - DNA, 22 bp, Artificial Sequence
  Synthetic oligonucleotide; TTT chr2 60504887 60504908 60504892 60504887 -
tttggggggacgctctgtttta

SEQ ID NO: 218805 - DNA, 22 bp, Artificial Sequence
  Synthetic oligonucleotide; TTT chr2 60504886 60504907 60504891 60504886 -
ttggggggacgctctgttttaa

SEQ ID NO: 218806 - DNA, 22 bp, Artificial Sequence
  Synthetic oligonucleotide; TTT chr2 60504885 60504906 60504890 60504885 -
tggggggacgctctgttttaat

SEQ ID NO: 218807 - DNA, 22 bp, Artificial Sequence
  Synthetic oligonucleotide; TTT chr2 60504884 60504905 60504889 60504884 -
ggggggacgctctgttttaata

SEQ ID NO: 218808 - DNA, 22 bp, Artificial Sequence
  Synthetic oligonucleotide; TTG chr2 60504883 60504904 60504888 60504883 -
gggggacgctctgttttaatag

SEQ ID NO: 218809 - DNA, 22 bp, Artificial Sequence
  Synthetic oligonucleotide; CTC chr2 60504872 60504893 60504877 60504872 -
tgttttaatagtttggagcaag

SEQ ID NO: 218810 - DNA, 22 bp, Artificial Sequence
  Synthetic oligonucleotide; CTG chr2 60504870 60504891 60504875 60504870 -
ttttaatagtttggagcaagga

SEQ ID NO: 218811 - DNA, 22 bp, Artificial Sequence
  Synthetic oligonucleotide; TTT chr2 60504867 60504888 60504872 60504867 -
taatagtttggagcaaggaagc

SEQ ID NO: 218812 - DNA, 22 bp, Artificial Sequence
  Synthetic oligonucleotide; TTT chr2 60504866 60504887 60504871 60504866 -
aatagtttggagcaaggaagct

SEQ ID NO: 218813 - DNA, 22 bp, Artificial Sequence
  Synthetic oligonucleotide; TTA chr2 60504865 60504886 60504870 60504865 -
atagtttggagcaaggaagcta

SEQ ID NO: 218814 - DNA, 22 bp, Artificial Sequence
  Synthetic oligonucleotide; TTT chr2 60504858 60504879 60504863 60504858 -
ggagcaaggaagctagtggtgg

SEQ ID NO: 218815 - DNA, 22 bp, Artificial Sequence
  Synthetic oligonucleotide; TTG chr2 60504857 60504878 60504862 60504857 -
gagcaaggaagctagtggtggg

SEQ ID NO: 218816 - DNA, 22 bp, Artificial Sequence
  Synthetic oligonucleotide; CTA chr2 60504843 60504864 60504848 60504843 -
gtggtgggcgctcactggtagg

SEQ ID NO: 218817 - DNA, 22 bp, Artificial Sequence
  Synthetic oligonucleotide; CTC chr2 60504830 60504851 60504835 60504830 -
actggtaggggaggcatgtgat

SEQ ID NO: 218818 - DNA, 22 bp, Artificial Sequence
  Synthetic oligonucleotide; CTG chr2 60504826 60504847 60504831 60504826 -
gtaggggaggcatgtgatagga

SEQ ID NO: 218819 - DNA, 22 bp, Artificial Sequence
  Synthetic oligonucleotide; TTT chr2 60504796 60504817 60504801 60504796 -
gatcttttaagcattttcaggg

SEQ ID NO: 218820 - DNA, 22 bp, Artificial Sequence
  Synthetic oligonucleotide; TTG chr2 60504795 60504816 60504800 60504795 -
atcttttaagcattttcaggga

SEQ ID NO: 218821 - DNA, 22 bp, Artificial Sequence
  Synthetic oligonucleotide; CTT chr2 60504790 60504811 60504795 60504790 -
ttaagcattttcagggacagat

SEQ ID NO: 218822 - DNA, 22 bp, Artificial Sequence
  Synthetic oligonucleotide; TTT chr2 60504789 60504810 60504794 60504789 -
taagcattttcagggacagata

SEQ ID NO: 218823 - DNA, 22 bp, Artificial Sequence
  Synthetic oligonucleotide; TTT chr2 60504788 60504809 60504793 60504788 -
aagcattttcagggacagatat

SEQ ID NO: 218824 - DNA, 22 bp, Artificial Sequence
  Synthetic oligonucleotide; TTA chr2 60504787 60504808 60504792 60504787 -
agcattttcagggacagatatg

SEQ ID NO: 218825 - DNA, 22 bp, Artificial Sequence
  Synthetic oligonucleotide; TTT chr2 60504780 60504801 60504785 60504780 -
tcagggacagatatgtacctga

SEQ ID NO: 218826 - DNA, 22 bp, Artificial Sequence
  Synthetic oligonucleotide; TTT chr2 60504779 60504800 60504784 60504779 -
cagggacagatatgtacctgat

SEQ ID NO: 218827 - DNA, 22 bp, Artificial Sequence
  Synthetic oligonucleotide; TTC chr2 60504778 60504799 60504783 60504778 -
agggacagatatgtacctgata

SEQ ID NO: 218828 - DNA, 22 bp, Artificial Sequence
  Synthetic oligonucleotide; CTG chr2 60504759 60504780 60504764 60504759 -
atattccacctctctatataat

SEQ ID NO: 218829 - DNA, 22 bp, Artificial Sequence
  Synthetic oligonucleotide; TTC chr2 60504753 60504774 60504758 60504753 -
cacctctctatataatttcaag

SEQ ID NO: 218830 - DNA, 22 bp, Artificial Sequence
  Synthetic oligonucleotide; CTC chr2 60504747 60504768 60504752 60504747 -
tctatataatttcaagacttga

SEQ ID NO: 218831 - DNA, 22 bp, Artificial Sequence
  Synthetic oligonucleotide; CTC chr2 60504745 60504766 60504750 60504745 -
tatataatttcaagacttgatt

SEQ ID NO: 218832 - DNA, 22 bp, Artificial Sequence
  Synthetic oligonucleotide; CTA chr2 60504743 60504764 60504748 60504743 -
tataatttcaagacttgattgg

SEQ ID NO: 218833 - DNA, 22 bp, Artificial Sequence
  Synthetic oligonucleotide; TTT chr2 60504735 60504756 60504740 60504735 -
caagacttgattggcattgtcc

SEQ ID NO: 218834 - DNA, 22 bp, Artificial Sequence
  Synthetic oligonucleotide; TTC chr2 60504734 60504755 60504739 60504734 -
aagacttgattggcattgtccc

SEQ ID NO: 218835 - DNA, 22 bp, Artificial Sequence
  Synthetic oligonucleotide; CTT chr2 60504727 60504748 60504732 60504727 -
gattggcattgtccctaagcac

SEQ ID NO: 218836 - DNA, 22 bp, Artificial Sequence
  Synthetic oligonucleotide; TTG chr2 60504726 60504747 60504731 60504726 -
attggcattgtccctaagcacc

SEQ ID NO: 218837 - DNA, 22 bp, Artificial Sequence
  Synthetic oligonucleotide; TTG chr2 60504722 60504743 60504727 60504722 -
gcattgtccctaagcaccagta

SEQ ID NO: 218838 - DNA, 22 bp, Artificial Sequence
  Synthetic oligonucleotide; TTG chr2 60504716 60504737 60504721 60504716 -
tccctaagcaccagtagaaagc

SEQ ID NO: 218839 - DNA, 22 bp, Artificial Sequence
  Synthetic oligonucleotide; CTA chr2 60504710 60504731 60504715 60504710 -
agcaccagtagaaagcttgaag

SEQ ID NO: 218840 - DNA, 22 bp, Artificial Sequence
  Synthetic oligonucleotide; CTT chr2 60504692 60504713 60504697 60504692 -
gaagaagcttctcagtaaatac

SEQ ID NO: 218841 - DNA, 22 bp, Artificial Sequence
  Synthetic oligonucleotide; TTG chr2 60504691 60504712 60504696 60504691 -
aagaagcttctcagtaaataca

SEQ ID NO: 218842 - DNA, 22 bp, Artificial Sequence
  Synthetic oligonucleotide; CTT chr2 60504682 60504703 60504687 60504682 -
ctcagtaaatacatcagctgta

SEQ ID NO: 218843 - DNA, 22 bp, Artificial Sequence
  Synthetic oligonucleotide; TTC chr2 60504681 60504702 60504686 60504681 -
tcagtaaatacatcagctgtat

SEQ ID NO: 218844 - DNA, 22 bp, Artificial Sequence
  Synthetic oligonucleotide; CTC chr2 60504679 60504700 60504684 60504679 -
agtaaatacatcagctgtattt

SEQ ID NO: 218845 - DNA, 22 bp, Artificial Sequence
  Synthetic oligonucleotide; CTG chr2 60504662 60504683 60504667 60504662 -
tatttccaggtgagcagtacct

SEQ ID NO: 218846 - DNA, 22 bp, Artificial Sequence
  Synthetic oligonucleotide; TTT chr2 60504657 60504678 60504662 60504657 -
ccaggtgagcagtacctgctga

SEQ ID NO: 218847 - DNA, 22 bp, Artificial Sequence
  Synthetic oligonucleotide; TTC chr2 60504656 60504677 60504661 60504656 -
caggtgagcagtacctgctgaa

SEQ ID NO: 218848 - DNA, 22 bp, Artificial Sequence
  Synthetic oligonucleotide; CTG chr2 60504639 60504660 60504644 60504639 -
ctgaaatgctgagagaacgttc

SEQ ID NO: 218849 - DNA, 22 bp, Artificial Sequence
  Synthetic oligonucleotide; CTG chr2 60504636 60504657 60504641 60504636 -
aaatgctgagagaacgttctga

SEQ ID NO: 218850 - DNA, 22 bp, Artificial Sequence
  Synthetic oligonucleotide; CTG chr2 60504628 60504649 60504633 60504628 -
agagaacgttctgactaggagg

SEQ ID NO: 218851 - DNA, 22 bp, Artificial Sequence
  Synthetic oligonucleotide; TTC chr2 60504617 60504638 60504622 60504617 -
tgactaggagggcttgggggag

SEQ ID NO: 218852 - DNA, 22 bp, Artificial Sequence
  Synthetic oligonucleotide; CTG chr2 60504615 60504636 60504620 60504615 -
actaggagggcttgggggagac

SEQ ID NO: 218853 - DNA, 22 bp, Artificial Sequence
  Synthetic oligonucleotide; CTA chr2 60504611 60504632 60504616 60504611 -
ggagggcttgggggagacagag

SEQ ID NO: 218854 - DNA, 22 bp, Artificial Sequence
  Synthetic oligonucleotide; CTT chr2 60504602 60504623 60504607 60504602 -
gggggagacagagacagagttg

SEQ ID NO: 218855 - DNA, 22 bp, Artificial Sequence
  Synthetic oligonucleotide; TTG chr2 60504601 60504622 60504606 60504601 -
ggggagacagagacagagttgg

SEQ ID NO: 218856 - DNA, 22 bp, Artificial Sequence
  Synthetic oligonucleotide; TTG chr2 60504580 60504601 60504585 60504580 -
gctgtttcagcagactcattct

SEQ ID NO: 218857 - DNA, 22 bp, Artificial Sequence
  Synthetic oligonucleotide; CTG chr2 60504576 60504597 60504581 60504576 -
tttcagcagactcattctgcta

SEQ ID NO: 218858 - DNA, 22 bp, Artificial Sequence
  Synthetic oligonucleotide; TTT chr2 60504573 60504594 60504578 60504573 -
cagcagactcattctgctattt

SEQ ID NO: 218859 - DNA, 22 bp, Artificial Sequence
  Synthetic oligonucleotide; TTC chr2 60504572 60504593 60504577 60504572 -
agcagactcattctgctatttg

SEQ ID NO: 218860 - DNA, 22 bp, Artificial Sequence
  Synthetic oligonucleotide; CTC chr2 60504563 60504584 60504568 60504563 -
attctgctatttgctttttgcc

SEQ ID NO: 218861 - DNA, 22 bp, Artificial Sequence
  Synthetic oligonucleotide; TTC chr2 60504559 60504580 60504564 60504559 -
tgctatttgctttttgccttgg

SEQ ID NO: 218862 - DNA, 22 bp, Artificial Sequence
  Synthetic oligonucleotide; CTG chr2 60504557 60504578 60504562 60504557 -
ctatttgctttttgccttggag

SEQ ID NO: 218863 - DNA, 22 bp, Artificial Sequence
  Synthetic oligonucleotide; CTA chr2 60504554 60504575 60504559 60504554 -
tttgctttttgccttggagatt

SEQ ID NO: 218864 - DNA, 22 bp, Artificial Sequence
  Synthetic oligonucleotide; TTT chr2 60504551 60504572 60504556 60504551 -
gctttttgccttggagattatt

SEQ ID NO: 218865 - DNA, 22 bp, Artificial Sequence
  Synthetic oligonucleotide; TTG chr2 60504550 60504571 60504555 60504550 -
ctttttgccttggagattattt

SEQ ID NO: 218866 - DNA, 22 bp, Artificial Sequence
  Synthetic oligonucleotide; CTT chr2 60504547 60504568 60504552 60504547 -
tttgccttggagattatttttt

SEQ ID NO: 218867 - DNA, 22 bp, Artificial Sequence
  Synthetic oligonucleotide; TTT chr2 60504546 60504567 60504551 60504546 -
ttgccttggagattattttttc

SEQ ID NO: 218868 - DNA, 22 bp, Artificial Sequence
  Synthetic oligonucleotide; TTT chr2 60504545 60504566 60504550 60504545 -
tgccttggagattattttttct

SEQ ID NO: 218869 - DNA, 22 bp, Artificial Sequence
  Synthetic oligonucleotide; TTT chr2 60504544 60504565 60504549 60504544 -
gccttggagattattttttctg

SEQ ID NO: 218870 - DNA, 22 bp, Artificial Sequence
  Synthetic oligonucleotide; TTG chr2 60504543 60504564 60504548 60504543 -
ccttggagattattttttctgg

SEQ ID NO: 218871 - DNA, 22 bp, Artificial Sequence
  Synthetic oligonucleotide; CTT chr2 60504539 60504560 60504544 60504539 -
ggagattattttttctgggtgt

SEQ ID NO: 218872 - DNA, 22 bp, Artificial Sequence
  Synthetic oligonucleotide; TTG chr2 60504538 60504559 60504543 60504538 -
gagattattttttctgggtgtc

SEQ ID NO: 218873 - DNA, 22 bp, Artificial Sequence
  Synthetic oligonucleotide; TTA chr2 60504531 60504552 60504536 60504531 -
ttttttctgggtgtcccgatgc

SEQ ID NO: 218874 - DNA, 22 bp, Artificial Sequence
  Synthetic oligonucleotide; TTT chr2 60504528 60504549 60504533 60504528 -
tttctgggtgtcccgatgctga

SEQ ID NO: 218875 - DNA, 22 bp, Artificial Sequence
  Synthetic oligonucleotide; TTT chr2 60504527 60504548 60504532 60504527 -
ttctgggtgtcccgatgctgag

SEQ ID NO: 218876 - DNA, 22 bp, Artificial Sequence
  Synthetic oligonucleotide; TTT chr2 60504526 60504547 60504531 60504526 -
tctgggtgtcccgatgctgagc

SEQ ID NO: 218877 - DNA, 22 bp, Artificial Sequence
  Synthetic oligonucleotide; TTT chr2 60504525 60504546 60504530 60504525 -
ctgggtgtcccgatgctgagct

SEQ ID NO: 218878 - DNA, 22 bp, Artificial Sequence
  Synthetic oligonucleotide; TTC chr2 60504524 60504545 60504529 60504524 -
tgggtgtcccgatgctgagctc

SEQ ID NO: 218879 - DNA, 22 bp, Artificial Sequence
  Synthetic oligonucleotide; CTG chr2 60504522 60504543 60504527 60504522 -
ggtgtcccgatgctgagctccc

SEQ ID NO: 218880 - DNA, 22 bp, Artificial Sequence
  Synthetic oligonucleotide; CTG chr2 60504507 60504528 60504512 60504507 -
agctcccacttcaagaagaaca

SEQ ID NO: 218881 - DNA, 22 bp, Artificial Sequence
  Synthetic oligonucleotide; CTC chr2 60504502 60504523 60504507 60504502 -
ccacttcaagaagaacattggt

SEQ ID NO: 218882 - DNA, 22 bp, Artificial Sequence
  Synthetic oligonucleotide; CTT chr2 60504496 60504517 60504501 60504496 -
caagaagaacattggtataaat

SEQ ID NO: 218883 - DNA, 22 bp, Artificial Sequence
  Synthetic oligonucleotide; TTC chr2 60504495 60504516 60504500 60504495 -
aagaagaacattggtataaatt

SEQ ID NO: 218884 - DNA, 22 bp, Artificial Sequence
  Synthetic oligonucleotide; TTG chr2 60504482 60504503 60504487 60504482 -
gtataaatttacaaaccagaag

SEQ ID NO: 218885 - DNA, 22 bp, Artificial Sequence
  Synthetic oligonucleotide; TTT chr2 60504472 60504493 60504477 60504472 -
acaaaccagaagtagtcagagg

SEQ ID NO: 218886 - DNA, 22 bp, Artificial Sequence
  Synthetic oligonucleotide; TTA chr2 60504471 60504492 60504476 60504471 -
caaaccagaagtagtcagaggt

SEQ ID NO: 218887 - DNA, 22 bp, Artificial Sequence
  Synthetic oligonucleotide; TTG chr2 60504447 60504468 60504452 60504447 -
acttttttgttctgttattcct

SEQ ID NO: 218888 - DNA, 22 bp, Artificial Sequence
  Synthetic oligonucleotide; CTT chr2 60504443 60504464 60504448 60504443 -
ttttgttctgttattccttctt

SEQ ID NO: 218889 - DNA, 22 bp, Artificial Sequence
  Synthetic oligonucleotide; TTT chr2 60504442 60504463 60504447 60504442 -
tttgttctgttattccttcttt

SEQ ID NO: 218890 - DNA, 22 bp, Artificial Sequence
  Synthetic oligonucleotide; TTT chr2 60504441 60504462 60504446 60504441 -
ttgttctgttattccttctttg

SEQ ID NO: 218891 - DNA, 22 bp, Artificial Sequence
  Synthetic oligonucleotide; TTT chr2 60504440 60504461 60504445 60504440 -
tgttctgttattccttctttgg

SEQ ID NO: 218892 - DNA, 22 bp, Artificial Sequence
  Synthetic oligonucleotide; TTT chr2 60504439 60504460 60504444 60504439 -
gttctgttattccttctttggg

SEQ ID NO: 218893 - DNA, 22 bp, Artificial Sequence
  Synthetic oligonucleotide; TTG chr2 60504438 60504459 60504443 60504438 -
ttctgttattccttctttggga

SEQ ID NO: 218894 - DNA, 22 bp, Artificial Sequence
  Synthetic oligonucleotide; TTC chr2 60504435 60504456 60504440 60504435 -
tgttattccttctttgggagag

SEQ ID NO: 218895 - DNA, 22 bp, Artificial Sequence
  Synthetic oligonucleotide; CTG chr2 60504433 60504454 60504438 60504433 -
ttattccttctttgggagagca

SEQ ID NO: 218896 - DNA, 22 bp, Artificial Sequence
  Synthetic oligonucleotide; TTA chr2 60504430 60504451 60504435 60504430 -
ttccttctttgggagagcaggc

SEQ ID NO: 218897 - DNA, 22 bp, Artificial Sequence
  Synthetic oligonucleotide; TTC chr2 60504427 60504448 60504432 60504427 -
cttctttgggagagcaggctgg

SEQ ID NO: 218898 - DNA, 22 bp, Artificial Sequence
  Synthetic oligonucleotide; CTT chr2 60504424 60504445 60504429 60504424 -
ctttgggagagcaggctggcca

SEQ ID NO: 218899 - DNA, 22 bp, Artificial Sequence
  Synthetic oligonucleotide; TTC chr2 60504423 60504444 60504428 60504423 -
tttgggagagcaggctggccag

SEQ ID NO: 218900 - DNA, 22 bp, Artificial Sequence
  Synthetic oligonucleotide; CTT chr2 60504421 60504442 60504426 60504421 -
tgggagagcaggctggccagga

SEQ ID NO: 218901 - DNA, 22 bp, Artificial Sequence
  Synthetic oligonucleotide; TTT chr2 60504420 60504441 60504425 60504420 -
gggagagcaggctggccaggag

SEQ ID NO: 218902 - DNA, 22 bp, Artificial Sequence
  Synthetic oligonucleotide; TTG chr2 60504419 60504440 60504424 60504419 -
ggagagcaggctggccaggagg

SEQ ID NO: 218903 - DNA, 22 bp, Artificial Sequence
  Synthetic oligonucleotide; CTG chr2 60504406 60504427 60504411 60504406 -
gccaggaggaaggttcaagtgt

SEQ ID NO: 218904 - DNA, 22 bp, Artificial Sequence
  Synthetic oligonucleotide; TTC chr2 60504390 60504411 60504395 60504390 -
aagtgtgtcatatcctagcatt

SEQ ID NO: 218905 - DNA, 22 bp, Artificial Sequence
  Synthetic oligonucleotide; CTA chr2 60504373 60504394 60504378 60504373 -
gcattcagataggtggcctcct

SEQ ID NO: 218906 - DNA, 22 bp, Artificial Sequence
  Synthetic oligonucleotide; TTC chr2 60504367 60504388 60504372 60504367 -
agataggtggcctcctctgcct

SEQ ID NO: 218907 - DNA, 22 bp, Artificial Sequence
  Synthetic oligonucleotide; CTC chr2 60504353 60504374 60504358 60504353 -
ctctgccttttcagtgggtggc

SEQ ID NO: 218908 - DNA, 22 bp, Artificial Sequence
  Synthetic oligonucleotide; CTC chr2 60504350 60504371 60504355 60504350 -
tgccttttcagtgggtggctgg

SEQ ID NO: 218909 - DNA, 22 bp, Artificial Sequence
  Synthetic oligonucleotide; CTG chr2 60504348 60504369 60504353 60504348 -
ccttttcagtgggtggctgggc

SEQ ID NO: 218910 - DNA, 22 bp, Artificial Sequence
  Synthetic oligonucleotide; CTT chr2 60504344 60504365 60504349 60504344 -
ttcagtgggtggctgggctggg

SEQ ID NO: 218911 - DNA, 22 bp, Artificial Sequence
  Synthetic oligonucleotide; TTT chr2 60504343 60504364 60504348 60504343 -
tcagtgggtggctgggctgggt

SEQ ID NO: 218912 - DNA, 22 bp, Artificial Sequence
  Synthetic oligonucleotide; TTT chr2 60504342 60504363 60504347 60504342 -
cagtgggtggctgggctgggtg

SEQ ID NO: 218913 - DNA, 22 bp, Artificial Sequence
  Synthetic oligonucleotide; TTC chr2 60504341 60504362 60504346 60504341 -
agtgggtggctgggctgggtga

SEQ ID NO: 218914 - DNA, 22 bp, Artificial Sequence
  Synthetic oligonucleotide; CTG chr2 60504329 60504350 60504334 60504329 -
ggctgggtgaaatcttgcagtg

SEQ ID NO: 218915 - DNA, 22 bp, Artificial Sequence
  Synthetic oligonucleotide; CTG chr2 60504324 60504345 60504329 60504324 -
ggtgaaatcttgcagtgactaa

SEQ ID NO: 218916 - DNA, 22 bp, Artificial Sequence
  Synthetic oligonucleotide; CTT chr2 60504313 60504334 60504318 60504313 -
gcagtgactaagaaaggaaggg

SEQ ID NO: 218917 - DNA, 22 bp, Artificial Sequence
  Synthetic oligonucleotide; TTG chr2 60504312 60504333 60504317 60504312 -
cagtgactaagaaaggaagggt

SEQ ID NO: 218918 - DNA, 22 bp, Artificial Sequence
  Synthetic oligonucleotide; CTA chr2 60504303 60504324 60504308 60504303 -
agaaaggaagggtggacccagg

SEQ ID NO: 218919 - DNA, 22 bp, Artificial Sequence
  Synthetic oligonucleotide; CTG chr2 60504263 60504284 60504268 60504263 -
catcttcatcattgatcctgca

SEQ ID NO: 218920 - DNA, 22 bp, Artificial Sequence
  Synthetic oligonucleotide; CTT chr2 60504257 60504278 60504262 60504257 -
catcattgatcctgcatgcgtg

SEQ ID NO: 218921 - DNA, 22 bp, Artificial Sequence
  Synthetic oligonucleotide; TTC chr2 60504256 60504277 60504261 60504256 -
atcattgatcctgcatgcgtgc

SEQ ID NO: 218922 - DNA, 22 bp, Artificial Sequence
  Synthetic oligonucleotide; TTG chr2 60504249 60504270 60504254 60504249 -
atcctgcatgcgtgccggtagg

SEQ ID NO: 218923 - DNA, 22 bp, Artificial Sequence
  Synthetic oligonucleotide; CTG chr2 60504243 60504264 60504248 60504243 -
catgcgtgccggtaggcagcag

SEQ ID NO: 218924 - DNA, 22 bp, Artificial Sequence
  Synthetic oligonucleotide; TTC chr2 60504218 60504239 60504223 60504218 -
tggaattgctggggaaaccaca

SEQ ID NO: 218925 - DNA, 22 bp, Artificial Sequence
  Synthetic oligonucleotide; CTG chr2 60504216 60504237 60504221 60504216 -
gaattgctggggaaaccacagt

SEQ ID NO: 218926 - DNA, 22 bp, Artificial Sequence
  Synthetic oligonucleotide; TTG chr2 60504210 60504231 60504215 60504210 -
ctggggaaaccacagtgcagca

SEQ ID NO: 218927 - DNA, 22 bp, Artificial Sequence
  Synthetic oligonucleotide; CTG chr2 60504207 60504228 60504212 60504207 -
gggaaaccacagtgcagcatga

SEQ ID NO: 218928 - DNA, 22 bp, Artificial Sequence
  Synthetic oligonucleotide; CTG chr2 60504179 60504200 60504184 60504179 -
gggcctgctctcttgtgcccgg

SEQ ID NO: 218929 - DNA, 22 bp, Artificial Sequence
  Synthetic oligonucleotide; CTG chr2 60504172 60504193 60504177 60504172 -
ctctcttgtgcccggctgagca

SEQ ID NO: 218930 - DNA, 22 bp, Artificial Sequence
  Synthetic oligonucleotide; CTC chr2 60504169 60504190 60504174 60504169 -
tcttgtgcccggctgagcatct

SEQ ID NO: 218931 - DNA, 22 bp, Artificial Sequence
  Synthetic oligonucleotide; CTC chr2 60504167 60504188 60504172 60504167 -
ttgtgcccggctgagcatctct

SEQ ID NO: 218932 - DNA, 22 bp, Artificial Sequence
  Synthetic oligonucleotide; CTT chr2 60504165 60504186 60504170 60504165 -
gtgcccggctgagcatctctgt

SEQ ID NO: 218933 - DNA, 22 bp, Artificial Sequence
  Synthetic oligonucleotide; TTG chr2 60504164 60504185 60504169 60504164 -
tgcccggctgagcatctctgtt

SEQ ID NO: 218934 - DNA, 22 bp, Artificial Sequence
  Synthetic oligonucleotide; CTG chr2 60504154 60504175 60504159 60504154 -
agcatctctgttctgtttgggg

SEQ ID NO: 218935 - DNA, 22 bp, Artificial Sequence
  Synthetic oligonucleotide; CTC chr2 60504146 60504167 60504151 60504146 -
tgttctgtttggggagtcctgc

SEQ ID NO: 218936 - DNA, 22 bp, Artificial Sequence
  Synthetic oligonucleotide; CTG chr2 60504144 60504165 60504149 60504144 -
ttctgtttggggagtcctgcca

SEQ ID NO: 218937 - DNA, 22 bp, Artificial Sequence
  Synthetic oligonucleotide; TTC chr2 60504141 60504162 60504146 60504141 -
tgtttggggagtcctgccaggc

SEQ ID NO: 218938 - DNA, 22 bp, Artificial Sequence
  Synthetic oligonucleotide; CTG chr2 60504139 60504160 60504144 60504139 -
tttggggagtcctgccaggcaa

SEQ ID NO: 218939 - DNA, 22 bp, Artificial Sequence
  Synthetic oligonucleotide; TTT chr2 60504136 60504157 60504141 60504136 -
ggggagtcctgccaggcaagtg

SEQ ID NO: 218940 - DNA, 22 bp, Artificial Sequence
  Synthetic oligonucleotide; TTG chr2 60504135 60504156 60504140 60504135 -
gggagtcctgccaggcaagtgt

SEQ ID NO: 218941 - DNA, 22 bp, Artificial Sequence
  Synthetic oligonucleotide; CTG chr2 60504125 60504146 60504130 60504125 -
ccaggcaagtgtgagtcaaaga

SEQ ID NO: 218942 - DNA, 22 bp, Artificial Sequence
  Synthetic oligonucleotide; CTA chr2 60504087 60504108 60504092 60504087 -
tgtcatgggggcagtgtcggct

SEQ ID NO: 218943 - DNA, 22 bp, Artificial Sequence
  Synthetic oligonucleotide; CTG chr2 60504064 60504085 60504069 60504064 -
agtggtactcttcagagttctc

SEQ ID NO: 218944 - DNA, 22 bp, Artificial Sequence
  Synthetic oligonucleotide; CTC chr2 60504054 60504075 60504059 60504054 -
ttcagagttctcagaatgtgcc

SEQ ID NO: 218945 - DNA, 22 bp, Artificial Sequence
  Synthetic oligonucleotide; CTT chr2 60504052 60504073 60504057 60504052 -
cagagttctcagaatgtgccgc

SEQ ID NO: 218946 - DNA, 22 bp, Artificial Sequence
  Synthetic oligonucleotide; TTC chr2 60504051 60504072 60504056 60504051 -
agagttctcagaatgtgccgct

SEQ ID NO: 218947 - DNA, 22 bp, Artificial Sequence
  Synthetic oligonucleotide; TTC chr2 60504044 60504065 60504049 60504044 -
tcagaatgtgccgctcgaagcc

SEQ ID NO: 218948 - DNA, 22 bp, Artificial Sequence
  Synthetic oligonucleotide; CTC chr2 60504042 60504063 60504047 60504042 -
agaatgtgccgctcgaagccat

SEQ ID NO: 218949 - DNA, 22 bp, Artificial Sequence
  Synthetic oligonucleotide; CTC chr2 60504028 60504049 60504033 60504028 -
gaagccatgtaggcttccagca

SEQ ID NO: 218950 - DNA, 22 bp, Artificial Sequence
  Synthetic oligonucleotide; CTT chr2 60504012 60504033 60504017 60504012 -
ccagcaggcttctagcagatgg

SEQ ID NO: 218951 - DNA, 22 bp, Artificial Sequence
  Synthetic oligonucleotide; TTC chr2 60504011 60504032 60504016 60504011 -
cagcaggcttctagcagatggg

SEQ ID NO: 218952 - DNA, 22 bp, Artificial Sequence
  Synthetic oligonucleotide; CTT chr2 60504001 60504022 60504006 60504001 -
ctagcagatggggttttggctg

SEQ ID NO: 218953 - DNA, 22 bp, Artificial Sequence
  Synthetic oligonucleotide; TTC chr2 60504000 60504021 60504005 60504000 -
tagcagatggggttttggctgg

SEQ ID NO: 218954 - DNA, 22 bp, Artificial Sequence
  Synthetic oligonucleotide; CTA chr2 60503998 60504019 60504003 60503998 -
gcagatggggttttggctgggt

SEQ ID NO: 218955 - DNA, 22 bp, Artificial Sequence
  Synthetic oligonucleotide; TTT chr2 60503985 60504006 60503990 60503985 -
tggctgggttgggccttaatac

SEQ ID NO: 218956 - DNA, 22 bp, Artificial Sequence
  Synthetic oligonucleotide; TTT chr2 60503984 60504005 60503989 60503984 -
ggctgggttgggccttaatact

SEQ ID NO: 218957 - DNA, 22 bp, Artificial Sequence
  Synthetic oligonucleotide; TTG chr2 60503983 60504004 60503988 60503983 -
gctgggttgggccttaatactc

SEQ ID NO: 218958 - DNA, 22 bp, Artificial Sequence
  Synthetic oligonucleotide; CTG chr2 60503979 60504000 60503984 60503979 -
ggttgggccttaatactcagtg

SEQ ID NO: 218959 - DNA, 22 bp, Artificial Sequence
  Synthetic oligonucleotide; TTG chr2 60503974 60503995 60503979 60503974 -
ggccttaatactcagtgtcttt

SEQ ID NO: 218960 - DNA, 22 bp, Artificial Sequence
  Synthetic oligonucleotide; CTT chr2 60503968 60503989 60503973 60503968 -
aatactcagtgtctttcattcc

SEQ ID NO: 218961 - DNA, 22 bp, Artificial Sequence
  Synthetic oligonucleotide; TTA chr2 60503967 60503988 60503972 60503967 -
atactcagtgtctttcattccc

SEQ ID NO: 218962 - DNA, 22 bp, Artificial Sequence
  Synthetic oligonucleotide; CTC chr2 60503961 60503982 60503966 60503961 -
agtgtctttcattccctctctg

SEQ ID NO: 218963 - DNA, 22 bp, Artificial Sequence
  Synthetic oligonucleotide; CTT chr2 60503953 60503974 60503958 60503953 -
tcattccctctctgccccctcg

SEQ ID NO: 218964 - DNA, 22 bp, Artificial Sequence
  Synthetic oligonucleotide; TTT chr2 60503952 60503973 60503957 60503952 -
cattccctctctgccccctcgt

SEQ ID NO: 218965 - DNA, 22 bp, Artificial Sequence
  Synthetic oligonucleotide; TTC chr2 60503951 60503972 60503956 60503951 -
attccctctctgccccctcgtt

SEQ ID NO: 218966 - DNA, 22 bp, Artificial Sequence
  Synthetic oligonucleotide; TTC chr2 60503947 60503968 60503952 60503947 -
cctctctgccccctcgttcctt

SEQ ID NO: 218967 - DNA, 22 bp, Artificial Sequence
  Synthetic oligonucleotide; CTC chr2 60503943 60503964 60503948 60503943 -
tctgccccctcgttcctttcct

SEQ ID NO: 218968 - DNA, 22 bp, Artificial Sequence
  Synthetic oligonucleotide; CTC chr2 60503941 60503962 60503946 60503941 -
tgccccctcgttcctttcctgc

SEQ ID NO: 218969 - DNA, 22 bp, Artificial Sequence
  Synthetic oligonucleotide; CTG chr2 60503939 60503960 60503944 60503939 -
ccccctcgttcctttcctgcat

SEQ ID NO: 218970 - DNA, 22 bp, Artificial Sequence
  Synthetic oligonucleotide; CTC chr2 60503932 60503953 60503937 60503932 -
gttcctttcctgcatttcttgc

SEQ ID NO: 218971 - DNA, 22 bp, Artificial Sequence
  Synthetic oligonucleotide; TTC chr2 60503928 60503949 60503933 60503928 -
ctttcctgcatttcttgctttc

SEQ ID NO: 218972 - DNA, 22 bp, Artificial Sequence
  Synthetic oligonucleotide; CTT chr2 60503925 60503946 60503930 60503925 -
tcctgcatttcttgctttcttt

SEQ ID NO: 218973 - DNA, 22 bp, Artificial Sequence
  Synthetic oligonucleotide; TTT chr2 60503924 60503945 60503929 60503924 -
cctgcatttcttgctttctttt

SEQ ID NO: 218974 - DNA, 22 bp, Artificial Sequence
  Synthetic oligonucleotide; TTC chr2 60503923 60503944 60503928 60503923 -
ctgcatttcttgctttcttttt

SEQ ID NO: 218975 - DNA, 22 bp, Artificial Sequence
  Synthetic oligonucleotide; CTG chr2 60503920 60503941 60503925 60503920 -
catttcttgctttctttttttt

SEQ ID NO: 218976 - DNA, 22 bp, Artificial Sequence
  Synthetic oligonucleotide; TTT chr2 60503915 60503936 60503920 60503915 -
cttgctttcttttttttctaga

SEQ ID NO: 218977 - DNA, 22 bp, Artificial Sequence
  Synthetic oligonucleotide; TTC chr2 60503914 60503935 60503919 60503914 -
ttgctttcttttttttctagaa

SEQ ID NO: 218978 - DNA, 22 bp, Artificial Sequence
  Synthetic oligonucleotide; CTT chr2 60503912 60503933 60503917 60503912 -
gctttcttttttttctagaatc

SEQ ID NO: 218979 - DNA, 22 bp, Artificial Sequence
  Synthetic oligonucleotide; TTG chr2 60503911 60503932 60503916 60503911 -
ctttcttttttttctagaatca

SEQ ID NO: 218980 - DNA, 22 bp, Artificial Sequence
  Synthetic oligonucleotide; CTT chr2 60503908 60503929 60503913 60503908 -
tcttttttttctagaatcaacg

SEQ ID NO: 218981 - DNA, 22 bp, Artificial Sequence
  Synthetic oligonucleotide; TTT chr2 60503907 60503928 60503912 60503907 -
cttttttttctagaatcaacga

SEQ ID NO: 218982 - DNA, 22 bp, Artificial Sequence
  Synthetic oligonucleotide; TTC chr2 60503906 60503927 60503911 60503906 -
ttttttttctagaatcaacgaa

SEQ ID NO: 218983 - DNA, 22 bp, Artificial Sequence
  Synthetic oligonucleotide; CTT chr2 60503904 60503925 60503909 60503904 -
ttttttctagaatcaacgaagc

SEQ ID NO: 218984 - DNA, 22 bp, Artificial Sequence
  Synthetic oligonucleotide; TTT chr2 60503903 60503924 60503908 60503903 -
tttttctagaatcaacgaagca

SEQ ID NO: 218985 - DNA, 22 bp, Artificial Sequence
  Synthetic oligonucleotide; TTT chr2 60503902 60503923 60503907 60503902 -
ttttctagaatcaacgaagcag

SEQ ID NO: 218986 - DNA, 22 bp, Artificial Sequence
  Synthetic oligonucleotide; TTT chr2 60503901 60503922 60503906 60503901 -
tttctagaatcaacgaagcagc

SEQ ID NO: 218987 - DNA, 22 bp, Artificial Sequence
  Synthetic oligonucleotide; TTT chr2 60503900 60503921 60503905 60503900 -
ttctagaatcaacgaagcagcc

SEQ ID NO: 218988 - DNA, 22 bp, Artificial Sequence
  Synthetic oligonucleotide; TTT chr2 60503899 60503920 60503904 60503899 -
tctagaatcaacgaagcagcca

SEQ ID NO: 218989 - DNA, 22 bp, Artificial Sequence
  Synthetic oligonucleotide; TTT chr2 60503898 60503919 60503903 60503898 -
ctagaatcaacgaagcagccaa

SEQ ID NO: 218990 - DNA, 22 bp, Artificial Sequence
  Synthetic oligonucleotide; TTC chr2 60503897 60503918 60503902 60503897 -
tagaatcaacgaagcagccaat

SEQ ID NO: 218991 - DNA, 22 bp, Artificial Sequence
  Synthetic oligonucleotide; CTA chr2 60503895 60503916 60503900 60503895 -
gaatcaacgaagcagccaataa

SEQ ID NO: 218992 - DNA, 22 bp, Artificial Sequence
  Synthetic oligonucleotide; TTT chr2 60503866 60503887 60503871 60503866 -
tcaggaggtttagatgaatgtg

SEQ ID NO: 218993 - DNA, 22 bp, Artificial Sequence
  Synthetic oligonucleotide; TTT chr2 60503865 60503886 60503870 60503865 -
caggaggtttagatgaatgtga

SEQ ID NO: 218994 - DNA, 22 bp, Artificial Sequence
  Synthetic oligonucleotide; TTC chr2 60503864 60503885 60503869 60503864 -
aggaggtttagatgaatgtgaa

SEQ ID NO: 218995 - DNA, 22 bp, Artificial Sequence
  Synthetic oligonucleotide; TTT chr2 60503855 60503876 60503860 60503855 -
agatgaatgtgaattgctgttt

SEQ ID NO: 218996 - DNA, 22 bp, Artificial Sequence
  Synthetic oligonucleotide; TTA chr2 60503854 60503875 60503859 60503854 -
gatgaatgtgaattgctgttta

SEQ ID NO: 218997 - DNA, 22 bp, Artificial Sequence
  Synthetic oligonucleotide; TTG chr2 60503839 60503860 60503844 60503839 -
ctgtttaatataaaaattttat

SEQ ID NO: 218998 - DNA, 22 bp, Artificial Sequence
  Synthetic oligonucleotide; CTG chr2 60503836 60503857 60503841 60503836 -
tttaatataaaaattttattaa

SEQ ID NO: 218999 - DNA, 22 bp, Artificial Sequence
  Synthetic oligonucleotide; TTT chr2 60503833 60503854 60503838 60503833 -
aatataaaaattttattaaaat

SEQ ID NO: 219000 - DNA, 22 bp, Artificial Sequence
  Synthetic oligonucleotide; TTA chr2 60503832 60503853 60503837 60503832 -
atataaaaattttattaaaata

SEQ ID NO: 219001 - DNA, 22 bp, Artificial Sequence
  Synthetic oligonucleotide; TTT chr2 60503820 60503841 60503825 60503820 -
tattaaaataataaagctctga

SEQ ID NO: 219002 - DNA, 22 bp, Artificial Sequence
  Synthetic oligonucleotide; TTT chr2 60503819 60503840 60503824 60503819 -
attaaaataataaagctctgac

SEQ ID NO: 219003 - DNA, 22 bp, Artificial Sequence
  Synthetic oligonucleotide; TTA chr2 60503818 60503839 60503823 60503818 -
ttaaaataataaagctctgaca

SEQ ID NO: 219004 - DNA, 22 bp, Artificial Sequence
  Synthetic oligonucleotide; TTA chr2 60503815 60503836 60503820 60503815 -
aaataataaagctctgacaaaa

SEQ ID NO: 219005 - DNA, 22 bp, Artificial Sequence
  Synthetic oligonucleotide; CTC chr2 60503801 60503822 60503806 60503801 -
tgacaaaagatccagaatattg

SEQ ID NO: 219006 - DNA, 22 bp, Artificial Sequence
  Synthetic oligonucleotide; CTG chr2 60503799 60503820 60503804 60503799 -
acaaaagatccagaatattgtc

SEQ ID NO: 219007 - DNA, 22 bp, Artificial Sequence
  Synthetic oligonucleotide; TTG chr2 60503779 60503800 60503784 60503779 -
tcccttgcagtgggctttaggg

SEQ ID NO: 219008 - DNA, 22 bp, Artificial Sequence
  Synthetic oligonucleotide; CTT chr2 60503773 60503794 60503778 60503773 -
gcagtgggctttagggttgcat

SEQ ID NO: 219009 - DNA, 22 bp, Artificial Sequence
  Synthetic oligonucleotide; TTG chr2 60503772 60503793 60503777 60503772 -
cagtgggctttagggttgcatc

SEQ ID NO: 219010 - DNA, 22 bp, Artificial Sequence
  Synthetic oligonucleotide; CTT chr2 60503762 60503783 60503767 60503762 -
tagggttgcatcttggctccta

SEQ ID NO: 219011 - DNA, 22 bp, Artificial Sequence
  Synthetic oligonucleotide; TTT chr2 60503761 60503782 60503766 60503761 -
agggttgcatcttggctcctaa

SEQ ID NO: 219012 - DNA, 22 bp, Artificial Sequence
  Synthetic oligonucleotide; TTA chr2 60503760 60503781 60503765 60503760 -
gggttgcatcttggctcctaaa

SEQ ID NO: 219013 - DNA, 22 bp, Artificial Sequence
  Synthetic oligonucleotide; TTG chr2 60503754 60503775 60503759 60503754 -
catcttggctcctaaatcttct

SEQ ID NO: 219014 - DNA, 22 bp, Artificial Sequence
  Synthetic oligonucleotide; CTT chr2 60503748 60503769 60503753 60503748 -
ggctcctaaatcttctaggcgg

SEQ ID NO: 219015 - DNA, 22 bp, Artificial Sequence
  Synthetic oligonucleotide; TTG chr2 60503747 60503768 60503752 60503747 -
gctcctaaatcttctaggcggg

SEQ ID NO: 219016 - DNA, 22 bp, Artificial Sequence
  Synthetic oligonucleotide; CTC chr2 60503743 60503764 60503748 60503743 -
ctaaatcttctaggcgggttaa

SEQ ID NO: 219017 - DNA, 22 bp, Artificial Sequence
  Synthetic oligonucleotide; CTA chr2 60503740 60503761 60503745 60503740 -
aatcttctaggcgggttaaatt

SEQ ID NO: 219018 - DNA, 22 bp, Artificial Sequence
  Synthetic oligonucleotide; CTT chr2 60503734 60503755 60503739 60503734 -
ctaggcgggttaaattagtcct

SEQ ID NO: 219019 - DNA, 22 bp, Artificial Sequence
  Synthetic oligonucleotide; TTC chr2 60503733 60503754 60503738 60503733 -
taggcgggttaaattagtcctc

SEQ ID NO: 219020 - DNA, 22 bp, Artificial Sequence
  Synthetic oligonucleotide; CTA chr2 60503731 60503752 60503736 60503731 -
ggcgggttaaattagtcctcac

SEQ ID NO: 219021 - DNA, 22 bp, Artificial Sequence
  Synthetic oligonucleotide; TTA chr2 60503722 60503743 60503727 60503722 -
aattagtcctcacaaaatgtca

SEQ ID NO: 219022 - DNA, 22 bp, Artificial Sequence
  Synthetic oligonucleotide; TTA chr2 60503717 60503738 60503722 60503717 -
gtcctcacaaaatgtcacattt

SEQ ID NO: 219023 - DNA, 22 bp, Artificial Sequence
  Synthetic oligonucleotide; CTC chr2 60503711 60503732 60503716 60503711 -
acaaaatgtcacatttccctgg

SEQ ID NO: 219024 - DNA, 22 bp, Artificial Sequence
  Synthetic oligonucleotide; TTT chr2 60503695 60503716 60503700 60503695 -
ccctggcagctataggtttcca

SEQ ID NO: 219025 - DNA, 22 bp, Artificial Sequence
  Synthetic oligonucleotide; TTC chr2 60503694 60503715 60503699 60503694 -
cctggcagctataggtttccag

SEQ ID NO: 219026 - DNA, 22 bp, Artificial Sequence
  Synthetic oligonucleotide; CTG chr2 60503690 60503711 60503695 60503690 -
gcagctataggtttccaggagg

SEQ ID NO: 219027 - DNA, 22 bp, Artificial Sequence
  Synthetic oligonucleotide; CTA chr2 60503683 60503704 60503688 60503683 -
taggtttccaggagggtgaaca

SEQ ID NO: 219028 - DNA, 22 bp, Artificial Sequence
  Synthetic oligonucleotide; TTT chr2 60503676 60503697 60503681 60503676 -
ccaggagggtgaacaagggcca

SEQ ID NO: 219029 - DNA, 22 bp, Artificial Sequence
  Synthetic oligonucleotide; TTC chr2 60503675 60503696 60503680 60503675 -
caggagggtgaacaagggccat

SEQ ID NO: 219030 - DNA, 22 bp, Artificial Sequence
  Synthetic oligonucleotide; CTG chr2 60503650 60503671 60503655 60503650 -
ggtgtttgctgagggcttctca

SEQ ID NO: 219031 - DNA, 22 bp, Artificial Sequence
  Synthetic oligonucleotide; TTT chr2 60503643 60503664 60503648 60503643 -
gctgagggcttctcagtcctgg

SEQ ID NO: 219032 - DNA, 22 bp, Artificial Sequence
  Synthetic oligonucleotide; TTG chr2 60503642 60503663 60503647 60503642 -
ctgagggcttctcagtcctggg

SEQ ID NO: 219033 - DNA, 22 bp, Artificial Sequence
  Synthetic oligonucleotide; CTG chr2 60503639 60503660 60503644 60503639 -
agggcttctcagtcctgggtag

SEQ ID NO: 219034 - DNA, 22 bp, Artificial Sequence
  Synthetic oligonucleotide; CTT chr2 60503632 60503653 60503637 60503632 -
ctcagtcctgggtaggaactgc

SEQ ID NO: 219035 - DNA, 22 bp, Artificial Sequence
  Synthetic oligonucleotide; TTC chr2 60503631 60503652 60503636 60503631 -
tcagtcctgggtaggaactgct

SEQ ID NO: 219036 - DNA, 22 bp, Artificial Sequence
  Synthetic oligonucleotide; CTC chr2 60503629 60503650 60503634 60503629 -
agtcctgggtaggaactgctgg

SEQ ID NO: 219037 - DNA, 22 bp, Artificial Sequence
  Synthetic oligonucleotide; CTG chr2 60503622 60503643 60503627 60503622 -
ggtaggaactgctgggtgtgga

SEQ ID NO: 219038 - DNA, 22 bp, Artificial Sequence
  Synthetic oligonucleotide; CTG chr2 60503611 60503632 60503616 60503611 -
ctgggtgtggaaaccaccaagg

SEQ ID NO: 219039 - DNA, 22 bp, Artificial Sequence
  Synthetic oligonucleotide; CTG chr2 60503608 60503629 60503613 60503608 -
ggtgtggaaaccaccaaggctt

SEQ ID NO: 219040 - DNA, 22 bp, Artificial Sequence
  Synthetic oligonucleotide; CTT chr2 60503586 60503607 60503591 60503586 -
tgtaagcctgaaagagccactg

SEQ ID NO: 219041 - DNA, 22 bp, Artificial Sequence
  Synthetic oligonucleotide; TTT chr2 60503585 60503606 60503590 60503585 -
gtaagcctgaaagagccactgg

SEQ ID NO: 219042 - DNA, 22 bp, Artificial Sequence
  Synthetic oligonucleotide; TTG chr2 60503584 60503605 60503589 60503584 -
taagcctgaaagagccactggt

SEQ ID NO: 219043 - DNA, 22 bp, Artificial Sequence
  Synthetic oligonucleotide; CTG chr2 60503576 60503597 60503581 60503576 -
aaagagccactggtattgggag

SEQ ID NO: 219044 - DNA, 22 bp, Artificial Sequence
  Synthetic oligonucleotide; CTG chr2 60503564 60503585 60503569 60503564 -
gtattgggagcttggtctgcac

SEQ ID NO: 219045 - DNA, 22 bp, Artificial Sequence
  Synthetic oligonucleotide; TTG chr2 60503558 60503579 60503563 60503558 -
ggagcttggtctgcactcagac

SEQ ID NO: 219046 - DNA, 22 bp, Artificial Sequence
  Synthetic oligonucleotide; CTT chr2 60503551 60503572 60503556 60503551 -
ggtctgcactcagacctgagcg

SEQ ID NO: 219047 - DNA, 22 bp, Artificial Sequence
  Synthetic oligonucleotide; TTG chr2 60503550 60503571 60503555 60503550 -
gtctgcactcagacctgagcgc

SEQ ID NO: 219048 - DNA, 22 bp, Artificial Sequence
  Synthetic oligonucleotide; CTG chr2 60503545 60503566 60503550 60503545 -
cactcagacctgagcgccacac

SEQ ID NO: 219049 - DNA, 22 bp, Artificial Sequence
  Synthetic oligonucleotide; CTC chr2 60503540 60503561 60503545 60503540 -
agacctgagcgccacacattat

SEQ ID NO: 219050 - DNA, 22 bp, Artificial Sequence
  Synthetic oligonucleotide; CTG chr2 60503533 60503554 60503538 60503533 -
agcgccacacattattttccca

SEQ ID NO: 219051 - DNA, 22 bp, Artificial Sequence
  Synthetic oligonucleotide; TTA chr2 60503519 60503540 60503524 60503519 -
ttttcccagatttgggcaatct

SEQ ID NO: 219052 - DNA, 22 bp, Artificial Sequence
  Synthetic oligonucleotide; TTT chr2 60503516 60503537 60503521 60503516 -
tcccagatttgggcaatctaat

SEQ ID NO: 219053 - DNA, 22 bp, Artificial Sequence
  Synthetic oligonucleotide; TTT chr2 60503515 60503536 60503520 60503515 -
cccagatttgggcaatctaatg

SEQ ID NO: 219054 - DNA, 22 bp, Artificial Sequence
  Synthetic oligonucleotide; TTC chr2 60503514 60503535 60503519 60503514 -
ccagatttgggcaatctaatgg

SEQ ID NO: 219055 - DNA, 22 bp, Artificial Sequence
  Synthetic oligonucleotide; TTT chr2 60503506 60503527 60503511 60503506 -
gggcaatctaatggataggagg

SEQ ID NO: 219056 - DNA, 22 bp, Artificial Sequence
  Synthetic oligonucleotide; TTG chr2 60503505 60503526 60503510 60503505 -
ggcaatctaatggataggaggg

SEQ ID NO: 219057 - DNA, 22 bp, Artificial Sequence
  Synthetic oligonucleotide; CTA chr2 60503496 60503517 60503501 60503496 -
atggataggagggagggttatg

SEQ ID NO: 219058 - DNA, 22 bp, Artificial Sequence
  Synthetic oligonucleotide; TTA chr2 60503476 60503497 60503481 60503476 -
tgccccatctgtgaataggtgg

SEQ ID NO: 219059 - DNA, 22 bp, Artificial Sequence
  Synthetic oligonucleotide; CTG chr2 60503465 60503486 60503470 60503465 -
tgaataggtggaggagagggtc

SEQ ID NO: 219060 - DNA, 22 bp, Artificial Sequence
  Synthetic oligonucleotide; TTG chr2 60503431 60503452 60503436 60503431 -
ttgcagtgctcagaggaagcaa

SEQ ID NO: 219061 - DNA, 22 bp, Artificial Sequence
  Synthetic oligonucleotide; TTG chr2 60503428 60503449 60503433 60503428 -
cagtgctcagaggaagcaatag

SEQ ID NO: 219062 - DNA, 22 bp, Artificial Sequence
  Synthetic oligonucleotide; CTC chr2 60503420 60503441 60503425 60503420 -
agaggaagcaatagcctactgt

SEQ ID NO: 219063 - DNA, 22 bp, Artificial Sequence
  Synthetic oligonucleotide; CTA chr2 60503402 60503423 60503407 60503402 -
ctgtcttccagggacatgtctg

SEQ ID NO: 219064 - DNA, 22 bp, Artificial Sequence
  Synthetic oligonucleotide; CTG chr2 60503399 60503420 60503404 60503399 -
tcttccagggacatgtctggct

SEQ ID NO: 219065 - DNA, 22 bp, Artificial Sequence
  Synthetic oligonucleotide; CTT chr2 60503395 60503416 60503400 60503395 -
ccagggacatgtctggctcctg

SEQ ID NO: 219066 - DNA, 22 bp, Artificial Sequence
  Synthetic oligonucleotide; TTC chr2 60503394 60503415 60503399 60503394 -
cagggacatgtctggctcctgg

SEQ ID NO: 219067 - DNA, 22 bp, Artificial Sequence
  Synthetic oligonucleotide; CTG chr2 60503380 60503401 60503385 60503380 -
gctcctggaatgcctgtccagg

SEQ ID NO: 219068 - DNA, 22 bp, Artificial Sequence
  Synthetic oligonucleotide; CTC chr2 60503376 60503397 60503381 60503376 -
ctggaatgcctgtccaggctgc

SEQ ID NO: 219069 - DNA, 22 bp, Artificial Sequence
  Synthetic oligonucleotide; CTG chr2 60503373 60503394 60503378 60503373 -
gaatgcctgtccaggctgcggt

SEQ ID NO: 219070 - DNA, 22 bp, Artificial Sequence
  Synthetic oligonucleotide; CTG chr2 60503364 60503385 60503369 60503364 -
tccaggctgcggtgggtggcat

SEQ ID NO: 219071 - DNA, 22 bp, Artificial Sequence
  Synthetic oligonucleotide; CTG chr2 60503355 60503376 60503360 60503355 -
cggtgggtggcatgggtaaggg

SEQ ID NO: 219072 - DNA, 22 bp, Artificial Sequence
  Synthetic oligonucleotide; TTT chr2 60503330 60503351 60503335 60503330 -
ttaataaaaagtcacaatgcct

SEQ ID NO: 219073 - DNA, 22 bp, Artificial Sequence
  Synthetic oligonucleotide; TTT chr2 60503329 60503350 60503334 60503329 -
taataaaaagtcacaatgcctg

SEQ ID NO: 219074 - DNA, 22 bp, Artificial Sequence
  Synthetic oligonucleotide; TTT chr2 60503328 60503349 60503333 60503328 -
aataaaaagtcacaatgcctgg

SEQ ID NO: 219075 - DNA, 22 bp, Artificial Sequence
  Synthetic oligonucleotide; TTA chr2 60503327 60503348 60503332 60503327 -
ataaaaagtcacaatgcctgga

SEQ ID NO: 219076 - DNA, 22 bp, Artificial Sequence
  Synthetic oligonucleotide; CTG chr2 60503307 60503328 60503312 60503307 -
gagaagtgaggctccttgcagc

SEQ ID NO: 219077 - DNA, 22 bp, Artificial Sequence
  Synthetic oligonucleotide; CTC chr2 60503293 60503314 60503298 60503293 -
cttgcagccacctgccttttct

SEQ ID NO: 219078 - DNA, 22 bp, Artificial Sequence
  Synthetic oligonucleotide; CTT chr2 60503290 60503311 60503295 60503290 -
gcagccacctgccttttctgtc

SEQ ID NO: 219079 - DNA, 22 bp, Artificial Sequence
  Synthetic oligonucleotide; TTG chr2 60503289 60503310 60503294 60503289 -
cagccacctgccttttctgtct

SEQ ID NO: 219080 - DNA, 22 bp, Artificial Sequence
  Synthetic oligonucleotide; CTG chr2 60503279 60503300 60503284 60503279 -
ccttttctgtcttgggtctcct

SEQ ID NO: 219081 - DNA, 22 bp, Artificial Sequence
  Synthetic oligonucleotide; CTT chr2 60503275 60503296 60503280 60503275 -
ttctgtcttgggtctcctggtt

SEQ ID NO: 219082 - DNA, 22 bp, Artificial Sequence
  Synthetic oligonucleotide; TTT chr2 60503274 60503295 60503279 60503274 -
tctgtcttgggtctcctggttg

SEQ ID NO: 219083 - DNA, 22 bp, Artificial Sequence
  Synthetic oligonucleotide; TTT chr2 60503273 60503294 60503278 60503273 -
ctgtcttgggtctcctggttgg

SEQ ID NO: 219084 - DNA, 22 bp, Artificial Sequence
  Synthetic oligonucleotide; TTC chr2 60503272 60503293 60503277 60503272 -
tgtcttgggtctcctggttgga

SEQ ID NO: 219085 - DNA, 22 bp, Artificial Sequence
  Synthetic oligonucleotide; CTG chr2 60503270 60503291 60503275 60503270 -
tcttgggtctcctggttggacc

SEQ ID NO: 219086 - DNA, 22 bp, Artificial Sequence
  Synthetic oligonucleotide; CTT chr2 60503266 60503287 60503271 60503266 -
gggtctcctggttggaccccat

SEQ ID NO: 219087 - DNA, 22 bp, Artificial Sequence
  Synthetic oligonucleotide; TTG chr2 60503265 60503286 60503270 60503265 -
ggtctcctggttggaccccatt

SEQ ID NO: 219088 - DNA, 22 bp, Artificial Sequence
  Synthetic oligonucleotide; CTC chr2 60503259 60503280 60503264 60503259 -
ctggttggaccccattctggct

SEQ ID NO: 219089 - DNA, 22 bp, Artificial Sequence
  Synthetic oligonucleotide; CTG chr2 60503256 60503277 60503261 60503256 -
gttggaccccattctggctttc

SEQ ID NO: 219090 - DNA, 22 bp, Artificial Sequence
  Synthetic oligonucleotide; TTG chr2 60503252 60503273 60503257 60503252 -
gaccccattctggctttccacc

SEQ ID NO: 219091 - DNA, 22 bp, Artificial Sequence
  Synthetic oligonucleotide; TTC chr2 60503242 60503263 60503247 60503242 -
tggctttccacctggtcagagc

SEQ ID NO: 219092 - DNA, 22 bp, Artificial Sequence
  Synthetic oligonucleotide; CTG chr2 60503240 60503261 60503245 60503240 -
gctttccacctggtcagagcct

SEQ ID NO: 219093 - DNA, 22 bp, Artificial Sequence
  Synthetic oligonucleotide; CTT chr2 60503236 60503257 60503241 60503236 -
tccacctggtcagagcctcctg

SEQ ID NO: 219094 - DNA, 22 bp, Artificial Sequence
  Synthetic oligonucleotide; TTT chr2 60503235 60503256 60503240 60503235 -
ccacctggtcagagcctcctga

SEQ ID NO: 219095 - DNA, 22 bp, Artificial Sequence
  Synthetic oligonucleotide; TTC chr2 60503234 60503255 60503239 60503234 -
cacctggtcagagcctcctgag

SEQ ID NO: 219096 - DNA, 22 bp, Artificial Sequence
  Synthetic oligonucleotide; CTG chr2 60503228 60503249 60503233 60503228 -
gtcagagcctcctgaggctgca

SEQ ID NO: 219097 - DNA, 22 bp, Artificial Sequence
  Synthetic oligonucleotide; CTC chr2 60503217 60503238 60503222 60503217 -
ctgaggctgcagaatggggcta

SEQ ID NO: 219098 - DNA, 22 bp, Artificial Sequence
  Synthetic oligonucleotide; CTG chr2 60503214 60503235 60503219 60503214 -
aggctgcagaatggggctaaca

SEQ ID NO: 219099 - DNA, 22 bp, Artificial Sequence
  Synthetic oligonucleotide; CTG chr2 60503208 60503229 60503213 60503208 -
cagaatggggctaacatgatca

SEQ ID NO: 219100 - DNA, 22 bp, Artificial Sequence
  Synthetic oligonucleotide; CTA chr2 60503195 60503216 60503200 60503195 -
acatgatcaagggtgatgtggc

SEQ ID NO: 219101 - DNA, 22 bp, Artificial Sequence
  Synthetic oligonucleotide; CTT chr2 60503171 60503192 60503176 60503171 -
ctccatcttgggactaggagtg

SEQ ID NO: 219102 - DNA, 22 bp, Artificial Sequence
  Synthetic oligonucleotide; TTC chr2 60503170 60503191 60503175 60503170 -
tccatcttgggactaggagtga

SEQ ID NO: 219103 - DNA, 22 bp, Artificial Sequence
  Synthetic oligonucleotide; CTC chr2 60503168 60503189 60503173 60503168 -
catcttgggactaggagtgacc

SEQ ID NO: 219104 - DNA, 22 bp, Artificial Sequence
  Synthetic oligonucleotide; CTT chr2 60503162 60503183 60503167 60503162 -
gggactaggagtgaccaggttt

SEQ ID NO: 219105 - DNA, 22 bp, Artificial Sequence
  Synthetic oligonucleotide; TTG chr2 60503161 60503182 60503166 60503161 -
ggactaggagtgaccaggttta

SEQ ID NO: 219106 - DNA, 22 bp, Artificial Sequence
  Synthetic oligonucleotide; CTA chr2 60503155 60503176 60503160 60503155 -
ggagtgaccaggtttagagaag

SEQ ID NO: 219107 - DNA, 22 bp, Artificial Sequence
  Synthetic oligonucleotide; TTT chr2 60503140 60503161 60503145 60503140 -
agagaaggtggactcattcctg

SEQ ID NO: 219108 - DNA, 22 bp, Artificial Sequence
  Synthetic oligonucleotide; TTA chr2 60503139 60503160 60503144 60503139 -
gagaaggtggactcattcctgc

SEQ ID NO: 219109 - DNA, 22 bp, Artificial Sequence
  Synthetic oligonucleotide; CTC chr2 60503125 60503146 60503130 60503125 -
attcctgctcccattgccagga

SEQ ID NO: 219110 - DNA, 22 bp, Artificial Sequence
  Synthetic oligonucleotide; TTC chr2 60503121 60503142 60503126 60503121 -
ctgctcccattgccaggacaaa

SEQ ID NO: 219111 - DNA, 22 bp, Artificial Sequence
  Synthetic oligonucleotide; CTG chr2 60503118 60503139 60503123 60503118 -
ctcccattgccaggacaaatgc

SEQ ID NO: 219112 - DNA, 22 bp, Artificial Sequence
  Synthetic oligonucleotide; CTC chr2 60503115 60503136 60503120 60503115 -
ccattgccaggacaaatgcaga

SEQ ID NO: 219113 - DNA, 22 bp, Artificial Sequence
  Synthetic oligonucleotide; TTG chr2 60503109 60503130 60503114 60503109 -
ccaggacaaatgcagagtggat

SEQ ID NO: 219114 - DNA, 22 bp, Artificial Sequence
  Synthetic oligonucleotide; CTG chr2 60503084 60503105 60503089 60503084 -
ggtctgtcccttccacacagac

SEQ ID NO: 219115 - DNA, 22 bp, Artificial Sequence
  Synthetic oligonucleotide; CTG chr2 60503078 60503099 60503083 60503078 -
tcccttccacacagacaccttc

SEQ ID NO: 219116 - DNA, 22 bp, Artificial Sequence
  Synthetic oligonucleotide; CTT chr2 60503072 60503093 60503077 60503072 -
ccacacagacaccttcatttca

SEQ ID NO: 219117 - DNA, 22 bp, Artificial Sequence
  Synthetic oligonucleotide; TTC chr2 60503071 60503092 60503076 60503071 -
cacacagacaccttcatttcaa

SEQ ID NO: 219118 - DNA, 22 bp, Artificial Sequence
  Synthetic oligonucleotide; CTT chr2 60503057 60503078 60503062 60503057 -
catttcaacacattccgtgtgt

SEQ ID NO: 219119 - DNA, 22 bp, Artificial Sequence
  Synthetic oligonucleotide; TTC chr2 60503056 60503077 60503061 60503056 -
atttcaacacattccgtgtgta

SEQ ID NO: 219120 - DNA, 22 bp, Artificial Sequence
  Synthetic oligonucleotide; TTT chr2 60503052 60503073 60503057 60503052 -
caacacattccgtgtgtattaa

SEQ ID NO: 219121 - DNA, 22 bp, Artificial Sequence
  Synthetic oligonucleotide; TTC chr2 60503051 60503072 60503056 60503051 -
aacacattccgtgtgtattaag

SEQ ID NO: 219122 - DNA, 22 bp, Artificial Sequence
  Synthetic oligonucleotide; TTC chr2 60503042 60503063 60503047 60503042 -
cgtgtgtattaagatgacagac

SEQ ID NO: 219123 - DNA, 22 bp, Artificial Sequence
  Synthetic oligonucleotide; TTA chr2 60503031 60503052 60503036 60503031 -
agatgacagacacgttggtttt

SEQ ID NO: 219124 - DNA, 22 bp, Artificial Sequence
  Synthetic oligonucleotide; TTG chr2 60503014 60503035 60503019 60503014 -
gttttgctccaagccagtagcc

SEQ ID NO: 219125 - DNA, 22 bp, Artificial Sequence
  Synthetic oligonucleotide; TTT chr2 60503010 60503031 60503015 60503010 -
tgctccaagccagtagccatcc

SEQ ID NO: 219126 - DNA, 22 bp, Artificial Sequence
  Synthetic oligonucleotide; TTT chr2 60503009 60503030 60503014 60503009 -
gctccaagccagtagccatccc

SEQ ID NO: 219127 - DNA, 22 bp, Artificial Sequence
  Synthetic oligonucleotide; TTG chr2 60503008 60503029 60503013 60503008 -
ctccaagccagtagccatcccc

SEQ ID NO: 219128 - DNA, 22 bp, Artificial Sequence
  Synthetic oligonucleotide; CTC chr2 60503005 60503026 60503010 60503005 -
caagccagtagccatcccccta

SEQ ID NO: 219129 - DNA, 22 bp, Artificial Sequence
  Synthetic oligonucleotide; CTA chr2 60502983 60503004 60502988 60502983 -
gacagcccaggccttaaaagac

SEQ ID NO: 219130 - DNA, 22 bp, Artificial Sequence
  Synthetic oligonucleotide; CTT chr2 60502968 60502989 60502973 60502968 -
aaaagacaaggaggtgtttgga

SEQ ID NO: 219131 - DNA, 22 bp, Artificial Sequence
  Synthetic oligonucleotide; TTA chr2 60502967 60502988 60502972 60502967 -
aaagacaaggaggtgtttggac

SEQ ID NO: 219132 - DNA, 22 bp, Artificial Sequence
  Synthetic oligonucleotide; TTT chr2 60502949 60502970 60502954 60502949 -
ggacaagagcaagaaagaagtc

SEQ ID NO: 219133 - DNA, 22 bp, Artificial Sequence
  Synthetic oligonucleotide; TTG chr2 60502948 60502969 60502953 60502948 -
gacaagagcaagaaagaagtct

SEQ ID NO: 219134 - DNA, 22 bp, Artificial Sequence
  Synthetic oligonucleotide; CTG chr2 60502925 60502946 60502930 60502925 -
gctgtgtcttctgggagcccca

SEQ ID NO: 219135 - DNA, 22 bp, Artificial Sequence
  Synthetic oligonucleotide; CTG chr2 60502921 60502942 60502926 60502921 -
tgtcttctgggagccccagaca

SEQ ID NO: 219136 - DNA, 22 bp, Artificial Sequence
  Synthetic oligonucleotide; CTT chr2 60502915 60502936 60502920 60502915 -
ctgggagccccagacagaccag

SEQ ID NO: 219137 - DNA, 22 bp, Artificial Sequence
  Synthetic oligonucleotide; TTC chr2 60502914 60502935 60502919 60502914 -
tgggagccccagacagaccagt

SEQ ID NO: 219138 - DNA, 22 bp, Artificial Sequence
  Synthetic oligonucleotide; CTG chr2 60502912 60502933 60502917 60502912 -
ggagccccagacagaccagtgt

SEQ ID NO: 219139 - DNA, 22 bp, Artificial Sequence
  Synthetic oligonucleotide; TTC chr2 60502888 60502909 60502893 60502888 -
tttctcactggttcactccttc

SEQ ID NO: 219140 - DNA, 22 bp, Artificial Sequence
  Synthetic oligonucleotide; CTT chr2 60502886 60502907 60502891 60502886 -
tctcactggttcactccttccc

SEQ ID NO: 219141 - DNA, 22 bp, Artificial Sequence
  Synthetic oligonucleotide; TTT chr2 60502885 60502906 60502890 60502885 -
ctcactggttcactccttcccc

SEQ ID NO: 219142 - DNA, 22 bp, Artificial Sequence
  Synthetic oligonucleotide; TTC chr2 60502884 60502905 60502889 60502884 -
tcactggttcactccttcccca

SEQ ID NO: 219143 - DNA, 22 bp, Artificial Sequence
  Synthetic oligonucleotide; CTC chr2 60502882 60502903 60502887 60502882 -
actggttcactccttccccagc

SEQ ID NO: 219144 - DNA, 22 bp, Artificial Sequence
  Synthetic oligonucleotide; CTG chr2 60502878 60502899 60502883 60502878 -
gttcactccttccccagctcat

SEQ ID NO: 219145 - DNA, 22 bp, Artificial Sequence
  Synthetic oligonucleotide; TTC chr2 60502874 60502895 60502879 60502874 -
actccttccccagctcatttta

SEQ ID NO: 219146 - DNA, 22 bp, Artificial Sequence
  Synthetic oligonucleotide; CTC chr2 60502870 60502891 60502875 60502870 -
cttccccagctcattttaccca

SEQ ID NO: 219147 - DNA, 22 bp, Artificial Sequence
  Synthetic oligonucleotide; CTT chr2 60502867 60502888 60502872 60502867 -
ccccagctcattttacccactc

SEQ ID NO: 219148 - DNA, 22 bp, Artificial Sequence
  Synthetic oligonucleotide; TTC chr2 60502866 60502887 60502871 60502866 -
cccagctcattttacccactcg

SEQ ID NO: 219149 - DNA, 22 bp, Artificial Sequence
  Synthetic oligonucleotide; CTC chr2 60502858 60502879 60502863 60502858 -
attttacccactcgagacttga

SEQ ID NO: 219150 - DNA, 22 bp, Artificial Sequence
  Synthetic oligonucleotide; TTT chr2 60502854 60502875 60502859 60502854 -
tacccactcgagacttgattct

SEQ ID NO: 219151 - DNA, 22 bp, Artificial Sequence
  Synthetic oligonucleotide; TTT chr2 60502853 60502874 60502858 60502853 -
acccactcgagacttgattctc

SEQ ID NO: 219152 - DNA, 22 bp, Artificial Sequence
  Synthetic oligonucleotide; TTA chr2 60502852 60502873 60502857 60502852 -
cccactcgagacttgattctct

SEQ ID NO: 219153 - DNA, 22 bp, Artificial Sequence
  Synthetic oligonucleotide; CTC chr2 60502845 60502866 60502850 60502845 -
gagacttgattctcttagagat

SEQ ID NO: 219154 - DNA, 22 bp, Artificial Sequence
  Synthetic oligonucleotide; CTT chr2 60502838 60502859 60502843 60502838 -
gattctcttagagattaagtac

SEQ ID NO: 219155 - DNA, 22 bp, Artificial Sequence
  Synthetic oligonucleotide; TTG chr2 60502837 60502858 60502842 60502837 -
attctcttagagattaagtacc

SEQ ID NO: 219156 - DNA, 22 bp, Artificial Sequence
  Synthetic oligonucleotide; TTC chr2 60502833 60502854 60502838 60502833 -
tcttagagattaagtacctccc

SEQ ID NO: 219157 - DNA, 22 bp, Artificial Sequence
  Synthetic oligonucleotide; CTC chr2 60502831 60502852 60502836 60502831 -
ttagagattaagtacctcccct

SEQ ID NO: 219158 - DNA, 22 bp, Artificial Sequence
  Synthetic oligonucleotide; CTT chr2 60502829 60502850 60502834 60502829 -
agagattaagtacctcccctgg

SEQ ID NO: 219159 - DNA, 22 bp, Artificial Sequence
  Synthetic oligonucleotide; TTA chr2 60502828 60502849 60502833 60502828 -
gagattaagtacctcccctggt

SEQ ID NO: 219160 - DNA, 22 bp, Artificial Sequence
  Synthetic oligonucleotide; TTA chr2 60502821 60502842 60502826 60502821 -
agtacctcccctggtcacatag

SEQ ID NO: 219161 - DNA, 22 bp, Artificial Sequence
  Synthetic oligonucleotide; CTC chr2 60502813 60502834 60502818 60502813 -
ccctggtcacatagtttctggg

SEQ ID NO: 219162 - DNA, 22 bp, Artificial Sequence
  Synthetic oligonucleotide; CTG chr2 60502808 60502829 60502813 60502808 -
gtcacatagtttctgggtgaca

SEQ ID NO: 219163 - DNA, 22 bp, Artificial Sequence
  Synthetic oligonucleotide; TTT chr2 60502796 60502817 60502801 60502796 -
ctgggtgacaggactagaattt

SEQ ID NO: 219164 - DNA, 22 bp, Artificial Sequence
  Synthetic oligonucleotide; TTC chr2 60502795 60502816 60502800 60502795 -
tgggtgacaggactagaattta

SEQ ID NO: 219165 - DNA, 22 bp, Artificial Sequence
  Synthetic oligonucleotide; CTG chr2 60502793 60502814 60502798 60502793 -
ggtgacaggactagaatttatt

SEQ ID NO: 219166 - DNA, 22 bp, Artificial Sequence
  Synthetic oligonucleotide; CTA chr2 60502780 60502801 60502785 60502780 -
gaatttatttcttttgatcacc

SEQ ID NO: 219167 - DNA, 22 bp, Artificial Sequence
  Synthetic oligonucleotide; TTT chr2 60502774 60502795 60502779 60502774 -
atttcttttgatcaccaattga

SEQ ID NO: 219168 - DNA, 22 bp, Artificial Sequence
  Synthetic oligonucleotide; TTA chr2 60502773 60502794 60502778 60502773 -
tttcttttgatcaccaattgag

SEQ ID NO: 219169 - DNA, 22 bp, Artificial Sequence
  Synthetic oligonucleotide; TTT chr2 60502770 60502791 60502775 60502770 -
cttttgatcaccaattgagtgc

SEQ ID NO: 219170 - DNA, 22 bp, Artificial Sequence
  Synthetic oligonucleotide; TTC chr2 60502769 60502790 60502774 60502769 -
ttttgatcaccaattgagtgct

SEQ ID NO: 219171 - DNA, 22 bp, Artificial Sequence
  Synthetic oligonucleotide; CTT chr2 60502767 60502788 60502772 60502767 -
ttgatcaccaattgagtgctct

SEQ ID NO: 219172 - DNA, 22 bp, Artificial Sequence
  Synthetic oligonucleotide; TTT chr2 60502766 60502787 60502771 60502766 -
tgatcaccaattgagtgctctt

SEQ ID NO: 219173 - DNA, 22 bp, Artificial Sequence
  Synthetic oligonucleotide; TTT chr2 60502765 60502786 60502770 60502765 -
gatcaccaattgagtgctcttt

SEQ ID NO: 219174 - DNA, 22 bp, Artificial Sequence
  Synthetic oligonucleotide; TTG chr2 60502764 60502785 60502769 60502764 -
atcaccaattgagtgctctttc

SEQ ID NO: 219175 - DNA, 22 bp, Artificial Sequence
  Synthetic oligonucleotide; TTG chr2 60502753 60502774 60502758 60502753 -
agtgctctttctgctctactgt

SEQ ID NO: 219176 - DNA, 22 bp, Artificial Sequence
  Synthetic oligonucleotide; CTC chr2 60502746 60502767 60502751 60502746 -
tttctgctctactgtgctacca

SEQ ID NO: 219177 - DNA, 22 bp, Artificial Sequence
  Synthetic oligonucleotide; CTT chr2 60502744 60502765 60502749 60502744 -
tctgctctactgtgctaccatg

SEQ ID NO: 219178 - DNA, 22 bp, Artificial Sequence
  Synthetic oligonucleotide; TTT chr2 60502743 60502764 60502748 60502743 -
ctgctctactgtgctaccatga

SEQ ID NO: 219179 - DNA, 22 bp, Artificial Sequence
  Synthetic oligonucleotide; TTC chr2 60502742 60502763 60502747 60502742 -
tgctctactgtgctaccatgat

SEQ ID NO: 219180 - DNA, 22 bp, Artificial Sequence
  Synthetic oligonucleotide; CTG chr2 60502740 60502761 60502745 60502740 -
ctctactgtgctaccatgatca

SEQ ID NO: 219181 - DNA, 22 bp, Artificial Sequence
  Synthetic oligonucleotide; CTC chr2 60502737 60502758 60502742 60502737 -
tactgtgctaccatgatcagag

SEQ ID NO: 219182 - DNA, 22 bp, Artificial Sequence
  Synthetic oligonucleotide; CTA chr2 60502735 60502756 60502740 60502735 -
ctgtgctaccatgatcagaggt

SEQ ID NO: 219183 - DNA, 22 bp, Artificial Sequence
  Synthetic oligonucleotide; CTG chr2 60502732 60502753 60502737 60502732 -
tgctaccatgatcagaggtaaa

SEQ ID NO: 219184 - DNA, 22 bp, Artificial Sequence
  Synthetic oligonucleotide; CTA chr2 60502727 60502748 60502732 60502727 -
ccatgatcagaggtaaatttgt

SEQ ID NO: 219185 - DNA, 22 bp, Artificial Sequence
  Synthetic oligonucleotide; TTT chr2 60502707 60502728 60502712 60502707 -
gtttttctctgatgatgattga

SEQ ID NO: 219186 - DNA, 22 bp, Artificial Sequence
  Synthetic oligonucleotide; TTG chr2 60502706 60502727 60502711 60502706 -
tttttctctgatgatgattgaa

SEQ ID NO: 219187 - DNA, 22 bp, Artificial Sequence
  Synthetic oligonucleotide; TTT chr2 60502703 60502724 60502708 60502703 -
ttctctgatgatgattgaaaac

SEQ ID NO: 219188 - DNA, 22 bp, Artificial Sequence
  Synthetic oligonucleotide; TTT chr2 60502702 60502723 60502707 60502702 -
tctctgatgatgattgaaaaca

SEQ ID NO: 219189 - DNA, 22 bp, Artificial Sequence
  Synthetic oligonucleotide; TTT chr2 60502701 60502722 60502706 60502701 -
ctctgatgatgattgaaaacag

SEQ ID NO: 219190 - DNA, 22 bp, Artificial Sequence
  Synthetic oligonucleotide; TTC chr2 60502700 60502721 60502705 60502700 -
tctgatgatgattgaaaacagt

SEQ ID NO: 219191 - DNA, 22 bp, Artificial Sequence
  Synthetic oligonucleotide; CTC chr2 60502698 60502719 60502703 60502698 -
tgatgatgattgaaaacagttt

SEQ ID NO: 219192 - DNA, 22 bp, Artificial Sequence
  Synthetic oligonucleotide; CTG chr2 60502696 60502717 60502701 60502696 -
atgatgattgaaaacagtttta

SEQ ID NO: 219193 - DNA, 22 bp, Artificial Sequence
  Synthetic oligonucleotide; TTG chr2 60502686 60502707 60502691 60502686 -
aaaacagttttattaacatatc

SEQ ID NO: 219194 - DNA, 22 bp, Artificial Sequence
  Synthetic oligonucleotide; TTT chr2 60502676 60502697 60502681 60502676 -
tattaacatatcaagaacatta

SEQ ID NO: 219195 - DNA, 22 bp, Artificial Sequence
  Synthetic oligonucleotide; TTT chr2 60502675 60502696 60502680 60502675 -
attaacatatcaagaacattac

SEQ ID NO: 219196 - DNA, 22 bp, Artificial Sequence
  Synthetic oligonucleotide; TTA chr2 60502674 60502695 60502679 60502674 -
ttaacatatcaagaacattaca

SEQ ID NO: 219197 - DNA, 22 bp, Artificial Sequence
  Synthetic oligonucleotide; TTA chr2 60502671 60502692 60502676 60502671 -
acatatcaagaacattacaaca

SEQ ID NO: 219198 - DNA, 22 bp, Artificial Sequence
  Synthetic oligonucleotide; TTA chr2 60502654 60502675 60502659 60502654 -
caacacaaagagtttctggttt

SEQ ID NO: 219199 - DNA, 22 bp, Artificial Sequence
  Synthetic oligonucleotide; TTT chr2 60502639 60502660 60502644 60502639 -
ctggtttaaaaaatctcttttc

SEQ ID NO: 219200 - DNA, 22 bp, Artificial Sequence
  Synthetic oligonucleotide; TTC chr2 60502638 60502659 60502643 60502638 -
tggtttaaaaaatctcttttca

SEQ ID NO: 219201 - DNA, 22 bp, Artificial Sequence
  Synthetic oligonucleotide; CTG chr2 60502636 60502657 60502641 60502636 -
gtttaaaaaatctcttttcact

SEQ ID NO: 219202 - DNA, 22 bp, Artificial Sequence
  Synthetic oligonucleotide; TTT chr2 60502632 60502653 60502637 60502632 -
aaaaaatctcttttcactggta

SEQ ID NO: 219203 - DNA, 22 bp, Artificial Sequence
  Synthetic oligonucleotide; TTA chr2 60502631 60502652 60502636 60502631 -
aaaaatctcttttcactggtat

SEQ ID NO: 219204 - DNA, 22 bp, Artificial Sequence
  Synthetic oligonucleotide; CTC chr2 60502622 60502643 60502627 60502622 -
ttttcactggtatttcttaaat

SEQ ID NO: 219205 - DNA, 22 bp, Artificial Sequence
  Synthetic oligonucleotide; CTT chr2 60502620 60502641 60502625 60502620 -
ttcactggtatttcttaaattc

SEQ ID NO: 219206 - DNA, 22 bp, Artificial Sequence
  Synthetic oligonucleotide; TTT chr2 60502619 60502640 60502624 60502619 -
tcactggtatttcttaaattca

SEQ ID NO: 219207 - DNA, 22 bp, Artificial Sequence
  Synthetic oligonucleotide; TTT chr2 60502618 60502639 60502623 60502618 -
cactggtatttcttaaattcat

SEQ ID NO: 219208 - DNA, 22 bp, Artificial Sequence
  Synthetic oligonucleotide; TTC chr2 60502617 60502638 60502622 60502617 -
actggtatttcttaaattcata

SEQ ID NO: 219209 - DNA, 22 bp, Artificial Sequence
  Synthetic oligonucleotide; CTG chr2 60502613 60502634 60502618 60502613 -
gtatttcttaaattcatatttt

SEQ ID NO: 219210 - DNA, 22 bp, Artificial Sequence
  Synthetic oligonucleotide; TTT chr2 60502607 60502628 60502612 60502607 -
cttaaattcatattttaatatt

SEQ ID NO: 219211 - DNA, 22 bp, Artificial Sequence
  Synthetic oligonucleotide; TTC chr2 60502606 60502627 60502611 60502606 -
ttaaattcatattttaatatta

SEQ ID NO: 219212 - DNA, 22 bp, Artificial Sequence
  Synthetic oligonucleotide; CTT chr2 60502604 60502625 60502609 60502604 -
aaattcatattttaatattaga

SEQ ID NO: 219213 - DNA, 22 bp, Artificial Sequence
  Synthetic oligonucleotide; TTA chr2 60502603 60502624 60502608 60502603 -
aattcatattttaatattagaa

SEQ ID NO: 219214 - DNA, 22 bp, Artificial Sequence
  Synthetic oligonucleotide; TTC chr2 60502598 60502619 60502603 60502598 -
atattttaatattagaaagcat

SEQ ID NO: 219215 - DNA, 22 bp, Artificial Sequence
  Synthetic oligonucleotide; TTT chr2 60502592 60502613 60502597 60502592 -
taatattagaaagcatgggatt

SEQ ID NO: 219216 - DNA, 22 bp, Artificial Sequence
  Synthetic oligonucleotide; TTT chr2 60502591 60502612 60502596 60502591 -
aatattagaaagcatgggattg

SEQ ID NO: 219217 - DNA, 22 bp, Artificial Sequence
  Synthetic oligonucleotide; TTA chr2 60502590 60502611 60502595 60502590 -
atattagaaagcatgggattgg

SEQ ID NO: 219218 - DNA, 22 bp, Artificial Sequence
  Synthetic oligonucleotide; TTA chr2 60502584 60502605 60502589 60502584 -
gaaagcatgggattgggtgtga

SEQ ID NO: 219219 - DNA, 22 bp, Artificial Sequence
  Synthetic oligonucleotide; TTG chr2 60502569 60502590 60502574 60502569 -
ggtgtgaacactgcttttggat

SEQ ID NO: 219220 - DNA, 22 bp, Artificial Sequence
  Synthetic oligonucleotide; CTG chr2 60502556 60502577 60502561 60502556 -
cttttggatgttggaggaagat

SEQ ID NO: 219221 - DNA, 22 bp, Artificial Sequence
  Synthetic oligonucleotide; CTT chr2 60502553 60502574 60502558 60502553 -
ttggatgttggaggaagataag

SEQ ID NO: 219222 - DNA, 22 bp, Artificial Sequence
  Synthetic oligonucleotide; TTT chr2 60502552 60502573 60502557 60502552 -
tggatgttggaggaagataaga

SEQ ID NO: 219223 - DNA, 22 bp, Artificial Sequence
  Synthetic oligonucleotide; TTT chr2 60502551 60502572 60502556 60502551 -
ggatgttggaggaagataagag

SEQ ID NO: 219224 - DNA, 22 bp, Artificial Sequence
  Synthetic oligonucleotide; TTG chr2 60502550 60502571 60502555 60502550 -
gatgttggaggaagataagaga

SEQ ID NO: 219225 - DNA, 22 bp, Artificial Sequence
  Synthetic oligonucleotide; TTG chr2 60502543 60502564 60502548 60502543 -
gaggaagataagagaaggaagc

SEQ ID NO: 219226 - DNA, 22 bp, Artificial Sequence
  Synthetic oligonucleotide; CTG chr2 60502519 60502540 60502524 60502519 -
gctctttctttaggagcaatac

SEQ ID NO: 219227 - DNA, 22 bp, Artificial Sequence
  Synthetic oligonucleotide; CTC chr2 60502515 60502536 60502520 60502515 -
tttctttaggagcaatacctga

SEQ ID NO: 219228 - DNA, 22 bp, Artificial Sequence
  Synthetic oligonucleotide; CTT chr2 60502513 60502534 60502518 60502513 -
tctttaggagcaatacctgaga

SEQ ID NO: 219229 - DNA, 22 bp, Artificial Sequence
  Synthetic oligonucleotide; TTT chr2 60502512 60502533 60502517 60502512 -
ctttaggagcaatacctgagat

SEQ ID NO: 219230 - DNA, 22 bp, Artificial Sequence
  Synthetic oligonucleotide; TTC chr2 60502511 60502532 60502516 60502511 -
tttaggagcaatacctgagatc

SEQ ID NO: 219231 - DNA, 22 bp, Artificial Sequence
  Synthetic oligonucleotide; CTT chr2 60502509 60502530 60502514 60502509 -
taggagcaatacctgagatccc

SEQ ID NO: 219232 - DNA, 22 bp, Artificial Sequence
  Synthetic oligonucleotide; TTT chr2 60502508 60502529 60502513 60502508 -
aggagcaatacctgagatccca

SEQ ID NO: 219233 - DNA, 22 bp, Artificial Sequence
  Synthetic oligonucleotide; TTA chr2 60502507 60502528 60502512 60502507 -
ggagcaatacctgagatcccag

SEQ ID NO: 219234 - DNA, 22 bp, Artificial Sequence
  Synthetic oligonucleotide; CTG chr2 60502494 60502515 60502499 60502494 -
agatcccagaattgtatgtaca

SEQ ID NO: 219235 - DNA, 22 bp, Artificial Sequence
  Synthetic oligonucleotide; TTG chr2 60502480 60502501 60502485 60502480 -
tatgtacaaagtgtgtgatggc

SEQ ID NO: 219236 - DNA, 22 bp, Artificial Sequence
  Synthetic oligonucleotide; CTC chr2 60502451 60502472 60502456 60502451 -
aaatctgtgctagcgagaaacc

SEQ ID NO: 219237 - DNA, 22 bp, Artificial Sequence
  Synthetic oligonucleotide; CTG chr2 60502444 60502465 60502449 60502444 -
tgctagcgagaaaccccctgct

SEQ ID NO: 219238 - DNA, 22 bp, Artificial Sequence
  Synthetic oligonucleotide; CTA chr2 60502439 60502460 60502444 60502439 -
gcgagaaaccccctgctactct

SEQ ID NO: 219239 - DNA, 22 bp, Artificial Sequence
  Synthetic oligonucleotide; CTG chr2 60502424 60502445 60502429 60502424 -
ctactcttctgaatctgatgaa

SEQ ID NO: 219240 - DNA, 22 bp, Artificial Sequence
  Synthetic oligonucleotide; CTA chr2 60502421 60502442 60502426 60502421 -
ctcttctgaatctgatgaagaa

SEQ ID NO: 219241 - DNA, 22 bp, Artificial Sequence
  Synthetic oligonucleotide; CTC chr2 60502418 60502439 60502423 60502418 -
ttctgaatctgatgaagaagtt

SEQ ID NO: 219242 - DNA, 22 bp, Artificial Sequence
  Synthetic oligonucleotide; CTT chr2 60502416 60502437 60502421 60502416 -
ctgaatctgatgaagaagttat

SEQ ID NO: 219243 - DNA, 22 bp, Artificial Sequence
  Synthetic oligonucleotide; TTC chr2 60502415 60502436 60502420 60502415 -
tgaatctgatgaagaagttatt

SEQ ID NO: 219244 - DNA, 22 bp, Artificial Sequence
  Synthetic oligonucleotide; CTG chr2 60502413 60502434 60502418 60502413 -
aatctgatgaagaagttattct

SEQ ID NO: 219245 - DNA, 22 bp, Artificial Sequence
  Synthetic oligonucleotide; CTG chr2 60502407 60502428 60502412 60502407 -
atgaagaagttattctgtctgt

SEQ ID NO: 219246 - DNA, 22 bp, Artificial Sequence
  Synthetic oligonucleotide; TTA chr2 60502395 60502416 60502400 60502395 -
ttctgtctgtgcagttttatta

SEQ ID NO: 219247 - DNA, 22 bp, Artificial Sequence
  Synthetic oligonucleotide; TTC chr2 60502392 60502413 60502397 60502392 -
tgtctgtgcagttttattaggc

SEQ ID NO: 219248 - DNA, 22 bp, Artificial Sequence
  Synthetic oligonucleotide; CTG chr2 60502390 60502411 60502395 60502390 -
tctgtgcagttttattaggctg

SEQ ID NO: 219249 - DNA, 22 bp, Artificial Sequence
  Synthetic oligonucleotide; CTG chr2 60502386 60502407 60502391 60502386 -
tgcagttttattaggctgagac

SEQ ID NO: 219250 - DNA, 22 bp, Artificial Sequence
  Synthetic oligonucleotide; TTT chr2 60502378 60502399 60502383 60502378 -
tattaggctgagactttttccg

SEQ ID NO: 219251 - DNA, 22 bp, Artificial Sequence
  Synthetic oligonucleotide; TTT chr2 60502377 60502398 60502382 60502377 -
attaggctgagactttttccga

SEQ ID NO: 219252 - DNA, 22 bp, Artificial Sequence
  Synthetic oligonucleotide; TTA chr2 60502376 60502397 60502381 60502376 -
ttaggctgagactttttccgat

SEQ ID NO: 219253 - DNA, 22 bp, Artificial Sequence
  Synthetic oligonucleotide; TTA chr2 60502373 60502394 60502378 60502373 -
ggctgagactttttccgatggt

SEQ ID NO: 219254 - DNA, 22 bp, Artificial Sequence
  Synthetic oligonucleotide; CTG chr2 60502368 60502389 60502373 60502368 -
agactttttccgatggtttatt

SEQ ID NO: 219255 - DNA, 22 bp, Artificial Sequence
  Synthetic oligonucleotide; CTT chr2 60502362 60502383 60502367 60502362 -
tttccgatggtttatttttccg

SEQ ID NO: 219256 - DNA, 22 bp, Artificial Sequence
  Synthetic oligonucleotide; TTT chr2 60502361 60502382 60502366 60502361 -
ttccgatggtttatttttccgt

SEQ ID NO: 219257 - DNA, 22 bp, Artificial Sequence
  Synthetic oligonucleotide; TTT chr2 60502360 60502381 60502365 60502360 -
tccgatggtttatttttccgtt

SEQ ID NO: 219258 - DNA, 22 bp, Artificial Sequence
  Synthetic oligonucleotide; TTT chr2 60502359 60502380 60502364 60502359 -
ccgatggtttatttttccgttt

SEQ ID NO: 219259 - DNA, 22 bp, Artificial Sequence
  Synthetic oligonucleotide; TTC chr2 60502358 60502379 60502363 60502358 -
cgatggtttatttttccgtttg

SEQ ID NO: 219260 - DNA, 22 bp, Artificial Sequence
  Synthetic oligonucleotide; TTT chr2 60502349 60502370 60502354 60502349 -
atttttccgtttgctcacagaa

SEQ ID NO: 219261 - DNA, 22 bp, Artificial Sequence
  Synthetic oligonucleotide; TTA chr2 60502348 60502369 60502353 60502348 -
tttttccgtttgctcacagaat

SEQ ID NO: 219262 - DNA, 22 bp, Artificial Sequence
  Synthetic oligonucleotide; TTT chr2 60502345 60502366 60502350 60502345 -
ttccgtttgctcacagaatgta

SEQ ID NO: 219263 - DNA, 22 bp, Artificial Sequence
  Synthetic oligonucleotide; TTT chr2 60502344 60502365 60502349 60502344 -
tccgtttgctcacagaatgtag

SEQ ID NO: 219264 - DNA, 22 bp, Artificial Sequence
  Synthetic oligonucleotide; TTT chr2 60502343 60502364 60502348 60502343 -
ccgtttgctcacagaatgtaga

SEQ ID NO: 219265 - DNA, 22 bp, Artificial Sequence
  Synthetic oligonucleotide; TTC chr2 60502342 60502363 60502347 60502342 -
cgtttgctcacagaatgtagag

SEQ ID NO: 219266 - DNA, 22 bp, Artificial Sequence
  Synthetic oligonucleotide; TTT chr2 60502337 60502358 60502342 60502337 -
gctcacagaatgtagaggagag

SEQ ID NO: 219267 - DNA, 22 bp, Artificial Sequence
  Synthetic oligonucleotide; TTG chr2 60502336 60502357 60502341 60502336 -
ctcacagaatgtagaggagagc

SEQ ID NO: 219268 - DNA, 22 bp, Artificial Sequence
  Synthetic oligonucleotide; CTC chr2 60502333 60502354 60502338 60502333 -
acagaatgtagaggagagccag

SEQ ID NO: 219269 - DNA, 22 bp, Artificial Sequence
  Synthetic oligonucleotide; CTG chr2 60502301 60502322 60502306 60502301 -
acacgttcacactgtttaccta

SEQ ID NO: 219270 - DNA, 22 bp, Artificial Sequence
  Synthetic oligonucleotide; TTC chr2 60502293 60502314 60502298 60502293 -
acactgtttacctactccctga

SEQ ID NO: 219271 - DNA, 22 bp, Artificial Sequence
  Synthetic oligonucleotide; CTG chr2 60502287 60502308 60502292 60502287 -
tttacctactccctgactttgg

SEQ ID NO: 219272 - DNA, 22 bp, Artificial Sequence
  Synthetic oligonucleotide; TTT chr2 60502284 60502305 60502289 60502284 -
acctactccctgactttggagc

SEQ ID NO: 219273 - DNA, 22 bp, Artificial Sequence
  Synthetic oligonucleotide; TTA chr2 60502283 60502304 60502288 60502283 -
cctactccctgactttggagct

SEQ ID NO: 219274 - DNA, 22 bp, Artificial Sequence
  Synthetic oligonucleotide; CTA chr2 60502279 60502300 60502284 60502279 -
ctccctgactttggagctcagc

SEQ ID NO: 219275 - DNA, 22 bp, Artificial Sequence
  Synthetic oligonucleotide; CTC chr2 60502276 60502297 60502281 60502276 -
cctgactttggagctcagcaaa

SEQ ID NO: 219276 - DNA, 22 bp, Artificial Sequence
  Synthetic oligonucleotide; CTG chr2 60502272 60502293 60502277 60502272 -
actttggagctcagcaaatctg

SEQ ID NO: 219277 - DNA, 22 bp, Artificial Sequence
  Synthetic oligonucleotide; CTT chr2 60502268 60502289 60502273 60502268 -
tggagctcagcaaatctgctat

SEQ ID NO: 219278 - DNA, 22 bp, Artificial Sequence
  Synthetic oligonucleotide; TTT chr2 60502267 60502288 60502272 60502267 -
ggagctcagcaaatctgctatc

SEQ ID NO: 219279 - DNA, 22 bp, Artificial Sequence
  Synthetic oligonucleotide; TTG chr2 60502266 60502287 60502271 60502266 -
gagctcagcaaatctgctatcc

SEQ ID NO: 219280 - DNA, 22 bp, Artificial Sequence
  Synthetic oligonucleotide; CTC chr2 60502260 60502281 60502265 60502260 -
agcaaatctgctatccatcatt

SEQ ID NO: 219281 - DNA, 22 bp, Artificial Sequence
  Synthetic oligonucleotide; CTG chr2 60502250 60502271 60502255 60502250 -
ctatccatcattttgtttcacc

SEQ ID NO: 219282 - DNA, 22 bp, Artificial Sequence
  Synthetic oligonucleotide; CTA chr2 60502247 60502268 60502252 60502247 -
tccatcattttgtttcaccagc

SEQ ID NO: 219283 - DNA, 22 bp, Artificial Sequence
  Synthetic oligonucleotide; TTT chr2 60502237 60502258 60502242 60502237 -
tgtttcaccagcttttacaaag

SEQ ID NO: 219284 - DNA, 22 bp, Artificial Sequence
  Synthetic oligonucleotide; TTT chr2 60502236 60502257 60502241 60502236 -
gtttcaccagcttttacaaagc

SEQ ID NO: 219285 - DNA, 22 bp, Artificial Sequence
  Synthetic oligonucleotide; TTG chr2 60502235 60502256 60502240 60502235 -
tttcaccagcttttacaaagca

SEQ ID NO: 219286 - DNA, 22 bp, Artificial Sequence
  Synthetic oligonucleotide; TTT chr2 60502232 60502253 60502237 60502232 -
caccagcttttacaaagcagga

SEQ ID NO: 219287 - DNA, 22 bp, Artificial Sequence
  Synthetic oligonucleotide; TTC chr2 60502231 60502252 60502236 60502231 -
accagcttttacaaagcaggat

SEQ ID NO: 219288 - DNA, 22 bp, Artificial Sequence
  Synthetic oligonucleotide; CTT chr2 60502223 60502244 60502228 60502223 -
ttacaaagcaggatcataaact

SEQ ID NO: 219289 - DNA, 22 bp, Artificial Sequence
  Synthetic oligonucleotide; TTT chr2 60502222 60502243 60502227 60502222 -
tacaaagcaggatcataaactg

SEQ ID NO: 219290 - DNA, 22 bp, Artificial Sequence
  Synthetic oligonucleotide; TTT chr2 60502221 60502242 60502226 60502221 -
acaaagcaggatcataaactgt

SEQ ID NO: 219291 - DNA, 22 bp, Artificial Sequence
  Synthetic oligonucleotide; TTA chr2 60502220 60502241 60502225 60502220 -
caaagcaggatcataaactgta

SEQ ID NO: 219292 - DNA, 22 bp, Artificial Sequence
  Synthetic oligonucleotide; CTG chr2 60502200 60502221 60502205 60502200 -
taagctcatttggagggacctg

SEQ ID NO: 219293 - DNA, 22 bp, Artificial Sequence
  Synthetic oligonucleotide; CTC chr2 60502193 60502214 60502198 60502193 -
atttggagggacctgatctctg

SEQ ID NO: 219294 - DNA, 22 bp, Artificial Sequence
  Synthetic oligonucleotide; TTT chr2 60502189 60502210 60502194 60502189 -
ggagggacctgatctctgattg

SEQ ID NO: 219295 - DNA, 22 bp, Artificial Sequence
  Synthetic oligonucleotide; TTG chr2 60502188 60502209 60502193 60502188 -
gagggacctgatctctgattgt

SEQ ID NO: 219296 - DNA, 22 bp, Artificial Sequence
  Synthetic oligonucleotide; CTG chr2 60502178 60502199 60502183 60502178 -
atctctgattgttgctttgata

SEQ ID NO: 219297 - DNA, 22 bp, Artificial Sequence
  Synthetic oligonucleotide; CTC chr2 60502173 60502194 60502178 60502173 -
tgattgttgctttgataagtat

SEQ ID NO: 219298 - DNA, 22 bp, Artificial Sequence
  Synthetic oligonucleotide; CTG chr2 60502171 60502192 60502176 60502171 -
attgttgctttgataagtatct

SEQ ID NO: 219299 - DNA, 22 bp, Artificial Sequence
  Synthetic oligonucleotide; TTG chr2 60502167 60502188 60502172 60502167 -
ttgctttgataagtatctatac

SEQ ID NO: 219300 - DNA, 22 bp, Artificial Sequence
  Synthetic oligonucleotide; TTG chr2 60502164 60502185 60502169 60502164 -
ctttgataagtatctatacaaa

SEQ ID NO: 219301 - DNA, 22 bp, Artificial Sequence
  Synthetic oligonucleotide; CTT chr2 60502161 60502182 60502166 60502161 -
tgataagtatctatacaaatat

SEQ ID NO: 219302 - DNA, 22 bp, Artificial Sequence
  Synthetic oligonucleotide; TTT chr2 60502160 60502181 60502165 60502160 -
gataagtatctatacaaatatt

SEQ ID NO: 219303 - DNA, 22 bp, Artificial Sequence
  Synthetic oligonucleotide; TTG chr2 60502159 60502180 60502164 60502159 -
ataagtatctatacaaatattc

SEQ ID NO: 219304 - DNA, 22 bp, Artificial Sequence
  Synthetic oligonucleotide; CTA chr2 60502148 60502169 60502153 60502148 -
tacaaatattcatatcattctg

SEQ ID NO: 219305 - DNA, 22 bp, Artificial Sequence
  Synthetic oligonucleotide; TTC chr2 60502137 60502158 60502142 60502137 -
atatcattctgatagtcttgag

SEQ ID NO: 219306 - DNA, 22 bp, Artificial Sequence
  Synthetic oligonucleotide; TTC chr2 60502128 60502149 60502133 60502128 -
tgatagtcttgagttgcattgt

SEQ ID NO: 219307 - DNA, 22 bp, Artificial Sequence
  Synthetic oligonucleotide; CTG chr2 60502126 60502147 60502131 60502126 -
atagtcttgagttgcattgtta

SEQ ID NO: 219308 - DNA, 22 bp, Artificial Sequence
  Synthetic oligonucleotide; CTT chr2 60502118 60502139 60502123 60502118 -
gagttgcattgttacaacatgc

SEQ ID NO: 219309 - DNA, 22 bp, Artificial Sequence
  Synthetic oligonucleotide; TTG chr2 60502117 60502138 60502122 60502117 -
agttgcattgttacaacatgca

SEQ ID NO: 219310 - DNA, 22 bp, Artificial Sequence
  Synthetic oligonucleotide; TTG chr2 60502112 60502133 60502117 60502112 -
cattgttacaacatgcaaacct

SEQ ID NO: 219311 - DNA, 22 bp, Artificial Sequence
  Synthetic oligonucleotide; TTG chr2 60502107 60502128 60502112 60502107 -
ttacaacatgcaaacctctcag

SEQ ID NO: 219312 - DNA, 22 bp, Artificial Sequence
  Synthetic oligonucleotide; TTA chr2 60502104 60502125 60502109 60502104 -
caacatgcaaacctctcagttt

SEQ ID NO: 219313 - DNA, 22 bp, Artificial Sequence
  Synthetic oligonucleotide; CTC chr2 60502089 60502110 60502094 60502089 -
tcagttttccaggacttctggt

SEQ ID NO: 219314 - DNA, 22 bp, Artificial Sequence
  Synthetic oligonucleotide; CTC chr2 60502087 60502108 60502092 60502087 -
agttttccaggacttctggtgg

SEQ ID NO: 219315 - DNA, 22 bp, Artificial Sequence
  Synthetic oligonucleotide; TTT chr2 60502082 60502103 60502087 60502082 -
tccaggacttctggtggtacag

SEQ ID NO: 219316 - DNA, 22 bp, Artificial Sequence
  Synthetic oligonucleotide; TTT chr2 60502081 60502102 60502086 60502081 -
ccaggacttctggtggtacagc

SEQ ID NO: 219317 - DNA, 22 bp, Artificial Sequence
  Synthetic oligonucleotide; TTC chr2 60502080 60502101 60502085 60502080 -
caggacttctggtggtacagct

SEQ ID NO: 219318 - DNA, 22 bp, Artificial Sequence
  Synthetic oligonucleotide; CTT chr2 60502072 60502093 60502077 60502072 -
ctggtggtacagcttctctgtg

SEQ ID NO: 219319 - DNA, 22 bp, Artificial Sequence
  Synthetic oligonucleotide; TTC chr2 60502071 60502092 60502076 60502071 -
tggtggtacagcttctctgtgg

SEQ ID NO: 219320 - DNA, 22 bp, Artificial Sequence
  Synthetic oligonucleotide; CTG chr2 60502069 60502090 60502074 60502069 -
gtggtacagcttctctgtggag

SEQ ID NO: 219321 - DNA, 22 bp, Artificial Sequence
  Synthetic oligonucleotide; CTT chr2 60502057 60502078 60502062 60502057 -
ctctgtggagtgaggcatattt

SEQ ID NO: 219322 - DNA, 22 bp, Artificial Sequence
  Synthetic oligonucleotide; TTC chr2 60502056 60502077 60502061 60502056 -
tctgtggagtgaggcatatttt

SEQ ID NO: 219323 - DNA, 22 bp, Artificial Sequence
  Synthetic oligonucleotide; CTC chr2 60502054 60502075 60502059 60502054 -
tgtggagtgaggcatatttttg

SEQ ID NO: 219324 - DNA, 22 bp, Artificial Sequence
  Synthetic oligonucleotide; CTG chr2 60502052 60502073 60502057 60502052 -
tggagtgaggcatatttttggt

SEQ ID NO: 219325 - DNA, 22 bp, Artificial Sequence
  Synthetic oligonucleotide; TTT chr2 60502035 60502056 60502040 60502035 -
ttggtctggcctttcctccctg

SEQ ID NO: 219326 - DNA, 22 bp, Artificial Sequence
  Synthetic oligonucleotide; TTT chr2 60502034 60502055 60502039 60502034 -
tggtctggcctttcctccctga

SEQ ID NO: 219327 - DNA, 22 bp, Artificial Sequence
  Synthetic oligonucleotide; TTT chr2 60502033 60502054 60502038 60502033 -
ggtctggcctttcctccctgaa

SEQ ID NO: 219328 - DNA, 22 bp, Artificial Sequence
  Synthetic oligonucleotide; TTG chr2 60502032 60502053 60502037 60502032 -
gtctggcctttcctccctgaag

SEQ ID NO: 219329 - DNA, 22 bp, Artificial Sequence
  Synthetic oligonucleotide; CTG chr2 60502027 60502048 60502032 60502027 -
gcctttcctccctgaagctctg

SEQ ID NO: 219330 - DNA, 22 bp, Artificial Sequence
  Synthetic oligonucleotide; CTT chr2 60502022 60502043 60502027 60502022 -
tcctccctgaagctctgttagc

SEQ ID NO: 219331 - DNA, 22 bp, Artificial Sequence
  Synthetic oligonucleotide; TTT chr2 60502021 60502042 60502026 60502021 -
cctccctgaagctctgttagcc

SEQ ID NO: 219332 - DNA, 22 bp, Artificial Sequence
  Synthetic oligonucleotide; TTC chr2 60502020 60502041 60502025 60502020 -
ctccctgaagctctgttagcct

SEQ ID NO: 219333 - DNA, 22 bp, Artificial Sequence
  Synthetic oligonucleotide; CTC chr2 60502017 60502038 60502022 60502017 -
cctgaagctctgttagcctgag

SEQ ID NO: 219334 - DNA, 22 bp, Artificial Sequence
  Synthetic oligonucleotide; CTG chr2 60502013 60502034 60502018 60502013 -
aagctctgttagcctgagattt

SEQ ID NO: 219335 - DNA, 22 bp, Artificial Sequence
  Synthetic oligonucleotide; CTC chr2 60502007 60502028 60502012 60502007 -
tgttagcctgagatttcaccta

SEQ ID NO: 219336 - DNA, 22 bp, Artificial Sequence
  Synthetic oligonucleotide; CTG chr2 60502005 60502026 60502010 60502005 -
ttagcctgagatttcacctagt

SEQ ID NO: 219337 - DNA, 22 bp, Artificial Sequence
  Synthetic oligonucleotide; TTA chr2 60502002 60502023 60502007 60502002 -
gcctgagatttcacctagtgca

SEQ ID NO: 219338 - DNA, 22 bp, Artificial Sequence
  Synthetic oligonucleotide; CTG chr2 60501997 60502018 60502002 60501997 -
agatttcacctagtgcaacaca

SEQ ID NO: 219339 - DNA, 22 bp, Artificial Sequence
  Synthetic oligonucleotide; TTT chr2 60501991 60502012 60501996 60501991 -
cacctagtgcaacacaagttgt

SEQ ID NO: 219340 - DNA, 22 bp, Artificial Sequence
  Synthetic oligonucleotide; TTC chr2 60501990 60502011 60501995 60501990 -
acctagtgcaacacaagttgtg

SEQ ID NO: 219341 - DNA, 22 bp, Artificial Sequence
  Synthetic oligonucleotide; CTA chr2 60501985 60502006 60501990 60501985 -
gtgcaacacaagttgtgtagaa

SEQ ID NO: 219342 - DNA, 22 bp, Artificial Sequence
  Synthetic oligonucleotide; TTG chr2 60501970 60501991 60501975 60501970 -
tgtagaaagaaacataatacta

SEQ ID NO: 219343 - DNA, 22 bp, Artificial Sequence
  Synthetic oligonucleotide; CTA chr2 60501948 60501969 60501953 60501948 -
ctttattccataattcactagt

SEQ ID NO: 219344 - DNA, 22 bp, Artificial Sequence
  Synthetic oligonucleotide; CTT chr2 60501945 60501966 60501950 60501945 -
tattccataattcactagtaaa

SEQ ID NO: 219345 - DNA, 22 bp, Artificial Sequence
  Synthetic oligonucleotide; TTT chr2 60501944 60501965 60501949 60501944 -
attccataattcactagtaaaa

SEQ ID NO: 219346 - DNA, 22 bp, Artificial Sequence
  Synthetic oligonucleotide; TTA chr2 60501943 60501964 60501948 60501943 -
ttccataattcactagtaaaat

SEQ ID NO: 219347 - DNA, 22 bp, Artificial Sequence
  Synthetic oligonucleotide; TTC chr2 60501940 60501961 60501945 60501940 -
cataattcactagtaaaataat

SEQ ID NO: 219348 - DNA, 22 bp, Artificial Sequence
  Synthetic oligonucleotide; TTC chr2 60501932 60501953 60501937 60501932 -
actagtaaaataattagaataa

SEQ ID NO: 219349 - DNA, 22 bp, Artificial Sequence
  Synthetic oligonucleotide; CTA chr2 60501928 60501949 60501933 60501928 -
gtaaaataattagaataaaagg

SEQ ID NO: 219350 - DNA, 22 bp, Artificial Sequence
  Synthetic oligonucleotide; TTA chr2 60501916 60501937 60501921 60501916 -
gaataaaaggctgttttggaat

SEQ ID NO: 219351 - DNA, 22 bp, Artificial Sequence
  Synthetic oligonucleotide; CTG chr2 60501903 60501924 60501908 60501903 -
ttttggaatgtagagaggcaga

SEQ ID NO: 219352 - DNA, 22 bp, Artificial Sequence
  Synthetic oligonucleotide; TTT chr2 60501900 60501921 60501905 60501900 -
tggaatgtagagaggcagaggg

SEQ ID NO: 219353 - DNA, 22 bp, Artificial Sequence
  Synthetic oligonucleotide; TTT chr2 60501899 60501920 60501904 60501899 -
ggaatgtagagaggcagagggg

SEQ ID NO: 219354 - DNA, 22 bp, Artificial Sequence
  Synthetic oligonucleotide; TTG chr2 60501898 60501919 60501903 60501898 -
gaatgtagagaggcagaggggc

SEQ ID NO: 219355 - DNA, 22 bp, Artificial Sequence
  Synthetic oligonucleotide; CTG chr2 60501874 60501895 60501879 60501874 -
atataacttctcagaatgcatc

SEQ ID NO: 219356 - DNA, 22 bp, Artificial Sequence
  Synthetic oligonucleotide; CTT chr2 60501865 60501886 60501870 60501865 -
ctcagaatgcatcttcctgttt

SEQ ID NO: 219357 - DNA, 22 bp, Artificial Sequence
  Synthetic oligonucleotide; TTC chr2 60501864 60501885 60501869 60501864 -
tcagaatgcatcttcctgtttt

SEQ ID NO: 219358 - DNA, 22 bp, Artificial Sequence
  Synthetic oligonucleotide; CTC chr2 60501862 60501883 60501867 60501862 -
agaatgcatcttcctgttttcc

SEQ ID NO: 219359 - DNA, 22 bp, Artificial Sequence
  Synthetic oligonucleotide; CTT chr2 60501850 60501871 60501855 60501850 -
cctgttttcccgtcttaaattt

SEQ ID NO: 219360 - DNA, 22 bp, Artificial Sequence
  Synthetic oligonucleotide; TTC chr2 60501849 60501870 60501854 60501849 -
ctgttttcccgtcttaaatttt

SEQ ID NO: 219361 - DNA, 22 bp, Artificial Sequence
  Synthetic oligonucleotide; CTG chr2 60501846 60501867 60501851 60501846 -
ttttcccgtcttaaatttttat

SEQ ID NO: 219362 - DNA, 22 bp, Artificial Sequence
  Synthetic oligonucleotide; TTT chr2 60501843 60501864 60501848 60501843 -
tcccgtcttaaatttttatgtg

SEQ ID NO: 219363 - DNA, 22 bp, Artificial Sequence
  Synthetic oligonucleotide; TTT chr2 60501842 60501863 60501847 60501842 -
cccgtcttaaatttttatgtga

SEQ ID NO: 219364 - DNA, 22 bp, Artificial Sequence
  Synthetic oligonucleotide; TTC chr2 60501841 60501862 60501846 60501841 -
ccgtcttaaatttttatgtgag

SEQ ID NO: 219365 - DNA, 22 bp, Artificial Sequence
  Synthetic oligonucleotide; CTT chr2 60501834 60501855 60501839 60501834 -
aaatttttatgtgagatgagca

SEQ ID NO: 219366 - DNA, 22 bp, Artificial Sequence
  Synthetic oligonucleotide; TTA chr2 60501833 60501854 60501838 60501833 -
aatttttatgtgagatgagcac

SEQ ID NO: 219367 - DNA, 22 bp, Artificial Sequence
  Synthetic oligonucleotide; TTT chr2 60501828 60501849 60501833 60501828 -
ttatgtgagatgagcacactgc

SEQ ID NO: 219368 - DNA, 22 bp, Artificial Sequence
  Synthetic oligonucleotide; TTT chr2 60501827 60501848 60501832 60501827 -
tatgtgagatgagcacactgct

SEQ ID NO: 219369 - DNA, 22 bp, Artificial Sequence
  Synthetic oligonucleotide; TTT chr2 60501826 60501847 60501831 60501826 -
atgtgagatgagcacactgctg

SEQ ID NO: 219370 - DNA, 22 bp, Artificial Sequence
  Synthetic oligonucleotide; TTA chr2 60501825 60501846 60501830 60501825 -
tgtgagatgagcacactgctgt

SEQ ID NO: 219371 - DNA, 22 bp, Artificial Sequence
  Synthetic oligonucleotide; CTG chr2 60501807 60501828 60501812 60501807 -
ctgtaattaagaaagcagtgta

SEQ ID NO: 219372 - DNA, 22 bp, Artificial Sequence
  Synthetic oligonucleotide; CTG chr2 60501804 60501825 60501809 60501804 -
taattaagaaagcagtgtaagg

SEQ ID NO: 219373 - DNA, 22 bp, Artificial Sequence
  Synthetic oligonucleotide; TTA chr2 60501798 60501819 60501803 60501798 -
agaaagcagtgtaaggctgggc

SEQ ID NO: 219374 - DNA, 22 bp, Artificial Sequence
  Synthetic oligonucleotide; CTG chr2 60501779 60501800 60501784 60501779 -
ggcgcagtggctcacgtctgta

SEQ ID NO: 219375 - DNA, 22 bp, Artificial Sequence
  Synthetic oligonucleotide; CTC chr2 60501766 60501787 60501771 60501766 -
acgtctgtaattccagcacttt

SEQ ID NO: 219376 - DNA, 22 bp, Artificial Sequence
  Synthetic oligonucleotide; CTG chr2 60501759 60501780 60501764 60501759 -
taattccagcactttgggaggc

SEQ ID NO: 219377 - DNA, 22 bp, Artificial Sequence
  Synthetic oligonucleotide; TTC chr2 60501753 60501774 60501758 60501753 -
cagcactttgggaggccgaggt

SEQ ID NO: 219378 - DNA, 22 bp, Artificial Sequence
  Synthetic oligonucleotide; CTT chr2 60501745 60501766 60501750 60501745 -
tgggaggccgaggtgggtagat

SEQ ID NO: 219379 - DNA, 22 bp, Artificial Sequence
  Synthetic oligonucleotide; TTT chr2 60501744 60501765 60501749 60501744 -
gggaggccgaggtgggtagatc

SEQ ID NO: 219380 - DNA, 22 bp, Artificial Sequence
  Synthetic oligonucleotide; TTG chr2 60501743 60501764 60501748 60501743 -
ggaggccgaggtgggtagatca

SEQ ID NO: 219381 - DNA, 22 bp, Artificial Sequence
  Synthetic oligonucleotide; CTG chr2 60501717 60501738 60501722 60501717 -
aggtcaagagtttgagaccagc

SEQ ID NO: 219382 - DNA, 22 bp, Artificial Sequence
  Synthetic oligonucleotide; TTT chr2 60501704 60501725 60501709 60501704 -
gagaccagcctgaccaacatgg

SEQ ID NO: 219383 - DNA, 22 bp, Artificial Sequence
  Synthetic oligonucleotide; TTG chr2 60501703 60501724 60501708 60501703 -
agaccagcctgaccaacatgga

SEQ ID NO: 219384 - DNA, 22 bp, Artificial Sequence
  Synthetic oligonucleotide; CTG chr2 60501692 60501713 60501697 60501692 -
accaacatggagaaacctcatc

SEQ ID NO: 219385 - DNA, 22 bp, Artificial Sequence
  Synthetic oligonucleotide; CTC chr2 60501673 60501694 60501678 60501673 -
atctctattaaaaatataaact

SEQ ID NO: 219386 - DNA, 22 bp, Artificial Sequence
  Synthetic oligonucleotide; CTC chr2 60501668 60501689 60501673 60501668 -
tattaaaaatataaacttagcc

SEQ ID NO: 219387 - DNA, 22 bp, Artificial Sequence
  Synthetic oligonucleotide; CTA chr2 60501666 60501687 60501671 60501666 -
ttaaaaatataaacttagccag

SEQ ID NO: 219388 - DNA, 22 bp, Artificial Sequence
  Synthetic oligonucleotide; TTA chr2 60501663 60501684 60501668 60501663 -
aaaatataaacttagccaggca

SEQ ID NO: 219389 - DNA, 22 bp, Artificial Sequence
  Synthetic oligonucleotide; CTT chr2 60501650 60501671 60501655 60501650 -
agccaggcatggtcgcacatgc

SEQ ID NO: 219390 - DNA, 22 bp, Artificial Sequence
  Synthetic oligonucleotide; TTA chr2 60501649 60501670 60501654 60501649 -
gccaggcatggtcgcacatgcc

SEQ ID NO: 219391 - DNA, 22 bp, Artificial Sequence
  Synthetic oligonucleotide; CTG chr2 60501625 60501646 60501630 60501625 -
taatcccagctactcaggaggc

SEQ ID NO: 219392 - DNA, 22 bp, Artificial Sequence
  Synthetic oligonucleotide; CTA chr2 60501613 60501634 60501618 60501613 -
ctcaggaggctgagggaggaga

SEQ ID NO: 219393 - DNA, 22 bp, Artificial Sequence
  Synthetic oligonucleotide; CTC chr2 60501610 60501631 60501615 60501610 -
aggaggctgagggaggagaatt

SEQ ID NO: 219394 - DNA, 22 bp, Artificial Sequence
  Synthetic oligonucleotide; CTG chr2 60501601 60501622 60501606 60501601 -
agggaggagaattgcttgaacc

SEQ ID NO: 219395 - DNA, 22 bp, Artificial Sequence
  Synthetic oligonucleotide; TTG chr2 60501587 60501608 60501592 60501587 -
cttgaacccaggaggcagaggt

SEQ ID NO: 219396 - DNA, 22 bp, Artificial Sequence
  Synthetic oligonucleotide; CTT chr2 60501584 60501605 60501589 60501584 -
gaacccaggaggcagaggtggt

SEQ ID NO: 219397 - DNA, 22 bp, Artificial Sequence
  Synthetic oligonucleotide; TTG chr2 60501583 60501604 60501588 60501583 -
aacccaggaggcagaggtggtg

SEQ ID NO: 219398 - DNA, 22 bp, Artificial Sequence
  Synthetic oligonucleotide; TTG chr2 60501542 60501563 60501547 60501542 -
caccccagcctgggcaacaaga

SEQ ID NO: 219399 - DNA, 22 bp, Artificial Sequence
  Synthetic oligonucleotide; CTG chr2 60501530 60501551 60501535 60501530 -
ggcaacaagagcgaaactctgt

SEQ ID NO: 219400 - DNA, 22 bp, Artificial Sequence
  Synthetic oligonucleotide; CTC chr2 60501511 60501532 60501516 60501511 -
tgtctcaaaaaaaaaaaaaaaa

SEQ ID NO: 219401 - DNA, 22 bp, Artificial Sequence
  Synthetic oligonucleotide; CTG chr2 60501509 60501530 60501514 60501509 -
tctcaaaaaaaaaaaaaaaaaa

SEQ ID NO: 219402 - DNA, 22 bp, Artificial Sequence
  Synthetic oligonucleotide; CTC chr2 60501505 60501526 60501510 60501505 -
aaaaaaaaaaaaaaaaaaaaag

SEQ ID NO: 219403 - DNA, 22 bp, Artificial Sequence
  Synthetic oligonucleotide; CTT chr2 60501465 60501486 60501470 60501465 -
gcaaaaggcctttccctcttgc

SEQ ID NO: 219404 - DNA, 22 bp, Artificial Sequence
  Synthetic oligonucleotide; TTG chr2 60501464 60501485 60501469 60501464 -
caaaaggcctttccctcttgcc

SEQ ID NO: 219405 - DNA, 22 bp, Artificial Sequence
  Synthetic oligonucleotide; CTT chr2 60501453 60501474 60501458 60501453 -
tccctcttgccactcagggaag

SEQ ID NO: 219406 - DNA, 22 bp, Artificial Sequence
  Synthetic oligonucleotide; TTT chr2 60501452 60501473 60501457 60501452 -
ccctcttgccactcagggaagc

SEQ ID NO: 219407 - DNA, 22 bp, Artificial Sequence
  Synthetic oligonucleotide; TTC chr2 60501451 60501472 60501456 60501451 -
cctcttgccactcagggaagca

SEQ ID NO: 219408 - DNA, 22 bp, Artificial Sequence
  Synthetic oligonucleotide; CTC chr2 60501447 60501468 60501452 60501447 -
ttgccactcagggaagcacccg

SEQ ID NO: 219409 - DNA, 22 bp, Artificial Sequence
  Synthetic oligonucleotide; CTT chr2 60501445 60501466 60501450 60501445 -
gccactcagggaagcacccgaa

SEQ ID NO: 219410 - DNA, 22 bp, Artificial Sequence
  Synthetic oligonucleotide; TTG chr2 60501444 60501465 60501449 60501444 -
ccactcagggaagcacccgaaa

SEQ ID NO: 219411 - DNA, 22 bp, Artificial Sequence
  Synthetic oligonucleotide; CTC chr2 60501438 60501459 60501443 60501438 -
agggaagcacccgaaagagaac

SEQ ID NO: 219412 - DNA, 22 bp, Artificial Sequence
  Synthetic oligonucleotide; CTT chr2 60501414 60501435 60501419 60501414 -
acaaaccaggtaaagtatttgg

SEQ ID NO: 219413 - DNA, 22 bp, Artificial Sequence
  Synthetic oligonucleotide; TTA chr2 60501413 60501434 60501418 60501413 -
caaaccaggtaaagtatttgga

SEQ ID NO: 219414 - DNA, 22 bp, Artificial Sequence
  Synthetic oligonucleotide; TTT chr2 60501394 60501415 60501399 60501394 -
ggaagtgattaatcatattaca

SEQ ID NO: 219415 - DNA, 22 bp, Artificial Sequence
  Synthetic oligonucleotide; TTG chr2 60501393 60501414 60501398 60501393 -
gaagtgattaatcatattacaa

SEQ ID NO: 219416 - DNA, 22 bp, Artificial Sequence
  Synthetic oligonucleotide; TTA chr2 60501383 60501404 60501388 60501383 -
atcatattacaagagtgttctt

SEQ ID NO: 219417 - DNA, 22 bp, Artificial Sequence
  Synthetic oligonucleotide; TTA chr2 60501374 60501395 60501379 60501374 -
caagagtgttcttcatttcccc

SEQ ID NO: 219418 - DNA, 22 bp, Artificial Sequence
  Synthetic oligonucleotide; TTC chr2 60501363 60501384 60501368 60501363 -
ttcatttcccccaaaggaccat

SEQ ID NO: 219419 - DNA, 22 bp, Artificial Sequence
  Synthetic oligonucleotide; CTT chr2 60501361 60501382 60501366 60501361 -
catttcccccaaaggaccatgg

SEQ ID NO: 219420 - DNA, 22 bp, Artificial Sequence
  Synthetic oligonucleotide; TTC chr2 60501360 60501381 60501365 60501360 -
atttcccccaaaggaccatggc

SEQ ID NO: 219421 - DNA, 22 bp, Artificial Sequence
  Synthetic oligonucleotide; TTT chr2 60501356 60501377 60501361 60501356 -
cccccaaaggaccatggcttcc

SEQ ID NO: 219422 - DNA, 22 bp, Artificial Sequence
  Synthetic oligonucleotide; TTC chr2 60501355 60501376 60501360 60501355 -
ccccaaaggaccatggcttcct

SEQ ID NO: 219423 - DNA, 22 bp, Artificial Sequence
  Synthetic oligonucleotide; CTT chr2 60501336 60501357 60501341 60501336 -
cctgtgacacttacctgtgctc

SEQ ID NO: 219424 - DNA, 22 bp, Artificial Sequence
  Synthetic oligonucleotide; TTC chr2 60501335 60501356 60501340 60501335 -
ctgtgacacttacctgtgctct

SEQ ID NO: 219425 - DNA, 22 bp, Artificial Sequence
  Synthetic oligonucleotide; CTG chr2 60501332 60501353 60501337 60501332 -
tgacacttacctgtgctcttat

SEQ ID NO: 219426 - DNA, 22 bp, Artificial Sequence
  Synthetic oligonucleotide; CTT chr2 60501324 60501345 60501329 60501324 -
acctgtgctcttatagatatta

SEQ ID NO: 219427 - DNA, 22 bp, Artificial Sequence
  Synthetic oligonucleotide; TTA chr2 60501323 60501344 60501328 60501323 -
cctgtgctcttatagatattaa

SEQ ID NO: 219428 - DNA, 22 bp, Artificial Sequence
  Synthetic oligonucleotide; CTG chr2 60501319 60501340 60501324 60501319 -
tgctcttatagatattaaagac

SEQ ID NO: 219429 - DNA, 22 bp, Artificial Sequence
  Synthetic oligonucleotide; CTC chr2 60501314 60501335 60501319 60501314 -
ttatagatattaaagacagagc

SEQ ID NO: 219430 - DNA, 22 bp, Artificial Sequence
  Synthetic oligonucleotide; CTT chr2 60501312 60501333 60501317 60501312 -
atagatattaaagacagagcca

SEQ ID NO: 219431 - DNA, 22 bp, Artificial Sequence
  Synthetic oligonucleotide; TTA chr2 60501311 60501332 60501316 60501311 -
tagatattaaagacagagccac

SEQ ID NO: 219432 - DNA, 22 bp, Artificial Sequence
  Synthetic oligonucleotide; TTA chr2 60501302 60501323 60501307 60501302 -
aagacagagccactggactgtg

SEQ ID NO: 219433 - DNA, 22 bp, Artificial Sequence
  Synthetic oligonucleotide; CTG chr2 60501287 60501308 60501292 60501287 -
gactgtgagctccttgagggca

SEQ ID NO: 219434 - DNA, 22 bp, Artificial Sequence
  Synthetic oligonucleotide; CTG chr2 60501282 60501303 60501287 60501282 -
tgagctccttgagggcagggaa

SEQ ID NO: 219435 - DNA, 22 bp, Artificial Sequence
  Synthetic oligonucleotide; CTC chr2 60501275 60501296 60501280 60501275 -
cttgagggcagggaatgaggct

SEQ ID NO: 219436 - DNA, 22 bp, Artificial Sequence
  Synthetic oligonucleotide; CTT chr2 60501272 60501293 60501277 60501272 -
gagggcagggaatgaggctcat

SEQ ID NO: 219437 - DNA, 22 bp, Artificial Sequence
  Synthetic oligonucleotide; TTG chr2 60501271 60501292 60501276 60501271 -
agggcagggaatgaggctcatt

SEQ ID NO: 219438 - DNA, 22 bp, Artificial Sequence
  Synthetic oligonucleotide; CTC chr2 60501252 60501273 60501257 60501252 -
attccattttgttctggcaagt

SEQ ID NO: 219439 - DNA, 22 bp, Artificial Sequence
  Synthetic oligonucleotide; TTC chr2 60501248 60501269 60501253 60501248 -
cattttgttctggcaagtagca

SEQ ID NO: 219440 - DNA, 22 bp, Artificial Sequence
  Synthetic oligonucleotide; TTT chr2 60501243 60501264 60501248 60501243 -
tgttctggcaagtagcactaca

SEQ ID NO: 219441 - DNA, 22 bp, Artificial Sequence
  Synthetic oligonucleotide; TTT chr2 60501242 60501263 60501247 60501242 -
gttctggcaagtagcactacag

SEQ ID NO: 219442 - DNA, 22 bp, Artificial Sequence
  Synthetic oligonucleotide; TTG chr2 60501241 60501262 60501246 60501241 -
ttctggcaagtagcactacagg

SEQ ID NO: 219443 - DNA, 22 bp, Artificial Sequence
  Synthetic oligonucleotide; TTC chr2 60501238 60501259 60501243 60501238 -
tggcaagtagcactacaggttt

SEQ ID NO: 219444 - DNA, 22 bp, Artificial Sequence
  Synthetic oligonucleotide; CTG chr2 60501236 60501257 60501241 60501236 -
gcaagtagcactacaggtttgg

SEQ ID NO: 219445 - DNA, 22 bp, Artificial Sequence
  Synthetic oligonucleotide; CTA chr2 60501223 60501244 60501228 60501223 -
caggtttggaccaaatgaatta

SEQ ID NO: 219446 - DNA, 22 bp, Artificial Sequence
  Synthetic oligonucleotide; TTT chr2 60501216 60501237 60501221 60501216 -
ggaccaaatgaattaaattggc

SEQ ID NO: 219447 - DNA, 22 bp, Artificial Sequence
  Synthetic oligonucleotide; TTG chr2 60501215 60501236 60501220 60501215 -
gaccaaatgaattaaattggct

SEQ ID NO: 219448 - DNA, 22 bp, Artificial Sequence
  Synthetic oligonucleotide; TTA chr2 60501201 60501222 60501206 60501201 -
aattggctgccattgaatcaaa

SEQ ID NO: 219449 - DNA, 22 bp, Artificial Sequence
  Synthetic oligonucleotide; TTG chr2 60501196 60501217 60501201 60501196 -
gctgccattgaatcaaagcaga

SEQ ID NO: 219450 - DNA, 22 bp, Artificial Sequence
  Synthetic oligonucleotide; CTG chr2 60501192 60501213 60501197 60501192 -
ccattgaatcaaagcagaatga

SEQ ID NO: 219451 - DNA, 22 bp, Artificial Sequence
  Synthetic oligonucleotide; TTG chr2 60501186 60501207 60501191 60501186 -
aatcaaagcagaatgaaggtag

SEQ ID NO: 219452 - DNA, 22 bp, Artificial Sequence
  Synthetic oligonucleotide; TTT chr2 60501159 60501180 60501164 60501159 -
ctgaaacaataatataaataag

SEQ ID NO: 219453 - DNA, 22 bp, Artificial Sequence
  Synthetic oligonucleotide; TTC chr2 60501158 60501179 60501163 60501158 -
tgaaacaataatataaataagt

SEQ ID NO: 219454 - DNA, 22 bp, Artificial Sequence
  Synthetic oligonucleotide; CTG chr2 60501156 60501177 60501161 60501156 -
aaacaataatataaataagtgc

SEQ ID NO: 219455 - DNA, 22 bp, Artificial Sequence
  Synthetic oligonucleotide; TTG chr2 60501127 60501148 60501132 60501127 -
gatgtttaccaacaactttcca

SEQ ID NO: 219456 - DNA, 22 bp, Artificial Sequence
  Synthetic oligonucleotide; TTT chr2 60501120 60501141 60501125 60501120 -
accaacaactttccagaaacag

SEQ ID NO: 219457 - DNA, 22 bp, Artificial Sequence
  Synthetic oligonucleotide; TTA chr2 60501119 60501140 60501124 60501119 -
ccaacaactttccagaaacagg

SEQ ID NO: 219458 - DNA, 22 bp, Artificial Sequence
  Synthetic oligonucleotide; CTT chr2 60501109 60501130 60501114 60501109 -
tccagaaacaggtcttgtttca

SEQ ID NO: 219459 - DNA, 22 bp, Artificial Sequence
  Synthetic oligonucleotide; TTT chr2 60501108 60501129 60501113 60501108 -
ccagaaacaggtcttgtttcag

SEQ ID NO: 219460 - DNA, 22 bp, Artificial Sequence
  Synthetic oligonucleotide; TTC chr2 60501107 60501128 60501112 60501107 -
cagaaacaggtcttgtttcaga

SEQ ID NO: 219461 - DNA, 22 bp, Artificial Sequence
  Synthetic oligonucleotide; CTT chr2 60501093 60501114 60501098 60501093 -
gtttcagaagatgtgccaaaga

SEQ ID NO: 219462 - DNA, 22 bp, Artificial Sequence
  Synthetic oligonucleotide; TTG chr2 60501092 60501113 60501097 60501092 -
tttcagaagatgtgccaaagat

SEQ ID NO: 219463 - DNA, 22 bp, Artificial Sequence
  Synthetic oligonucleotide; TTT chr2 60501089 60501110 60501094 60501089 -
cagaagatgtgccaaagatgtc

SEQ ID NO: 219464 - DNA, 22 bp, Artificial Sequence
  Synthetic oligonucleotide; TTC chr2 60501088 60501109 60501093 60501088 -
agaagatgtgccaaagatgtct

SEQ ID NO: 219465 - DNA, 22 bp, Artificial Sequence
  Synthetic oligonucleotide; CTC chr2 60501065 60501086 60501070 60501065 -
atgtgggcagggctcctgtgga

SEQ ID NO: 219466 - DNA, 22 bp, Artificial Sequence
  Synthetic oligonucleotide; CTC chr2 60501050 60501071 60501055 60501050 -
ctgtggagacctctgttgctga

SEQ ID NO: 219467 - DNA, 22 bp, Artificial Sequence
  Synthetic oligonucleotide; CTG chr2 60501047 60501068 60501052 60501047 -
tggagacctctgttgctgagtg

SEQ ID NO: 219468 - DNA, 22 bp, Artificial Sequence
  Synthetic oligonucleotide; CTC chr2 60501037 60501058 60501042 60501037 -
tgttgctgagtgagtcaaccat

SEQ ID NO: 219469 - DNA, 22 bp, Artificial Sequence
  Synthetic oligonucleotide; CTG chr2 60501035 60501056 60501040 60501035 -
ttgctgagtgagtcaaccatga

SEQ ID NO: 219470 - DNA, 22 bp, Artificial Sequence
  Synthetic oligonucleotide; TTG chr2 60501032 60501053 60501037 60501032 -
ctgagtgagtcaaccatgaggt

SEQ ID NO: 219471 - DNA, 22 bp, Artificial Sequence
  Synthetic oligonucleotide; CTG chr2 60501029 60501050 60501034 60501029 -
agtgagtcaaccatgaggtcgg

SEQ ID NO: 219472 - DNA, 22 bp, Artificial Sequence
  Synthetic oligonucleotide; CTG chr2 60501004 60501025 60501009 60501004 -
agcagttcagggttctcccatt

SEQ ID NO: 219473 - DNA, 22 bp, Artificial Sequence
  Synthetic oligonucleotide; TTC chr2 60500996 60501017 60501001 60500996 -
agggttctcccattttacagag

SEQ ID NO: 219474 - DNA, 22 bp, Artificial Sequence
  Synthetic oligonucleotide; TTC chr2 60500989 60501010 60500994 60500989 -
tcccattttacagaggaggatg

SEQ ID NO: 219475 - DNA, 22 bp, Artificial Sequence
  Synthetic oligonucleotide; CTC chr2 60500987 60501008 60500992 60500987 -
ccattttacagaggaggatgca

SEQ ID NO: 219476 - DNA, 22 bp, Artificial Sequence
  Synthetic oligonucleotide; TTT chr2 60500981 60501002 60500986 60500981 -
tacagaggaggatgcagcgacc

SEQ ID NO: 219477 - DNA, 22 bp, Artificial Sequence
  Synthetic oligonucleotide; TTT chr2 60500980 60501001 60500985 60500980 -
acagaggaggatgcagcgaccc

SEQ ID NO: 219478 - DNA, 22 bp, Artificial Sequence
  Synthetic oligonucleotide; TTA chr2 60500979 60501000 60500984 60500979 -
cagaggaggatgcagcgaccca

SEQ ID NO: 219479 - DNA, 22 bp, Artificial Sequence
  Synthetic oligonucleotide; CTT chr2 60500948 60500969 60500953 60500948 -
gcaagcccacccagctaggctt

SEQ ID NO: 219480 - DNA, 22 bp, Artificial Sequence
  Synthetic oligonucleotide; TTG chr2 60500947 60500968 60500952 60500947 -
caagcccacccagctaggcttg

SEQ ID NO: 219481 - DNA, 22 bp, Artificial Sequence
  Synthetic oligonucleotide; CTA chr2 60500931 60500952 60500936 60500931 -
ggcttgcttcacagacactctt

SEQ ID NO: 219482 - DNA, 22 bp, Artificial Sequence
  Synthetic oligonucleotide; CTT chr2 60500926 60500947 60500931 60500926 -
gcttcacagacactcttttaac

SEQ ID NO: 219483 - DNA, 22 bp, Artificial Sequence
  Synthetic oligonucleotide; TTG chr2 60500925 60500946 60500930 60500925 -
cttcacagacactcttttaact

SEQ ID NO: 219484 - DNA, 22 bp, Artificial Sequence
  Synthetic oligonucleotide; CTT chr2 60500922 60500943 60500927 60500922 -
cacagacactcttttaactagt

SEQ ID NO: 219485 - DNA, 22 bp, Artificial Sequence
  Synthetic oligonucleotide; TTC chr2 60500921 60500942 60500926 60500921 -
acagacactcttttaactagtt

SEQ ID NO: 219486 - DNA, 22 bp, Artificial Sequence
  Synthetic oligonucleotide; CTC chr2 60500911 60500932 60500916 60500911 -
ttttaactagttccatcagcaa

SEQ ID NO: 219487 - DNA, 22 bp, Artificial Sequence
  Synthetic oligonucleotide; CTT chr2 60500909 60500930 60500914 60500909 -
ttaactagttccatcagcaacc

SEQ ID NO: 219488 - DNA, 22 bp, Artificial Sequence
  Synthetic oligonucleotide; TTT chr2 60500908 60500929 60500913 60500908 -
taactagttccatcagcaaccc

SEQ ID NO: 219489 - DNA, 22 bp, Artificial Sequence
  Synthetic oligonucleotide; TTT chr2 60500907 60500928 60500912 60500907 -
aactagttccatcagcaacccc

SEQ ID NO: 219490 - DNA, 22 bp, Artificial Sequence
  Synthetic oligonucleotide; TTA chr2 60500906 60500927 60500911 60500906 -
actagttccatcagcaacccca

SEQ ID NO: 219491 - DNA, 22 bp, Artificial Sequence
  Synthetic oligonucleotide; CTA chr2 60500902 60500923 60500907 60500902 -
gttccatcagcaaccccaggtt

SEQ ID NO: 219492 - DNA, 22 bp, Artificial Sequence
  Synthetic oligonucleotide; TTC chr2 60500898 60500919 60500903 60500898 -
catcagcaaccccaggttggcc

SEQ ID NO: 219493 - DNA, 22 bp, Artificial Sequence
  Synthetic oligonucleotide; TTG chr2 60500879 60500900 60500884 60500879 -
gccatacaatgtcatcatacac

SEQ ID NO: 219494 - DNA, 22 bp, Artificial Sequence
  Synthetic oligonucleotide; TTT chr2 60500853 60500874 60500858 60500853 -
taccagtgaagaaactgaggct

SEQ ID NO: 219495 - DNA, 22 bp, Artificial Sequence
  Synthetic oligonucleotide; TTT chr2 60500852 60500873 60500857 60500852 -
accagtgaagaaactgaggctt

SEQ ID NO: 219496 - DNA, 22 bp, Artificial Sequence
  Synthetic oligonucleotide; TTA chr2 60500851 60500872 60500856 60500851 -
ccagtgaagaaactgaggcttg

SEQ ID NO: 219497 - DNA, 22 bp, Artificial Sequence
  Synthetic oligonucleotide; CTG chr2 60500836 60500857 60500841 60500836 -
aggcttggagaggttaaagagc

SEQ ID NO: 219498 - DNA, 22 bp, Artificial Sequence
  Synthetic oligonucleotide; CTT chr2 60500830 60500851 60500835 60500830 -
ggagaggttaaagagctgctcc

SEQ ID NO: 219499 - DNA, 22 bp, Artificial Sequence
  Synthetic oligonucleotide; TTG chr2 60500829 60500850 60500834 60500829 -
gagaggttaaagagctgctccc

SEQ ID NO: 219500 - DNA, 22 bp, Artificial Sequence
  Synthetic oligonucleotide; TTA chr2 60500820 60500841 60500825 60500820 -
aagagctgctcccagacacaca

SEQ ID NO: 219501 - DNA, 22 bp, Artificial Sequence
  Synthetic oligonucleotide; CTG chr2 60500812 60500833 60500817 60500812 -
ctcccagacacacagccaggaa

SEQ ID NO: 219502 - DNA, 22 bp, Artificial Sequence
  Synthetic oligonucleotide; CTC chr2 60500809 60500830 60500814 60500809 -
ccagacacacagccaggaaatt

SEQ ID NO: 219503 - DNA, 22 bp, Artificial Sequence
  Synthetic oligonucleotide; TTG chr2 60500786 60500807 60500791 60500786 -
gtggtagatgaaggatccagct

SEQ ID NO: 219504 - DNA, 22 bp, Artificial Sequence
  Synthetic oligonucleotide; CTC chr2 60500763 60500784 60500768 60500763 -
atctgtctaacttgggagcctg

SEQ ID NO: 219505 - DNA, 22 bp, Artificial Sequence
  Synthetic oligonucleotide; CTG chr2 60500758 60500779 60500763 60500758 -
tctaacttgggagcctgagtgt

SEQ ID NO: 219506 - DNA, 22 bp, Artificial Sequence
  Synthetic oligonucleotide; CTA chr2 60500754 60500775 60500759 60500754 -
acttgggagcctgagtgttcat

SEQ ID NO: 219507 - DNA, 22 bp, Artificial Sequence
  Synthetic oligonucleotide; CTT chr2 60500750 60500771 60500755 60500750 -
gggagcctgagtgttcatctta

SEQ ID NO: 219508 - DNA, 22 bp, Artificial Sequence
  Synthetic oligonucleotide; TTG chr2 60500749 60500770 60500754 60500749 -
ggagcctgagtgttcatcttac

SEQ ID NO: 219509 - DNA, 22 bp, Artificial Sequence
  Synthetic oligonucleotide; CTG chr2 60500741 60500762 60500746 60500741 -
agtgttcatcttacctatccac

SEQ ID NO: 219510 - DNA, 22 bp, Artificial Sequence
  Synthetic oligonucleotide; TTC chr2 60500734 60500755 60500739 60500734 -
atcttacctatccaccaaggct

SEQ ID NO: 219511 - DNA, 22 bp, Artificial Sequence
  Synthetic oligonucleotide; CTT chr2 60500729 60500750 60500734 60500729 -
acctatccaccaaggcttgaag

SEQ ID NO: 219512 - DNA, 22 bp, Artificial Sequence
  Synthetic oligonucleotide; TTA chr2 60500728 60500749 60500733 60500728 -
cctatccaccaaggcttgaagt

SEQ ID NO: 219513 - DNA, 22 bp, Artificial Sequence
  Synthetic oligonucleotide; CTA chr2 60500724 60500745 60500729 60500724 -
tccaccaaggcttgaagtgagg

SEQ ID NO: 219514 - DNA, 22 bp, Artificial Sequence
  Synthetic oligonucleotide; CTT chr2 60500711 60500732 60500716 60500711 -
gaagtgaggtgccccgactgtg

SEQ ID NO: 219515 - DNA, 22 bp, Artificial Sequence
  Synthetic oligonucleotide; TTG chr2 60500710 60500731 60500715 60500710 -
aagtgaggtgccccgactgtga

SEQ ID NO: 219516 - DNA, 22 bp, Artificial Sequence
  Synthetic oligonucleotide; CTG chr2 60500691 60500712 60500696 60500691 -
tgagttccaggtttgatgccta

SEQ ID NO: 219517 - DNA, 22 bp, Artificial Sequence
  Synthetic oligonucleotide; TTC chr2 60500684 60500705 60500689 60500684 -
caggtttgatgcctacagccca

SEQ ID NO: 219518 - DNA, 22 bp, Artificial Sequence
  Synthetic oligonucleotide; TTT chr2 60500677 60500698 60500682 60500677 -
gatgcctacagcccatcagcct

SEQ ID NO: 219519 - DNA, 22 bp, Artificial Sequence
  Synthetic oligonucleotide; TTG chr2 60500676 60500697 60500681 60500676 -
atgcctacagcccatcagcctt

SEQ ID NO: 219520 - DNA, 22 bp, Artificial Sequence
  Synthetic oligonucleotide; CTA chr2 60500669 60500690 60500674 60500669 -
cagcccatcagccttatacctt

SEQ ID NO: 219521 - DNA, 22 bp, Artificial Sequence
  Synthetic oligonucleotide; CTT chr2 60500654 60500675 60500659 60500654 -
ataccttgtcttataccttaac

SEQ ID NO: 219522 - DNA, 22 bp, Artificial Sequence
  Synthetic oligonucleotide; TTA chr2 60500653 60500674 60500658 60500653 -
taccttgtcttataccttaact

SEQ ID NO: 219523 - DNA, 22 bp, Artificial Sequence
  Synthetic oligonucleotide; CTT chr2 60500647 60500668 60500652 60500647 -
gtcttataccttaactggtgga

SEQ ID NO: 219524 - DNA, 22 bp, Artificial Sequence
  Synthetic oligonucleotide; TTG chr2 60500646 60500667 60500651 60500646 -
tcttataccttaactggtggag

SEQ ID NO: 219525 - DNA, 22 bp, Artificial Sequence
  Synthetic oligonucleotide; CTT chr2 60500642 60500663 60500647 60500642 -
ataccttaactggtggagggtg

SEQ ID NO: 219526 - DNA, 22 bp, Artificial Sequence
  Synthetic oligonucleotide; TTA chr2 60500641 60500662 60500646 60500641 -
taccttaactggtggagggtgc

SEQ ID NO: 219527 - DNA, 22 bp, Artificial Sequence
  Synthetic oligonucleotide; CTT chr2 60500635 60500656 60500640 60500635 -
aactggtggagggtgctgtctc

SEQ ID NO: 219528 - DNA, 22 bp, Artificial Sequence
  Synthetic oligonucleotide; TTA chr2 60500634 60500655 60500639 60500634 -
actggtggagggtgctgtctct

SEQ ID NO: 219529 - DNA, 22 bp, Artificial Sequence
  Synthetic oligonucleotide; CTG chr2 60500630 60500651 60500635 60500630 -
gtggagggtgctgtctctgtgt

SEQ ID NO: 219530 - DNA, 22 bp, Artificial Sequence
  Synthetic oligonucleotide; CTG chr2 60500617 60500638 60500622 60500617 -
tctctgtgtagcagccaccagc

SEQ ID NO: 219531 - DNA, 22 bp, Artificial Sequence
  Synthetic oligonucleotide; CTC chr2 60500613 60500634 60500618 60500613 -
tgtgtagcagccaccagcctag

SEQ ID NO: 219532 - DNA, 22 bp, Artificial Sequence
  Synthetic oligonucleotide; CTG chr2 60500611 60500632 60500616 60500611 -
tgtagcagccaccagcctagct

SEQ ID NO: 219533 - DNA, 22 bp, Artificial Sequence
  Synthetic oligonucleotide; CTA chr2 60500592 60500613 60500597 60500592 -
gctctgaaccctgtcctgagga

SEQ ID NO: 219534 - DNA, 22 bp, Artificial Sequence
  Synthetic oligonucleotide; CTC chr2 60500588 60500609 60500593 60500588 -
tgaaccctgtcctgaggagttg

SEQ ID NO: 219535 - DNA, 22 bp, Artificial Sequence
  Synthetic oligonucleotide; CTG chr2 60500586 60500607 60500591 60500586 -
aaccctgtcctgaggagttggg

SEQ ID NO: 219536 - DNA, 22 bp, Artificial Sequence
  Synthetic oligonucleotide; CTG chr2 60500579 60500600 60500584 60500579 -
tcctgaggagttgggaagtgtg

SEQ ID NO: 219537 - DNA, 22 bp, Artificial Sequence
  Synthetic oligonucleotide; CTG chr2 60500574 60500595 60500579 60500574 -
aggagttgggaagtgtggggtg

SEQ ID NO: 219538 - DNA, 22 bp, Artificial Sequence
  Synthetic oligonucleotide; TTG chr2 60500566 60500587 60500571 60500566 -
ggaagtgtggggtgtctggttt

SEQ ID NO: 219539 - DNA, 22 bp, Artificial Sequence
  Synthetic oligonucleotide; CTG chr2 60500548 60500569 60500553 60500548 -
gtttattccatcaatacacgta

SEQ ID NO: 219540 - DNA, 22 bp, Artificial Sequence
  Synthetic oligonucleotide; TTT chr2 60500544 60500565 60500549 60500544 -
attccatcaatacacgtagtcc

SEQ ID NO: 219541 - DNA, 22 bp, Artificial Sequence
  Synthetic oligonucleotide; TTA chr2 60500543 60500564 60500548 60500543 -
ttccatcaatacacgtagtccc

SEQ ID NO: 219542 - DNA, 22 bp, Artificial Sequence
  Synthetic oligonucleotide; TTC chr2 60500540 60500561 60500545 60500540 -
catcaatacacgtagtcccttc

SEQ ID NO: 219543 - DNA, 22 bp, Artificial Sequence
  Synthetic oligonucleotide; CTT chr2 60500519 60500540 60500524 60500519 -
ccattcttctgccattttttct

SEQ ID NO: 219544 - DNA, 22 bp, Artificial Sequence
  Synthetic oligonucleotide; TTC chr2 60500518 60500539 60500523 60500518 -
cattcttctgccattttttctc

SEQ ID NO: 219545 - DNA, 22 bp, Artificial Sequence
  Synthetic oligonucleotide; TTC chr2 60500513 60500534 60500518 60500513 -
ttctgccattttttctcagggg

SEQ ID NO: 219546 - DNA, 22 bp, Artificial Sequence
  Synthetic oligonucleotide; CTT chr2 60500511 60500532 60500516 60500511 -
ctgccattttttctcaggggct

SEQ ID NO: 219547 - DNA, 22 bp, Artificial Sequence
  Synthetic oligonucleotide; TTC chr2 60500510 60500531 60500515 60500510 -
tgccattttttctcaggggctc

SEQ ID NO: 219548 - DNA, 22 bp, Artificial Sequence
  Synthetic oligonucleotide; CTG chr2 60500508 60500529 60500513 60500508 -
ccattttttctcaggggctctc

SEQ ID NO: 219549 - DNA, 22 bp, Artificial Sequence
  Synthetic oligonucleotide; TTT chr2 60500502 60500523 60500507 60500502 -
tttctcaggggctctccttcct

SEQ ID NO: 219550 - DNA, 22 bp, Artificial Sequence
  Synthetic oligonucleotide; TTT chr2 60500501 60500522 60500506 60500501 -
ttctcaggggctctccttcctt

SEQ ID NO: 219551 - DNA, 22 bp, Artificial Sequence
  Synthetic oligonucleotide; TTT chr2 60500500 60500521 60500505 60500500 -
tctcaggggctctccttccttc

SEQ ID NO: 219552 - DNA, 22 bp, Artificial Sequence
  Synthetic oligonucleotide; TTT chr2 60500499 60500520 60500504 60500499 -
ctcaggggctctccttccttcc

SEQ ID NO: 219553 - DNA, 22 bp, Artificial Sequence
  Synthetic oligonucleotide; TTC chr2 60500498 60500519 60500503 60500498 -
tcaggggctctccttccttccc

SEQ ID NO: 219554 - DNA, 22 bp, Artificial Sequence
  Synthetic oligonucleotide; CTC chr2 60500496 60500517 60500501 60500496 -
aggggctctccttccttccctg

SEQ ID NO: 219555 - DNA, 22 bp, Artificial Sequence
  Synthetic oligonucleotide; CTC chr2 60500488 60500509 60500493 60500488 -
tccttccttccctggctcttgg

SEQ ID NO: 219556 - DNA, 22 bp, Artificial Sequence
  Synthetic oligonucleotide; CTC chr2 60500486 60500507 60500491 60500486 -
cttccttccctggctcttgggt

SEQ ID NO: 219557 - DNA, 22 bp, Artificial Sequence
  Synthetic oligonucleotide; CTT chr2 60500483 60500504 60500488 60500483 -
ccttccctggctcttgggtagg

SEQ ID NO: 219558 - DNA, 22 bp, Artificial Sequence
  Synthetic oligonucleotide; TTC chr2 60500482 60500503 60500487 60500482 -
cttccctggctcttgggtaggc

SEQ ID NO: 219559 - DNA, 22 bp, Artificial Sequence
  Synthetic oligonucleotide; CTT chr2 60500479 60500500 60500484 60500479 -
ccctggctcttgggtaggctgc

SEQ ID NO: 219560 - DNA, 22 bp, Artificial Sequence
  Synthetic oligonucleotide; TTC chr2 60500478 60500499 60500483 60500478 -
cctggctcttgggtaggctgcc

SEQ ID NO: 219561 - DNA, 22 bp, Artificial Sequence
  Synthetic oligonucleotide; CTG chr2 60500474 60500495 60500479 60500474 -
gctcttgggtaggctgcctgct

SEQ ID NO: 219562 - DNA, 22 bp, Artificial Sequence
  Synthetic oligonucleotide; CTC chr2 60500470 60500491 60500475 60500470 -
ttgggtaggctgcctgctctga

SEQ ID NO: 219563 - DNA, 22 bp, Artificial Sequence
  Synthetic oligonucleotide; CTT chr2 60500468 60500489 60500473 60500468 -
gggtaggctgcctgctctgatg

SEQ ID NO: 219564 - DNA, 22 bp, Artificial Sequence
  Synthetic oligonucleotide; TTG chr2 60500467 60500488 60500472 60500467 -
ggtaggctgcctgctctgatgt

SEQ ID NO: 219565 - DNA, 22 bp, Artificial Sequence
  Synthetic oligonucleotide; CTG chr2 60500458 60500479 60500463 60500458 -
cctgctctgatgtaagttcctg

SEQ ID NO: 219566 - DNA, 22 bp, Artificial Sequence
  Synthetic oligonucleotide; CTG chr2 60500454 60500475 60500459 60500454 -
ctctgatgtaagttcctgctgg

SEQ ID NO: 219567 - DNA, 22 bp, Artificial Sequence
  Synthetic oligonucleotide; CTC chr2 60500451 60500472 60500456 60500451 -
tgatgtaagttcctgctgggat

SEQ ID NO: 219568 - DNA, 22 bp, Artificial Sequence
  Synthetic oligonucleotide; CTG chr2 60500449 60500470 60500454 60500449 -
atgtaagttcctgctgggatga

SEQ ID NO: 219569 - DNA, 22 bp, Artificial Sequence
  Synthetic oligonucleotide; TTC chr2 60500439 60500460 60500444 60500439 -
ctgctgggatgattgctctggc

SEQ ID NO: 219570 - DNA, 22 bp, Artificial Sequence
  Synthetic oligonucleotide; CTG chr2 60500436 60500457 60500441 60500436 -
ctgggatgattgctctggccag

SEQ ID NO: 219571 - DNA, 22 bp, Artificial Sequence
  Synthetic oligonucleotide; CTG chr2 60500433 60500454 60500438 60500433 -
ggatgattgctctggccaggcc

SEQ ID NO: 219572 - DNA, 22 bp, Artificial Sequence
  Synthetic oligonucleotide; TTG chr2 60500424 60500445 60500429 60500424 -
ctctggccaggcccccagctgc

SEQ ID NO: 219573 - DNA, 22 bp, Artificial Sequence
  Synthetic oligonucleotide; CTC chr2 60500421 60500442 60500426 60500421 -
tggccaggcccccagctgctcc

SEQ ID NO: 219574 - DNA, 22 bp, Artificial Sequence
  Synthetic oligonucleotide; CTG chr2 60500419 60500440 60500424 60500419 -
gccaggcccccagctgctccct

SEQ ID NO: 219575 - DNA, 22 bp, Artificial Sequence
  Synthetic oligonucleotide; CTG chr2 60500403 60500424 60500408 60500403 -
ctccctgcccttctctgaaggc

SEQ ID NO: 219576 - DNA, 22 bp, Artificial Sequence
  Synthetic oligonucleotide; CTC chr2 60500400 60500421 60500405 60500400 -
cctgcccttctctgaaggcaca

SEQ ID NO: 219577 - DNA, 22 bp, Artificial Sequence
  Synthetic oligonucleotide; CTG chr2 60500396 60500417 60500401 60500396 -
cccttctctgaaggcacatctg

SEQ ID NO: 219578 - DNA, 22 bp, Artificial Sequence
  Synthetic oligonucleotide; CTT chr2 60500391 60500412 60500396 60500391 -
ctctgaaggcacatctgtcagc

SEQ ID NO: 219579 - DNA, 22 bp, Artificial Sequence
  Synthetic oligonucleotide; TTC chr2 60500390 60500411 60500395 60500390 -
tctgaaggcacatctgtcagcc

SEQ ID NO: 219580 - DNA, 22 bp, Artificial Sequence
  Synthetic oligonucleotide; CTC chr2 60500388 60500409 60500393 60500388 -
tgaaggcacatctgtcagccca

SEQ ID NO: 219581 - DNA, 22 bp, Artificial Sequence
  Synthetic oligonucleotide; CTG chr2 60500386 60500407 60500391 60500386 -
aaggcacatctgtcagcccaca

SEQ ID NO: 219582 - DNA, 22 bp, Artificial Sequence
  Synthetic oligonucleotide; CTG chr2 60500374 60500395 60500379 60500374 -
tcagcccacagaggcacggtta

SEQ ID NO: 219583 - DNA, 22 bp, Artificial Sequence
  Synthetic oligonucleotide; TTA chr2 60500352 60500373 60500357 60500352 -
atggtggcggggaagcagaggc

SEQ ID NO: 219584 - DNA, 22 bp, Artificial Sequence
  Synthetic oligonucleotide; CTG chr2 60500310 60500331 60500315 60500310 -
gccccgggaacctcacctgccc

SEQ ID NO: 219585 - DNA, 22 bp, Artificial Sequence
  Synthetic oligonucleotide; CTC chr2 60500296 60500317 60500301 60500296 -
acctgccctatccctacctgcc

SEQ ID NO: 219586 - DNA, 22 bp, Artificial Sequence
  Synthetic oligonucleotide; CTG chr2 60500291 60500312 60500296 60500291 -
ccctatccctacctgccccctg

SEQ ID NO: 219587 - DNA, 22 bp, Artificial Sequence
  Synthetic oligonucleotide; CTA chr2 60500286 60500307 60500291 60500286 -
tccctacctgccccctgtcccc

SEQ ID NO: 219588 - DNA, 22 bp, Artificial Sequence
  Synthetic oligonucleotide; CTA chr2 60500280 60500301 60500285 60500280 -
cctgccccctgtcccctccccg

SEQ ID NO: 219589 - DNA, 22 bp, Artificial Sequence
  Synthetic oligonucleotide; CTG chr2 60500276 60500297 60500281 60500276 -
ccccctgtcccctccccgcctg

SEQ ID NO: 219590 - DNA, 22 bp, Artificial Sequence
  Synthetic oligonucleotide; CTG chr2 60500269 60500290 60500274 60500269 -
tcccctccccgcctgggcttga

SEQ ID NO: 219591 - DNA, 22 bp, Artificial Sequence
  Synthetic oligonucleotide; CTC chr2 60500262 60500283 60500267 60500262 -
cccgcctgggcttgacttgtcc

SEQ ID NO: 219592 - DNA, 22 bp, Artificial Sequence
  Synthetic oligonucleotide; CTG chr2 60500254 60500275 60500259 60500254 -
ggcttgacttgtccactttcac

SEQ ID NO: 219593 - DNA, 22 bp, Artificial Sequence
  Synthetic oligonucleotide; CTT chr2 60500249 60500270 60500254 60500249 -
gacttgtccactttcactctca

SEQ ID NO: 219594 - DNA, 22 bp, Artificial Sequence
  Synthetic oligonucleotide; TTG chr2 60500248 60500269 60500253 60500248 -
acttgtccactttcactctcaa

SEQ ID NO: 219595 - DNA, 22 bp, Artificial Sequence
  Synthetic oligonucleotide; CTT chr2 60500244 60500265 60500249 60500244 -
gtccactttcactctcaagacc

SEQ ID NO: 219596 - DNA, 22 bp, Artificial Sequence
  Synthetic oligonucleotide; TTG chr2 60500243 60500264 60500248 60500243 -
tccactttcactctcaagacca

SEQ ID NO: 219597 - DNA, 22 bp, Artificial Sequence
  Synthetic oligonucleotide; CTT chr2 60500236 60500257 60500241 60500236 -
tcactctcaagaccaccgctct

SEQ ID NO: 219598 - DNA, 22 bp, Artificial Sequence
  Synthetic oligonucleotide; TTT chr2 60500235 60500256 60500240 60500235 -
cactctcaagaccaccgctctc

SEQ ID NO: 219599 - DNA, 22 bp, Artificial Sequence
  Synthetic oligonucleotide; TTC chr2 60500234 60500255 60500239 60500234 -
actctcaagaccaccgctctca

SEQ ID NO: 219600 - DNA, 22 bp, Artificial Sequence
  Synthetic oligonucleotide; CTC chr2 60500230 60500251 60500235 60500230 -
tcaagaccaccgctctcacaca

SEQ ID NO: 219601 - DNA, 22 bp, Artificial Sequence
  Synthetic oligonucleotide; CTC chr2 60500228 60500249 60500233 60500228 -
aagaccaccgctctcacacaca

SEQ ID NO: 219602 - DNA, 22 bp, Artificial Sequence
  Synthetic oligonucleotide; CTC chr2 60500215 60500236 60500220 60500215 -
tcacacacaggtcctgtgctgc

SEQ ID NO: 219603 - DNA, 22 bp, Artificial Sequence
  Synthetic oligonucleotide; CTC chr2 60500213 60500234 60500218 60500213 -
acacacaggtcctgtgctgccc

SEQ ID NO: 219604 - DNA, 22 bp, Artificial Sequence
  Synthetic oligonucleotide; CTG chr2 60500199 60500220 60500204 60500199 -
tgctgcccccacagctttgcag

SEQ ID NO: 219605 - DNA, 22 bp, Artificial Sequence
  Synthetic oligonucleotide; CTG chr2 60500194 60500215 60500199 60500194 -
cccccacagctttgcaggctgc

SEQ ID NO: 219606 - DNA, 22 bp, Artificial Sequence
  Synthetic oligonucleotide; CTT chr2 60500182 60500203 60500187 60500182 -
tgcaggctgctggttttccatc

SEQ ID NO: 219607 - DNA, 22 bp, Artificial Sequence
  Synthetic oligonucleotide; TTT chr2 60500181 60500202 60500186 60500181 -
gcaggctgctggttttccatcc

SEQ ID NO: 219608 - DNA, 22 bp, Artificial Sequence
  Synthetic oligonucleotide; TTG chr2 60500180 60500201 60500185 60500180 -
caggctgctggttttccatcca

SEQ ID NO: 219609 - DNA, 22 bp, Artificial Sequence
  Synthetic oligonucleotide; CTG chr2 60500173 60500194 60500178 60500173 -
ctggttttccatccagggcaca

SEQ ID NO: 219610 - DNA, 22 bp, Artificial Sequence
  Synthetic oligonucleotide; CTG chr2 60500170 60500191 60500175 60500170 -
gttttccatccagggcacagcc

SEQ ID NO: 219611 - DNA, 22 bp, Artificial Sequence
  Synthetic oligonucleotide; TTT chr2 60500166 60500187 60500171 60500166 -
tccatccagggcacagccgcag

SEQ ID NO: 219612 - DNA, 22 bp, Artificial Sequence
  Synthetic oligonucleotide; TTT chr2 60500165 60500186 60500170 60500165 -
ccatccagggcacagccgcagg

SEQ ID NO: 219613 - DNA, 22 bp, Artificial Sequence
  Synthetic oligonucleotide; TTC chr2 60500164 60500185 60500169 60500164 -
catccagggcacagccgcaggc

SEQ ID NO: 219614 - DNA, 22 bp, Artificial Sequence
  Synthetic oligonucleotide; CTC chr2 60500139 60500160 60500144 60500139 -
tgggcaccctagccctcagtgc

SEQ ID NO: 219615 - DNA, 22 bp, Artificial Sequence
  Synthetic oligonucleotide; CTG chr2 60500137 60500158 60500142 60500137 -
ggcaccctagccctcagtgccc

SEQ ID NO: 219616 - DNA, 22 bp, Artificial Sequence
  Synthetic oligonucleotide; CTA chr2 60500128 60500149 60500133 60500128 -
gccctcagtgcccagggcaaag

SEQ ID NO: 219617 - DNA, 22 bp, Artificial Sequence
  Synthetic oligonucleotide; CTC chr2 60500122 60500143 60500127 60500122 -
agtgcccagggcaaagccctga

SEQ ID NO: 219618 - DNA, 22 bp, Artificial Sequence
  Synthetic oligonucleotide; CTG chr2 60500101 60500122 60500106 60500101 -
acatgcaatctcactggcaggc

SEQ ID NO: 219619 - DNA, 22 bp, Artificial Sequence
  Synthetic oligonucleotide; CTC chr2 60500089 60500110 60500094 60500089 -
actggcaggcagcctcaggcag

SEQ ID NO: 219620 - DNA, 22 bp, Artificial Sequence
  Synthetic oligonucleotide; CTG chr2 60500085 60500106 60500090 60500085 -
gcaggcagcctcaggcaggcct

SEQ ID NO: 219621 - DNA, 22 bp, Artificial Sequence
  Synthetic oligonucleotide; CTC chr2 60500073 60500094 60500078 60500073 -
aggcaggcctgggcagaggacc

SEQ ID NO: 219622 - DNA, 22 bp, Artificial Sequence
  Synthetic oligonucleotide; CTG chr2 60500062 60500083 60500067 60500062 -
ggcagaggaccgaaaggaggag

SEQ ID NO: 219623 - DNA, 22 bp, Artificial Sequence
  Synthetic oligonucleotide; CTA chr2 60500024 60500045 60500029 60500024 -
cagtagagcagacaggagacaa

SEQ ID NO: 219624 - DNA, 22 bp, Artificial Sequence
  Synthetic oligonucleotide; CTA chr2 60499992 60500013 60499997 60499992 -
agagtaaacagcctggcagtgg

SEQ ID NO: 219625 - DNA, 22 bp, Artificial Sequence
  Synthetic oligonucleotide; CTG chr2 60499977 60499998 60499982 60499977 -
gcagtggggtgagtgcctggct

SEQ ID NO: 219626 - DNA, 22 bp, Artificial Sequence
  Synthetic oligonucleotide; CTG chr2 60499958 60499979 60499963 60499958 -
gctggaggggctcacctgggct

SEQ ID NO: 219627 - DNA, 22 bp, Artificial Sequence
  Synthetic oligonucleotide; CTG chr2 60499954 60499975 60499959 60499954 -
gaggggctcacctgggctggcc

SEQ ID NO: 219628 - DNA, 22 bp, Artificial Sequence
  Synthetic oligonucleotide; CTC chr2 60499945 60499966 60499950 60499945 -
acctgggctggcctgcctggga

SEQ ID NO: 219629 - DNA, 22 bp, Artificial Sequence
  Synthetic oligonucleotide; CTG chr2 60499940 60499961 60499945 60499940 -
ggctggcctgcctgggaggagc

SEQ ID NO: 219630 - DNA, 22 bp, Artificial Sequence
  Synthetic oligonucleotide; CTG chr2 60499935 60499956 60499940 60499935 -
gcctgcctgggaggagccaggt

SEQ ID NO: 219631 - DNA, 22 bp, Artificial Sequence
  Synthetic oligonucleotide; CTG chr2 60499930 60499951 60499935 60499930 -
cctgggaggagccaggtcggtg

SEQ ID NO: 219632 - DNA, 22 bp, Artificial Sequence
  Synthetic oligonucleotide; CTG chr2 60499926 60499947 60499931 60499926 -
ggaggagccaggtcggtggctg

SEQ ID NO: 219633 - DNA, 22 bp, Artificial Sequence
  Synthetic oligonucleotide; CTG chr2 60499904 60499925 60499909 60499904 -
ctctctccgaatcttagtcctg

SEQ ID NO: 219634 - DNA, 22 bp, Artificial Sequence
  Synthetic oligonucleotide; CTC chr2 60499901 60499922 60499906 60499901 -
tctccgaatcttagtcctgctt

SEQ ID NO: 219635 - DNA, 22 bp, Artificial Sequence
  Synthetic oligonucleotide; CTC chr2 60499899 60499920 60499904 60499899 -
tccgaatcttagtcctgcttga

SEQ ID NO: 219636 - DNA, 22 bp, Artificial Sequence
  Synthetic oligonucleotide; CTC chr2 60499897 60499918 60499902 60499897 -
cgaatcttagtcctgcttgagg

SEQ ID NO: 219637 - DNA, 22 bp, Artificial Sequence
  Synthetic oligonucleotide; CTT chr2 60499889 60499910 60499894 60499889 -
agtcctgcttgaggtctagcag

SEQ ID NO: 219638 - DNA, 22 bp, Artificial Sequence
  Synthetic oligonucleotide; TTA chr2 60499888 60499909 60499893 60499888 -
gtcctgcttgaggtctagcagc

SEQ ID NO: 219639 - DNA, 22 bp, Artificial Sequence
  Synthetic oligonucleotide; CTG chr2 60499882 60499903 60499887 60499882 -
cttgaggtctagcagcttccgg

SEQ ID NO: 219640 - DNA, 22 bp, Artificial Sequence
  Synthetic oligonucleotide; CTT chr2 60499879 60499900 60499884 60499879 -
gaggtctagcagcttccggagc

SEQ ID NO: 219641 - DNA, 22 bp, Artificial Sequence
  Synthetic oligonucleotide; TTG chr2 60499878 60499899 60499883 60499878 -
aggtctagcagcttccggagct

SEQ ID NO: 219642 - DNA, 22 bp, Artificial Sequence
  Synthetic oligonucleotide; CTA chr2 60499871 60499892 60499876 60499871 -
gcagcttccggagctgcacatg

SEQ ID NO: 219643 - DNA, 22 bp, Artificial Sequence
  Synthetic oligonucleotide; CTT chr2 60499864 60499885 60499869 60499864 -
ccggagctgcacatggggcttg

SEQ ID NO: 219644 - DNA, 22 bp, Artificial Sequence
  Synthetic oligonucleotide; TTC chr2 60499863 60499884 60499868 60499863 -
cggagctgcacatggggcttga

SEQ ID NO: 219645 - DNA, 22 bp, Artificial Sequence
  Synthetic oligonucleotide; CTG chr2 60499855 60499876 60499860 60499855 -
cacatggggcttgaggtctggt

SEQ ID NO: 219646 - DNA, 22 bp, Artificial Sequence
  Synthetic oligonucleotide; CTT chr2 60499843 60499864 60499848 60499843 -
gaggtctggtgcttatggatta

SEQ ID NO: 219647 - DNA, 22 bp, Artificial Sequence
  Synthetic oligonucleotide; TTG chr2 60499842 60499863 60499847 60499842 -
aggtctggtgcttatggattag

SEQ ID NO: 219648 - DNA, 22 bp, Artificial Sequence
  Synthetic oligonucleotide; CTG chr2 60499835 60499856 60499840 60499835 -
gtgcttatggattaggaggaag

SEQ ID NO: 219649 - DNA, 22 bp, Artificial Sequence
  Synthetic oligonucleotide; CTT chr2 60499829 60499850 60499834 60499829 -
atggattaggaggaagagaaga

SEQ ID NO: 219650 - DNA, 22 bp, Artificial Sequence
  Synthetic oligonucleotide; TTA chr2 60499828 60499849 60499833 60499828 -
tggattaggaggaagagaagac

SEQ ID NO: 219651 - DNA, 22 bp, Artificial Sequence
  Synthetic oligonucleotide; TTA chr2 60499821 60499842 60499826 60499821 -
ggaggaagagaagacagatggc

SEQ ID NO: 219652 - DNA, 22 bp, Artificial Sequence
  Synthetic oligonucleotide; CTT chr2 60499782 60499803 60499787 60499782 -
aggaacatgtctccttccacat

SEQ ID NO: 219653 - DNA, 22 bp, Artificial Sequence
  Synthetic oligonucleotide; TTA chr2 60499781 60499802 60499786 60499781 -
ggaacatgtctccttccacatg

SEQ ID NO: 219654 - DNA, 22 bp, Artificial Sequence
  Synthetic oligonucleotide; CTC chr2 60499769 60499790 60499774 60499769 -
cttccacatgctgtggcccagg

SEQ ID NO: 219655 - DNA, 22 bp, Artificial Sequence
  Synthetic oligonucleotide; CTT chr2 60499766 60499787 60499771 60499766 -
ccacatgctgtggcccaggtgc

SEQ ID NO: 219656 - DNA, 22 bp, Artificial Sequence
  Synthetic oligonucleotide; TTC chr2 60499765 60499786 60499770 60499765 -
cacatgctgtggcccaggtgct

SEQ ID NO: 219657 - DNA, 22 bp, Artificial Sequence
  Synthetic oligonucleotide; CTG chr2 60499756 60499777 60499761 60499756 -
tggcccaggtgctgcccagagc

SEQ ID NO: 219658 - DNA, 22 bp, Artificial Sequence
  Synthetic oligonucleotide; CTG chr2 60499742 60499763 60499747 60499742 -
cccagagctgtttcacagcagc

SEQ ID NO: 219659 - DNA, 22 bp, Artificial Sequence
  Synthetic oligonucleotide; CTG chr2 60499732 60499753 60499737 60499732 -
tttcacagcagcctctccactc

SEQ ID NO: 219660 - DNA, 22 bp, Artificial Sequence
  Synthetic oligonucleotide; TTT chr2 60499729 60499750 60499734 60499729 -
cacagcagcctctccactcaag

SEQ ID NO: 219661 - DNA, 22 bp, Artificial Sequence
  Synthetic oligonucleotide; TTC chr2 60499728 60499749 60499733 60499728 -
acagcagcctctccactcaagg

SEQ ID NO: 219662 - DNA, 22 bp, Artificial Sequence
  Synthetic oligonucleotide; CTC chr2 60499717 60499738 60499722 60499717 -
tccactcaaggttgagcggttt

SEQ ID NO: 219663 - DNA, 22 bp, Artificial Sequence
  Synthetic oligonucleotide; CTC chr2 60499715 60499736 60499720 60499715 -
cactcaaggttgagcggtttcc

SEQ ID NO: 219664 - DNA, 22 bp, Artificial Sequence
  Synthetic oligonucleotide; CTC chr2 60499710 60499731 60499715 60499710 -
aaggttgagcggtttccttcag

SEQ ID NO: 219665 - DNA, 22 bp, Artificial Sequence
  Synthetic oligonucleotide; TTG chr2 60499703 60499724 60499708 60499703 -
agcggtttccttcagtgctgtc

SEQ ID NO: 219666 - DNA, 22 bp, Artificial Sequence
  Synthetic oligonucleotide; TTT chr2 60499695 60499716 60499700 60499695 -
ccttcagtgctgtccacccctt

SEQ ID NO: 219667 - DNA, 22 bp, Artificial Sequence
  Synthetic oligonucleotide; TTC chr2 60499694 60499715 60499699 60499694 -
cttcagtgctgtccaccccttt

SEQ ID NO: 219668 - DNA, 22 bp, Artificial Sequence
  Synthetic oligonucleotide; CTT chr2 60499691 60499712 60499696 60499691 -
cagtgctgtccacccctttggt

SEQ ID NO: 219669 - DNA, 22 bp, Artificial Sequence
  Synthetic oligonucleotide; TTC chr2 60499690 60499711 60499695 60499690 -
agtgctgtccacccctttggtc

SEQ ID NO: 219670 - DNA, 22 bp, Artificial Sequence
  Synthetic oligonucleotide; CTG chr2 60499683 60499704 60499688 60499683 -
tccacccctttggtccggggag

SEQ ID NO: 219671 - DNA, 22 bp, Artificial Sequence
  Synthetic oligonucleotide; CTT chr2 60499673 60499694 60499678 60499673 -
tggtccggggagcttcatgttc

SEQ ID NO: 219672 - DNA, 22 bp, Artificial Sequence
  Synthetic oligonucleotide; TTT chr2 60499672 60499693 60499677 60499672 -
ggtccggggagcttcatgttcc

SEQ ID NO: 219673 - DNA, 22 bp, Artificial Sequence
  Synthetic oligonucleotide; TTG chr2 60499671 60499692 60499676 60499671 -
gtccggggagcttcatgttcct

SEQ ID NO: 219674 - DNA, 22 bp, Artificial Sequence
  Synthetic oligonucleotide; CTT chr2 60499658 60499679 60499663 60499658 -
catgttcctgggcctcactgac

SEQ ID NO: 219675 - DNA, 22 bp, Artificial Sequence
  Synthetic oligonucleotide; TTC chr2 60499657 60499678 60499662 60499657 -
atgttcctgggcctcactgaca

SEQ ID NO: 219676 - DNA, 22 bp, Artificial Sequence
  Synthetic oligonucleotide; TTC chr2 60499651 60499672 60499656 60499651 -
ctgggcctcactgacacctgca

SEQ ID NO: 219677 - DNA, 22 bp, Artificial Sequence
  Synthetic oligonucleotide; CTG chr2 60499648 60499669 60499653 60499648 -
ggcctcactgacacctgcatgg

SEQ ID NO: 219678 - DNA, 22 bp, Artificial Sequence
  Synthetic oligonucleotide; CTC chr2 60499642 60499663 60499647 60499642 -
actgacacctgcatggggttgg

SEQ ID NO: 219679 - DNA, 22 bp, Artificial Sequence
  Synthetic oligonucleotide; CTG chr2 60499638 60499659 60499643 60499638 -
acacctgcatggggttggtggg

SEQ ID NO: 219680 - DNA, 22 bp, Artificial Sequence
  Synthetic oligonucleotide; CTG chr2 60499631 60499652 60499636 60499631 -
catggggttggtggggaggtat

SEQ ID NO: 219681 - DNA, 22 bp, Artificial Sequence
  Synthetic oligonucleotide; TTG chr2 60499621 60499642 60499626 60499621 -
gtggggaggtatgaggggttgg

SEQ ID NO: 219682 - DNA, 22 bp, Artificial Sequence
  Synthetic oligonucleotide; TTG chr2 60499600 60499621 60499605 60499600 -
gaggggtctttttgctagccct

SEQ ID NO: 219683 - DNA, 22 bp, Artificial Sequence
  Synthetic oligonucleotide; CTT chr2 60499590 60499611 60499595 60499590 -
tttgctagccctggcccgtggc

SEQ ID NO: 219684 - DNA, 22 bp, Artificial Sequence
  Synthetic oligonucleotide; TTT chr2 60499589 60499610 60499594 60499589 -
ttgctagccctggcccgtggca

SEQ ID NO: 219685 - DNA, 22 bp, Artificial Sequence
  Synthetic oligonucleotide; TTT chr2 60499588 60499609 60499593 60499588 -
tgctagccctggcccgtggcaa

SEQ ID NO: 219686 - DNA, 22 bp, Artificial Sequence
  Synthetic oligonucleotide; TTT chr2 60499587 60499608 60499592 60499587 -
gctagccctggcccgtggcaaa

SEQ ID NO: 219687 - DNA, 22 bp, Artificial Sequence
  Synthetic oligonucleotide; TTG chr2 60499586 60499607 60499591 60499586 -
ctagccctggcccgtggcaaac

SEQ ID NO: 219688 - DNA, 22 bp, Artificial Sequence
  Synthetic oligonucleotide; CTA chr2 60499583 60499604 60499588 60499583 -
gccctggcccgtggcaaacact

SEQ ID NO: 219689 - DNA, 22 bp, Artificial Sequence
  Synthetic oligonucleotide; CTG chr2 60499577 60499598 60499582 60499577 -
gcccgtggcaaacactgtcttg

SEQ ID NO: 219690 - DNA, 22 bp, Artificial Sequence
  Synthetic oligonucleotide; CTG chr2 60499560 60499581 60499565 60499560 -
tcttgagaaagtgggacgttga

SEQ ID NO: 219691 - DNA, 22 bp, Artificial Sequence
  Synthetic oligonucleotide; CTT chr2 60499556 60499577 60499561 60499556 -
gagaaagtgggacgttgaagga

SEQ ID NO: 219692 - DNA, 22 bp, Artificial Sequence
  Synthetic oligonucleotide; TTG chr2 60499555 60499576 60499560 60499555 -
agaaagtgggacgttgaaggag

SEQ ID NO: 219693 - DNA, 22 bp, Artificial Sequence
  Synthetic oligonucleotide; TTG chr2 60499539 60499560 60499544 60499539 -
aaggagcttggactctaaagtc

SEQ ID NO: 219694 - DNA, 22 bp, Artificial Sequence
  Synthetic oligonucleotide; CTT chr2 60499530 60499551 60499535 60499530 -
ggactctaaagtcagctacaca

SEQ ID NO: 219695 - DNA, 22 bp, Artificial Sequence
  Synthetic oligonucleotide; TTG chr2 60499529 60499550 60499534 60499529 -
gactctaaagtcagctacacat

SEQ ID NO: 219696 - DNA, 22 bp, Artificial Sequence
  Synthetic oligonucleotide; CTC chr2 60499524 60499545 60499529 60499524 -
taaagtcagctacacatgagtc

SEQ ID NO: 219697 - DNA, 22 bp, Artificial Sequence
  Synthetic oligonucleotide; CTA chr2 60499522 60499543 60499527 60499522 -
aagtcagctacacatgagtctt

SEQ ID NO: 219698 - DNA, 22 bp, Artificial Sequence
  Synthetic oligonucleotide; CTA chr2 60499512 60499533 60499517 60499512 -
cacatgagtcttttcacctgct

SEQ ID NO: 219699 - DNA, 22 bp, Artificial Sequence
  Synthetic oligonucleotide; CTT chr2 60499500 60499521 60499505 60499500 -
ttcacctgctggctaggtggcc

SEQ ID NO: 219700 - DNA, 22 bp, Artificial Sequence
  Synthetic oligonucleotide; TTT chr2 60499499 60499520 60499504 60499499 -
tcacctgctggctaggtggccc

SEQ ID NO: 219701 - DNA, 22 bp, Artificial Sequence
  Synthetic oligonucleotide; TTT chr2 60499498 60499519 60499503 60499498 -
cacctgctggctaggtggcccc

SEQ ID NO: 219702 - DNA, 22 bp, Artificial Sequence
  Synthetic oligonucleotide; TTC chr2 60499497 60499518 60499502 60499497 -
acctgctggctaggtggccccg

SEQ ID NO: 219703 - DNA, 22 bp, Artificial Sequence
  Synthetic oligonucleotide; CTG chr2 60499492 60499513 60499497 60499492 -
ctggctaggtggccccggacaa

SEQ ID NO: 219704 - DNA, 22 bp, Artificial Sequence
  Synthetic oligonucleotide; CTG chr2 60499489 60499510 60499494 60499489 -
gctaggtggccccggacaagtc

SEQ ID NO: 219705 - DNA, 22 bp, Artificial Sequence
  Synthetic oligonucleotide; CTA chr2 60499485 60499506 60499490 60499485 -
ggtggccccggacaagtcaatc

SEQ ID NO: 219706 - DNA, 22 bp, Artificial Sequence
  Synthetic oligonucleotide; CTA chr2 60499457 60499478 60499462 60499457 -
ttgggcctcaggctctttatct

SEQ ID NO: 219707 - DNA, 22 bp, Artificial Sequence
  Synthetic oligonucleotide; TTG chr2 60499454 60499475 60499459 60499454 -
ggcctcaggctctttatctata

SEQ ID NO: 219708 - DNA, 22 bp, Artificial Sequence
  Synthetic oligonucleotide; CTC chr2 60499448 60499469 60499453 60499448 -
aggctctttatctataaaatgg

SEQ ID NO: 219709 - DNA, 22 bp, Artificial Sequence
  Synthetic oligonucleotide; CTC chr2 60499442 60499463 60499447 60499442 -
tttatctataaaatggggctaa

SEQ ID NO: 219710 - DNA, 22 bp, Artificial Sequence
  Synthetic oligonucleotide; CTT chr2 60499440 60499461 60499445 60499440 -
tatctataaaatggggctaatt

SEQ ID NO: 219711 - DNA, 22 bp, Artificial Sequence
  Synthetic oligonucleotide; TTT chr2 60499439 60499460 60499444 60499439 -
atctataaaatggggctaattt

SEQ ID NO: 219712 - DNA, 22 bp, Artificial Sequence
  Synthetic oligonucleotide; TTA chr2 60499438 60499459 60499443 60499438 -
tctataaaatggggctaatttc

SEQ ID NO: 219713 - DNA, 22 bp, Artificial Sequence
  Synthetic oligonucleotide; CTA chr2 60499434 60499455 60499439 60499434 -
taaaatggggctaatttccttt

SEQ ID NO: 219714 - DNA, 22 bp, Artificial Sequence
  Synthetic oligonucleotide; CTA chr2 60499421 60499442 60499426 60499421 -
atttccttttttgcccctggga

SEQ ID NO: 219715 - DNA, 22 bp, Artificial Sequence
  Synthetic oligonucleotide; TTT chr2 60499417 60499438 60499422 60499417 -
ccttttttgcccctgggaagaa

SEQ ID NO: 219716 - DNA, 22 bp, Artificial Sequence
  Synthetic oligonucleotide; TTC chr2 60499416 60499437 60499421 60499416 -
cttttttgcccctgggaagaaa

SEQ ID NO: 219717 - DNA, 22 bp, Artificial Sequence
  Synthetic oligonucleotide; CTT chr2 60499413 60499434 60499418 60499413 -
ttttgcccctgggaagaaatat

SEQ ID NO: 219718 - DNA, 22 bp, Artificial Sequence
  Synthetic oligonucleotide; TTT chr2 60499412 60499433 60499417 60499412 -
tttgcccctgggaagaaatatc

SEQ ID NO: 219719 - DNA, 22 bp, Artificial Sequence
  Synthetic oligonucleotide; TTT chr2 60499411 60499432 60499416 60499411 -
ttgcccctgggaagaaatatca

SEQ ID NO: 219720 - DNA, 22 bp, Artificial Sequence
  Synthetic oligonucleotide; TTT chr2 60499410 60499431 60499415 60499410 -
tgcccctgggaagaaatatcac

SEQ ID NO: 219721 - DNA, 22 bp, Artificial Sequence
  Synthetic oligonucleotide; TTT chr2 60499409 60499430 60499414 60499409 -
gcccctgggaagaaatatcact

SEQ ID NO: 219722 - DNA, 22 bp, Artificial Sequence
  Synthetic oligonucleotide; TTG chr2 60499408 60499429 60499413 60499408 -
cccctgggaagaaatatcactt

SEQ ID NO: 219723 - DNA, 22 bp, Artificial Sequence
  Synthetic oligonucleotide; CTG chr2 60499402 60499423 60499407 60499402 -
ggaagaaatatcacttagagga

SEQ ID NO: 219724 - DNA, 22 bp, Artificial Sequence
  Synthetic oligonucleotide; CTT chr2 60499386 60499407 60499391 60499386 -
agaggagttacagaatgtgcaa

SEQ ID NO: 219725 - DNA, 22 bp, Artificial Sequence
  Synthetic oligonucleotide; TTA chr2 60499385 60499406 60499390 60499385 -
gaggagttacagaatgtgcaac

SEQ ID NO: 219726 - DNA, 22 bp, Artificial Sequence
  Synthetic oligonucleotide; TTA chr2 60499376 60499397 60499381 60499376 -
cagaatgtgcaacctttcccag

SEQ ID NO: 219727 - DNA, 22 bp, Artificial Sequence
  Synthetic oligonucleotide; CTT chr2 60499360 60499381 60499365 60499360 -
tcccaggagtattgctcctgaa

SEQ ID NO: 219728 - DNA, 22 bp, Artificial Sequence
  Synthetic oligonucleotide; TTT chr2 60499359 60499380 60499364 60499359 -
cccaggagtattgctcctgaag

SEQ ID NO: 219729 - DNA, 22 bp, Artificial Sequence
  Synthetic oligonucleotide; TTC chr2 60499358 60499379 60499363 60499358 -
ccaggagtattgctcctgaagg

SEQ ID NO: 219730 - DNA, 22 bp, Artificial Sequence
  Synthetic oligonucleotide; TTG chr2 60499346 60499367 60499351 60499346 -
ctcctgaaggaataaggcacga

SEQ ID NO: 219731 - DNA, 22 bp, Artificial Sequence
  Synthetic oligonucleotide; CTC chr2 60499343 60499364 60499348 60499343 -
ctgaaggaataaggcacgatgg

SEQ ID NO: 219732 - DNA, 22 bp, Artificial Sequence
  Synthetic oligonucleotide; CTG chr2 60499340 60499361 60499345 60499340 -
aaggaataaggcacgatgggct

SEQ ID NO: 219733 - DNA, 22 bp, Artificial Sequence
  Synthetic oligonucleotide; CTT chr2 60499317 60499338 60499322 60499317 -
tgacttcagcctccagcactgt

SEQ ID NO: 219734 - DNA, 22 bp, Artificial Sequence
  Synthetic oligonucleotide; TTT chr2 60499316 60499337 60499321 60499316 -
gacttcagcctccagcactgtg

SEQ ID NO: 219735 - DNA, 22 bp, Artificial Sequence
  Synthetic oligonucleotide; TTG chr2 60499315 60499336 60499320 60499315 -
acttcagcctccagcactgtgg

SEQ ID NO: 219736 - DNA, 22 bp, Artificial Sequence
  Synthetic oligonucleotide; CTT chr2 60499311 60499332 60499316 60499311 -
cagcctccagcactgtggccca

SEQ ID NO: 219737 - DNA, 22 bp, Artificial Sequence
  Synthetic oligonucleotide; TTC chr2 60499310 60499331 60499315 60499310 -
agcctccagcactgtggcccag

SEQ ID NO: 219738 - DNA, 22 bp, Artificial Sequence
  Synthetic oligonucleotide; CTC chr2 60499304 60499325 60499309 60499304 -
cagcactgtggcccagaagggt

SEQ ID NO: 219739 - DNA, 22 bp, Artificial Sequence
  Synthetic oligonucleotide; CTG chr2 60499296 60499317 60499301 60499296 -
tggcccagaagggtatggctgg

SEQ ID NO: 219740 - DNA, 22 bp, Artificial Sequence
  Synthetic oligonucleotide; CTG chr2 60499275 60499296 60499280 60499275 -
ggcaggggcgtcacacccctgc

SEQ ID NO: 219741 - DNA, 22 bp, Artificial Sequence
  Synthetic oligonucleotide; CTG chr2 60499254 60499275 60499259 60499254 -
cagctctgtgggagtgacggaa

SEQ ID NO: 219742 - DNA, 22 bp, Artificial Sequence
  Synthetic oligonucleotide; CTC chr2 60499248 60499269 60499253 60499248 -
tgtgggagtgacggaagggcgc

SEQ ID NO: 219743 - DNA, 22 bp, Artificial Sequence
  Synthetic oligonucleotide; CTG chr2 60499246 60499267 60499251 60499246 -
tgggagtgacggaagggcgcta

SEQ ID NO: 219744 - DNA, 22 bp, Artificial Sequence
  Synthetic oligonucleotide; CTA chr2 60499224 60499245 60499229 60499224 -
tccactcgccttgcacatggct

SEQ ID NO: 219745 - DNA, 22 bp, Artificial Sequence
  Synthetic oligonucleotide; CTC chr2 60499217 60499238 60499222 60499217 -
gccttgcacatggctgtcttgc

SEQ ID NO: 219746 - DNA, 22 bp, Artificial Sequence
  Synthetic oligonucleotide; CTT chr2 60499212 60499233 60499217 60499212 -
gcacatggctgtcttgctctac

SEQ ID NO: 219747 - DNA, 22 bp, Artificial Sequence
  Synthetic oligonucleotide; TTG chr2 60499211 60499232 60499216 60499211 -
cacatggctgtcttgctctacc

SEQ ID NO: 219748 - DNA, 22 bp, Artificial Sequence
  Synthetic oligonucleotide; CTG chr2 60499201 60499222 60499206 60499201 -
tcttgctctaccaggccttagg

SEQ ID NO: 219749 - DNA, 22 bp, Artificial Sequence
  Synthetic oligonucleotide; CTT chr2 60499197 60499218 60499202 60499197 -
gctctaccaggccttaggttct

SEQ ID NO: 219750 - DNA, 22 bp, Artificial Sequence
  Synthetic oligonucleotide; TTG chr2 60499196 60499217 60499201 60499196 -
ctctaccaggccttaggttctg

SEQ ID NO: 219751 - DNA, 22 bp, Artificial Sequence
  Synthetic oligonucleotide; CTC chr2 60499193 60499214 60499198 60499193 -
taccaggccttaggttctgtgg

SEQ ID NO: 219752 - DNA, 22 bp, Artificial Sequence
  Synthetic oligonucleotide; CTA chr2 60499191 60499212 60499196 60499191 -
ccaggccttaggttctgtggcc

SEQ ID NO: 219753 - DNA, 22 bp, Artificial Sequence
  Synthetic oligonucleotide; CTT chr2 60499182 60499203 60499187 60499182 -
aggttctgtggccagatactgt

SEQ ID NO: 219754 - DNA, 22 bp, Artificial Sequence
  Synthetic oligonucleotide; TTA chr2 60499181 60499202 60499186 60499181 -
ggttctgtggccagatactgtt

SEQ ID NO: 219755 - DNA, 22 bp, Artificial Sequence
  Synthetic oligonucleotide; TTC chr2 60499176 60499197 60499181 60499176 -
tgtggccagatactgttctcca

SEQ ID NO: 219756 - DNA, 22 bp, Artificial Sequence
  Synthetic oligonucleotide; CTG chr2 60499174 60499195 60499179 60499174 -
tggccagatactgttctccagc

SEQ ID NO: 219757 - DNA, 22 bp, Artificial Sequence
  Synthetic oligonucleotide; CTG chr2 60499161 60499182 60499166 60499161 -
ttctccagctctttggcttggg

SEQ ID NO: 219758 - DNA, 22 bp, Artificial Sequence
  Synthetic oligonucleotide; TTC chr2 60499158 60499179 60499163 60499158 -
tccagctctttggcttgggccc

SEQ ID NO: 219759 - DNA, 22 bp, Artificial Sequence
  Synthetic oligonucleotide; CTC chr2 60499156 60499177 60499161 60499156 -
cagctctttggcttgggccccg

SEQ ID NO: 219760 - DNA, 22 bp, Artificial Sequence
  Synthetic oligonucleotide; CTC chr2 60499150 60499171 60499155 60499150 -
tttggcttgggccccgagacca

SEQ ID NO: 219761 - DNA, 22 bp, Artificial Sequence
  Synthetic oligonucleotide; CTT chr2 60499148 60499169 60499153 60499148 -
tggcttgggccccgagaccaga

SEQ ID NO: 219762 - DNA, 22 bp, Artificial Sequence
  Synthetic oligonucleotide; TTT chr2 60499147 60499168 60499152 60499147 -
ggcttgggccccgagaccagag

SEQ ID NO: 219763 - DNA, 22 bp, Artificial Sequence
  Synthetic oligonucleotide; TTG chr2 60499146 60499167 60499151 60499146 -
gcttgggccccgagaccagaga

SEQ ID NO: 219764 - DNA, 22 bp, Artificial Sequence
  Synthetic oligonucleotide; CTT chr2 60499142 60499163 60499147 60499142 -
gggccccgagaccagagaagat

SEQ ID NO: 219765 - DNA, 22 bp, Artificial Sequence
  Synthetic oligonucleotide; TTG chr2 60499141 60499162 60499146 60499141 -
ggccccgagaccagagaagata

SEQ ID NO: 219766 - DNA, 22 bp, Artificial Sequence
  Synthetic oligonucleotide; CTG chr2 60499100 60499121 60499105 60499100 -
aatactggggaacacattgtag

SEQ ID NO: 219767 - DNA, 22 bp, Artificial Sequence
  Synthetic oligonucleotide; CTG chr2 60499093 60499114 60499098 60499093 -
gggaacacattgtagggtgatc

SEQ ID NO: 219768 - DNA, 22 bp, Artificial Sequence
  Synthetic oligonucleotide; TTG chr2 60499081 60499102 60499086 60499081 -
tagggtgatctcccagaaaagc

SEQ ID NO: 219769 - DNA, 22 bp, Artificial Sequence
  Synthetic oligonucleotide; CTC chr2 60499069 60499090 60499074 60499069 -
ccagaaaagccagcgagaaatg

SEQ ID NO: 219770 - DNA, 22 bp, Artificial Sequence
  Synthetic oligonucleotide; CTG chr2 60499042 60499063 60499047 60499042 -
tagctgtagcattcttcccttt

SEQ ID NO: 219771 - DNA, 22 bp, Artificial Sequence
  Synthetic oligonucleotide; CTG chr2 60499036 60499057 60499041 60499036 -
tagcattcttccctttggatgc

SEQ ID NO: 219772 - DNA, 22 bp, Artificial Sequence
  Synthetic oligonucleotide; TTC chr2 60499028 60499049 60499033 60499028 -
ttccctttggatgcctgtgtgg

SEQ ID NO: 219773 - DNA, 22 bp, Artificial Sequence
  Synthetic oligonucleotide; CTT chr2 60499026 60499047 60499031 60499026 -
ccctttggatgcctgtgtgggg

SEQ ID NO: 219774 - DNA, 22 bp, Artificial Sequence
  Synthetic oligonucleotide; TTC chr2 60499025 60499046 60499030 60499025 -
cctttggatgcctgtgtgggga

SEQ ID NO: 219775 - DNA, 22 bp, Artificial Sequence
  Synthetic oligonucleotide; CTT chr2 60499021 60499042 60499026 60499021 -
tggatgcctgtgtggggacaga

SEQ ID NO: 219776 - DNA, 22 bp, Artificial Sequence
  Synthetic oligonucleotide; TTT chr2 60499020 60499041 60499025 60499020 -
ggatgcctgtgtggggacagaa

SEQ ID NO: 219777 - DNA, 22 bp, Artificial Sequence
  Synthetic oligonucleotide; TTG chr2 60499019 60499040 60499024 60499019 -
gatgcctgtgtggggacagaat

SEQ ID NO: 219778 - DNA, 22 bp, Artificial Sequence
  Synthetic oligonucleotide; CTG chr2 60499011 60499032 60499016 60499011 -
tgtggggacagaatcagtggaa

SEQ ID NO: 219779 - DNA, 22 bp, Artificial Sequence
  Synthetic oligonucleotide; CTG chr2 60498966 60498987 60498971 60498966 -
gccctgcctctcatcaatgccc

SEQ ID NO: 219780 - DNA, 22 bp, Artificial Sequence
  Synthetic oligonucleotide; CTG chr2 60498960 60498981 60498965 60498960 -
cctctcatcaatgcccccccac

SEQ ID NO: 219781 - DNA, 22 bp, Artificial Sequence
  Synthetic oligonucleotide; CTC chr2 60498956 60498977 60498961 60498956 -
tcatcaatgcccccccaccacc

SEQ ID NO: 219782 - DNA, 22 bp, Artificial Sequence
  Synthetic oligonucleotide; CTC chr2 60498954 60498975 60498959 60498954 -
atcaatgcccccccaccaccca

SEQ ID NO: 219783 - DNA, 22 bp, Artificial Sequence
  Synthetic oligonucleotide; CTG chr2 60498919 60498940 60498924 60498919 -
cttcctgttctattagacaaac

SEQ ID NO: 219784 - DNA, 22 bp, Artificial Sequence
  Synthetic oligonucleotide; CTT chr2 60498916 60498937 60498921 60498916 -
cctgttctattagacaaacgta

SEQ ID NO: 219785 - DNA, 22 bp, Artificial Sequence
  Synthetic oligonucleotide; TTC chr2 60498915 60498936 60498920 60498915 -
ctgttctattagacaaacgtag

SEQ ID NO: 219786 - DNA, 22 bp, Artificial Sequence
  Synthetic oligonucleotide; CTG chr2 60498912 60498933 60498917 60498912 -
ttctattagacaaacgtagttt

SEQ ID NO: 219787 - DNA, 22 bp, Artificial Sequence
  Synthetic oligonucleotide; TTC chr2 60498909 60498930 60498914 60498909 -
tattagacaaacgtagtttctg

SEQ ID NO: 219788 - DNA, 22 bp, Artificial Sequence
  Synthetic oligonucleotide; CTA chr2 60498907 60498928 60498912 60498907 -
ttagacaaacgtagtttctgga

SEQ ID NO: 219789 - DNA, 22 bp, Artificial Sequence
  Synthetic oligonucleotide; TTA chr2 60498904 60498925 60498909 60498904 -
gacaaacgtagtttctggatga

SEQ ID NO: 219790 - DNA, 22 bp, Artificial Sequence
  Synthetic oligonucleotide; TTT chr2 60498890 60498911 60498895 60498890 -
ctggatgagttggacagtcatc

SEQ ID NO: 219791 - DNA, 22 bp, Artificial Sequence
  Synthetic oligonucleotide; TTC chr2 60498889 60498910 60498894 60498889 -
tggatgagttggacagtcatct

SEQ ID NO: 219792 - DNA, 22 bp, Artificial Sequence
  Synthetic oligonucleotide; CTG chr2 60498887 60498908 60498892 60498887 -
gatgagttggacagtcatctga

SEQ ID NO: 219793 - DNA, 22 bp, Artificial Sequence
  Synthetic oligonucleotide; TTG chr2 60498878 60498899 60498883 60498878 -
gacagtcatctgagtttgatca

SEQ ID NO: 219794 - DNA, 22 bp, Artificial Sequence
  Synthetic oligonucleotide; CTG chr2 60498866 60498887 60498871 60498866 -
agtttgatcaagatttacaggt

SEQ ID NO: 219795 - DNA, 22 bp, Artificial Sequence
  Synthetic oligonucleotide; TTT chr2 60498861 60498882 60498866 60498861 -
gatcaagatttacaggtaattc

SEQ ID NO: 219796 - DNA, 22 bp, Artificial Sequence
  Synthetic oligonucleotide; TTG chr2 60498860 60498881 60498865 60498860 -
atcaagatttacaggtaattca

SEQ ID NO: 219797 - DNA, 22 bp, Artificial Sequence
  Synthetic oligonucleotide; TTT chr2 60498850 60498871 60498855 60498850 -
acaggtaattcaaatgtatgta

SEQ ID NO: 219798 - DNA, 22 bp, Artificial Sequence
  Synthetic oligonucleotide; TTA chr2 60498849 60498870 60498854 60498849 -
caggtaattcaaatgtatgtat

SEQ ID NO: 219799 - DNA, 22 bp, Artificial Sequence
  Synthetic oligonucleotide; TTC chr2 60498839 60498860 60498844 60498839 -
aaatgtatgtataaggtacata

SEQ ID NO: 219800 - DNA, 22 bp, Artificial Sequence
  Synthetic oligonucleotide; TTA chr2 60498810 60498831 60498815 60498810 -
gtacatccatcagagaggcttc

SEQ ID NO: 219801 - DNA, 22 bp, Artificial Sequence
  Synthetic oligonucleotide; CTT chr2 60498789 60498810 60498794 60498789 -
ccttaagccacaagtctctagc

SEQ ID NO: 219802 - DNA, 22 bp, Artificial Sequence
  Synthetic oligonucleotide; TTC chr2 60498788 60498809 60498793 60498788 -
cttaagccacaagtctctagct

SEQ ID NO: 219803 - DNA, 22 bp, Artificial Sequence
  Synthetic oligonucleotide; CTT chr2 60498785 60498806 60498790 60498785 -
aagccacaagtctctagctcct

SEQ ID NO: 219804 - DNA, 22 bp, Artificial Sequence
  Synthetic oligonucleotide; TTA chr2 60498784 60498805 60498789 60498784 -
agccacaagtctctagctcctc

SEQ ID NO: 219805 - DNA, 22 bp, Artificial Sequence
  Synthetic oligonucleotide; CTC chr2 60498771 60498792 60498776 60498771 -
tagctcctcagagaactggcag

SEQ ID NO: 219806 - DNA, 22 bp, Artificial Sequence
  Synthetic oligonucleotide; CTA chr2 60498769 60498790 60498774 60498769 -
gctcctcagagaactggcagtc

SEQ ID NO: 219807 - DNA, 22 bp, Artificial Sequence
  Synthetic oligonucleotide; CTC chr2 60498765 60498786 60498770 60498765 -
ctcagagaactggcagtctggc

SEQ ID NO: 219808 - DNA, 22 bp, Artificial Sequence
  Synthetic oligonucleotide; CTC chr2 60498762 60498783 60498767 60498762 -
agagaactggcagtctggctgg

SEQ ID NO: 219809 - DNA, 22 bp, Artificial Sequence
  Synthetic oligonucleotide; CTG chr2 60498753 60498774 60498758 60498753 -
gcagtctggctgggtctgtacg

SEQ ID NO: 219810 - DNA, 22 bp, Artificial Sequence
  Synthetic oligonucleotide; CTG chr2 60498745 60498766 60498750 60498745 -
gctgggtctgtacgaacttgga

SEQ ID NO: 219811 - DNA, 22 bp, Artificial Sequence
  Synthetic oligonucleotide; CTG chr2 60498741 60498762 60498746 60498741 -
ggtctgtacgaacttggaccta

SEQ ID NO: 219812 - DNA, 22 bp, Artificial Sequence
  Synthetic oligonucleotide; CTG chr2 60498735 60498756 60498740 60498735 -
tacgaacttggacctatagatg

SEQ ID NO: 219813 - DNA, 22 bp, Artificial Sequence
  Synthetic oligonucleotide; CTT chr2 60498726 60498747 60498731 60498726 -
ggacctatagatgacctcactg

SEQ ID NO: 219814 - DNA, 22 bp, Artificial Sequence
  Synthetic oligonucleotide; TTG chr2 60498725 60498746 60498730 60498725 -
gacctatagatgacctcactgg

SEQ ID NO: 219815 - DNA, 22 bp, Artificial Sequence
  Synthetic oligonucleotide; CTA chr2 60498719 60498740 60498724 60498719 -
tagatgacctcactggtttctc

SEQ ID NO: 219816 - DNA, 22 bp, Artificial Sequence
  Synthetic oligonucleotide; CTC chr2 60498708 60498729 60498713 60498708 -
actggtttctccccttgtcacc

SEQ ID NO: 219817 - DNA, 22 bp, Artificial Sequence
  Synthetic oligonucleotide; CTG chr2 60498704 60498725 60498709 60498704 -
gtttctccccttgtcacctcat

SEQ ID NO: 219818 - DNA, 22 bp, Artificial Sequence
  Synthetic oligonucleotide; TTT chr2 60498700 60498721 60498705 60498700 -
ctccccttgtcacctcatctgc

SEQ ID NO: 219819 - DNA, 22 bp, Artificial Sequence
  Synthetic oligonucleotide; TTC chr2 60498699 60498720 60498704 60498699 -
tccccttgtcacctcatctgcc

SEQ ID NO: 219820 - DNA, 22 bp, Artificial Sequence
  Synthetic oligonucleotide; CTC chr2 60498697 60498718 60498702 60498697 -
cccttgtcacctcatctgcctg

SEQ ID NO: 219821 - DNA, 22 bp, Artificial Sequence
  Synthetic oligonucleotide; CTT chr2 60498692 60498713 60498697 60498692 -
gtcacctcatctgcctgcttcc

SEQ ID NO: 219822 - DNA, 22 bp, Artificial Sequence
  Synthetic oligonucleotide; TTG chr2 60498691 60498712 60498696 60498691 -
tcacctcatctgcctgcttcct

SEQ ID NO: 219823 - DNA, 22 bp, Artificial Sequence
  Synthetic oligonucleotide; CTC chr2 60498684 60498705 60498689 60498684 -
atctgcctgcttccttctcttt

SEQ ID NO: 219824 - DNA, 22 bp, Artificial Sequence
  Synthetic oligonucleotide; CTG chr2 60498679 60498700 60498684 60498679 -
cctgcttccttctctttactga

SEQ ID NO: 219825 - DNA, 22 bp, Artificial Sequence
  Synthetic oligonucleotide; CTG chr2 60498675 60498696 60498680 60498675 -
cttccttctctttactgatctt

SEQ ID NO: 219826 - DNA, 22 bp, Artificial Sequence
  Synthetic oligonucleotide; CTT chr2 60498672 60498693 60498677 60498672 -
ccttctctttactgatcttatg

SEQ ID NO: 219827 - DNA, 22 bp, Artificial Sequence
  Synthetic oligonucleotide; TTC chr2 60498671 60498692 60498676 60498671 -
cttctctttactgatcttatgt

SEQ ID NO: 219828 - DNA, 22 bp, Artificial Sequence
  Synthetic oligonucleotide; CTT chr2 60498668 60498689 60498673 60498668 -
ctctttactgatcttatgtgag

SEQ ID NO: 219829 - DNA, 22 bp, Artificial Sequence
  Synthetic oligonucleotide; TTC chr2 60498667 60498688 60498672 60498667 -
tctttactgatcttatgtgagt

SEQ ID NO: 219830 - DNA, 22 bp, Artificial Sequence
  Synthetic oligonucleotide; CTC chr2 60498665 60498686 60498670 60498665 -
tttactgatcttatgtgagtag

SEQ ID NO: 219831 - DNA, 22 bp, Artificial Sequence
  Synthetic oligonucleotide; CTT chr2 60498663 60498684 60498668 60498663 -
tactgatcttatgtgagtaggt

SEQ ID NO: 219832 - DNA, 22 bp, Artificial Sequence
  Synthetic oligonucleotide; TTT chr2 60498662 60498683 60498667 60498662 -
actgatcttatgtgagtaggta

SEQ ID NO: 219833 - DNA, 22 bp, Artificial Sequence
  Synthetic oligonucleotide; TTA chr2 60498661 60498682 60498666 60498661 -
ctgatcttatgtgagtaggtag

SEQ ID NO: 219834 - DNA, 22 bp, Artificial Sequence
  Synthetic oligonucleotide; CTG chr2 60498658 60498679 60498663 60498658 -
atcttatgtgagtaggtagagg

SEQ ID NO: 219835 - DNA, 22 bp, Artificial Sequence
  Synthetic oligonucleotide; CTT chr2 60498653 60498674 60498658 60498653 -
atgtgagtaggtagaggggtca

SEQ ID NO: 219836 - DNA, 22 bp, Artificial Sequence
  Synthetic oligonucleotide; TTA chr2 60498652 60498673 60498657 60498652 -
tgtgagtaggtagaggggtcag

SEQ ID NO: 219837 - DNA, 22 bp, Artificial Sequence
  Synthetic oligonucleotide; CTC chr2 60498622 60498643 60498627 60498622 -
tgctcagctctgcccagcacac

SEQ ID NO: 219838 - DNA, 22 bp, Artificial Sequence
  Synthetic oligonucleotide; CTG chr2 60498620 60498641 60498625 60498620 -
ctcagctctgcccagcacacta

SEQ ID NO: 219839 - DNA, 22 bp, Artificial Sequence
  Synthetic oligonucleotide; CTC chr2 60498617 60498638 60498622 60498617 -
agctctgcccagcacactaagc

SEQ ID NO: 219840 - DNA, 22 bp, Artificial Sequence
  Synthetic oligonucleotide; CTC chr2 60498612 60498633 60498617 60498612 -
tgcccagcacactaagcctatt

SEQ ID NO: 219841 - DNA, 22 bp, Artificial Sequence
  Synthetic oligonucleotide; CTG chr2 60498610 60498631 60498615 60498610 -
cccagcacactaagcctatttg

SEQ ID NO: 219842 - DNA, 22 bp, Artificial Sequence
  Synthetic oligonucleotide; CTA chr2 60498598 60498619 60498603 60498598 -
agcctatttgctattaaaattt

SEQ ID NO: 219843 - DNA, 22 bp, Artificial Sequence
  Synthetic oligonucleotide; CTA chr2 60498592 60498613 60498597 60498592 -
tttgctattaaaatttgaaaaa

SEQ ID NO: 219844 - DNA, 22 bp, Artificial Sequence
  Synthetic oligonucleotide; TTT chr2 60498589 60498610 60498594 60498589 -
gctattaaaatttgaaaaacaa

SEQ ID NO: 219845 - DNA, 22 bp, Artificial Sequence
  Synthetic oligonucleotide; TTG chr2 60498588 60498609 60498593 60498588 -
ctattaaaatttgaaaaacaaa

SEQ ID NO: 219846 - DNA, 22 bp, Artificial Sequence
  Synthetic oligonucleotide; CTA chr2 60498585 60498606 60498590 60498585 -
ttaaaatttgaaaaacaaatgc

SEQ ID NO: 219847 - DNA, 22 bp, Artificial Sequence
  Synthetic oligonucleotide; TTA chr2 60498582 60498603 60498587 60498582 -
aaatttgaaaaacaaatgcagg

SEQ ID NO: 219848 - DNA, 22 bp, Artificial Sequence
  Synthetic oligonucleotide; TTT chr2 60498576 60498597 60498581 60498576 -
gaaaaacaaatgcaggtgccag

SEQ ID NO: 219849 - DNA, 22 bp, Artificial Sequence
  Synthetic oligonucleotide; TTG chr2 60498575 60498596 60498580 60498575 -
aaaaacaaatgcaggtgccaga

SEQ ID NO: 219850 - DNA, 22 bp, Artificial Sequence
  Synthetic oligonucleotide; CTA chr2 60498545 60498566 60498550 60498545 -
aataatgaatgtcccaggccaa

SEQ ID NO: 219851 - DNA, 22 bp, Artificial Sequence
  Synthetic oligonucleotide; TTC chr2 60498520 60498541 60498525 60498520 -
taggaagggaagtgggtatggg

SEQ ID NO: 219852 - DNA, 22 bp, Artificial Sequence
  Synthetic oligonucleotide; CTA chr2 60498518 60498539 60498523 60498518 -
ggaagggaagtgggtatggggc

SEQ ID NO: 219853 - DNA, 22 bp, Artificial Sequence
  Synthetic oligonucleotide; TTG chr2 60498487 60498508 60498492 60498487 -
ccttcctggtaccaggatgatg

SEQ ID NO: 219854 - DNA, 22 bp, Artificial Sequence
  Synthetic oligonucleotide; CTT chr2 60498483 60498504 60498488 60498483 -
cctggtaccaggatgatgcaat

SEQ ID NO: 219855 - DNA, 22 bp, Artificial Sequence
  Synthetic oligonucleotide; TTC chr2 60498482 60498503 60498487 60498482 -
ctggtaccaggatgatgcaatg

SEQ ID NO: 219856 - DNA, 22 bp, Artificial Sequence
  Synthetic oligonucleotide; CTG chr2 60498479 60498500 60498484 60498479 -
gtaccaggatgatgcaatgctt

SEQ ID NO: 219857 - DNA, 22 bp, Artificial Sequence
  Synthetic oligonucleotide; CTT chr2 60498457 60498478 60498462 60498457 -
ggaggctgtgagctccccacct

SEQ ID NO: 219858 - DNA, 22 bp, Artificial Sequence
  Synthetic oligonucleotide; TTG chr2 60498456 60498477 60498461 60498456 -
gaggctgtgagctccccacctt

SEQ ID NO: 219859 - DNA, 22 bp, Artificial Sequence
  Synthetic oligonucleotide; CTG chr2 60498449 60498470 60498454 60498449 -
tgagctccccaccttctcaggg

SEQ ID NO: 219860 - DNA, 22 bp, Artificial Sequence
  Synthetic oligonucleotide; CTC chr2 60498442 60498463 60498447 60498442 -
cccaccttctcagggcacaccc

SEQ ID NO: 219861 - DNA, 22 bp, Artificial Sequence
  Synthetic oligonucleotide; CTT chr2 60498434 60498455 60498439 60498434 -
ctcagggcacaccctgtgatct

SEQ ID NO: 219862 - DNA, 22 bp, Artificial Sequence
  Synthetic oligonucleotide; TTC chr2 60498433 60498454 60498438 60498433 -
tcagggcacaccctgtgatctt

SEQ ID NO: 219863 - DNA, 22 bp, Artificial Sequence
  Synthetic oligonucleotide; CTC chr2 60498431 60498452 60498436 60498431 -
agggcacaccctgtgatcttgt

SEQ ID NO: 219864 - DNA, 22 bp, Artificial Sequence
  Synthetic oligonucleotide; CTG chr2 60498418 60498439 60498423 60498418 -
tgatcttgtgggacccctctgt

SEQ ID NO: 219865 - DNA, 22 bp, Artificial Sequence
  Synthetic oligonucleotide; CTT chr2 60498411 60498432 60498416 60498411 -
gtgggacccctctgtccagccc

SEQ ID NO: 219866 - DNA, 22 bp, Artificial Sequence
  Synthetic oligonucleotide; TTG chr2 60498410 60498431 60498415 60498410 -
tgggacccctctgtccagccca

SEQ ID NO: 219867 - DNA, 22 bp, Artificial Sequence
  Synthetic oligonucleotide; CTC chr2 60498399 60498420 60498404 60498399 -
tgtccagcccagcctgggtgtg

SEQ ID NO: 219868 - DNA, 22 bp, Artificial Sequence
  Synthetic oligonucleotide; CTG chr2 60498397 60498418 60498402 60498397 -
tccagcccagcctgggtgtgca

SEQ ID NO: 219869 - DNA, 22 bp, Artificial Sequence
  Synthetic oligonucleotide; CTG chr2 60498383 60498404 60498388 60498383 -
ggtgtgcatcttgtgtgcttgg

SEQ ID NO: 219870 - DNA, 22 bp, Artificial Sequence
  Synthetic oligonucleotide; CTT chr2 60498371 60498392 60498376 60498371 -
gtgtgcttggtcggcactgata

SEQ ID NO: 219871 - DNA, 22 bp, Artificial Sequence
  Synthetic oligonucleotide; TTG chr2 60498370 60498391 60498375 60498370 -
tgtgcttggtcggcactgatag

SEQ ID NO: 219872 - DNA, 22 bp, Artificial Sequence
  Synthetic oligonucleotide; CTT chr2 60498363 60498384 60498368 60498363 -
ggtcggcactgataggggtcgc

SEQ ID NO: 219873 - DNA, 22 bp, Artificial Sequence
  Synthetic oligonucleotide; TTG chr2 60498362 60498383 60498367 60498362 -
gtcggcactgataggggtcgcg

SEQ ID NO: 219874 - DNA, 22 bp, Artificial Sequence
  Synthetic oligonucleotide; CTG chr2 60498352 60498373 60498357 60498352 -
ataggggtcgcggtagggagtt

SEQ ID NO: 219875 - DNA, 22 bp, Artificial Sequence
  Synthetic oligonucleotide; TTG chr2 60498329 60498350 60498334 60498329 -
tcggcacacactgctgcatgtc

SEQ ID NO: 219876 - DNA, 22 bp, Artificial Sequence
  Synthetic oligonucleotide; CTG chr2 60498316 60498337 60498321 60498316 -
ctgcatgtcctgtgagcggtcc

SEQ ID NO: 219877 - DNA, 22 bp, Artificial Sequence
  Synthetic oligonucleotide; CTG chr2 60498313 60498334 60498318 60498313 -
catgtcctgtgagcggtcccca

SEQ ID NO: 219878 - DNA, 22 bp, Artificial Sequence
  Synthetic oligonucleotide; CTG chr2 60498304 60498325 60498309 60498304 -
tgagcggtccccaaggctgtgc

SEQ ID NO: 219879 - DNA, 22 bp, Artificial Sequence
  Synthetic oligonucleotide; CTG chr2 60498285 60498306 60498290 60498285 -
tgcccagccttcagtgtccagg

SEQ ID NO: 219880 - DNA, 22 bp, Artificial Sequence
  Synthetic oligonucleotide; CTT chr2 60498274 60498295 60498279 60498274 -
cagtgtccagggcctcttctga

SEQ ID NO: 219881 - DNA, 22 bp, Artificial Sequence
  Synthetic oligonucleotide; TTC chr2 60498273 60498294 60498278 60498273 -
agtgtccagggcctcttctgac

SEQ ID NO: 219882 - DNA, 22 bp, Artificial Sequence
  Synthetic oligonucleotide; CTC chr2 60498258 60498279 60498263 60498258 -
ttctgacaggccctgctggtta

SEQ ID NO: 219883 - DNA, 22 bp, Artificial Sequence
  Synthetic oligonucleotide; CTT chr2 60498256 60498277 60498261 60498256 -
ctgacaggccctgctggttatc

SEQ ID NO: 219884 - DNA, 22 bp, Artificial Sequence
  Synthetic oligonucleotide; TTC chr2 60498255 60498276 60498260 60498255 -
tgacaggccctgctggttatca

SEQ ID NO: 219885 - DNA, 22 bp, Artificial Sequence
  Synthetic oligonucleotide; CTG chr2 60498253 60498274 60498258 60498253 -
acaggccctgctggttatcact

SEQ ID NO: 219886 - DNA, 22 bp, Artificial Sequence
  Synthetic oligonucleotide; CTG chr2 60498243 60498264 60498248 60498243 -
ctggttatcactgttggcatta

SEQ ID NO: 219887 - DNA, 22 bp, Artificial Sequence
  Synthetic oligonucleotide; CTG chr2 60498240 60498261 60498245 60498240 -
gttatcactgttggcattatct

SEQ ID NO: 219888 - DNA, 22 bp, Artificial Sequence
  Synthetic oligonucleotide; TTA chr2 60498236 60498257 60498241 60498236 -
tcactgttggcattatctccac

SEQ ID NO: 219889 - DNA, 22 bp, Artificial Sequence
  Synthetic oligonucleotide; CTG chr2 60498230 60498251 60498235 60498230 -
ttggcattatctccacgcacca

SEQ ID NO: 219890 - DNA, 22 bp, Artificial Sequence
  Synthetic oligonucleotide; TTG chr2 60498227 60498248 60498232 60498227 -
gcattatctccacgcaccactt

SEQ ID NO: 219891 - DNA, 22 bp, Artificial Sequence
  Synthetic oligonucleotide; TTA chr2 60498221 60498242 60498226 60498221 -
tctccacgcaccacttctgtgc

SEQ ID NO: 219892 - DNA, 22 bp, Artificial Sequence
  Synthetic oligonucleotide; CTC chr2 60498217 60498238 60498222 60498217 -
cacgcaccacttctgtgcccag

SEQ ID NO: 219893 - DNA, 22 bp, Artificial Sequence
  Synthetic oligonucleotide; CTT chr2 60498205 60498226 60498210 60498205 -
ctgtgcccagggctgctgggtc

SEQ ID NO: 219894 - DNA, 22 bp, Artificial Sequence
  Synthetic oligonucleotide; TTC chr2 60498204 60498225 60498209 60498204 -
tgtgcccagggctgctgggtca

SEQ ID NO: 219895 - DNA, 22 bp, Artificial Sequence
  Synthetic oligonucleotide; CTG chr2 60498202 60498223 60498207 60498202 -
tgcccagggctgctgggtcacc

SEQ ID NO: 219896 - DNA, 22 bp, Artificial Sequence
  Synthetic oligonucleotide; CTG chr2 60498190 60498211 60498195 60498190 -
ctgggtcaccttaaggagccac

SEQ ID NO: 219897 - DNA, 22 bp, Artificial Sequence
  Synthetic oligonucleotide; CTG chr2 60498187 60498208 60498192 60498187 -
ggtcaccttaaggagccacaca

SEQ ID NO: 219898 - DNA, 22 bp, Artificial Sequence
  Synthetic oligonucleotide; CTT chr2 60498178 60498199 60498183 60498178 -
aaggagccacacacccgtctac

SEQ ID NO: 219899 - DNA, 22 bp, Artificial Sequence
  Synthetic oligonucleotide; TTA chr2 60498177 60498198 60498182 60498177 -
aggagccacacacccgtctaca

SEQ ID NO: 219900 - DNA, 22 bp, Artificial Sequence
  Synthetic oligonucleotide; CTA chr2 60498157 60498178 60498162 60498157 -
catagaggcccttcctgcttgg

SEQ ID NO: 219901 - DNA, 22 bp, Artificial Sequence
  Synthetic oligonucleotide; CTT chr2 60498144 60498165 60498149 60498144 -
cctgcttggggtctgacccagt

SEQ ID NO: 219902 - DNA, 22 bp, Artificial Sequence
  Synthetic oligonucleotide; TTC chr2 60498143 60498164 60498148 60498143 -
ctgcttggggtctgacccagtt

SEQ ID NO: 219903 - DNA, 22 bp, Artificial Sequence
  Synthetic oligonucleotide; CTG chr2 60498140 60498161 60498145 60498140 -
cttggggtctgacccagttatc

SEQ ID NO: 219904 - DNA, 22 bp, Artificial Sequence
  Synthetic oligonucleotide; CTT chr2 60498137 60498158 60498142 60498137 -
ggggtctgacccagttatcccc

SEQ ID NO: 219905 - DNA, 22 bp, Artificial Sequence
  Synthetic oligonucleotide; TTG chr2 60498136 60498157 60498141 60498136 -
gggtctgacccagttatcccct

SEQ ID NO: 219906 - DNA, 22 bp, Artificial Sequence
  Synthetic oligonucleotide; CTG chr2 60498129 60498150 60498134 60498129 -
acccagttatcccctccacacc

SEQ ID NO: 219907 - DNA, 22 bp, Artificial Sequence
  Synthetic oligonucleotide; TTA chr2 60498120 60498141 60498125 60498120 -
tcccctccacacctccattctc

SEQ ID NO: 219908 - DNA, 22 bp, Artificial Sequence
  Synthetic oligonucleotide; CTC chr2 60498113 60498134 60498118 60498113 -
cacacctccattctcccagact

SEQ ID NO: 219909 - DNA, 22 bp, Artificial Sequence
  Synthetic oligonucleotide; CTC chr2 60498105 60498126 60498110 60498105 -
cattctcccagacttttgactc

SEQ ID NO: 219910 - DNA, 22 bp, Artificial Sequence
  Synthetic oligonucleotide; TTC chr2 60498100 60498121 60498105 60498100 -
tcccagacttttgactcacccc

SEQ ID NO: 219911 - DNA, 22 bp, Artificial Sequence
  Synthetic oligonucleotide; CTC chr2 60498098 60498119 60498103 60498098 -
ccagacttttgactcaccccag

SEQ ID NO: 219912 - DNA, 22 bp, Artificial Sequence
  Synthetic oligonucleotide; CTT chr2 60498090 60498111 60498095 60498090 -
ttgactcaccccagccctgcta

SEQ ID NO: 219913 - DNA, 22 bp, Artificial Sequence
  Synthetic oligonucleotide; TTT chr2 60498089 60498110 60498094 60498089 -
tgactcaccccagccctgctaa

SEQ ID NO: 219914 - DNA, 22 bp, Artificial Sequence
  Synthetic oligonucleotide; TTT chr2 60498088 60498109 60498093 60498088 -
gactcaccccagccctgctaag

SEQ ID NO: 219915 - DNA, 22 bp, Artificial Sequence
  Synthetic oligonucleotide; TTG chr2 60498087 60498108 60498092 60498087 -
actcaccccagccctgctaaga

SEQ ID NO: 219916 - DNA, 22 bp, Artificial Sequence
  Synthetic oligonucleotide; CTC chr2 60498083 60498104 60498088 60498083 -
accccagccctgctaagagtga

SEQ ID NO: 219917 - DNA, 22 bp, Artificial Sequence
  Synthetic oligonucleotide; CTG chr2 60498071 60498092 60498076 60498071 -
ctaagagtgatgtcctccccca

SEQ ID NO: 219918 - DNA, 22 bp, Artificial Sequence
  Synthetic oligonucleotide; CTA chr2 60498068 60498089 60498073 60498068 -
agagtgatgtcctcccccaaag

SEQ ID NO: 219919 - DNA, 22 bp, Artificial Sequence
  Synthetic oligonucleotide; CTC chr2 60498054 60498075 60498059 60498054 -
ccccaaagagaagacccctgct

SEQ ID NO: 219920 - DNA, 22 bp, Artificial Sequence
  Synthetic oligonucleotide; CTG chr2 60498034 60498055 60498039 60498034 -
ctcttgagggtctgccaggtgg

SEQ ID NO: 219921 - DNA, 22 bp, Artificial Sequence
  Synthetic oligonucleotide; CTC chr2 60498031 60498052 60498036 60498031 -
ttgagggtctgccaggtgggtc

SEQ ID NO: 219922 - DNA, 22 bp, Artificial Sequence
  Synthetic oligonucleotide; CTT chr2 60498029 60498050 60498034 60498029 -
gagggtctgccaggtgggtccc

SEQ ID NO: 219923 - DNA, 22 bp, Artificial Sequence
  Synthetic oligonucleotide; TTG chr2 60498028 60498049 60498033 60498028 -
agggtctgccaggtgggtccct

SEQ ID NO: 219924 - DNA, 22 bp, Artificial Sequence
  Synthetic oligonucleotide; CTG chr2 60498020 60498041 60498025 60498020 -
ccaggtgggtccctcatctccc

SEQ ID NO: 219925 - DNA, 22 bp, Artificial Sequence
  Synthetic oligonucleotide; CTC chr2 60498005 60498026 60498010 60498005 -
atctccccacctccatgggcct

SEQ ID NO: 219926 - DNA, 22 bp, Artificial Sequence
  Synthetic oligonucleotide; CTC chr2 60498000 60498021 60498005 60498000 -
cccacctccatgggcctcttgg

SEQ ID NO: 219927 - DNA, 22 bp, Artificial Sequence
  Synthetic oligonucleotide; CTC chr2 60497992 60498013 60497997 60497992 -
catgggcctcttggattttgtg

SEQ ID NO: 219928 - DNA, 22 bp, Artificial Sequence
  Synthetic oligonucleotide; CTC chr2 60497982 60498003 60497987 60497982 -
ttggattttgtgcatagcaatc

SEQ ID NO: 219929 - DNA, 22 bp, Artificial Sequence
  Synthetic oligonucleotide; CTT chr2 60497980 60498001 60497985 60497980 -
ggattttgtgcatagcaatctc

SEQ ID NO: 219930 - DNA, 22 bp, Artificial Sequence
  Synthetic oligonucleotide; TTG chr2 60497979 60498000 60497984 60497979 -
gattttgtgcatagcaatctct

SEQ ID NO: 219931 - DNA, 22 bp, Artificial Sequence
  Synthetic oligonucleotide; TTT chr2 60497974 60497995 60497979 60497974 -
tgtgcatagcaatctctgcaac

SEQ ID NO: 219932 - DNA, 22 bp, Artificial Sequence
  Synthetic oligonucleotide; TTT chr2 60497973 60497994 60497978 60497973 -
gtgcatagcaatctctgcaaca

SEQ ID NO: 219933 - DNA, 22 bp, Artificial Sequence
  Synthetic oligonucleotide; TTG chr2 60497972 60497993 60497977 60497972 -
tgcatagcaatctctgcaacac

SEQ ID NO: 219934 - DNA, 22 bp, Artificial Sequence
  Synthetic oligonucleotide; CTC chr2 60497958 60497979 60497963 60497958 -
tgcaacaccctgacctttatgg

SEQ ID NO: 219935 - DNA, 22 bp, Artificial Sequence
  Synthetic oligonucleotide; CTG chr2 60497956 60497977 60497961 60497956 -
caacaccctgacctttatgggg

SEQ ID NO: 219936 - DNA, 22 bp, Artificial Sequence
  Synthetic oligonucleotide; CTG chr2 60497946 60497967 60497951 60497946 -
acctttatggggtcatcctcgg

SEQ ID NO: 219937 - DNA, 22 bp, Artificial Sequence
  Synthetic oligonucleotide; CTT chr2 60497941 60497962 60497946 60497941 -
tatggggtcatcctcggccaat

SEQ ID NO: 219938 - DNA, 22 bp, Artificial Sequence
  Synthetic oligonucleotide; TTT chr2 60497940 60497961 60497945 60497940 -
atggggtcatcctcggccaatg

SEQ ID NO: 219939 - DNA, 22 bp, Artificial Sequence
  Synthetic oligonucleotide; TTA chr2 60497939 60497960 60497944 60497939 -
tggggtcatcctcggccaatga

SEQ ID NO: 219940 - DNA, 22 bp, Artificial Sequence
  Synthetic oligonucleotide; CTC chr2 60497926 60497947 60497931 60497926 -
ggccaatgaagcggtgggtcca

SEQ ID NO: 219941 - DNA, 22 bp, Artificial Sequence
  Synthetic oligonucleotide; CTC chr2 60497899 60497920 60497904 60497899 -
ccccttctatcacctggctcac

SEQ ID NO: 219942 - DNA, 22 bp, Artificial Sequence
  Synthetic oligonucleotide; CTT chr2 60497893 60497914 60497898 60497893 -
ctatcacctggctcacttccat

SEQ ID NO: 219943 - DNA, 22 bp, Artificial Sequence
  Synthetic oligonucleotide; TTC chr2 60497892 60497913 60497897 60497892 -
tatcacctggctcacttccatc

SEQ ID NO: 219944 - DNA, 22 bp, Artificial Sequence
  Synthetic oligonucleotide; CTA chr2 60497890 60497911 60497895 60497890 -
tcacctggctcacttccatcct

SEQ ID NO: 219945 - DNA, 22 bp, Artificial Sequence
  Synthetic oligonucleotide; CTG chr2 60497883 60497904 60497888 60497883 -
gctcacttccatcctgcagagg

SEQ ID NO: 219946 - DNA, 22 bp, Artificial Sequence
  Synthetic oligonucleotide; CTC chr2 60497879 60497900 60497884 60497879 -
acttccatcctgcagaggaagc

SEQ ID NO: 219947 - DNA, 22 bp, Artificial Sequence
  Synthetic oligonucleotide; CTT chr2 60497875 60497896 60497880 60497875 -
ccatcctgcagaggaagcttgg

SEQ ID NO: 219948 - DNA, 22 bp, Artificial Sequence
  Synthetic oligonucleotide; TTC chr2 60497874 60497895 60497879 60497874 -
catcctgcagaggaagcttggt

SEQ ID NO: 219949 - DNA, 22 bp, Artificial Sequence
  Synthetic oligonucleotide; CTG chr2 60497867 60497888 60497872 60497867 -
cagaggaagcttggtttcattt

SEQ ID NO: 219950 - DNA, 22 bp, Artificial Sequence
  Synthetic oligonucleotide; CTT chr2 60497855 60497876 60497860 60497855 -
ggtttcatttaggacaatgtgc

SEQ ID NO: 219951 - DNA, 22 bp, Artificial Sequence
  Synthetic oligonucleotide; TTG chr2 60497854 60497875 60497859 60497854 -
gtttcatttaggacaatgtgca

SEQ ID NO: 219952 - DNA, 22 bp, Artificial Sequence
  Synthetic oligonucleotide; TTT chr2 60497850 60497871 60497855 60497850 -
catttaggacaatgtgcaggat

SEQ ID NO: 219953 - DNA, 22 bp, Artificial Sequence
  Synthetic oligonucleotide; TTC chr2 60497849 60497870 60497854 60497849 -
atttaggacaatgtgcaggatc

SEQ ID NO: 219954 - DNA, 22 bp, Artificial Sequence
  Synthetic oligonucleotide; TTT chr2 60497845 60497866 60497850 60497845 -
aggacaatgtgcaggatccttt

SEQ ID NO: 219955 - DNA, 22 bp, Artificial Sequence
  Synthetic oligonucleotide; TTA chr2 60497844 60497865 60497849 60497844 -
ggacaatgtgcaggatcctttt

SEQ ID NO: 219956 - DNA, 22 bp, Artificial Sequence
  Synthetic oligonucleotide; CTT chr2 60497824 60497845 60497829 60497824 -
ttgatcatttctctactggatc

SEQ ID NO: 219957 - DNA, 22 bp, Artificial Sequence
  Synthetic oligonucleotide; TTT chr2 60497823 60497844 60497828 60497823 -
tgatcatttctctactggatca

SEQ ID NO: 219958 - DNA, 22 bp, Artificial Sequence
  Synthetic oligonucleotide; TTT chr2 60497822 60497843 60497827 60497822 -
gatcatttctctactggatcat

SEQ ID NO: 219959 - DNA, 22 bp, Artificial Sequence
  Synthetic oligonucleotide; TTG chr2 60497821 60497842 60497826 60497821 -
atcatttctctactggatcatc

SEQ ID NO: 219960 - DNA, 22 bp, Artificial Sequence
  Synthetic oligonucleotide; TTT chr2 60497814 60497835 60497819 60497814 -
ctctactggatcatcagcaaag

SEQ ID NO: 219961 - DNA, 22 bp, Artificial Sequence
  Synthetic oligonucleotide; TTC chr2 60497813 60497834 60497818 60497813 -
tctactggatcatcagcaaagg

SEQ ID NO: 219962 - DNA, 22 bp, Artificial Sequence
  Synthetic oligonucleotide; CTC chr2 60497811 60497832 60497816 60497811 -
tactggatcatcagcaaaggga

SEQ ID NO: 219963 - DNA, 22 bp, Artificial Sequence
  Synthetic oligonucleotide; CTA chr2 60497809 60497830 60497814 60497809 -
ctggatcatcagcaaagggaga

SEQ ID NO: 219964 - DNA, 22 bp, Artificial Sequence
  Synthetic oligonucleotide; CTG chr2 60497806 60497827 60497811 60497806 -
gatcatcagcaaagggagaaat

SEQ ID NO: 219965 - DNA, 22 bp, Artificial Sequence
  Synthetic oligonucleotide; CTG chr2 60497765 60497786 60497770 60497765 -
agtcctttgggggaaatatgtg

SEQ ID NO: 219966 - DNA, 22 bp, Artificial Sequence
  Synthetic oligonucleotide; CTT chr2 60497758 60497779 60497763 60497758 -
tgggggaaatatgtgcctatag

SEQ ID NO: 219967 - DNA, 22 bp, Artificial Sequence
  Synthetic oligonucleotide; TTT chr2 60497757 60497778 60497762 60497757 -
gggggaaatatgtgcctatagt

SEQ ID NO: 219968 - DNA, 22 bp, Artificial Sequence
  Synthetic oligonucleotide; TTG chr2 60497756 60497777 60497761 60497756 -
ggggaaatatgtgcctatagta

SEQ ID NO: 219969 - DNA, 22 bp, Artificial Sequence
  Synthetic oligonucleotide; CTA chr2 60497739 60497760 60497744 60497739 -
tagtaaggtgatagttcagaga

SEQ ID NO: 219970 - DNA, 22 bp, Artificial Sequence
  Synthetic oligonucleotide; TTC chr2 60497722 60497743 60497727 60497722 -
agagaaagagaagagtaggagg

SEQ ID NO: 219971 - DNA, 22 bp, Artificial Sequence
  Synthetic oligonucleotide; CTG chr2 60497697 60497718 60497702 60497697 -
gacctgaaggccttccaaaaaa

SEQ ID NO: 219972 - DNA, 22 bp, Artificial Sequence
  Synthetic oligonucleotide; CTG chr2 60497691 60497712 60497696 60497691 -
aaggccttccaaaaaaagtaaa

SEQ ID NO: 219973 - DNA, 22 bp, Artificial Sequence
  Synthetic oligonucleotide; CTT chr2 60497683 60497704 60497688 60497683 -
ccaaaaaaagtaaaggatgtta

SEQ ID NO: 219974 - DNA, 22 bp, Artificial Sequence
  Synthetic oligonucleotide; TTC chr2 60497682 60497703 60497687 60497682 -
caaaaaaagtaaaggatgttaa

SEQ ID NO: 219975 - DNA, 22 bp, Artificial Sequence
  Synthetic oligonucleotide; TTA chr2 60497661 60497682 60497666 60497661 -
aattgctctggaaggtgcaaag

SEQ ID NO: 219976 - DNA, 22 bp, Artificial Sequence
  Synthetic oligonucleotide; TTG chr2 60497656 60497677 60497661 60497656 -
ctctggaaggtgcaaagtgcca

SEQ ID NO: 219977 - DNA, 22 bp, Artificial Sequence
  Synthetic oligonucleotide; CTC chr2 60497653 60497674 60497658 60497653 -
tggaaggtgcaaagtgccatcc

SEQ ID NO: 219978 - DNA, 22 bp, Artificial Sequence
  Synthetic oligonucleotide; CTG chr2 60497651 60497672 60497656 60497651 -
gaaggtgcaaagtgccatccag

SEQ ID NO: 219979 - DNA, 22 bp, Artificial Sequence
  Synthetic oligonucleotide; CTA chr2 60497620 60497641 60497625 60497620 -
ttattattattatcatcatcat

SEQ ID NO: 219980 - DNA, 22 bp, Artificial Sequence
  Synthetic oligonucleotide; TTA chr2 60497617 60497638 60497622 60497617 -
ttattattatcatcatcataat

SEQ ID NO: 219981 - DNA, 22 bp, Artificial Sequence
  Synthetic oligonucleotide; TTA chr2 60497614 60497635 60497619 60497614 -
ttattatcatcatcataatggt

SEQ ID NO: 219982 - DNA, 22 bp, Artificial Sequence
  Synthetic oligonucleotide; TTA chr2 60497611 60497632 60497616 60497611 -
ttatcatcatcataatggtcat

SEQ ID NO: 219983 - DNA, 22 bp, Artificial Sequence
  Synthetic oligonucleotide; TTA chr2 60497608 60497629 60497613 60497608 -
tcatcatcataatggtcattat

SEQ ID NO: 219984 - DNA, 22 bp, Artificial Sequence
  Synthetic oligonucleotide; TTA chr2 60497587 60497608 60497592 60497587 -
tcatcaccattataggatatgg

SEQ ID NO: 219985 - DNA, 22 bp, Artificial Sequence
  Synthetic oligonucleotide; TTA chr2 60497575 60497596 60497580 60497575 -
taggatatggcactgacgtagg

SEQ ID NO: 219986 - DNA, 22 bp, Artificial Sequence
  Synthetic oligonucleotide; CTG chr2 60497560 60497581 60497565 60497560 -
acgtaggtagtgactggtaaga

SEQ ID NO: 219987 - DNA, 22 bp, Artificial Sequence
  Synthetic oligonucleotide; CTG chr2 60497544 60497565 60497549 60497544 -
gtaagagccgattgagtttcta

SEQ ID NO: 219988 - DNA, 22 bp, Artificial Sequence
  Synthetic oligonucleotide; TTG chr2 60497530 60497551 60497535 60497530 -
agtttctagctgattcctgatg

SEQ ID NO: 219989 - DNA, 22 bp, Artificial Sequence
  Synthetic oligonucleotide; TTT chr2 60497525 60497546 60497530 60497525 -
ctagctgattcctgatgttagg

SEQ ID NO: 219990 - DNA, 22 bp, Artificial Sequence
  Synthetic oligonucleotide; TTC chr2 60497524 60497545 60497529 60497524 -
tagctgattcctgatgttaggg

SEQ ID NO: 219991 - DNA, 22 bp, Artificial Sequence
  Synthetic oligonucleotide; CTA chr2 60497522 60497543 60497527 60497522 -
gctgattcctgatgttaggggc

SEQ ID NO: 219992 - DNA, 22 bp, Artificial Sequence
  Synthetic oligonucleotide; CTG chr2 60497518 60497539 60497523 60497518 -
attcctgatgttaggggccatg

SEQ ID NO: 219993 - DNA, 22 bp, Artificial Sequence
  Synthetic oligonucleotide; TTC chr2 60497514 60497535 60497519 60497514 -
ctgatgttaggggccatgaatc

SEQ ID NO: 219994 - DNA, 22 bp, Artificial Sequence
  Synthetic oligonucleotide; CTG chr2 60497511 60497532 60497516 60497511 -
atgttaggggccatgaatctgt

SEQ ID NO: 219995 - DNA, 22 bp, Artificial Sequence
  Synthetic oligonucleotide; TTA chr2 60497505 60497526 60497510 60497505 -
ggggccatgaatctgtctacct

SEQ ID NO: 219996 - DNA, 22 bp, Artificial Sequence
  Synthetic oligonucleotide; CTG chr2 60497490 60497511 60497495 60497490 -
tctacctggaatgttctaattc

SEQ ID NO: 219997 - DNA, 22 bp, Artificial Sequence
  Synthetic oligonucleotide; CTA chr2 60497486 60497507 60497491 60497486 -
cctggaatgttctaattcaatt

SEQ ID NO: 219998 - DNA, 22 bp, Artificial Sequence
  Synthetic oligonucleotide; CTG chr2 60497482 60497503 60497487 60497482 -
gaatgttctaattcaattcagg

SEQ ID NO: 219999 - DNA, 22 bp, Artificial Sequence
  Synthetic oligonucleotide; TTC chr2 60497474 60497495 60497479 60497474 -
taattcaattcaggagcggcag

SEQ ID NO: 220000 - DNA, 22 bp, Artificial Sequence
  Synthetic oligonucleotide; CTA chr2 60497472 60497493 60497477 60497472 -
attcaattcaggagcggcagtt

SEQ ID NO: 220001 - DNA, 22 bp, Artificial Sequence
  Synthetic oligonucleotide; TTC chr2 60497468 60497489 60497473 60497468 -
aattcaggagcggcagtttaag

SEQ ID NO: 220002 - DNA, 22 bp, Artificial Sequence
  Synthetic oligonucleotide; TTC chr2 60497463 60497484 60497468 60497463 -
aggagcggcagtttaagtctag

SEQ ID NO: 220003 - DNA, 22 bp, Artificial Sequence
  Synthetic oligonucleotide; TTT chr2 60497449 60497470 60497454 60497449 -
aagtctagacttcaaagcactc

SEQ ID NO: 220004 - DNA, 22 bp, Artificial Sequence
  Synthetic oligonucleotide; TTA chr2 60497448 60497469 60497453 60497448 -
agtctagacttcaaagcactct

SEQ ID NO: 220005 - DNA, 22 bp, Artificial Sequence
  Synthetic oligonucleotide; CTA chr2 60497442 60497463 60497447 60497442 -
gacttcaaagcactctcatata

SEQ ID NO: 220006 - DNA, 22 bp, Artificial Sequence
  Synthetic oligonucleotide; CTT chr2 60497437 60497458 60497442 60497437 -
caaagcactctcatatatcctt

SEQ ID NO: 220007 - DNA, 22 bp, Artificial Sequence
  Synthetic oligonucleotide; TTC chr2 60497436 60497457 60497441 60497436 -
aaagcactctcatatatccttg

SEQ ID NO: 220008 - DNA, 22 bp, Artificial Sequence
  Synthetic oligonucleotide; CTC chr2 60497427 60497448 60497432 60497427 -
tcatatatccttggcctgctaa

SEQ ID NO: 220009 - DNA, 22 bp, Artificial Sequence
  Synthetic oligonucleotide; CTC chr2 60497425 60497446 60497430 60497425 -
atatatccttggcctgctaacc

SEQ ID NO: 220010 - DNA, 22 bp, Artificial Sequence
  Synthetic oligonucleotide; CTT chr2 60497415 60497436 60497420 60497415 -
ggcctgctaacctgagggctag

SEQ ID NO: 220011 - DNA, 22 bp, Artificial Sequence
  Synthetic oligonucleotide; TTG chr2 60497414 60497435 60497419 60497414 -
gcctgctaacctgagggctagt

SEQ ID NO: 220012 - DNA, 22 bp, Artificial Sequence
  Synthetic oligonucleotide; CTG chr2 60497409 60497430 60497414 60497409 -
ctaacctgagggctagtttcta

SEQ ID NO: 220013 - DNA, 22 bp, Artificial Sequence
  Synthetic oligonucleotide; CTA chr2 60497406 60497427 60497411 60497406 -
acctgagggctagtttctaggg

SEQ ID NO: 220014 - DNA, 22 bp, Artificial Sequence
  Synthetic oligonucleotide; CTG chr2 60497401 60497422 60497406 60497401 -
agggctagtttctagggattga

SEQ ID NO: 220015 - DNA, 22 bp, Artificial Sequence
  Synthetic oligonucleotide; CTA chr2 60497394 60497415 60497399 60497394 -
gtttctagggattgattaactt

SEQ ID NO: 220016 - DNA, 22 bp, Artificial Sequence
  Synthetic oligonucleotide; TTT chr2 60497390 60497411 60497395 60497390 -
ctagggattgattaacttaaag

SEQ ID NO: 220017 - DNA, 22 bp, Artificial Sequence
  Synthetic oligonucleotide; TTC chr2 60497389 60497410 60497394 60497389 -
tagggattgattaacttaaaga

SEQ ID NO: 220018 - DNA, 22 bp, Artificial Sequence
  Synthetic oligonucleotide; CTA chr2 60497387 60497408 60497392 60497387 -
gggattgattaacttaaagaca

SEQ ID NO: 220019 - DNA, 22 bp, Artificial Sequence
  Synthetic oligonucleotide; TTG chr2 60497380 60497401 60497385 60497380 -
attaacttaaagacagttcata

SEQ ID NO: 220020 - DNA, 22 bp, Artificial Sequence
  Synthetic oligonucleotide; TTA chr2 60497376 60497397 60497381 60497376 -
acttaaagacagttcatatatg

SEQ ID NO: 220021 - DNA, 22 bp, Artificial Sequence
  Synthetic oligonucleotide; CTT chr2 60497372 60497393 60497377 60497372 -
aaagacagttcatatatgcttg

SEQ ID NO: 220022 - DNA, 22 bp, Artificial Sequence
  Synthetic oligonucleotide; TTA chr2 60497371 60497392 60497376 60497371 -
aagacagttcatatatgcttga

SEQ ID NO: 220023 - DNA, 22 bp, Artificial Sequence
  Synthetic oligonucleotide; TTC chr2 60497361 60497382 60497366 60497361 -
atatatgcttgaatactagcta

SEQ ID NO: 220024 - DNA, 22 bp, Artificial Sequence
  Synthetic oligonucleotide; CTT chr2 60497351 60497372 60497356 60497351 -
gaatactagctattcatattct

SEQ ID NO: 220025 - DNA, 22 bp, Artificial Sequence
  Synthetic oligonucleotide; TTG chr2 60497350 60497371 60497355 60497350 -
aatactagctattcatattctg

SEQ ID NO: 220026 - DNA, 22 bp, Artificial Sequence
  Synthetic oligonucleotide; CTA chr2 60497343 60497364 60497348 60497343 -
gctattcatattctgaaaaatc

SEQ ID NO: 220027 - DNA, 22 bp, Artificial Sequence
  Synthetic oligonucleotide; CTA chr2 60497339 60497360 60497344 60497339 -
ttcatattctgaaaaatctgac

SEQ ID NO: 220028 - DNA, 22 bp, Artificial Sequence
  Synthetic oligonucleotide; TTC chr2 60497336 60497357 60497341 60497336 -
atattctgaaaaatctgacttg

SEQ ID NO: 220029 - DNA, 22 bp, Artificial Sequence
  Synthetic oligonucleotide; TTC chr2 60497330 60497351 60497335 60497330 -
tgaaaaatctgacttgatcaaa

SEQ ID NO: 220030 - DNA, 22 bp, Artificial Sequence
  Synthetic oligonucleotide; CTG chr2 60497328 60497349 60497333 60497328 -
aaaaatctgacttgatcaaaca

SEQ ID NO: 220031 - DNA, 22 bp, Artificial Sequence
  Synthetic oligonucleotide; CTG chr2 60497319 60497340 60497324 60497319 -
acttgatcaaacagagcagtta

SEQ ID NO: 220032 - DNA, 22 bp, Artificial Sequence
  Synthetic oligonucleotide; CTT chr2 60497315 60497336 60497320 60497315 -
gatcaaacagagcagttaaagg

SEQ ID NO: 220033 - DNA, 22 bp, Artificial Sequence
  Synthetic oligonucleotide; TTG chr2 60497314 60497335 60497319 60497314 -
atcaaacagagcagttaaaggc

SEQ ID NO: 220034 - DNA, 22 bp, Artificial Sequence
  Synthetic oligonucleotide; TTA chr2 60497297 60497318 60497302 60497297 -
aaggcgatgcttcgttttacaa

SEQ ID NO: 220035 - DNA, 22 bp, Artificial Sequence
  Synthetic oligonucleotide; CTT chr2 60497285 60497306 60497290 60497285 -
cgttttacaaaagattttcccc

SEQ ID NO: 220036 - DNA, 22 bp, Artificial Sequence
  Synthetic oligonucleotide; TTC chr2 60497284 60497305 60497289 60497284 -
gttttacaaaagattttccccc

SEQ ID NO: 220037 - DNA, 22 bp, Artificial Sequence
  Synthetic oligonucleotide; TTT chr2 60497280 60497301 60497285 60497280 -
tacaaaagattttcccccctct

SEQ ID NO: 220038 - DNA, 22 bp, Artificial Sequence
  Synthetic oligonucleotide; TTT chr2 60497279 60497300 60497284 60497279 -
acaaaagattttcccccctctt

SEQ ID NO: 220039 - DNA, 22 bp, Artificial Sequence
  Synthetic oligonucleotide; TTA chr2 60497278 60497299 60497283 60497278 -
caaaagattttcccccctcttt

SEQ ID NO: 220040 - DNA, 22 bp, Artificial Sequence
  Synthetic oligonucleotide; TTT chr2 60497268 60497289 60497273 60497268 -
tcccccctctttacaaaaggat

SEQ ID NO: 220041 - DNA, 22 bp, Artificial Sequence
  Synthetic oligonucleotide; TTT chr2 60497267 60497288 60497272 60497267 -
cccccctctttacaaaaggatg

SEQ ID NO: 220042 - DNA, 22 bp, Artificial Sequence
  Synthetic oligonucleotide; TTC chr2 60497266 60497287 60497271 60497266 -
ccccctctttacaaaaggatgc

SEQ ID NO: 220043 - DNA, 22 bp, Artificial Sequence
  Synthetic oligonucleotide; CTC chr2 60497259 60497280 60497264 60497259 -
tttacaaaaggatgcacagtgg

SEQ ID NO: 220044 - DNA, 22 bp, Artificial Sequence
  Synthetic oligonucleotide; CTT chr2 60497257 60497278 60497262 60497257 -
tacaaaaggatgcacagtggta

SEQ ID NO: 220045 - DNA, 22 bp, Artificial Sequence
  Synthetic oligonucleotide; TTT chr2 60497256 60497277 60497261 60497256 -
acaaaaggatgcacagtggtat

SEQ ID NO: 220046 - DNA, 22 bp, Artificial Sequence
  Synthetic oligonucleotide; TTA chr2 60497255 60497276 60497260 60497255 -
caaaaggatgcacagtggtatt

SEQ ID NO: 220047 - DNA, 22 bp, Artificial Sequence
  Synthetic oligonucleotide; TTC chr2 60497232 60497253 60497237 60497232 -
ctttcaatggaatgtttctcta

SEQ ID NO: 220048 - DNA, 22 bp, Artificial Sequence
  Synthetic oligonucleotide; CTT chr2 60497229 60497250 60497234 60497229 -
tcaatggaatgtttctctagct

SEQ ID NO: 220049 - DNA, 22 bp, Artificial Sequence
  Synthetic oligonucleotide; TTT chr2 60497228 60497249 60497233 60497228 -
caatggaatgtttctctagctc

SEQ ID NO: 220050 - DNA, 22 bp, Artificial Sequence
  Synthetic oligonucleotide; TTC chr2 60497227 60497248 60497232 60497227 -
aatggaatgtttctctagctca

SEQ ID NO: 220051 - DNA, 22 bp, Artificial Sequence
  Synthetic oligonucleotide; TTT chr2 60497215 60497236 60497220 60497215 -
ctctagctcattaagtgtttac

SEQ ID NO: 220052 - DNA, 22 bp, Artificial Sequence
  Synthetic oligonucleotide; TTC chr2 60497214 60497235 60497219 60497214 -
tctagctcattaagtgtttaca

SEQ ID NO: 220053 - DNA, 22 bp, Artificial Sequence
  Synthetic oligonucleotide; CTC chr2 60497212 60497233 60497217 60497212 -
tagctcattaagtgtttacagg

SEQ ID NO: 220054 - DNA, 22 bp, Artificial Sequence
  Synthetic oligonucleotide; CTA chr2 60497210 60497231 60497215 60497210 -
gctcattaagtgtttacaggtc

SEQ ID NO: 220055 - DNA, 22 bp, Artificial Sequence
  Synthetic oligonucleotide; CTC chr2 60497206 60497227 60497211 60497206 -
attaagtgtttacaggtcatta

SEQ ID NO: 220056 - DNA, 22 bp, Artificial Sequence
  Synthetic oligonucleotide; TTA chr2 60497202 60497223 60497207 60497202 -
agtgtttacaggtcattagcta

SEQ ID NO: 220057 - DNA, 22 bp, Artificial Sequence
  Synthetic oligonucleotide; TTT chr2 60497195 60497216 60497200 60497195 -
acaggtcattagctactgcatg

SEQ ID NO: 220058 - DNA, 22 bp, Artificial Sequence
  Synthetic oligonucleotide; TTA chr2 60497194 60497215 60497199 60497194 -
caggtcattagctactgcatgg

SEQ ID NO: 220059 - DNA, 22 bp, Artificial Sequence
  Synthetic oligonucleotide; TTA chr2 60497184 60497205 60497189 60497184 -
gctactgcatggaaggactttg

SEQ ID NO: 220060 - DNA, 22 bp, Artificial Sequence
  Synthetic oligonucleotide; CTA chr2 60497180 60497201 60497185 60497180 -
ctgcatggaaggactttgctag

SEQ ID NO: 220061 - DNA, 22 bp, Artificial Sequence
  Synthetic oligonucleotide; CTG chr2 60497177 60497198 60497182 60497177 -
catggaaggactttgctagaga

SEQ ID NO: 220062 - DNA, 22 bp, Artificial Sequence
  Synthetic oligonucleotide; CTT chr2 60497164 60497185 60497169 60497164 -
tgctagagaaaaggaaggctgc

SEQ ID NO: 220063 - DNA, 22 bp, Artificial Sequence
  Synthetic oligonucleotide; TTT chr2 60497163 60497184 60497168 60497163 -
gctagagaaaaggaaggctgca

SEQ ID NO: 220064 - DNA, 22 bp, Artificial Sequence
  Synthetic oligonucleotide; TTG chr2 60497162 60497183 60497167 60497162 -
ctagagaaaaggaaggctgcaa

SEQ ID NO: 220065 - DNA, 22 bp, Artificial Sequence
  Synthetic oligonucleotide; CTA chr2 60497159 60497180 60497164 60497159 -
gagaaaaggaaggctgcaagga

SEQ ID NO: 220066 - DNA, 22 bp, Artificial Sequence
  Synthetic oligonucleotide; CTG chr2 60497143 60497164 60497148 60497143 -
caaggaaatagctctagctcta

SEQ ID NO: 220067 - DNA, 22 bp, Artificial Sequence
  Synthetic oligonucleotide; CTC chr2 60497129 60497150 60497134 60497129 -
tagctctagctctagcttaggg

SEQ ID NO: 220068 - DNA, 22 bp, Artificial Sequence
  Synthetic oligonucleotide; CTA chr2 60497127 60497148 60497132 60497127 -
gctctagctctagcttagggga

SEQ ID NO: 220069 - DNA, 22 bp, Artificial Sequence
  Synthetic oligonucleotide; CTC chr2 60497123 60497144 60497128 60497123 -
tagctctagcttaggggatgct

SEQ ID NO: 220070 - DNA, 22 bp, Artificial Sequence
  Synthetic oligonucleotide; CTA chr2 60497121 60497142 60497126 60497121 -
gctctagcttaggggatgctag

SEQ ID NO: 220071 - DNA, 22 bp, Artificial Sequence
  Synthetic oligonucleotide; CTC chr2 60497117 60497138 60497122 60497117 -
tagcttaggggatgctagctaa

SEQ ID NO: 220072 - DNA, 22 bp, Artificial Sequence
  Synthetic oligonucleotide; CTA chr2 60497115 60497136 60497120 60497115 -
gcttaggggatgctagctaaag

SEQ ID NO: 220073 - DNA, 22 bp, Artificial Sequence
  Synthetic oligonucleotide; CTT chr2 60497111 60497132 60497116 60497111 -
aggggatgctagctaaagggaa

SEQ ID NO: 220074 - DNA, 22 bp, Artificial Sequence
  Synthetic oligonucleotide; TTA chr2 60497110 60497131 60497115 60497110 -
ggggatgctagctaaagggaat

SEQ ID NO: 220075 - DNA, 22 bp, Artificial Sequence
  Synthetic oligonucleotide; CTA chr2 60497100 60497121 60497105 60497100 -
gctaaagggaattagaattggt

SEQ ID NO: 220076 - DNA, 22 bp, Artificial Sequence
  Synthetic oligonucleotide; CTA chr2 60497096 60497117 60497101 60497096 -
aagggaattagaattggttggc

SEQ ID NO: 220077 - DNA, 22 bp, Artificial Sequence
  Synthetic oligonucleotide; TTA chr2 60497086 60497107 60497091 60497086 -
gaattggttggccaacaggtgt

SEQ ID NO: 220078 - DNA, 22 bp, Artificial Sequence
  Synthetic oligonucleotide; TTG chr2 60497080 60497101 60497085 60497080 -
gttggccaacaggtgtctgcgg

SEQ ID NO: 220079 - DNA, 22 bp, Artificial Sequence
  Synthetic oligonucleotide; TTG chr2 60497076 60497097 60497081 60497076 -
gccaacaggtgtctgcggtgta

SEQ ID NO: 220080 - DNA, 22 bp, Artificial Sequence
  Synthetic oligonucleotide; CTG chr2 60497061 60497082 60497066 60497061 -
cggtgtactccctgtccactca

SEQ ID NO: 220081 - DNA, 22 bp, Artificial Sequence
  Synthetic oligonucleotide; CTC chr2 60497051 60497072 60497056 60497051 -
cctgtccactcaacactggggg

SEQ ID NO: 220082 - DNA, 22 bp, Artificial Sequence
  Synthetic oligonucleotide; CTG chr2 60497047 60497068 60497052 60497047 -
tccactcaacactgggggagga

SEQ ID NO: 220083 - DNA, 22 bp, Artificial Sequence
  Synthetic oligonucleotide; CTC chr2 60497040 60497061 60497045 60497040 -
aacactgggggaggagtagaga

SEQ ID NO: 220084 - DNA, 22 bp, Artificial Sequence
  Synthetic oligonucleotide; CTG chr2 60497033 60497054 60497038 60497033 -
ggggaggagtagagatcttgct

SEQ ID NO: 220085 - DNA, 22 bp, Artificial Sequence
  Synthetic oligonucleotide; CTT chr2 60497014 60497035 60497019 60497014 -
gcttccttccatgtgagagctt

SEQ ID NO: 220086 - DNA, 22 bp, Artificial Sequence
  Synthetic oligonucleotide; TTG chr2 60497013 60497034 60497018 60497013 -
cttccttccatgtgagagctta

SEQ ID NO: 220087 - DNA, 22 bp, Artificial Sequence
  Synthetic oligonucleotide; CTT chr2 60497010 60497031 60497015 60497010 -
ccttccatgtgagagcttatag

SEQ ID NO: 220088 - DNA, 22 bp, Artificial Sequence
  Synthetic oligonucleotide; TTC chr2 60497009 60497030 60497014 60497009 -
cttccatgtgagagcttatagt

SEQ ID NO: 220089 - DNA, 22 bp, Artificial Sequence
  Synthetic oligonucleotide; CTT chr2 60497006 60497027 60497011 60497006 -
ccatgtgagagcttatagtccc

SEQ ID NO: 220090 - DNA, 22 bp, Artificial Sequence
  Synthetic oligonucleotide; TTC chr2 60497005 60497026 60497010 60497005 -
catgtgagagcttatagtccct

SEQ ID NO: 220091 - DNA, 22 bp, Artificial Sequence
  Synthetic oligonucleotide; CTT chr2 60496992 60497013 60496997 60496992 -
atagtccctttggaatccagat

SEQ ID NO: 220092 - DNA, 22 bp, Artificial Sequence
  Synthetic oligonucleotide; TTA chr2 60496991 60497012 60496996 60496991 -
tagtccctttggaatccagatt

SEQ ID NO: 220093 - DNA, 22 bp, Artificial Sequence
  Synthetic oligonucleotide; CTT chr2 60496982 60497003 60496987 60496982 -
tggaatccagatttatcgtgaa

SEQ ID NO: 220094 - DNA, 22 bp, Artificial Sequence
  Synthetic oligonucleotide; TTT chr2 60496981 60497002 60496986 60496981 -
ggaatccagatttatcgtgaag

SEQ ID NO: 220095 - DNA, 22 bp, Artificial Sequence
  Synthetic oligonucleotide; TTG chr2 60496980 60497001 60496985 60496980 -
gaatccagatttatcgtgaagt

SEQ ID NO: 220096 - DNA, 22 bp, Artificial Sequence
  Synthetic oligonucleotide; TTT chr2 60496968 60496989 60496973 60496968 -
atcgtgaagtaatcgtgaagac

SEQ ID NO: 220097 - DNA, 22 bp, Artificial Sequence
  Synthetic oligonucleotide; TTA chr2 60496967 60496988 60496972 60496967 -
tcgtgaagtaatcgtgaagaca

SEQ ID NO: 220098 - DNA, 22 bp, Artificial Sequence
  Synthetic oligonucleotide; TTA chr2 60496938 60496959 60496943 60496938 -
agtgctacattgtgttcactca

SEQ ID NO: 220099 - DNA, 22 bp, Artificial Sequence
  Synthetic oligonucleotide; CTA chr2 60496931 60496952 60496936 60496931 -
cattgtgttcactcatctctta

SEQ ID NO: 220100 - DNA, 22 bp, Artificial Sequence
  Synthetic oligonucleotide; TTG chr2 60496926 60496947 60496931 60496926 -
tgttcactcatctcttatgact

SEQ ID NO: 220101 - DNA, 22 bp, Artificial Sequence
  Synthetic oligonucleotide; TTC chr2 60496921 60496942 60496926 60496921 -
actcatctcttatgactgtcca

SEQ ID NO: 220102 - DNA, 22 bp, Artificial Sequence
  Synthetic oligonucleotide; CTC chr2 60496917 60496938 60496922 60496917 -
atctcttatgactgtccatggg

SEQ ID NO: 220103 - DNA, 22 bp, Artificial Sequence
  Synthetic oligonucleotide; CTC chr2 60496912 60496933 60496917 60496912 -
ttatgactgtccatggggaaat

SEQ ID NO: 220104 - DNA, 22 bp, Artificial Sequence
  Synthetic oligonucleotide; CTT chr2 60496910 60496931 60496915 60496910 -
atgactgtccatggggaaatgg

SEQ ID NO: 220105 - DNA, 22 bp, Artificial Sequence
  Synthetic oligonucleotide; TTA chr2 60496909 60496930 60496914 60496909 -
tgactgtccatggggaaatggg

SEQ ID NO: 220106 - DNA, 22 bp, Artificial Sequence
  Synthetic oligonucleotide; CTG chr2 60496903 60496924 60496908 60496903 -
tccatggggaaatgggtcctgc

SEQ ID NO: 220107 - DNA, 22 bp, Artificial Sequence
  Synthetic oligonucleotide; CTG chr2 60496882 60496903 60496887 60496882 -
ctttacaaaaattcagtttgca

SEQ ID NO: 220108 - DNA, 22 bp, Artificial Sequence
  Synthetic oligonucleotide; CTT chr2 60496879 60496900 60496884 60496879 -
tacaaaaattcagtttgcatgc

SEQ ID NO: 220109 - DNA, 22 bp, Artificial Sequence
  Synthetic oligonucleotide; TTT chr2 60496878 60496899 60496883 60496878 -
acaaaaattcagtttgcatgct

SEQ ID NO: 220110 - DNA, 22 bp, Artificial Sequence
  Synthetic oligonucleotide; TTA chr2 60496877 60496898 60496882 60496877 -
caaaaattcagtttgcatgctg

SEQ ID NO: 220111 - DNA, 22 bp, Artificial Sequence
  Synthetic oligonucleotide; TTC chr2 60496868 60496889 60496873 60496868 -
agtttgcatgctgcttttcagg

SEQ ID NO: 220112 - DNA, 22 bp, Artificial Sequence
  Synthetic oligonucleotide; TTT chr2 60496863 60496884 60496868 60496863 -
gcatgctgcttttcaggcctat

SEQ ID NO: 220113 - DNA, 22 bp, Artificial Sequence
  Synthetic oligonucleotide; TTG chr2 60496862 60496883 60496867 60496862 -
catgctgcttttcaggcctatg

SEQ ID NO: 220114 - DNA, 22 bp, Artificial Sequence
  Synthetic oligonucleotide; CTG chr2 60496855 60496876 60496860 60496855 -
cttttcaggcctatgactgtga

SEQ ID NO: 220115 - DNA, 22 bp, Artificial Sequence
  Synthetic oligonucleotide; CTT chr2 60496852 60496873 60496857 60496852 -
ttcaggcctatgactgtgacat

SEQ ID NO: 220116 - DNA, 22 bp, Artificial Sequence
  Synthetic oligonucleotide; TTT chr2 60496851 60496872 60496856 60496851 -
tcaggcctatgactgtgacatc

SEQ ID NO: 220117 - DNA, 22 bp, Artificial Sequence
  Synthetic oligonucleotide; TTT chr2 60496850 60496871 60496855 60496850 -
caggcctatgactgtgacatcc

SEQ ID NO: 220118 - DNA, 22 bp, Artificial Sequence
  Synthetic oligonucleotide; TTC chr2 60496849 60496870 60496854 60496849 -
aggcctatgactgtgacatcca

SEQ ID NO: 220119 - DNA, 22 bp, Artificial Sequence
  Synthetic oligonucleotide; CTA chr2 60496842 60496863 60496847 60496842 -
tgactgtgacatccagtgaggg

SEQ ID NO: 220120 - DNA, 22 bp, Artificial Sequence
  Synthetic oligonucleotide; CTG chr2 60496836 60496857 60496841 60496836 -
tgacatccagtgagggagattt

SEQ ID NO: 220121 - DNA, 22 bp, Artificial Sequence
  Synthetic oligonucleotide; TTT chr2 60496814 60496835 60496819 60496814 -
gaggaaggggttgatgtaagac

SEQ ID NO: 220122 - DNA, 22 bp, Artificial Sequence
  Synthetic oligonucleotide; TTG chr2 60496813 60496834 60496818 60496813 -
aggaaggggttgatgtaagact

SEQ ID NO: 220123 - DNA, 22 bp, Artificial Sequence
  Synthetic oligonucleotide; TTG chr2 60496801 60496822 60496806 60496801 -
atgtaagactcctcttgggagc

SEQ ID NO: 220124 - DNA, 22 bp, Artificial Sequence
  Synthetic oligonucleotide; CTC chr2 60496790 60496811 60496795 60496790 -
ctcttgggagcatagtgagaga

SEQ ID NO: 220125 - DNA, 22 bp, Artificial Sequence
  Synthetic oligonucleotide; CTC chr2 60496787 60496808 60496792 60496787 -
ttgggagcatagtgagagagag

SEQ ID NO: 220126 - DNA, 22 bp, Artificial Sequence
  Synthetic oligonucleotide; CTT chr2 60496785 60496806 60496790 60496785 -
gggagcatagtgagagagagag

SEQ ID NO: 220127 - DNA, 22 bp, Artificial Sequence
  Synthetic oligonucleotide; TTG chr2 60496784 60496805 60496789 60496784 -
ggagcatagtgagagagagaga

SEQ ID NO: 220128 - DNA, 22 bp, Artificial Sequence
  Synthetic oligonucleotide; CTC chr2 60496748 60496769 60496753 60496748 -
acagtggaacctagagtgggaa

SEQ ID NO: 220129 - DNA, 22 bp, Artificial Sequence
  Synthetic oligonucleotide; CTA chr2 60496735 60496756 60496740 60496735 -
gagtgggaaaggctacctggtg

SEQ ID NO: 220130 - DNA, 22 bp, Artificial Sequence
  Synthetic oligonucleotide; CTA chr2 60496720 60496741 60496725 60496720 -
cctggtggctgtcctggcatgt

SEQ ID NO: 220131 - DNA, 22 bp, Artificial Sequence
  Synthetic oligonucleotide; CTG chr2 60496716 60496737 60496721 60496716 -
gtggctgtcctggcatgtaagt

SEQ ID NO: 220132 - DNA, 22 bp, Artificial Sequence
  Synthetic oligonucleotide; CTG chr2 60496709 60496730 60496714 60496709 -
tcctggcatgtaagtaagtctg

SEQ ID NO: 220133 - DNA, 22 bp, Artificial Sequence
  Synthetic oligonucleotide; CTG chr2 60496704 60496725 60496709 60496704 -
gcatgtaagtaagtctgtgtgg

SEQ ID NO: 220134 - DNA, 22 bp, Artificial Sequence
  Synthetic oligonucleotide; CTG chr2 60496687 60496708 60496692 60496687 -
tgtggtcagggcttgcattcca

SEQ ID NO: 220135 - DNA, 22 bp, Artificial Sequence
  Synthetic oligonucleotide; CTT chr2 60496673 60496694 60496678 60496673 -
gcattccataaatggcccaggc

SEQ ID NO: 220136 - DNA, 22 bp, Artificial Sequence
  Synthetic oligonucleotide; TTG chr2 60496672 60496693 60496677 60496672 -
cattccataaatggcccaggcc

SEQ ID NO: 220137 - DNA, 22 bp, Artificial Sequence
  Synthetic oligonucleotide; TTC chr2 60496667 60496688 60496672 60496667 -
cataaatggcccaggcccctgc

SEQ ID NO: 220138 - DNA, 22 bp, Artificial Sequence
  Synthetic oligonucleotide; CTG chr2 60496646 60496667 60496651 60496646 -
ctggctgctgggagagaaagtc

SEQ ID NO: 220139 - DNA, 22 bp, Artificial Sequence
  Synthetic oligonucleotide; CTG chr2 60496643 60496664 60496648 60496643 -
gctgctgggagagaaagtcggt

SEQ ID NO: 220140 - DNA, 22 bp, Artificial Sequence
  Synthetic oligonucleotide; CTG chr2 60496639 60496660 60496644 60496639 -
ctgggagagaaagtcggtgagg

SEQ ID NO: 220141 - DNA, 22 bp, Artificial Sequence
  Synthetic oligonucleotide; CTG chr2 60496636 60496657 60496641 60496636 -
ggagagaaagtcggtgaggaga

SEQ ID NO: 220142 - DNA, 22 bp, Artificial Sequence
  Synthetic oligonucleotide; TTG chr2 60496606 60496627 60496611 60496606 -
tacaaggcaggagagatgtact

SEQ ID NO: 220143 - DNA, 22 bp, Artificial Sequence
  Synthetic oligonucleotide; CTC chr2 60496583 60496604 60496588 60496583 -
accaggctcttccagaaggggt

SEQ ID NO: 220144 - DNA, 22 bp, Artificial Sequence
  Synthetic oligonucleotide; CTC chr2 60496574 60496595 60496579 60496574 -
ttccagaaggggtaactgtctc

SEQ ID NO: 220145 - DNA, 22 bp, Artificial Sequence
  Synthetic oligonucleotide; CTT chr2 60496572 60496593 60496577 60496572 -
ccagaaggggtaactgtctcaa

SEQ ID NO: 220146 - DNA, 22 bp, Artificial Sequence
  Synthetic oligonucleotide; TTC chr2 60496571 60496592 60496576 60496571 -
cagaaggggtaactgtctcaaa

SEQ ID NO: 220147 - DNA, 22 bp, Artificial Sequence
  Synthetic oligonucleotide; CTG chr2 60496556 60496577 60496561 60496556 -
tctcaaatccttgccttgaacc

SEQ ID NO: 220148 - DNA, 22 bp, Artificial Sequence
  Synthetic oligonucleotide; CTC chr2 60496552 60496573 60496557 60496552 -
aaatccttgccttgaacctgca

SEQ ID NO: 220149 - DNA, 22 bp, Artificial Sequence
  Synthetic oligonucleotide; CTT chr2 60496544 60496565 60496549 60496544 -
gccttgaacctgcagcaaagtg

SEQ ID NO: 220150 - DNA, 22 bp, Artificial Sequence
  Synthetic oligonucleotide; TTG chr2 60496543 60496564 60496548 60496543 -
ccttgaacctgcagcaaagtgg

SEQ ID NO: 220151 - DNA, 22 bp, Artificial Sequence
  Synthetic oligonucleotide; CTT chr2 60496539 60496560 60496544 60496539 -
gaacctgcagcaaagtggaaga

SEQ ID NO: 220152 - DNA, 22 bp, Artificial Sequence
  Synthetic oligonucleotide; TTG chr2 60496538 60496559 60496543 60496538 -
aacctgcagcaaagtggaagat

SEQ ID NO: 220153 - DNA, 22 bp, Artificial Sequence
  Synthetic oligonucleotide; CTG chr2 60496532 60496553 60496537 60496532 -
cagcaaagtggaagataggtgt

SEQ ID NO: 220154 - DNA, 22 bp, Artificial Sequence
  Synthetic oligonucleotide; TTA chr2 60496508 60496529 60496513 60496508 -
tcctcctctcttccctctttcc

SEQ ID NO: 220155 - DNA, 22 bp, Artificial Sequence
  Synthetic oligonucleotide; CTC chr2 60496503 60496524 60496508 60496503 -
ctctcttccctctttcctgctt

SEQ ID NO: 220156 - DNA, 22 bp, Artificial Sequence
  Synthetic oligonucleotide; CTC chr2 60496500 60496521 60496505 60496500 -
tcttccctctttcctgcttcag

SEQ ID NO: 220157 - DNA, 22 bp, Artificial Sequence
  Synthetic oligonucleotide; CTC chr2 60496498 60496519 60496503 60496498 -
ttccctctttcctgcttcaggc

SEQ ID NO: 220158 - DNA, 22 bp, Artificial Sequence
  Synthetic oligonucleotide; CTT chr2 60496496 60496517 60496501 60496496 -
ccctctttcctgcttcaggcta

SEQ ID NO: 220159 - DNA, 22 bp, Artificial Sequence
  Synthetic oligonucleotide; TTC chr2 60496495 60496516 60496500 60496495 -
cctctttcctgcttcaggctac

SEQ ID NO: 220160 - DNA, 22 bp, Artificial Sequence
  Synthetic oligonucleotide; CTC chr2 60496491 60496512 60496496 60496491 -
tttcctgcttcaggctactctg

SEQ ID NO: 220161 - DNA, 22 bp, Artificial Sequence
  Synthetic oligonucleotide; CTT chr2 60496489 60496510 60496494 60496489 -
tcctgcttcaggctactctgaa

SEQ ID NO: 220162 - DNA, 22 bp, Artificial Sequence
  Synthetic oligonucleotide; TTT chr2 60496488 60496509 60496493 60496488 -
cctgcttcaggctactctgaac

SEQ ID NO: 220163 - DNA, 22 bp, Artificial Sequence
  Synthetic oligonucleotide; TTC chr2 60496487 60496508 60496492 60496487 -
ctgcttcaggctactctgaact

SEQ ID NO: 220164 - DNA, 22 bp, Artificial Sequence
  Synthetic oligonucleotide; CTG chr2 60496484 60496505 60496489 60496484 -
cttcaggctactctgaactcac

SEQ ID NO: 220165 - DNA, 22 bp, Artificial Sequence
  Synthetic oligonucleotide; CTT chr2 60496481 60496502 60496486 60496481 -
caggctactctgaactcacttt

SEQ ID NO: 220166 - DNA, 22 bp, Artificial Sequence
  Synthetic oligonucleotide; TTC chr2 60496480 60496501 60496485 60496480 -
aggctactctgaactcactttt

SEQ ID NO: 220167 - DNA, 22 bp, Artificial Sequence
  Synthetic oligonucleotide; CTA chr2 60496474 60496495 60496479 60496474 -
ctctgaactcacttttgctgtg

SEQ ID NO: 220168 - DNA, 22 bp, Artificial Sequence
  Synthetic oligonucleotide; CTC chr2 60496471 60496492 60496476 60496471 -
tgaactcacttttgctgtgtgt

SEQ ID NO: 220169 - DNA, 22 bp, Artificial Sequence
  Synthetic oligonucleotide; CTG chr2 60496469 60496490 60496474 60496469 -
aactcacttttgctgtgtgtcc

SEQ ID NO: 220170 - DNA, 22 bp, Artificial Sequence
  Synthetic oligonucleotide; CTC chr2 60496464 60496485 60496469 60496464 -
acttttgctgtgtgtccagagc

SEQ ID NO: 220171 - DNA, 22 bp, Artificial Sequence
  Synthetic oligonucleotide; CTT chr2 60496460 60496481 60496465 60496460 -
ttgctgtgtgtccagagctgac

SEQ ID NO: 220172 - DNA, 22 bp, Artificial Sequence
  Synthetic oligonucleotide; TTT chr2 60496459 60496480 60496464 60496459 -
tgctgtgtgtccagagctgacc

SEQ ID NO: 220173 - DNA, 22 bp, Artificial Sequence
  Synthetic oligonucleotide; TTT chr2 60496458 60496479 60496463 60496458 -
gctgtgtgtccagagctgacca

SEQ ID NO: 220174 - DNA, 22 bp, Artificial Sequence
  Synthetic oligonucleotide; TTG chr2 60496457 60496478 60496462 60496457 -
ctgtgtgtccagagctgaccag

SEQ ID NO: 220175 - DNA, 22 bp, Artificial Sequence
  Synthetic oligonucleotide; CTG chr2 60496454 60496475 60496459 60496454 -
tgtgtccagagctgaccagagg

SEQ ID NO: 220176 - DNA, 22 bp, Artificial Sequence
  Synthetic oligonucleotide; CTG chr2 60496440 60496461 60496445 60496440 -
accagaggacaatggcagactt

SEQ ID NO: 220177 - DNA, 22 bp, Artificial Sequence
  Synthetic oligonucleotide; CTT chr2 60496418 60496439 60496423 60496418 -
attgtcagactggcagcaccag

SEQ ID NO: 220178 - DNA, 22 bp, Artificial Sequence
  Synthetic oligonucleotide; TTA chr2 60496417 60496438 60496422 60496417 -
ttgtcagactggcagcaccagc

SEQ ID NO: 220179 - DNA, 22 bp, Artificial Sequence
  Synthetic oligonucleotide; TTG chr2 60496414 60496435 60496419 60496414 -
tcagactggcagcaccagccta

SEQ ID NO: 220180 - DNA, 22 bp, Artificial Sequence
  Synthetic oligonucleotide; CTG chr2 60496406 60496427 60496411 60496406 -
gcagcaccagcctagtgctctg

SEQ ID NO: 220181 - DNA, 22 bp, Artificial Sequence
  Synthetic oligonucleotide; CTA chr2 60496392 60496413 60496397 60496392 -
gtgctctgtctctgcctgggaa

SEQ ID NO: 220182 - DNA, 22 bp, Artificial Sequence
  Synthetic oligonucleotide; CTC chr2 60496386 60496407 60496391 60496386 -
tgtctctgcctgggaaatggtt

SEQ ID NO: 220183 - DNA, 22 bp, Artificial Sequence
  Synthetic oligonucleotide; CTG chr2 60496384 60496405 60496389 60496384 -
tctctgcctgggaaatggtttc

SEQ ID NO: 220184 - DNA, 22 bp, Artificial Sequence
  Synthetic oligonucleotide; CTC chr2 60496380 60496401 60496385 60496380 -
tgcctgggaaatggtttcacaa

SEQ ID NO: 220185 - DNA, 22 bp, Artificial Sequence
  Synthetic oligonucleotide; CTG chr2 60496378 60496399 60496383 60496378 -
cctgggaaatggtttcacaaag

SEQ ID NO: 220186 - DNA, 22 bp, Artificial Sequence
  Synthetic oligonucleotide; CTG chr2 60496374 60496395 60496379 60496374 -
ggaaatggtttcacaaagctcc

SEQ ID NO: 220187 - DNA, 22 bp, Artificial Sequence
  Synthetic oligonucleotide; TTT chr2 60496363 60496384 60496368 60496363 -
cacaaagctccagttctgccct

SEQ ID NO: 220188 - DNA, 22 bp, Artificial Sequence
  Synthetic oligonucleotide; TTC chr2 60496362 60496383 60496367 60496362 -
acaaagctccagttctgccctg

SEQ ID NO: 220189 - DNA, 22 bp, Artificial Sequence
  Synthetic oligonucleotide; CTC chr2 60496353 60496374 60496358 60496353 -
cagttctgccctggacacttgc

SEQ ID NO: 220190 - DNA, 22 bp, Artificial Sequence
  Synthetic oligonucleotide; TTC chr2 60496347 60496368 60496352 60496347 -
tgccctggacacttgcctcata

SEQ ID NO: 220191 - DNA, 22 bp, Artificial Sequence
  Synthetic oligonucleotide; CTG chr2 60496345 60496366 60496350 60496345 -
ccctggacacttgcctcatagg

SEQ ID NO: 220192 - DNA, 22 bp, Artificial Sequence
  Synthetic oligonucleotide; CTG chr2 60496340 60496361 60496345 60496340 -
gacacttgcctcatagggctat

SEQ ID NO: 220193 - DNA, 22 bp, Artificial Sequence
  Synthetic oligonucleotide; CTT chr2 60496333 60496354 60496338 60496333 -
gcctcatagggctatccctttg

SEQ ID NO: 220194 - DNA, 22 bp, Artificial Sequence
  Synthetic oligonucleotide; TTG chr2 60496332 60496353 60496337 60496332 -
cctcatagggctatccctttgc

SEQ ID NO: 220195 - DNA, 22 bp, Artificial Sequence
  Synthetic oligonucleotide; CTC chr2 60496328 60496349 60496333 60496328 -
atagggctatccctttgcccct

SEQ ID NO: 220196 - DNA, 22 bp, Artificial Sequence
  Synthetic oligonucleotide; CTA chr2 60496319 60496340 60496324 60496319 -
tccctttgcccctcagtaacac

SEQ ID NO: 220197 - DNA, 22 bp, Artificial Sequence
  Synthetic oligonucleotide; CTT chr2 60496313 60496334 60496318 60496313 -
tgcccctcagtaacaccactgg

SEQ ID NO: 220198 - DNA, 22 bp, Artificial Sequence
  Synthetic oligonucleotide; TTT chr2 60496312 60496333 60496317 60496312 -
gcccctcagtaacaccactggg

SEQ ID NO: 220199 - DNA, 22 bp, Artificial Sequence
  Synthetic oligonucleotide; TTG chr2 60496311 60496332 60496316 60496311 -
cccctcagtaacaccactggga

SEQ ID NO: 220200 - DNA, 22 bp, Artificial Sequence
  Synthetic oligonucleotide; CTC chr2 60496305 60496326 60496310 60496305 -
agtaacaccactgggatggtcc

SEQ ID NO: 220201 - DNA, 22 bp, Artificial Sequence
  Synthetic oligonucleotide; CTG chr2 60496292 60496313 60496297 60496292 -
ggatggtccactcccaccctgt

SEQ ID NO: 220202 - DNA, 22 bp, Artificial Sequence
  Synthetic oligonucleotide; CTC chr2 60496279 60496300 60496284 60496279 -
ccaccctgtcccccatctgtgg

SEQ ID NO: 220203 - DNA, 22 bp, Artificial Sequence
  Synthetic oligonucleotide; CTG chr2 60496271 60496292 60496276 60496271 -
tcccccatctgtggtagcctgt

SEQ ID NO: 220204 - DNA, 22 bp, Artificial Sequence
  Synthetic oligonucleotide; CTG chr2 60496260 60496281 60496265 60496260 -
tggtagcctgtgttgcctcgtg

SEQ ID NO: 220205 - DNA, 22 bp, Artificial Sequence
  Synthetic oligonucleotide; CTG chr2 60496250 60496271 60496255 60496250 -
tgttgcctcgtgggacaaggca

SEQ ID NO: 220206 - DNA, 22 bp, Artificial Sequence
  Synthetic oligonucleotide; TTG chr2 60496245 60496266 60496250 60496245 -
cctcgtgggacaaggcattctg

SEQ ID NO: 220207 - DNA, 22 bp, Artificial Sequence
  Synthetic oligonucleotide; CTC chr2 60496241 60496262 60496246 60496241 -
gtgggacaaggcattctgtaaa

SEQ ID NO: 220208 - DNA, 22 bp, Artificial Sequence
  Synthetic oligonucleotide; TTC chr2 60496225 60496246 60496230 60496225 -
tgtaaacgtgtattggacttcc

SEQ ID NO: 220209 - DNA, 22 bp, Artificial Sequence
  Synthetic oligonucleotide; CTG chr2 60496223 60496244 60496228 60496223 -
taaacgtgtattggacttccat

SEQ ID NO: 220210 - DNA, 22 bp, Artificial Sequence
  Synthetic oligonucleotide; TTG chr2 60496210 60496231 60496215 60496210 -
gacttccattgcttaagtcatg

SEQ ID NO: 220211 - DNA, 22 bp, Artificial Sequence
  Synthetic oligonucleotide; CTT chr2 60496205 60496226 60496210 60496205 -
ccattgcttaagtcatgatttg

SEQ ID NO: 220212 - DNA, 22 bp, Artificial Sequence
  Synthetic oligonucleotide; TTC chr2 60496204 60496225 60496209 60496204 -
cattgcttaagtcatgatttgt

SEQ ID NO: 220213 - DNA, 22 bp, Artificial Sequence
  Synthetic oligonucleotide; TTG chr2 60496199 60496220 60496204 60496199 -
cttaagtcatgatttgtttttc

SEQ ID NO: 220214 - DNA, 22 bp, Artificial Sequence
  Synthetic oligonucleotide; CTT chr2 60496196 60496217 60496201 60496196 -
aagtcatgatttgtttttccga

SEQ ID NO: 220215 - DNA, 22 bp, Artificial Sequence
  Synthetic oligonucleotide; TTA chr2 60496195 60496216 60496200 60496195 -
agtcatgatttgtttttccgac

SEQ ID NO: 220216 - DNA, 22 bp, Artificial Sequence
  Synthetic oligonucleotide; TTT chr2 60496184 60496205 60496189 60496184 -
gtttttccgacttccagaactt

SEQ ID NO: 220217 - DNA, 22 bp, Artificial Sequence
  Synthetic oligonucleotide; TTG chr2 60496183 60496204 60496188 60496183 -
tttttccgacttccagaacttt

SEQ ID NO: 220218 - DNA, 22 bp, Artificial Sequence
  Synthetic oligonucleotide; TTT chr2 60496180 60496201 60496185 60496180 -
ttccgacttccagaactttccc

SEQ ID NO: 220219 - DNA, 22 bp, Artificial Sequence
  Synthetic oligonucleotide; TTT chr2 60496179 60496200 60496184 60496179 -
tccgacttccagaactttcccg

SEQ ID NO: 220220 - DNA, 22 bp, Artificial Sequence
  Synthetic oligonucleotide; TTT chr2 60496178 60496199 60496183 60496178 -
ccgacttccagaactttcccgg

SEQ ID NO: 220221 - DNA, 22 bp, Artificial Sequence
  Synthetic oligonucleotide; TTC chr2 60496177 60496198 60496182 60496177 -
cgacttccagaactttcccggt

SEQ ID NO: 220222 - DNA, 22 bp, Artificial Sequence
  Synthetic oligonucleotide; CTT chr2 60496171 60496192 60496176 60496171 -
ccagaactttcccggttctggt

SEQ ID NO: 220223 - DNA, 22 bp, Artificial Sequence
  Synthetic oligonucleotide; TTC chr2 60496170 60496191 60496175 60496170 -
cagaactttcccggttctggtt

SEQ ID NO: 220224 - DNA, 22 bp, Artificial Sequence
  Synthetic oligonucleotide; CTT chr2 60496162 60496183 60496167 60496162 -
tcccggttctggttttctggga

SEQ ID NO: 220225 - DNA, 22 bp, Artificial Sequence
  Synthetic oligonucleotide; TTT chr2 60496161 60496182 60496166 60496161 -
cccggttctggttttctgggat

SEQ ID NO: 220226 - DNA, 22 bp, Artificial Sequence
  Synthetic oligonucleotide; TTC chr2 60496160 60496181 60496165 60496160 -
ccggttctggttttctgggatt

SEQ ID NO: 220227 - DNA, 22 bp, Artificial Sequence
  Synthetic oligonucleotide; TTC chr2 60496153 60496174 60496158 60496153 -
tggttttctgggatttcatgaa

SEQ ID NO: 220228 - DNA, 22 bp, Artificial Sequence
  Synthetic oligonucleotide; CTG chr2 60496151 60496172 60496156 60496151 -
gttttctgggatttcatgaaca

SEQ ID NO: 220229 - DNA, 22 bp, Artificial Sequence
  Synthetic oligonucleotide; TTT chr2 60496147 60496168 60496152 60496147 -
tctgggatttcatgaacaattc

SEQ ID NO: 220230 - DNA, 22 bp, Artificial Sequence
  Synthetic oligonucleotide; TTT chr2 60496146 60496167 60496151 60496146 -
ctgggatttcatgaacaattcc

SEQ ID NO: 220231 - DNA, 22 bp, Artificial Sequence
  Synthetic oligonucleotide; TTC chr2 60496145 60496166 60496150 60496145 -
tgggatttcatgaacaattccc

SEQ ID NO: 220232 - DNA, 22 bp, Artificial Sequence
  Synthetic oligonucleotide; CTG chr2 60496143 60496164 60496148 60496143 -
ggatttcatgaacaattccctg

SEQ ID NO: 220233 - DNA, 22 bp, Artificial Sequence
  Synthetic oligonucleotide; TTT chr2 60496137 60496158 60496142 60496137 -
catgaacaattccctgtttccg

SEQ ID NO: 220234 - DNA, 22 bp, Artificial Sequence
  Synthetic oligonucleotide; TTC chr2 60496136 60496157 60496141 60496136 -
atgaacaattccctgtttccgt

SEQ ID NO: 220235 - DNA, 22 bp, Artificial Sequence
  Synthetic oligonucleotide; TTC chr2 60496125 60496146 60496130 60496125 -
cctgtttccgtaatccatttcc

SEQ ID NO: 220236 - DNA, 22 bp, Artificial Sequence
  Synthetic oligonucleotide; CTG chr2 60496121 60496142 60496126 60496121 -
tttccgtaatccatttcctgca

SEQ ID NO: 220237 - DNA, 22 bp, Artificial Sequence
  Synthetic oligonucleotide; TTT chr2 60496118 60496139 60496123 60496118 -
ccgtaatccatttcctgcacag

SEQ ID NO: 220238 - DNA, 22 bp, Artificial Sequence
  Synthetic oligonucleotide; TTC chr2 60496117 60496138 60496122 60496117 -
cgtaatccatttcctgcacagg

SEQ ID NO: 220239 - DNA, 22 bp, Artificial Sequence
  Synthetic oligonucleotide; TTT chr2 60496105 60496126 60496110 60496105 -
cctgcacaggtgcattgctttc

SEQ ID NO: 220240 - DNA, 22 bp, Artificial Sequence
  Synthetic oligonucleotide; TTC chr2 60496104 60496125 60496109 60496104 -
ctgcacaggtgcattgctttca

SEQ ID NO: 220241 - DNA, 22 bp, Artificial Sequence
  Synthetic oligonucleotide; CTG chr2 60496101 60496122 60496106 60496101 -
cacaggtgcattgctttcaatc

SEQ ID NO: 220242 - DNA, 22 bp, Artificial Sequence
  Synthetic oligonucleotide; TTG chr2 60496088 60496109 60496093 60496088 -
ctttcaatcatctcccctccgg

SEQ ID NO: 220243 - DNA, 22 bp, Artificial Sequence
  Synthetic oligonucleotide; CTT chr2 60496085 60496106 60496090 60496085 -
tcaatcatctcccctccggtta

SEQ ID NO: 220244 - DNA, 22 bp, Artificial Sequence
  Synthetic oligonucleotide; TTT chr2 60496084 60496105 60496089 60496084 -
caatcatctcccctccggttat

SEQ ID NO: 220245 - DNA, 22 bp, Artificial Sequence
  Synthetic oligonucleotide; TTC chr2 60496083 60496104 60496088 60496083 -
aatcatctcccctccggttatc

SEQ ID NO: 220246 - DNA, 22 bp, Artificial Sequence
  Synthetic oligonucleotide; CTC chr2 60496074 60496095 60496079 60496074 -
ccctccggttatcctaaagcct

SEQ ID NO: 220247 - DNA, 22 bp, Artificial Sequence
  Synthetic oligonucleotide; CTC chr2 60496069 60496090 60496074 60496069 -
cggttatcctaaagccttcatt

SEQ ID NO: 220248 - DNA, 22 bp, Artificial Sequence
  Synthetic oligonucleotide; TTA chr2 60496063 60496084 60496068 60496063 -
tcctaaagccttcattatcaat

SEQ ID NO: 220249 - DNA, 22 bp, Artificial Sequence
  Synthetic oligonucleotide; CTA chr2 60496058 60496079 60496063 60496058 -
aagccttcattatcaattgact

SEQ ID NO: 220250 - DNA, 22 bp, Artificial Sequence
  Synthetic oligonucleotide; CTT chr2 60496051 60496072 60496056 60496051 -
cattatcaattgacttttcaca

SEQ ID NO: 220251 - DNA, 22 bp, Artificial Sequence
  Synthetic oligonucleotide; TTC chr2 60496050 60496071 60496055 60496050 -
attatcaattgacttttcacat

SEQ ID NO: 220252 - DNA, 22 bp, Artificial Sequence
  Synthetic oligonucleotide; TTA chr2 60496046 60496067 60496051 60496046 -
tcaattgacttttcacatatga

SEQ ID NO: 220253 - DNA, 22 bp, Artificial Sequence
  Synthetic oligonucleotide; TTG chr2 60496039 60496060 60496044 60496039 -
acttttcacatatgagggtgac

SEQ ID NO: 220254 - DNA, 22 bp, Artificial Sequence
  Synthetic oligonucleotide; CTT chr2 60496035 60496056 60496040 60496035 -
ttcacatatgagggtgacctct

SEQ ID NO: 220255 - DNA, 22 bp, Artificial Sequence
  Synthetic oligonucleotide; TTT chr2 60496034 60496055 60496039 60496034 -
tcacatatgagggtgacctctg

SEQ ID NO: 220256 - DNA, 22 bp, Artificial Sequence
  Synthetic oligonucleotide; TTT chr2 60496033 60496054 60496038 60496033 -
cacatatgagggtgacctctgg

SEQ ID NO: 220257 - DNA, 22 bp, Artificial Sequence
  Synthetic oligonucleotide; TTC chr2 60496032 60496053 60496037 60496032 -
acatatgagggtgacctctgga

SEQ ID NO: 220258 - DNA, 22 bp, Artificial Sequence
  Synthetic oligonucleotide; CTC chr2 60496014 60496035 60496019 60496014 -
tggatcccttctctttggtttg

SEQ ID NO: 220259 - DNA, 22 bp, Artificial Sequence
  Synthetic oligonucleotide; CTG chr2 60496012 60496033 60496017 60496012 -
gatcccttctctttggtttgtt

SEQ ID NO: 220260 - DNA, 22 bp, Artificial Sequence
  Synthetic oligonucleotide; CTT chr2 60496004 60496025 60496009 60496004 -
ctctttggtttgtttgttctct

SEQ ID NO: 220261 - DNA, 22 bp, Artificial Sequence
  Synthetic oligonucleotide; TTC chr2 60496003 60496024 60496008 60496003 -
tctttggtttgtttgttctctt

SEQ ID NO: 220262 - DNA, 22 bp, Artificial Sequence
  Synthetic oligonucleotide; CTC chr2 60496001 60496022 60496006 60496001 -
tttggtttgtttgttctctttt

SEQ ID NO: 220263 - DNA, 22 bp, Artificial Sequence
  Synthetic oligonucleotide; CTT chr2 60495999 60496020 60496004 60495999 -
tggtttgtttgttctcttttcc

SEQ ID NO: 220264 - DNA, 22 bp, Artificial Sequence
  Synthetic oligonucleotide; TTT chr2 60495998 60496019 60496003 60495998 -
ggtttgtttgttctcttttcca

SEQ ID NO: 220265 - DNA, 22 bp, Artificial Sequence
  Synthetic oligonucleotide; TTG chr2 60495997 60496018 60496002 60495997 -
gtttgtttgttctcttttccag

SEQ ID NO: 220266 - DNA, 22 bp, Artificial Sequence
  Synthetic oligonucleotide; TTT chr2 60495993 60496014 60495998 60495993 -
gtttgttctcttttccagagct

SEQ ID NO: 220267 - DNA, 22 bp, Artificial Sequence
  Synthetic oligonucleotide; TTG chr2 60495992 60496013 60495997 60495992 -
tttgttctcttttccagagctg

SEQ ID NO: 220268 - DNA, 22 bp, Artificial Sequence
  Synthetic oligonucleotide; TTT chr2 60495989 60496010 60495994 60495989 -
gttctcttttccagagctgcag

SEQ ID NO: 220269 - DNA, 22 bp, Artificial Sequence
  Synthetic oligonucleotide; TTG chr2 60495988 60496009 60495993 60495988 -
ttctcttttccagagctgcagt

SEQ ID NO: 220270 - DNA, 22 bp, Artificial Sequence
  Synthetic oligonucleotide; TTC chr2 60495985 60496006 60495990 60495985 -
tcttttccagagctgcagtatg

SEQ ID NO: 220271 - DNA, 22 bp, Artificial Sequence
  Synthetic oligonucleotide; CTC chr2 60495983 60496004 60495988 60495983 -
ttttccagagctgcagtatgtt

SEQ ID NO: 220272 - DNA, 22 bp, Artificial Sequence
  Synthetic oligonucleotide; CTT chr2 60495981 60496002 60495986 60495981 -
ttccagagctgcagtatgtttc

SEQ ID NO: 220273 - DNA, 22 bp, Artificial Sequence
  Synthetic oligonucleotide; TTT chr2 60495980 60496001 60495985 60495980 -
tccagagctgcagtatgtttct

SEQ ID NO: 220274 - DNA, 22 bp, Artificial Sequence
  Synthetic oligonucleotide; TTT chr2 60495979 60496000 60495984 60495979 -
ccagagctgcagtatgtttctt

SEQ ID NO: 220275 - DNA, 22 bp, Artificial Sequence
  Synthetic oligonucleotide; TTC chr2 60495978 60495999 60495983 60495978 -
cagagctgcagtatgtttctta

SEQ ID NO: 220276 - DNA, 22 bp, Artificial Sequence
  Synthetic oligonucleotide; CTG chr2 60495970 60495991 60495975 60495970 -
cagtatgtttcttaggtgtttt

SEQ ID NO: 220277 - DNA, 22 bp, Artificial Sequence
  Synthetic oligonucleotide; TTT chr2 60495960 60495981 60495965 60495960 -
cttaggtgttttaaaaaatagc

SEQ ID NO: 220278 - DNA, 22 bp, Artificial Sequence
  Synthetic oligonucleotide; TTC chr2 60495959 60495980 60495964 60495959 -
ttaggtgttttaaaaaatagct

SEQ ID NO: 220279 - DNA, 22 bp, Artificial Sequence
  Synthetic oligonucleotide; CTT chr2 60495957 60495978 60495962 60495957 -
aggtgttttaaaaaatagctaa

SEQ ID NO: 220280 - DNA, 22 bp, Artificial Sequence
  Synthetic oligonucleotide; TTA chr2 60495956 60495977 60495961 60495956 -
ggtgttttaaaaaatagctaag

SEQ ID NO: 220281 - DNA, 22 bp, Artificial Sequence
  Synthetic oligonucleotide; TTT chr2 60495949 60495970 60495954 60495949 -
taaaaaatagctaagaatagtg

SEQ ID NO: 220282 - DNA, 22 bp, Artificial Sequence
  Synthetic oligonucleotide; TTT chr2 60495948 60495969 60495953 60495948 -
aaaaaatagctaagaatagtga

SEQ ID NO: 220283 - DNA, 22 bp, Artificial Sequence
  Synthetic oligonucleotide; TTA chr2 60495947 60495968 60495952 60495947 -
aaaaatagctaagaatagtgaa

SEQ ID NO: 220284 - DNA, 22 bp, Artificial Sequence
  Synthetic oligonucleotide; CTA chr2 60495936 60495957 60495941 60495936 -
agaatagtgaaaacacccttgt

SEQ ID NO: 220285 - DNA, 22 bp, Artificial Sequence
  Synthetic oligonucleotide; CTT chr2 60495916 60495937 60495921 60495916 -
gtaatttagagactctcagaaa

SEQ ID NO: 220286 - DNA, 22 bp, Artificial Sequence
  Synthetic oligonucleotide; TTG chr2 60495915 60495936 60495920 60495915 -
taatttagagactctcagaaaa

SEQ ID NO: 220287 - DNA, 22 bp, Artificial Sequence
  Synthetic oligonucleotide; TTT chr2 60495909 60495930 60495914 60495909 -
agagactctcagaaaaatgaca

SEQ ID NO: 220288 - DNA, 22 bp, Artificial Sequence
  Synthetic oligonucleotide; TTA chr2 60495908 60495929 60495913 60495908 -
gagactctcagaaaaatgacag

SEQ ID NO: 220289 - DNA, 22 bp, Artificial Sequence
  Synthetic oligonucleotide; CTC chr2 60495901 60495922 60495906 60495901 -
tcagaaaaatgacagcaccatt

SEQ ID NO: 220290 - DNA, 22 bp, Artificial Sequence
  Synthetic oligonucleotide; CTC chr2 60495899 60495920 60495904 60495899 -
agaaaaatgacagcaccattta

SEQ ID NO: 220291 - DNA, 22 bp, Artificial Sequence
  Synthetic oligonucleotide; TTT chr2 60495878 60495899 60495883 60495878 -
agagcctggaattacagtttga

SEQ ID NO: 220292 - DNA, 22 bp, Artificial Sequence
  Synthetic oligonucleotide; TTA chr2 60495877 60495898 60495882 60495877 -
gagcctggaattacagtttgac

SEQ ID NO: 220293 - DNA, 22 bp, Artificial Sequence
  Synthetic oligonucleotide; CTG chr2 60495870 60495891 60495875 60495870 -
gaattacagtttgacttcactg

SEQ ID NO: 220294 - DNA, 22 bp, Artificial Sequence
  Synthetic oligonucleotide; TTA chr2 60495864 60495885 60495869 60495864 -
cagtttgacttcactgtgcctt

SEQ ID NO: 220295 - DNA, 22 bp, Artificial Sequence
  Synthetic oligonucleotide; TTT chr2 60495858 60495879 60495863 60495858 -
gacttcactgtgccttctctgc

SEQ ID NO: 220296 - DNA, 22 bp, Artificial Sequence
  Synthetic oligonucleotide; TTG chr2 60495857 60495878 60495862 60495857 -
acttcactgtgccttctctgcc

SEQ ID NO: 220297 - DNA, 22 bp, Artificial Sequence
  Synthetic oligonucleotide; CTT chr2 60495853 60495874 60495858 60495853 -
cactgtgccttctctgccccag

SEQ ID NO: 220298 - DNA, 22 bp, Artificial Sequence
  Synthetic oligonucleotide; TTC chr2 60495852 60495873 60495857 60495852 -
actgtgccttctctgccccagg

SEQ ID NO: 220299 - DNA, 22 bp, Artificial Sequence
  Synthetic oligonucleotide; CTG chr2 60495848 60495869 60495853 60495848 -
tgccttctctgccccaggctcc

SEQ ID NO: 220300 - DNA, 22 bp, Artificial Sequence
  Synthetic oligonucleotide; CTT chr2 60495842 60495863 60495847 60495842 -
ctctgccccaggctcccatggt

SEQ ID NO: 220301 - DNA, 22 bp, Artificial Sequence
  Synthetic oligonucleotide; TTC chr2 60495841 60495862 60495846 60495841 -
tctgccccaggctcccatggtg

SEQ ID NO: 220302 - DNA, 22 bp, Artificial Sequence
  Synthetic oligonucleotide; CTC chr2 60495839 60495860 60495844 60495839 -
tgccccaggctcccatggtggc

SEQ ID NO: 220303 - DNA, 22 bp, Artificial Sequence
  Synthetic oligonucleotide; CTG chr2 60495837 60495858 60495842 60495837 -
ccccaggctcccatggtggcaa

SEQ ID NO: 220304 - DNA, 22 bp, Artificial Sequence
  Synthetic oligonucleotide; CTC chr2 60495827 60495848 60495832 60495827 -
ccatggtggcaagggtttttgg

SEQ ID NO: 220305 - DNA, 22 bp, Artificial Sequence
  Synthetic oligonucleotide; TTT chr2 60495809 60495830 60495814 60495809 -
ttggttgggggaaggggtattg

SEQ ID NO: 220306 - DNA, 22 bp, Artificial Sequence
  Synthetic oligonucleotide; TTT chr2 60495808 60495829 60495813 60495808 -
tggttgggggaaggggtattga

SEQ ID NO: 220307 - DNA, 22 bp, Artificial Sequence
  Synthetic oligonucleotide; TTT chr2 60495807 60495828 60495812 60495807 -
ggttgggggaaggggtattgaa

SEQ ID NO: 220308 - DNA, 22 bp, Artificial Sequence
  Synthetic oligonucleotide; TTG chr2 60495806 60495827 60495811 60495806 -
gttgggggaaggggtattgaat

SEQ ID NO: 220309 - DNA, 22 bp, Artificial Sequence
  Synthetic oligonucleotide; TTG chr2 60495802 60495823 60495807 60495802 -
ggggaaggggtattgaattgcc

SEQ ID NO: 220310 - DNA, 22 bp, Artificial Sequence
  Synthetic oligonucleotide; TTG chr2 60495787 60495808 60495792 60495787 -
aattgcctgtctttgagcagga

SEQ ID NO: 220311 - DNA, 22 bp, Artificial Sequence
  Synthetic oligonucleotide; TTG chr2 60495782 60495803 60495787 60495782 -
cctgtctttgagcaggaaaaga

SEQ ID NO: 220312 - DNA, 22 bp, Artificial Sequence
  Synthetic oligonucleotide; CTG chr2 60495778 60495799 60495783 60495778 -
tctttgagcaggaaaagaatta

SEQ ID NO: 220313 - DNA, 22 bp, Artificial Sequence
  Synthetic oligonucleotide; CTT chr2 60495774 60495795 60495779 60495774 -
tgagcaggaaaagaattacagt

SEQ ID NO: 220314 - DNA, 22 bp, Artificial Sequence
  Synthetic oligonucleotide; TTT chr2 60495773 60495794 60495778 60495773 -
gagcaggaaaagaattacagtt

SEQ ID NO: 220315 - DNA, 22 bp, Artificial Sequence
  Synthetic oligonucleotide; TTG chr2 60495772 60495793 60495777 60495772 -
agcaggaaaagaattacagttt

SEQ ID NO: 220316 - DNA, 22 bp, Artificial Sequence
  Synthetic oligonucleotide; TTA chr2 60495756 60495777 60495761 60495756 -
cagttttccaggtaccttttgt

SEQ ID NO: 220317 - DNA, 22 bp, Artificial Sequence
  Synthetic oligonucleotide; TTT chr2 60495750 60495771 60495755 60495750 -
tccaggtaccttttgtgtgtat

SEQ ID NO: 220318 - DNA, 22 bp, Artificial Sequence
  Synthetic oligonucleotide; TTT chr2 60495749 60495770 60495754 60495749 -
ccaggtaccttttgtgtgtatg

SEQ ID NO: 220319 - DNA, 22 bp, Artificial Sequence
  Synthetic oligonucleotide; TTC chr2 60495748 60495769 60495753 60495748 -
caggtaccttttgtgtgtatgt

SEQ ID NO: 220320 - DNA, 22 bp, Artificial Sequence
  Synthetic oligonucleotide; CTT chr2 60495738 60495759 60495743 60495738 -
ttgtgtgtatgtgctgattgag

SEQ ID NO: 220321 - DNA, 22 bp, Artificial Sequence
  Synthetic oligonucleotide; TTT chr2 60495737 60495758 60495742 60495737 -
tgtgtgtatgtgctgattgagg

SEQ ID NO: 220322 - DNA, 22 bp, Artificial Sequence
  Synthetic oligonucleotide; TTT chr2 60495736 60495757 60495741 60495736 -
gtgtgtatgtgctgattgaggg

SEQ ID NO: 220323 - DNA, 22 bp, Artificial Sequence
  Synthetic oligonucleotide; TTG chr2 60495735 60495756 60495740 60495735 -
tgtgtatgtgctgattgagggc

SEQ ID NO: 220324 - DNA, 22 bp, Artificial Sequence
  Synthetic oligonucleotide; CTG chr2 60495722 60495743 60495727 60495722 -
attgagggcccattgagaatat

SEQ ID NO: 220325 - DNA, 22 bp, Artificial Sequence
  Synthetic oligonucleotide; TTG chr2 60495718 60495739 60495723 60495718 -
agggcccattgagaatattttg

SEQ ID NO: 220326 - DNA, 22 bp, Artificial Sequence
  Synthetic oligonucleotide; TTG chr2 60495707 60495728 60495712 60495707 -
agaatattttgacttttaggga

SEQ ID NO: 220327 - DNA, 22 bp, Artificial Sequence
  Synthetic oligonucleotide; TTT chr2 60495698 60495719 60495703 60495698 -
tgacttttagggaagctccaaa

SEQ ID NO: 220328 - DNA, 22 bp, Artificial Sequence
  Synthetic oligonucleotide; TTT chr2 60495697 60495718 60495702 60495697 -
gacttttagggaagctccaaac

SEQ ID NO: 220329 - DNA, 22 bp, Artificial Sequence
  Synthetic oligonucleotide; TTG chr2 60495696 60495717 60495701 60495696 -
acttttagggaagctccaaact

SEQ ID NO: 220330 - DNA, 22 bp, Artificial Sequence
  Synthetic oligonucleotide; CTT chr2 60495692 60495713 60495697 60495692 -
ttagggaagctccaaactctca

SEQ ID NO: 220331 - DNA, 22 bp, Artificial Sequence
  Synthetic oligonucleotide; TTT chr2 60495691 60495712 60495696 60495691 -
tagggaagctccaaactctcaa

SEQ ID NO: 220332 - DNA, 22 bp, Artificial Sequence
  Synthetic oligonucleotide; TTT chr2 60495690 60495711 60495695 60495690 -
agggaagctccaaactctcaaa

SEQ ID NO: 220333 - DNA, 22 bp, Artificial Sequence
  Synthetic oligonucleotide; TTA chr2 60495689 60495710 60495694 60495689 -
gggaagctccaaactctcaaac

SEQ ID NO: 220334 - DNA, 22 bp, Artificial Sequence
  Synthetic oligonucleotide; CTC chr2 60495680 60495701 60495685 60495680 -
caaactctcaaaccacagggat

SEQ ID NO: 220335 - DNA, 22 bp, Artificial Sequence
  Synthetic oligonucleotide; CTC chr2 60495673 60495694 60495678 60495673 -
tcaaaccacagggatcacaaca

SEQ ID NO: 220336 - DNA, 22 bp, Artificial Sequence
  Synthetic oligonucleotide; CTC chr2 60495671 60495692 60495676 60495671 -
aaaccacagggatcacaacaca

SEQ ID NO: 220337 - DNA, 22 bp, Artificial Sequence
  Synthetic oligonucleotide; CTG chr2 60495637 60495658 60495642 60495637 -
ttatgacgttatatgtaagcat

SEQ ID NO: 220338 - DNA, 22 bp, Artificial Sequence
  Synthetic oligonucleotide; TTA chr2 60495634 60495655 60495639 60495634 -
tgacgttatatgtaagcatcac

SEQ ID NO: 220339 - DNA, 22 bp, Artificial Sequence
  Synthetic oligonucleotide; TTA chr2 60495626 60495647 60495631 60495626 -
tatgtaagcatcacaacaggca

SEQ ID NO: 220340 - DNA, 22 bp, Artificial Sequence
  Synthetic oligonucleotide; CTG chr2 60495593 60495614 60495598 60495593 -
caccccaccctggaaaacagcc

SEQ ID NO: 220341 - DNA, 22 bp, Artificial Sequence
  Synthetic oligonucleotide; CTG chr2 60495581 60495602 60495586 60495581 -
gaaaacagcctgactgtgcccc

SEQ ID NO: 220342 - DNA, 22 bp, Artificial Sequence
  Synthetic oligonucleotide; CTG chr2 60495569 60495590 60495574 60495569 -
actgtgccccatgggcaaacca

SEQ ID NO: 220343 - DNA, 22 bp, Artificial Sequence
  Synthetic oligonucleotide; CTG chr2 60495565 60495586 60495570 60495565 -
tgccccatgggcaaaccagact

SEQ ID NO: 220344 - DNA, 22 bp, Artificial Sequence
  Synthetic oligonucleotide; CTA chr2 60495542 60495563 60495547 60495542 -
gtttatagggggttctactctg

SEQ ID NO: 220345 - DNA, 22 bp, Artificial Sequence
  Synthetic oligonucleotide; TTT chr2 60495538 60495559 60495543 60495538 -
atagggggttctactctgaggt

SEQ ID NO: 220346 - DNA, 22 bp, Artificial Sequence
  Synthetic oligonucleotide; TTA chr2 60495537 60495558 60495542 60495537 -
tagggggttctactctgaggta

SEQ ID NO: 220347 - DNA, 22 bp, Artificial Sequence
  Synthetic oligonucleotide; TTC chr2 60495527 60495548 60495532 60495527 -
tactctgaggtactgatggacc

SEQ ID NO: 220348 - DNA, 22 bp, Artificial Sequence
  Synthetic oligonucleotide; CTA chr2 60495525 60495546 60495530 60495525 -
ctctgaggtactgatggacctt

SEQ ID NO: 220349 - DNA, 22 bp, Artificial Sequence
  Synthetic oligonucleotide; CTC chr2 60495522 60495543 60495527 60495522 -
tgaggtactgatggaccttggg

SEQ ID NO: 220350 - DNA, 22 bp, Artificial Sequence
  Synthetic oligonucleotide; CTG chr2 60495520 60495541 60495525 60495520 -
aggtactgatggaccttgggtg

SEQ ID NO: 220351 - DNA, 22 bp, Artificial Sequence
  Synthetic oligonucleotide; CTG chr2 60495512 60495533 60495517 60495512 -
atggaccttgggtgctattcct

SEQ ID NO: 220352 - DNA, 22 bp, Artificial Sequence
  Synthetic oligonucleotide; CTT chr2 60495503 60495524 60495508 60495503 -
gggtgctattcctgtgataagg

SEQ ID NO: 220353 - DNA, 22 bp, Artificial Sequence
  Synthetic oligonucleotide; TTG chr2 60495502 60495523 60495507 60495502 -
ggtgctattcctgtgataagga

SEQ ID NO: 220354 - DNA, 22 bp, Artificial Sequence
  Synthetic oligonucleotide; CTA chr2 60495495 60495516 60495500 60495495 -
ttcctgtgataaggaaggcagc

SEQ ID NO: 220355 - DNA, 22 bp, Artificial Sequence
  Synthetic oligonucleotide; TTC chr2 60495492 60495513 60495497 60495492 -
ctgtgataaggaaggcagctag

SEQ ID NO: 220356 - DNA, 22 bp, Artificial Sequence
  Synthetic oligonucleotide; CTG chr2 60495489 60495510 60495494 60495489 -
tgataaggaaggcagctagaca

SEQ ID NO: 220357 - DNA, 22 bp, Artificial Sequence
  Synthetic oligonucleotide; CTA chr2 60495471 60495492 60495476 60495471 -
gacaggacttgggagttatctg

SEQ ID NO: 220358 - DNA, 22 bp, Artificial Sequence
  Synthetic oligonucleotide; CTT chr2 60495461 60495482 60495466 60495461 -
gggagttatctgtagtgagatg

SEQ ID NO: 220359 - DNA, 22 bp, Artificial Sequence
  Synthetic oligonucleotide; TTG chr2 60495460 60495481 60495465 60495460 -
ggagttatctgtagtgagatgg

SEQ ID NO: 220360 - DNA, 22 bp, Artificial Sequence
  Synthetic oligonucleotide; TTA chr2 60495453 60495474 60495458 60495453 -
tctgtagtgagatggctgaaaa

SEQ ID NO: 220361 - DNA, 22 bp, Artificial Sequence
  Synthetic oligonucleotide; CTG chr2 60495449 60495470 60495454 60495449 -
tagtgagatggctgaaaagcga

SEQ ID NO: 220362 - DNA, 22 bp, Artificial Sequence
  Synthetic oligonucleotide; CTG chr2 60495435 60495456 60495440 60495435 -
aaaagcgatacagggctggctc

SEQ ID NO: 220363 - DNA, 22 bp, Artificial Sequence
  Synthetic oligonucleotide; CTG chr2 60495417 60495438 60495422 60495417 -
gctctatgccccaggtgtgcat

SEQ ID NO: 220364 - DNA, 22 bp, Artificial Sequence
  Synthetic oligonucleotide; CTC chr2 60495413 60495434 60495418 60495413 -
tatgccccaggtgtgcataagt

SEQ ID NO: 220365 - DNA, 22 bp, Artificial Sequence
  Synthetic oligonucleotide; CTA chr2 60495411 60495432 60495416 60495411 -
tgccccaggtgtgcataagtaa

SEQ ID NO: 220366 - DNA, 22 bp, Artificial Sequence
  Synthetic oligonucleotide; CTG chr2 60495376 60495397 60495381 60495376 -
attccagtgcaaagtccataca

SEQ ID NO: 220367 - DNA, 22 bp, Artificial Sequence
  Synthetic oligonucleotide; TTC chr2 60495372 60495393 60495377 60495372 -
cagtgcaaagtccatacaggta

SEQ ID NO: 220368 - DNA, 22 bp, Artificial Sequence
  Synthetic oligonucleotide; CTA chr2 60495317 60495338 60495322 60495317 -
ctcttagacataacacaccagg

SEQ ID NO: 220369 - DNA, 22 bp, Artificial Sequence
  Synthetic oligonucleotide; CTC chr2 60495314 60495335 60495319 60495314 -
ttagacataacacaccagggtc

SEQ ID NO: 220370 - DNA, 22 bp, Artificial Sequence
  Synthetic oligonucleotide; CTT chr2 60495312 60495333 60495317 60495312 -
agacataacacaccagggtcaa

SEQ ID NO: 220371 - DNA, 22 bp, Artificial Sequence
  Synthetic oligonucleotide; TTA chr2 60495311 60495332 60495316 60495311 -
gacataacacaccagggtcaat

SEQ ID NO: 220372 - DNA, 22 bp, Artificial Sequence
  Synthetic oligonucleotide; CTT chr2 60495282 60495303 60495287 60495282 -
tgaagctagtctagtgcaagct

SEQ ID NO: 220373 - DNA, 22 bp, Artificial Sequence
  Synthetic oligonucleotide; TTT chr2 60495281 60495302 60495286 60495281 -
gaagctagtctagtgcaagcta

SEQ ID NO: 220374 - DNA, 22 bp, Artificial Sequence
  Synthetic oligonucleotide; TTG chr2 60495280 60495301 60495285 60495280 -
aagctagtctagtgcaagctaa

SEQ ID NO: 220375 - DNA, 22 bp, Artificial Sequence
  Synthetic oligonucleotide; CTA chr2 60495274 60495295 60495279 60495274 -
gtctagtgcaagctaacagttg

SEQ ID NO: 220376 - DNA, 22 bp, Artificial Sequence
  Synthetic oligonucleotide; CTA chr2 60495269 60495290 60495274 60495269 -
gtgcaagctaacagttgctttt

SEQ ID NO: 220377 - DNA, 22 bp, Artificial Sequence
  Synthetic oligonucleotide; CTA chr2 60495259 60495280 60495264 60495259 -
acagttgcttttatcacaggct

SEQ ID NO: 220378 - DNA, 22 bp, Artificial Sequence
  Synthetic oligonucleotide; TTG chr2 60495252 60495273 60495257 60495252 -
cttttatcacaggctccaggaa

SEQ ID NO: 220379 - DNA, 22 bp, Artificial Sequence
  Synthetic oligonucleotide; CTT chr2 60495249 60495270 60495254 60495249 -
ttatcacaggctccaggaaggg

SEQ ID NO: 220380 - DNA, 22 bp, Artificial Sequence
  Synthetic oligonucleotide; TTT chr2 60495248 60495269 60495253 60495248 -
tatcacaggctccaggaagggt

SEQ ID NO: 220381 - DNA, 22 bp, Artificial Sequence
  Synthetic oligonucleotide; TTT chr2 60495247 60495268 60495252 60495247 -
atcacaggctccaggaagggtt

SEQ ID NO: 220382 - DNA, 22 bp, Artificial Sequence
  Synthetic oligonucleotide; TTA chr2 60495246 60495267 60495251 60495246 -
tcacaggctccaggaagggttt

SEQ ID NO: 220383 - DNA, 22 bp, Artificial Sequence
  Synthetic oligonucleotide; CTC chr2 60495236 60495257 60495241 60495236 -
caggaagggtttggcctctgat

SEQ ID NO: 220384 - DNA, 22 bp, Artificial Sequence
  Synthetic oligonucleotide; TTT chr2 60495224 60495245 60495229 60495224 -
ggcctctgattagggtgggggc

SEQ ID NO: 220385 - DNA, 22 bp, Artificial Sequence
  Synthetic oligonucleotide; TTG chr2 60495223 60495244 60495228 60495223 -
gcctctgattagggtgggggcg

SEQ ID NO: 220386 - DNA, 22 bp, Artificial Sequence
  Synthetic oligonucleotide; CTC chr2 60495218 60495239 60495223 60495218 -
tgattagggtgggggcgtgggt

SEQ ID NO: 220387 - DNA, 22 bp, Artificial Sequence
  Synthetic oligonucleotide; CTG chr2 60495216 60495237 60495221 60495216 -
attagggtgggggcgtgggtgg

SEQ ID NO: 220388 - DNA, 22 bp, Artificial Sequence
  Synthetic oligonucleotide; TTA chr2 60495212 60495233 60495217 60495212 -
gggtgggggcgtgggtggggta

SEQ ID NO: 220389 - DNA, 22 bp, Artificial Sequence
  Synthetic oligonucleotide; CTG chr2 60495179 60495200 60495184 60495179 -
gcagacctctccatcggtggcc

SEQ ID NO: 220390 - DNA, 22 bp, Artificial Sequence
  Synthetic oligonucleotide; CTC chr2 60495170 60495191 60495175 60495170 -
tccatcggtggccgtttgccca

SEQ ID NO: 220391 - DNA, 22 bp, Artificial Sequence
  Synthetic oligonucleotide; CTC chr2 60495168 60495189 60495173 60495168 -
catcggtggccgtttgcccagg

SEQ ID NO: 220392 - DNA, 22 bp, Artificial Sequence
  Synthetic oligonucleotide; TTT chr2 60495153 60495174 60495158 60495153 -
gcccaggggggcctctttcgga

SEQ ID NO: 220393 - DNA, 22 bp, Artificial Sequence
  Synthetic oligonucleotide; TTG chr2 60495152 60495173 60495157 60495152 -
cccaggggggcctctttcggaa

SEQ ID NO: 220394 - DNA, 22 bp, Artificial Sequence
  Synthetic oligonucleotide; CTC chr2 60495138 60495159 60495143 60495138 -
tttcggaaggctctcttggtga

SEQ ID NO: 220395 - DNA, 22 bp, Artificial Sequence
  Synthetic oligonucleotide; CTT chr2 60495136 60495157 60495141 60495136 -
tcggaaggctctcttggtgatg

SEQ ID NO: 220396 - DNA, 22 bp, Artificial Sequence
  Synthetic oligonucleotide; TTT chr2 60495135 60495156 60495140 60495135 -
cggaaggctctcttggtgatgg

SEQ ID NO: 220397 - DNA, 22 bp, Artificial Sequence
  Synthetic oligonucleotide; TTC chr2 60495134 60495155 60495139 60495134 -
ggaaggctctcttggtgatgga

SEQ ID NO: 220398 - DNA, 22 bp, Artificial Sequence
  Synthetic oligonucleotide; CTC chr2 60495125 60495146 60495130 60495125 -
tcttggtgatggagaattggat

SEQ ID NO: 220399 - DNA, 22 bp, Artificial Sequence
  Synthetic oligonucleotide; CTC chr2 60495123 60495144 60495128 60495123 -
ttggtgatggagaattggattt

SEQ ID NO: 220400 - DNA, 22 bp, Artificial Sequence
  Synthetic oligonucleotide; CTT chr2 60495121 60495142 60495126 60495121 -
ggtgatggagaattggatttta

SEQ ID NO: 220401 - DNA, 22 bp, Artificial Sequence
  Synthetic oligonucleotide; TTG chr2 60495120 60495141 60495125 60495120 -
gtgatggagaattggattttat

SEQ ID NO: 220402 - DNA, 22 bp, Artificial Sequence
  Synthetic oligonucleotide; TTG chr2 60495106 60495127 60495111 60495106 -
gattttatttctcaatgggaat

SEQ ID NO: 220403 - DNA, 22 bp, Artificial Sequence
  Synthetic oligonucleotide; TTT chr2 60495101 60495122 60495106 60495101 -
tatttctcaatgggaatgaaat

SEQ ID NO: 220404 - DNA, 22 bp, Artificial Sequence
  Synthetic oligonucleotide; TTT chr2 60495100 60495121 60495105 60495100 -
atttctcaatgggaatgaaata

SEQ ID NO: 220405 - DNA, 22 bp, Artificial Sequence
  Synthetic oligonucleotide; TTA chr2 60495099 60495120 60495104 60495099 -
tttctcaatgggaatgaaataa

SEQ ID NO: 220406 - DNA, 22 bp, Artificial Sequence
  Synthetic oligonucleotide; TTT chr2 60495096 60495117 60495101 60495096 -
ctcaatgggaatgaaataattt

SEQ ID NO: 220407 - DNA, 22 bp, Artificial Sequence
  Synthetic oligonucleotide; TTC chr2 60495095 60495116 60495100 60495095 -
tcaatgggaatgaaataatttg

SEQ ID NO: 220408 - DNA, 22 bp, Artificial Sequence
  Synthetic oligonucleotide; CTC chr2 60495093 60495114 60495098 60495093 -
aatgggaatgaaataatttgta

SEQ ID NO: 220409 - DNA, 22 bp, Artificial Sequence
  Synthetic oligonucleotide; TTT chr2 60495074 60495095 60495079 60495074 -
gtatgccatgccgtgtggactc

SEQ ID NO: 220410 - DNA, 22 bp, Artificial Sequence
  Synthetic oligonucleotide; TTG chr2 60495073 60495094 60495078 60495073 -
tatgccatgccgtgtggactcc

SEQ ID NO: 220411 - DNA, 22 bp, Artificial Sequence
  Synthetic oligonucleotide; CTC chr2 60495052 60495073 60495057 60495052 -
ccaaaattgtaaaggaggtgaa

SEQ ID NO: 220412 - DNA, 22 bp, Artificial Sequence
  Synthetic oligonucleotide; TTG chr2 60495043 60495064 60495048 60495043 -
taaaggaggtgaagcttcccct

SEQ ID NO: 220413 - DNA, 22 bp, Artificial Sequence
  Synthetic oligonucleotide; CTT chr2 60495026 60495047 60495031 60495026 -
cccctgtctgcactctcccctc

SEQ ID NO: 220414 - DNA, 22 bp, Artificial Sequence
  Synthetic oligonucleotide; TTC chr2 60495025 60495046 60495030 60495025 -
ccctgtctgcactctcccctcc

SEQ ID NO: 220415 - DNA, 22 bp, Artificial Sequence
  Synthetic oligonucleotide; CTG chr2 60495020 60495041 60495025 60495020 -
tctgcactctcccctcctcata

SEQ ID NO: 220416 - DNA, 22 bp, Artificial Sequence
  Synthetic oligonucleotide; CTG chr2 60495016 60495037 60495021 60495016 -
cactctcccctcctcataattg

SEQ ID NO: 220417 - DNA, 22 bp, Artificial Sequence
  Synthetic oligonucleotide; CTC chr2 60495011 60495032 60495016 60495011 -
tcccctcctcataattgtccat

SEQ ID NO: 220418 - DNA, 22 bp, Artificial Sequence
  Synthetic oligonucleotide; CTC chr2 60495009 60495030 60495014 60495009 -
ccctcctcataattgtccattt

SEQ ID NO: 220419 - DNA, 22 bp, Artificial Sequence
  Synthetic oligonucleotide; CTC chr2 60495004 60495025 60495009 60495004 -
ctcataattgtccatttttcat

SEQ ID NO: 220420 - DNA, 22 bp, Artificial Sequence
  Synthetic oligonucleotide; CTC chr2 60495001 60495022 60495006 60495001 -
ataattgtccatttttcatctg

SEQ ID NO: 220421 - DNA, 22 bp, Artificial Sequence
  Synthetic oligonucleotide; TTG chr2 60494994 60495015 60494999 60494994 -
tccatttttcatctgtcgggct

SEQ ID NO: 220422 - DNA, 22 bp, Artificial Sequence
  Synthetic oligonucleotide; TTT chr2 60494987 60495008 60494992 60494987 -
ttcatctgtcgggctgtccacc

SEQ ID NO: 220423 - DNA, 22 bp, Artificial Sequence
  Synthetic oligonucleotide; TTT chr2 60494986 60495007 60494991 60494986 -
tcatctgtcgggctgtccaccc

SEQ ID NO: 220424 - DNA, 22 bp, Artificial Sequence
  Synthetic oligonucleotide; TTT chr2 60494985 60495006 60494990 60494985 -
catctgtcgggctgtccaccca

SEQ ID NO: 220425 - DNA, 22 bp, Artificial Sequence
  Synthetic oligonucleotide; TTC chr2 60494984 60495005 60494989 60494984 -
atctgtcgggctgtccacccat

SEQ ID NO: 220426 - DNA, 22 bp, Artificial Sequence
  Synthetic oligonucleotide; CTG chr2 60494979 60495000 60494984 60494979 -
tcgggctgtccacccatccatc

SEQ ID NO: 220427 - DNA, 22 bp, Artificial Sequence
  Synthetic oligonucleotide; CTG chr2 60494971 60494992 60494976 60494971 -
tccacccatccatcacatatag

SEQ ID NO: 220428 - DNA, 22 bp, Artificial Sequence
  Synthetic oligonucleotide; CTA chr2 60494942 60494963 60494947 60494942 -
tcaggtaccagctactgtgtta

SEQ ID NO: 220429 - DNA, 22 bp, Artificial Sequence
  Synthetic oligonucleotide; CTA chr2 60494928 60494949 60494933 60494928 -
ctgtgttaggatctgtgttccc

SEQ ID NO: 220430 - DNA, 22 bp, Artificial Sequence
  Synthetic oligonucleotide; CTG chr2 60494925 60494946 60494930 60494925 -
tgttaggatctgtgttcccaac

SEQ ID NO: 220431 - DNA, 22 bp, Artificial Sequence
  Synthetic oligonucleotide; TTA chr2 60494920 60494941 60494925 60494920 -
ggatctgtgttcccaactgact

SEQ ID NO: 220432 - DNA, 22 bp, Artificial Sequence
  Synthetic oligonucleotide; CTG chr2 60494913 60494934 60494918 60494913 -
tgttcccaactgacttgcctcc

SEQ ID NO: 220433 - DNA, 22 bp, Artificial Sequence
  Synthetic oligonucleotide; TTC chr2 60494908 60494929 60494913 60494908 -
ccaactgacttgcctccccctg

SEQ ID NO: 220434 - DNA, 22 bp, Artificial Sequence
  Synthetic oligonucleotide; CTG chr2 60494901 60494922 60494906 60494901 -
acttgcctccccctgacgtcat

SEQ ID NO: 220435 - DNA, 22 bp, Artificial Sequence
  Synthetic oligonucleotide; CTT chr2 60494897 60494918 60494902 60494897 -
gcctccccctgacgtcatattc

SEQ ID NO: 220436 - DNA, 22 bp, Artificial Sequence
  Synthetic oligonucleotide; TTG chr2 60494896 60494917 60494901 60494896 -
cctccccctgacgtcatattct

SEQ ID NO: 220437 - DNA, 22 bp, Artificial Sequence
  Synthetic oligonucleotide; CTC chr2 60494892 60494913 60494897 60494892 -
cccctgacgtcatattcttttc

SEQ ID NO: 220438 - DNA, 22 bp, Artificial Sequence
  Synthetic oligonucleotide; CTG chr2 60494886 60494907 60494891 60494886 -
acgtcatattcttttccttttt

SEQ ID NO: 220439 - DNA, 22 bp, Artificial Sequence
  Synthetic oligonucleotide; TTC chr2 60494875 60494896 60494880 60494875 -
ttttcctttttcctctcccttt

SEQ ID NO: 220440 - DNA, 22 bp, Artificial Sequence
  Synthetic oligonucleotide; CTT chr2 60494873 60494894 60494878 60494873 -
ttcctttttcctctcccttttc

SEQ ID NO: 220441 - DNA, 22 bp, Artificial Sequence
  Synthetic oligonucleotide; TTT chr2 60494872 60494893 60494877 60494872 -
tcctttttcctctcccttttcc

SEQ ID NO: 220442 - DNA, 22 bp, Artificial Sequence
  Synthetic oligonucleotide; TTT chr2 60494871 60494892 60494876 60494871 -
cctttttcctctcccttttccc

SEQ ID NO: 220443 - DNA, 22 bp, Artificial Sequence
  Synthetic oligonucleotide; TTC chr2 60494870 60494891 60494875 60494870 -
ctttttcctctcccttttccct

SEQ ID NO: 220444 - DNA, 22 bp, Artificial Sequence
  Synthetic oligonucleotide; CTT chr2 60494867 60494888 60494872 60494867 -
tttcctctcccttttccctttt

SEQ ID NO: 220445 - DNA, 22 bp, Artificial Sequence
  Synthetic oligonucleotide; TTT chr2 60494866 60494887 60494871 60494866 -
ttcctctcccttttcccttttc

SEQ ID NO: 220446 - DNA, 22 bp, Artificial Sequence
  Synthetic oligonucleotide; TTT chr2 60494865 60494886 60494870 60494865 -
tcctctcccttttcccttttct

SEQ ID NO: 220447 - DNA, 22 bp, Artificial Sequence
  Synthetic oligonucleotide; TTT chr2 60494864 60494885 60494869 60494864 -
cctctcccttttcccttttctt

SEQ ID NO: 220448 - DNA, 22 bp, Artificial Sequence
  Synthetic oligonucleotide; TTC chr2 60494863 60494884 60494868 60494863 -
ctctcccttttcccttttcttc

SEQ ID NO: 220449 - DNA, 22 bp, Artificial Sequence
  Synthetic oligonucleotide; CTC chr2 60494860 60494881 60494865 60494860 -
tcccttttcccttttcttctga

SEQ ID NO: 220450 - DNA, 22 bp, Artificial Sequence
  Synthetic oligonucleotide; CTC chr2 60494858 60494879 60494863 60494858 -
ccttttcccttttcttctgacc

SEQ ID NO: 220451 - DNA, 22 bp, Artificial Sequence
  Synthetic oligonucleotide; CTT chr2 60494854 60494875 60494859 60494854 -
ttcccttttcttctgacccaaa

SEQ ID NO: 220452 - DNA, 22 bp, Artificial Sequence
  Synthetic oligonucleotide; TTT chr2 60494853 60494874 60494858 60494853 -
tcccttttcttctgacccaaac

SEQ ID NO: 220453 - DNA, 22 bp, Artificial Sequence
  Synthetic oligonucleotide; TTT chr2 60494852 60494873 60494857 60494852 -
cccttttcttctgacccaaact

SEQ ID NO: 220454 - DNA, 22 bp, Artificial Sequence
  Synthetic oligonucleotide; TTC chr2 60494851 60494872 60494856 60494851 -
ccttttcttctgacccaaacta

SEQ ID NO: 220455 - DNA, 22 bp, Artificial Sequence
  Synthetic oligonucleotide; CTT chr2 60494847 60494868 60494852 60494847 -
ttcttctgacccaaactaggaa

SEQ ID NO: 220456 - DNA, 22 bp, Artificial Sequence
  Synthetic oligonucleotide; TTT chr2 60494846 60494867 60494851 60494846 -
tcttctgacccaaactaggaat

SEQ ID NO: 220457 - DNA, 22 bp, Artificial Sequence
  Synthetic oligonucleotide; TTT chr2 60494845 60494866 60494850 60494845 -
cttctgacccaaactaggaatt

SEQ ID NO: 220458 - DNA, 22 bp, Artificial Sequence
  Synthetic oligonucleotide; TTC chr2 60494844 60494865 60494849 60494844 -
ttctgacccaaactaggaattg

SEQ ID NO: 220459 - DNA, 22 bp, Artificial Sequence
  Synthetic oligonucleotide; CTT chr2 60494842 60494863 60494847 60494842 -
ctgacccaaactaggaattggg

SEQ ID NO: 220460 - DNA, 22 bp, Artificial Sequence
  Synthetic oligonucleotide; TTC chr2 60494841 60494862 60494846 60494841 -
tgacccaaactaggaattgggg

SEQ ID NO: 220461 - DNA, 22 bp, Artificial Sequence
  Synthetic oligonucleotide; CTG chr2 60494839 60494860 60494844 60494839 -
acccaaactaggaattggggaa

SEQ ID NO: 220462 - DNA, 22 bp, Artificial Sequence
  Synthetic oligonucleotide; CTA chr2 60494829 60494850 60494834 60494829 -
ggaattggggaaagggcctgat

SEQ ID NO: 220463 - DNA, 22 bp, Artificial Sequence
  Synthetic oligonucleotide; TTG chr2 60494822 60494843 60494827 60494822 -
gggaaagggcctgataactttg

SEQ ID NO: 220464 - DNA, 22 bp, Artificial Sequence
  Synthetic oligonucleotide; CTG chr2 60494809 60494830 60494814 60494809 -
ataactttgtttctgctgaggt

SEQ ID NO: 220465 - DNA, 22 bp, Artificial Sequence
  Synthetic oligonucleotide; CTT chr2 60494802 60494823 60494807 60494802 -
tgtttctgctgaggtgtaacta

SEQ ID NO: 220466 - DNA, 22 bp, Artificial Sequence
  Synthetic oligonucleotide; TTT chr2 60494801 60494822 60494806 60494801 -
gtttctgctgaggtgtaactaa

SEQ ID NO: 220467 - DNA, 22 bp, Artificial Sequence
  Synthetic oligonucleotide; TTG chr2 60494800 60494821 60494805 60494800 -
tttctgctgaggtgtaactaat

SEQ ID NO: 220468 - DNA, 22 bp, Artificial Sequence
  Synthetic oligonucleotide; TTT chr2 60494797 60494818 60494802 60494797 -
ctgctgaggtgtaactaataaa

SEQ ID NO: 220469 - DNA, 22 bp, Artificial Sequence
  Synthetic oligonucleotide; TTC chr2 60494796 60494817 60494801 60494796 -
tgctgaggtgtaactaataaat

SEQ ID NO: 220470 - DNA, 22 bp, Artificial Sequence
  Synthetic oligonucleotide; CTG chr2 60494794 60494815 60494799 60494794 -
ctgaggtgtaactaataaatac

SEQ ID NO: 220471 - DNA, 22 bp, Artificial Sequence
  Synthetic oligonucleotide; CTG chr2 60494791 60494812 60494796 60494791 -
aggtgtaactaataaataccag

SEQ ID NO: 220472 - DNA, 22 bp, Artificial Sequence
  Synthetic oligonucleotide; CTA chr2 60494780 60494801 60494785 60494780 -
ataaataccaggaggcagcatt

SEQ ID NO: 220473 - DNA, 22 bp, Artificial Sequence
  Synthetic oligonucleotide; TTT chr2 60494757 60494778 60494762 60494757 -
tagttcacaagctcggagcact

SEQ ID NO: 220474 - DNA, 22 bp, Artificial Sequence
  Synthetic oligonucleotide; TTT chr2 60494756 60494777 60494761 60494756 -
agttcacaagctcggagcactt

SEQ ID NO: 220475 - DNA, 22 bp, Artificial Sequence
  Synthetic oligonucleotide; TTA chr2 60494755 60494776 60494760 60494755 -
gttcacaagctcggagcactta

SEQ ID NO: 220476 - DNA, 22 bp, Artificial Sequence
  Synthetic oligonucleotide; TTC chr2 60494751 60494772 60494756 60494751 -
acaagctcggagcacttactct

SEQ ID NO: 220477 - DNA, 22 bp, Artificial Sequence
  Synthetic oligonucleotide; CTC chr2 60494743 60494764 60494748 60494743 -
ggagcacttactctgctctagg

SEQ ID NO: 220478 - DNA, 22 bp, Artificial Sequence
  Synthetic oligonucleotide; CTT chr2 60494734 60494755 60494739 60494734 -
actctgctctaggaactttaca

SEQ ID NO: 220479 - DNA, 22 bp, Artificial Sequence
  Synthetic oligonucleotide; TTA chr2 60494733 60494754 60494738 60494733 -
ctctgctctaggaactttacaa

SEQ ID NO: 220480 - DNA, 22 bp, Artificial Sequence
  Synthetic oligonucleotide; CTC chr2 60494730 60494751 60494735 60494730 -
tgctctaggaactttacaaata

SEQ ID NO: 220481 - DNA, 22 bp, Artificial Sequence
  Synthetic oligonucleotide; CTG chr2 60494728 60494749 60494733 60494728 -
ctctaggaactttacaaatacg

SEQ ID NO: 220482 - DNA, 22 bp, Artificial Sequence
  Synthetic oligonucleotide; CTC chr2 60494725 60494746 60494730 60494725 -
taggaactttacaaatacgcac

SEQ ID NO: 220483 - DNA, 22 bp, Artificial Sequence
  Synthetic oligonucleotide; CTA chr2 60494723 60494744 60494728 60494723 -
ggaactttacaaatacgcactc

SEQ ID NO: 220484 - DNA, 22 bp, Artificial Sequence
  Synthetic oligonucleotide; CTT chr2 60494716 60494737 60494721 60494716 -
tacaaatacgcactcattttat

SEQ ID NO: 220485 - DNA, 22 bp, Artificial Sequence
  Synthetic oligonucleotide; TTT chr2 60494715 60494736 60494720 60494715 -
acaaatacgcactcattttatt

SEQ ID NO: 220486 - DNA, 22 bp, Artificial Sequence
  Synthetic oligonucleotide; TTA chr2 60494714 60494735 60494719 60494714 -
caaatacgcactcattttattt

SEQ ID NO: 220487 - DNA, 22 bp, Artificial Sequence
  Synthetic oligonucleotide; CTC chr2 60494701 60494722 60494706 60494701 -
attttattttcatacaaaccct

SEQ ID NO: 220488 - DNA, 22 bp, Artificial Sequence
  Synthetic oligonucleotide; TTT chr2 60494697 60494718 60494702 60494697 -
tattttcatacaaaccctatga

SEQ ID NO: 220489 - DNA, 22 bp, Artificial Sequence
  Synthetic oligonucleotide; TTT chr2 60494696 60494717 60494701 60494696 -
attttcatacaaaccctatgaa

SEQ ID NO: 220490 - DNA, 22 bp, Artificial Sequence
  Synthetic oligonucleotide; TTA chr2 60494695 60494716 60494700 60494695 -
ttttcatacaaaccctatgaag

SEQ ID NO: 220491 - DNA, 22 bp, Artificial Sequence
  Synthetic oligonucleotide; TTT chr2 60494692 60494713 60494697 60494692 -
tcatacaaaccctatgaagcat

SEQ ID NO: 220492 - DNA, 22 bp, Artificial Sequence
  Synthetic oligonucleotide; TTT chr2 60494691 60494712 60494696 60494691 -
catacaaaccctatgaagcata

SEQ ID NO: 220493 - DNA, 22 bp, Artificial Sequence
  Synthetic oligonucleotide; TTC chr2 60494690 60494711 60494695 60494690 -
atacaaaccctatgaagcatat

SEQ ID NO: 220494 - DNA, 22 bp, Artificial Sequence
  Synthetic oligonucleotide; CTA chr2 60494678 60494699 60494683 60494678 -
tgaagcatatactattattatt

SEQ ID NO: 220495 - DNA, 22 bp, Artificial Sequence
  Synthetic oligonucleotide; CTA chr2 60494664 60494685 60494669 60494664 -
ttattattcctattttacggat

SEQ ID NO: 220496 - DNA, 22 bp, Artificial Sequence
  Synthetic oligonucleotide; TTA chr2 60494661 60494682 60494666 60494661 -
ttattcctattttacggatgag

SEQ ID NO: 220497 - DNA, 22 bp, Artificial Sequence
  Synthetic oligonucleotide; TTA chr2 60494658 60494679 60494663 60494658 -
ttcctattttacggatgagtcc

SEQ ID NO: 220498 - DNA, 22 bp, Artificial Sequence
  Synthetic oligonucleotide; TTC chr2 60494655 60494676 60494660 60494655 -
ctattttacggatgagtccata

SEQ ID NO: 220499 - DNA, 22 bp, Artificial Sequence
  Synthetic oligonucleotide; CTA chr2 60494652 60494673 60494657 60494652 -
ttttacggatgagtccatattt

SEQ ID NO: 220500 - DNA, 22 bp, Artificial Sequence
  Synthetic oligonucleotide; TTT chr2 60494649 60494670 60494654 60494649 -
tacggatgagtccatattttaa

SEQ ID NO: 220501 - DNA, 22 bp, Artificial Sequence
  Synthetic oligonucleotide; TTT chr2 60494648 60494669 60494653 60494648 -
acggatgagtccatattttaaa

SEQ ID NO: 220502 - DNA, 22 bp, Artificial Sequence
  Synthetic oligonucleotide; TTA chr2 60494647 60494668 60494652 60494647 -
cggatgagtccatattttaaat

SEQ ID NO: 220503 - DNA, 22 bp, Artificial Sequence
  Synthetic oligonucleotide; TTT chr2 60494630 60494651 60494635 60494630 -
taaattccagctgaagaaagaa

SEQ ID NO: 220504 - DNA, 22 bp, Artificial Sequence
  Synthetic oligonucleotide; TTT chr2 60494629 60494650 60494634 60494629 -
aaattccagctgaagaaagaac

SEQ ID NO: 220505 - DNA, 22 bp, Artificial Sequence
  Synthetic oligonucleotide; TTA chr2 60494628 60494649 60494633 60494628 -
aattccagctgaagaaagaaca

SEQ ID NO: 220506 - DNA, 22 bp, Artificial Sequence
  Synthetic oligonucleotide; TTC chr2 60494623 60494644 60494628 60494623 -
cagctgaagaaagaacatttgg

SEQ ID NO: 220507 - DNA, 22 bp, Artificial Sequence
  Synthetic oligonucleotide; CTG chr2 60494617 60494638 60494622 60494617 -
aagaaagaacatttggtgataa

SEQ ID NO: 220508 - DNA, 22 bp, Artificial Sequence
  Synthetic oligonucleotide; TTT chr2 60494603 60494624 60494608 60494603 -
ggtgataaatcattaggaatga

SEQ ID NO: 220509 - DNA, 22 bp, Artificial Sequence
  Synthetic oligonucleotide; TTG chr2 60494602 60494623 60494607 60494602 -
gtgataaatcattaggaatgag

SEQ ID NO: 220510 - DNA, 22 bp, Artificial Sequence
  Synthetic oligonucleotide; TTA chr2 60494588 60494609 60494593 60494588 -
ggaatgagctaggagttatttg

SEQ ID NO: 220511 - DNA, 22 bp, Artificial Sequence
  Synthetic oligonucleotide; CTA chr2 60494577 60494598 60494582 60494577 -
ggagttatttgtcatcacagaa

SEQ ID NO: 220512 - DNA, 22 bp, Artificial Sequence
  Synthetic oligonucleotide; TTA chr2 60494570 60494591 60494575 60494570 -
tttgtcatcacagaaccagtct

SEQ ID NO: 220513 - DNA, 22 bp, Artificial Sequence
  Synthetic oligonucleotide; TTT chr2 60494567 60494588 60494572 60494567 -
gtcatcacagaaccagtctgta

SEQ ID NO: 220514 - DNA, 22 bp, Artificial Sequence
  Synthetic oligonucleotide; TTG chr2 60494566 60494587 60494571 60494566 -
tcatcacagaaccagtctgtat

SEQ ID NO: 220515 - DNA, 22 bp, Artificial Sequence
  Synthetic oligonucleotide; CTG chr2 60494547 60494568 60494552 60494547 -
tattgccccaagtctggctttg

SEQ ID NO: 220516 - DNA, 22 bp, Artificial Sequence
  Synthetic oligonucleotide; TTG chr2 60494542 60494563 60494547 60494542 -
ccccaagtctggctttgccaat

SEQ ID NO: 220517 - DNA, 22 bp, Artificial Sequence
  Synthetic oligonucleotide; CTG chr2 60494531 60494552 60494536 60494531 -
gctttgccaattggagattagg

SEQ ID NO: 220518 - DNA, 22 bp, Artificial Sequence
  Synthetic oligonucleotide; CTT chr2 60494527 60494548 60494532 60494527 -
tgccaattggagattagggaga

SEQ ID NO: 220519 - DNA, 22 bp, Artificial Sequence
  Synthetic oligonucleotide; TTT chr2 60494526 60494547 60494531 60494526 -
gccaattggagattagggagat

SEQ ID NO: 220520 - DNA, 22 bp, Artificial Sequence
  Synthetic oligonucleotide; TTG chr2 60494525 60494546 60494530 60494525 -
ccaattggagattagggagatg

SEQ ID NO: 220521 - DNA, 22 bp, Artificial Sequence
  Synthetic oligonucleotide; TTG chr2 60494518 60494539 60494523 60494518 -
gagattagggagatggaatgaa

SEQ ID NO: 220522 - DNA, 22 bp, Artificial Sequence
  Synthetic oligonucleotide; TTA chr2 60494511 60494532 60494516 60494511 -
gggagatggaatgaacactttt

SEQ ID NO: 220523 - DNA, 22 bp, Artificial Sequence
  Synthetic oligonucleotide; CTT chr2 60494491 60494512 60494496 60494491 -
ttcgtcccctttgatatctcat

SEQ ID NO: 220524 - DNA, 22 bp, Artificial Sequence
  Synthetic oligonucleotide; TTT chr2 60494490 60494511 60494495 60494490 -
tcgtcccctttgatatctcatc

SEQ ID NO: 220525 - DNA, 22 bp, Artificial Sequence
  Synthetic oligonucleotide; TTT chr2 60494489 60494510 60494494 60494489 -
cgtcccctttgatatctcatct

SEQ ID NO: 220526 - DNA, 22 bp, Artificial Sequence
  Synthetic oligonucleotide; TTC chr2 60494488 60494509 60494493 60494488 -
gtcccctttgatatctcatctc

SEQ ID NO: 220527 - DNA, 22 bp, Artificial Sequence
  Synthetic oligonucleotide; CTT chr2 60494480 60494501 60494485 60494480 -
tgatatctcatctcactgagct

SEQ ID NO: 220528 - DNA, 22 bp, Artificial Sequence
  Synthetic oligonucleotide; TTT chr2 60494479 60494500 60494484 60494479 -
gatatctcatctcactgagctc

SEQ ID NO: 220529 - DNA, 22 bp, Artificial Sequence
  Synthetic oligonucleotide; TTG chr2 60494478 60494499 60494483 60494478 -
atatctcatctcactgagctct

SEQ ID NO: 220530 - DNA, 22 bp, Artificial Sequence
  Synthetic oligonucleotide; CTC chr2 60494471 60494492 60494476 60494471 -
atctcactgagctctgggccgt

SEQ ID NO: 220531 - DNA, 22 bp, Artificial Sequence
  Synthetic oligonucleotide; CTC chr2 60494466 60494487 60494471 60494466 -
actgagctctgggccgtttcca

SEQ ID NO: 220532 - DNA, 22 bp, Artificial Sequence
  Synthetic oligonucleotide; CTG chr2 60494462 60494483 60494467 60494462 -
agctctgggccgtttccactct

SEQ ID NO: 220533 - DNA, 22 bp, Artificial Sequence
  Synthetic oligonucleotide; CTC chr2 60494457 60494478 60494462 60494457 -
tgggccgtttccactcttctct

SEQ ID NO: 220534 - DNA, 22 bp, Artificial Sequence
  Synthetic oligonucleotide; CTG chr2 60494455 60494476 60494460 60494455 -
ggccgtttccactcttctctcc

SEQ ID NO: 220535 - DNA, 22 bp, Artificial Sequence
  Synthetic oligonucleotide; TTT chr2 60494447 60494468 60494452 60494447 -
ccactcttctctccccatactc

SEQ ID NO: 220536 - DNA, 22 bp, Artificial Sequence
  Synthetic oligonucleotide; TTC chr2 60494446 60494467 60494451 60494446 -
cactcttctctccccatactcc

SEQ ID NO: 220537 - DNA, 22 bp, Artificial Sequence
  Synthetic oligonucleotide; CTC chr2 60494441 60494462 60494446 60494441 -
ttctctccccatactcccatct

SEQ ID NO: 220538 - DNA, 22 bp, Artificial Sequence
  Synthetic oligonucleotide; CTT chr2 60494439 60494460 60494444 60494439 -
ctctccccatactcccatcttg

SEQ ID NO: 220539 - DNA, 22 bp, Artificial Sequence
  Synthetic oligonucleotide; TTC chr2 60494438 60494459 60494443 60494438 -
tctccccatactcccatcttgg

SEQ ID NO: 220540 - DNA, 22 bp, Artificial Sequence
  Synthetic oligonucleotide; CTC chr2 60494436 60494457 60494441 60494436 -
tccccatactcccatcttggca

SEQ ID NO: 220541 - DNA, 22 bp, Artificial Sequence
  Synthetic oligonucleotide; CTC chr2 60494434 60494455 60494439 60494434 -
cccatactcccatcttggcaaa

SEQ ID NO: 220542 - DNA, 22 bp, Artificial Sequence
  Synthetic oligonucleotide; CTC chr2 60494425 60494446 60494430 60494425 -
ccatcttggcaaaaattgcata

SEQ ID NO: 220543 - DNA, 22 bp, Artificial Sequence
  Synthetic oligonucleotide; CTT chr2 60494418 60494439 60494423 60494418 -
ggcaaaaattgcataagattta

SEQ ID NO: 220544 - DNA, 22 bp, Artificial Sequence
  Synthetic oligonucleotide; TTG chr2 60494417 60494438 60494422 60494417 -
gcaaaaattgcataagatttat

SEQ ID NO: 220545 - DNA, 22 bp, Artificial Sequence
  Synthetic oligonucleotide; TTG chr2 60494407 60494428 60494412 60494407 -
cataagatttataagacattag

SEQ ID NO: 220546 - DNA, 22 bp, Artificial Sequence
  Synthetic oligonucleotide; TTT chr2 60494397 60494418 60494402 60494397 -
ataagacattagggtattggag

SEQ ID NO: 220547 - DNA, 22 bp, Artificial Sequence
  Synthetic oligonucleotide; TTA chr2 60494396 60494417 60494401 60494396 -
taagacattagggtattggaga

SEQ ID NO: 220548 - DNA, 22 bp, Artificial Sequence
  Synthetic oligonucleotide; TTA chr2 60494386 60494407 60494391 60494386 -
gggtattggagataatttatta

SEQ ID NO: 220549 - DNA, 22 bp, Artificial Sequence
  Synthetic oligonucleotide; TTG chr2 60494378 60494399 60494383 60494378 -
gagataatttattacaacctcc

SEQ ID NO: 220550 - DNA, 22 bp, Artificial Sequence
  Synthetic oligonucleotide; TTT chr2 60494368 60494389 60494373 60494368 -
attacaacctccttgtttacag

SEQ ID NO: 220551 - DNA, 22 bp, Artificial Sequence
  Synthetic oligonucleotide; TTA chr2 60494367 60494388 60494372 60494367 -
ttacaacctccttgtttacaga

SEQ ID NO: 220552 - DNA, 22 bp, Artificial Sequence
  Synthetic oligonucleotide; TTA chr2 60494364 60494385 60494369 60494364 -
caacctccttgtttacagaggg

SEQ ID NO: 220553 - DNA, 22 bp, Artificial Sequence
  Synthetic oligonucleotide; CTC chr2 60494357 60494378 60494362 60494357 -
cttgtttacagaggggcaaccc

SEQ ID NO: 220554 - DNA, 22 bp, Artificial Sequence
  Synthetic oligonucleotide; CTT chr2 60494354 60494375 60494359 60494354 -
gtttacagaggggcaacccagg

SEQ ID NO: 220555 - DNA, 22 bp, Artificial Sequence
  Synthetic oligonucleotide; TTG chr2 60494353 60494374 60494358 60494353 -
tttacagaggggcaacccaggt

SEQ ID NO: 220556 - DNA, 22 bp, Artificial Sequence
  Synthetic oligonucleotide; TTT chr2 60494350 60494371 60494355 60494350 -
acagaggggcaacccaggtcca

SEQ ID NO: 220557 - DNA, 22 bp, Artificial Sequence
  Synthetic oligonucleotide; TTA chr2 60494349 60494370 60494354 60494349 -
cagaggggcaacccaggtccag

SEQ ID NO: 220558 - DNA, 22 bp, Artificial Sequence
  Synthetic oligonucleotide; CTG chr2 60494297 60494318 60494302 60494297 -
cccagtttagaggccatgcaca

SEQ ID NO: 220559 - DNA, 22 bp, Artificial Sequence
  Synthetic oligonucleotide; TTT chr2 60494289 60494310 60494294 60494289 -
agaggccatgcacagatgagaa

SEQ ID NO: 220560 - DNA, 22 bp, Artificial Sequence
  Synthetic oligonucleotide; TTA chr2 60494288 60494309 60494293 60494288 -
gaggccatgcacagatgagaag

SEQ ID NO: 220561 - DNA, 22 bp, Artificial Sequence
  Synthetic oligonucleotide; CTC chr2 60494258 60494279 60494263 60494258 -
ccagctcccagcccacgtcttc

SEQ ID NO: 220562 - DNA, 22 bp, Artificial Sequence
  Synthetic oligonucleotide; CTC chr2 60494251 60494272 60494256 60494251 -
ccagcccacgtcttcccactct

SEQ ID NO: 220563 - DNA, 22 bp, Artificial Sequence
  Synthetic oligonucleotide; CTT chr2 60494237 60494258 60494242 60494237 -
cccactctcccatgtggcctgt

SEQ ID NO: 220564 - DNA, 22 bp, Artificial Sequence
  Synthetic oligonucleotide; TTC chr2 60494236 60494257 60494241 60494236 -
ccactctcccatgtggcctgtc

SEQ ID NO: 220565 - DNA, 22 bp, Artificial Sequence
  Synthetic oligonucleotide; CTC chr2 60494230 60494251 60494235 60494230 -
tcccatgtggcctgtcagcatc

SEQ ID NO: 220566 - DNA, 22 bp, Artificial Sequence
  Synthetic oligonucleotide; CTC chr2 60494228 60494249 60494233 60494228 -
ccatgtggcctgtcagcatcac

SEQ ID NO: 220567 - DNA, 22 bp, Artificial Sequence
  Synthetic oligonucleotide; CTG chr2 60494216 60494237 60494221 60494216 -
tcagcatcaccctctctcactc

SEQ ID NO: 220568 - DNA, 22 bp, Artificial Sequence
  Synthetic oligonucleotide; CTC chr2 60494202 60494223 60494207 60494202 -
tctcactcttgcttagcctgtg

SEQ ID NO: 220569 - DNA, 22 bp, Artificial Sequence
  Synthetic oligonucleotide; CTC chr2 60494200 60494221 60494205 60494200 -
tcactcttgcttagcctgtgta

SEQ ID NO: 220570 - DNA, 22 bp, Artificial Sequence
  Synthetic oligonucleotide; CTC chr2 60494198 60494219 60494203 60494198 -
actcttgcttagcctgtgtagc

SEQ ID NO: 220571 - DNA, 22 bp, Artificial Sequence
  Synthetic oligonucleotide; CTC chr2 60494194 60494215 60494199 60494194 -
ttgcttagcctgtgtagctcaa

SEQ ID NO: 220572 - DNA, 22 bp, Artificial Sequence
  Synthetic oligonucleotide; CTT chr2 60494192 60494213 60494197 60494192 -
gcttagcctgtgtagctcaagg

SEQ ID NO: 220573 - DNA, 22 bp, Artificial Sequence
  Synthetic oligonucleotide; TTG chr2 60494191 60494212 60494196 60494191 -
cttagcctgtgtagctcaagga

SEQ ID NO: 220574 - DNA, 22 bp, Artificial Sequence
  Synthetic oligonucleotide; CTT chr2 60494188 60494209 60494193 60494188 -
agcctgtgtagctcaaggatgt

SEQ ID NO: 220575 - DNA, 22 bp, Artificial Sequence
  Synthetic oligonucleotide; TTA chr2 60494187 60494208 60494192 60494187 -
gcctgtgtagctcaaggatgta

SEQ ID NO: 220576 - DNA, 22 bp, Artificial Sequence
  Synthetic oligonucleotide; CTG chr2 60494182 60494203 60494187 60494182 -
tgtagctcaaggatgtatttat

SEQ ID NO: 220577 - DNA, 22 bp, Artificial Sequence
  Synthetic oligonucleotide; CTC chr2 60494174 60494195 60494179 60494174 -
aaggatgtatttattgccctag

SEQ ID NO: 220578 - DNA, 22 bp, Artificial Sequence
  Synthetic oligonucleotide; TTT chr2 60494162 60494183 60494167 60494162 -
attgccctaggcgtaagaatgt

SEQ ID NO: 220579 - DNA, 22 bp, Artificial Sequence
  Synthetic oligonucleotide; TTA chr2 60494161 60494182 60494166 60494161 -
ttgccctaggcgtaagaatgtg

SEQ ID NO: 220580 - DNA, 22 bp, Artificial Sequence
  Synthetic oligonucleotide; TTG chr2 60494158 60494179 60494163 60494158 -
ccctaggcgtaagaatgtgctc

SEQ ID NO: 220581 - DNA, 22 bp, Artificial Sequence
  Synthetic oligonucleotide; CTA chr2 60494153 60494174 60494158 60494153 -
ggcgtaagaatgtgctcaggtt

SEQ ID NO: 220582 - DNA, 22 bp, Artificial Sequence
  Synthetic oligonucleotide; CTC chr2 60494136 60494157 60494141 60494136 -
aggtttcttaagtaatgtaggt

SEQ ID NO: 220583 - DNA, 22 bp, Artificial Sequence
  Synthetic oligonucleotide; TTT chr2 60494130 60494151 60494135 60494130 -
cttaagtaatgtaggtgtgcct

SEQ ID NO: 220584 - DNA, 22 bp, Artificial Sequence
  Synthetic oligonucleotide; TTC chr2 60494129 60494150 60494134 60494129 -
ttaagtaatgtaggtgtgcctc

SEQ ID NO: 220585 - DNA, 22 bp, Artificial Sequence
  Synthetic oligonucleotide; CTT chr2 60494127 60494148 60494132 60494127 -
aagtaatgtaggtgtgcctcac

SEQ ID NO: 220586 - DNA, 22 bp, Artificial Sequence
  Synthetic oligonucleotide; TTA chr2 60494126 60494147 60494131 60494126 -
agtaatgtaggtgtgcctcacc

SEQ ID NO: 220587 - DNA, 22 bp, Artificial Sequence
  Synthetic oligonucleotide; CTC chr2 60494107 60494128 60494112 60494107 -
acccatggggcttcactttctc

SEQ ID NO: 220588 - DNA, 22 bp, Artificial Sequence
  Synthetic oligonucleotide; CTT chr2 60494094 60494115 60494099 60494094 -
cactttctctctgtttattgcc

SEQ ID NO: 220589 - DNA, 22 bp, Artificial Sequence
  Synthetic oligonucleotide; TTC chr2 60494093 60494114 60494098 60494093 -
actttctctctgtttattgcca

SEQ ID NO: 220590 - DNA, 22 bp, Artificial Sequence
  Synthetic oligonucleotide; CTT chr2 60494089 60494110 60494094 60494089 -
tctctctgtttattgccagtag

SEQ ID NO: 220591 - DNA, 22 bp, Artificial Sequence
  Synthetic oligonucleotide; TTT chr2 60494088 60494109 60494093 60494088 -
ctctctgtttattgccagtagt

SEQ ID NO: 220592 - DNA, 22 bp, Artificial Sequence
  Synthetic oligonucleotide; TTC chr2 60494087 60494108 60494092 60494087 -
tctctgtttattgccagtagtg

SEQ ID NO: 220593 - DNA, 22 bp, Artificial Sequence
  Synthetic oligonucleotide; CTC chr2 60494085 60494106 60494090 60494085 -
tctgtttattgccagtagtggt

SEQ ID NO: 220594 - DNA, 22 bp, Artificial Sequence
  Synthetic oligonucleotide; CTC chr2 60494083 60494104 60494088 60494083 -
tgtttattgccagtagtggtct

SEQ ID NO: 220595 - DNA, 22 bp, Artificial Sequence
  Synthetic oligonucleotide; CTG chr2 60494081 60494102 60494086 60494081 -
tttattgccagtagtggtctct

SEQ ID NO: 220596 - DNA, 22 bp, Artificial Sequence
  Synthetic oligonucleotide; TTT chr2 60494078 60494099 60494083 60494078 -
attgccagtagtggtctctgtt

SEQ ID NO: 220597 - DNA, 22 bp, Artificial Sequence
  Synthetic oligonucleotide; TTA chr2 60494077 60494098 60494082 60494077 -
ttgccagtagtggtctctgttc

SEQ ID NO: 220598 - DNA, 22 bp, Artificial Sequence
  Synthetic oligonucleotide; TTG chr2 60494074 60494095 60494079 60494074 -
ccagtagtggtctctgttctgt

SEQ ID NO: 220599 - DNA, 22 bp, Artificial Sequence
  Synthetic oligonucleotide; CTC chr2 60494060 60494081 60494065 60494060 -
tgttctgttttcttcagtttct

SEQ ID NO: 220600 - DNA, 22 bp, Artificial Sequence
  Synthetic oligonucleotide; CTG chr2 60494058 60494079 60494063 60494058 -
ttctgttttcttcagtttctcc

SEQ ID NO: 220601 - DNA, 22 bp, Artificial Sequence
  Synthetic oligonucleotide; TTC chr2 60494055 60494076 60494060 60494055 -
tgttttcttcagtttctccccc

SEQ ID NO: 220602 - DNA, 22 bp, Artificial Sequence
  Synthetic oligonucleotide; CTG chr2 60494053 60494074 60494058 60494053 -
ttttcttcagtttctccccctt

SEQ ID NO: 220603 - DNA, 22 bp, Artificial Sequence
  Synthetic oligonucleotide; TTT chr2 60494050 60494071 60494055 60494050 -
tcttcagtttctcccccttgca

SEQ ID NO: 220604 - DNA, 22 bp, Artificial Sequence
  Synthetic oligonucleotide; TTT chr2 60494049 60494070 60494054 60494049 -
cttcagtttctcccccttgcat

SEQ ID NO: 220605 - DNA, 22 bp, Artificial Sequence
  Synthetic oligonucleotide; TTC chr2 60494048 60494069 60494053 60494048 -
ttcagtttctcccccttgcatt

SEQ ID NO: 220606 - DNA, 22 bp, Artificial Sequence
  Synthetic oligonucleotide; CTT chr2 60494046 60494067 60494051 60494046 -
cagtttctcccccttgcattgt

SEQ ID NO: 220607 - DNA, 22 bp, Artificial Sequence
  Synthetic oligonucleotide; TTC chr2 60494045 60494066 60494050 60494045 -
agtttctcccccttgcattgtt

SEQ ID NO: 220608 - DNA, 22 bp, Artificial Sequence
  Synthetic oligonucleotide; TTT chr2 60494040 60494061 60494045 60494040 -
ctcccccttgcattgttgtcta

SEQ ID NO: 220609 - DNA, 22 bp, Artificial Sequence
  Synthetic oligonucleotide; TTC chr2 60494039 60494060 60494044 60494039 -
tcccccttgcattgttgtctaa

SEQ ID NO: 220610 - DNA, 22 bp, Artificial Sequence
  Synthetic oligonucleotide; CTC chr2 60494037 60494058 60494042 60494037 -
ccccttgcattgttgtctaaga

SEQ ID NO: 220611 - DNA, 22 bp, Artificial Sequence
  Synthetic oligonucleotide; CTT chr2 60494031 60494052 60494036 60494031 -
gcattgttgtctaagatggctg

SEQ ID NO: 220612 - DNA, 22 bp, Artificial Sequence
  Synthetic oligonucleotide; TTG chr2 60494030 60494051 60494035 60494030 -
cattgttgtctaagatggctgt

SEQ ID NO: 220613 - DNA, 22 bp, Artificial Sequence
  Synthetic oligonucleotide; TTG chr2 60494025 60494046 60494030 60494025 -
ttgtctaagatggctgtcctgt

SEQ ID NO: 220614 - DNA, 22 bp, Artificial Sequence
  Synthetic oligonucleotide; TTG chr2 60494022 60494043 60494027 60494022 -
tctaagatggctgtcctgtctt

SEQ ID NO: 220615 - DNA, 22 bp, Artificial Sequence
  Synthetic oligonucleotide; CTA chr2 60494018 60494039 60494023 60494018 -
agatggctgtcctgtcttttgt

SEQ ID NO: 220616 - DNA, 22 bp, Artificial Sequence
  Synthetic oligonucleotide; CTG chr2 60494009 60494030 60494014 60494009 -
tcctgtcttttgtccacttccc

SEQ ID NO: 220617 - DNA, 22 bp, Artificial Sequence
  Synthetic oligonucleotide; CTG chr2 60494004 60494025 60494009 60494004 -
tcttttgtccacttcccctcca

SEQ ID NO: 220618 - DNA, 22 bp, Artificial Sequence
  Synthetic oligonucleotide; CTT chr2 60494000 60494021 60494005 60494000 -
ttgtccacttcccctccactcc

SEQ ID NO: 220619 - DNA, 22 bp, Artificial Sequence
  Synthetic oligonucleotide; TTT chr2 60493999 60494020 60494004 60493999 -
tgtccacttcccctccactccc

SEQ ID NO: 220620 - DNA, 22 bp, Artificial Sequence
  Synthetic oligonucleotide; TTT chr2 60493998 60494019 60494003 60493998 -
gtccacttcccctccactcccc

SEQ ID NO: 220621 - DNA, 22 bp, Artificial Sequence
  Synthetic oligonucleotide; TTG chr2 60493997 60494018 60494002 60493997 -
tccacttcccctccactccccg

SEQ ID NO: 220622 - DNA, 22 bp, Artificial Sequence
  Synthetic oligonucleotide; CTT chr2 60493990 60494011 60493995 60493990 -
cccctccactccccgtaccttc

SEQ ID NO: 220623 - DNA, 22 bp, Artificial Sequence
  Synthetic oligonucleotide; TTC chr2 60493989 60494010 60493994 60493989 -
ccctccactccccgtaccttcc

SEQ ID NO: 220624 - DNA, 22 bp, Artificial Sequence
  Synthetic oligonucleotide; CTC chr2 60493984 60494005 60493989 60493984 -
cactccccgtaccttcctttaa

SEQ ID NO: 220625 - DNA, 22 bp, Artificial Sequence
  Synthetic oligonucleotide; CTC chr2 60493979 60494000 60493984 60493979 -
cccgtaccttcctttaatcagc

SEQ ID NO: 220626 - DNA, 22 bp, Artificial Sequence
  Synthetic oligonucleotide; CTT chr2 60493969 60493990 60493974 60493969 -
cctttaatcagcttccgccact

SEQ ID NO: 220627 - DNA, 22 bp, Artificial Sequence
  Synthetic oligonucleotide; TTC chr2 60493968 60493989 60493973 60493968 -
ctttaatcagcttccgccactg

SEQ ID NO: 220628 - DNA, 22 bp, Artificial Sequence
  Synthetic oligonucleotide; CTT chr2 60493965 60493986 60493970 60493965 -
taatcagcttccgccactgcct

SEQ ID NO: 220629 - DNA, 22 bp, Artificial Sequence
  Synthetic oligonucleotide; TTT chr2 60493964 60493985 60493969 60493964 -
aatcagcttccgccactgcctg

SEQ ID NO: 220630 - DNA, 22 bp, Artificial Sequence
  Synthetic oligonucleotide; TTA chr2 60493963 60493984 60493968 60493963 -
atcagcttccgccactgcctga

SEQ ID NO: 220631 - DNA, 22 bp, Artificial Sequence
  Synthetic oligonucleotide; CTT chr2 60493955 60493976 60493960 60493955 -
ccgccactgcctgaggccactc

SEQ ID NO: 220632 - DNA, 22 bp, Artificial Sequence
  Synthetic oligonucleotide; TTC chr2 60493954 60493975 60493959 60493954 -
cgccactgcctgaggccactca

SEQ ID NO: 220633 - DNA, 22 bp, Artificial Sequence
  Synthetic oligonucleotide; CTG chr2 60493946 60493967 60493951 60493946 -
cctgaggccactcagctctggt

SEQ ID NO: 220634 - DNA, 22 bp, Artificial Sequence
  Synthetic oligonucleotide; CTG chr2 60493942 60493963 60493947 60493942 -
aggccactcagctctggtccca

SEQ ID NO: 220635 - DNA, 22 bp, Artificial Sequence
  Synthetic oligonucleotide; CTC chr2 60493933 60493954 60493938 60493933 -
agctctggtcccactggaggcc

SEQ ID NO: 220636 - DNA, 22 bp, Artificial Sequence
  Synthetic oligonucleotide; CTC chr2 60493928 60493949 60493933 60493928 -
tggtcccactggaggccctgtc

SEQ ID NO: 220637 - DNA, 22 bp, Artificial Sequence
  Synthetic oligonucleotide; CTG chr2 60493926 60493947 60493931 60493926 -
gtcccactggaggccctgtctc

SEQ ID NO: 220638 - DNA, 22 bp, Artificial Sequence
  Synthetic oligonucleotide; CTG chr2 60493917 60493938 60493922 60493917 -
gaggccctgtctcccccagggg

SEQ ID NO: 220639 - DNA, 22 bp, Artificial Sequence
  Synthetic oligonucleotide; CTG chr2 60493908 60493929 60493913 60493908 -
tctcccccaggggtccttctgc

SEQ ID NO: 220640 - DNA, 22 bp, Artificial Sequence
  Synthetic oligonucleotide; CTC chr2 60493904 60493925 60493909 60493904 -
ccccaggggtccttctgcttcc

SEQ ID NO: 220641 - DNA, 22 bp, Artificial Sequence
  Synthetic oligonucleotide; CTT chr2 60493890 60493911 60493895 60493890 -
ctgcttcctgttcacctctgat

SEQ ID NO: 220642 - DNA, 22 bp, Artificial Sequence
  Synthetic oligonucleotide; TTC chr2 60493889 60493910 60493894 60493889 -
tgcttcctgttcacctctgatc

SEQ ID NO: 220643 - DNA, 22 bp, Artificial Sequence
  Synthetic oligonucleotide; CTG chr2 60493887 60493908 60493892 60493887 -
cttcctgttcacctctgatccc

SEQ ID NO: 220644 - DNA, 22 bp, Artificial Sequence
  Synthetic oligonucleotide; CTT chr2 60493884 60493905 60493889 60493884 -
cctgttcacctctgatccccca

SEQ ID NO: 220645 - DNA, 22 bp, Artificial Sequence
  Synthetic oligonucleotide; TTC chr2 60493883 60493904 60493888 60493883 -
ctgttcacctctgatcccccag

SEQ ID NO: 220646 - DNA, 22 bp, Artificial Sequence
  Synthetic oligonucleotide; CTG chr2 60493880 60493901 60493885 60493880 -
ttcacctctgatcccccagccc

SEQ ID NO: 220647 - DNA, 22 bp, Artificial Sequence
  Synthetic oligonucleotide; TTC chr2 60493877 60493898 60493882 60493877 -
acctctgatcccccagccctgc

SEQ ID NO: 220648 - DNA, 22 bp, Artificial Sequence
  Synthetic oligonucleotide; CTC chr2 60493872 60493893 60493877 60493872 -
tgatcccccagccctgccatgg

SEQ ID NO: 220649 - DNA, 22 bp, Artificial Sequence
  Synthetic oligonucleotide; CTG chr2 60493870 60493891 60493875 60493870 -
atcccccagccctgccatggcc

SEQ ID NO: 220650 - DNA, 22 bp, Artificial Sequence
  Synthetic oligonucleotide; CTG chr2 60493856 60493877 60493861 60493856 -
ccatggccaagctgatgaggat

SEQ ID NO: 220651 - DNA, 22 bp, Artificial Sequence
  Synthetic oligonucleotide; CTG chr2 60493842 60493863 60493847 60493842 -
atgaggatgggggagggggagg

SEQ ID NO: 220652 - DNA, 22 bp, Artificial Sequence
  Synthetic oligonucleotide; CTT chr2 60493807 60493828 60493812 60493807 -
aatttcctgcactgaagctttg

SEQ ID NO: 220653 - DNA, 22 bp, Artificial Sequence
  Synthetic oligonucleotide; TTA chr2 60493806 60493827 60493811 60493806 -
atttcctgcactgaagctttgc

SEQ ID NO: 220654 - DNA, 22 bp, Artificial Sequence
  Synthetic oligonucleotide; TTT chr2 60493802 60493823 60493807 60493802 -
cctgcactgaagctttgctgtc

SEQ ID NO: 220655 - DNA, 22 bp, Artificial Sequence
  Synthetic oligonucleotide; TTC chr2 60493801 60493822 60493806 60493801 -
ctgcactgaagctttgctgtcc

SEQ ID NO: 220656 - DNA, 22 bp, Artificial Sequence
  Synthetic oligonucleotide; CTG chr2 60493798 60493819 60493803 60493798 -
cactgaagctttgctgtccaca

SEQ ID NO: 220657 - DNA, 22 bp, Artificial Sequence
  Synthetic oligonucleotide; CTG chr2 60493793 60493814 60493798 60493793 -
aagctttgctgtccacagcact

SEQ ID NO: 220658 - DNA, 22 bp, Artificial Sequence
  Synthetic oligonucleotide; CTT chr2 60493787 60493808 60493792 60493787 -
tgctgtccacagcactgggcag

SEQ ID NO: 220659 - DNA, 22 bp, Artificial Sequence
  Synthetic oligonucleotide; TTT chr2 60493786 60493807 60493791 60493786 -
gctgtccacagcactgggcagc

SEQ ID NO: 220660 - DNA, 22 bp, Artificial Sequence
  Synthetic oligonucleotide; TTG chr2 60493785 60493806 60493790 60493785 -
ctgtccacagcactgggcagca

SEQ ID NO: 220661 - DNA, 22 bp, Artificial Sequence
  Synthetic oligonucleotide; CTG chr2 60493782 60493803 60493787 60493782 -
tccacagcactgggcagcagct

SEQ ID NO: 220662 - DNA, 22 bp, Artificial Sequence
  Synthetic oligonucleotide; CTG chr2 60493770 60493791 60493775 60493770 -
ggcagcagctgcctccctggag

SEQ ID NO: 220663 - DNA, 22 bp, Artificial Sequence
  Synthetic oligonucleotide; CTG chr2 60493759 60493780 60493764 60493759 -
cctccctggagtgttgtgtgag

SEQ ID NO: 220664 - DNA, 22 bp, Artificial Sequence
  Synthetic oligonucleotide; CTC chr2 60493755 60493776 60493760 60493755 -
cctggagtgttgtgtgagacct

SEQ ID NO: 220665 - DNA, 22 bp, Artificial Sequence
  Synthetic oligonucleotide; CTG chr2 60493751 60493772 60493756 60493751 -
gagtgttgtgtgagaccttgat

SEQ ID NO: 220666 - DNA, 22 bp, Artificial Sequence
  Synthetic oligonucleotide; TTG chr2 60493743 60493764 60493748 60493743 -
tgtgagaccttgatgctgtctt

SEQ ID NO: 220667 - DNA, 22 bp, Artificial Sequence
  Synthetic oligonucleotide; CTT chr2 60493732 60493753 60493737 60493732 -
gatgctgtctttcttcccaagg

SEQ ID NO: 220668 - DNA, 22 bp, Artificial Sequence
  Synthetic oligonucleotide; TTG chr2 60493731 60493752 60493736 60493731 -
atgctgtctttcttcccaaggc

SEQ ID NO: 220669 - DNA, 22 bp, Artificial Sequence
  Synthetic oligonucleotide; CTG chr2 60493725 60493746 60493730 60493725 -
tctttcttcccaaggcctttgg

SEQ ID NO: 220670 - DNA, 22 bp, Artificial Sequence
  Synthetic oligonucleotide; CTT chr2 60493721 60493742 60493726 60493721 -
tcttcccaaggcctttggcaag

SEQ ID NO: 220671 - DNA, 22 bp, Artificial Sequence
  Synthetic oligonucleotide; TTT chr2 60493720 60493741 60493725 60493720 -
cttcccaaggcctttggcaagg

SEQ ID NO: 220672 - DNA, 22 bp, Artificial Sequence
  Synthetic oligonucleotide; TTC chr2 60493719 60493740 60493724 60493719 -
ttcccaaggcctttggcaaggt

SEQ ID NO: 220673 - DNA, 22 bp, Artificial Sequence
  Synthetic oligonucleotide; CTT chr2 60493717 60493738 60493722 60493717 -
cccaaggcctttggcaaggtag

SEQ ID NO: 220674 - DNA, 22 bp, Artificial Sequence
  Synthetic oligonucleotide; TTC chr2 60493716 60493737 60493721 60493716 -
ccaaggcctttggcaaggtaga

SEQ ID NO: 220675 - DNA, 22 bp, Artificial Sequence
  Synthetic oligonucleotide; CTT chr2 60493706 60493727 60493711 60493706 -
tggcaaggtagaagtcatctcc

SEQ ID NO: 220676 - DNA, 22 bp, Artificial Sequence
  Synthetic oligonucleotide; TTT chr2 60493705 60493726 60493710 60493705 -
ggcaaggtagaagtcatctcct

SEQ ID NO: 220677 - DNA, 22 bp, Artificial Sequence
  Synthetic oligonucleotide; TTG chr2 60493704 60493725 60493709 60493704 -
gcaaggtagaagtcatctcctt

SEQ ID NO: 220678 - DNA, 22 bp, Artificial Sequence
  Synthetic oligonucleotide; CTC chr2 60493685 60493706 60493690 60493685 -
cttgactctccatgctgctaat

SEQ ID NO: 220679 - DNA, 22 bp, Artificial Sequence
  Synthetic oligonucleotide; CTT chr2 60493682 60493703 60493687 60493682 -
gactctccatgctgctaatggg

SEQ ID NO: 220680 - DNA, 22 bp, Artificial Sequence
  Synthetic oligonucleotide; TTG chr2 60493681 60493702 60493686 60493681 -
actctccatgctgctaatgggg

SEQ ID NO: 220681 - DNA, 22 bp, Artificial Sequence
  Synthetic oligonucleotide; CTC chr2 60493677 60493698 60493682 60493677 -
tccatgctgctaatgggggagg

SEQ ID NO: 220682 - DNA, 22 bp, Artificial Sequence
  Synthetic oligonucleotide; CTC chr2 60493675 60493696 60493680 60493675 -
catgctgctaatgggggaggtc

SEQ ID NO: 220683 - DNA, 22 bp, Artificial Sequence
  Synthetic oligonucleotide; CTG chr2 60493668 60493689 60493673 60493668 -
ctaatgggggaggtcaactaag

SEQ ID NO: 220684 - DNA, 22 bp, Artificial Sequence
  Synthetic oligonucleotide; CTA chr2 60493665 60493686 60493670 60493665 -
atgggggaggtcaactaagtcc

SEQ ID NO: 220685 - DNA, 22 bp, Artificial Sequence
  Synthetic oligonucleotide; CTA chr2 60493648 60493669 60493653 60493648 -
agtccatttctgagctagtggg

SEQ ID NO: 220686 - DNA, 22 bp, Artificial Sequence
  Synthetic oligonucleotide; TTT chr2 60493639 60493660 60493644 60493639 -
ctgagctagtgggggctcttag

SEQ ID NO: 220687 - DNA, 22 bp, Artificial Sequence
  Synthetic oligonucleotide; TTC chr2 60493638 60493659 60493643 60493638 -
tgagctagtgggggctcttagg

SEQ ID NO: 220688 - DNA, 22 bp, Artificial Sequence
  Synthetic oligonucleotide; CTG chr2 60493636 60493657 60493641 60493636 -
agctagtgggggctcttaggac

SEQ ID NO: 220689 - DNA, 22 bp, Artificial Sequence
  Synthetic oligonucleotide; CTA chr2 60493631 60493652 60493636 60493631 -
gtgggggctcttaggactccga

SEQ ID NO: 220690 - DNA, 22 bp, Artificial Sequence
  Synthetic oligonucleotide; CTC chr2 60493621 60493642 60493626 60493621 -
ttaggactccgaacaccacact

SEQ ID NO: 220691 - DNA, 22 bp, Artificial Sequence
  Synthetic oligonucleotide; CTT chr2 60493619 60493640 60493624 60493619 -
aggactccgaacaccacactta

SEQ ID NO: 220692 - DNA, 22 bp, Artificial Sequence
  Synthetic oligonucleotide; TTA chr2 60493618 60493639 60493623 60493618 -
ggactccgaacaccacacttaa

SEQ ID NO: 220693 - DNA, 22 bp, Artificial Sequence
  Synthetic oligonucleotide; CTC chr2 60493612 60493633 60493617 60493612 -
cgaacaccacacttaagttatc

SEQ ID NO: 220694 - DNA, 22 bp, Artificial Sequence
  Synthetic oligonucleotide; CTT chr2 60493598 60493619 60493603 60493598 -
aagttatctctgacccagagtc

SEQ ID NO: 220695 - DNA, 22 bp, Artificial Sequence
  Synthetic oligonucleotide; TTA chr2 60493597 60493618 60493602 60493597 -
agttatctctgacccagagtcc

SEQ ID NO: 220696 - DNA, 22 bp, Artificial Sequence
  Synthetic oligonucleotide; TTA chr2 60493592 60493613 60493597 60493592 -
tctctgacccagagtccaattt

SEQ ID NO: 220697 - DNA, 22 bp, Artificial Sequence
  Synthetic oligonucleotide; CTC chr2 60493588 60493609 60493593 60493588 -
tgacccagagtccaatttattt

SEQ ID NO: 220698 - DNA, 22 bp, Artificial Sequence
  Synthetic oligonucleotide; CTG chr2 60493586 60493607 60493591 60493586 -
acccagagtccaatttatttgg

SEQ ID NO: 220699 - DNA, 22 bp, Artificial Sequence
  Synthetic oligonucleotide; TTT chr2 60493570 60493591 60493575 60493570 -
atttggcctgattcaaatgaat

SEQ ID NO: 220700 - DNA, 22 bp, Artificial Sequence
  Synthetic oligonucleotide; TTA chr2 60493569 60493590 60493574 60493569 -
tttggcctgattcaaatgaatg

SEQ ID NO: 220701 - DNA, 22 bp, Artificial Sequence
  Synthetic oligonucleotide; TTT chr2 60493566 60493587 60493571 60493566 -
ggcctgattcaaatgaatgccc

SEQ ID NO: 220702 - DNA, 22 bp, Artificial Sequence
  Synthetic oligonucleotide; TTG chr2 60493565 60493586 60493570 60493565 -
gcctgattcaaatgaatgccca

SEQ ID NO: 220703 - DNA, 22 bp, Artificial Sequence
  Synthetic oligonucleotide; CTG chr2 60493560 60493581 60493565 60493560 -
attcaaatgaatgcccatttta

SEQ ID NO: 220704 - DNA, 22 bp, Artificial Sequence
  Synthetic oligonucleotide; TTC chr2 60493556 60493577 60493561 60493556 -
aaatgaatgcccattttaagaa

SEQ ID NO: 220705 - DNA, 22 bp, Artificial Sequence
  Synthetic oligonucleotide; TTT chr2 60493540 60493561 60493545 60493540 -
taagaatgttttggggtctctt

SEQ ID NO: 220706 - DNA, 22 bp, Artificial Sequence
  Synthetic oligonucleotide; TTT chr2 60493539 60493560 60493544 60493539 -
aagaatgttttggggtctcttc

SEQ ID NO: 220707 - DNA, 22 bp, Artificial Sequence
  Synthetic oligonucleotide; TTA chr2 60493538 60493559 60493543 60493538 -
agaatgttttggggtctcttcc

SEQ ID NO: 220708 - DNA, 22 bp, Artificial Sequence
  Synthetic oligonucleotide; TTT chr2 60493529 60493550 60493534 60493529 -
tggggtctcttcccatcatttc

SEQ ID NO: 220709 - DNA, 22 bp, Artificial Sequence
  Synthetic oligonucleotide; TTT chr2 60493528 60493549 60493533 60493528 -
ggggtctcttcccatcatttcc

SEQ ID NO: 220710 - DNA, 22 bp, Artificial Sequence
  Synthetic oligonucleotide; TTG chr2 60493527 60493548 60493532 60493527 -
gggtctcttcccatcatttcct

SEQ ID NO: 220711 - DNA, 22 bp, Artificial Sequence
  Synthetic oligonucleotide; CTC chr2 60493520 60493541 60493525 60493520 -
ttcccatcatttccttagtgta

SEQ ID NO: 220712 - DNA, 22 bp, Artificial Sequence
  Synthetic oligonucleotide; CTT chr2 60493518 60493539 60493523 60493518 -
cccatcatttccttagtgtagt

SEQ ID NO: 220713 - DNA, 22 bp, Artificial Sequence
  Synthetic oligonucleotide; TTC chr2 60493517 60493538 60493522 60493517 -
ccatcatttccttagtgtagtg

SEQ ID NO: 220714 - DNA, 22 bp, Artificial Sequence
  Synthetic oligonucleotide; TTT chr2 60493508 60493529 60493513 60493508 -
ccttagtgtagtggagaggttt

SEQ ID NO: 220715 - DNA, 22 bp, Artificial Sequence
  Synthetic oligonucleotide; TTC chr2 60493507 60493528 60493512 60493507 -
cttagtgtagtggagaggtttc

SEQ ID NO: 220716 - DNA, 22 bp, Artificial Sequence
  Synthetic oligonucleotide; CTT chr2 60493504 60493525 60493509 60493504 -
agtgtagtggagaggtttctat

SEQ ID NO: 220717 - DNA, 22 bp, Artificial Sequence
  Synthetic oligonucleotide; TTA chr2 60493503 60493524 60493508 60493503 -
gtgtagtggagaggtttctatt

SEQ ID NO: 220718 - DNA, 22 bp, Artificial Sequence
  Synthetic oligonucleotide; TTT chr2 60493486 60493507 60493491 60493486 -
ctattcggaataggatgacatt

SEQ ID NO: 220719 - DNA, 22 bp, Artificial Sequence
  Synthetic oligonucleotide; TTC chr2 60493485 60493506 60493490 60493485 -
tattcggaataggatgacattt

SEQ ID NO: 220720 - DNA, 22 bp, Artificial Sequence
  Synthetic oligonucleotide; CTA chr2 60493483 60493504 60493488 60493483 -
ttcggaataggatgacatttgg

SEQ ID NO: 220721 - DNA, 22 bp, Artificial Sequence
  Synthetic oligonucleotide; TTC chr2 60493480 60493501 60493485 60493480 -
ggaataggatgacatttggtag

SEQ ID NO: 220722 - DNA, 22 bp, Artificial Sequence
  Synthetic oligonucleotide; TTT chr2 60493463 60493484 60493468 60493463 -
ggtagctgagccaaacagatag

SEQ ID NO: 220723 - DNA, 22 bp, Artificial Sequence
  Synthetic oligonucleotide; TTG chr2 60493462 60493483 60493467 60493462 -
gtagctgagccaaacagatagc

SEQ ID NO: 220724 - DNA, 22 bp, Artificial Sequence
  Synthetic oligonucleotide; CTG chr2 60493455 60493476 60493460 60493455 -
agccaaacagatagctgggata

SEQ ID NO: 220725 - DNA, 22 bp, Artificial Sequence
  Synthetic oligonucleotide; CTG chr2 60493438 60493459 60493443 60493438 -
ggatatagggtttggagttgaa

SEQ ID NO: 220726 - DNA, 22 bp, Artificial Sequence
  Synthetic oligonucleotide; TTT chr2 60493425 60493446 60493430 60493425 -
ggagttgaactctccagggaat

SEQ ID NO: 220727 - DNA, 22 bp, Artificial Sequence
  Synthetic oligonucleotide; TTG chr2 60493424 60493445 60493429 60493424 -
gagttgaactctccagggaatg

SEQ ID NO: 220728 - DNA, 22 bp, Artificial Sequence
  Synthetic oligonucleotide; TTG chr2 60493418 60493439 60493423 60493418 -
aactctccagggaatggggtgg

SEQ ID NO: 220729 - DNA, 22 bp, Artificial Sequence
  Synthetic oligonucleotide; CTC chr2 60493413 60493434 60493418 60493413 -
tccagggaatggggtgggaggg

SEQ ID NO: 220730 - DNA, 22 bp, Artificial Sequence
  Synthetic oligonucleotide; CTC chr2 60493411 60493432 60493416 60493411 -
cagggaatggggtgggaggggg

SEQ ID NO: 220731 - DNA, 22 bp, Artificial Sequence
  Synthetic oligonucleotide; CTG chr2 60493381 60493402 60493386 60493381 -
gaggatgacaaaatgagggctc

SEQ ID NO: 220732 - DNA, 22 bp, Artificial Sequence
  Synthetic oligonucleotide; CTC chr2 60493359 60493380 60493364 60493359 -
cctggactcaaactcaaaacct

SEQ ID NO: 220733 - DNA, 22 bp, Artificial Sequence
  Synthetic oligonucleotide; CTG chr2 60493355 60493376 60493360 60493355 -
gactcaaactcaaaaccttttc

SEQ ID NO: 220734 - DNA, 22 bp, Artificial Sequence
  Synthetic oligonucleotide; CTC chr2 60493350 60493371 60493355 60493350 -
aaactcaaaaccttttctgtgt

SEQ ID NO: 220735 - DNA, 22 bp, Artificial Sequence
  Synthetic oligonucleotide; CTC chr2 60493344 60493365 60493349 60493344 -
aaaaccttttctgtgttctcga

SEQ ID NO: 220736 - DNA, 22 bp, Artificial Sequence
  Synthetic oligonucleotide; CTT chr2 60493336 60493357 60493341 60493336 -
ttctgtgttctcgaaatgcctt

SEQ ID NO: 220737 - DNA, 22 bp, Artificial Sequence
  Synthetic oligonucleotide; TTT chr2 60493335 60493356 60493340 60493335 -
tctgtgttctcgaaatgcctta

SEQ ID NO: 220738 - DNA, 22 bp, Artificial Sequence
  Synthetic oligonucleotide; TTT chr2 60493334 60493355 60493339 60493334 -
ctgtgttctcgaaatgccttag

SEQ ID NO: 220739 - DNA, 22 bp, Artificial Sequence
  Synthetic oligonucleotide; TTC chr2 60493333 60493354 60493338 60493333 -
tgtgttctcgaaatgccttaga

SEQ ID NO: 220740 - DNA, 22 bp, Artificial Sequence
  Synthetic oligonucleotide; CTG chr2 60493331 60493352 60493336 60493331 -
tgttctcgaaatgccttagatg

SEQ ID NO: 220741 - DNA, 22 bp, Artificial Sequence
  Synthetic oligonucleotide; TTC chr2 60493326 60493347 60493331 60493326 -
tcgaaatgccttagatgtttac

SEQ ID NO: 220742 - DNA, 22 bp, Artificial Sequence
  Synthetic oligonucleotide; CTC chr2 60493324 60493345 60493329 60493324 -
gaaatgccttagatgtttacct

SEQ ID NO: 220743 - DNA, 22 bp, Artificial Sequence
  Synthetic oligonucleotide; CTT chr2 60493314 60493335 60493319 60493314 -
agatgtttacctaagagaaatg

SEQ ID NO: 220744 - DNA, 22 bp, Artificial Sequence
  Synthetic oligonucleotide; TTA chr2 60493313 60493334 60493318 60493313 -
gatgtttacctaagagaaatgt

SEQ ID NO: 220745 - DNA, 22 bp, Artificial Sequence
  Synthetic oligonucleotide; TTT chr2 60493306 60493327 60493311 60493306 -
acctaagagaaatgtagacata

SEQ ID NO: 220746 - DNA, 22 bp, Artificial Sequence
  Synthetic oligonucleotide; TTA chr2 60493305 60493326 60493310 60493305 -
cctaagagaaatgtagacatac

SEQ ID NO: 220747 - DNA, 22 bp, Artificial Sequence
  Synthetic oligonucleotide; CTA chr2 60493301 60493322 60493306 60493301 -
agagaaatgtagacatacattc

SEQ ID NO: 220748 - DNA, 22 bp, Artificial Sequence
  Synthetic oligonucleotide; TTC chr2 60493279 60493300 60493284 60493279 -
ctataaacacatctacacagtg

SEQ ID NO: 220749 - DNA, 22 bp, Artificial Sequence
  Synthetic oligonucleotide; CTA chr2 60493276 60493297 60493281 60493276 -
taaacacatctacacagtgtcc

SEQ ID NO: 220750 - DNA, 22 bp, Artificial Sequence
  Synthetic oligonucleotide; CTA chr2 60493264 60493285 60493269 60493264 -
cacagtgtccattgtagcactg

SEQ ID NO: 220751 - DNA, 22 bp, Artificial Sequence
  Synthetic oligonucleotide; TTG chr2 60493250 60493271 60493255 60493250 -
tagcactgttcatagtggtcaa

SEQ ID NO: 220752 - DNA, 22 bp, Artificial Sequence
  Synthetic oligonucleotide; CTG chr2 60493242 60493263 60493247 60493242 -
ttcatagtggtcaaaaagtggt

SEQ ID NO: 220753 - DNA, 22 bp, Artificial Sequence
  Synthetic oligonucleotide; TTC chr2 60493239 60493260 60493244 60493239 -
atagtggtcaaaaagtggtcac

SEQ ID NO: 220754 - DNA, 22 bp, Artificial Sequence
  Synthetic oligonucleotide; TTG chr2 60493192 60493213 60493197 60493192 -
aatggataaacgccctatggtg

SEQ ID NO: 220755 - DNA, 22 bp, Artificial Sequence
  Synthetic oligonucleotide; CTA chr2 60493175 60493196 60493180 60493175 -
tggtggaatacaactcaacagt

SEQ ID NO: 220756 - DNA, 22 bp, Artificial Sequence
  Synthetic oligonucleotide; CTC chr2 60493159 60493180 60493164 60493159 -
aacagtagaagaatgaaagagt

SEQ ID NO: 220757 - DNA, 22 bp, Artificial Sequence
  Synthetic oligonucleotide; CTC chr2 60493128 60493149 60493133 60493128 -
cacaccatggatgaatcccaga

SEQ ID NO: 220758 - DNA, 22 bp, Artificial Sequence
  Synthetic oligonucleotide; TTC chr2 60493099 60493120 60493104 60493099 -
tgctctgtggaagaaattaaac

SEQ ID NO: 220759 - DNA, 22 bp, Artificial Sequence
  Synthetic oligonucleotide; CTG chr2 60493097 60493118 60493102 60493097 -
ctctgtggaagaaattaaacac

SEQ ID NO: 220760 - DNA, 22 bp, Artificial Sequence
  Synthetic oligonucleotide; CTC chr2 60493094 60493115 60493099 60493094 -
tgtggaagaaattaaacacaaa

SEQ ID NO: 220761 - DNA, 22 bp, Artificial Sequence
  Synthetic oligonucleotide; CTG chr2 60493092 60493113 60493097 60493092 -
tggaagaaattaaacacaaaag

SEQ ID NO: 220762 - DNA, 22 bp, Artificial Sequence
  Synthetic oligonucleotide; TTA chr2 60493080 60493101 60493085 60493080 -
aacacaaaagacgatatcctgt

SEQ ID NO: 220763 - DNA, 22 bp, Artificial Sequence
  Synthetic oligonucleotide; CTG chr2 60493059 60493080 60493064 60493059 -
tatgagtccatttgtaacaaat

SEQ ID NO: 220764 - DNA, 22 bp, Artificial Sequence
  Synthetic oligonucleotide; TTT chr2 60493046 60493067 60493051 60493046 -
gtaacaaattctagaattctca

SEQ ID NO: 220765 - DNA, 22 bp, Artificial Sequence
  Synthetic oligonucleotide; TTG chr2 60493045 60493066 60493050 60493045 -
taacaaattctagaattctcaa

SEQ ID NO: 220766 - DNA, 22 bp, Artificial Sequence
  Synthetic oligonucleotide; TTC chr2 60493035 60493056 60493040 60493035 -
tagaattctcaacactgtggtg

SEQ ID NO: 220767 - DNA, 22 bp, Artificial Sequence
  Synthetic oligonucleotide; CTA chr2 60493033 60493054 60493038 60493033 -
gaattctcaacactgtggtggt

SEQ ID NO: 220768 - DNA, 22 bp, Artificial Sequence
  Synthetic oligonucleotide; TTC chr2 60493027 60493048 60493032 60493027 -
tcaacactgtggtggtaggtgg

SEQ ID NO: 220769 - DNA, 22 bp, Artificial Sequence
  Synthetic oligonucleotide; CTC chr2 60493025 60493046 60493030 60493025 -
aacactgtggtggtaggtgggg

SEQ ID NO: 220770 - DNA, 22 bp, Artificial Sequence
  Synthetic oligonucleotide; CTG chr2 60493018 60493039 60493023 60493018 -
tggtggtaggtgggggttcagt

SEQ ID NO: 220771 - DNA, 22 bp, Artificial Sequence
  Synthetic oligonucleotide; TTC chr2 60492999 60493020 60493004 60492999 -
agtggttagaaggaaggggtca

SEQ ID NO: 220772 - DNA, 22 bp, Artificial Sequence
  Synthetic oligonucleotide; TTA chr2 60492991 60493012 60492996 60492991 -
gaaggaaggggtcagagggtta

SEQ ID NO: 220773 - DNA, 22 bp, Artificial Sequence
  Synthetic oligonucleotide; TTA chr2 60492969 60492990 60492974 60492969 -
gggaaggggattgacagcaaag

SEQ ID NO: 220774 - DNA, 22 bp, Artificial Sequence
  Synthetic oligonucleotide; TTG chr2 60492956 60492977 60492961 60492956 -
acagcaaaggggcatgaggggg

SEQ ID NO: 220775 - DNA, 22 bp, Artificial Sequence
  Synthetic oligonucleotide; CTT chr2 60492931 60492952 60492936 60492931 -
tctagactggtggacgtgttct

SEQ ID NO: 220776 - DNA, 22 bp, Artificial Sequence
  Synthetic oligonucleotide; TTT chr2 60492930 60492951 60492935 60492930 -
ctagactggtggacgtgttctg

SEQ ID NO: 220777 - DNA, 22 bp, Artificial Sequence
  Synthetic oligonucleotide; TTC chr2 60492929 60492950 60492934 60492929 -
tagactggtggacgtgttctgt

SEQ ID NO: 220778 - DNA, 22 bp, Artificial Sequence
  Synthetic oligonucleotide; CTA chr2 60492927 60492948 60492932 60492927 -
gactggtggacgtgttctgtat

SEQ ID NO: 220779 - DNA, 22 bp, Artificial Sequence
  Synthetic oligonucleotide; CTG chr2 60492922 60492943 60492927 60492922 -
gtggacgtgttctgtatcttga

SEQ ID NO: 220780 - DNA, 22 bp, Artificial Sequence
  Synthetic oligonucleotide; TTC chr2 60492910 60492931 60492915 60492910 -
tgtatcttgattttggtggagg

SEQ ID NO: 220781 - DNA, 22 bp, Artificial Sequence
  Synthetic oligonucleotide; CTG chr2 60492908 60492929 60492913 60492908 -
tatcttgattttggtggaggcc

SEQ ID NO: 220782 - DNA, 22 bp, Artificial Sequence
  Synthetic oligonucleotide; CTT chr2 60492902 60492923 60492907 60492902 -
gattttggtggaggccacacag

SEQ ID NO: 220783 - DNA, 22 bp, Artificial Sequence
  Synthetic oligonucleotide; TTG chr2 60492901 60492922 60492906 60492901 -
attttggtggaggccacacagc

SEQ ID NO: 220784 - DNA, 22 bp, Artificial Sequence
  Synthetic oligonucleotide; TTT chr2 60492897 60492918 60492902 60492897 -
tggtggaggccacacagctgta

SEQ ID NO: 220785 - DNA, 22 bp, Artificial Sequence
  Synthetic oligonucleotide; TTT chr2 60492896 60492917 60492901 60492896 -
ggtggaggccacacagctgtat

SEQ ID NO: 220786 - DNA, 22 bp, Artificial Sequence
  Synthetic oligonucleotide; TTG chr2 60492895 60492916 60492900 60492895 -
gtggaggccacacagctgtata

SEQ ID NO: 220787 - DNA, 22 bp, Artificial Sequence
  Synthetic oligonucleotide; CTG chr2 60492877 60492898 60492882 60492877 -
tatacaactggcaaattgaatc

SEQ ID NO: 220788 - DNA, 22 bp, Artificial Sequence
  Synthetic oligonucleotide; CTG chr2 60492867 60492888 60492872 60492867 -
gcaaattgaatccaactgtaca

SEQ ID NO: 220789 - DNA, 22 bp, Artificial Sequence
  Synthetic oligonucleotide; TTG chr2 60492859 60492880 60492864 60492859 -
aatccaactgtacacttaaaat

SEQ ID NO: 220790 - DNA, 22 bp, Artificial Sequence
  Synthetic oligonucleotide; CTG chr2 60492849 60492870 60492854 60492849 -
tacacttaaaatgaatgacttt

SEQ ID NO: 220791 - DNA, 22 bp, Artificial Sequence
  Synthetic oligonucleotide; CTT chr2 60492842 60492863 60492847 60492842 -
aaaatgaatgacttttgttgta

SEQ ID NO: 220792 - DNA, 22 bp, Artificial Sequence
  Synthetic oligonucleotide; TTA chr2 60492841 60492862 60492846 60492841 -
aaatgaatgacttttgttgtat

SEQ ID NO: 220793 - DNA, 22 bp, Artificial Sequence
  Synthetic oligonucleotide; CTT chr2 60492828 60492849 60492833 60492828 -
ttgttgtatgtaaagtatacct

SEQ ID NO: 220794 - DNA, 22 bp, Artificial Sequence
  Synthetic oligonucleotide; TTT chr2 60492827 60492848 60492832 60492827 -
tgttgtatgtaaagtatacctt

SEQ ID NO: 220795 - DNA, 22 bp, Artificial Sequence
  Synthetic oligonucleotide; TTT chr2 60492826 60492847 60492831 60492826 -
gttgtatgtaaagtatacctta

SEQ ID NO: 220796 - DNA, 22 bp, Artificial Sequence
  Synthetic oligonucleotide; TTG chr2 60492825 60492846 60492830 60492825 -
ttgtatgtaaagtataccttaa

SEQ ID NO: 220797 - DNA, 22 bp, Artificial Sequence
  Synthetic oligonucleotide; TTG chr2 60492822 60492843 60492827 60492822 -
tatgtaaagtataccttaataa

SEQ ID NO: 220798 - DNA, 22 bp, Artificial Sequence
  Synthetic oligonucleotide; CTT chr2 60492805 60492826 60492810 60492805 -
aataaagctaaagcgaaacaaa

SEQ ID NO: 220799 - DNA, 22 bp, Artificial Sequence
  Synthetic oligonucleotide; TTA chr2 60492804 60492825 60492809 60492804 -
ataaagctaaagcgaaacaaaa

SEQ ID NO: 220800 - DNA, 22 bp, Artificial Sequence
  Synthetic oligonucleotide; CTA chr2 60492795 60492816 60492800 60492795 -
aagcgaaacaaaacaaaacacc

SEQ ID NO: 220801 - DNA, 22 bp, Artificial Sequence
  Synthetic oligonucleotide; CTG chr2 60492765 60492786 60492770 60492765 -
gagtggaaccaagtctgtctgt

SEQ ID NO: 220802 - DNA, 22 bp, Artificial Sequence
  Synthetic oligonucleotide; CTG chr2 60492748 60492769 60492753 60492748 -
tctgtaacctttaactgtttgg

SEQ ID NO: 220803 - DNA, 22 bp, Artificial Sequence
  Synthetic oligonucleotide; CTG chr2 60492744 60492765 60492749 60492744 -
taacctttaactgtttgggtct

SEQ ID NO: 220804 - DNA, 22 bp, Artificial Sequence
  Synthetic oligonucleotide; CTT chr2 60492737 60492758 60492742 60492737 -
taactgtttgggtctcctcaag

SEQ ID NO: 220805 - DNA, 22 bp, Artificial Sequence
  Synthetic oligonucleotide; TTT chr2 60492736 60492757 60492741 60492736 -
aactgtttgggtctcctcaaga

SEQ ID NO: 220806 - DNA, 22 bp, Artificial Sequence
  Synthetic oligonucleotide; TTA chr2 60492735 60492756 60492740 60492735 -
actgtttgggtctcctcaagac

SEQ ID NO: 220807 - DNA, 22 bp, Artificial Sequence
  Synthetic oligonucleotide; CTG chr2 60492731 60492752 60492736 60492731 -
tttgggtctcctcaagactcta

SEQ ID NO: 220808 - DNA, 22 bp, Artificial Sequence
  Synthetic oligonucleotide; TTT chr2 60492728 60492749 60492733 60492728 -
gggtctcctcaagactctagcc

SEQ ID NO: 220809 - DNA, 22 bp, Artificial Sequence
  Synthetic oligonucleotide; TTG chr2 60492727 60492748 60492732 60492727 -
ggtctcctcaagactctagccg

SEQ ID NO: 220810 - DNA, 22 bp, Artificial Sequence
  Synthetic oligonucleotide; CTC chr2 60492721 60492742 60492726 60492721 -
ctcaagactctagccgtctttc

SEQ ID NO: 220811 - DNA, 22 bp, Artificial Sequence
  Synthetic oligonucleotide; CTC chr2 60492718 60492739 60492723 60492718 -
aagactctagccgtctttcagg

SEQ ID NO: 220812 - DNA, 22 bp, Artificial Sequence
  Synthetic oligonucleotide; CTC chr2 60492711 60492732 60492716 60492711 -
tagccgtctttcagggtagcac

SEQ ID NO: 220813 - DNA, 22 bp, Artificial Sequence
  Synthetic oligonucleotide; CTA chr2 60492709 60492730 60492714 60492709 -
gccgtctttcagggtagcacca

SEQ ID NO: 220814 - DNA, 22 bp, Artificial Sequence
  Synthetic oligonucleotide; CTT chr2 60492701 60492722 60492706 60492701 -
tcagggtagcaccaaagtacat

SEQ ID NO: 220815 - DNA, 22 bp, Artificial Sequence
  Synthetic oligonucleotide; TTT chr2 60492700 60492721 60492705 60492700 -
cagggtagcaccaaagtacatt

SEQ ID NO: 220816 - DNA, 22 bp, Artificial Sequence
  Synthetic oligonucleotide; TTC chr2 60492699 60492720 60492704 60492699 -
agggtagcaccaaagtacattt

SEQ ID NO: 220817 - DNA, 22 bp, Artificial Sequence
  Synthetic oligonucleotide; TTT chr2 60492677 60492698 60492682 60492677 -
cagggaaatgagaatgcccttt

SEQ ID NO: 220818 - DNA, 22 bp, Artificial Sequence
  Synthetic oligonucleotide; TTC chr2 60492676 60492697 60492681 60492676 -
agggaaatgagaatgccctttg

SEQ ID NO: 220819 - DNA, 22 bp, Artificial Sequence
  Synthetic oligonucleotide; CTT chr2 60492656 60492677 60492661 60492656 -
tgtattctgagattttatagaa

SEQ ID NO: 220820 - DNA, 22 bp, Artificial Sequence
  Synthetic oligonucleotide; TTT chr2 60492655 60492676 60492660 60492655 -
gtattctgagattttatagaag

SEQ ID NO: 220821 - DNA, 22 bp, Artificial Sequence
  Synthetic oligonucleotide; TTG chr2 60492654 60492675 60492659 60492654 -
tattctgagattttatagaagt

SEQ ID NO: 220822 - DNA, 22 bp, Artificial Sequence
  Synthetic oligonucleotide; TTC chr2 60492649 60492670 60492654 60492649 -
tgagattttatagaagttggta

SEQ ID NO: 220823 - DNA, 22 bp, Artificial Sequence
  Synthetic oligonucleotide; CTG chr2 60492647 60492668 60492652 60492647 -
agattttatagaagttggtaat

SEQ ID NO: 220824 - DNA, 22 bp, Artificial Sequence
  Synthetic oligonucleotide; TTT chr2 60492641 60492662 60492646 60492641 -
tatagaagttggtaatgacaga

SEQ ID NO: 220825 - DNA, 22 bp, Artificial Sequence
  Synthetic oligonucleotide; TTT chr2 60492640 60492661 60492645 60492640 -
atagaagttggtaatgacagag

SEQ ID NO: 220826 - DNA, 22 bp, Artificial Sequence
  Synthetic oligonucleotide; TTA chr2 60492639 60492660 60492644 60492639 -
tagaagttggtaatgacagaga

SEQ ID NO: 220827 - DNA, 22 bp, Artificial Sequence
  Synthetic oligonucleotide; TTG chr2 60492630 60492651 60492635 60492630 -
gtaatgacagagagagagagag

SEQ ID NO: 220828 - DNA, 22 bp, Artificial Sequence
  Synthetic oligonucleotide; CTG chr2 60492582 60492603 60492587 60492582 -
agatggggttatccaccataag

SEQ ID NO: 220829 - DNA, 22 bp, Artificial Sequence
  Synthetic oligonucleotide; TTA chr2 60492571 60492592 60492576 60492571 -
tccaccataagcagagcatttg

SEQ ID NO: 220830 - DNA, 22 bp, Artificial Sequence
  Synthetic oligonucleotide; TTT chr2 60492550 60492571 60492555 60492550 -
gggtctgagaagcgcatgagta

SEQ ID NO: 220831 - DNA, 22 bp, Artificial Sequence
  Synthetic oligonucleotide; TTG chr2 60492549 60492570 60492554 60492549 -
ggtctgagaagcgcatgagtac

SEQ ID NO: 220832 - DNA, 22 bp, Artificial Sequence
  Synthetic oligonucleotide; CTG chr2 60492543 60492564 60492548 60492543 -
agaagcgcatgagtactggtga

SEQ ID NO: 220833 - DNA, 22 bp, Artificial Sequence
  Synthetic oligonucleotide; CTG chr2 60492525 60492546 60492530 60492525 -
gtgagtatgtgaggaaggagag

SEQ ID NO: 220834 - DNA, 22 bp, Artificial Sequence
  Synthetic oligonucleotide; CTG chr2 60492484 60492505 60492489 60492484 -
ttttcctagaattccagcaggc

SEQ ID NO: 220835 - DNA, 22 bp, Artificial Sequence
  Synthetic oligonucleotide; TTT chr2 60492481 60492502 60492486 60492481 -
tcctagaattccagcaggcttc

SEQ ID NO: 220836 - DNA, 22 bp, Artificial Sequence
  Synthetic oligonucleotide; TTT chr2 60492480 60492501 60492485 60492480 -
cctagaattccagcaggcttca

SEQ ID NO: 220837 - DNA, 22 bp, Artificial Sequence
  Synthetic oligonucleotide; TTC chr2 60492479 60492500 60492484 60492479 -
ctagaattccagcaggcttcaa

SEQ ID NO: 220838 - DNA, 22 bp, Artificial Sequence
  Synthetic oligonucleotide; CTA chr2 60492476 60492497 60492481 60492476 -
gaattccagcaggcttcaaaaa

SEQ ID NO: 220839 - DNA, 22 bp, Artificial Sequence
  Synthetic oligonucleotide; TTC chr2 60492470 60492491 60492475 60492470 -
cagcaggcttcaaaaagtaaaa

SEQ ID NO: 220840 - DNA, 22 bp, Artificial Sequence
  Synthetic oligonucleotide; CTT chr2 60492460 60492481 60492465 60492460 -
caaaaagtaaaaaggggaggga

SEQ ID NO: 220841 - DNA, 22 bp, Artificial Sequence
  Synthetic oligonucleotide; TTC chr2 60492459 60492480 60492464 60492459 -
aaaaagtaaaaaggggagggag

SEQ ID NO: 220842 - DNA, 22 bp, Artificial Sequence
  Synthetic oligonucleotide; CTA chr2 60492427 60492448 60492432 60492427 -
agtttttttcttccctagaaat

SEQ ID NO: 220843 - DNA, 22 bp, Artificial Sequence
  Synthetic oligonucleotide; TTT chr2 60492422 60492443 60492427 60492422 -
ttttcttccctagaaatacatt

SEQ ID NO: 220844 - DNA, 22 bp, Artificial Sequence
  Synthetic oligonucleotide; TTT chr2 60492421 60492442 60492426 60492421 -
tttcttccctagaaatacattt

SEQ ID NO: 220845 - DNA, 22 bp, Artificial Sequence
  Synthetic oligonucleotide; TTT chr2 60492420 60492441 60492425 60492420 -
ttcttccctagaaatacattta

SEQ ID NO: 220846 - DNA, 22 bp, Artificial Sequence
  Synthetic oligonucleotide; TTT chr2 60492419 60492440 60492424 60492419 -
tcttccctagaaatacatttat

SEQ ID NO: 220847 - DNA, 22 bp, Artificial Sequence
  Synthetic oligonucleotide; TTT chr2 60492418 60492439 60492423 60492418 -
cttccctagaaatacatttatt

SEQ ID NO: 220848 - DNA, 22 bp, Artificial Sequence
  Synthetic oligonucleotide; TTC chr2 60492417 60492438 60492422 60492417 -
ttccctagaaatacatttattc

SEQ ID NO: 220849 - DNA, 22 bp, Artificial Sequence
  Synthetic oligonucleotide; CTT chr2 60492415 60492436 60492420 60492415 -
ccctagaaatacatttattcta

SEQ ID NO: 220850 - DNA, 22 bp, Artificial Sequence
  Synthetic oligonucleotide; TTC chr2 60492414 60492435 60492419 60492414 -
cctagaaatacatttattctaa

SEQ ID NO: 220851 - DNA, 22 bp, Artificial Sequence
  Synthetic oligonucleotide; CTA chr2 60492410 60492431 60492415 60492410 -
gaaatacatttattctaaacat

SEQ ID NO: 220852 - DNA, 22 bp, Artificial Sequence
  Synthetic oligonucleotide; TTT chr2 60492399 60492420 60492404 60492399 -
attctaaacattagcccaatta

SEQ ID NO: 220853 - DNA, 22 bp, Artificial Sequence
  Synthetic oligonucleotide; TTA chr2 60492398 60492419 60492403 60492398 -
ttctaaacattagcccaattag

SEQ ID NO: 220854 - DNA, 22 bp, Artificial Sequence
  Synthetic oligonucleotide; TTC chr2 60492395 60492416 60492400 60492395 -
taaacattagcccaattagttg

SEQ ID NO: 220855 - DNA, 22 bp, Artificial Sequence
  Synthetic oligonucleotide; CTA chr2 60492393 60492414 60492398 60492393 -
aacattagcccaattagttgtc

SEQ ID NO: 220856 - DNA, 22 bp, Artificial Sequence
  Synthetic oligonucleotide; TTA chr2 60492386 60492407 60492391 60492386 -
gcccaattagttgtcttttgtt

SEQ ID NO: 220857 - DNA, 22 bp, Artificial Sequence
  Synthetic oligonucleotide; TTA chr2 60492377 60492398 60492382 60492377 -
gttgtcttttgtttgtttgttt

SEQ ID NO: 220858 - DNA, 22 bp, Artificial Sequence
  Synthetic oligonucleotide; TTG chr2 60492373 60492394 60492378 60492373 -
tcttttgtttgtttgtttgttt

SEQ ID NO: 220859 - DNA, 22 bp, Artificial Sequence
  Synthetic oligonucleotide; CTT chr2 60492369 60492390 60492374 60492369 -
ttgtttgtttgtttgtttgttt

SEQ ID NO: 220860 - DNA, 22 bp, Artificial Sequence
  Synthetic oligonucleotide; TTT chr2 60492368 60492389 60492373 60492368 -
tgtttgtttgtttgtttgtttt

SEQ ID NO: 220861 - DNA, 22 bp, Artificial Sequence
  Synthetic oligonucleotide; TTT chr2 60492367 60492388 60492372 60492367 -
gtttgtttgtttgtttgttttt

SEQ ID NO: 220862 - DNA, 22 bp, Artificial Sequence
  Synthetic oligonucleotide; TTG chr2 60492366 60492387 60492371 60492366 -
tttgtttgtttgtttgtttttg

SEQ ID NO: 220863 - DNA, 22 bp, Artificial Sequence
  Synthetic oligonucleotide; TTT chr2 60492363 60492384 60492368 60492363 -
gtttgtttgtttgtttttgaga

SEQ ID NO: 220864 - DNA, 22 bp, Artificial Sequence
  Synthetic oligonucleotide; TTG chr2 60492362 60492383 60492367 60492362 -
tttgtttgtttgtttttgagac

SEQ ID NO: 220865 - DNA, 22 bp, Artificial Sequence
  Synthetic oligonucleotide; TTT chr2 60492359 60492380 60492364 60492359 -
gtttgtttgtttttgagacagg

SEQ ID NO: 220866 - DNA, 22 bp, Artificial Sequence
  Synthetic oligonucleotide; TTG chr2 60492358 60492379 60492363 60492358 -
tttgtttgtttttgagacaggg

SEQ ID NO: 220867 - DNA, 22 bp, Artificial Sequence
  Synthetic oligonucleotide; TTT chr2 60492355 60492376 60492360 60492355 -
gtttgtttttgagacagggtct

SEQ ID NO: 220868 - DNA, 22 bp, Artificial Sequence
  Synthetic oligonucleotide; TTG chr2 60492354 60492375 60492359 60492354 -
tttgtttttgagacagggtctc

SEQ ID NO: 220869 - DNA, 22 bp, Artificial Sequence
  Synthetic oligonucleotide; TTT chr2 60492351 60492372 60492356 60492351 -
gtttttgagacagggtctcgct

SEQ ID NO: 220870 - DNA, 22 bp, Artificial Sequence
  Synthetic oligonucleotide; TTG chr2 60492350 60492371 60492355 60492350 -
tttttgagacagggtctcgctg

SEQ ID NO: 220871 - DNA, 22 bp, Artificial Sequence
  Synthetic oligonucleotide; TTT chr2 60492347 60492368 60492352 60492347 -
ttgagacagggtctcgctgtgt

SEQ ID NO: 220872 - DNA, 22 bp, Artificial Sequence
  Synthetic oligonucleotide; TTT chr2 60492346 60492367 60492351 60492346 -
tgagacagggtctcgctgtgtt

SEQ ID NO: 220873 - DNA, 22 bp, Artificial Sequence
  Synthetic oligonucleotide; TTT chr2 60492345 60492366 60492350 60492345 -
gagacagggtctcgctgtgttg

SEQ ID NO: 220874 - DNA, 22 bp, Artificial Sequence
  Synthetic oligonucleotide; TTG chr2 60492344 60492365 60492349 60492344 -
agacagggtctcgctgtgttgc

SEQ ID NO: 220875 - DNA, 22 bp, Artificial Sequence
  Synthetic oligonucleotide; CTC chr2 60492332 60492353 60492337 60492332 -
gctgtgttgcctaggctagagt

SEQ ID NO: 220876 - DNA, 22 bp, Artificial Sequence
  Synthetic oligonucleotide; CTG chr2 60492328 60492349 60492333 60492328 -
tgttgcctaggctagagtgtag

SEQ ID NO: 220877 - DNA, 22 bp, Artificial Sequence
  Synthetic oligonucleotide; TTG chr2 60492323 60492344 60492328 60492323 -
cctaggctagagtgtagtggca

SEQ ID NO: 220878 - DNA, 22 bp, Artificial Sequence
  Synthetic oligonucleotide; CTA chr2 60492319 60492340 60492324 60492319 -
ggctagagtgtagtggcatgtt

SEQ ID NO: 220879 - DNA, 22 bp, Artificial Sequence
  Synthetic oligonucleotide; CTA chr2 60492314 60492335 60492319 60492314 -
gagtgtagtggcatgttcatag

SEQ ID NO: 220880 - DNA, 22 bp, Artificial Sequence
  Synthetic oligonucleotide; TTC chr2 60492296 60492317 60492301 60492296 -
atagctcactgcagccttgatc

SEQ ID NO: 220881 - DNA, 22 bp, Artificial Sequence
  Synthetic oligonucleotide; CTC chr2 60492289 60492310 60492294 60492289 -
actgcagccttgatctcctagg

SEQ ID NO: 220882 - DNA, 22 bp, Artificial Sequence
  Synthetic oligonucleotide; CTG chr2 60492285 60492306 60492290 60492285 -
cagccttgatctcctaggctca

SEQ ID NO: 220883 - DNA, 22 bp, Artificial Sequence
  Synthetic oligonucleotide; CTT chr2 60492278 60492299 60492283 60492278 -
gatctcctaggctcaagccatc

SEQ ID NO: 220884 - DNA, 22 bp, Artificial Sequence
  Synthetic oligonucleotide; TTG chr2 60492277 60492298 60492282 60492277 -
atctcctaggctcaagccatcc

SEQ ID NO: 220885 - DNA, 22 bp, Artificial Sequence
  Synthetic oligonucleotide; CTC chr2 60492272 60492293 60492277 60492272 -
ctaggctcaagccatcctgtca

SEQ ID NO: 220886 - DNA, 22 bp, Artificial Sequence
  Synthetic oligonucleotide; CTA chr2 60492269 60492290 60492274 60492269 -
ggctcaagccatcctgtcacct

SEQ ID NO: 220887 - DNA, 22 bp, Artificial Sequence
  Synthetic oligonucleotide; CTC chr2 60492264 60492285 60492269 60492264 -
aagccatcctgtcacctcagcc

SEQ ID NO: 220888 - DNA, 22 bp, Artificial Sequence
  Synthetic oligonucleotide; CTG chr2 60492253 60492274 60492258 60492253 -
tcacctcagcctcctgagtagc

SEQ ID NO: 220889 - DNA, 22 bp, Artificial Sequence
  Synthetic oligonucleotide; CTC chr2 60492246 60492267 60492251 60492246 -
agcctcctgagtagctgggacg

SEQ ID NO: 220890 - DNA, 22 bp, Artificial Sequence
  Synthetic oligonucleotide; CTC chr2 60492240 60492261 60492245 60492240 -
ctgagtagctgggacgacaggt

SEQ ID NO: 220891 - DNA, 22 bp, Artificial Sequence
  Synthetic oligonucleotide; CTG chr2 60492237 60492258 60492242 60492237 -
agtagctgggacgacaggtgca

SEQ ID NO: 220892 - DNA, 22 bp, Artificial Sequence
  Synthetic oligonucleotide; CTG chr2 60492229 60492250 60492234 60492229 -
ggacgacaggtgcatgccacca

SEQ ID NO: 220893 - DNA, 22 bp, Artificial Sequence
  Synthetic oligonucleotide; CTG chr2 60492201 60492222 60492206 60492201 -
gctaattttgtagagatggagt

SEQ ID NO: 220894 - DNA, 22 bp, Artificial Sequence
  Synthetic oligonucleotide; CTA chr2 60492197 60492218 60492202 60492197 -
attttgtagagatggagtttct

SEQ ID NO: 220895 - DNA, 22 bp, Artificial Sequence
  Synthetic oligonucleotide; TTT chr2 60492193 60492214 60492198 60492193 -
tgtagagatggagtttctccct

SEQ ID NO: 220896 - DNA, 22 bp, Artificial Sequence
  Synthetic oligonucleotide; TTT chr2 60492192 60492213 60492197 60492192 -
gtagagatggagtttctccctg

SEQ ID NO: 220897 - DNA, 22 bp, Artificial Sequence
  Synthetic oligonucleotide; TTG chr2 60492191 60492212 60492196 60492191 -
tagagatggagtttctccctgt

SEQ ID NO: 220898 - DNA, 22 bp, Artificial Sequence
  Synthetic oligonucleotide; TTT chr2 60492177 60492198 60492182 60492177 -
ctccctgttgcccaggctggtc

SEQ ID NO: 220899 - DNA, 22 bp, Artificial Sequence
  Synthetic oligonucleotide; TTC chr2 60492176 60492197 60492181 60492176 -
tccctgttgcccaggctggtct

SEQ ID NO: 220900 - DNA, 22 bp, Artificial Sequence
  Synthetic oligonucleotide; CTC chr2 60492174 60492195 60492179 60492174 -
cctgttgcccaggctggtcttg

SEQ ID NO: 220901 - DNA, 22 bp, Artificial Sequence
  Synthetic oligonucleotide; CTG chr2 60492170 60492191 60492175 60492170 -
ttgcccaggctggtcttgaact

SEQ ID NO: 220902 - DNA, 22 bp, Artificial Sequence
  Synthetic oligonucleotide; TTG chr2 60492167 60492188 60492172 60492167 -
cccaggctggtcttgaactcct

SEQ ID NO: 220903 - DNA, 22 bp, Artificial Sequence
  Synthetic oligonucleotide; CTG chr2 60492158 60492179 60492163 60492158 -
gtcttgaactcctgggctccag

SEQ ID NO: 220904 - DNA, 22 bp, Artificial Sequence
  Synthetic oligonucleotide; CTT chr2 60492153 60492174 60492158 60492153 -
gaactcctgggctccagtgatc

SEQ ID NO: 220905 - DNA, 22 bp, Artificial Sequence
  Synthetic oligonucleotide; TTG chr2 60492152 60492173 60492157 60492152 -
aactcctgggctccagtgatcc

SEQ ID NO: 220906 - DNA, 22 bp, Artificial Sequence
  Synthetic oligonucleotide; CTC chr2 60492147 60492168 60492152 60492147 -
ctgggctccagtgatcctcctg

SEQ ID NO: 220907 - DNA, 22 bp, Artificial Sequence
  Synthetic oligonucleotide; CTG chr2 60492144 60492165 60492149 60492144 -
ggctccagtgatcctcctgcct

SEQ ID NO: 220908 - DNA, 22 bp, Artificial Sequence
  Synthetic oligonucleotide; CTC chr2 60492139 60492160 60492144 60492139 -
cagtgatcctcctgccttgacc

SEQ ID NO: 220909 - DNA, 22 bp, Artificial Sequence
  Synthetic oligonucleotide; CTC chr2 60492128 60492149 60492133 60492128 -
ctgccttgacctcccaaagtgc

SEQ ID NO: 220910 - DNA, 22 bp, Artificial Sequence
  Synthetic oligonucleotide; CTG chr2 60492125 60492146 60492130 60492125 -
ccttgacctcccaaagtgctgg

SEQ ID NO: 220911 - DNA, 22 bp, Artificial Sequence
  Synthetic oligonucleotide; CTT chr2 60492121 60492142 60492126 60492121 -
gacctcccaaagtgctgggatt

SEQ ID NO: 220912 - DNA, 22 bp, Artificial Sequence
  Synthetic oligonucleotide; TTG chr2 60492120 60492141 60492125 60492120 -
acctcccaaagtgctgggatta

SEQ ID NO: 220913 - DNA, 22 bp, Artificial Sequence
  Synthetic oligonucleotide; CTC chr2 60492115 60492136 60492120 60492115 -
ccaaagtgctgggattacaggc

SEQ ID NO: 220914 - DNA, 22 bp, Artificial Sequence
  Synthetic oligonucleotide; CTG chr2 60492104 60492125 60492109 60492104 -
ggattacaggcgagagccactg

SEQ ID NO: 220915 - DNA, 22 bp, Artificial Sequence
  Synthetic oligonucleotide; TTA chr2 60492098 60492119 60492103 60492098 -
caggcgagagccactgtgcctg

SEQ ID NO: 220916 - DNA, 22 bp, Artificial Sequence
  Synthetic oligonucleotide; CTG chr2 60492082 60492103 60492087 60492082 -
tgcctgtcaccaactcagtctt

SEQ ID NO: 220917 - DNA, 22 bp, Artificial Sequence
  Synthetic oligonucleotide; CTG chr2 60492076 60492097 60492081 60492076 -
tcaccaactcagtcttattcat

SEQ ID NO: 220918 - DNA, 22 bp, Artificial Sequence
  Synthetic oligonucleotide; CTC chr2 60492066 60492087 60492071 60492066 -
agtcttattcatcagtatgtct

SEQ ID NO: 220919 - DNA, 22 bp, Artificial Sequence
  Synthetic oligonucleotide; CTT chr2 60492060 60492081 60492065 60492060 -
attcatcagtatgtcttctcct

SEQ ID NO: 220920 - DNA, 22 bp, Artificial Sequence
  Synthetic oligonucleotide; TTA chr2 60492059 60492080 60492064 60492059 -
ttcatcagtatgtcttctcctt

SEQ ID NO: 220921 - DNA, 22 bp, Artificial Sequence
  Synthetic oligonucleotide; TTC chr2 60492056 60492077 60492061 60492056 -
atcagtatgtcttctccttaag

SEQ ID NO: 220922 - DNA, 22 bp, Artificial Sequence
  Synthetic oligonucleotide; CTT chr2 60492043 60492064 60492048 60492043 -
ctccttaagcggagatgctaac

SEQ ID NO: 220923 - DNA, 22 bp, Artificial Sequence
  Synthetic oligonucleotide; TTC chr2 60492042 60492063 60492047 60492042 -
tccttaagcggagatgctaaca

SEQ ID NO: 220924 - DNA, 22 bp, Artificial Sequence
  Synthetic oligonucleotide; CTC chr2 60492040 60492061 60492045 60492040 -
cttaagcggagatgctaacaat

SEQ ID NO: 220925 - DNA, 22 bp, Artificial Sequence
  Synthetic oligonucleotide; CTT chr2 60492037 60492058 60492042 60492037 -
aagcggagatgctaacaatgta

SEQ ID NO: 220926 - DNA, 22 bp, Artificial Sequence
  Synthetic oligonucleotide; TTA chr2 60492036 60492057 60492041 60492036 -
agcggagatgctaacaatgtag

SEQ ID NO: 220927 - DNA, 22 bp, Artificial Sequence
  Synthetic oligonucleotide; CTA chr2 60492023 60492044 60492028 60492023 -
acaatgtagcatctcctgtgct

SEQ ID NO: 220928 - DNA, 22 bp, Artificial Sequence
  Synthetic oligonucleotide; CTC chr2 60492008 60492029 60492013 60492008 -
ctgtgctgaattcctgtaaagt

SEQ ID NO: 220929 - DNA, 22 bp, Artificial Sequence
  Synthetic oligonucleotide; CTG chr2 60492005 60492026 60492010 60492005 -
tgctgaattcctgtaaagtgag

SEQ ID NO: 220930 - DNA, 22 bp, Artificial Sequence
  Synthetic oligonucleotide; CTG chr2 60492000 60492021 60492005 60492000 -
aattcctgtaaagtgagggttt

SEQ ID NO: 220931 - DNA, 22 bp, Artificial Sequence
  Synthetic oligonucleotide; TTC chr2 60491995 60492016 60492000 60491995 -
ctgtaaagtgagggtttttgtt

SEQ ID NO: 220932 - DNA, 22 bp, Artificial Sequence
  Synthetic oligonucleotide; CTG chr2 60491992 60492013 60491997 60491992 -
taaagtgagggtttttgttttt

SEQ ID NO: 220933 - DNA, 22 bp, Artificial Sequence
  Synthetic oligonucleotide; TTT chr2 60491978 60491999 60491983 60491978 -
ttgtttttcctacatccatctt

SEQ ID NO: 220934 - DNA, 22 bp, Artificial Sequence
  Synthetic oligonucleotide; TTT chr2 60491977 60491998 60491982 60491977 -
tgtttttcctacatccatcttc

SEQ ID NO: 220935 - DNA, 22 bp, Artificial Sequence
  Synthetic oligonucleotide; TTT chr2 60491976 60491997 60491981 60491976 -
gtttttcctacatccatcttcc

SEQ ID NO: 220936 - DNA, 22 bp, Artificial Sequence
  Synthetic oligonucleotide; TTG chr2 60491975 60491996 60491980 60491975 -
tttttcctacatccatcttcct

SEQ ID NO: 220937 - DNA, 22 bp, Artificial Sequence
  Synthetic oligonucleotide; TTT chr2 60491972 60491993 60491977 60491972 -
ttcctacatccatcttcctctc

SEQ ID NO: 220938 - DNA, 22 bp, Artificial Sequence
  Synthetic oligonucleotide; TTT chr2 60491971 60491992 60491976 60491971 -
tcctacatccatcttcctctcc

SEQ ID NO: 220939 - DNA, 22 bp, Artificial Sequence
  Synthetic oligonucleotide; TTT chr2 60491970 60491991 60491975 60491970 -
cctacatccatcttcctctcca

SEQ ID NO: 220940 - DNA, 22 bp, Artificial Sequence
  Synthetic oligonucleotide; TTC chr2 60491969 60491990 60491974 60491969 -
ctacatccatcttcctctccag

SEQ ID NO: 220941 - DNA, 22 bp, Artificial Sequence
  Synthetic oligonucleotide; CTA chr2 60491966 60491987 60491971 60491966 -
catccatcttcctctccagatt

SEQ ID NO: 220942 - DNA, 22 bp, Artificial Sequence
  Synthetic oligonucleotide; CTT chr2 60491956 60491977 60491961 60491956 -
cctctccagattccctctcaat

SEQ ID NO: 220943 - DNA, 22 bp, Artificial Sequence
  Synthetic oligonucleotide; TTC chr2 60491955 60491976 60491960 60491955 -
ctctccagattccctctcaatt

SEQ ID NO: 220944 - DNA, 22 bp, Artificial Sequence
  Synthetic oligonucleotide; CTC chr2 60491952 60491973 60491957 60491952 -
tccagattccctctcaatttcc

SEQ ID NO: 220945 - DNA, 22 bp, Artificial Sequence
  Synthetic oligonucleotide; CTC chr2 60491950 60491971 60491955 60491950 -
cagattccctctcaatttccaa

SEQ ID NO: 220946 - DNA, 22 bp, Artificial Sequence
  Synthetic oligonucleotide; TTC chr2 60491943 60491964 60491948 60491943 -
cctctcaatttccaaggtattt

SEQ ID NO: 220947 - DNA, 22 bp, Artificial Sequence
  Synthetic oligonucleotide; CTC chr2 60491939 60491960 60491944 60491939 -
tcaatttccaaggtatttagcg

SEQ ID NO: 220948 - DNA, 22 bp, Artificial Sequence
  Synthetic oligonucleotide; CTC chr2 60491937 60491958 60491942 60491937 -
aatttccaaggtatttagcgta

SEQ ID NO: 220949 - DNA, 22 bp, Artificial Sequence
  Synthetic oligonucleotide; TTT chr2 60491932 60491953 60491937 60491932 -
ccaaggtatttagcgtaaatgc

SEQ ID NO: 220950 - DNA, 22 bp, Artificial Sequence
  Synthetic oligonucleotide; TTC chr2 60491931 60491952 60491936 60491931 -
caaggtatttagcgtaaatgca

SEQ ID NO: 220951 - DNA, 22 bp, Artificial Sequence
  Synthetic oligonucleotide; TTT chr2 60491921 60491942 60491926 60491921 -
agcgtaaatgcaatatctgaac

SEQ ID NO: 220952 - DNA, 22 bp, Artificial Sequence
  Synthetic oligonucleotide; TTA chr2 60491920 60491941 60491925 60491920 -
gcgtaaatgcaatatctgaact

SEQ ID NO: 220953 - DNA, 22 bp, Artificial Sequence
  Synthetic oligonucleotide; CTG chr2 60491902 60491923 60491907 60491902 -
aacttcatttatttggcagatt

SEQ ID NO: 220954 - DNA, 22 bp, Artificial Sequence
  Synthetic oligonucleotide; CTT chr2 60491897 60491918 60491902 60491897 -
catttatttggcagatttgtgt

SEQ ID NO: 220955 - DNA, 22 bp, Artificial Sequence
  Synthetic oligonucleotide; TTC chr2 60491896 60491917 60491901 60491896 -
atttatttggcagatttgtgtg

SEQ ID NO: 220956 - DNA, 22 bp, Artificial Sequence
  Synthetic oligonucleotide; TTT chr2 60491892 60491913 60491897 60491892 -
atttggcagatttgtgtggact

SEQ ID NO: 220957 - DNA, 22 bp, Artificial Sequence
  Synthetic oligonucleotide; TTA chr2 60491891 60491912 60491896 60491891 -
tttggcagatttgtgtggactg

SEQ ID NO: 220958 - DNA, 22 bp, Artificial Sequence
  Synthetic oligonucleotide; TTT chr2 60491888 60491909 60491893 60491888 -
ggcagatttgtgtggactgcct

SEQ ID NO: 220959 - DNA, 22 bp, Artificial Sequence
  Synthetic oligonucleotide; TTG chr2 60491887 60491908 60491892 60491887 -
gcagatttgtgtggactgcctt

SEQ ID NO: 220960 - DNA, 22 bp, Artificial Sequence
  Synthetic oligonucleotide; TTT chr2 60491879 60491900 60491884 60491879 -
gtgtggactgccttttctgaac

SEQ ID NO: 220961 - DNA, 22 bp, Artificial Sequence
  Synthetic oligonucleotide; TTG chr2 60491878 60491899 60491883 60491878 -
tgtggactgccttttctgaacc

SEQ ID NO: 220962 - DNA, 22 bp, Artificial Sequence
  Synthetic oligonucleotide; CTG chr2 60491869 60491890 60491874 60491869 -
ccttttctgaacctatttgggt

SEQ ID NO: 220963 - DNA, 22 bp, Artificial Sequence
  Synthetic oligonucleotide; CTT chr2 60491865 60491886 60491870 60491865 -
ttctgaacctatttgggtgcta

SEQ ID NO: 220964 - DNA, 22 bp, Artificial Sequence
  Synthetic oligonucleotide; TTT chr2 60491864 60491885 60491869 60491864 -
tctgaacctatttgggtgctaa

SEQ ID NO: 220965 - DNA, 22 bp, Artificial Sequence
  Synthetic oligonucleotide; TTT chr2 60491863 60491884 60491868 60491863 -
ctgaacctatttgggtgctaag

SEQ ID NO: 220966 - DNA, 22 bp, Artificial Sequence
  Synthetic oligonucleotide; TTC chr2 60491862 60491883 60491867 60491862 -
tgaacctatttgggtgctaagg

SEQ ID NO: 220967 - DNA, 22 bp, Artificial Sequence
  Synthetic oligonucleotide; CTG chr2 60491860 60491881 60491865 60491860 -
aacctatttgggtgctaaggac

SEQ ID NO: 220968 - DNA, 22 bp, Artificial Sequence
  Synthetic oligonucleotide; CTA chr2 60491854 60491875 60491859 60491854 -
tttgggtgctaaggactgtatg

SEQ ID NO: 220969 - DNA, 22 bp, Artificial Sequence
  Synthetic oligonucleotide; TTT chr2 60491851 60491872 60491856 60491851 -
gggtgctaaggactgtatggat

SEQ ID NO: 220970 - DNA, 22 bp, Artificial Sequence
  Synthetic oligonucleotide; TTG chr2 60491850 60491871 60491855 60491850 -
ggtgctaaggactgtatggatt

SEQ ID NO: 220971 - DNA, 22 bp, Artificial Sequence
  Synthetic oligonucleotide; CTA chr2 60491843 60491864 60491848 60491843 -
aggactgtatggatttgggttc

SEQ ID NO: 220972 - DNA, 22 bp, Artificial Sequence
  Synthetic oligonucleotide; CTG chr2 60491836 60491857 60491841 60491836 -
tatggatttgggttcttaacat

SEQ ID NO: 220973 - DNA, 22 bp, Artificial Sequence
  Synthetic oligonucleotide; TTT chr2 60491827 60491848 60491832 60491827 -
gggttcttaacatggaaaacgt

SEQ ID NO: 220974 - DNA, 22 bp, Artificial Sequence
  Synthetic oligonucleotide; TTG chr2 60491826 60491847 60491831 60491826 -
ggttcttaacatggaaaacgtc

SEQ ID NO: 220975 - DNA, 22 bp, Artificial Sequence
  Synthetic oligonucleotide; TTC chr2 60491821 60491842 60491826 60491821 -
ttaacatggaaaacgtctgtgc

SEQ ID NO: 220976 - DNA, 22 bp, Artificial Sequence
  Synthetic oligonucleotide; CTT chr2 60491819 60491840 60491824 60491819 -
aacatggaaaacgtctgtgcct

SEQ ID NO: 220977 - DNA, 22 bp, Artificial Sequence
  Synthetic oligonucleotide; TTA chr2 60491818 60491839 60491823 60491818 -
acatggaaaacgtctgtgcctg

SEQ ID NO: 220978 - DNA, 22 bp, Artificial Sequence
  Synthetic oligonucleotide; CTG chr2 60491802 60491823 60491807 60491802 -
tgcctgcgtagtgttgggtcct

SEQ ID NO: 220979 - DNA, 22 bp, Artificial Sequence
  Synthetic oligonucleotide; CTG chr2 60491796 60491817 60491801 60491796 -
cgtagtgttgggtcctacctgg

SEQ ID NO: 220980 - DNA, 22 bp, Artificial Sequence
  Synthetic oligonucleotide; TTG chr2 60491786 60491807 60491791 60491786 -
ggtcctacctggccacttggct

SEQ ID NO: 220981 - DNA, 22 bp, Artificial Sequence
  Synthetic oligonucleotide; CTA chr2 60491779 60491800 60491784 60491779 -
cctggccacttggctctcaaca

SEQ ID NO: 220982 - DNA, 22 bp, Artificial Sequence
  Synthetic oligonucleotide; CTG chr2 60491775 60491796 60491780 60491775 -
gccacttggctctcaacacgga

SEQ ID NO: 220983 - DNA, 22 bp, Artificial Sequence
  Synthetic oligonucleotide; CTT chr2 60491768 60491789 60491773 60491768 -
ggctctcaacacggagtgatga

SEQ ID NO: 220984 - DNA, 22 bp, Artificial Sequence
  Synthetic oligonucleotide; TTG chr2 60491767 60491788 60491772 60491767 -
gctctcaacacggagtgatgat

SEQ ID NO: 220985 - DNA, 22 bp, Artificial Sequence
  Synthetic oligonucleotide; CTC chr2 60491763 60491784 60491768 60491763 -
tcaacacggagtgatgatgcct

SEQ ID NO: 220986 - DNA, 22 bp, Artificial Sequence
  Synthetic oligonucleotide; CTC chr2 60491761 60491782 60491766 60491761 -
aacacggagtgatgatgcctag

SEQ ID NO: 220987 - DNA, 22 bp, Artificial Sequence
  Synthetic oligonucleotide; CTA chr2 60491740 60491761 60491745 60491740 -
gggtgttttgacgtgggcagtc

SEQ ID NO: 220988 - DNA, 22 bp, Artificial Sequence
  Synthetic oligonucleotide; TTT chr2 60491732 60491753 60491737 60491732 -
tgacgtgggcagtcagcccagc

SEQ ID NO: 220989 - DNA, 22 bp, Artificial Sequence
  Synthetic oligonucleotide; TTT chr2 60491731 60491752 60491736 60491731 -
gacgtgggcagtcagcccagcc

SEQ ID NO: 220990 - DNA, 22 bp, Artificial Sequence
  Synthetic oligonucleotide; TTG chr2 60491730 60491751 60491735 60491730 -
acgtgggcagtcagcccagcct

SEQ ID NO: 220991 - DNA, 22 bp, Artificial Sequence
  Synthetic oligonucleotide; CTG chr2 60491707 60491728 60491712 60491707 -
gagaactgaggggagcatttct

SEQ ID NO: 220992 - DNA, 22 bp, Artificial Sequence
  Synthetic oligonucleotide; CTG chr2 60491699 60491720 60491704 60491699 -
aggggagcatttctttcttttt

SEQ ID NO: 220993 - DNA, 22 bp, Artificial Sequence
  Synthetic oligonucleotide; TTT chr2 60491687 60491708 60491692 60491687 -
ctttcttttttttttttttctt

SEQ ID NO: 220994 - DNA, 22 bp, Artificial Sequence
  Synthetic oligonucleotide; TTC chr2 60491686 60491707 60491691 60491686 -
tttcttttttttttttttcttt

SEQ ID NO: 220995 - DNA, 22 bp, Artificial Sequence
  Synthetic oligonucleotide; CTT chr2 60491684 60491705 60491689 60491684 -
tcttttttttttttttcttttt

SEQ ID NO: 220996 - DNA, 22 bp, Artificial Sequence
  Synthetic oligonucleotide; TTT chr2 60491683 60491704 60491688 60491683 -
cttttttttttttttctttttt

SEQ ID NO: 220997 - DNA, 22 bp, Artificial Sequence
  Synthetic oligonucleotide; TTC chr2 60491682 60491703 60491687 60491682 -
ttttttttttttttcttttttc

SEQ ID NO: 220998 - DNA, 22 bp, Artificial Sequence
  Synthetic oligonucleotide; CTT chr2 60491680 60491701 60491685 60491680 -
ttttttttttttcttttttctt

SEQ ID NO: 220999 - DNA, 22 bp, Artificial Sequence
  Synthetic oligonucleotide; TTT chr2 60491679 60491700 60491684 60491679 -
tttttttttttcttttttcttt

SEQ ID NO: 221000 - DNA, 22 bp, Artificial Sequence
  Synthetic oligonucleotide; TTT chr2 60491678 60491699 60491683 60491678 -
ttttttttttcttttttctttt

SEQ ID NO: 221001 - DNA, 22 bp, Artificial Sequence
  Synthetic oligonucleotide; TTT chr2 60491677 60491698 60491682 60491677 -
tttttttttcttttttcttttt

SEQ ID NO: 221002 - DNA, 22 bp, Artificial Sequence
  Synthetic oligonucleotide; TTT chr2 60491676 60491697 60491681 60491676 -
ttttttttcttttttctttttt

SEQ ID NO: 221003 - DNA, 22 bp, Artificial Sequence
  Synthetic oligonucleotide; TTT chr2 60491675 60491696 60491680 60491675 -
tttttttcttttttcttttttt

SEQ ID NO: 221004 - DNA, 22 bp, Artificial Sequence
  Synthetic oligonucleotide; TTT chr2 60491674 60491695 60491679 60491674 -
ttttttcttttttctttttttg

SEQ ID NO: 221005 - DNA, 22 bp, Artificial Sequence
  Synthetic oligonucleotide; TTT chr2 60491673 60491694 60491678 60491673 -
tttttcttttttctttttttgg

SEQ ID NO: 221006 - DNA, 22 bp, Artificial Sequence
  Synthetic oligonucleotide; TTT chr2 60491672 60491693 60491677 60491672 -
ttttcttttttctttttttggt

SEQ ID NO: 221007 - DNA, 22 bp, Artificial Sequence
  Synthetic oligonucleotide; TTT chr2 60491671 60491692 60491676 60491671 -
tttcttttttctttttttggtg

SEQ ID NO: 221008 - DNA, 22 bp, Artificial Sequence
  Synthetic oligonucleotide; TTT chr2 60491670 60491691 60491675 60491670 -
ttcttttttctttttttggtga

SEQ ID NO: 221009 - DNA, 22 bp, Artificial Sequence
  Synthetic oligonucleotide; TTT chr2 60491669 60491690 60491674 60491669 -
tcttttttctttttttggtgag

SEQ ID NO: 221010 - DNA, 22 bp, Artificial Sequence
  Synthetic oligonucleotide; TTT chr2 60491668 60491689 60491673 60491668 -
cttttttctttttttggtgaga

SEQ ID NO: 221011 - DNA, 22 bp, Artificial Sequence
  Synthetic oligonucleotide; TTC chr2 60491667 60491688 60491672 60491667 -
ttttttctttttttggtgagac

SEQ ID NO: 221012 - DNA, 22 bp, Artificial Sequence
  Synthetic oligonucleotide; CTT chr2 60491665 60491686 60491670 60491665 -
ttttctttttttggtgagacgg

SEQ ID NO: 221013 - DNA, 22 bp, Artificial Sequence
  Synthetic oligonucleotide; TTT chr2 60491664 60491685 60491669 60491664 -
tttctttttttggtgagacgga

SEQ ID NO: 221014 - DNA, 22 bp, Artificial Sequence
  Synthetic oligonucleotide; TTT chr2 60491663 60491684 60491668 60491663 -
ttctttttttggtgagacggag

SEQ ID NO: 221015 - DNA, 22 bp, Artificial Sequence
  Synthetic oligonucleotide; TTT chr2 60491662 60491683 60491667 60491662 -
tctttttttggtgagacggaga

SEQ ID NO: 221016 - DNA, 22 bp, Artificial Sequence
  Synthetic oligonucleotide; TTT chr2 60491661 60491682 60491666 60491661 -
ctttttttggtgagacggagat

SEQ ID NO: 221017 - DNA, 22 bp, Artificial Sequence
  Synthetic oligonucleotide; TTC chr2 60491660 60491681 60491665 60491660 -
tttttttggtgagacggagatt

SEQ ID NO: 221018 - DNA, 22 bp, Artificial Sequence
  Synthetic oligonucleotide; CTT chr2 60491658 60491679 60491663 60491658 -
tttttggtgagacggagattta

SEQ ID NO: 221019 - DNA, 22 bp, Artificial Sequence
  Synthetic oligonucleotide; TTT chr2 60491657 60491678 60491662 60491657 -
ttttggtgagacggagatttac

SEQ ID NO: 221020 - DNA, 22 bp, Artificial Sequence
  Synthetic oligonucleotide; TTT chr2 60491656 60491677 60491661 60491656 -
tttggtgagacggagatttact

SEQ ID NO: 221021 - DNA, 22 bp, Artificial Sequence
  Synthetic oligonucleotide; TTT chr2 60491655 60491676 60491660 60491655 -
ttggtgagacggagatttactc

SEQ ID NO: 221022 - DNA, 22 bp, Artificial Sequence
  Synthetic oligonucleotide; TTT chr2 60491654 60491675 60491659 60491654 -
tggtgagacggagatttactct

SEQ ID NO: 221023 - DNA, 22 bp, Artificial Sequence
  Synthetic oligonucleotide; TTT chr2 60491653 60491674 60491658 60491653 -
ggtgagacggagatttactctt

SEQ ID NO: 221024 - DNA, 22 bp, Artificial Sequence
  Synthetic oligonucleotide; TTG chr2 60491652 60491673 60491657 60491652 -
gtgagacggagatttactcttg

SEQ ID NO: 221025 - DNA, 22 bp, Artificial Sequence
  Synthetic oligonucleotide; TTT chr2 60491637 60491658 60491642 60491637 -
actcttgttgcccgggctggaa

SEQ ID NO: 221026 - DNA, 22 bp, Artificial Sequence
  Synthetic oligonucleotide; TTA chr2 60491636 60491657 60491641 60491636 -
ctcttgttgcccgggctggaat

SEQ ID NO: 221027 - DNA, 22 bp, Artificial Sequence
  Synthetic oligonucleotide; CTC chr2 60491633 60491654 60491638 60491633 -
ttgttgcccgggctggaatgca

SEQ ID NO: 221028 - DNA, 22 bp, Artificial Sequence
  Synthetic oligonucleotide; CTT chr2 60491631 60491652 60491636 60491631 -
gttgcccgggctggaatgcaat

SEQ ID NO: 221029 - DNA, 22 bp, Artificial Sequence
  Synthetic oligonucleotide; TTG chr2 60491630 60491651 60491635 60491630 -
ttgcccgggctggaatgcaatg

SEQ ID NO: 221030 - DNA, 22 bp, Artificial Sequence
  Synthetic oligonucleotide; TTG chr2 60491627 60491648 60491632 60491627 -
cccgggctggaatgcaatggcg

SEQ ID NO: 221031 - DNA, 22 bp, Artificial Sequence
  Synthetic oligonucleotide; CTG chr2 60491618 60491639 60491623 60491618 -
gaatgcaatggcgcgatctcgg

SEQ ID NO: 221032 - DNA, 22 bp, Artificial Sequence
  Synthetic oligonucleotide; CTC chr2 60491598 60491619 60491603 60491598 -
ggctcactgcatcttctgcctc

SEQ ID NO: 221033 - DNA, 22 bp, Artificial Sequence
  Synthetic oligonucleotide; CTC chr2 60491593 60491614 60491598 60491593 -
actgcatcttctgcctcccagg

SEQ ID NO: 221034 - DNA, 22 bp, Artificial Sequence
  Synthetic oligonucleotide; CTG chr2 60491589 60491610 60491594 60491589 -
catcttctgcctcccaggttca

SEQ ID NO: 221035 - DNA, 22 bp, Artificial Sequence
  Synthetic oligonucleotide; CTT chr2 60491583 60491604 60491588 60491583 -
ctgcctcccaggttcaagcgat

SEQ ID NO: 221036 - DNA, 22 bp, Artificial Sequence
  Synthetic oligonucleotide; TTC chr2 60491582 60491603 60491587 60491582 -
tgcctcccaggttcaagcgatc

SEQ ID NO: 221037 - DNA, 22 bp, Artificial Sequence
  Synthetic oligonucleotide; CTG chr2 60491580 60491601 60491585 60491580 -
cctcccaggttcaagcgatctc

SEQ ID NO: 221038 - DNA, 22 bp, Artificial Sequence
  Synthetic oligonucleotide; CTC chr2 60491576 60491597 60491581 60491576 -
ccaggttcaagcgatctcctgc

SEQ ID NO: 221039 - DNA, 22 bp, Artificial Sequence
  Synthetic oligonucleotide; TTC chr2 60491568 60491589 60491573 60491568 -
aagcgatctcctgcctcagcct

SEQ ID NO: 221040 - DNA, 22 bp, Artificial Sequence
  Synthetic oligonucleotide; CTC chr2 60491558 60491579 60491563 60491558 -
ctgcctcagcctcccgagtagc

SEQ ID NO: 221041 - DNA, 22 bp, Artificial Sequence
  Synthetic oligonucleotide; CTG chr2 60491555 60491576 60491560 60491555 -
cctcagcctcccgagtagctga

SEQ ID NO: 221042 - DNA, 22 bp, Artificial Sequence
  Synthetic oligonucleotide; CTC chr2 60491551 60491572 60491556 60491551 -
agcctcccgagtagctgagatt

SEQ ID NO: 221043 - DNA, 22 bp, Artificial Sequence
  Synthetic oligonucleotide; CTC chr2 60491545 60491566 60491550 60491545 -
ccgagtagctgagattacaggc

SEQ ID NO: 221044 - DNA, 22 bp, Artificial Sequence
  Synthetic oligonucleotide; CTG chr2 60491534 60491555 60491539 60491534 -
agattacaggcatgtattacca

SEQ ID NO: 221045 - DNA, 22 bp, Artificial Sequence
  Synthetic oligonucleotide; TTA chr2 60491528 60491549 60491533 60491528 -
caggcatgtattaccatgcccg

SEQ ID NO: 221046 - DNA, 22 bp, Artificial Sequence
  Synthetic oligonucleotide; TTA chr2 60491515 60491536 60491520 60491515 -
ccatgcccggctaattttgtat

SEQ ID NO: 221047 - DNA, 22 bp, Artificial Sequence
  Synthetic oligonucleotide; CTA chr2 60491502 60491523 60491507 60491502 -
attttgtatttttagtagagac

SEQ ID NO: 221048 - DNA, 22 bp, Artificial Sequence
  Synthetic oligonucleotide; TTT chr2 60491498 60491519 60491503 60491498 -
tgtatttttagtagagacgggg

SEQ ID NO: 221049 - DNA, 22 bp, Artificial Sequence
  Synthetic oligonucleotide; TTT chr2 60491497 60491518 60491502 60491497 -
gtatttttagtagagacggggt

SEQ ID NO: 221050 - DNA, 22 bp, Artificial Sequence
  Synthetic oligonucleotide; TTG chr2 60491496 60491517 60491501 60491496 -
tatttttagtagagacggggtt

SEQ ID NO: 221051 - DNA, 22 bp, Artificial Sequence
  Synthetic oligonucleotide; TTT chr2 60491491 60491512 60491496 60491491 -
ttagtagagacggggtttcact

SEQ ID NO: 221052 - DNA, 22 bp, Artificial Sequence
  Synthetic oligonucleotide; TTT chr2 60491490 60491511 60491495 60491490 -
tagtagagacggggtttcactg

SEQ ID NO: 221053 - DNA, 22 bp, Artificial Sequence
  Synthetic oligonucleotide; TTT chr2 60491489 60491510 60491494 60491489 -
agtagagacggggtttcactgt

SEQ ID NO: 221054 - DNA, 22 bp, Artificial Sequence
  Synthetic oligonucleotide; TTA chr2 60491488 60491509 60491493 60491488 -
gtagagacggggtttcactgtg

SEQ ID NO: 221055 - DNA, 22 bp, Artificial Sequence
  Synthetic oligonucleotide; TTT chr2 60491473 60491494 60491478 60491473 -
cactgtgttgtccaaactgatc

SEQ ID NO: 221056 - DNA, 22 bp, Artificial Sequence
  Synthetic oligonucleotide; TTC chr2 60491472 60491493 60491477 60491472 -
actgtgttgtccaaactgatct

SEQ ID NO: 221057 - DNA, 22 bp, Artificial Sequence
  Synthetic oligonucleotide; CTG chr2 60491468 60491489 60491473 60491468 -
tgttgtccaaactgatcttgaa

SEQ ID NO: 221058 - DNA, 22 bp, Artificial Sequence
  Synthetic oligonucleotide; TTG chr2 60491463 60491484 60491468 60491463 -
tccaaactgatcttgaactcct

SEQ ID NO: 221059 - DNA, 22 bp, Artificial Sequence
  Synthetic oligonucleotide; CTG chr2 60491454 60491475 60491459 60491454 -
atcttgaactcctgacctcagg

SEQ ID NO: 221060 - DNA, 22 bp, Artificial Sequence
  Synthetic oligonucleotide; CTT chr2 60491449 60491470 60491454 60491449 -
gaactcctgacctcaggtgatc

SEQ ID NO: 221061 - DNA, 22 bp, Artificial Sequence
  Synthetic oligonucleotide; TTG chr2 60491448 60491469 60491453 60491448 -
aactcctgacctcaggtgatcc

SEQ ID NO: 221062 - DNA, 22 bp, Artificial Sequence
  Synthetic oligonucleotide; CTC chr2 60491443 60491464 60491448 60491443 -
ctgacctcaggtgatcctcctg

SEQ ID NO: 221063 - DNA, 22 bp, Artificial Sequence
  Synthetic oligonucleotide; CTG chr2 60491440 60491461 60491445 60491440 -
acctcaggtgatcctcctgccc

SEQ ID NO: 221064 - DNA, 22 bp, Artificial Sequence
  Synthetic oligonucleotide; CTC chr2 60491435 60491456 60491440 60491435 -
aggtgatcctcctgccccggcc

SEQ ID NO: 221065 - DNA, 22 bp, Artificial Sequence
  Synthetic oligonucleotide; CTC chr2 60491424 60491445 60491429 60491424 -
ctgccccggcctcccaaagtgc

SEQ ID NO: 221066 - DNA, 22 bp, Artificial Sequence
  Synthetic oligonucleotide; CTG chr2 60491421 60491442 60491426 60491421 -
ccccggcctcccaaagtgctgg

SEQ ID NO: 221067 - DNA, 22 bp, Artificial Sequence
  Synthetic oligonucleotide; CTC chr2 60491411 60491432 60491416 60491411 -
ccaaagtgctgggattacaggt

SEQ ID NO: 221068 - DNA, 22 bp, Artificial Sequence
  Synthetic oligonucleotide; CTG chr2 60491400 60491421 60491405 60491400 -
ggattacaggtgtgagccacag

SEQ ID NO: 221069 - DNA, 22 bp, Artificial Sequence
  Synthetic oligonucleotide; TTA chr2 60491394 60491415 60491399 60491394 -
caggtgtgagccacagcgcctg

SEQ ID NO: 221070 - DNA, 22 bp, Artificial Sequence
  Synthetic oligonucleotide; CTG chr2 60491372 60491393 60491377 60491372 -
gccgggagcatttcaaatgata

SEQ ID NO: 221071 - DNA, 22 bp, Artificial Sequence
  Synthetic oligonucleotide; TTT chr2 60491359 60491380 60491364 60491359 -
caaatgatagttaggacttcct

SEQ ID NO: 221072 - DNA, 22 bp, Artificial Sequence
  Synthetic oligonucleotide; TTC chr2 60491358 60491379 60491363 60491358 -
aaatgatagttaggacttcctt

SEQ ID NO: 221073 - DNA, 22 bp, Artificial Sequence
  Synthetic oligonucleotide; TTA chr2 60491346 60491367 60491351 60491346 -
ggacttccttttactgtactta

SEQ ID NO: 221074 - DNA, 22 bp, Artificial Sequence
  Synthetic oligonucleotide; CTT chr2 60491340 60491361 60491345 60491340 -
ccttttactgtacttaatagct

SEQ ID NO: 221075 - DNA, 22 bp, Artificial Sequence
  Synthetic oligonucleotide; TTC chr2 60491339 60491360 60491344 60491339 -
cttttactgtacttaatagctg

SEQ ID NO: 221076 - DNA, 22 bp, Artificial Sequence
  Synthetic oligonucleotide; CTT chr2 60491336 60491357 60491341 60491336 -
ttactgtacttaatagctgaag

SEQ ID NO: 221077 - DNA, 22 bp, Artificial Sequence
  Synthetic oligonucleotide; TTT chr2 60491335 60491356 60491340 60491335 -
tactgtacttaatagctgaagg

SEQ ID NO: 221078 - DNA, 22 bp, Artificial Sequence
  Synthetic oligonucleotide; TTT chr2 60491334 60491355 60491339 60491334 -
actgtacttaatagctgaaggg

SEQ ID NO: 221079 - DNA, 22 bp, Artificial Sequence
  Synthetic oligonucleotide; TTA chr2 60491333 60491354 60491338 60491333 -
ctgtacttaatagctgaagggg

SEQ ID NO: 221080 - DNA, 22 bp, Artificial Sequence
  Synthetic oligonucleotide; CTG chr2 60491330 60491351 60491335 60491330 -
tacttaatagctgaagggggcc

SEQ ID NO: 221081 - DNA, 22 bp, Artificial Sequence
  Synthetic oligonucleotide; CTT chr2 60491325 60491346 60491330 60491325 -
aatagctgaagggggccaaaag

SEQ ID NO: 221082 - DNA, 22 bp, Artificial Sequence
  Synthetic oligonucleotide; TTA chr2 60491324 60491345 60491329 60491324 -
atagctgaagggggccaaaagt

SEQ ID NO: 221083 - DNA, 22 bp, Artificial Sequence
  Synthetic oligonucleotide; CTG chr2 60491317 60491338 60491322 60491317 -
aagggggccaaaagtgtccatg

SEQ ID NO: 221084 - DNA, 22 bp, Artificial Sequence
  Synthetic oligonucleotide; TTT chr2 60491292 60491313 60491297 60491292 -
gctgccctctggcatcaaaatg

SEQ ID NO: 221085 - DNA, 22 bp, Artificial Sequence
  Synthetic oligonucleotide; TTG chr2 60491291 60491312 60491296 60491291 -
ctgccctctggcatcaaaatga

SEQ ID NO: 221086 - DNA, 22 bp, Artificial Sequence
  Synthetic oligonucleotide; CTG chr2 60491288 60491309 60491293 60491288 -
ccctctggcatcaaaatgaggt

SEQ ID NO: 221087 - DNA, 22 bp, Artificial Sequence
  Synthetic oligonucleotide; CTC chr2 60491283 60491304 60491288 60491283 -
tggcatcaaaatgaggtccttt

SEQ ID NO: 221088 - DNA, 22 bp, Artificial Sequence
  Synthetic oligonucleotide; CTG chr2 60491281 60491302 60491286 60491281 -
gcatcaaaatgaggtccttttt

SEQ ID NO: 221089 - DNA, 22 bp, Artificial Sequence
  Synthetic oligonucleotide; CTT chr2 60491262 60491283 60491267 60491262 -
tttagtagtgctgcatttaaaa

SEQ ID NO: 221090 - DNA, 22 bp, Artificial Sequence
  Synthetic oligonucleotide; TTT chr2 60491261 60491282 60491266 60491261 -
ttagtagtgctgcatttaaaac

SEQ ID NO: 221091 - DNA, 22 bp, Artificial Sequence
  Synthetic oligonucleotide; TTT chr2 60491260 60491281 60491265 60491260 -
tagtagtgctgcatttaaaaca

SEQ ID NO: 221092 - DNA, 22 bp, Artificial Sequence
  Synthetic oligonucleotide; TTT chr2 60491259 60491280 60491264 60491259 -
agtagtgctgcatttaaaacag

SEQ ID NO: 221093 - DNA, 22 bp, Artificial Sequence
  Synthetic oligonucleotide; TTA chr2 60491258 60491279 60491263 60491258 -
gtagtgctgcatttaaaacagc

SEQ ID NO: 221094 - DNA, 22 bp, Artificial Sequence
  Synthetic oligonucleotide; CTG chr2 60491249 60491270 60491254 60491249 -
catttaaaacagcattaagaat

SEQ ID NO: 221095 - DNA, 22 bp, Artificial Sequence
  Synthetic oligonucleotide; TTT chr2 60491244 60491265 60491249 60491244 -
aaaacagcattaagaatacgtt

SEQ ID NO: 221096 - DNA, 22 bp, Artificial Sequence
  Synthetic oligonucleotide; TTA chr2 60491243 60491264 60491248 60491243 -
aaacagcattaagaatacgttt

SEQ ID NO: 221097 - DNA, 22 bp, Artificial Sequence
  Synthetic oligonucleotide; TTA chr2 60491232 60491253 60491237 60491232 -
agaatacgtttttagaacttag

SEQ ID NO: 221098 - DNA, 22 bp, Artificial Sequence
  Synthetic oligonucleotide; TTT chr2 60491221 60491242 60491226 60491221 -
ttagaacttagctttttgcatt

SEQ ID NO: 221099 - DNA, 22 bp, Artificial Sequence
  Synthetic oligonucleotide; TTT chr2 60491220 60491241 60491225 60491220 -
tagaacttagctttttgcattg

SEQ ID NO: 221100 - DNA, 22 bp, Artificial Sequence
  Synthetic oligonucleotide; TTT chr2 60491219 60491240 60491224 60491219 -
agaacttagctttttgcattga

SEQ ID NO: 221101 - DNA, 22 bp, Artificial Sequence
  Synthetic oligonucleotide; TTA chr2 60491218 60491239 60491223 60491218 -
gaacttagctttttgcattgag

SEQ ID NO: 221102 - DNA, 22 bp, Artificial Sequence
  Synthetic oligonucleotide; CTT chr2 60491212 60491233 60491217 60491212 -
agctttttgcattgaggatgcg

SEQ ID NO: 221103 - DNA, 22 bp, Artificial Sequence
  Synthetic oligonucleotide; TTA chr2 60491211 60491232 60491216 60491211 -
gctttttgcattgaggatgcgc

SEQ ID NO: 221104 - DNA, 22 bp, Artificial Sequence
  Synthetic oligonucleotide; CTT chr2 60491207 60491228 60491212 60491207 -
tttgcattgaggatgcgcaggt

SEQ ID NO: 221105 - DNA, 22 bp, Artificial Sequence
  Synthetic oligonucleotide; TTT chr2 60491206 60491227 60491211 60491206 -
ttgcattgaggatgcgcaggtg

SEQ ID NO: 221106 - DNA, 22 bp, Artificial Sequence
  Synthetic oligonucleotide; TTT chr2 60491205 60491226 60491210 60491205 -
tgcattgaggatgcgcaggtgg

SEQ ID NO: 221107 - DNA, 22 bp, Artificial Sequence
  Synthetic oligonucleotide; TTT chr2 60491204 60491225 60491209 60491204 -
gcattgaggatgcgcaggtggc

SEQ ID NO: 221108 - DNA, 22 bp, Artificial Sequence
  Synthetic oligonucleotide; TTG chr2 60491203 60491224 60491208 60491203 -
cattgaggatgcgcaggtggct

SEQ ID NO: 221109 - DNA, 22 bp, Artificial Sequence
  Synthetic oligonucleotide; TTG chr2 60491198 60491219 60491203 60491198 -
aggatgcgcaggtggctgagac

SEQ ID NO: 221110 - DNA, 22 bp, Artificial Sequence
  Synthetic oligonucleotide; CTG chr2 60491180 60491201 60491185 60491180 -
agactaacttctttgcagatga

SEQ ID NO: 221111 - DNA, 22 bp, Artificial Sequence
  Synthetic oligonucleotide; CTA chr2 60491174 60491195 60491179 60491174 -
acttctttgcagatgaccatgg

SEQ ID NO: 221112 - DNA, 22 bp, Artificial Sequence
  Synthetic oligonucleotide; CTT chr2 60491170 60491191 60491175 60491170 -
ctttgcagatgaccatggttga

SEQ ID NO: 221113 - DNA, 22 bp, Artificial Sequence
  Synthetic oligonucleotide; TTC chr2 60491169 60491190 60491174 60491169 -
tttgcagatgaccatggttgaa

SEQ ID NO: 221114 - DNA, 22 bp, Artificial Sequence
  Synthetic oligonucleotide; CTT chr2 60491167 60491188 60491172 60491167 -
tgcagatgaccatggttgaaag

SEQ ID NO: 221115 - DNA, 22 bp, Artificial Sequence
  Synthetic oligonucleotide; TTT chr2 60491166 60491187 60491171 60491166 -
gcagatgaccatggttgaaagt

SEQ ID NO: 221116 - DNA, 22 bp, Artificial Sequence
  Synthetic oligonucleotide; TTG chr2 60491165 60491186 60491170 60491165 -
cagatgaccatggttgaaagtc

SEQ ID NO: 221117 - DNA, 22 bp, Artificial Sequence
  Synthetic oligonucleotide; TTG chr2 60491149 60491170 60491154 60491149 -
aaagtcagctatagagttgcac

SEQ ID NO: 221118 - DNA, 22 bp, Artificial Sequence
  Synthetic oligonucleotide; CTA chr2 60491138 60491159 60491143 60491138 -
tagagttgcacaaccacgtagt

SEQ ID NO: 221119 - DNA, 22 bp, Artificial Sequence
  Synthetic oligonucleotide; TTG chr2 60491130 60491151 60491135 60491130 -
cacaaccacgtagttgggcttc

SEQ ID NO: 221120 - DNA, 22 bp, Artificial Sequence
  Synthetic oligonucleotide; TTG chr2 60491114 60491135 60491119 60491114 -
ggcttcacatatagaagatgtt

SEQ ID NO: 221121 - DNA, 22 bp, Artificial Sequence
  Synthetic oligonucleotide; CTT chr2 60491109 60491130 60491114 60491109 -
cacatatagaagatgttgtcat

SEQ ID NO: 221122 - DNA, 22 bp, Artificial Sequence
  Synthetic oligonucleotide; TTC chr2 60491108 60491129 60491113 60491108 -
acatatagaagatgttgtcatt

SEQ ID NO: 221123 - DNA, 22 bp, Artificial Sequence
  Synthetic oligonucleotide; TTG chr2 60491091 60491112 60491096 60491091 -
tcattttttggtaactctgtca

SEQ ID NO: 221124 - DNA, 22 bp, Artificial Sequence
  Synthetic oligonucleotide; TTT chr2 60491085 60491106 60491090 60491085 -
tttggtaactctgtcagacttt

SEQ ID NO: 221125 - DNA, 22 bp, Artificial Sequence
  Synthetic oligonucleotide; TTT chr2 60491084 60491105 60491089 60491084 -
ttggtaactctgtcagacttta

SEQ ID NO: 221126 - DNA, 22 bp, Artificial Sequence
  Synthetic oligonucleotide; TTT chr2 60491083 60491104 60491088 60491083 -
tggtaactctgtcagactttac

SEQ ID NO: 221127 - DNA, 22 bp, Artificial Sequence
  Synthetic oligonucleotide; TTT chr2 60491082 60491103 60491087 60491082 -
ggtaactctgtcagactttacc

SEQ ID NO: 221128 - DNA, 22 bp, Artificial Sequence
  Synthetic oligonucleotide; TTG chr2 60491081 60491102 60491086 60491081 -
gtaactctgtcagactttacca

SEQ ID NO: 221129 - DNA, 22 bp, Artificial Sequence
  Synthetic oligonucleotide; CTC chr2 60491074 60491095 60491079 60491074 -
tgtcagactttaccaacctggc

SEQ ID NO: 221130 - DNA, 22 bp, Artificial Sequence
  Synthetic oligonucleotide; CTG chr2 60491072 60491093 60491077 60491072 -
tcagactttaccaacctggcgc

SEQ ID NO: 221131 - DNA, 22 bp, Artificial Sequence
  Synthetic oligonucleotide; CTT chr2 60491064 60491085 60491069 60491064 -
taccaacctggcgcacagtctg

SEQ ID NO: 221132 - DNA, 22 bp, Artificial Sequence
  Synthetic oligonucleotide; TTT chr2 60491063 60491084 60491068 60491063 -
accaacctggcgcacagtctgg

SEQ ID NO: 221133 - DNA, 22 bp, Artificial Sequence
  Synthetic oligonucleotide; TTA chr2 60491062 60491083 60491067 60491062 -
ccaacctggcgcacagtctggt

SEQ ID NO: 221134 - DNA, 22 bp, Artificial Sequence
  Synthetic oligonucleotide; CTG chr2 60491054 60491075 60491059 60491054 -
gcgcacagtctggttggcacat

SEQ ID NO: 221135 - DNA, 22 bp, Artificial Sequence
  Synthetic oligonucleotide; CTG chr2 60491042 60491063 60491047 60491042 -
gttggcacataaacttcacatt

SEQ ID NO: 221136 - DNA, 22 bp, Artificial Sequence
  Synthetic oligonucleotide; TTG chr2 60491038 60491059 60491043 60491038 -
gcacataaacttcacatttgct

SEQ ID NO: 221137 - DNA, 22 bp, Artificial Sequence
  Synthetic oligonucleotide; CTT chr2 60491026 60491047 60491031 60491026 -
cacatttgctcttctccagggt

SEQ ID NO: 221138 - DNA, 22 bp, Artificial Sequence
  Synthetic oligonucleotide; TTC chr2 60491025 60491046 60491030 60491025 -
acatttgctcttctccagggtg

SEQ ID NO: 221139 - DNA, 22 bp, Artificial Sequence
  Synthetic oligonucleotide; TTT chr2 60491019 60491040 60491024 60491019 -
gctcttctccagggtgtggggt

SEQ ID NO: 221140 - DNA, 22 bp, Artificial Sequence
  Synthetic oligonucleotide; TTG chr2 60491018 60491039 60491023 60491018 -
ctcttctccagggtgtggggtg

SEQ ID NO: 221141 - DNA, 22 bp, Artificial Sequence
  Synthetic oligonucleotide; CTC chr2 60491015 60491036 60491020 60491015 -
ttctccagggtgtggggtggct

SEQ ID NO: 221142 - DNA, 22 bp, Artificial Sequence
  Synthetic oligonucleotide; CTT chr2 60491013 60491034 60491018 60491013 -
ctccagggtgtggggtggctgt

SEQ ID NO: 221143 - DNA, 22 bp, Artificial Sequence
  Synthetic oligonucleotide; TTC chr2 60491012 60491033 60491017 60491012 -
tccagggtgtggggtggctgtt

SEQ ID NO: 221144 - DNA, 22 bp, Artificial Sequence
  Synthetic oligonucleotide; CTC chr2 60491010 60491031 60491015 60491010 -
cagggtgtggggtggctgttta

SEQ ID NO: 221145 - DNA, 22 bp, Artificial Sequence
  Synthetic oligonucleotide; CTG chr2 60490992 60491013 60490997 60490992 -
tttaaagagggtggatattcat

SEQ ID NO: 221146 - DNA, 22 bp, Artificial Sequence
  Synthetic oligonucleotide; TTT chr2 60490989 60491010 60490994 60490989 -
aaagagggtggatattcatgct

SEQ ID NO: 221147 - DNA, 22 bp, Artificial Sequence
  Synthetic oligonucleotide; TTA chr2 60490988 60491009 60490993 60490988 -
aagagggtggatattcatgcta

SEQ ID NO: 221148 - DNA, 22 bp, Artificial Sequence
  Synthetic oligonucleotide; TTC chr2 60490972 60490993 60490977 60490972 -
atgctaatctttgtgtagcata

SEQ ID NO: 221149 - DNA, 22 bp, Artificial Sequence
  Synthetic oligonucleotide; CTA chr2 60490966 60490987 60490971 60490966 -
atctttgtgtagcataacatgt

SEQ ID NO: 221150 - DNA, 22 bp, Artificial Sequence
  Synthetic oligonucleotide; CTT chr2 60490961 60490982 60490966 60490961 -
tgtgtagcataacatgttactg

SEQ ID NO: 221151 - DNA, 22 bp, Artificial Sequence
  Synthetic oligonucleotide; TTT chr2 60490960 60490981 60490965 60490960 -
gtgtagcataacatgttactgc

SEQ ID NO: 221152 - DNA, 22 bp, Artificial Sequence
  Synthetic oligonucleotide; TTG chr2 60490959 60490980 60490964 60490959 -
tgtagcataacatgttactgca

SEQ ID NO: 221153 - DNA, 22 bp, Artificial Sequence
  Synthetic oligonucleotide; TTA chr2 60490942 60490963 60490947 60490942 -
ctgcaacttgcttttttttttt

SEQ ID NO: 221154 - DNA, 22 bp, Artificial Sequence
  Synthetic oligonucleotide; CTG chr2 60490939 60490960 60490944 60490939 -
caacttgcttttttttttttat

SEQ ID NO: 221155 - DNA, 22 bp, Artificial Sequence
  Synthetic oligonucleotide; CTT chr2 60490933 60490954 60490938 60490933 -
gcttttttttttttatctgaaa

SEQ ID NO: 221156 - DNA, 22 bp, Artificial Sequence
  Synthetic oligonucleotide; TTG chr2 60490932 60490953 60490937 60490932 -
cttttttttttttatctgaaag

SEQ ID NO: 221157 - DNA, 22 bp, Artificial Sequence
  Synthetic oligonucleotide; CTT chr2 60490929 60490950 60490934 60490929 -
ttttttttttatctgaaagttc

SEQ ID NO: 221158 - DNA, 22 bp, Artificial Sequence
  Synthetic oligonucleotide; TTT chr2 60490928 60490949 60490933 60490928 -
tttttttttatctgaaagttca

SEQ ID NO: 221159 - DNA, 22 bp, Artificial Sequence
  Synthetic oligonucleotide; TTT chr2 60490927 60490948 60490932 60490927 -
ttttttttatctgaaagttcaa

SEQ ID NO: 221160 - DNA, 22 bp, Artificial Sequence
  Synthetic oligonucleotide; TTT chr2 60490926 60490947 60490931 60490926 -
tttttttatctgaaagttcaag

SEQ ID NO: 221161 - DNA, 22 bp, Artificial Sequence
  Synthetic oligonucleotide; TTT chr2 60490925 60490946 60490930 60490925 -
ttttttatctgaaagttcaagt

SEQ ID NO: 221162 - DNA, 22 bp, Artificial Sequence
  Synthetic oligonucleotide; TTT chr2 60490924 60490945 60490929 60490924 -
tttttatctgaaagttcaagta

SEQ ID NO: 221163 - DNA, 22 bp, Artificial Sequence
  Synthetic oligonucleotide; TTT chr2 60490923 60490944 60490928 60490923 -
ttttatctgaaagttcaagtag

SEQ ID NO: 221164 - DNA, 22 bp, Artificial Sequence
  Synthetic oligonucleotide; TTT chr2 60490922 60490943 60490927 60490922 -
tttatctgaaagttcaagtaga

SEQ ID NO: 221165 - DNA, 22 bp, Artificial Sequence
  Synthetic oligonucleotide; TTT chr2 60490921 60490942 60490926 60490921 -
ttatctgaaagttcaagtagat

SEQ ID NO: 221166 - DNA, 22 bp, Artificial Sequence
  Synthetic oligonucleotide; TTT chr2 60490920 60490941 60490925 60490920 -
tatctgaaagttcaagtagata

SEQ ID NO: 221167 - DNA, 22 bp, Artificial Sequence
  Synthetic oligonucleotide; TTT chr2 60490919 60490940 60490924 60490919 -
atctgaaagttcaagtagatat

SEQ ID NO: 221168 - DNA, 22 bp, Artificial Sequence
  Synthetic oligonucleotide; TTA chr2 60490918 60490939 60490923 60490918 -
tctgaaagttcaagtagatatc

SEQ ID NO: 221169 - DNA, 22 bp, Artificial Sequence
  Synthetic oligonucleotide; CTG chr2 60490914 60490935 60490919 60490914 -
aaagttcaagtagatatcagaa

SEQ ID NO: 221170 - DNA, 22 bp, Artificial Sequence
  Synthetic oligonucleotide; TTC chr2 60490907 60490928 60490912 60490907 -
aagtagatatcagaagggaaat

SEQ ID NO: 221171 - DNA, 22 bp, Artificial Sequence
  Synthetic oligonucleotide; TTT chr2 60490881 60490902 60490886 60490881 -
gtgggtgctaagaaggttaaaa

SEQ ID NO: 221172 - DNA, 22 bp, Artificial Sequence
  Synthetic oligonucleotide; TTG chr2 60490880 60490901 60490885 60490880 -
tgggtgctaagaaggttaaaat

SEQ ID NO: 221173 - DNA, 22 bp, Artificial Sequence
  Synthetic oligonucleotide; CTA chr2 60490871 60490892 60490876 60490871 -
agaaggttaaaattaccatttt

SEQ ID NO: 221174 - DNA, 22 bp, Artificial Sequence
  Synthetic oligonucleotide; TTA chr2 60490862 60490883 60490867 60490862 -
aaattaccattttgaacagaaa

SEQ ID NO: 221175 - DNA, 22 bp, Artificial Sequence
  Synthetic oligonucleotide; TTA chr2 60490856 60490877 60490861 60490856 -
ccattttgaacagaaatgatat

SEQ ID NO: 221176 - DNA, 22 bp, Artificial Sequence
  Synthetic oligonucleotide; TTT chr2 60490850 60490871 60490855 60490850 -
tgaacagaaatgatatttggaa

SEQ ID NO: 221177 - DNA, 22 bp, Artificial Sequence
  Synthetic oligonucleotide; TTT chr2 60490849 60490870 60490854 60490849 -
gaacagaaatgatatttggaaa

SEQ ID NO: 221178 - DNA, 22 bp, Artificial Sequence
  Synthetic oligonucleotide; TTG chr2 60490848 60490869 60490853 60490848 -
aacagaaatgatatttggaaaa

SEQ ID NO: 221179 - DNA, 22 bp, Artificial Sequence
  Synthetic oligonucleotide; TTT chr2 60490832 60490853 60490837 60490832 -
ggaaaaataacttcccttttag

SEQ ID NO: 221180 - DNA, 22 bp, Artificial Sequence
  Synthetic oligonucleotide; TTG chr2 60490831 60490852 60490836 60490831 -
gaaaaataacttcccttttagg

SEQ ID NO: 221181 - DNA, 22 bp, Artificial Sequence
  Synthetic oligonucleotide; CTT chr2 60490819 60490840 60490824 60490819 -
cccttttaggaaggtaaatcag

SEQ ID NO: 221182 - DNA, 22 bp, Artificial Sequence
  Synthetic oligonucleotide; TTC chr2 60490818 60490839 60490823 60490818 -
ccttttaggaaggtaaatcagt

SEQ ID NO: 221183 - DNA, 22 bp, Artificial Sequence
  Synthetic oligonucleotide; CTT chr2 60490814 60490835 60490819 60490814 -
ttaggaaggtaaatcagtcatt

SEQ ID NO: 221184 - DNA, 22 bp, Artificial Sequence
  Synthetic oligonucleotide; TTT chr2 60490813 60490834 60490818 60490813 -
taggaaggtaaatcagtcattt

SEQ ID NO: 221185 - DNA, 22 bp, Artificial Sequence
  Synthetic oligonucleotide; TTT chr2 60490812 60490833 60490817 60490812 -
aggaaggtaaatcagtcattta

SEQ ID NO: 221186 - DNA, 22 bp, Artificial Sequence
  Synthetic oligonucleotide; TTA chr2 60490811 60490832 60490816 60490811 -
ggaaggtaaatcagtcatttat

SEQ ID NO: 221187 - DNA, 22 bp, Artificial Sequence
  Synthetic oligonucleotide; TTT chr2 60490791 60490812 60490796 60490791 -
atatgctatttgttgaattcct

SEQ ID NO: 221188 - DNA, 22 bp, Artificial Sequence
  Synthetic oligonucleotide; TTA chr2 60490790 60490811 60490795 60490790 -
tatgctatttgttgaattccta

SEQ ID NO: 221189 - DNA, 22 bp, Artificial Sequence
  Synthetic oligonucleotide; CTA chr2 60490783 60490804 60490788 60490783 -
tttgttgaattcctagaatata

SEQ ID NO: 221190 - DNA, 22 bp, Artificial Sequence
  Synthetic oligonucleotide; TTT chr2 60490780 60490801 60490785 60490780 -
gttgaattcctagaatatatga

SEQ ID NO: 221191 - DNA, 22 bp, Artificial Sequence
  Synthetic oligonucleotide; TTG chr2 60490779 60490800 60490784 60490779 -
ttgaattcctagaatatatgaa

SEQ ID NO: 221192 - DNA, 22 bp, Artificial Sequence
  Synthetic oligonucleotide; TTG chr2 60490776 60490797 60490781 60490776 -
aattcctagaatatatgaatat

SEQ ID NO: 221193 - DNA, 22 bp, Artificial Sequence
  Synthetic oligonucleotide; TTC chr2 60490771 60490792 60490776 60490771 -
ctagaatatatgaatatcatgt

SEQ ID NO: 221194 - DNA, 22 bp, Artificial Sequence
  Synthetic oligonucleotide; CTA chr2 60490768 60490789 60490773 60490768 -
gaatatatgaatatcatgtcac

SEQ ID NO: 221195 - DNA, 22 bp, Artificial Sequence
  Synthetic oligonucleotide; CTG chr2 60490740 60490761 60490745 60490740 -
tgctggtactttcaaatataat

SEQ ID NO: 221196 - DNA, 22 bp, Artificial Sequence
  Synthetic oligonucleotide; CTG chr2 60490735 60490756 60490740 60490735 -
gtactttcaaatataatagaag

SEQ ID NO: 221197 - DNA, 22 bp, Artificial Sequence
  Synthetic oligonucleotide; CTT chr2 60490729 60490750 60490734 60490729 -
tcaaatataatagaagcaagta

SEQ ID NO: 221198 - DNA, 22 bp, Artificial Sequence
  Synthetic oligonucleotide; TTT chr2 60490728 60490749 60490733 60490728 -
caaatataatagaagcaagtag

SEQ ID NO: 221199 - DNA, 22 bp, Artificial Sequence
  Synthetic oligonucleotide; TTC chr2 60490727 60490748 60490732 60490727 -
aaatataatagaagcaagtagg

SEQ ID NO: 221200 - DNA, 22 bp, Artificial Sequence
  Synthetic oligonucleotide; CTG chr2 60490691 60490712 60490696 60490691 -
tattgaagaaactcattgggaa

SEQ ID NO: 221201 - DNA, 22 bp, Artificial Sequence
  Synthetic oligonucleotide; TTG chr2 60490686 60490707 60490691 60490686 -
aagaaactcattgggaacacat

SEQ ID NO: 221202 - DNA, 22 bp, Artificial Sequence
  Synthetic oligonucleotide; CTC chr2 60490677 60490698 60490682 60490677 -
attgggaacacatgaaattaat

SEQ ID NO: 221203 - DNA, 22 bp, Artificial Sequence
  Synthetic oligonucleotide; TTG chr2 60490673 60490694 60490678 60490673 -
ggaacacatgaaattaattaga

SEQ ID NO: 221204 - DNA, 22 bp, Artificial Sequence
  Synthetic oligonucleotide; TTA chr2 60490657 60490678 60490662 60490657 -
attagaggcatagagggttaac

SEQ ID NO: 221205 - DNA, 22 bp, Artificial Sequence
  Synthetic oligonucleotide; TTA chr2 60490653 60490674 60490658 60490653 -
gaggcatagagggttaaccagc

SEQ ID NO: 221206 - DNA, 22 bp, Artificial Sequence
  Synthetic oligonucleotide; TTA chr2 60490637 60490658 60490642 60490637 -
accagcaatgtaaggcctagat

SEQ ID NO: 221207 - DNA, 22 bp, Artificial Sequence
  Synthetic oligonucleotide; CTA chr2 60490618 60490639 60490623 60490618 -
gatatgagtcagggagtggtgc

SEQ ID NO: 221208 - DNA, 22 bp, Artificial Sequence
  Synthetic oligonucleotide; TTC chr2 60490581 60490602 60490586 60490581 -
tatgaggttggagaaggatgag

SEQ ID NO: 221209 - DNA, 22 bp, Artificial Sequence
  Synthetic oligonucleotide; CTA chr2 60490579 60490600 60490584 60490579 -
tgaggttggagaaggatgagat

SEQ ID NO: 221210 - DNA, 22 bp, Artificial Sequence
  Synthetic oligonucleotide; TTG chr2 60490571 60490592 60490576 60490571 -
gagaaggatgagattgattctt

SEQ ID NO: 221211 - DNA, 22 bp, Artificial Sequence
  Synthetic oligonucleotide; TTG chr2 60490555 60490576 60490560 60490555 -
attcttcttgctaaggtgacta

SEQ ID NO: 221212 - DNA, 22 bp, Artificial Sequence
  Synthetic oligonucleotide; TTC chr2 60490551 60490572 60490556 60490551 -
ttcttgctaaggtgactaggta

SEQ ID NO: 221213 - DNA, 22 bp, Artificial Sequence
  Synthetic oligonucleotide; CTT chr2 60490549 60490570 60490554 60490549 -
cttgctaaggtgactaggtaga

SEQ ID NO: 221214 - DNA, 22 bp, Artificial Sequence
  Synthetic oligonucleotide; TTC chr2 60490548 60490569 60490553 60490548 -
ttgctaaggtgactaggtagac

SEQ ID NO: 221215 - DNA, 22 bp, Artificial Sequence
  Synthetic oligonucleotide; CTT chr2 60490546 60490567 60490551 60490546 -
gctaaggtgactaggtagacct

SEQ ID NO: 221216 - DNA, 22 bp, Artificial Sequence
  Synthetic oligonucleotide; TTG chr2 60490545 60490566 60490550 60490545 -
ctaaggtgactaggtagacctt

SEQ ID NO: 221217 - DNA, 22 bp, Artificial Sequence
  Synthetic oligonucleotide; CTA chr2 60490542 60490563 60490547 60490542 -
aggtgactaggtagaccttcat

SEQ ID NO: 221218 - DNA, 22 bp, Artificial Sequence
  Synthetic oligonucleotide; CTA chr2 60490533 60490554 60490538 60490533 -
ggtagaccttcattgaggcctt

SEQ ID NO: 221219 - DNA, 22 bp, Artificial Sequence
  Synthetic oligonucleotide; CTT chr2 60490523 60490544 60490528 60490523 -
cattgaggccttgaagtatgag

SEQ ID NO: 221220 - DNA, 22 bp, Artificial Sequence
  Synthetic oligonucleotide; TTC chr2 60490522 60490543 60490527 60490522 -
attgaggccttgaagtatgagc

SEQ ID NO: 221221 - DNA, 22 bp, Artificial Sequence
  Synthetic oligonucleotide; TTG chr2 60490518 60490539 60490523 60490518 -
aggccttgaagtatgagcagga

SEQ ID NO: 221222 - DNA, 22 bp, Artificial Sequence
  Synthetic oligonucleotide; CTT chr2 60490511 60490532 60490516 60490511 -
gaagtatgagcaggattccagg

SEQ ID NO: 221223 - DNA, 22 bp, Artificial Sequence
  Synthetic oligonucleotide; TTG chr2 60490510 60490531 60490515 60490510 -
aagtatgagcaggattccagga

SEQ ID NO: 221224 - DNA, 22 bp, Artificial Sequence
  Synthetic oligonucleotide; TTC chr2 60490493 60490514 60490498 60490493 -
caggaggtaagagaagaagaag

SEQ ID NO: 221225 - DNA, 22 bp, Artificial Sequence
  Synthetic oligonucleotide; TTT chr2 60490436 60490457 60490441 60490436 -
ttacttgggcagaatattttcc

SEQ ID NO: 221226 - DNA, 22 bp, Artificial Sequence
  Synthetic oligonucleotide; TTT chr2 60490435 60490456 60490440 60490435 -
tacttgggcagaatattttcct

SEQ ID NO: 221227 - DNA, 22 bp, Artificial Sequence
  Synthetic oligonucleotide; TTT chr2 60490434 60490455 60490439 60490434 -
acttgggcagaatattttcctt

SEQ ID NO: 221228 - DNA, 22 bp, Artificial Sequence
  Synthetic oligonucleotide; TTA chr2 60490433 60490454 60490438 60490433 -
cttgggcagaatattttccttg

SEQ ID NO: 221229 - DNA, 22 bp, Artificial Sequence
  Synthetic oligonucleotide; CTT chr2 60490430 60490451 60490435 60490430 -
gggcagaatattttccttgatg

SEQ ID NO: 221230 - DNA, 22 bp, Artificial Sequence
  Synthetic oligonucleotide; TTG chr2 60490429 60490450 60490434 60490429 -
ggcagaatattttccttgatgg

SEQ ID NO: 221231 - DNA, 22 bp, Artificial Sequence
  Synthetic oligonucleotide; TTT chr2 60490417 60490438 60490422 60490417 -
tccttgatgggtacggggaact

SEQ ID NO: 221232 - DNA, 22 bp, Artificial Sequence
  Synthetic oligonucleotide; TTT chr2 60490416 60490437 60490421 60490416 -
ccttgatgggtacggggaacta

SEQ ID NO: 221233 - DNA, 22 bp, Artificial Sequence
  Synthetic oligonucleotide; TTC chr2 60490415 60490436 60490420 60490415 -
cttgatgggtacggggaactaa

SEQ ID NO: 221234 - DNA, 22 bp, Artificial Sequence
  Synthetic oligonucleotide; CTT chr2 60490412 60490433 60490417 60490412 -
gatgggtacggggaactaagac

SEQ ID NO: 221235 - DNA, 22 bp, Artificial Sequence
  Synthetic oligonucleotide; TTG chr2 60490411 60490432 60490416 60490411 -
atgggtacggggaactaagact

SEQ ID NO: 221236 - DNA, 22 bp, Artificial Sequence
  Synthetic oligonucleotide; CTA chr2 60490394 60490415 60490399 60490394 -
agactggaatagaaaattggag

SEQ ID NO: 221237 - DNA, 22 bp, Artificial Sequence
  Synthetic oligonucleotide; CTG chr2 60490388 60490409 60490393 60490388 -
gaatagaaaattggagttggat

SEQ ID NO: 221238 - DNA, 22 bp, Artificial Sequence
  Synthetic oligonucleotide; TTG chr2 60490375 60490396 60490380 60490375 -
gagttggattgtggagctctgg

SEQ ID NO: 221239 - DNA, 22 bp, Artificial Sequence
  Synthetic oligonucleotide; TTG chr2 60490369 60490390 60490374 60490369 -
gattgtggagctctggaatgat

SEQ ID NO: 221240 - DNA, 22 bp, Artificial Sequence
  Synthetic oligonucleotide; TTG chr2 60490364 60490385 60490369 60490364 -
tggagctctggaatgatggctt

SEQ ID NO: 221241 - DNA, 22 bp, Artificial Sequence
  Synthetic oligonucleotide; CTC chr2 60490356 60490377 60490361 60490356 -
tggaatgatggcttaaggagtt

SEQ ID NO: 221242 - DNA, 22 bp, Artificial Sequence
  Synthetic oligonucleotide; CTG chr2 60490354 60490375 60490359 60490354 -
gaatgatggcttaaggagttgg

SEQ ID NO: 221243 - DNA, 22 bp, Artificial Sequence
  Synthetic oligonucleotide; CTT chr2 60490342 60490363 60490347 60490342 -
aaggagttggaccatatcctat

SEQ ID NO: 221244 - DNA, 22 bp, Artificial Sequence
  Synthetic oligonucleotide; TTA chr2 60490341 60490362 60490346 60490341 -
aggagttggaccatatcctata

SEQ ID NO: 221245 - DNA, 22 bp, Artificial Sequence
  Synthetic oligonucleotide; TTG chr2 60490333 60490354 60490338 60490333 -
gaccatatcctatagatcacag

SEQ ID NO: 221246 - DNA, 22 bp, Artificial Sequence
  Synthetic oligonucleotide; CTA chr2 60490321 60490342 60490326 60490321 -
tagatcacagagggctgctgaa

SEQ ID NO: 221247 - DNA, 22 bp, Artificial Sequence
  Synthetic oligonucleotide; CTG chr2 60490304 60490325 60490309 60490304 -
ctgaaatactctgatcagaaga

SEQ ID NO: 221248 - DNA, 22 bp, Artificial Sequence
  Synthetic oligonucleotide; CTG chr2 60490301 60490322 60490306 60490301 -
aaatactctgatcagaagacaa

SEQ ID NO: 221249 - DNA, 22 bp, Artificial Sequence
  Synthetic oligonucleotide; CTC chr2 60490293 60490314 60490298 60490293 -
tgatcagaagacaaaggcagca

SEQ ID NO: 221250 - DNA, 22 bp, Artificial Sequence
  Synthetic oligonucleotide; CTG chr2 60490291 60490312 60490296 60490291 -
atcagaagacaaaggcagcatg

SEQ ID NO: 221251 - DNA, 22 bp, Artificial Sequence
  Synthetic oligonucleotide; CTA chr2 60490266 60490287 60490271 60490266 -
ggggatgttaagtgaggactct

SEQ ID NO: 221252 - DNA, 22 bp, Artificial Sequence
  Synthetic oligonucleotide; TTA chr2 60490256 60490277 60490261 60490256 -
agtgaggactctgcaaaggggg

SEQ ID NO: 221253 - DNA, 22 bp, Artificial Sequence
  Synthetic oligonucleotide; CTC chr2 60490245 60490266 60490250 60490245 -
tgcaaagggggtggatgagttg

SEQ ID NO: 221254 - DNA, 22 bp, Artificial Sequence
  Synthetic oligonucleotide; CTG chr2 60490243 60490264 60490248 60490243 -
caaagggggtggatgagttgtt

SEQ ID NO: 221255 - DNA, 22 bp, Artificial Sequence
  Synthetic oligonucleotide; TTG chr2 60490223 60490244 60490228 60490223 -
ttgaaattctctgttataccct

SEQ ID NO: 221256 - DNA, 22 bp, Artificial Sequence
  Synthetic oligonucleotide; TTG chr2 60490220 60490241 60490225 60490220 -
aaattctctgttatacccttca

SEQ ID NO: 221257 - DNA, 22 bp, Artificial Sequence
  Synthetic oligonucleotide; TTC chr2 60490214 60490235 60490219 60490214 -
tctgttatacccttcatgccga

SEQ ID NO: 221258 - DNA, 22 bp, Artificial Sequence
  Synthetic oligonucleotide; CTC chr2 60490212 60490233 60490217 60490212 -
tgttatacccttcatgccgagt

SEQ ID NO: 221259 - DNA, 22 bp, Artificial Sequence
  Synthetic oligonucleotide; CTG chr2 60490210 60490231 60490215 60490210 -
ttatacccttcatgccgagttc

SEQ ID NO: 221260 - DNA, 22 bp, Artificial Sequence
  Synthetic oligonucleotide; TTA chr2 60490207 60490228 60490212 60490207 -
tacccttcatgccgagttctcc

SEQ ID NO: 221261 - DNA, 22 bp, Artificial Sequence
  Synthetic oligonucleotide; CTT chr2 60490200 60490221 60490205 60490200 -
catgccgagttctcccctgttg

SEQ ID NO: 221262 - DNA, 22 bp, Artificial Sequence
  Synthetic oligonucleotide; TTC chr2 60490199 60490220 60490204 60490199 -
atgccgagttctcccctgttga

SEQ ID NO: 221263 - DNA, 22 bp, Artificial Sequence
  Synthetic oligonucleotide; TTC chr2 60490188 60490209 60490193 60490188 -
tcccctgttgacttatatgttc

SEQ ID NO: 221264 - DNA, 22 bp, Artificial Sequence
  Synthetic oligonucleotide; CTC chr2 60490186 60490207 60490191 60490186 -
ccctgttgacttatatgttcta

SEQ ID NO: 221265 - DNA, 22 bp, Artificial Sequence
  Synthetic oligonucleotide; CTG chr2 60490181 60490202 60490186 60490181 -
ttgacttatatgttctagagga

SEQ ID NO: 221266 - DNA, 22 bp, Artificial Sequence
  Synthetic oligonucleotide; TTG chr2 60490178 60490199 60490183 60490178 -
acttatatgttctagaggatgg

SEQ ID NO: 221267 - DNA, 22 bp, Artificial Sequence
  Synthetic oligonucleotide; CTT chr2 60490174 60490195 60490179 60490174 -
atatgttctagaggatggagtt

SEQ ID NO: 221268 - DNA, 22 bp, Artificial Sequence
  Synthetic oligonucleotide; TTA chr2 60490173 60490194 60490178 60490173 -
tatgttctagaggatggagttg

SEQ ID NO: 221269 - DNA, 22 bp, Artificial Sequence
  Synthetic oligonucleotide; TTC chr2 60490166 60490187 60490171 60490166 -
tagaggatggagttggttgacc

SEQ ID NO: 221270 - DNA, 22 bp, Artificial Sequence
  Synthetic oligonucleotide; CTA chr2 60490164 60490185 60490169 60490164 -
gaggatggagttggttgaccgt

SEQ ID NO: 221271 - DNA, 22 bp, Artificial Sequence
  Synthetic oligonucleotide; TTG chr2 60490151 60490172 60490156 60490151 -
gttgaccgtagggtttcctttc

SEQ ID NO: 221272 - DNA, 22 bp, Artificial Sequence
  Synthetic oligonucleotide; TTG chr2 60490147 60490168 60490152 60490147 -
accgtagggtttcctttcacta

SEQ ID NO: 221273 - DNA, 22 bp, Artificial Sequence
  Synthetic oligonucleotide; TTT chr2 60490135 60490156 60490140 60490135 -
cctttcactagcagaatggaac

SEQ ID NO: 221274 - DNA, 22 bp, Artificial Sequence
  Synthetic oligonucleotide; TTC chr2 60490134 60490155 60490139 60490134 -
ctttcactagcagaatggaacc

SEQ ID NO: 221275 - DNA, 22 bp, Artificial Sequence
  Synthetic oligonucleotide; CTT chr2 60490131 60490152 60490136 60490131 -
tcactagcagaatggaaccaga

SEQ ID NO: 221276 - DNA, 22 bp, Artificial Sequence
  Synthetic oligonucleotide; TTT chr2 60490130 60490151 60490135 60490130 -
cactagcagaatggaaccagat

SEQ ID NO: 221277 - DNA, 22 bp, Artificial Sequence
  Synthetic oligonucleotide; TTC chr2 60490129 60490150 60490134 60490129 -
actagcagaatggaaccagata

SEQ ID NO: 221278 - DNA, 22 bp, Artificial Sequence
  Synthetic oligonucleotide; CTA chr2 60490125 60490146 60490130 60490125 -
gcagaatggaaccagatattgt

SEQ ID NO: 221279 - DNA, 22 bp, Artificial Sequence
  Synthetic oligonucleotide; TTG chr2 60490104 60490125 60490109 60490104 -
taggagcctagcacatgggtct

SEQ ID NO: 221280 - DNA, 22 bp, Artificial Sequence
  Synthetic oligonucleotide; CTA chr2 60490094 60490115 60490099 60490094 -
gcacatgggtctgttactaata

SEQ ID NO: 221281 - DNA, 22 bp, Artificial Sequence
  Synthetic oligonucleotide; CTG chr2 60490081 60490102 60490086 60490081 -
ttactaatatagaggactgttt

SEQ ID NO: 221282 - DNA, 22 bp, Artificial Sequence
  Synthetic oligonucleotide; TTA chr2 60490078 60490099 60490083 60490078 -
ctaatatagaggactgtttaaa

SEQ ID NO: 221283 - DNA, 22 bp, Artificial Sequence
  Synthetic oligonucleotide; CTA chr2 60490075 60490096 60490080 60490075 -
atatagaggactgtttaaatct

SEQ ID NO: 221284 - DNA, 22 bp, Artificial Sequence
  Synthetic oligonucleotide; CTG chr2 60490062 60490083 60490067 60490062 -
tttaaatcttggaaagctttcc

SEQ ID NO: 221285 - DNA, 22 bp, Artificial Sequence
  Synthetic oligonucleotide; TTT chr2 60490059 60490080 60490064 60490059 -
aaatcttggaaagctttccttt

SEQ ID NO: 221286 - DNA, 22 bp, Artificial Sequence
  Synthetic oligonucleotide; TTA chr2 60490058 60490079 60490063 60490058 -
aatcttggaaagctttcctttt

SEQ ID NO: 221287 - DNA, 22 bp, Artificial Sequence
  Synthetic oligonucleotide; CTT chr2 60490052 60490073 60490057 60490052 -
ggaaagctttccttttgccttt

SEQ ID NO: 221288 - DNA, 22 bp, Artificial Sequence
  Synthetic oligonucleotide; TTG chr2 60490051 60490072 60490056 60490051 -
gaaagctttccttttgcctttg

SEQ ID NO: 221289 - DNA, 22 bp, Artificial Sequence
  Synthetic oligonucleotide; CTT chr2 60490043 60490064 60490048 60490043 -
tccttttgcctttgcccccatt

SEQ ID NO: 221290 - DNA, 22 bp, Artificial Sequence
  Synthetic oligonucleotide; TTT chr2 60490042 60490063 60490047 60490042 -
ccttttgcctttgcccccattg

SEQ ID NO: 221291 - DNA, 22 bp, Artificial Sequence
  Synthetic oligonucleotide; TTC chr2 60490041 60490062 60490046 60490041 -
cttttgcctttgcccccattgc

SEQ ID NO: 221292 - DNA, 22 bp, Artificial Sequence
  Synthetic oligonucleotide; CTT chr2 60490038 60490059 60490043 60490038 -
ttgcctttgcccccattgcaga

SEQ ID NO: 221293 - DNA, 22 bp, Artificial Sequence
  Synthetic oligonucleotide; TTT chr2 60490037 60490058 60490042 60490037 -
tgcctttgcccccattgcagat

SEQ ID NO: 221294 - DNA, 22 bp, Artificial Sequence
  Synthetic oligonucleotide; TTT chr2 60490036 60490057 60490041 60490036 -
gcctttgcccccattgcagatg

SEQ ID NO: 221295 - DNA, 22 bp, Artificial Sequence
  Synthetic oligonucleotide; TTG chr2 60490035 60490056 60490040 60490035 -
cctttgcccccattgcagatgg

SEQ ID NO: 221296 - DNA, 22 bp, Artificial Sequence
  Synthetic oligonucleotide; CTT chr2 60490031 60490052 60490036 60490031 -
tgcccccattgcagatggggag

SEQ ID NO: 221297 - DNA, 22 bp, Artificial Sequence
  Synthetic oligonucleotide; TTT chr2 60490030 60490051 60490035 60490030 -
gcccccattgcagatggggagt

SEQ ID NO: 221298 - DNA, 22 bp, Artificial Sequence
  Synthetic oligonucleotide; TTG chr2 60490029 60490050 60490034 60490029 -
cccccattgcagatggggagtg

SEQ ID NO: 221299 - DNA, 22 bp, Artificial Sequence
  Synthetic oligonucleotide; TTG chr2 60490020 60490041 60490025 60490020 -
cagatggggagtgggcaggaat

SEQ ID NO: 221300 - DNA, 22 bp, Artificial Sequence
  Synthetic oligonucleotide; TTC chr2 60489991 60490012 60489996 60489991 -
agaatcaagggcccatcagggt

SEQ ID NO: 221301 - DNA, 22 bp, Artificial Sequence
  Synthetic oligonucleotide; CTG chr2 60489966 60489987 60489971 60489966 -
tattggtcccttgtccctctcc

SEQ ID NO: 221302 - DNA, 22 bp, Artificial Sequence
  Synthetic oligonucleotide; TTG chr2 60489961 60489982 60489966 60489961 -
gtcccttgtccctctcctccag

SEQ ID NO: 221303 - DNA, 22 bp, Artificial Sequence
  Synthetic oligonucleotide; CTT chr2 60489954 60489975 60489959 60489954 -
gtccctctcctccagtccatcc

SEQ ID NO: 221304 - DNA, 22 bp, Artificial Sequence
  Synthetic oligonucleotide; TTG chr2 60489953 60489974 60489958 60489953 -
tccctctcctccagtccatcca

SEQ ID NO: 221305 - DNA, 22 bp, Artificial Sequence
  Synthetic oligonucleotide; CTC chr2 60489947 60489968 60489952 60489947 -
tcctccagtccatccatgttgg

SEQ ID NO: 221306 - DNA, 22 bp, Artificial Sequence
  Synthetic oligonucleotide; CTC chr2 60489945 60489966 60489950 60489945 -
ctccagtccatccatgttggga

SEQ ID NO: 221307 - DNA, 22 bp, Artificial Sequence
  Synthetic oligonucleotide; CTC chr2 60489942 60489963 60489947 60489942 -
cagtccatccatgttgggatac

SEQ ID NO: 221308 - DNA, 22 bp, Artificial Sequence
  Synthetic oligonucleotide; TTG chr2 60489926 60489947 60489931 60489926 -
ggatactcagggcatggatggt

SEQ ID NO: 221309 - DNA, 22 bp, Artificial Sequence
  Synthetic oligonucleotide; CTC chr2 60489918 60489939 60489923 60489918 -
agggcatggatggtgtttcatg

SEQ ID NO: 221310 - DNA, 22 bp, Artificial Sequence
  Synthetic oligonucleotide; TTT chr2 60489900 60489921 60489905 60489900 -
catgatagcatttatcattttg

SEQ ID NO: 221311 - DNA, 22 bp, Artificial Sequence
  Synthetic oligonucleotide; TTC chr2 60489899 60489920 60489904 60489899 -
atgatagcatttatcattttga

SEQ ID NO: 221312 - DNA, 22 bp, Artificial Sequence
  Synthetic oligonucleotide; TTT chr2 60489887 60489908 60489892 60489887 -
atcattttgatgatatgtgaca

SEQ ID NO: 221313 - DNA, 22 bp, Artificial Sequence
  Synthetic oligonucleotide; TTA chr2 60489886 60489907 60489891 60489886 -
tcattttgatgatatgtgacaa

SEQ ID NO: 221314 - DNA, 22 bp, Artificial Sequence
  Synthetic oligonucleotide; TTT chr2 60489880 60489901 60489885 60489880 -
tgatgatatgtgacaaaataag

SEQ ID NO: 221315 - DNA, 22 bp, Artificial Sequence
  Synthetic oligonucleotide; TTT chr2 60489879 60489900 60489884 60489879 -
gatgatatgtgacaaaataagg

SEQ ID NO: 221316 - DNA, 22 bp, Artificial Sequence
  Synthetic oligonucleotide; TTG chr2 60489878 60489899 60489883 60489878 -
atgatatgtgacaaaataaggc

SEQ ID NO: 221317 - DNA, 22 bp, Artificial Sequence
  Synthetic oligonucleotide; TTC chr2 60489842 60489863 60489847 60489842 -
atatccctgtgatctctcttta

SEQ ID NO: 221318 - DNA, 22 bp, Artificial Sequence
  Synthetic oligonucleotide; CTG chr2 60489833 60489854 60489838 60489833 -
tgatctctctttaatagtgtcc

SEQ ID NO: 221319 - DNA, 22 bp, Artificial Sequence
  Synthetic oligonucleotide; CTC chr2 60489826 60489847 60489831 60489826 -
tctttaatagtgtcctcctgct

SEQ ID NO: 221320 - DNA, 22 bp, Artificial Sequence
  Synthetic oligonucleotide; CTC chr2 60489824 60489845 60489829 60489824 -
tttaatagtgtcctcctgcttt

SEQ ID NO: 221321 - DNA, 22 bp, Artificial Sequence
  Synthetic oligonucleotide; CTT chr2 60489822 60489843 60489827 60489822 -
taatagtgtcctcctgctttgg

SEQ ID NO: 221322 - DNA, 22 bp, Artificial Sequence
  Synthetic oligonucleotide; TTT chr2 60489821 60489842 60489826 60489821 -
aatagtgtcctcctgctttggg

SEQ ID NO: 221323 - DNA, 22 bp, Artificial Sequence
  Synthetic oligonucleotide; TTA chr2 60489820 60489841 60489825 60489820 -
atagtgtcctcctgctttgggg

SEQ ID NO: 221324 - DNA, 22 bp, Artificial Sequence
  Synthetic oligonucleotide; CTC chr2 60489809 60489830 60489814 60489809 -
ctgctttgggggttattaagct

SEQ ID NO: 221325 - DNA, 22 bp, Artificial Sequence
  Synthetic oligonucleotide; CTG chr2 60489806 60489827 60489811 60489806 -
ctttgggggttattaagctagc

SEQ ID NO: 221326 - DNA, 22 bp, Artificial Sequence
  Synthetic oligonucleotide; CTT chr2 60489803 60489824 60489808 60489803 -
tgggggttattaagctagcctg

SEQ ID NO: 221327 - DNA, 22 bp, Artificial Sequence
  Synthetic oligonucleotide; TTT chr2 60489802 60489823 60489807 60489802 -
gggggttattaagctagcctga

SEQ ID NO: 221328 - DNA, 22 bp, Artificial Sequence
  Synthetic oligonucleotide; TTG chr2 60489801 60489822 60489806 60489801 -
ggggttattaagctagcctgaa

SEQ ID NO: 221329 - DNA, 22 bp, Artificial Sequence
  Synthetic oligonucleotide; TTA chr2 60489794 60489815 60489799 60489794 -
ttaagctagcctgaacttgagt

SEQ ID NO: 221330 - DNA, 22 bp, Artificial Sequence
  Synthetic oligonucleotide; TTA chr2 60489791 60489812 60489796 60489791 -
agctagcctgaacttgagtaaa

SEQ ID NO: 221331 - DNA, 22 bp, Artificial Sequence
  Synthetic oligonucleotide; CTA chr2 60489786 60489807 60489791 60489786 -
gcctgaacttgagtaaacattt

SEQ ID NO: 221332 - DNA, 22 bp, Artificial Sequence
  Synthetic oligonucleotide; CTG chr2 60489781 60489802 60489786 60489781 -
aacttgagtaaacatttttgga

SEQ ID NO: 221333 - DNA, 22 bp, Artificial Sequence
  Synthetic oligonucleotide; CTT chr2 60489776 60489797 60489781 60489776 -
gagtaaacatttttggatgggg

SEQ ID NO: 221334 - DNA, 22 bp, Artificial Sequence
  Synthetic oligonucleotide; TTG chr2 60489775 60489796 60489780 60489775 -
agtaaacatttttggatggggt

SEQ ID NO: 221335 - DNA, 22 bp, Artificial Sequence
  Synthetic oligonucleotide; TTT chr2 60489764 60489785 60489769 60489764 -
ttggatggggtgagaggggggc

SEQ ID NO: 221336 - DNA, 22 bp, Artificial Sequence
  Synthetic oligonucleotide; TTT chr2 60489763 60489784 60489768 60489763 -
tggatggggtgagaggggggct

SEQ ID NO: 221337 - DNA, 22 bp, Artificial Sequence
  Synthetic oligonucleotide; TTT chr2 60489762 60489783 60489767 60489762 -
ggatggggtgagaggggggctg

SEQ ID NO: 221338 - DNA, 22 bp, Artificial Sequence
  Synthetic oligonucleotide; TTG chr2 60489761 60489782 60489766 60489761 -
gatggggtgagaggggggctga

SEQ ID NO: 221339 - DNA, 22 bp, Artificial Sequence
  Synthetic oligonucleotide; CTG chr2 60489740 60489761 60489745 60489740 -
ataaaagtggttagtaaataga

SEQ ID NO: 221340 - DNA, 22 bp, Artificial Sequence
  Synthetic oligonucleotide; TTA chr2 60489727 60489748 60489732 60489727 -
gtaaatagacagttggaaagga

SEQ ID NO: 221341 - DNA, 22 bp, Artificial Sequence
  Synthetic oligonucleotide; TTG chr2 60489712 60489733 60489717 60489712 -
gaaaggagaacggcccgggggc

SEQ ID NO: 221342 - DNA, 22 bp, Artificial Sequence
  Synthetic oligonucleotide; CTC chr2 60489688 60489709 60489693 60489688 -
aggagatgagccagggaacaag

SEQ ID NO: 221343 - DNA, 22 bp, Artificial Sequence
  Synthetic oligonucleotide; CTA chr2 60489650 60489671 60489655 60489650 -
gtgacccagagtgtcctagagg

SEQ ID NO: 221344 - DNA, 22 bp, Artificial Sequence
  Synthetic oligonucleotide; CTA chr2 60489632 60489653 60489637 60489632 -
gaggggaaagaacctctgttag

SEQ ID NO: 221345 - DNA, 22 bp, Artificial Sequence
  Synthetic oligonucleotide; CTC chr2 60489616 60489637 60489621 60489616 -
tgttagaatttcaaatgtcaga

SEQ ID NO: 221346 - DNA, 22 bp, Artificial Sequence
  Synthetic oligonucleotide; CTG chr2 60489614 60489635 60489619 60489614 -
ttagaatttcaaatgtcagact

SEQ ID NO: 221347 - DNA, 22 bp, Artificial Sequence
  Synthetic oligonucleotide; TTA chr2 60489611 60489632 60489616 60489611 -
gaatttcaaatgtcagactttc

SEQ ID NO: 221348 - DNA, 22 bp, Artificial Sequence
  Synthetic oligonucleotide; TTT chr2 60489605 60489626 60489610 60489605 -
caaatgtcagactttcttttca

SEQ ID NO: 221349 - DNA, 22 bp, Artificial Sequence
  Synthetic oligonucleotide; TTC chr2 60489604 60489625 60489609 60489604 -
aaatgtcagactttcttttcag

SEQ ID NO: 221350 - DNA, 22 bp, Artificial Sequence
  Synthetic oligonucleotide; CTT chr2 60489591 60489612 60489596 60489591 -
tcttttcagcttccttcaggtg

SEQ ID NO: 221351 - DNA, 22 bp, Artificial Sequence
  Synthetic oligonucleotide; TTT chr2 60489590 60489611 60489595 60489590 -
cttttcagcttccttcaggtgc

SEQ ID NO: 221352 - DNA, 22 bp, Artificial Sequence
  Synthetic oligonucleotide; TTC chr2 60489589 60489610 60489594 60489589 -
ttttcagcttccttcaggtgct

SEQ ID NO: 221353 - DNA, 22 bp, Artificial Sequence
  Synthetic oligonucleotide; CTT chr2 60489587 60489608 60489592 60489587 -
ttcagcttccttcaggtgcttc

SEQ ID NO: 221354 - DNA, 22 bp, Artificial Sequence
  Synthetic oligonucleotide; TTT chr2 60489586 60489607 60489591 60489586 -
tcagcttccttcaggtgcttcc

SEQ ID NO: 221355 - DNA, 22 bp, Artificial Sequence
  Synthetic oligonucleotide; TTT chr2 60489585 60489606 60489590 60489585 -
cagcttccttcaggtgcttcct

SEQ ID NO: 221356 - DNA, 22 bp, Artificial Sequence
  Synthetic oligonucleotide; TTC chr2 60489584 60489605 60489589 60489584 -
agcttccttcaggtgcttcctc

SEQ ID NO: 221357 - DNA, 22 bp, Artificial Sequence
  Synthetic oligonucleotide; CTT chr2 60489579 60489600 60489584 60489579 -
ccttcaggtgcttcctcttcta

SEQ ID NO: 221358 - DNA, 22 bp, Artificial Sequence
  Synthetic oligonucleotide; TTC chr2 60489578 60489599 60489583 60489578 -
cttcaggtgcttcctcttctac

SEQ ID NO: 221359 - DNA, 22 bp, Artificial Sequence
  Synthetic oligonucleotide; CTT chr2 60489575 60489596 60489580 60489575 -
caggtgcttcctcttctactca

SEQ ID NO: 221360 - DNA, 22 bp, Artificial Sequence
  Synthetic oligonucleotide; TTC chr2 60489574 60489595 60489579 60489574 -
aggtgcttcctcttctactcag

SEQ ID NO: 221361 - DNA, 22 bp, Artificial Sequence
  Synthetic oligonucleotide; CTT chr2 60489566 60489587 60489571 60489566 -
cctcttctactcagaattttct

SEQ ID NO: 221362 - DNA, 22 bp, Artificial Sequence
  Synthetic oligonucleotide; TTC chr2 60489565 60489586 60489570 60489565 -
ctcttctactcagaattttctt

SEQ ID NO: 221363 - DNA, 22 bp, Artificial Sequence
  Synthetic oligonucleotide; CTC chr2 60489562 60489583 60489567 60489562 -
ttctactcagaattttcttttg

SEQ ID NO: 221364 - DNA, 22 bp, Artificial Sequence
  Synthetic oligonucleotide; CTT chr2 60489560 60489581 60489565 60489560 -
ctactcagaattttcttttgag

SEQ ID NO: 221365 - DNA, 22 bp, Artificial Sequence
  Synthetic oligonucleotide; TTC chr2 60489559 60489580 60489564 60489559 -
tactcagaattttcttttgaga

SEQ ID NO: 221366 - DNA, 22 bp, Artificial Sequence
  Synthetic oligonucleotide; CTA chr2 60489557 60489578 60489562 60489557 -
ctcagaattttcttttgagata

SEQ ID NO: 221367 - DNA, 22 bp, Artificial Sequence
  Synthetic oligonucleotide; CTC chr2 60489554 60489575 60489559 60489554 -
agaattttcttttgagataggt

SEQ ID NO: 221368 - DNA, 22 bp, Artificial Sequence
  Synthetic oligonucleotide; TTT chr2 60489547 60489568 60489552 60489547 -
tcttttgagataggtgctggtc

SEQ ID NO: 221369 - DNA, 22 bp, Artificial Sequence
  Synthetic oligonucleotide; TTT chr2 60489546 60489567 60489551 60489546 -
cttttgagataggtgctggtca

SEQ ID NO: 221370 - DNA, 22 bp, Artificial Sequence
  Synthetic oligonucleotide; TTC chr2 60489545 60489566 60489550 60489545 -
ttttgagataggtgctggtcaa

SEQ ID NO: 221371 - DNA, 22 bp, Artificial Sequence
  Synthetic oligonucleotide; CTT chr2 60489543 60489564 60489548 60489543 -
ttgagataggtgctggtcaaac

SEQ ID NO: 221372 - DNA, 22 bp, Artificial Sequence
  Synthetic oligonucleotide; TTT chr2 60489542 60489563 60489547 60489542 -
tgagataggtgctggtcaaaca

SEQ ID NO: 221373 - DNA, 22 bp, Artificial Sequence
  Synthetic oligonucleotide; TTT chr2 60489541 60489562 60489546 60489541 -
gagataggtgctggtcaaacaa

SEQ ID NO: 221374 - DNA, 22 bp, Artificial Sequence
  Synthetic oligonucleotide; TTG chr2 60489540 60489561 60489545 60489540 -
agataggtgctggtcaaacaag

SEQ ID NO: 221375 - DNA, 22 bp, Artificial Sequence
  Synthetic oligonucleotide; CTG chr2 60489528 60489549 60489533 60489528 -
gtcaaacaagcttttgtttgtg

SEQ ID NO: 221376 - DNA, 22 bp, Artificial Sequence
  Synthetic oligonucleotide; CTT chr2 60489515 60489536 60489520 60489515 -
ttgtttgtggctggtcacttgg

SEQ ID NO: 221377 - DNA, 22 bp, Artificial Sequence
  Synthetic oligonucleotide; TTT chr2 60489514 60489535 60489519 60489514 -
tgtttgtggctggtcacttggc

SEQ ID NO: 221378 - DNA, 22 bp, Artificial Sequence
  Synthetic oligonucleotide; TTT chr2 60489513 60489534 60489518 60489513 -
gtttgtggctggtcacttggca

SEQ ID NO: 221379 - DNA, 22 bp, Artificial Sequence
  Synthetic oligonucleotide; TTG chr2 60489512 60489533 60489517 60489512 -
tttgtggctggtcacttggcac

SEQ ID NO: 221380 - DNA, 22 bp, Artificial Sequence
  Synthetic oligonucleotide; TTT chr2 60489509 60489530 60489514 60489509 -
gtggctggtcacttggcacaca

SEQ ID NO: 221381 - DNA, 22 bp, Artificial Sequence
  Synthetic oligonucleotide; TTG chr2 60489508 60489529 60489513 60489508 -
tggctggtcacttggcacacag

SEQ ID NO: 221382 - DNA, 22 bp, Artificial Sequence
  Synthetic oligonucleotide; CTG chr2 60489502 60489523 60489507 60489502 -
gtcacttggcacacagtgtggc

SEQ ID NO: 221383 - DNA, 22 bp, Artificial Sequence
  Synthetic oligonucleotide; CTT chr2 60489495 60489516 60489500 60489495 -
ggcacacagtgtggctgtttgt

SEQ ID NO: 221384 - DNA, 22 bp, Artificial Sequence
  Synthetic oligonucleotide; TTG chr2 60489494 60489515 60489499 60489494 -
gcacacagtgtggctgtttgtc

SEQ ID NO: 221385 - DNA, 22 bp, Artificial Sequence
  Synthetic oligonucleotide; CTG chr2 60489478 60489499 60489483 60489478 -
tttgtcatcctggatgatgagg

SEQ ID NO: 221386 - DNA, 22 bp, Artificial Sequence
  Synthetic oligonucleotide; TTT chr2 60489475 60489496 60489480 60489475 -
gtcatcctggatgatgaggcag

SEQ ID NO: 221387 - DNA, 22 bp, Artificial Sequence
  Synthetic oligonucleotide; TTG chr2 60489474 60489495 60489479 60489474 -
tcatcctggatgatgaggcagc

SEQ ID NO: 221388 - DNA, 22 bp, Artificial Sequence
  Synthetic oligonucleotide; CTG chr2 60489466 60489487 60489471 60489466 -
gatgatgaggcagctattttaa

SEQ ID NO: 221389 - DNA, 22 bp, Artificial Sequence
  Synthetic oligonucleotide; CTA chr2 60489450 60489471 60489455 60489450 -
ttttaatggcacgcagggccgc

SEQ ID NO: 221390 - DNA, 22 bp, Artificial Sequence
  Synthetic oligonucleotide; TTT chr2 60489447 60489468 60489452 60489447 -
taatggcacgcagggccgccgt

SEQ ID NO: 221391 - DNA, 22 bp, Artificial Sequence
  Synthetic oligonucleotide; TTT chr2 60489446 60489467 60489451 60489446 -
aatggcacgcagggccgccgtg

SEQ ID NO: 221392 - DNA, 22 bp, Artificial Sequence
  Synthetic oligonucleotide; TTA chr2 60489445 60489466 60489450 60489445 -
atggcacgcagggccgccgtgt

SEQ ID NO: 221393 - DNA, 22 bp, Artificial Sequence
  Synthetic oligonucleotide; TTT chr2 60489419 60489440 60489424 60489419 -
actgccaagaaataagggcttc

SEQ ID NO: 221394 - DNA, 22 bp, Artificial Sequence
  Synthetic oligonucleotide; TTA chr2 60489418 60489439 60489423 60489418 -
ctgccaagaaataagggcttct

SEQ ID NO: 221395 - DNA, 22 bp, Artificial Sequence
  Synthetic oligonucleotide; CTG chr2 60489415 60489436 60489420 60489415 -
ccaagaaataagggcttctagg

SEQ ID NO: 221396 - DNA, 22 bp, Artificial Sequence
  Synthetic oligonucleotide; CTT chr2 60489398 60489419 60489403 60489398 -
ctaggagacttggtggctttag

SEQ ID NO: 221397 - DNA, 22 bp, Artificial Sequence
  Synthetic oligonucleotide; TTC chr2 60489397 60489418 60489402 60489397 -
taggagacttggtggctttagg

SEQ ID NO: 221398 - DNA, 22 bp, Artificial Sequence
  Synthetic oligonucleotide; CTA chr2 60489395 60489416 60489400 60489395 -
ggagacttggtggctttaggaa

SEQ ID NO: 221399 - DNA, 22 bp, Artificial Sequence
  Synthetic oligonucleotide; CTT chr2 60489387 60489408 60489392 60489387 -
ggtggctttaggaacaaacttc

SEQ ID NO: 221400 - DNA, 22 bp, Artificial Sequence
  Synthetic oligonucleotide; TTG chr2 60489386 60489407 60489391 60489386 -
gtggctttaggaacaaacttcc

SEQ ID NO: 221401 - DNA, 22 bp, Artificial Sequence
  Synthetic oligonucleotide; CTT chr2 60489379 60489400 60489384 60489379 -
taggaacaaacttccagcggca

SEQ ID NO: 221402 - DNA, 22 bp, Artificial Sequence
  Synthetic oligonucleotide; TTT chr2 60489378 60489399 60489383 60489378 -
aggaacaaacttccagcggcag

SEQ ID NO: 221403 - DNA, 22 bp, Artificial Sequence
  Synthetic oligonucleotide; TTA chr2 60489377 60489398 60489382 60489377 -
ggaacaaacttccagcggcaga

SEQ ID NO: 221404 - DNA, 22 bp, Artificial Sequence
  Synthetic oligonucleotide; CTT chr2 60489366 60489387 60489371 60489366 -
ccagcggcagaaattagttagg

SEQ ID NO: 221405 - DNA, 22 bp, Artificial Sequence
  Synthetic oligonucleotide; TTC chr2 60489365 60489386 60489370 60489365 -
cagcggcagaaattagttagga

SEQ ID NO: 221406 - DNA, 22 bp, Artificial Sequence
  Synthetic oligonucleotide; TTA chr2 60489350 60489371 60489355 60489350 -
gttaggaagcagagtagcactg

SEQ ID NO: 221407 - DNA, 22 bp, Artificial Sequence
  Synthetic oligonucleotide; TTA chr2 60489346 60489367 60489351 60489346 -
ggaagcagagtagcactgggtt

SEQ ID NO: 221408 - DNA, 22 bp, Artificial Sequence
  Synthetic oligonucleotide; CTG chr2 60489328 60489349 60489333 60489328 -
ggttccaaatgcctctattgta

SEQ ID NO: 221409 - DNA, 22 bp, Artificial Sequence
  Synthetic oligonucleotide; TTC chr2 60489323 60489344 60489328 60489323 -
caaatgcctctattgtatgaat

SEQ ID NO: 221410 - DNA, 22 bp, Artificial Sequence
  Synthetic oligonucleotide; CTC chr2 60489313 60489334 60489318 60489313 -
tattgtatgaatttggatatgt

SEQ ID NO: 221411 - DNA, 22 bp, Artificial Sequence
  Synthetic oligonucleotide; CTA chr2 60489311 60489332 60489316 60489311 -
ttgtatgaatttggatatgttg

SEQ ID NO: 221412 - DNA, 22 bp, Artificial Sequence
  Synthetic oligonucleotide; TTG chr2 60489308 60489329 60489313 60489308 -
tatgaatttggatatgttgtgg

SEQ ID NO: 221413 - DNA, 22 bp, Artificial Sequence
  Synthetic oligonucleotide; TTT chr2 60489299 60489320 60489304 60489299 -
ggatatgttgtgggcaaaatga

SEQ ID NO: 221414 - DNA, 22 bp, Artificial Sequence
  Synthetic oligonucleotide; TTG chr2 60489298 60489319 60489303 60489298 -
gatatgttgtgggcaaaatgac

SEQ ID NO: 221415 - DNA, 22 bp, Artificial Sequence
  Synthetic oligonucleotide; TTG chr2 60489289 60489310 60489294 60489289 -
tgggcaaaatgacataaaagaa

SEQ ID NO: 221416 - DNA, 22 bp, Artificial Sequence
  Synthetic oligonucleotide; CTG chr2 60489239 60489260 60489244 60489239 -
acaaggaccccattggcatgtg

SEQ ID NO: 221417 - DNA, 22 bp, Artificial Sequence
  Synthetic oligonucleotide; TTG chr2 60489224 60489245 60489229 60489224 -
gcatgtgggctagtgttgactg

SEQ ID NO: 221418 - DNA, 22 bp, Artificial Sequence
  Synthetic oligonucleotide; CTA chr2 60489212 60489233 60489217 60489212 -
gtgttgactggctctcacagtg

SEQ ID NO: 221419 - DNA, 22 bp, Artificial Sequence
  Synthetic oligonucleotide; TTG chr2 60489206 60489227 60489211 60489206 -
actggctctcacagtgtgaatt

SEQ ID NO: 221420 - DNA, 22 bp, Artificial Sequence
  Synthetic oligonucleotide; CTG chr2 60489202 60489223 60489207 60489202 -
gctctcacagtgtgaatttagt

SEQ ID NO: 221421 - DNA, 22 bp, Artificial Sequence
  Synthetic oligonucleotide; CTC chr2 60489198 60489219 60489203 60489198 -
tcacagtgtgaatttagttagg

SEQ ID NO: 221422 - DNA, 22 bp, Artificial Sequence
  Synthetic oligonucleotide; CTC chr2 60489196 60489217 60489201 60489196 -
acagtgtgaatttagttaggtg

SEQ ID NO: 221423 - DNA, 22 bp, Artificial Sequence
  Synthetic oligonucleotide; TTT chr2 60489183 60489204 60489188 60489183 -
agttaggtgtttccactttatt

SEQ ID NO: 221424 - DNA, 22 bp, Artificial Sequence
  Synthetic oligonucleotide; TTA chr2 60489182 60489203 60489187 60489182 -
gttaggtgtttccactttattt

SEQ ID NO: 221425 - DNA, 22 bp, Artificial Sequence
  Synthetic oligonucleotide; TTA chr2 60489178 60489199 60489183 60489178 -
ggtgtttccactttattttccc

SEQ ID NO: 221426 - DNA, 22 bp, Artificial Sequence
  Synthetic oligonucleotide; TTT chr2 60489171 60489192 60489176 60489171 -
ccactttattttccccaaactc

SEQ ID NO: 221427 - DNA, 22 bp, Artificial Sequence
  Synthetic oligonucleotide; TTC chr2 60489170 60489191 60489175 60489170 -
cactttattttccccaaactct

SEQ ID NO: 221428 - DNA, 22 bp, Artificial Sequence
  Synthetic oligonucleotide; CTT chr2 60489165 60489186 60489170 60489165 -
tattttccccaaactctaaagc

SEQ ID NO: 221429 - DNA, 22 bp, Artificial Sequence
  Synthetic oligonucleotide; TTT chr2 60489164 60489185 60489169 60489164 -
attttccccaaactctaaagca

SEQ ID NO: 221430 - DNA, 22 bp, Artificial Sequence
  Synthetic oligonucleotide; TTA chr2 60489163 60489184 60489168 60489163 -
ttttccccaaactctaaagcaa

SEQ ID NO: 221431 - DNA, 22 bp, Artificial Sequence
  Synthetic oligonucleotide; TTT chr2 60489160 60489181 60489165 60489160 -
tccccaaactctaaagcaacag

SEQ ID NO: 221432 - DNA, 22 bp, Artificial Sequence
  Synthetic oligonucleotide; TTT chr2 60489159 60489180 60489164 60489159 -
ccccaaactctaaagcaacagt

SEQ ID NO: 221433 - DNA, 22 bp, Artificial Sequence
  Synthetic oligonucleotide; TTC chr2 60489158 60489179 60489163 60489158 -
cccaaactctaaagcaacagtt

SEQ ID NO: 221434 - DNA, 22 bp, Artificial Sequence
  Synthetic oligonucleotide; CTC chr2 60489149 60489170 60489154 60489149 -
taaagcaacagtttaattgggg

SEQ ID NO: 221435 - DNA, 22 bp, Artificial Sequence
  Synthetic oligonucleotide; CTA chr2 60489147 60489168 60489152 60489147 -
aagcaacagtttaattggggtc

SEQ ID NO: 221436 - DNA, 22 bp, Artificial Sequence
  Synthetic oligonucleotide; TTT chr2 60489135 60489156 60489140 60489135 -
aattggggtctaaggtaccctt

SEQ ID NO: 221437 - DNA, 22 bp, Artificial Sequence
  Synthetic oligonucleotide; TTA chr2 60489134 60489155 60489139 60489134 -
attggggtctaaggtacccttt

SEQ ID NO: 221438 - DNA, 22 bp, Artificial Sequence
  Synthetic oligonucleotide; TTG chr2 60489130 60489151 60489135 60489130 -
gggtctaaggtaccctttagaa

SEQ ID NO: 221439 - DNA, 22 bp, Artificial Sequence
  Synthetic oligonucleotide; CTA chr2 60489123 60489144 60489128 60489123 -
aggtaccctttagaaacatttt

SEQ ID NO: 221440 - DNA, 22 bp, Artificial Sequence
  Synthetic oligonucleotide; CTT chr2 60489113 60489134 60489118 60489113 -
tagaaacattttgaccacctat

SEQ ID NO: 221441 - DNA, 22 bp, Artificial Sequence
  Synthetic oligonucleotide; TTT chr2 60489112 60489133 60489117 60489112 -
agaaacattttgaccacctatt

SEQ ID NO: 221442 - DNA, 22 bp, Artificial Sequence
  Synthetic oligonucleotide; TTA chr2 60489111 60489132 60489116 60489111 -
gaaacattttgaccacctatta

SEQ ID NO: 221443 - DNA, 22 bp, Artificial Sequence
  Synthetic oligonucleotide; TTT chr2 60489102 60489123 60489107 60489102 -
tgaccacctattatttaggaca

SEQ ID NO: 221444 - DNA, 22 bp, Artificial Sequence
  Synthetic oligonucleotide; TTT chr2 60489101 60489122 60489106 60489101 -
gaccacctattatttaggacac

SEQ ID NO: 221445 - DNA, 22 bp, Artificial Sequence
  Synthetic oligonucleotide; TTG chr2 60489100 60489121 60489105 60489100 -
accacctattatttaggacaca

SEQ ID NO: 221446 - DNA, 22 bp, Artificial Sequence
  Synthetic oligonucleotide; CTA chr2 60489092 60489113 60489097 60489092 -
ttatttaggacacacagcattt

SEQ ID NO: 221447 - DNA, 22 bp, Artificial Sequence
  Synthetic oligonucleotide; TTA chr2 60489089 60489110 60489094 60489089 -
tttaggacacacagcatttttt

SEQ ID NO: 221448 - DNA, 22 bp, Artificial Sequence
  Synthetic oligonucleotide; TTT chr2 60489086 60489107 60489091 60489086 -
aggacacacagcattttttttc

SEQ ID NO: 221449 - DNA, 22 bp, Artificial Sequence
  Synthetic oligonucleotide; TTA chr2 60489085 60489106 60489090 60489085 -
ggacacacagcattttttttct

SEQ ID NO: 221450 - DNA, 22 bp, Artificial Sequence
  Synthetic oligonucleotide; TTT chr2 60489070 60489091 60489075 60489070 -
tttttctttgaagataaatttg

SEQ ID NO: 221451 - DNA, 22 bp, Artificial Sequence
  Synthetic oligonucleotide; TTT chr2 60489069 60489090 60489074 60489069 -
ttttctttgaagataaatttgt

SEQ ID NO: 221452 - DNA, 22 bp, Artificial Sequence
  Synthetic oligonucleotide; TTT chr2 60489068 60489089 60489073 60489068 -
tttctttgaagataaatttgtt

SEQ ID NO: 221453 - DNA, 22 bp, Artificial Sequence
  Synthetic oligonucleotide; TTT chr2 60489067 60489088 60489072 60489067 -
ttctttgaagataaatttgttt

SEQ ID NO: 221454 - DNA, 22 bp, Artificial Sequence
  Synthetic oligonucleotide; TTT chr2 60489066 60489087 60489071 60489066 -
tctttgaagataaatttgtttt

SEQ ID NO: 221455 - DNA, 22 bp, Artificial Sequence
  Synthetic oligonucleotide; TTT chr2 60489065 60489086 60489070 60489065 -
ctttgaagataaatttgttttg

SEQ ID NO: 221456 - DNA, 22 bp, Artificial Sequence
  Synthetic oligonucleotide; TTC chr2 60489064 60489085 60489069 60489064 -
tttgaagataaatttgttttgg

SEQ ID NO: 221457 - DNA, 22 bp, Artificial Sequence
  Synthetic oligonucleotide; CTT chr2 60489062 60489083 60489067 60489062 -
tgaagataaatttgttttgggt

SEQ ID NO: 221458 - DNA, 22 bp, Artificial Sequence
  Synthetic oligonucleotide; TTT chr2 60489061 60489082 60489066 60489061 -
gaagataaatttgttttgggta

SEQ ID NO: 221459 - DNA, 22 bp, Artificial Sequence
  Synthetic oligonucleotide; TTG chr2 60489060 60489081 60489065 60489060 -
aagataaatttgttttgggtat

SEQ ID NO: 221460 - DNA, 22 bp, Artificial Sequence
  Synthetic oligonucleotide; TTT chr2 60489049 60489070 60489054 60489049 -
gttttgggtatggctgggtgtg

SEQ ID NO: 221461 - DNA, 22 bp, Artificial Sequence
  Synthetic oligonucleotide; TTG chr2 60489048 60489069 60489053 60489048 -
ttttgggtatggctgggtgtgg

SEQ ID NO: 221462 - DNA, 22 bp, Artificial Sequence
  Synthetic oligonucleotide; TTT chr2 60489045 60489066 60489050 60489045 -
tgggtatggctgggtgtggtag

SEQ ID NO: 221463 - DNA, 22 bp, Artificial Sequence
  Synthetic oligonucleotide; TTT chr2 60489044 60489065 60489049 60489044 -
gggtatggctgggtgtggtagc

SEQ ID NO: 221464 - DNA, 22 bp, Artificial Sequence
  Synthetic oligonucleotide; TTG chr2 60489043 60489064 60489048 60489043 -
ggtatggctgggtgtggtagct

SEQ ID NO: 221465 - DNA, 22 bp, Artificial Sequence
  Synthetic oligonucleotide; CTG chr2 60489033 60489054 60489038 60489033 -
ggtgtggtagcttatgcctata

SEQ ID NO: 221466 - DNA, 22 bp, Artificial Sequence
  Synthetic oligonucleotide; CTT chr2 60489020 60489041 60489025 60489020 -
atgcctataatcccagcacttt

SEQ ID NO: 221467 - DNA, 22 bp, Artificial Sequence
  Synthetic oligonucleotide; TTA chr2 60489019 60489040 60489024 60489019 -
tgcctataatcccagcactttg

SEQ ID NO: 221468 - DNA, 22 bp, Artificial Sequence
  Synthetic oligonucleotide; CTA chr2 60489013 60489034 60489018 60489013 -
taatcccagcactttgggaggc

SEQ ID NO: 221469 - DNA, 22 bp, Artificial Sequence
  Synthetic oligonucleotide; CTT chr2 60488999 60489020 60489004 60488999 -
tgggaggctgaggtgggtggat

SEQ ID NO: 221470 - DNA, 22 bp, Artificial Sequence
  Synthetic oligonucleotide; TTT chr2 60488998 60489019 60489003 60488998 -
gggaggctgaggtgggtggatc

SEQ ID NO: 221471 - DNA, 22 bp, Artificial Sequence
  Synthetic oligonucleotide; TTG chr2 60488997 60489018 60489002 60488997 -
ggaggctgaggtgggtggatca

SEQ ID NO: 221472 - DNA, 22 bp, Artificial Sequence
  Synthetic oligonucleotide; CTG chr2 60488989 60489010 60488994 60488989 -
aggtgggtggatcacctaaggt

SEQ ID NO: 221473 - DNA, 22 bp, Artificial Sequence
  Synthetic oligonucleotide; CTA chr2 60488971 60488992 60488976 60488971 -
aggtcgggagtttgagaccagc

SEQ ID NO: 221474 - DNA, 22 bp, Artificial Sequence
  Synthetic oligonucleotide; TTT chr2 60488958 60488979 60488963 60488958 -
gagaccagcctgaccaacatgg

SEQ ID NO: 221475 - DNA, 22 bp, Artificial Sequence
  Synthetic oligonucleotide; TTG chr2 60488957 60488978 60488962 60488957 -
agaccagcctgaccaacatgga

SEQ ID NO: 221476 - DNA, 22 bp, Artificial Sequence
  Synthetic oligonucleotide; CTG chr2 60488946 60488967 60488951 60488946 -
accaacatggagaaaccccgtc

SEQ ID NO: 221477 - DNA, 22 bp, Artificial Sequence
  Synthetic oligonucleotide; CTC chr2 60488922 60488943 60488927 60488922 -
taccaaaaatacagaaattagc

SEQ ID NO: 221478 - DNA, 22 bp, Artificial Sequence
  Synthetic oligonucleotide; CTA chr2 60488920 60488941 60488925 60488920 -
ccaaaaatacagaaattagccg

SEQ ID NO: 221479 - DNA, 22 bp, Artificial Sequence
  Synthetic oligonucleotide; TTA chr2 60488902 60488923 60488907 60488902 -
gccgcgtgtggtggcgcatgcc

SEQ ID NO: 221480 - DNA, 22 bp, Artificial Sequence
  Synthetic oligonucleotide; CTA chr2 60488878 60488899 60488883 60488878 -
taatcccagctacttgggaggc

SEQ ID NO: 221481 - DNA, 22 bp, Artificial Sequence
  Synthetic oligonucleotide; CTA chr2 60488866 60488887 60488871 60488866 -
cttgggaggctgaggcaggaga

SEQ ID NO: 221482 - DNA, 22 bp, Artificial Sequence
  Synthetic oligonucleotide; CTT chr2 60488863 60488884 60488868 60488863 -
gggaggctgaggcaggagaatc

SEQ ID NO: 221483 - DNA, 22 bp, Artificial Sequence
  Synthetic oligonucleotide; TTG chr2 60488862 60488883 60488867 60488862 -
ggaggctgaggcaggagaatcg

SEQ ID NO: 221484 - DNA, 22 bp, Artificial Sequence
  Synthetic oligonucleotide; CTG chr2 60488854 60488875 60488859 60488854 -
aggcaggagaatcgcttgaacc

SEQ ID NO: 221485 - DNA, 22 bp, Artificial Sequence
  Synthetic oligonucleotide; CTT chr2 60488837 60488858 60488842 60488837 -
gaacccgggaggcggagattgc

SEQ ID NO: 221486 - DNA, 22 bp, Artificial Sequence
  Synthetic oligonucleotide; TTG chr2 60488836 60488857 60488841 60488836 -
aacccgggaggcggagattgcg

SEQ ID NO: 221487 - DNA, 22 bp, Artificial Sequence
  Synthetic oligonucleotide; TTG chr2 60488816 60488837 60488821 60488816 -
cggtgagccgagattgcgccat

SEQ ID NO: 221488 - DNA, 22 bp, Artificial Sequence
  Synthetic oligonucleotide; TTG chr2 60488800 60488821 60488805 60488800 -
cgccattgcactccagcccggg

SEQ ID NO: 221489 - DNA, 22 bp, Artificial Sequence
  Synthetic oligonucleotide; TTG chr2 60488792 60488813 60488797 60488792 -
cactccagcccgggcaacaaga

SEQ ID NO: 221490 - DNA, 22 bp, Artificial Sequence
  Synthetic oligonucleotide; CTC chr2 60488787 60488808 60488792 60488787 -
cagcccgggcaacaagagcgaa

SEQ ID NO: 221491 - DNA, 22 bp, Artificial Sequence
  Synthetic oligonucleotide; CTC chr2 60488761 60488782 60488766 60488761 -
cacctcagaaacaaaaaacaaa

SEQ ID NO: 221492 - DNA, 22 bp, Artificial Sequence
  Synthetic oligonucleotide; CTC chr2 60488755 60488776 60488760 60488755 -
agaaacaaaaaacaaacaaaca

SEQ ID NO: 221493 - DNA, 22 bp, Artificial Sequence
  Synthetic oligonucleotide; TTT chr2 60488708 60488729 60488713 60488708 -
tgggtagcagtggctttaggct

SEQ ID NO: 221494 - DNA, 22 bp, Artificial Sequence
  Synthetic oligonucleotide; TTT chr2 60488707 60488728 60488712 60488707 -
gggtagcagtggctttaggctg

SEQ ID NO: 221495 - DNA, 22 bp, Artificial Sequence
  Synthetic oligonucleotide; TTG chr2 60488706 60488727 60488711 60488706 -
ggtagcagtggctttaggctgt

SEQ ID NO: 221496 - DNA, 22 bp, Artificial Sequence
  Synthetic oligonucleotide; CTT chr2 60488692 60488713 60488697 60488692 -
taggctgtttttggatctttgg

SEQ ID NO: 221497 - DNA, 22 bp, Artificial Sequence
  Synthetic oligonucleotide; TTT chr2 60488691 60488712 60488696 60488691 -
aggctgtttttggatctttggc

SEQ ID NO: 221498 - DNA, 22 bp, Artificial Sequence
  Synthetic oligonucleotide; TTA chr2 60488690 60488711 60488695 60488690 -
ggctgtttttggatctttggct

SEQ ID NO: 221499 - DNA, 22 bp, Artificial Sequence
  Synthetic oligonucleotide; CTG chr2 60488685 60488706 60488690 60488685 -
tttttggatctttggctattga

SEQ ID NO: 221500 - DNA, 22 bp, Artificial Sequence
  Synthetic oligonucleotide; TTT chr2 60488682 60488703 60488687 60488682 -
ttggatctttggctattgatac

SEQ ID NO: 221501 - DNA, 22 bp, Artificial Sequence
  Synthetic oligonucleotide; TTT chr2 60488681 60488702 60488686 60488681 -
tggatctttggctattgatact

SEQ ID NO: 221502 - DNA, 22 bp, Artificial Sequence
  Synthetic oligonucleotide; TTT chr2 60488680 60488701 60488685 60488680 -
ggatctttggctattgatactg

SEQ ID NO: 221503 - DNA, 22 bp, Artificial Sequence
  Synthetic oligonucleotide; TTG chr2 60488679 60488700 60488684 60488679 -
gatctttggctattgatactga

SEQ ID NO: 221504 - DNA, 22 bp, Artificial Sequence
  Synthetic oligonucleotide; CTT chr2 60488673 60488694 60488678 60488673 -
tggctattgatactgatttgaa

SEQ ID NO: 221505 - DNA, 22 bp, Artificial Sequence
  Synthetic oligonucleotide; TTT chr2 60488672 60488693 60488677 60488672 -
ggctattgatactgatttgaaa

SEQ ID NO: 221506 - DNA, 22 bp, Artificial Sequence
  Synthetic oligonucleotide; TTG chr2 60488671 60488692 60488676 60488671 -
gctattgatactgatttgaaat

SEQ ID NO: 221507 - DNA, 22 bp, Artificial Sequence
  Synthetic oligonucleotide; CTA chr2 60488667 60488688 60488672 60488667 -
ttgatactgatttgaaattttt

SEQ ID NO: 221508 - DNA, 22 bp, Artificial Sequence
  Synthetic oligonucleotide; TTG chr2 60488664 60488685 60488669 60488664 -
atactgatttgaaattttttgt

SEQ ID NO: 221509 - DNA, 22 bp, Artificial Sequence
  Synthetic oligonucleotide; CTG chr2 60488658 60488679 60488663 60488658 -
atttgaaattttttgttattat

SEQ ID NO: 221510 - DNA, 22 bp, Artificial Sequence
  Synthetic oligonucleotide; TTT chr2 60488654 60488675 60488659 60488654 -
gaaattttttgttattattttc

SEQ ID NO: 221511 - DNA, 22 bp, Artificial Sequence
  Synthetic oligonucleotide; TTG chr2 60488653 60488674 60488658 60488653 -
aaattttttgttattattttca

SEQ ID NO: 221512 - DNA, 22 bp, Artificial Sequence
  Synthetic oligonucleotide; TTT chr2 60488647 60488668 60488652 60488647 -
tttgttattattttcatgttaa

SEQ ID NO: 221513 - DNA, 22 bp, Artificial Sequence
  Synthetic oligonucleotide; TTT chr2 60488646 60488667 60488651 60488646 -
ttgttattattttcatgttaag

SEQ ID NO: 221514 - DNA, 22 bp, Artificial Sequence
  Synthetic oligonucleotide; TTT chr2 60488645 60488666 60488650 60488645 -
tgttattattttcatgttaagc

SEQ ID NO: 221515 - DNA, 22 bp, Artificial Sequence
  Synthetic oligonucleotide; TTT chr2 60488644 60488665 60488649 60488644 -
gttattattttcatgttaagca

SEQ ID NO: 221516 - DNA, 22 bp, Artificial Sequence
  Synthetic oligonucleotide; TTG chr2 60488643 60488664 60488648 60488643 -
ttattattttcatgttaagcaa

SEQ ID NO: 221517 - DNA, 22 bp, Artificial Sequence
  Synthetic oligonucleotide; TTA chr2 60488640 60488661 60488645 60488640 -
ttattttcatgttaagcaaaac

SEQ ID NO: 221518 - DNA, 22 bp, Artificial Sequence
  Synthetic oligonucleotide; TTA chr2 60488637 60488658 60488642 60488637 -
ttttcatgttaagcaaaactag

SEQ ID NO: 221519 - DNA, 22 bp, Artificial Sequence
  Synthetic oligonucleotide; TTT chr2 60488634 60488655 60488639 60488634 -
tcatgttaagcaaaactagaaa

SEQ ID NO: 221520 - DNA, 22 bp, Artificial Sequence
  Synthetic oligonucleotide; TTT chr2 60488633 60488654 60488638 60488633 -
catgttaagcaaaactagaaag

SEQ ID NO: 221521 - DNA, 22 bp, Artificial Sequence
  Synthetic oligonucleotide; TTC chr2 60488632 60488653 60488637 60488632 -
atgttaagcaaaactagaaagt

SEQ ID NO: 221522 - DNA, 22 bp, Artificial Sequence
  Synthetic oligonucleotide; TTA chr2 60488626 60488647 60488631 60488626 -
agcaaaactagaaagttttacc

SEQ ID NO: 221523 - DNA, 22 bp, Artificial Sequence
  Synthetic oligonucleotide; CTA chr2 60488616 60488637 60488621 60488616 -
gaaagttttaccgaattcccct

SEQ ID NO: 221524 - DNA, 22 bp, Artificial Sequence
  Synthetic oligonucleotide; TTT chr2 60488608 60488629 60488613 60488608 -
taccgaattcccctgcagtaca

SEQ ID NO: 221525 - DNA, 22 bp, Artificial Sequence
  Synthetic oligonucleotide; TTT chr2 60488607 60488628 60488612 60488607 -
accgaattcccctgcagtacag

SEQ ID NO: 221526 - DNA, 22 bp, Artificial Sequence
  Synthetic oligonucleotide; TTA chr2 60488606 60488627 60488611 60488606 -
ccgaattcccctgcagtacagt

SEQ ID NO: 221527 - DNA, 22 bp, Artificial Sequence
  Synthetic oligonucleotide; TTC chr2 60488598 60488619 60488603 60488598 -
ccctgcagtacagtaagtattt

SEQ ID NO: 221528 - DNA, 22 bp, Artificial Sequence
  Synthetic oligonucleotide; CTG chr2 60488593 60488614 60488598 60488593 -
cagtacagtaagtattttcttt

SEQ ID NO: 221529 - DNA, 22 bp, Artificial Sequence
  Synthetic oligonucleotide; TTT chr2 60488576 60488597 60488581 60488576 -
tctttcattgggggaagcaaac

SEQ ID NO: 221530 - DNA, 22 bp, Artificial Sequence
  Synthetic oligonucleotide; TTT chr2 60488575 60488596 60488580 60488575 -
ctttcattgggggaagcaaact

SEQ ID NO: 221531 - DNA, 22 bp, Artificial Sequence
  Synthetic oligonucleotide; TTC chr2 60488574 60488595 60488579 60488574 -
tttcattgggggaagcaaacta

SEQ ID NO: 221532 - DNA, 22 bp, Artificial Sequence
  Synthetic oligonucleotide; CTT chr2 60488572 60488593 60488577 60488572 -
tcattgggggaagcaaactatt

SEQ ID NO: 221533 - DNA, 22 bp, Artificial Sequence
  Synthetic oligonucleotide; TTT chr2 60488571 60488592 60488576 60488571 -
cattgggggaagcaaactattt

SEQ ID NO: 221534 - DNA, 22 bp, Artificial Sequence
  Synthetic oligonucleotide; TTC chr2 60488570 60488591 60488575 60488570 -
attgggggaagcaaactattta

SEQ ID NO: 221535 - DNA, 22 bp, Artificial Sequence
  Synthetic oligonucleotide; TTG chr2 60488566 60488587 60488571 60488566 -
ggggaagcaaactatttacagc

SEQ ID NO: 221536 - DNA, 22 bp, Artificial Sequence
  Synthetic oligonucleotide; CTA chr2 60488552 60488573 60488557 60488552 -
tttacagccataacagggtttc

SEQ ID NO: 221537 - DNA, 22 bp, Artificial Sequence
  Synthetic oligonucleotide; TTT chr2 60488549 60488570 60488554 60488549 -
acagccataacagggtttccag

SEQ ID NO: 221538 - DNA, 22 bp, Artificial Sequence
  Synthetic oligonucleotide; TTA chr2 60488548 60488569 60488553 60488548 -
cagccataacagggtttccagt

SEQ ID NO: 221539 - DNA, 22 bp, Artificial Sequence
  Synthetic oligonucleotide; TTT chr2 60488531 60488552 60488536 60488531 -
ccagtgaattgtataagtagca

SEQ ID NO: 221540 - DNA, 22 bp, Artificial Sequence
  Synthetic oligonucleotide; TTC chr2 60488530 60488551 60488535 60488530 -
cagtgaattgtataagtagcac

SEQ ID NO: 221541 - DNA, 22 bp, Artificial Sequence
  Synthetic oligonucleotide; TTG chr2 60488520 60488541 60488525 60488520 -
tataagtagcactgagttctgt

SEQ ID NO: 221542 - DNA, 22 bp, Artificial Sequence
  Synthetic oligonucleotide; CTG chr2 60488506 60488527 60488511 60488506 -
agttctgtgtcagcaaaaaatg

SEQ ID NO: 221543 - DNA, 22 bp, Artificial Sequence
  Synthetic oligonucleotide; TTC chr2 60488501 60488522 60488506 60488501 -
tgtgtcagcaaaaaatgaaaca

SEQ ID NO: 221544 - DNA, 22 bp, Artificial Sequence
  Synthetic oligonucleotide; CTG chr2 60488499 60488520 60488504 60488499 -
tgtcagcaaaaaatgaaacaaa

SEQ ID NO: 221545 - DNA, 22 bp, Artificial Sequence
  Synthetic oligonucleotide; CTG chr2 60488472 60488493 60488477 60488472 -
atcatagatgacattacctaaa

SEQ ID NO: 221546 - DNA, 22 bp, Artificial Sequence
  Synthetic oligonucleotide; TTA chr2 60488456 60488477 60488461 60488456 -
cctaaatgacagtacctacgtg

SEQ ID NO: 221547 - DNA, 22 bp, Artificial Sequence
  Synthetic oligonucleotide; CTA chr2 60488452 60488473 60488457 60488452 -
aatgacagtacctacgtgtgtc

SEQ ID NO: 221548 - DNA, 22 bp, Artificial Sequence
  Synthetic oligonucleotide; CTA chr2 60488438 60488459 60488443 60488438 -
cgtgtgtcctttctttcacatt

SEQ ID NO: 221549 - DNA, 22 bp, Artificial Sequence
  Synthetic oligonucleotide; CTT chr2 60488427 60488448 60488432 60488427 -
tctttcacatttgctgtaatcc

SEQ ID NO: 221550 - DNA, 22 bp, Artificial Sequence
  Synthetic oligonucleotide; TTT chr2 60488426 60488447 60488431 60488426 -
ctttcacatttgctgtaatcct

SEQ ID NO: 221551 - DNA, 22 bp, Artificial Sequence
  Synthetic oligonucleotide; TTC chr2 60488425 60488446 60488430 60488425 -
tttcacatttgctgtaatcctg

SEQ ID NO: 221552 - DNA, 22 bp, Artificial Sequence
  Synthetic oligonucleotide; CTT chr2 60488423 60488444 60488428 60488423 -
tcacatttgctgtaatcctgtt

SEQ ID NO: 221553 - DNA, 22 bp, Artificial Sequence
  Synthetic oligonucleotide; TTT chr2 60488422 60488443 60488427 60488422 -
cacatttgctgtaatcctgtta

SEQ ID NO: 221554 - DNA, 22 bp, Artificial Sequence
  Synthetic oligonucleotide; TTC chr2 60488421 60488442 60488426 60488421 -
acatttgctgtaatcctgttat

SEQ ID NO: 221555 - DNA, 22 bp, Artificial Sequence
  Synthetic oligonucleotide; TTT chr2 60488415 60488436 60488420 60488415 -
gctgtaatcctgttatggcatt

SEQ ID NO: 221556 - DNA, 22 bp, Artificial Sequence
  Synthetic oligonucleotide; TTG chr2 60488414 60488435 60488419 60488414 -
ctgtaatcctgttatggcattg

SEQ ID NO: 221557 - DNA, 22 bp, Artificial Sequence
  Synthetic oligonucleotide; CTG chr2 60488411 60488432 60488416 60488411 -
taatcctgttatggcattgtcc

SEQ ID NO: 221558 - DNA, 22 bp, Artificial Sequence
  Synthetic oligonucleotide; CTG chr2 60488403 60488424 60488408 60488403 -
ttatggcattgtcctattatct

SEQ ID NO: 221559 - DNA, 22 bp, Artificial Sequence
  Synthetic oligonucleotide; TTA chr2 60488400 60488421 60488405 60488400 -
tggcattgtcctattatctcaa

SEQ ID NO: 221560 - DNA, 22 bp, Artificial Sequence
  Synthetic oligonucleotide; TTG chr2 60488392 60488413 60488397 60488392 -
tcctattatctcaagtactgtc

SEQ ID NO: 221561 - DNA, 22 bp, Artificial Sequence
  Synthetic oligonucleotide; CTA chr2 60488387 60488408 60488392 60488387 -
ttatctcaagtactgtcatctt

SEQ ID NO: 221562 - DNA, 22 bp, Artificial Sequence
  Synthetic oligonucleotide; TTA chr2 60488384 60488405 60488389 60488384 -
tctcaagtactgtcatctttaa

SEQ ID NO: 221563 - DNA, 22 bp, Artificial Sequence
  Synthetic oligonucleotide; CTC chr2 60488380 60488401 60488385 60488380 -
aagtactgtcatctttaaatgc

SEQ ID NO: 221564 - DNA, 22 bp, Artificial Sequence
  Synthetic oligonucleotide; CTG chr2 60488372 60488393 60488377 60488372 -
tcatctttaaatgctgtcaaat

SEQ ID NO: 221565 - DNA, 22 bp, Artificial Sequence
  Synthetic oligonucleotide; CTT chr2 60488365 60488386 60488370 60488365 -
taaatgctgtcaaattgtaact

SEQ ID NO: 221566 - DNA, 22 bp, Artificial Sequence
  Synthetic oligonucleotide; TTT chr2 60488364 60488385 60488369 60488364 -
aaatgctgtcaaattgtaactg

SEQ ID NO: 221567 - DNA, 22 bp, Artificial Sequence
  Synthetic oligonucleotide; TTA chr2 60488363 60488384 60488368 60488363 -
aatgctgtcaaattgtaactgg

SEQ ID NO: 221568 - DNA, 22 bp, Artificial Sequence
  Synthetic oligonucleotide; CTG chr2 60488356 60488377 60488361 60488356 -
tcaaattgtaactggattgcca

SEQ ID NO: 221569 - DNA, 22 bp, Artificial Sequence
  Synthetic oligonucleotide; TTG chr2 60488348 60488369 60488353 60488348 -
taactggattgccaaggacaga

SEQ ID NO: 221570 - DNA, 22 bp, Artificial Sequence
  Synthetic oligonucleotide; CTG chr2 60488342 60488363 60488347 60488342 -
gattgccaaggacagaggagag

SEQ ID NO: 221571 - DNA, 22 bp, Artificial Sequence
  Synthetic oligonucleotide; TTG chr2 60488337 60488358 60488342 60488337 -
ccaaggacagaggagaggaacc

SEQ ID NO: 221572 - DNA, 22 bp, Artificial Sequence
  Synthetic oligonucleotide; TTC chr2 60488293 60488314 60488298 60488293 -
ccactgcaccaaagagacggtc

SEQ ID NO: 221573 - DNA, 22 bp, Artificial Sequence
  Synthetic oligonucleotide; CTG chr2 60488287 60488308 60488292 60488287 -
caccaaagagacggtcttcttc

SEQ ID NO: 221574 - DNA, 22 bp, Artificial Sequence
  Synthetic oligonucleotide; CTT chr2 60488269 60488290 60488274 60488269 -
cttccccctctcacagtctgaa

SEQ ID NO: 221575 - DNA, 22 bp, Artificial Sequence
  Synthetic oligonucleotide; TTC chr2 60488268 60488289 60488273 60488268 -
ttccccctctcacagtctgaat

SEQ ID NO: 221576 - DNA, 22 bp, Artificial Sequence
  Synthetic oligonucleotide; CTT chr2 60488266 60488287 60488271 60488266 -
ccccctctcacagtctgaattc

SEQ ID NO: 221577 - DNA, 22 bp, Artificial Sequence
  Synthetic oligonucleotide; TTC chr2 60488265 60488286 60488270 60488265 -
cccctctcacagtctgaattct

SEQ ID NO: 221578 - DNA, 22 bp, Artificial Sequence
  Synthetic oligonucleotide; CTC chr2 60488259 60488280 60488264 60488259 -
tcacagtctgaattcttggaga

SEQ ID NO: 221579 - DNA, 22 bp, Artificial Sequence
  Synthetic oligonucleotide; CTC chr2 60488257 60488278 60488262 60488257 -
acagtctgaattcttggagaca

SEQ ID NO: 221580 - DNA, 22 bp, Artificial Sequence
  Synthetic oligonucleotide; CTG chr2 60488249 60488270 60488254 60488249 -
aattcttggagacattgttcag

SEQ ID NO: 221581 - DNA, 22 bp, Artificial Sequence
  Synthetic oligonucleotide; TTC chr2 60488244 60488265 60488249 60488244 -
ttggagacattgttcagttaaa

SEQ ID NO: 221582 - DNA, 22 bp, Artificial Sequence
  Synthetic oligonucleotide; CTT chr2 60488242 60488263 60488247 60488242 -
ggagacattgttcagttaaaat

SEQ ID NO: 221583 - DNA, 22 bp, Artificial Sequence
  Synthetic oligonucleotide; TTG chr2 60488241 60488262 60488246 60488241 -
gagacattgttcagttaaaatc

SEQ ID NO: 221584 - DNA, 22 bp, Artificial Sequence
  Synthetic oligonucleotide; TTG chr2 60488232 60488253 60488237 60488232 -
ttcagttaaaatcatgactcag

SEQ ID NO: 221585 - DNA, 22 bp, Artificial Sequence
  Synthetic oligonucleotide; TTC chr2 60488229 60488250 60488234 60488229 -
agttaaaatcatgactcaggta

SEQ ID NO: 221586 - DNA, 22 bp, Artificial Sequence
  Synthetic oligonucleotide; TTA chr2 60488224 60488245 60488229 60488224 -
aaatcatgactcaggtatcttt

SEQ ID NO: 221587 - DNA, 22 bp, Artificial Sequence
  Synthetic oligonucleotide; CTC chr2 60488212 60488233 60488217 60488212 -
aggtatcttttacaggctttga

SEQ ID NO: 221588 - DNA, 22 bp, Artificial Sequence
  Synthetic oligonucleotide; CTT chr2 60488203 60488224 60488208 60488203 -
ttacaggctttgatgaaatagt

SEQ ID NO: 221589 - DNA, 22 bp, Artificial Sequence
  Synthetic oligonucleotide; TTT chr2 60488202 60488223 60488207 60488202 -
tacaggctttgatgaaatagtc

SEQ ID NO: 221590 - DNA, 22 bp, Artificial Sequence
  Synthetic oligonucleotide; TTT chr2 60488201 60488222 60488206 60488201 -
acaggctttgatgaaatagtca

SEQ ID NO: 221591 - DNA, 22 bp, Artificial Sequence
  Synthetic oligonucleotide; TTA chr2 60488200 60488221 60488205 60488200 -
caggctttgatgaaatagtcag

SEQ ID NO: 221592 - DNA, 22 bp, Artificial Sequence
  Synthetic oligonucleotide; CTT chr2 60488193 60488214 60488198 60488193 -
tgatgaaatagtcagattcact

SEQ ID NO: 221593 - DNA, 22 bp, Artificial Sequence
  Synthetic oligonucleotide; TTT chr2 60488192 60488213 60488197 60488192 -
gatgaaatagtcagattcactc

SEQ ID NO: 221594 - DNA, 22 bp, Artificial Sequence
  Synthetic oligonucleotide; TTG chr2 60488191 60488212 60488196 60488191 -
atgaaatagtcagattcactcc

SEQ ID NO: 221595 - DNA, 22 bp, Artificial Sequence
  Synthetic oligonucleotide; TTC chr2 60488174 60488195 60488179 60488174 -
actcctcatgttcctagaagga

SEQ ID NO: 221596 - DNA, 22 bp, Artificial Sequence
  Synthetic oligonucleotide; CTC chr2 60488170 60488191 60488175 60488170 -
ctcatgttcctagaaggaaagg

SEQ ID NO: 221597 - DNA, 22 bp, Artificial Sequence
  Synthetic oligonucleotide; CTC chr2 60488167 60488188 60488172 60488167 -
atgttcctagaaggaaaggaag

SEQ ID NO: 221598 - DNA, 22 bp, Artificial Sequence
  Synthetic oligonucleotide; TTC chr2 60488161 60488182 60488166 60488161 -
ctagaaggaaaggaagaaacac

SEQ ID NO: 221599 - DNA, 22 bp, Artificial Sequence
  Synthetic oligonucleotide; CTA chr2 60488158 60488179 60488163 60488158 -
gaaggaaaggaagaaacactct

SEQ ID NO: 221600 - DNA, 22 bp, Artificial Sequence
  Synthetic oligonucleotide; CTC chr2 60488137 60488158 60488142 60488137 -
tttgaacagcccgtgagacaaa

SEQ ID NO: 221601 - DNA, 22 bp, Artificial Sequence
  Synthetic oligonucleotide; CTT chr2 60488135 60488156 60488140 60488135 -
tgaacagcccgtgagacaaact

SEQ ID NO: 221602 - DNA, 22 bp, Artificial Sequence
  Synthetic oligonucleotide; TTT chr2 60488134 60488155 60488139 60488134 -
gaacagcccgtgagacaaactc

SEQ ID NO: 221603 - DNA, 22 bp, Artificial Sequence
  Synthetic oligonucleotide; TTG chr2 60488133 60488154 60488138 60488133 -
aacagcccgtgagacaaactct

SEQ ID NO: 221604 - DNA, 22 bp, Artificial Sequence
  Synthetic oligonucleotide; CTC chr2 60488112 60488133 60488117 60488112 -
ttccaggataatttaaatgttt

SEQ ID NO: 221605 - DNA, 22 bp, Artificial Sequence
  Synthetic oligonucleotide; CTT chr2 60488110 60488131 60488115 60488110 -
ccaggataatttaaatgtttct

SEQ ID NO: 221606 - DNA, 22 bp, Artificial Sequence
  Synthetic oligonucleotide; TTC chr2 60488109 60488130 60488114 60488109 -
caggataatttaaatgtttcta

SEQ ID NO: 221607 - DNA, 22 bp, Artificial Sequence
  Synthetic oligonucleotide; TTT chr2 60488098 60488119 60488103 60488098 -
aaatgtttctacataatgagaa

SEQ ID NO: 221608 - DNA, 22 bp, Artificial Sequence
  Synthetic oligonucleotide; TTA chr2 60488097 60488118 60488102 60488097 -
aatgtttctacataatgagaat

SEQ ID NO: 221609 - DNA, 22 bp, Artificial Sequence
  Synthetic oligonucleotide; TTT chr2 60488090 60488111 60488095 60488090 -
ctacataatgagaataaattgt

SEQ ID NO: 221610 - DNA, 22 bp, Artificial Sequence
  Synthetic oligonucleotide; TTC chr2 60488089 60488110 60488094 60488089 -
tacataatgagaataaattgta

SEQ ID NO: 221611 - DNA, 22 bp, Artificial Sequence
  Synthetic oligonucleotide; CTA chr2 60488087 60488108 60488092 60488087 -
cataatgagaataaattgtaag

SEQ ID NO: 221612 - DNA, 22 bp, Artificial Sequence
  Synthetic oligonucleotide; TTG chr2 60488069 60488090 60488074 60488069 -
taagtgttactgtgtttttaaa

SEQ ID NO: 221613 - DNA, 22 bp, Artificial Sequence
  Synthetic oligonucleotide; TTA chr2 60488060 60488081 60488065 60488060 -
ctgtgtttttaaaacccaggtc

SEQ ID NO: 221614 - DNA, 22 bp, Artificial Sequence
  Synthetic oligonucleotide; CTG chr2 60488057 60488078 60488062 60488057 -
tgtttttaaaacccaggtcaaa

SEQ ID NO: 221615 - DNA, 22 bp, Artificial Sequence
  Synthetic oligonucleotide; TTT chr2 60488052 60488073 60488057 60488052 -
ttaaaacccaggtcaaaagtaa

SEQ ID NO: 221616 - DNA, 22 bp, Artificial Sequence
  Synthetic oligonucleotide; TTT chr2 60488051 60488072 60488056 60488051 -
taaaacccaggtcaaaagtaat

SEQ ID NO: 221617 - DNA, 22 bp, Artificial Sequence
  Synthetic oligonucleotide; TTT chr2 60488050 60488071 60488055 60488050 -
aaaacccaggtcaaaagtaata

SEQ ID NO: 221618 - DNA, 22 bp, Artificial Sequence
  Synthetic oligonucleotide; TTA chr2 60488049 60488070 60488054 60488049 -
aaacccaggtcaaaagtaatag

SEQ ID NO: 221619 - DNA, 22 bp, Artificial Sequence
  Synthetic oligonucleotide; CTA chr2 60488011 60488032 60488016 60488011 -
taagcatttaatatctaattgt

SEQ ID NO: 221620 - DNA, 22 bp, Artificial Sequence
  Synthetic oligonucleotide; TTT chr2 60488002 60488023 60488007 60488002 -
aatatctaattgttcatatatt

SEQ ID NO: 221621 - DNA, 22 bp, Artificial Sequence
  Synthetic oligonucleotide; TTA chr2 60488001 60488022 60488006 60488001 -
atatctaattgttcatatattg

SEQ ID NO: 221622 - DNA, 22 bp, Artificial Sequence
  Synthetic oligonucleotide; CTA chr2 60487994 60488015 60487999 60487994 -
attgttcatatattgcttcccc

SEQ ID NO: 221623 - DNA, 22 bp, Artificial Sequence
  Synthetic oligonucleotide; TTG chr2 60487990 60488011 60487995 60487990 -
ttcatatattgcttccccaggt

SEQ ID NO: 221624 - DNA, 22 bp, Artificial Sequence
  Synthetic oligonucleotide; TTC chr2 60487987 60488008 60487992 60487987 -
atatattgcttccccaggttta

SEQ ID NO: 221625 - DNA, 22 bp, Artificial Sequence
  Synthetic oligonucleotide; TTG chr2 60487979 60488000 60487984 60487979 -
cttccccaggtttagatgaggg

SEQ ID NO: 221626 - DNA, 22 bp, Artificial Sequence
  Synthetic oligonucleotide; CTT chr2 60487976 60487997 60487981 60487976 -
ccccaggtttagatgagggctc

SEQ ID NO: 221627 - DNA, 22 bp, Artificial Sequence
  Synthetic oligonucleotide; TTC chr2 60487975 60487996 60487980 60487975 -
cccaggtttagatgagggctcc

SEQ ID NO: 221628 - DNA, 22 bp, Artificial Sequence
  Synthetic oligonucleotide; TTT chr2 60487966 60487987 60487971 60487966 -
agatgagggctccattctagag

SEQ ID NO: 221629 - DNA, 22 bp, Artificial Sequence
  Synthetic oligonucleotide; TTA chr2 60487965 60487986 60487970 60487965 -
gatgagggctccattctagagt

SEQ ID NO: 221630 - DNA, 22 bp, Artificial Sequence
  Synthetic oligonucleotide; CTC chr2 60487954 60487975 60487959 60487954 -
cattctagagttgggaaaacca

SEQ ID NO: 221631 - DNA, 22 bp, Artificial Sequence
  Synthetic oligonucleotide; TTC chr2 60487949 60487970 60487954 60487949 -
tagagttgggaaaaccaagtca

SEQ ID NO: 221632 - DNA, 22 bp, Artificial Sequence
  Synthetic oligonucleotide; CTA chr2 60487947 60487968 60487952 60487947 -
gagttgggaaaaccaagtcagt

SEQ ID NO: 221633 - DNA, 22 bp, Artificial Sequence
  Synthetic oligonucleotide; TTG chr2 60487941 60487962 60487946 60487941 -
ggaaaaccaagtcagtaaacct

SEQ ID NO: 221634 - DNA, 22 bp, Artificial Sequence
  Synthetic oligonucleotide; CTT chr2 60487918 60487939 60487923 60487918 -
tagtggcagatgttatcaggga

SEQ ID NO: 221635 - DNA, 22 bp, Artificial Sequence
  Synthetic oligonucleotide; TTT chr2 60487917 60487938 60487922 60487917 -
agtggcagatgttatcagggag

SEQ ID NO: 221636 - DNA, 22 bp, Artificial Sequence
  Synthetic oligonucleotide; TTA chr2 60487916 60487937 60487921 60487916 -
gtggcagatgttatcagggagc

SEQ ID NO: 221637 - DNA, 22 bp, Artificial Sequence
  Synthetic oligonucleotide; TTA chr2 60487903 60487924 60487908 60487903 -
tcagggagctggagttggagta

SEQ ID NO: 221638 - DNA, 22 bp, Artificial Sequence
  Synthetic oligonucleotide; CTG chr2 60487892 60487913 60487897 60487892 -
gagttggagtacttgcattttg

SEQ ID NO: 221639 - DNA, 22 bp, Artificial Sequence
  Synthetic oligonucleotide; TTG chr2 60487886 60487907 60487891 60487886 -
gagtacttgcattttgtgtttg

SEQ ID NO: 221640 - DNA, 22 bp, Artificial Sequence
  Synthetic oligonucleotide; CTT chr2 60487878 60487899 60487883 60487878 -
gcattttgtgtttgtgccagct

SEQ ID NO: 221641 - DNA, 22 bp, Artificial Sequence
  Synthetic oligonucleotide; TTG chr2 60487877 60487898 60487882 60487877 -
cattttgtgtttgtgccagctg

SEQ ID NO: 221642 - DNA, 22 bp, Artificial Sequence
  Synthetic oligonucleotide; TTT chr2 60487872 60487893 60487877 60487872 -
tgtgtttgtgccagctgtccat

SEQ ID NO: 221643 - DNA, 22 bp, Artificial Sequence
  Synthetic oligonucleotide; TTT chr2 60487871 60487892 60487876 60487871 -
gtgtttgtgccagctgtccatg

SEQ ID NO: 221644 - DNA, 22 bp, Artificial Sequence
  Synthetic oligonucleotide; TTG chr2 60487870 60487891 60487875 60487870 -
tgtttgtgccagctgtccatgt

SEQ ID NO: 221645 - DNA, 22 bp, Artificial Sequence
  Synthetic oligonucleotide; TTT chr2 60487865 60487886 60487870 60487865 -
gtgccagctgtccatgttcctc

SEQ ID NO: 221646 - DNA, 22 bp, Artificial Sequence
  Synthetic oligonucleotide; TTG chr2 60487864 60487885 60487869 60487864 -
tgccagctgtccatgttcctct

SEQ ID NO: 221647 - DNA, 22 bp, Artificial Sequence
  Synthetic oligonucleotide; CTG chr2 60487855 60487876 60487860 60487855 -
tccatgttcctcttcatatatt

SEQ ID NO: 221648 - DNA, 22 bp, Artificial Sequence
  Synthetic oligonucleotide; TTC chr2 60487846 60487867 60487851 60487846 -
ctcttcatatatttagaccaaa

SEQ ID NO: 221649 - DNA, 22 bp, Artificial Sequence
  Synthetic oligonucleotide; CTC chr2 60487843 60487864 60487848 60487843 -
ttcatatatttagaccaaattc

SEQ ID NO: 221650 - DNA, 22 bp, Artificial Sequence
  Synthetic oligonucleotide; CTT chr2 60487841 60487862 60487846 60487841 -
catatatttagaccaaattctt

SEQ ID NO: 221651 - DNA, 22 bp, Artificial Sequence
  Synthetic oligonucleotide; TTC chr2 60487840 60487861 60487845 60487840 -
atatatttagaccaaattctta

SEQ ID NO: 221652 - DNA, 22 bp, Artificial Sequence
  Synthetic oligonucleotide; TTT chr2 60487832 60487853 60487837 60487832 -
agaccaaattcttatccagatt

SEQ ID NO: 221653 - DNA, 22 bp, Artificial Sequence
  Synthetic oligonucleotide; TTA chr2 60487831 60487852 60487836 60487831 -
gaccaaattcttatccagattt

SEQ ID NO: 221654 - DNA, 22 bp, Artificial Sequence
  Synthetic oligonucleotide; TTC chr2 60487821 60487842 60487826 60487821 -
ttatccagatttcccattaaag

SEQ ID NO: 221655 - DNA, 22 bp, Artificial Sequence
  Synthetic oligonucleotide; CTT chr2 60487819 60487840 60487824 60487819 -
atccagatttcccattaaaggt

SEQ ID NO: 221656 - DNA, 22 bp, Artificial Sequence
  Synthetic oligonucleotide; TTA chr2 60487818 60487839 60487823 60487818 -
tccagatttcccattaaaggtt

SEQ ID NO: 221657 - DNA, 22 bp, Artificial Sequence
  Synthetic oligonucleotide; TTT chr2 60487809 60487830 60487814 60487809 -
cccattaaaggttcataaattt

SEQ ID NO: 221658 - DNA, 22 bp, Artificial Sequence
  Synthetic oligonucleotide; TTC chr2 60487808 60487829 60487813 60487808 -
ccattaaaggttcataaatttc

SEQ ID NO: 221659 - DNA, 22 bp, Artificial Sequence
  Synthetic oligonucleotide; TTA chr2 60487802 60487823 60487807 60487802 -
aaggttcataaatttccagttt

SEQ ID NO: 221660 - DNA, 22 bp, Artificial Sequence
  Synthetic oligonucleotide; TTC chr2 60487795 60487816 60487800 60487795 -
ataaatttccagttttcacctt

SEQ ID NO: 221661 - DNA, 22 bp, Artificial Sequence
  Synthetic oligonucleotide; TTT chr2 60487787 60487808 60487792 60487787 -
ccagttttcacctttctgcagc

SEQ ID NO: 221662 - DNA, 22 bp, Artificial Sequence
  Synthetic oligonucleotide; TTC chr2 60487786 60487807 60487791 60487786 -
cagttttcacctttctgcagct

SEQ ID NO: 221663 - DNA, 22 bp, Artificial Sequence
  Synthetic oligonucleotide; TTT chr2 60487780 60487801 60487785 60487780 -
tcacctttctgcagcttcctta

SEQ ID NO: 221664 - DNA, 22 bp, Artificial Sequence
  Synthetic oligonucleotide; TTT chr2 60487779 60487800 60487784 60487779 -
cacctttctgcagcttccttag

SEQ ID NO: 221665 - DNA, 22 bp, Artificial Sequence
  Synthetic oligonucleotide; TTC chr2 60487778 60487799 60487783 60487778 -
acctttctgcagcttccttaga

SEQ ID NO: 221666 - DNA, 22 bp, Artificial Sequence
  Synthetic oligonucleotide; CTT chr2 60487773 60487794 60487778 60487773 -
tctgcagcttccttagatagaa

SEQ ID NO: 221667 - DNA, 22 bp, Artificial Sequence
  Synthetic oligonucleotide; TTT chr2 60487772 60487793 60487777 60487772 -
ctgcagcttccttagatagaat

SEQ ID NO: 221668 - DNA, 22 bp, Artificial Sequence
  Synthetic oligonucleotide; TTC chr2 60487771 60487792 60487776 60487771 -
tgcagcttccttagatagaatg

SEQ ID NO: 221669 - DNA, 22 bp, Artificial Sequence
  Synthetic oligonucleotide; CTG chr2 60487769 60487790 60487774 60487769 -
cagcttccttagatagaatggt

SEQ ID NO: 221670 - DNA, 22 bp, Artificial Sequence
  Synthetic oligonucleotide; CTT chr2 60487763 60487784 60487768 60487763 -
ccttagatagaatggttgatga

SEQ ID NO: 221671 - DNA, 22 bp, Artificial Sequence
  Synthetic oligonucleotide; TTC chr2 60487762 60487783 60487767 60487762 -
cttagatagaatggttgatgag

SEQ ID NO: 221672 - DNA, 22 bp, Artificial Sequence
  Synthetic oligonucleotide; CTT chr2 60487759 60487780 60487764 60487759 -
agatagaatggttgatgagaaa

SEQ ID NO: 221673 - DNA, 22 bp, Artificial Sequence
  Synthetic oligonucleotide; TTA chr2 60487758 60487779 60487763 60487758 -
gatagaatggttgatgagaaaa

SEQ ID NO: 221674 - DNA, 22 bp, Artificial Sequence
  Synthetic oligonucleotide; TTG chr2 60487745 60487766 60487750 60487745 -
atgagaaaattaccgcattaaa

SEQ ID NO: 221675 - DNA, 22 bp, Artificial Sequence
  Synthetic oligonucleotide; TTA chr2 60487733 60487754 60487738 60487733 -
ccgcattaaaattaagcctctt

SEQ ID NO: 221676 - DNA, 22 bp, Artificial Sequence
  Synthetic oligonucleotide; TTA chr2 60487725 60487746 60487730 60487725 -
aaattaagcctcttgcttttta

SEQ ID NO: 221677 - DNA, 22 bp, Artificial Sequence
  Synthetic oligonucleotide; TTA chr2 60487719 60487740 60487724 60487719 -
agcctcttgctttttacattct

SEQ ID NO: 221678 - DNA, 22 bp, Artificial Sequence
  Synthetic oligonucleotide; CTC chr2 60487713 60487734 60487718 60487713 -
ttgctttttacattctgctgct

SEQ ID NO: 221679 - DNA, 22 bp, Artificial Sequence
  Synthetic oligonucleotide; CTT chr2 60487711 60487732 60487716 60487711 -
gctttttacattctgctgctca

SEQ ID NO: 221680 - DNA, 22 bp, Artificial Sequence
  Synthetic oligonucleotide; TTG chr2 60487710 60487731 60487715 60487710 -
ctttttacattctgctgctcat

SEQ ID NO: 221681 - DNA, 22 bp, Artificial Sequence
  Synthetic oligonucleotide; CTT chr2 60487707 60487728 60487712 60487707 -
tttacattctgctgctcataaa

SEQ ID NO: 221682 - DNA, 22 bp, Artificial Sequence
  Synthetic oligonucleotide; TTT chr2 60487706 60487727 60487711 60487706 -
ttacattctgctgctcataaat

SEQ ID NO: 221683 - DNA, 22 bp, Artificial Sequence
  Synthetic oligonucleotide; TTT chr2 60487705 60487726 60487710 60487705 -
tacattctgctgctcataaata

SEQ ID NO: 221684 - DNA, 22 bp, Artificial Sequence
  Synthetic oligonucleotide; TTT chr2 60487704 60487725 60487709 60487704 -
acattctgctgctcataaataa

SEQ ID NO: 221685 - DNA, 22 bp, Artificial Sequence
  Synthetic oligonucleotide; TTA chr2 60487703 60487724 60487708 60487703 -
cattctgctgctcataaataag

SEQ ID NO: 221686 - DNA, 22 bp, Artificial Sequence
  Synthetic oligonucleotide; TTC chr2 60487698 60487719 60487703 60487698 -
tgctgctcataaataagggagt

SEQ ID NO: 221687 - DNA, 22 bp, Artificial Sequence
  Synthetic oligonucleotide; CTG chr2 60487696 60487717 60487701 60487696 -
ctgctcataaataagggagtgg

SEQ ID NO: 221688 - DNA, 22 bp, Artificial Sequence
  Synthetic oligonucleotide; CTG chr2 60487693 60487714 60487698 60487693 -
ctcataaataagggagtgggaa

SEQ ID NO: 221689 - DNA, 22 bp, Artificial Sequence
  Synthetic oligonucleotide; CTC chr2 60487690 60487711 60487695 60487690 -
ataaataagggagtgggaaatg

SEQ ID NO: 221690 - DNA, 22 bp, Artificial Sequence
  Synthetic oligonucleotide; TTA chr2 60487664 60487685 60487669 60487664 -
ctttgaacaccctcgttaaagg

SEQ ID NO: 221691 - DNA, 22 bp, Artificial Sequence
  Synthetic oligonucleotide; CTT chr2 60487661 60487682 60487666 60487661 -
tgaacaccctcgttaaaggctg

SEQ ID NO: 221692 - DNA, 22 bp, Artificial Sequence
  Synthetic oligonucleotide; TTT chr2 60487660 60487681 60487665 60487660 -
gaacaccctcgttaaaggctgg

SEQ ID NO: 221693 - DNA, 22 bp, Artificial Sequence
  Synthetic oligonucleotide; TTG chr2 60487659 60487680 60487664 60487659 -
aacaccctcgttaaaggctggt

SEQ ID NO: 221694 - DNA, 22 bp, Artificial Sequence
  Synthetic oligonucleotide; CTC chr2 60487650 60487671 60487655 60487650 -
gttaaaggctggtgtggttgcc

SEQ ID NO: 221695 - DNA, 22 bp, Artificial Sequence
  Synthetic oligonucleotide; TTA chr2 60487646 60487667 60487651 60487646 -
aaggctggtgtggttgccagag

SEQ ID NO: 221696 - DNA, 22 bp, Artificial Sequence
  Synthetic oligonucleotide; CTG chr2 60487639 60487660 60487644 60487639 -
gtgtggttgccagagaataggg

SEQ ID NO: 221697 - DNA, 22 bp, Artificial Sequence
  Synthetic oligonucleotide; TTG chr2 60487630 60487651 60487635 60487630 -
ccagagaatagggctaacttaa

SEQ ID NO: 221698 - DNA, 22 bp, Artificial Sequence
  Synthetic oligonucleotide; CTA chr2 60487614 60487635 60487619 60487614 -
acttaagggggatccgctaagc

SEQ ID NO: 221699 - DNA, 22 bp, Artificial Sequence
  Synthetic oligonucleotide; CTT chr2 60487610 60487631 60487615 60487610 -
aagggggatccgctaagccttc

SEQ ID NO: 221700 - DNA, 22 bp, Artificial Sequence
  Synthetic oligonucleotide; TTA chr2 60487609 60487630 60487614 60487609 -
agggggatccgctaagccttct

SEQ ID NO: 221701 - DNA, 22 bp, Artificial Sequence
  Synthetic oligonucleotide; CTA chr2 60487595 60487616 60487600 60487595 -
agccttctttttcatgcctttt

SEQ ID NO: 221702 - DNA, 22 bp, Artificial Sequence
  Synthetic oligonucleotide; CTT chr2 60487589 60487610 60487594 60487589 -
ctttttcatgcctttttttgtt

SEQ ID NO: 221703 - DNA, 22 bp, Artificial Sequence
  Synthetic oligonucleotide; TTC chr2 60487588 60487609 60487593 60487588 -
tttttcatgcctttttttgttt

SEQ ID NO: 221704 - DNA, 22 bp, Artificial Sequence
  Synthetic oligonucleotide; CTT chr2 60487586 60487607 60487591 60487586 -
tttcatgcctttttttgttttg

SEQ ID NO: 221705 - DNA, 22 bp, Artificial Sequence
  Synthetic oligonucleotide; TTT chr2 60487585 60487606 60487590 60487585 -
ttcatgcctttttttgttttgt

SEQ ID NO: 221706 - DNA, 22 bp, Artificial Sequence
  Synthetic oligonucleotide; TTT chr2 60487584 60487605 60487589 60487584 -
tcatgcctttttttgttttgtt

SEQ ID NO: 221707 - DNA, 22 bp, Artificial Sequence
  Synthetic oligonucleotide; TTT chr2 60487583 60487604 60487588 60487583 -
catgcctttttttgttttgttt

SEQ ID NO: 221708 - DNA, 22 bp, Artificial Sequence
  Synthetic oligonucleotide; TTC chr2 60487582 60487603 60487587 60487582 -
atgcctttttttgttttgtttt

SEQ ID NO: 221709 - DNA, 22 bp, Artificial Sequence
  Synthetic oligonucleotide; CTT chr2 60487575 60487596 60487580 60487575 -
tttttgttttgttttgttctgg

SEQ ID NO: 221710 - DNA, 22 bp, Artificial Sequence
  Synthetic oligonucleotide; TTT chr2 60487574 60487595 60487579 60487574 -
ttttgttttgttttgttctgga

SEQ ID NO: 221711 - DNA, 22 bp, Artificial Sequence
  Synthetic oligonucleotide; TTT chr2 60487573 60487594 60487578 60487573 -
tttgttttgttttgttctggat

SEQ ID NO: 221712 - DNA, 22 bp, Artificial Sequence
  Synthetic oligonucleotide; TTT chr2 60487572 60487593 60487577 60487572 -
ttgttttgttttgttctggatt

SEQ ID NO: 221713 - DNA, 22 bp, Artificial Sequence
  Synthetic oligonucleotide; TTT chr2 60487571 60487592 60487576 60487571 -
tgttttgttttgttctggattt

SEQ ID NO: 221714 - DNA, 22 bp, Artificial Sequence
  Synthetic oligonucleotide; TTT chr2 60487570 60487591 60487575 60487570 -
gttttgttttgttctggatttt

SEQ ID NO: 221715 - DNA, 22 bp, Artificial Sequence
  Synthetic oligonucleotide; TTG chr2 60487569 60487590 60487574 60487569 -
ttttgttttgttctggatttta

SEQ ID NO: 221716 - DNA, 22 bp, Artificial Sequence
  Synthetic oligonucleotide; TTT chr2 60487566 60487587 60487571 60487566 -
tgttttgttctggattttataa

SEQ ID NO: 221717 - DNA, 22 bp, Artificial Sequence
  Synthetic oligonucleotide; TTT chr2 60487565 60487586 60487570 60487565 -
gttttgttctggattttataaa

SEQ ID NO: 221718 - DNA, 22 bp, Artificial Sequence
  Synthetic oligonucleotide; TTG chr2 60487564 60487585 60487569 60487564 -
ttttgttctggattttataaag

SEQ ID NO: 221719 - DNA, 22 bp, Artificial Sequence
  Synthetic oligonucleotide; TTT chr2 60487561 60487582 60487566 60487561 -
tgttctggattttataaaggca

SEQ ID NO: 221720 - DNA, 22 bp, Artificial Sequence
  Synthetic oligonucleotide; TTT chr2 60487560 60487581 60487565 60487560 -
gttctggattttataaaggcat

SEQ ID NO: 221721 - DNA, 22 bp, Artificial Sequence
  Synthetic oligonucleotide; TTG chr2 60487559 60487580 60487564 60487559 -
ttctggattttataaaggcatc

SEQ ID NO: 221722 - DNA, 22 bp, Artificial Sequence
  Synthetic oligonucleotide; TTC chr2 60487556 60487577 60487561 60487556 -
tggattttataaaggcatcatt

SEQ ID NO: 221723 - DNA, 22 bp, Artificial Sequence
  Synthetic oligonucleotide; CTG chr2 60487554 60487575 60487559 60487554 -
gattttataaaggcatcattta

SEQ ID NO: 221724 - DNA, 22 bp, Artificial Sequence
  Synthetic oligonucleotide; TTT chr2 60487549 60487570 60487554 60487549 -
tataaaggcatcatttagtttt

SEQ ID NO: 221725 - DNA, 22 bp, Artificial Sequence
  Synthetic oligonucleotide; TTT chr2 60487548 60487569 60487553 60487548 -
ataaaggcatcatttagttttc

SEQ ID NO: 221726 - DNA, 22 bp, Artificial Sequence
  Synthetic oligonucleotide; TTA chr2 60487547 60487568 60487552 60487547 -
taaaggcatcatttagttttcc

SEQ ID NO: 221727 - DNA, 22 bp, Artificial Sequence
  Synthetic oligonucleotide; TTT chr2 60487533 60487554 60487538 60487533 -
agttttcccttaatctgaatct

SEQ ID NO: 221728 - DNA, 22 bp, Artificial Sequence
  Synthetic oligonucleotide; TTA chr2 60487532 60487553 60487537 60487532 -
gttttcccttaatctgaatctg

SEQ ID NO: 221729 - DNA, 22 bp, Artificial Sequence
  Synthetic oligonucleotide; TTT chr2 60487528 60487549 60487533 60487528 -
tcccttaatctgaatctgtatt

SEQ ID NO: 221730 - DNA, 22 bp, Artificial Sequence
  Synthetic oligonucleotide; TTT chr2 60487527 60487548 60487532 60487527 -
cccttaatctgaatctgtattc

SEQ ID NO: 221731 - DNA, 22 bp, Artificial Sequence
  Synthetic oligonucleotide; TTC chr2 60487526 60487547 60487531 60487526 -
ccttaatctgaatctgtattca

SEQ ID NO: 221732 - DNA, 22 bp, Artificial Sequence
  Synthetic oligonucleotide; CTT chr2 60487522 60487543 60487527 60487522 -
aatctgaatctgtattcatttt

SEQ ID NO: 221733 - DNA, 22 bp, Artificial Sequence
  Synthetic oligonucleotide; TTA chr2 60487521 60487542 60487526 60487521 -
atctgaatctgtattcattttt

SEQ ID NO: 221734 - DNA, 22 bp, Artificial Sequence
  Synthetic oligonucleotide; CTG chr2 60487516 60487537 60487521 60487516 -
aatctgtattcatttttaaata

SEQ ID NO: 221735 - DNA, 22 bp, Artificial Sequence
  Synthetic oligonucleotide; CTG chr2 60487510 60487531 60487515 60487510 -
tattcatttttaaatatctaat

SEQ ID NO: 221736 - DNA, 22 bp, Artificial Sequence
  Synthetic oligonucleotide; TTC chr2 60487505 60487526 60487510 60487505 -
atttttaaatatctaatgttga

SEQ ID NO: 221737 - DNA, 22 bp, Artificial Sequence
  Synthetic oligonucleotide; TTT chr2 60487501 60487522 60487506 60487501 -
ttaaatatctaatgttgattag

SEQ ID NO: 221738 - DNA, 22 bp, Artificial Sequence
  Synthetic oligonucleotide; TTT chr2 60487500 60487521 60487505 60487500 -
taaatatctaatgttgattagt

SEQ ID NO: 221739 - DNA, 22 bp, Artificial Sequence
  Synthetic oligonucleotide; TTT chr2 60487499 60487520 60487504 60487499 -
aaatatctaatgttgattagta

SEQ ID NO: 221740 - DNA, 22 bp, Artificial Sequence
  Synthetic oligonucleotide; TTA chr2 60487498 60487519 60487503 60487498 -
aatatctaatgttgattagtat

SEQ ID NO: 221741 - DNA, 22 bp, Artificial Sequence
  Synthetic oligonucleotide; CTA chr2 60487490 60487511 60487495 60487490 -
atgttgattagtatgttctatt

SEQ ID NO: 221742 - DNA, 22 bp, Artificial Sequence
  Synthetic oligonucleotide; TTG chr2 60487484 60487505 60487489 60487484 -
attagtatgttctattatttat

SEQ ID NO: 221743 - DNA, 22 bp, Artificial Sequence
  Synthetic oligonucleotide; TTA chr2 60487480 60487501 60487485 60487480 -
gtatgttctattatttatagcc

SEQ ID NO: 221744 - DNA, 22 bp, Artificial Sequence
  Synthetic oligonucleotide; TTC chr2 60487472 60487493 60487477 60487472 -
tattatttatagccctccagaa

SEQ ID NO: 221745 - DNA, 22 bp, Artificial Sequence
  Synthetic oligonucleotide; CTA chr2 60487470 60487491 60487475 60487470 -
ttatttatagccctccagaagg

SEQ ID NO: 221746 - DNA, 22 bp, Artificial Sequence
  Synthetic oligonucleotide; TTA chr2 60487467 60487488 60487472 60487467 -
tttatagccctccagaaggatc

SEQ ID NO: 221747 - DNA, 22 bp, Artificial Sequence
  Synthetic oligonucleotide; TTT chr2 60487464 60487485 60487469 60487464 -
atagccctccagaaggatccca

SEQ ID NO: 221748 - DNA, 22 bp, Artificial Sequence
  Synthetic oligonucleotide; TTA chr2 60487463 60487484 60487468 60487463 -
tagccctccagaaggatcccaa

SEQ ID NO: 221749 - DNA, 22 bp, Artificial Sequence
  Synthetic oligonucleotide; CTC chr2 60487455 60487476 60487460 60487455 -
cagaaggatcccaagggaagat

SEQ ID NO: 221750 - DNA, 22 bp, Artificial Sequence
  Synthetic oligonucleotide; CTA chr2 60487427 60487448 60487432 60487427 -
catttgagaagacgatttccca

SEQ ID NO: 221751 - DNA, 22 bp, Artificial Sequence
  Synthetic oligonucleotide; TTT chr2 60487422 60487443 60487427 60487422 -
gagaagacgatttcccaatttc

SEQ ID NO: 221752 - DNA, 22 bp, Artificial Sequence
  Synthetic oligonucleotide; TTG chr2 60487421 60487442 60487426 60487421 -
agaagacgatttcccaatttcc

SEQ ID NO: 221753 - DNA, 22 bp, Artificial Sequence
  Synthetic oligonucleotide; TTT chr2 60487409 60487430 60487414 60487409 -
cccaatttccatacagatgacg

SEQ ID NO: 221754 - DNA, 22 bp, Artificial Sequence
  Synthetic oligonucleotide; TTC chr2 60487408 60487429 60487413 60487408 -
ccaatttccatacagatgacga

SEQ ID NO: 221755 - DNA, 22 bp, Artificial Sequence
  Synthetic oligonucleotide; TTT chr2 60487401 60487422 60487406 60487401 -
ccatacagatgacgaaaacgta

SEQ ID NO: 221756 - DNA, 22 bp, Artificial Sequence
  Synthetic oligonucleotide; TTC chr2 60487400 60487421 60487405 60487400 -
catacagatgacgaaaacgtaa

SEQ ID NO: 221757 - DNA, 22 bp, Artificial Sequence
  Synthetic oligonucleotide; CTG chr2 60487375 60487396 60487380 60487375 -
cccactacactgctccccctgc

SEQ ID NO: 221758 - DNA, 22 bp, Artificial Sequence
  Synthetic oligonucleotide; CTA chr2 60487368 60487389 60487373 60487368 -
cactgctccccctgctgaattt

SEQ ID NO: 221759 - DNA, 22 bp, Artificial Sequence
  Synthetic oligonucleotide; CTG chr2 60487363 60487384 60487368 60487363 -
ctccccctgctgaattttcttt

SEQ ID NO: 221760 - DNA, 22 bp, Artificial Sequence
  Synthetic oligonucleotide; CTC chr2 60487360 60487381 60487365 60487360 -
cccctgctgaattttctttttc

SEQ ID NO: 221761 - DNA, 22 bp, Artificial Sequence
  Synthetic oligonucleotide; CTG chr2 60487354 60487375 60487359 60487354 -
ctgaattttctttttccactct

SEQ ID NO: 221762 - DNA, 22 bp, Artificial Sequence
  Synthetic oligonucleotide; CTG chr2 60487351 60487372 60487356 60487351 -
aattttctttttccactctcgg

SEQ ID NO: 221763 - DNA, 22 bp, Artificial Sequence
  Synthetic oligonucleotide; TTT chr2 60487346 60487367 60487351 60487346 -
tctttttccactctcggtgtgt

SEQ ID NO: 221764 - DNA, 22 bp, Artificial Sequence
  Synthetic oligonucleotide; TTT chr2 60487345 60487366 60487350 60487345 -
ctttttccactctcggtgtgtg

SEQ ID NO: 221765 - DNA, 22 bp, Artificial Sequence
  Synthetic oligonucleotide; TTC chr2 60487344 60487365 60487349 60487344 -
tttttccactctcggtgtgtgg

SEQ ID NO: 221766 - DNA, 22 bp, Artificial Sequence
  Synthetic oligonucleotide; CTT chr2 60487342 60487363 60487347 60487342 -
tttccactctcggtgtgtggca

SEQ ID NO: 221767 - DNA, 22 bp, Artificial Sequence
  Synthetic oligonucleotide; TTT chr2 60487341 60487362 60487346 60487341 -
ttccactctcggtgtgtggcat

SEQ ID NO: 221768 - DNA, 22 bp, Artificial Sequence
  Synthetic oligonucleotide; TTT chr2 60487340 60487361 60487345 60487340 -
tccactctcggtgtgtggcatt

SEQ ID NO: 221769 - DNA, 22 bp, Artificial Sequence
  Synthetic oligonucleotide; TTT chr2 60487339 60487360 60487344 60487339 -
ccactctcggtgtgtggcattg

SEQ ID NO: 221770 - DNA, 22 bp, Artificial Sequence
  Synthetic oligonucleotide; TTC chr2 60487338 60487359 60487343 60487338 -
cactctcggtgtgtggcattgt

SEQ ID NO: 221771 - DNA, 22 bp, Artificial Sequence
  Synthetic oligonucleotide; CTC chr2 60487333 60487354 60487338 60487333 -
tcggtgtgtggcattgtggggt

SEQ ID NO: 221772 - DNA, 22 bp, Artificial Sequence
  Synthetic oligonucleotide; CTC chr2 60487331 60487352 60487336 60487331 -
ggtgtgtggcattgtggggtgc

SEQ ID NO: 221773 - DNA, 22 bp, Artificial Sequence
  Synthetic oligonucleotide; TTG chr2 60487317 60487338 60487322 60487317 -
tggggtgcagacacctgaaagc

SEQ ID NO: 221774 - DNA, 22 bp, Artificial Sequence
  Synthetic oligonucleotide; CTG chr2 60487300 60487321 60487305 60487300 -
aaagcctgactggagatgtaac

SEQ ID NO: 221775 - DNA, 22 bp, Artificial Sequence
  Synthetic oligonucleotide; CTG chr2 60487292 60487313 60487297 60487292 -
actggagatgtaacatgggctc

SEQ ID NO: 221776 - DNA, 22 bp, Artificial Sequence
  Synthetic oligonucleotide; CTG chr2 60487288 60487309 60487293 60487288 -
gagatgtaacatgggctctgct

SEQ ID NO: 221777 - DNA, 22 bp, Artificial Sequence
  Synthetic oligonucleotide; CTC chr2 60487270 60487291 60487275 60487270 -
tgctgacattagcatgaagagc

SEQ ID NO: 221778 - DNA, 22 bp, Artificial Sequence
  Synthetic oligonucleotide; CTG chr2 60487268 60487289 60487273 60487268 -
ctgacattagcatgaagagctt

SEQ ID NO: 221779 - DNA, 22 bp, Artificial Sequence
  Synthetic oligonucleotide; CTG chr2 60487265 60487286 60487270 60487265 -
acattagcatgaagagcttagc

SEQ ID NO: 221780 - DNA, 22 bp, Artificial Sequence
  Synthetic oligonucleotide; TTA chr2 60487259 60487280 60487264 60487259 -
gcatgaagagcttagctaatcg

SEQ ID NO: 221781 - DNA, 22 bp, Artificial Sequence
  Synthetic oligonucleotide; CTT chr2 60487246 60487267 60487251 60487246 -
agctaatcgacttgcaaaatat

SEQ ID NO: 221782 - DNA, 22 bp, Artificial Sequence
  Synthetic oligonucleotide; TTA chr2 60487245 60487266 60487250 60487245 -
gctaatcgacttgcaaaatata

SEQ ID NO: 221783 - DNA, 22 bp, Artificial Sequence
  Synthetic oligonucleotide; CTA chr2 60487241 60487262 60487246 60487241 -
atcgacttgcaaaatataggtt

SEQ ID NO: 221784 - DNA, 22 bp, Artificial Sequence
  Synthetic oligonucleotide; CTT chr2 60487233 60487254 60487238 60487233 -
gcaaaatataggttagggagtt

SEQ ID NO: 221785 - DNA, 22 bp, Artificial Sequence
  Synthetic oligonucleotide; TTG chr2 60487232 60487253 60487237 60487232 -
caaaatataggttagggagttt

SEQ ID NO: 221786 - DNA, 22 bp, Artificial Sequence
  Synthetic oligonucleotide; TTA chr2 60487218 60487239 60487223 60487218 -
gggagttttataggatatcaaa

SEQ ID NO: 221787 - DNA, 22 bp, Artificial Sequence
  Synthetic oligonucleotide; TTT chr2 60487210 60487231 60487215 60487210 -
tataggatatcaaattatctta

SEQ ID NO: 221788 - DNA, 22 bp, Artificial Sequence
  Synthetic oligonucleotide; TTT chr2 60487209 60487230 60487214 60487209 -
ataggatatcaaattatcttac

SEQ ID NO: 221789 - DNA, 22 bp, Artificial Sequence
  Synthetic oligonucleotide; TTA chr2 60487208 60487229 60487213 60487208 -
taggatatcaaattatcttact

SEQ ID NO: 221790 - DNA, 22 bp, Artificial Sequence
  Synthetic oligonucleotide; TTA chr2 60487193 60487214 60487198 60487193 -
tcttactctttcattgattaaa

SEQ ID NO: 221791 - DNA, 22 bp, Artificial Sequence
  Synthetic oligonucleotide; CTT chr2 60487189 60487210 60487194 60487189 -
actctttcattgattaaaggca

SEQ ID NO: 221792 - DNA, 22 bp, Artificial Sequence
  Synthetic oligonucleotide; TTA chr2 60487188 60487209 60487193 60487188 -
ctctttcattgattaaaggcaa

SEQ ID NO: 221793 - DNA, 22 bp, Artificial Sequence
  Synthetic oligonucleotide; CTC chr2 60487185 60487206 60487190 60487185 -
tttcattgattaaaggcaaaat

SEQ ID NO: 221794 - DNA, 22 bp, Artificial Sequence
  Synthetic oligonucleotide; CTT chr2 60487183 60487204 60487188 60487183 -
tcattgattaaaggcaaaatat

SEQ ID NO: 221795 - DNA, 22 bp, Artificial Sequence
  Synthetic oligonucleotide; TTT chr2 60487182 60487203 60487187 60487182 -
cattgattaaaggcaaaatatt

SEQ ID NO: 221796 - DNA, 22 bp, Artificial Sequence
  Synthetic oligonucleotide; TTC chr2 60487181 60487202 60487186 60487181 -
attgattaaaggcaaaatatta

SEQ ID NO: 221797 - DNA, 22 bp, Artificial Sequence
  Synthetic oligonucleotide; TTG chr2 60487177 60487198 60487182 60487177 -
attaaaggcaaaatattacatt

SEQ ID NO: 221798 - DNA, 22 bp, Artificial Sequence
  Synthetic oligonucleotide; TTA chr2 60487173 60487194 60487178 60487173 -
aaggcaaaatattacattaact

SEQ ID NO: 221799 - DNA, 22 bp, Artificial Sequence
  Synthetic oligonucleotide; TTA chr2 60487159 60487180 60487164 60487159 -
cattaactagatcattacatgg

SEQ ID NO: 221800 - DNA, 22 bp, Artificial Sequence
  Synthetic oligonucleotide; TTA chr2 60487154 60487175 60487159 60487154 -
actagatcattacatgggtaaa

SEQ ID NO: 221801 - DNA, 22 bp, Artificial Sequence
  Synthetic oligonucleotide; CTA chr2 60487150 60487171 60487155 60487150 -
gatcattacatgggtaaaaggt

SEQ ID NO: 221802 - DNA, 22 bp, Artificial Sequence
  Synthetic oligonucleotide; TTA chr2 60487142 60487163 60487147 60487142 -
catgggtaaaaggttagaactt

SEQ ID NO: 221803 - DNA, 22 bp, Artificial Sequence
  Synthetic oligonucleotide; TTA chr2 60487126 60487147 60487131 60487126 -
gaacttcacacacttaggggtg

SEQ ID NO: 221804 - DNA, 22 bp, Artificial Sequence
  Synthetic oligonucleotide; CTT chr2 60487120 60487141 60487125 60487120 -
cacacacttaggggtgttgcac

SEQ ID NO: 221805 - DNA, 22 bp, Artificial Sequence
  Synthetic oligonucleotide; TTC chr2 60487119 60487140 60487124 60487119 -
acacacttaggggtgttgcact

SEQ ID NO: 221806 - DNA, 22 bp, Artificial Sequence
  Synthetic oligonucleotide; CTT chr2 60487111 60487132 60487116 60487111 -
aggggtgttgcactatccttcc

SEQ ID NO: 221807 - DNA, 22 bp, Artificial Sequence
  Synthetic oligonucleotide; TTA chr2 60487110 60487131 60487115 60487110 -
ggggtgttgcactatccttccc

SEQ ID NO: 221808 - DNA, 22 bp, Artificial Sequence
  Synthetic oligonucleotide; TTG chr2 60487101 60487122 60487106 60487101 -
cactatccttccccttcctgcc

SEQ ID NO: 221809 - DNA, 22 bp, Artificial Sequence
  Synthetic oligonucleotide; CTA chr2 60487096 60487117 60487101 60487096 -
tccttccccttcctgccttgtg

SEQ ID NO: 221810 - DNA, 22 bp, Artificial Sequence
  Synthetic oligonucleotide; CTT chr2 60487091 60487112 60487096 60487091 -
ccccttcctgccttgtggcaaa

SEQ ID NO: 221811 - DNA, 22 bp, Artificial Sequence
  Synthetic oligonucleotide; TTC chr2 60487090 60487111 60487095 60487090 -
cccttcctgccttgtggcaaat

SEQ ID NO: 221812 - DNA, 22 bp, Artificial Sequence
  Synthetic oligonucleotide; CTT chr2 60487085 60487106 60487090 60487085 -
cctgccttgtggcaaatcacag

SEQ ID NO: 221813 - DNA, 22 bp, Artificial Sequence
  Synthetic oligonucleotide; TTC chr2 60487084 60487105 60487089 60487084 -
ctgccttgtggcaaatcacagg

SEQ ID NO: 221814 - DNA, 22 bp, Artificial Sequence
  Synthetic oligonucleotide; CTG chr2 60487081 60487102 60487086 60487081 -
ccttgtggcaaatcacaggttg

SEQ ID NO: 221815 - DNA, 22 bp, Artificial Sequence
  Synthetic oligonucleotide; CTT chr2 60487077 60487098 60487082 60487077 -
gtggcaaatcacaggttggagg

SEQ ID NO: 221816 - DNA, 22 bp, Artificial Sequence
  Synthetic oligonucleotide; TTG chr2 60487076 60487097 60487081 60487076 -
tggcaaatcacaggttggaggc

SEQ ID NO: 221817 - DNA, 22 bp, Artificial Sequence
  Synthetic oligonucleotide; TTG chr2 60487059 60487080 60487064 60487059 -
gaggcagggaaactcactgtgt

SEQ ID NO: 221818 - DNA, 22 bp, Artificial Sequence
  Synthetic oligonucleotide; CTC chr2 60487044 60487065 60487049 60487044 -
actgtgtctagcgctcctaaat

SEQ ID NO: 221819 - DNA, 22 bp, Artificial Sequence
  Synthetic oligonucleotide; CTG chr2 60487040 60487061 60487045 60487040 -
tgtctagcgctcctaaatgcct

SEQ ID NO: 221820 - DNA, 22 bp, Artificial Sequence
  Synthetic oligonucleotide; CTA chr2 60487034 60487055 60487039 60487034 -
gcgctcctaaatgcctgaatag

SEQ ID NO: 221821 - DNA, 22 bp, Artificial Sequence
  Synthetic oligonucleotide; CTC chr2 60487028 60487049 60487033 60487028 -
ctaaatgcctgaatagcaacgt

SEQ ID NO: 221822 - DNA, 22 bp, Artificial Sequence
  Synthetic oligonucleotide; CTA chr2 60487025 60487046 60487030 60487025 -
aatgcctgaatagcaacgttag

SEQ ID NO: 221823 - DNA, 22 bp, Artificial Sequence
  Synthetic oligonucleotide; CTG chr2 60487017 60487038 60487022 60487017 -
aatagcaacgttagacttaaag

SEQ ID NO: 221824 - DNA, 22 bp, Artificial Sequence
  Synthetic oligonucleotide; TTA chr2 60487004 60487025 60487009 60487004 -
gacttaaaggaggggcatttgc

SEQ ID NO: 221825 - DNA, 22 bp, Artificial Sequence
  Synthetic oligonucleotide; CTT chr2 60486999 60487020 60487004 60486999 -
aaaggaggggcatttgccttcg

SEQ ID NO: 221826 - DNA, 22 bp, Artificial Sequence
  Synthetic oligonucleotide; TTA chr2 60486998 60487019 60487003 60486998 -
aaggaggggcatttgccttcgc

SEQ ID NO: 221827 - DNA, 22 bp, Artificial Sequence
  Synthetic oligonucleotide; TTT chr2 60486984 60487005 60486989 60486984 -
gccttcgctttgaatctcccga

SEQ ID NO: 221828 - DNA, 22 bp, Artificial Sequence
  Synthetic oligonucleotide; TTG chr2 60486983 60487004 60486988 60486983 -
ccttcgctttgaatctcccgag

SEQ ID NO: 221829 - DNA, 22 bp, Artificial Sequence
  Synthetic oligonucleotide; CTT chr2 60486979 60487000 60486984 60486979 -
cgctttgaatctcccgagtctt

SEQ ID NO: 221830 - DNA, 22 bp, Artificial Sequence
  Synthetic oligonucleotide; TTC chr2 60486978 60486999 60486983 60486978 -
gctttgaatctcccgagtcttt

SEQ ID NO: 221831 - DNA, 22 bp, Artificial Sequence
  Synthetic oligonucleotide; CTT chr2 60486974 60486995 60486979 60486974 -
tgaatctcccgagtctttttta

SEQ ID NO: 221832 - DNA, 22 bp, Artificial Sequence
  Synthetic oligonucleotide; TTT chr2 60486973 60486994 60486978 60486973 -
gaatctcccgagtcttttttat

SEQ ID NO: 221833 - DNA, 22 bp, Artificial Sequence
  Synthetic oligonucleotide; TTG chr2 60486972 60486993 60486977 60486972 -
aatctcccgagtcttttttatt

SEQ ID NO: 221834 - DNA, 22 bp, Artificial Sequence
  Synthetic oligonucleotide; CTC chr2 60486966 60486987 60486971 60486966 -
ccgagtcttttttattctgata

SEQ ID NO: 221835 - DNA, 22 bp, Artificial Sequence
  Synthetic oligonucleotide; CTT chr2 60486957 60486978 60486962 60486957 -
ttttattctgatagaatagtaa

SEQ ID NO: 221836 - DNA, 22 bp, Artificial Sequence
  Synthetic oligonucleotide; TTT chr2 60486956 60486977 60486961 60486956 -
tttattctgatagaatagtaat

SEQ ID NO: 221837 - DNA, 22 bp, Artificial Sequence
  Synthetic oligonucleotide; TTT chr2 60486955 60486976 60486960 60486955 -
ttattctgatagaatagtaatc

SEQ ID NO: 221838 - DNA, 22 bp, Artificial Sequence
  Synthetic oligonucleotide; TTT chr2 60486954 60486975 60486959 60486954 -
tattctgatagaatagtaatct

SEQ ID NO: 221839 - DNA, 22 bp, Artificial Sequence
  Synthetic oligonucleotide; TTT chr2 60486953 60486974 60486958 60486953 -
attctgatagaatagtaatctt

SEQ ID NO: 221840 - DNA, 22 bp, Artificial Sequence
  Synthetic oligonucleotide; TTA chr2 60486952 60486973 60486957 60486952 -
ttctgatagaatagtaatctta

SEQ ID NO: 221841 - DNA, 22 bp, Artificial Sequence
  Synthetic oligonucleotide; TTC chr2 60486949 60486970 60486954 60486949 -
tgatagaatagtaatcttaaaa

SEQ ID NO: 221842 - DNA, 22 bp, Artificial Sequence
  Synthetic oligonucleotide; CTG chr2 60486947 60486968 60486952 60486947 -
atagaatagtaatcttaaaatt

SEQ ID NO: 221843 - DNA, 22 bp, Artificial Sequence
  Synthetic oligonucleotide; CTT chr2 60486931 60486952 60486936 60486931 -
aaaattaaatattaatttgttc

SEQ ID NO: 221844 - DNA, 22 bp, Artificial Sequence
  Synthetic oligonucleotide; TTA chr2 60486930 60486951 60486935 60486930 -
aaattaaatattaatttgttct

SEQ ID NO: 221845 - DNA, 22 bp, Artificial Sequence
  Synthetic oligonucleotide; TTA chr2 60486924 60486945 60486929 60486924 -
aatattaatttgttctgattcc

SEQ ID NO: 221846 - DNA, 22 bp, Artificial Sequence
  Synthetic oligonucleotide; TTA chr2 60486917 60486938 60486922 60486917 -
atttgttctgattccatttctg

SEQ ID NO: 221847 - DNA, 22 bp, Artificial Sequence
  Synthetic oligonucleotide; TTT chr2 60486913 60486934 60486918 60486913 -
gttctgattccatttctgttag

SEQ ID NO: 221848 - DNA, 22 bp, Artificial Sequence
  Synthetic oligonucleotide; TTG chr2 60486912 60486933 60486917 60486912 -
ttctgattccatttctgttagc

SEQ ID NO: 221849 - DNA, 22 bp, Artificial Sequence
  Synthetic oligonucleotide; TTC chr2 60486909 60486930 60486914 60486909 -
tgattccatttctgttagcagg

SEQ ID NO: 221850 - DNA, 22 bp, Artificial Sequence
  Synthetic oligonucleotide; CTG chr2 60486907 60486928 60486912 60486907 -
attccatttctgttagcaggga

SEQ ID NO: 221851 - DNA, 22 bp, Artificial Sequence
  Synthetic oligonucleotide; TTC chr2 60486903 60486924 60486908 60486903 -
catttctgttagcagggaaaag

SEQ ID NO: 221852 - DNA, 22 bp, Artificial Sequence
  Synthetic oligonucleotide; TTT chr2 60486898 60486919 60486903 60486898 -
ctgttagcagggaaaagggcaa

SEQ ID NO: 221853 - DNA, 22 bp, Artificial Sequence
  Synthetic oligonucleotide; TTC chr2 60486897 60486918 60486902 60486897 -
tgttagcagggaaaagggcaaa

SEQ ID NO: 221854 - DNA, 22 bp, Artificial Sequence
  Synthetic oligonucleotide; CTG chr2 60486895 60486916 60486900 60486895 -
ttagcagggaaaagggcaaata

SEQ ID NO: 221855 - DNA, 22 bp, Artificial Sequence
  Synthetic oligonucleotide; TTA chr2 60486892 60486913 60486897 60486892 -
gcagggaaaagggcaaatacat

SEQ ID NO: 221856 - DNA, 22 bp, Artificial Sequence
  Synthetic oligonucleotide; CTG chr2 60486854 60486875 60486859 60486854 -
agccatggccaggtttgagaga

SEQ ID NO: 221857 - DNA, 22 bp, Artificial Sequence
  Synthetic oligonucleotide; TTT chr2 60486838 60486859 60486843 60486838 -
gagagacagagtgattcgcagt

SEQ ID NO: 221858 - DNA, 22 bp, Artificial Sequence
  Synthetic oligonucleotide; TTG chr2 60486837 60486858 60486842 60486837 -
agagacagagtgattcgcagta

SEQ ID NO: 221859 - DNA, 22 bp, Artificial Sequence
  Synthetic oligonucleotide; TTC chr2 60486821 60486842 60486826 60486821 -
gcagtagtcttcccagggtgtt

SEQ ID NO: 221860 - DNA, 22 bp, Artificial Sequence
  Synthetic oligonucleotide; CTT chr2 60486810 60486831 60486815 60486810 -
cccagggtgttgagtgggaacg

SEQ ID NO: 221861 - DNA, 22 bp, Artificial Sequence
  Synthetic oligonucleotide; TTC chr2 60486809 60486830 60486814 60486809 -
ccagggtgttgagtgggaacgt

SEQ ID NO: 221862 - DNA, 22 bp, Artificial Sequence
  Synthetic oligonucleotide; TTG chr2 60486798 60486819 60486803 60486798 -
agtgggaacgtctccctgggaa

SEQ ID NO: 221863 - DNA, 22 bp, Artificial Sequence
  Synthetic oligonucleotide; CTC chr2 60486784 60486805 60486789 60486784 -
cctgggaagggatgtggtcatt

SEQ ID NO: 221864 - DNA, 22 bp, Artificial Sequence
  Synthetic oligonucleotide; CTG chr2 60486780 60486801 60486785 60486780 -
ggaagggatgtggtcattctca

SEQ ID NO: 221865 - DNA, 22 bp, Artificial Sequence
  Synthetic oligonucleotide; TTC chr2 60486761 60486782 60486766 60486761 -
tcagactgtgggctcagactct

SEQ ID NO: 221866 - DNA, 22 bp, Artificial Sequence
  Synthetic oligonucleotide; CTC chr2 60486759 60486780 60486764 60486759 -
agactgtgggctcagactctgt

SEQ ID NO: 221867 - DNA, 22 bp, Artificial Sequence
  Synthetic oligonucleotide; CTG chr2 60486753 60486774 60486758 60486753 -
tgggctcagactctgtcacact

SEQ ID NO: 221868 - DNA, 22 bp, Artificial Sequence
  Synthetic oligonucleotide; CTC chr2 60486746 60486767 60486751 60486746 -
agactctgtcacactgtaatac

SEQ ID NO: 221869 - DNA, 22 bp, Artificial Sequence
  Synthetic oligonucleotide; CTC chr2 60486740 60486761 60486745 60486740 -
tgtcacactgtaatacctctgt

SEQ ID NO: 221870 - DNA, 22 bp, Artificial Sequence
  Synthetic oligonucleotide; CTG chr2 60486738 60486759 60486743 60486738 -
tcacactgtaatacctctgtca

SEQ ID NO: 221871 - DNA, 22 bp, Artificial Sequence
  Synthetic oligonucleotide; CTG chr2 60486730 60486751 60486735 60486730 -
taatacctctgtcaaccatcta

SEQ ID NO: 221872 - DNA, 22 bp, Artificial Sequence
  Synthetic oligonucleotide; CTC chr2 60486721 60486742 60486726 60486721 -
tgtcaaccatctaatgctatca

SEQ ID NO: 221873 - DNA, 22 bp, Artificial Sequence
  Synthetic oligonucleotide; CTG chr2 60486719 60486740 60486724 60486719 -
tcaaccatctaatgctatcaag

SEQ ID NO: 221874 - DNA, 22 bp, Artificial Sequence
  Synthetic oligonucleotide; CTA chr2 60486708 60486729 60486713 60486708 -
atgctatcaaggccttcctgag

SEQ ID NO: 221875 - DNA, 22 bp, Artificial Sequence
  Synthetic oligonucleotide; CTA chr2 60486702 60486723 60486707 60486702 -
tcaaggccttcctgagagaagt

SEQ ID NO: 221876 - DNA, 22 bp, Artificial Sequence
  Synthetic oligonucleotide; CTT chr2 60486692 60486713 60486697 60486692 -
cctgagagaagtttcaggccca

SEQ ID NO: 221877 - DNA, 22 bp, Artificial Sequence
  Synthetic oligonucleotide; TTC chr2 60486691 60486712 60486696 60486691 -
ctgagagaagtttcaggcccaa

SEQ ID NO: 221878 - DNA, 22 bp, Artificial Sequence
  Synthetic oligonucleotide; CTG chr2 60486688 60486709 60486693 60486688 -
agagaagtttcaggcccaatcc

SEQ ID NO: 221879 - DNA, 22 bp, Artificial Sequence
  Synthetic oligonucleotide; TTT chr2 60486678 60486699 60486683 60486678 -
caggcccaatcctgatgttgag

SEQ ID NO: 221880 - DNA, 22 bp, Artificial Sequence
  Synthetic oligonucleotide; TTC chr2 60486677 60486698 60486682 60486677 -
aggcccaatcctgatgttgagt

SEQ ID NO: 221881 - DNA, 22 bp, Artificial Sequence
  Synthetic oligonucleotide; CTG chr2 60486664 60486685 60486669 60486664 -
atgttgagttggcatgttcaca

SEQ ID NO: 221882 - DNA, 22 bp, Artificial Sequence
  Synthetic oligonucleotide; TTG chr2 60486658 60486679 60486663 60486658 -
agttggcatgttcacatgtctg

SEQ ID NO: 221883 - DNA, 22 bp, Artificial Sequence
  Synthetic oligonucleotide; TTG chr2 60486653 60486674 60486658 60486653 -
gcatgttcacatgtctggtaat

SEQ ID NO: 221884 - DNA, 22 bp, Artificial Sequence
  Synthetic oligonucleotide; TTC chr2 60486645 60486666 60486650 60486645 -
acatgtctggtaataatctgcc

SEQ ID NO: 221885 - DNA, 22 bp, Artificial Sequence
  Synthetic oligonucleotide; CTG chr2 60486636 60486657 60486641 60486636 -
gtaataatctgccagctaatcc

SEQ ID NO: 221886 - DNA, 22 bp, Artificial Sequence
  Synthetic oligonucleotide; CTG chr2 60486625 60486646 60486630 60486625 -
ccagctaatccatcatgctgct

SEQ ID NO: 221887 - DNA, 22 bp, Artificial Sequence
  Synthetic oligonucleotide; CTA chr2 60486618 60486639 60486623 60486618 -
atccatcatgctgctcatttct

SEQ ID NO: 221888 - DNA, 22 bp, Artificial Sequence
  Synthetic oligonucleotide; CTG chr2 60486605 60486626 60486610 60486605 -
ctcatttctgtgcattattcat

SEQ ID NO: 221889 - DNA, 22 bp, Artificial Sequence
  Synthetic oligonucleotide; CTC chr2 60486602 60486623 60486607 60486602 -
atttctgtgcattattcatctc

SEQ ID NO: 221890 - DNA, 22 bp, Artificial Sequence
  Synthetic oligonucleotide; TTT chr2 60486598 60486619 60486603 60486598 -
ctgtgcattattcatctcaaag

SEQ ID NO: 221891 - DNA, 22 bp, Artificial Sequence
  Synthetic oligonucleotide; TTC chr2 60486597 60486618 60486602 60486597 -
tgtgcattattcatctcaaagc

SEQ ID NO: 221892 - DNA, 22 bp, Artificial Sequence
  Synthetic oligonucleotide; CTG chr2 60486595 60486616 60486600 60486595 -
tgcattattcatctcaaagcca

SEQ ID NO: 221893 - DNA, 22 bp, Artificial Sequence
  Synthetic oligonucleotide; TTA chr2 60486588 60486609 60486593 60486588 -
ttcatctcaaagccagaggatc

SEQ ID NO: 221894 - DNA, 22 bp, Artificial Sequence
  Synthetic oligonucleotide; TTC chr2 60486585 60486606 60486590 60486585 -
atctcaaagccagaggatctca

SEQ ID NO: 221895 - DNA, 22 bp, Artificial Sequence
  Synthetic oligonucleotide; CTC chr2 60486580 60486601 60486585 60486580 -
aaagccagaggatctcatgtcc

SEQ ID NO: 221896 - DNA, 22 bp, Artificial Sequence
  Synthetic oligonucleotide; CTC chr2 60486564 60486585 60486569 60486564 -
atgtccatcacagggctgtggt

SEQ ID NO: 221897 - DNA, 22 bp, Artificial Sequence
  Synthetic oligonucleotide; CTG chr2 60486546 60486567 60486551 60486546 -
tggtctgtggatagggaaaatt

SEQ ID NO: 221898 - DNA, 22 bp, Artificial Sequence
  Synthetic oligonucleotide; CTG chr2 60486539 60486560 60486544 60486539 -
tggatagggaaaatttcaaggc

SEQ ID NO: 221899 - DNA, 22 bp, Artificial Sequence
  Synthetic oligonucleotide; TTT chr2 60486523 60486544 60486528 60486523 -
caaggcttttctgggcctgatg

SEQ ID NO: 221900 - DNA, 22 bp, Artificial Sequence
  Synthetic oligonucleotide; TTC chr2 60486522 60486543 60486527 60486522 -
aaggcttttctgggcctgatgt

SEQ ID NO: 221901 - DNA, 22 bp, Artificial Sequence
  Synthetic oligonucleotide; CTT chr2 60486515 60486536 60486520 60486515 -
ttctgggcctgatgtagccatt

SEQ ID NO: 221902 - DNA, 22 bp, Artificial Sequence
  Synthetic oligonucleotide; TTT chr2 60486514 60486535 60486519 60486514 -
tctgggcctgatgtagccattt

SEQ ID NO: 221903 - DNA, 22 bp, Artificial Sequence
  Synthetic oligonucleotide; TTT chr2 60486513 60486534 60486518 60486513 -
ctgggcctgatgtagccatttt

SEQ ID NO: 221904 - DNA, 22 bp, Artificial Sequence
  Synthetic oligonucleotide; TTC chr2 60486512 60486533 60486517 60486512 -
tgggcctgatgtagccattttc

SEQ ID NO: 221905 - DNA, 22 bp, Artificial Sequence
  Synthetic oligonucleotide; CTG chr2 60486510 60486531 60486515 60486510 -
ggcctgatgtagccattttctt

SEQ ID NO: 221906 - DNA, 22 bp, Artificial Sequence
  Synthetic oligonucleotide; CTG chr2 60486504 60486525 60486509 60486504 -
atgtagccattttctttcagta

SEQ ID NO: 221907 - DNA, 22 bp, Artificial Sequence
  Synthetic oligonucleotide; TTT chr2 60486492 60486513 60486497 60486492 -
tctttcagtatcttagattggt

SEQ ID NO: 221908 - DNA, 22 bp, Artificial Sequence
  Synthetic oligonucleotide; TTT chr2 60486491 60486512 60486496 60486491 -
ctttcagtatcttagattggta

SEQ ID NO: 221909 - DNA, 22 bp, Artificial Sequence
  Synthetic oligonucleotide; TTC chr2 60486490 60486511 60486495 60486490 -
tttcagtatcttagattggtag

SEQ ID NO: 221910 - DNA, 22 bp, Artificial Sequence
  Synthetic oligonucleotide; CTT chr2 60486488 60486509 60486493 60486488 -
tcagtatcttagattggtaggt

SEQ ID NO: 221911 - DNA, 22 bp, Artificial Sequence
  Synthetic oligonucleotide; TTT chr2 60486487 60486508 60486492 60486487 -
cagtatcttagattggtaggtc

SEQ ID NO: 221912 - DNA, 22 bp, Artificial Sequence
  Synthetic oligonucleotide; TTC chr2 60486486 60486507 60486491 60486486 -
agtatcttagattggtaggtct

SEQ ID NO: 221913 - DNA, 22 bp, Artificial Sequence
  Synthetic oligonucleotide; CTT chr2 60486478 60486499 60486483 60486478 -
agattggtaggtctttagaaat

SEQ ID NO: 221914 - DNA, 22 bp, Artificial Sequence
  Synthetic oligonucleotide; TTA chr2 60486477 60486498 60486482 60486477 -
gattggtaggtctttagaaatt

SEQ ID NO: 221915 - DNA, 22 bp, Artificial Sequence
  Synthetic oligonucleotide; TTG chr2 60486472 60486493 60486477 60486472 -
gtaggtctttagaaattatctc

SEQ ID NO: 221916 - DNA, 22 bp, Artificial Sequence
  Synthetic oligonucleotide; CTT chr2 60486463 60486484 60486468 60486463 -
tagaaattatctctcaaaatgt

SEQ ID NO: 221917 - DNA, 22 bp, Artificial Sequence
  Synthetic oligonucleotide; TTT chr2 60486462 60486483 60486467 60486462 -
agaaattatctctcaaaatgtg

SEQ ID NO: 221918 - DNA, 22 bp, Artificial Sequence
  Synthetic oligonucleotide; TTA chr2 60486461 60486482 60486466 60486461 -
gaaattatctctcaaaatgtgt

SEQ ID NO: 221919 - DNA, 22 bp, Artificial Sequence
  Synthetic oligonucleotide; TTA chr2 60486454 60486475 60486459 60486454 -
tctctcaaaatgtgtgtgtgtg

SEQ ID NO: 221920 - DNA, 22 bp, Artificial Sequence
  Synthetic oligonucleotide; CTC chr2 60486450 60486471 60486455 60486450 -
tcaaaatgtgtgtgtgtgtgcc

SEQ ID NO: 221921 - DNA, 22 bp, Artificial Sequence
  Synthetic oligonucleotide; CTC chr2 60486448 60486469 60486453 60486448 -
aaaatgtgtgtgtgtgtgccta

SEQ ID NO: 221922 - DNA, 22 bp, Artificial Sequence
  Synthetic oligonucleotide; CTA chr2 60486426 60486447 60486431 60486426 -
agtatagttttcttgaatttct

SEQ ID NO: 221923 - DNA, 22 bp, Artificial Sequence
  Synthetic oligonucleotide; TTT chr2 60486416 60486437 60486421 60486416 -
tcttgaatttctcacttcagta

SEQ ID NO: 221924 - DNA, 22 bp, Artificial Sequence
  Synthetic oligonucleotide; TTT chr2 60486415 60486436 60486420 60486415 -
cttgaatttctcacttcagtac

SEQ ID NO: 221925 - DNA, 22 bp, Artificial Sequence
  Synthetic oligonucleotide; TTC chr2 60486414 60486435 60486419 60486414 -
ttgaatttctcacttcagtact

SEQ ID NO: 221926 - DNA, 22 bp, Artificial Sequence
  Synthetic oligonucleotide; CTT chr2 60486412 60486433 60486417 60486412 -
gaatttctcacttcagtactta

SEQ ID NO: 221927 - DNA, 22 bp, Artificial Sequence
  Synthetic oligonucleotide; TTG chr2 60486411 60486432 60486416 60486411 -
aatttctcacttcagtacttaa

SEQ ID NO: 221928 - DNA, 22 bp, Artificial Sequence
  Synthetic oligonucleotide; TTT chr2 60486406 60486427 60486411 60486406 -
ctcacttcagtacttaactaca

SEQ ID NO: 221929 - DNA, 22 bp, Artificial Sequence
  Synthetic oligonucleotide; TTC chr2 60486405 60486426 60486410 60486405 -
tcacttcagtacttaactacac

SEQ ID NO: 221930 - DNA, 22 bp, Artificial Sequence
  Synthetic oligonucleotide; CTC chr2 60486403 60486424 60486408 60486403 -
acttcagtacttaactacacat

SEQ ID NO: 221931 - DNA, 22 bp, Artificial Sequence
  Synthetic oligonucleotide; CTT chr2 60486399 60486420 60486404 60486399 -
cagtacttaactacacatatgt

SEQ ID NO: 221932 - DNA, 22 bp, Artificial Sequence
  Synthetic oligonucleotide; TTC chr2 60486398 60486419 60486403 60486398 -
agtacttaactacacatatgtg

SEQ ID NO: 221933 - DNA, 22 bp, Artificial Sequence
  Synthetic oligonucleotide; CTT chr2 60486391 60486412 60486396 60486391 -
aactacacatatgtgcagaaag

SEQ ID NO: 221934 - DNA, 22 bp, Artificial Sequence
  Synthetic oligonucleotide; TTA chr2 60486390 60486411 60486395 60486390 -
actacacatatgtgcagaaagt

SEQ ID NO: 221935 - DNA, 22 bp, Artificial Sequence
  Synthetic oligonucleotide; CTA chr2 60486386 60486407 60486391 60486386 -
cacatatgtgcagaaagtgaac

SEQ ID NO: 221936 - DNA, 22 bp, Artificial Sequence
  Synthetic oligonucleotide; CTC chr2 60486362 60486383 60486367 60486362 -
ttagaatttggctatccgttct

SEQ ID NO: 221937 - DNA, 22 bp, Artificial Sequence
  Synthetic oligonucleotide; CTT chr2 60486360 60486381 60486365 60486360 -
agaatttggctatccgttcttt

SEQ ID NO: 221938 - DNA, 22 bp, Artificial Sequence
  Synthetic oligonucleotide; TTA chr2 60486359 60486380 60486364 60486359 -
gaatttggctatccgttctttc

SEQ ID NO: 221939 - DNA, 22 bp, Artificial Sequence
  Synthetic oligonucleotide; TTT chr2 60486353 60486374 60486358 60486353 -
ggctatccgttctttctcattg

SEQ ID NO: 221940 - DNA, 22 bp, Artificial Sequence
  Synthetic oligonucleotide; TTG chr2 60486352 60486373 60486357 60486352 -
gctatccgttctttctcattgt

SEQ ID NO: 221941 - DNA, 22 bp, Artificial Sequence
  Synthetic oligonucleotide; CTA chr2 60486348 60486369 60486353 60486348 -
tccgttctttctcattgtgtga

SEQ ID NO: 221942 - DNA, 22 bp, Artificial Sequence
  Synthetic oligonucleotide; TTC chr2 60486341 60486362 60486346 60486341 -
tttctcattgtgtgagaaggag

SEQ ID NO: 221943 - DNA, 22 bp, Artificial Sequence
  Synthetic oligonucleotide; CTT chr2 60486339 60486360 60486344 60486339 -
tctcattgtgtgagaaggaggc

SEQ ID NO: 221944 - DNA, 22 bp, Artificial Sequence
  Synthetic oligonucleotide; TTT chr2 60486338 60486359 60486343 60486338 -
ctcattgtgtgagaaggaggca

SEQ ID NO: 221945 - DNA, 22 bp, Artificial Sequence
  Synthetic oligonucleotide; TTC chr2 60486337 60486358 60486342 60486337 -
tcattgtgtgagaaggaggcaa

SEQ ID NO: 221946 - DNA, 22 bp, Artificial Sequence
  Synthetic oligonucleotide; CTC chr2 60486335 60486356 60486340 60486335 -
attgtgtgagaaggaggcaaag

SEQ ID NO: 221947 - DNA, 22 bp, Artificial Sequence
  Synthetic oligonucleotide; TTG chr2 60486331 60486352 60486336 60486331 -
tgtgagaaggaggcaaagttgc

SEQ ID NO: 221948 - DNA, 22 bp, Artificial Sequence
  Synthetic oligonucleotide; TTG chr2 60486310 60486331 60486315 60486310 -
ccaaattggaggtggggcaagg

SEQ ID NO: 221949 - DNA, 22 bp, Artificial Sequence
  Synthetic oligonucleotide; TTG chr2 60486302 60486323 60486307 60486302 -
gaggtggggcaaggtgggccag

SEQ ID NO: 221950 - DNA, 22 bp, Artificial Sequence
  Synthetic oligonucleotide; CTG chr2 60486272 60486293 60486277 60486272 -
tgattggtgtctcactttgatg

SEQ ID NO: 221951 - DNA, 22 bp, Artificial Sequence
  Synthetic oligonucleotide; TTG chr2 60486266 60486287 60486271 60486266 -
gtgtctcactttgatgtgtagg

SEQ ID NO: 221952 - DNA, 22 bp, Artificial Sequence
  Synthetic oligonucleotide; CTC chr2 60486259 60486280 60486264 60486259 -
actttgatgtgtaggagagaga

SEQ ID NO: 221953 - DNA, 22 bp, Artificial Sequence
  Synthetic oligonucleotide; CTT chr2 60486255 60486276 60486260 60486255 -
tgatgtgtaggagagagaacaa

SEQ ID NO: 221954 - DNA, 22 bp, Artificial Sequence
  Synthetic oligonucleotide; TTT chr2 60486254 60486275 60486259 60486254 -
gatgtgtaggagagagaacaaa

SEQ ID NO: 221955 - DNA, 22 bp, Artificial Sequence
  Synthetic oligonucleotide; TTG chr2 60486253 60486274 60486258 60486253 -
atgtgtaggagagagaacaaat

SEQ ID NO: 221956 - DNA, 22 bp, Artificial Sequence
  Synthetic oligonucleotide; TTC chr2 60486219 60486240 60486224 60486219 -
tctggaaaggagccatggtcca

SEQ ID NO: 221957 - DNA, 22 bp, Artificial Sequence
  Synthetic oligonucleotide; CTC chr2 60486217 60486238 60486222 60486217 -
tggaaaggagccatggtccacc

SEQ ID NO: 221958 - DNA, 22 bp, Artificial Sequence
  Synthetic oligonucleotide; CTG chr2 60486215 60486236 60486220 60486215 -
gaaaggagccatggtccaccca

SEQ ID NO: 221959 - DNA, 22 bp, Artificial Sequence
  Synthetic oligonucleotide; CTG chr2 60486177 60486198 60486182 60486177 -
aaatccccagtaccagtctccc

SEQ ID NO: 221960 - DNA, 22 bp, Artificial Sequence
  Synthetic oligonucleotide; CTC chr2 60486157 60486178 60486162 60486157 -
cctaggatgtcttgcctttcag

SEQ ID NO: 221961 - DNA, 22 bp, Artificial Sequence
  Synthetic oligonucleotide; CTA chr2 60486153 60486174 60486158 60486153 -
ggatgtcttgcctttcagcagc

SEQ ID NO: 221962 - DNA, 22 bp, Artificial Sequence
  Synthetic oligonucleotide; CTT chr2 60486144 60486165 60486149 60486144 -
gcctttcagcagctgttcagtc

SEQ ID NO: 221963 - DNA, 22 bp, Artificial Sequence
  Synthetic oligonucleotide; TTG chr2 60486143 60486164 60486148 60486143 -
cctttcagcagctgttcagtca

SEQ ID NO: 221964 - DNA, 22 bp, Artificial Sequence
  Synthetic oligonucleotide; CTT chr2 60486139 60486160 60486144 60486139 -
tcagcagctgttcagtcaaatc

SEQ ID NO: 221965 - DNA, 22 bp, Artificial Sequence
  Synthetic oligonucleotide; TTT chr2 60486138 60486159 60486143 60486138 -
cagcagctgttcagtcaaatcc

SEQ ID NO: 221966 - DNA, 22 bp, Artificial Sequence
  Synthetic oligonucleotide; TTC chr2 60486137 60486158 60486142 60486137 -
agcagctgttcagtcaaatcca

SEQ ID NO: 221967 - DNA, 22 bp, Artificial Sequence
  Synthetic oligonucleotide; CTG chr2 60486129 60486150 60486134 60486129 -
ttcagtcaaatccatttcagaa

SEQ ID NO: 221968 - DNA, 22 bp, Artificial Sequence
  Synthetic oligonucleotide; TTC chr2 60486126 60486147 60486131 60486126 -
agtcaaatccatttcagaatgg

SEQ ID NO: 221969 - DNA, 22 bp, Artificial Sequence
  Synthetic oligonucleotide; TTT chr2 60486112 60486133 60486117 60486112 -
cagaatggagaacagcttgtca

SEQ ID NO: 221970 - DNA, 22 bp, Artificial Sequence
  Synthetic oligonucleotide; TTC chr2 60486111 60486132 60486116 60486111 -
agaatggagaacagcttgtcac

SEQ ID NO: 221971 - DNA, 22 bp, Artificial Sequence
  Synthetic oligonucleotide; CTT chr2 60486094 60486115 60486099 60486094 -
gtcacagttctctactcttgac

SEQ ID NO: 221972 - DNA, 22 bp, Artificial Sequence
  Synthetic oligonucleotide; TTG chr2 60486093 60486114 60486098 60486093 -
tcacagttctctactcttgacc

SEQ ID NO: 221973 - DNA, 22 bp, Artificial Sequence
  Synthetic oligonucleotide; TTC chr2 60486084 60486105 60486089 60486084 -
tctactcttgacctgctgatag

SEQ ID NO: 221974 - DNA, 22 bp, Artificial Sequence
  Synthetic oligonucleotide; CTC chr2 60486082 60486103 60486087 60486082 -
tactcttgacctgctgatagaa

SEQ ID NO: 221975 - DNA, 22 bp, Artificial Sequence
  Synthetic oligonucleotide; CTA chr2 60486080 60486101 60486085 60486080 -
ctcttgacctgctgatagaaca

SEQ ID NO: 221976 - DNA, 22 bp, Artificial Sequence
  Synthetic oligonucleotide; CTC chr2 60486077 60486098 60486082 60486077 -
ttgacctgctgatagaacaagg

SEQ ID NO: 221977 - DNA, 22 bp, Artificial Sequence
  Synthetic oligonucleotide; CTT chr2 60486075 60486096 60486080 60486075 -
gacctgctgatagaacaagggg

SEQ ID NO: 221978 - DNA, 22 bp, Artificial Sequence
  Synthetic oligonucleotide; TTG chr2 60486074 60486095 60486079 60486074 -
acctgctgatagaacaaggggc

SEQ ID NO: 221979 - DNA, 22 bp, Artificial Sequence
  Synthetic oligonucleotide; CTG chr2 60486069 60486090 60486074 60486069 -
ctgatagaacaaggggcttgga

SEQ ID NO: 221980 - DNA, 22 bp, Artificial Sequence
  Synthetic oligonucleotide; CTG chr2 60486066 60486087 60486071 60486066 -
atagaacaaggggcttggagat

SEQ ID NO: 221981 - DNA, 22 bp, Artificial Sequence
  Synthetic oligonucleotide; CTT chr2 60486050 60486071 60486055 60486050 -
ggagattttgggtagatatgga

SEQ ID NO: 221982 - DNA, 22 bp, Artificial Sequence
  Synthetic oligonucleotide; TTG chr2 60486049 60486070 60486054 60486049 -
gagattttgggtagatatggaa

SEQ ID NO: 221983 - DNA, 22 bp, Artificial Sequence
  Synthetic oligonucleotide; TTT chr2 60486042 60486063 60486047 60486042 -
tgggtagatatggaaatagatc

SEQ ID NO: 221984 - DNA, 22 bp, Artificial Sequence
  Synthetic oligonucleotide; TTT chr2 60486041 60486062 60486046 60486041 -
gggtagatatggaaatagatcc

SEQ ID NO: 221985 - DNA, 22 bp, Artificial Sequence
  Synthetic oligonucleotide; TTG chr2 60486040 60486061 60486045 60486040 -
ggtagatatggaaatagatccc

SEQ ID NO: 221986 - DNA, 22 bp, Artificial Sequence
  Synthetic oligonucleotide; CTA chr2 60486016 60486037 60486021 60486016 -
aacatactaaaaagattttttt

SEQ ID NO: 221987 - DNA, 22 bp, Artificial Sequence
  Synthetic oligonucleotide; CTA chr2 60486007 60486028 60486012 60486007 -
aaaagattttttttgtacgtgt

SEQ ID NO: 221988 - DNA, 22 bp, Artificial Sequence
  Synthetic oligonucleotide; TTT chr2 60485998 60486019 60486003 60485998 -
tttttgtacgtgtggtggggga

SEQ ID NO: 221989 - DNA, 22 bp, Artificial Sequence
  Synthetic oligonucleotide; TTT chr2 60485997 60486018 60486002 60485997 -
ttttgtacgtgtggtgggggag

SEQ ID NO: 221990 - DNA, 22 bp, Artificial Sequence
  Synthetic oligonucleotide; TTT chr2 60485996 60486017 60486001 60485996 -
tttgtacgtgtggtgggggaga

SEQ ID NO: 221991 - DNA, 22 bp, Artificial Sequence
  Synthetic oligonucleotide; TTT chr2 60485995 60486016 60486000 60485995 -
ttgtacgtgtggtgggggagag

SEQ ID NO: 221992 - DNA, 22 bp, Artificial Sequence
  Synthetic oligonucleotide; TTT chr2 60485994 60486015 60485999 60485994 -
tgtacgtgtggtgggggagagg

SEQ ID NO: 221993 - DNA, 22 bp, Artificial Sequence
  Synthetic oligonucleotide; TTT chr2 60485993 60486014 60485998 60485993 -
gtacgtgtggtgggggagagga

SEQ ID NO: 221994 - DNA, 22 bp, Artificial Sequence
  Synthetic oligonucleotide; TTG chr2 60485992 60486013 60485997 60485992 -
tacgtgtggtgggggagaggag

SEQ ID NO: 221995 - DNA, 22 bp, Artificial Sequence
  Synthetic oligonucleotide; TTG chr2 60485952 60485973 60485957 60485952 -
gagaaagaaagttggggaagga

SEQ ID NO: 221996 - DNA, 22 bp, Artificial Sequence
  Synthetic oligonucleotide; TTG chr2 60485938 60485959 60485943 60485938 -
gggaaggaaactaaaatgtgca

SEQ ID NO: 221997 - DNA, 22 bp, Artificial Sequence
  Synthetic oligonucleotide; CTA chr2 60485925 60485946 60485930 60485925 -
aaatgtgcaatctcattcctca

SEQ ID NO: 221998 - DNA, 22 bp, Artificial Sequence
  Synthetic oligonucleotide; CTC chr2 60485911 60485932 60485916 60485911 -
attcctcagccttcttgttgaa

SEQ ID NO: 221999 - DNA, 22 bp, Artificial Sequence
  Synthetic oligonucleotide; TTC chr2 60485907 60485928 60485912 60485907 -
ctcagccttcttgttgaaaatg

SEQ ID NO: 222000 - DNA, 22 bp, Artificial Sequence
  Synthetic oligonucleotide; CTC chr2 60485904 60485925 60485909 60485904 -
agccttcttgttgaaaatgaga

SEQ ID NO: 222001 - DNA, 22 bp, Artificial Sequence
  Synthetic oligonucleotide; CTT chr2 60485898 60485919 60485903 60485898 -
cttgttgaaaatgagaatcaga

SEQ ID NO: 222002 - DNA, 22 bp, Artificial Sequence
  Synthetic oligonucleotide; TTC chr2 60485897 60485918 60485902 60485897 -
ttgttgaaaatgagaatcagat

SEQ ID NO: 222003 - DNA, 22 bp, Artificial Sequence
  Synthetic oligonucleotide; CTT chr2 60485895 60485916 60485900 60485895 -
gttgaaaatgagaatcagatgc

SEQ ID NO: 222004 - DNA, 22 bp, Artificial Sequence
  Synthetic oligonucleotide; TTG chr2 60485894 60485915 60485899 60485894 -
ttgaaaatgagaatcagatgca

SEQ ID NO: 222005 - DNA, 22 bp, Artificial Sequence
  Synthetic oligonucleotide; TTG chr2 60485891 60485912 60485896 60485891 -
aaaatgagaatcagatgcagca

SEQ ID NO: 222006 - DNA, 22 bp, Artificial Sequence
  Synthetic oligonucleotide; TTA chr2 60485861 60485882 60485866 60485861 -
tttccaagagctatctggtgat

SEQ ID NO: 222007 - DNA, 22 bp, Artificial Sequence
  Synthetic oligonucleotide; TTT chr2 60485858 60485879 60485863 60485858 -
ccaagagctatctggtgatggg

SEQ ID NO: 222008 - DNA, 22 bp, Artificial Sequence
  Synthetic oligonucleotide; TTC chr2 60485857 60485878 60485862 60485857 -
caagagctatctggtgatggga

SEQ ID NO: 222009 - DNA, 22 bp, Artificial Sequence
  Synthetic oligonucleotide; CTA chr2 60485848 60485869 60485853 60485848 -
tctggtgatgggatccatctgg

SEQ ID NO: 222010 - DNA, 22 bp, Artificial Sequence
  Synthetic oligonucleotide; CTG chr2 60485844 60485865 60485849 60485844 -
gtgatgggatccatctggtgaa

SEQ ID NO: 222011 - DNA, 22 bp, Artificial Sequence
  Synthetic oligonucleotide; CTG chr2 60485827 60485848 60485832 60485827 -
gtgaagggctacttctggggga

SEQ ID NO: 222012 - DNA, 22 bp, Artificial Sequence
  Synthetic oligonucleotide; CTA chr2 60485816 60485837 60485821 60485816 -
cttctgggggacctggaattgc

SEQ ID NO: 222013 - DNA, 22 bp, Artificial Sequence
  Synthetic oligonucleotide; CTT chr2 60485813 60485834 60485818 60485813 -
ctgggggacctggaattgctgt

SEQ ID NO: 222014 - DNA, 22 bp, Artificial Sequence
  Synthetic oligonucleotide; TTC chr2 60485812 60485833 60485817 60485812 -
tgggggacctggaattgctgtg

SEQ ID NO: 222015 - DNA, 22 bp, Artificial Sequence
  Synthetic oligonucleotide; CTG chr2 60485810 60485831 60485815 60485810 -
ggggacctggaattgctgtgtg

SEQ ID NO: 222016 - DNA, 22 bp, Artificial Sequence
  Synthetic oligonucleotide; CTG chr2 60485801 60485822 60485806 60485801 -
gaattgctgtgtgacctttggg

SEQ ID NO: 222017 - DNA, 22 bp, Artificial Sequence
  Synthetic oligonucleotide; TTG chr2 60485795 60485816 60485800 60485795 -
ctgtgtgacctttgggaaacac

SEQ ID NO: 222018 - DNA, 22 bp, Artificial Sequence
  Synthetic oligonucleotide; CTG chr2 60485792 60485813 60485797 60485792 -
tgtgacctttgggaaacacttg

SEQ ID NO: 222019 - DNA, 22 bp, Artificial Sequence
  Synthetic oligonucleotide; CTT chr2 60485783 60485804 60485788 60485783 -
tgggaaacacttgccttctctg

SEQ ID NO: 222020 - DNA, 22 bp, Artificial Sequence
  Synthetic oligonucleotide; TTT chr2 60485782 60485803 60485787 60485782 -
gggaaacacttgccttctctgg

SEQ ID NO: 222021 - DNA, 22 bp, Artificial Sequence
  Synthetic oligonucleotide; TTG chr2 60485781 60485802 60485786 60485781 -
ggaaacacttgccttctctggg

SEQ ID NO: 222022 - DNA, 22 bp, Artificial Sequence
  Synthetic oligonucleotide; CTT chr2 60485771 60485792 60485776 60485771 -
gccttctctgggttgagctcag

SEQ ID NO: 222023 - DNA, 22 bp, Artificial Sequence
  Synthetic oligonucleotide; TTG chr2 60485770 60485791 60485775 60485770 -
ccttctctgggttgagctcagc

SEQ ID NO: 222024 - DNA, 22 bp, Artificial Sequence
  Synthetic oligonucleotide; CTT chr2 60485766 60485787 60485771 60485766 -
ctctgggttgagctcagcccgt

SEQ ID NO: 222025 - DNA, 22 bp, Artificial Sequence
  Synthetic oligonucleotide; TTC chr2 60485765 60485786 60485770 60485765 -
tctgggttgagctcagcccgta

SEQ ID NO: 222026 - DNA, 22 bp, Artificial Sequence
  Synthetic oligonucleotide; CTC chr2 60485763 60485784 60485768 60485763 -
tgggttgagctcagcccgtagt

SEQ ID NO: 222027 - DNA, 22 bp, Artificial Sequence
  Synthetic oligonucleotide; CTG chr2 60485761 60485782 60485766 60485761 -
ggttgagctcagcccgtagttc

SEQ ID NO: 222028 - DNA, 22 bp, Artificial Sequence
  Synthetic oligonucleotide; TTG chr2 60485756 60485777 60485761 60485756 -
agctcagcccgtagttcacaag

SEQ ID NO: 222029 - DNA, 22 bp, Artificial Sequence
  Synthetic oligonucleotide; CTC chr2 60485751 60485772 60485756 60485751 -
agcccgtagttcacaaggggca

SEQ ID NO: 222030 - DNA, 22 bp, Artificial Sequence
  Synthetic oligonucleotide; TTC chr2 60485739 60485760 60485744 60485739 -
acaaggggcattgctggtattt

SEQ ID NO: 222031 - DNA, 22 bp, Artificial Sequence
  Synthetic oligonucleotide; TTG chr2 60485726 60485747 60485731 60485726 -
ctggtatttatagactgtgttt

SEQ ID NO: 222032 - DNA, 22 bp, Artificial Sequence
  Synthetic oligonucleotide; CTG chr2 60485723 60485744 60485728 60485723 -
gtatttatagactgtgtttgac

SEQ ID NO: 222033 - DNA, 22 bp, Artificial Sequence
  Synthetic oligonucleotide; TTT chr2 60485717 60485738 60485722 60485717 -
atagactgtgtttgacagtccc

SEQ ID NO: 222034 - DNA, 22 bp, Artificial Sequence
  Synthetic oligonucleotide; TTA chr2 60485716 60485737 60485721 60485716 -
tagactgtgtttgacagtcccg

SEQ ID NO: 222035 - DNA, 22 bp, Artificial Sequence
  Synthetic oligonucleotide; CTG chr2 60485709 60485730 60485714 60485709 -
tgtttgacagtcccgagtgaaa

SEQ ID NO: 222036 - DNA, 22 bp, Artificial Sequence
  Synthetic oligonucleotide; TTT chr2 60485704 60485725 60485709 60485704 -
gacagtcccgagtgaaaggcaa

SEQ ID NO: 222037 - DNA, 22 bp, Artificial Sequence
  Synthetic oligonucleotide; TTG chr2 60485703 60485724 60485708 60485703 -
acagtcccgagtgaaaggcaac

SEQ ID NO: 222038 - DNA, 22 bp, Artificial Sequence
  Synthetic oligonucleotide; CTT chr2 60485679 60485700 60485684 60485679 -
cacttctcaccccagaatagca

SEQ ID NO: 222039 - DNA, 22 bp, Artificial Sequence
  Synthetic oligonucleotide; TTC chr2 60485678 60485699 60485683 60485678 -
acttctcaccccagaatagcaa

SEQ ID NO: 222040 - DNA, 22 bp, Artificial Sequence
  Synthetic oligonucleotide; CTT chr2 60485674 60485695 60485679 60485674 -
ctcaccccagaatagcaagcgt

SEQ ID NO: 222041 - DNA, 22 bp, Artificial Sequence
  Synthetic oligonucleotide; TTC chr2 60485673 60485694 60485678 60485673 -
tcaccccagaatagcaagcgtt

SEQ ID NO: 222042 - DNA, 22 bp, Artificial Sequence
  Synthetic oligonucleotide; CTC chr2 60485671 60485692 60485676 60485671 -
accccagaatagcaagcgttgt

SEQ ID NO: 222043 - DNA, 22 bp, Artificial Sequence
  Synthetic oligonucleotide; TTG chr2 60485650 60485671 60485655 60485650 -
tttctcatatctaggttgctgg

SEQ ID NO: 222044 - DNA, 22 bp, Artificial Sequence
  Synthetic oligonucleotide; TTT chr2 60485647 60485668 60485652 60485647 -
ctcatatctaggttgctgggac

SEQ ID NO: 222045 - DNA, 22 bp, Artificial Sequence
  Synthetic oligonucleotide; TTC chr2 60485646 60485667 60485651 60485646 -
tcatatctaggttgctgggaca

SEQ ID NO: 222046 - DNA, 22 bp, Artificial Sequence
  Synthetic oligonucleotide; CTC chr2 60485644 60485665 60485649 60485644 -
atatctaggttgctgggacagc

SEQ ID NO: 222047 - DNA, 22 bp, Artificial Sequence
  Synthetic oligonucleotide; CTA chr2 60485637 60485658 60485642 60485637 -
ggttgctgggacagcttcccag

SEQ ID NO: 222048 - DNA, 22 bp, Artificial Sequence
  Synthetic oligonucleotide; TTG chr2 60485632 60485653 60485637 60485632 -
ctgggacagcttcccaggaacc

SEQ ID NO: 222049 - DNA, 22 bp, Artificial Sequence
  Synthetic oligonucleotide; CTG chr2 60485629 60485650 60485634 60485629 -
ggacagcttcccaggaacctaa

SEQ ID NO: 222050 - DNA, 22 bp, Artificial Sequence
  Synthetic oligonucleotide; CTT chr2 60485620 60485641 60485625 60485620 -
cccaggaacctaatattcagca

SEQ ID NO: 222051 - DNA, 22 bp, Artificial Sequence
  Synthetic oligonucleotide; TTC chr2 60485619 60485640 60485624 60485619 -
ccaggaacctaatattcagcag

SEQ ID NO: 222052 - DNA, 22 bp, Artificial Sequence
  Synthetic oligonucleotide; CTA chr2 60485608 60485629 60485613 60485608 -
atattcagcagcttcgtgacgt

SEQ ID NO: 222053 - DNA, 22 bp, Artificial Sequence
  Synthetic oligonucleotide; TTC chr2 60485602 60485623 60485607 60485602 -
agcagcttcgtgacgttggatg

SEQ ID NO: 222054 - DNA, 22 bp, Artificial Sequence
  Synthetic oligonucleotide; CTT chr2 60485594 60485615 60485599 60485594 -
cgtgacgttggatggagggttt

SEQ ID NO: 222055 - DNA, 22 bp, Artificial Sequence
  Synthetic oligonucleotide; TTC chr2 60485593 60485614 60485598 60485593 -
gtgacgttggatggagggtttt

SEQ ID NO: 222056 - DNA, 22 bp, Artificial Sequence
  Synthetic oligonucleotide; TTG chr2 60485584 60485605 60485589 60485584 -
gatggagggtttttctttttaa

SEQ ID NO: 222057 - DNA, 22 bp, Artificial Sequence
  Synthetic oligonucleotide; TTT chr2 60485572 60485593 60485577 60485572 -
ttctttttaaatgagttgattg

SEQ ID NO: 222058 - DNA, 22 bp, Artificial Sequence
  Synthetic oligonucleotide; TTT chr2 60485571 60485592 60485576 60485571 -
tctttttaaatgagttgattgg

SEQ ID NO: 222059 - DNA, 22 bp, Artificial Sequence
  Synthetic oligonucleotide; TTT chr2 60485570 60485591 60485575 60485570 -
ctttttaaatgagttgattggc

SEQ ID NO: 222060 - DNA, 22 bp, Artificial Sequence
  Synthetic oligonucleotide; TTC chr2 60485569 60485590 60485574 60485569 -
tttttaaatgagttgattggct

SEQ ID NO: 222061 - DNA, 22 bp, Artificial Sequence
  Synthetic oligonucleotide; CTT chr2 60485567 60485588 60485572 60485567 -
tttaaatgagttgattggcttt

SEQ ID NO: 222062 - DNA, 22 bp, Artificial Sequence
  Synthetic oligonucleotide; TTT chr2 60485566 60485587 60485571 60485566 -
ttaaatgagttgattggctttt

SEQ ID NO: 222063 - DNA, 22 bp, Artificial Sequence
  Synthetic oligonucleotide; TTT chr2 60485565 60485586 60485570 60485565 -
taaatgagttgattggcttttg

SEQ ID NO: 222064 - DNA, 22 bp, Artificial Sequence
  Synthetic oligonucleotide; TTT chr2 60485564 60485585 60485569 60485564 -
aaatgagttgattggcttttgc

SEQ ID NO: 222065 - DNA, 22 bp, Artificial Sequence
  Synthetic oligonucleotide; TTA chr2 60485563 60485584 60485568 60485563 -
aatgagttgattggcttttgcc

SEQ ID NO: 222066 - DNA, 22 bp, Artificial Sequence
  Synthetic oligonucleotide; TTG chr2 60485554 60485575 60485559 60485554 -
attggcttttgccactttacac

SEQ ID NO: 222067 - DNA, 22 bp, Artificial Sequence
  Synthetic oligonucleotide; TTG chr2 60485550 60485571 60485555 60485550 -
gcttttgccactttacacattg

SEQ ID NO: 222068 - DNA, 22 bp, Artificial Sequence
  Synthetic oligonucleotide; CTT chr2 60485546 60485567 60485551 60485546 -
ttgccactttacacattgtttt

SEQ ID NO: 222069 - DNA, 22 bp, Artificial Sequence
  Synthetic oligonucleotide; TTT chr2 60485545 60485566 60485550 60485545 -
tgccactttacacattgttttc

SEQ ID NO: 222070 - DNA, 22 bp, Artificial Sequence
  Synthetic oligonucleotide; TTT chr2 60485544 60485565 60485549 60485544 -
gccactttacacattgttttcc

SEQ ID NO: 222071 - DNA, 22 bp, Artificial Sequence
  Synthetic oligonucleotide; TTG chr2 60485543 60485564 60485548 60485543 -
ccactttacacattgttttcca

SEQ ID NO: 222072 - DNA, 22 bp, Artificial Sequence
  Synthetic oligonucleotide; CTT chr2 60485537 60485558 60485542 60485537 -
tacacattgttttccaggtcta

SEQ ID NO: 222073 - DNA, 22 bp, Artificial Sequence
  Synthetic oligonucleotide; TTT chr2 60485536 60485557 60485541 60485536 -
acacattgttttccaggtctag

SEQ ID NO: 222074 - DNA, 22 bp, Artificial Sequence
  Synthetic oligonucleotide; TTA chr2 60485535 60485556 60485540 60485535 -
cacattgttttccaggtctagg

SEQ ID NO: 222075 - DNA, 22 bp, Artificial Sequence
  Synthetic oligonucleotide; TTG chr2 60485528 60485549 60485533 60485528 -
ttttccaggtctaggtttattt

SEQ ID NO: 222076 - DNA, 22 bp, Artificial Sequence
  Synthetic oligonucleotide; TTT chr2 60485525 60485546 60485530 60485525 -
tccaggtctaggtttatttttc

SEQ ID NO: 222077 - DNA, 22 bp, Artificial Sequence
  Synthetic oligonucleotide; TTT chr2 60485524 60485545 60485529 60485524 -
ccaggtctaggtttatttttcc

SEQ ID NO: 222078 - DNA, 22 bp, Artificial Sequence
  Synthetic oligonucleotide; TTC chr2 60485523 60485544 60485528 60485523 -
caggtctaggtttatttttccc

SEQ ID NO: 222079 - DNA, 22 bp, Artificial Sequence
  Synthetic oligonucleotide; CTA chr2 60485515 60485536 60485520 60485515 -
ggtttatttttcccttataggt

SEQ ID NO: 222080 - DNA, 22 bp, Artificial Sequence
  Synthetic oligonucleotide; TTT chr2 60485510 60485531 60485515 60485510 -
atttttcccttataggtagaat

SEQ ID NO: 222081 - DNA, 22 bp, Artificial Sequence
  Synthetic oligonucleotide; TTA chr2 60485509 60485530 60485514 60485509 -
tttttcccttataggtagaata

SEQ ID NO: 222082 - DNA, 22 bp, Artificial Sequence
  Synthetic oligonucleotide; TTT chr2 60485506 60485527 60485511 60485506 -
ttcccttataggtagaatataa

SEQ ID NO: 222083 - DNA, 22 bp, Artificial Sequence
  Synthetic oligonucleotide; TTT chr2 60485505 60485526 60485510 60485505 -
tcccttataggtagaatataaa

SEQ ID NO: 222084 - DNA, 22 bp, Artificial Sequence
  Synthetic oligonucleotide; TTT chr2 60485504 60485525 60485509 60485504 -
cccttataggtagaatataaaa

SEQ ID NO: 222085 - DNA, 22 bp, Artificial Sequence
  Synthetic oligonucleotide; TTC chr2 60485503 60485524 60485508 60485503 -
ccttataggtagaatataaaag

SEQ ID NO: 222086 - DNA, 22 bp, Artificial Sequence
  Synthetic oligonucleotide; CTT chr2 60485499 60485520 60485504 60485499 -
ataggtagaatataaaagagta

SEQ ID NO: 222087 - DNA, 22 bp, Artificial Sequence
  Synthetic oligonucleotide; TTA chr2 60485498 60485519 60485503 60485498 -
taggtagaatataaaagagtat

SEQ ID NO: 222088 - DNA, 22 bp, Artificial Sequence
  Synthetic oligonucleotide; CTG chr2 60485468 60485489 60485473 60485468 -
ccctggctcacaccgttctgtt

SEQ ID NO: 222089 - DNA, 22 bp, Artificial Sequence
  Synthetic oligonucleotide; CTG chr2 60485463 60485484 60485468 60485463 -
gctcacaccgttctgtttttgc

SEQ ID NO: 222090 - DNA, 22 bp, Artificial Sequence
  Synthetic oligonucleotide; CTC chr2 60485459 60485480 60485464 60485459 -
acaccgttctgtttttgcagtt

SEQ ID NO: 222091 - DNA, 22 bp, Artificial Sequence
  Synthetic oligonucleotide; TTC chr2 60485450 60485471 60485455 60485450 -
tgtttttgcagttagcttaaag

SEQ ID NO: 222092 - DNA, 22 bp, Artificial Sequence
  Synthetic oligonucleotide; CTG chr2 60485448 60485469 60485453 60485448 -
tttttgcagttagcttaaaggc

SEQ ID NO: 222093 - DNA, 22 bp, Artificial Sequence
  Synthetic oligonucleotide; TTT chr2 60485445 60485466 60485450 60485445 -
ttgcagttagcttaaaggcatg

SEQ ID NO: 222094 - DNA, 22 bp, Artificial Sequence
  Synthetic oligonucleotide; TTT chr2 60485444 60485465 60485449 60485444 -
tgcagttagcttaaaggcatgg

SEQ ID NO: 222095 - DNA, 22 bp, Artificial Sequence
  Synthetic oligonucleotide; TTT chr2 60485443 60485464 60485448 60485443 -
gcagttagcttaaaggcatgga

SEQ ID NO: 222096 - DNA, 22 bp, Artificial Sequence
  Synthetic oligonucleotide; TTG chr2 60485442 60485463 60485447 60485442 -
cagttagcttaaaggcatggag

SEQ ID NO: 222097 - DNA, 22 bp, Artificial Sequence
  Synthetic oligonucleotide; TTA chr2 60485436 60485457 60485441 60485436 -
gcttaaaggcatggaggacatt

SEQ ID NO: 222098 - DNA, 22 bp, Artificial Sequence
  Synthetic oligonucleotide; CTT chr2 60485432 60485453 60485437 60485432 -
aaaggcatggaggacattcctg

SEQ ID NO: 222099 - DNA, 22 bp, Artificial Sequence
  Synthetic oligonucleotide; TTA chr2 60485431 60485452 60485436 60485431 -
aaggcatggaggacattcctgg

SEQ ID NO: 222100 - DNA, 22 bp, Artificial Sequence
  Synthetic oligonucleotide; TTC chr2 60485413 60485434 60485418 60485413 -
ctgggactagcatctgctagcc

SEQ ID NO: 222101 - DNA, 22 bp, Artificial Sequence
  Synthetic oligonucleotide; CTG chr2 60485410 60485431 60485415 60485410 -
ggactagcatctgctagccaag

SEQ ID NO: 222102 - DNA, 22 bp, Artificial Sequence
  Synthetic oligonucleotide; CTA chr2 60485404 60485425 60485409 60485404 -
gcatctgctagccaagaacgaa

SEQ ID NO: 222103 - DNA, 22 bp, Artificial Sequence
  Synthetic oligonucleotide; CTG chr2 60485397 60485418 60485402 60485397 -
ctagccaagaacgaagatgaca

SEQ ID NO: 222104 - DNA, 22 bp, Artificial Sequence
  Synthetic oligonucleotide; CTA chr2 60485394 60485415 60485399 60485394 -
gccaagaacgaagatgacagca

SEQ ID NO: 222105 - DNA, 22 bp, Artificial Sequence
  Synthetic oligonucleotide; CTG chr2 60485346 60485367 60485351 60485346 -
ctggggctaataacccactgca

SEQ ID NO: 222106 - DNA, 22 bp, Artificial Sequence
  Synthetic oligonucleotide; CTG chr2 60485343 60485364 60485348 60485343 -
gggctaataacccactgcaggc

SEQ ID NO: 222107 - DNA, 22 bp, Artificial Sequence
  Synthetic oligonucleotide; CTA chr2 60485337 60485358 60485342 60485337 -
ataacccactgcaggctatcct

SEQ ID NO: 222108 - DNA, 22 bp, Artificial Sequence
  Synthetic oligonucleotide; CTG chr2 60485326 60485347 60485331 60485326 -
caggctatccttggcattcttg

SEQ ID NO: 222109 - DNA, 22 bp, Artificial Sequence
  Synthetic oligonucleotide; CTA chr2 60485319 60485340 60485324 60485319 -
tccttggcattcttgctggagt

SEQ ID NO: 222110 - DNA, 22 bp, Artificial Sequence
  Synthetic oligonucleotide; CTT chr2 60485314 60485335 60485319 60485314 -
ggcattcttgctggagtggcct

SEQ ID NO: 222111 - DNA, 22 bp, Artificial Sequence
  Synthetic oligonucleotide; TTG chr2 60485313 60485334 60485318 60485313 -
gcattcttgctggagtggcctt

SEQ ID NO: 222112 - DNA, 22 bp, Artificial Sequence
  Synthetic oligonucleotide; TTC chr2 60485307 60485328 60485312 60485307 -
ttgctggagtggccttgctcca

SEQ ID NO: 222113 - DNA, 22 bp, Artificial Sequence
  Synthetic oligonucleotide; CTT chr2 60485305 60485326 60485310 60485305 -
gctggagtggccttgctccacc

SEQ ID NO: 222114 - DNA, 22 bp, Artificial Sequence
  Synthetic oligonucleotide; TTG chr2 60485304 60485325 60485309 60485304 -
ctggagtggccttgctccaccc

SEQ ID NO: 222115 - DNA, 22 bp, Artificial Sequence
  Synthetic oligonucleotide; CTG chr2 60485301 60485322 60485306 60485301 -
gagtggccttgctccaccctac

SEQ ID NO: 222116 - DNA, 22 bp, Artificial Sequence
  Synthetic oligonucleotide; CTT chr2 60485291 60485312 60485296 60485291 -
gctccaccctacctggtcactg

SEQ ID NO: 222117 - DNA, 22 bp, Artificial Sequence
  Synthetic oligonucleotide; TTG chr2 60485290 60485311 60485295 60485290 -
ctccaccctacctggtcactgt

SEQ ID NO: 222118 - DNA, 22 bp, Artificial Sequence
  Synthetic oligonucleotide; CTC chr2 60485287 60485308 60485292 60485287 -
caccctacctggtcactgtgcc

SEQ ID NO: 222119 - DNA, 22 bp, Artificial Sequence
  Synthetic oligonucleotide; CTA chr2 60485280 60485301 60485285 60485280 -
cctggtcactgtgccgttcagt

SEQ ID NO: 222120 - DNA, 22 bp, Artificial Sequence
  Synthetic oligonucleotide; CTG chr2 60485276 60485297 60485281 60485276 -
gtcactgtgccgttcagtctgg

SEQ ID NO: 222121 - DNA, 22 bp, Artificial Sequence
  Synthetic oligonucleotide; CTG chr2 60485269 60485290 60485274 60485269 -
tgccgttcagtctgggctatgg

SEQ ID NO: 222122 - DNA, 22 bp, Artificial Sequence
  Synthetic oligonucleotide; TTC chr2 60485261 60485282 60485266 60485261 -
agtctgggctatggcctctcac

SEQ ID NO: 222123 - DNA, 22 bp, Artificial Sequence
  Synthetic oligonucleotide; CTG chr2 60485255 60485276 60485260 60485255 -
ggctatggcctctcaccccacc

SEQ ID NO: 222124 - DNA, 22 bp, Artificial Sequence
  Synthetic oligonucleotide; CTA chr2 60485250 60485271 60485255 60485250 -
tggcctctcaccccacctcatc

SEQ ID NO: 222125 - DNA, 22 bp, Artificial Sequence
  Synthetic oligonucleotide; CTC chr2 60485243 60485264 60485248 60485243 -
tcaccccacctcatcccattgc

SEQ ID NO: 222126 - DNA, 22 bp, Artificial Sequence
  Synthetic oligonucleotide; CTC chr2 60485241 60485262 60485246 60485241 -
accccacctcatcccattgcat

SEQ ID NO: 222127 - DNA, 22 bp, Artificial Sequence
  Synthetic oligonucleotide; CTC chr2 60485231 60485252 60485236 60485231 -
atcccattgcatttcataagcc

SEQ ID NO: 222128 - DNA, 22 bp, Artificial Sequence
  Synthetic oligonucleotide; TTG chr2 60485222 60485243 60485227 60485222 -
catttcataagccagtaactcc

SEQ ID NO: 222129 - DNA, 22 bp, Artificial Sequence
  Synthetic oligonucleotide; TTT chr2 60485217 60485238 60485222 60485217 -
cataagccagtaactccaaggc

SEQ ID NO: 222130 - DNA, 22 bp, Artificial Sequence
  Synthetic oligonucleotide; TTC chr2 60485216 60485237 60485221 60485216 -
ataagccagtaactccaaggcc

SEQ ID NO: 222131 - DNA, 22 bp, Artificial Sequence
  Synthetic oligonucleotide; CTC chr2 60485201 60485222 60485206 60485201 -
caaggccagacttccattacac

SEQ ID NO: 222132 - DNA, 22 bp, Artificial Sequence
  Synthetic oligonucleotide; CTT chr2 60485188 60485209 60485193 60485188 -
ccattacactctggatgactgc

SEQ ID NO: 222133 - DNA, 22 bp, Artificial Sequence
  Synthetic oligonucleotide; TTC chr2 60485187 60485208 60485192 60485187 -
cattacactctggatgactgca

SEQ ID NO: 222134 - DNA, 22 bp, Artificial Sequence
  Synthetic oligonucleotide; TTA chr2 60485182 60485203 60485187 60485182 -
cactctggatgactgcatttat

SEQ ID NO: 222135 - DNA, 22 bp, Artificial Sequence
  Synthetic oligonucleotide; CTC chr2 60485177 60485198 60485182 60485177 -
tggatgactgcatttatttgca

SEQ ID NO: 222136 - DNA, 22 bp, Artificial Sequence
  Synthetic oligonucleotide; CTG chr2 60485175 60485196 60485180 60485175 -
gatgactgcatttatttgcagt

SEQ ID NO: 222137 - DNA, 22 bp, Artificial Sequence
  Synthetic oligonucleotide; CTG chr2 60485167 60485188 60485172 60485167 -
catttatttgcagtgacttcaa

SEQ ID NO: 222138 - DNA, 22 bp, Artificial Sequence
  Synthetic oligonucleotide; TTT chr2 60485162 60485183 60485167 60485162 -
atttgcagtgacttcaaggaag

SEQ ID NO: 222139 - DNA, 22 bp, Artificial Sequence
  Synthetic oligonucleotide; TTA chr2 60485161 60485182 60485166 60485161 -
tttgcagtgacttcaaggaaga

SEQ ID NO: 222140 - DNA, 22 bp, Artificial Sequence
  Synthetic oligonucleotide; TTT chr2 60485158 60485179 60485163 60485158 -
gcagtgacttcaaggaagaagg

SEQ ID NO: 222141 - DNA, 22 bp, Artificial Sequence
  Synthetic oligonucleotide; TTG chr2 60485157 60485178 60485162 60485157 -
cagtgacttcaaggaagaaggg

SEQ ID NO: 222142 - DNA, 22 bp, Artificial Sequence
  Synthetic oligonucleotide; CTT chr2 60485148 60485169 60485153 60485148 -
caaggaagaaggggcctgttta

SEQ ID NO: 222143 - DNA, 22 bp, Artificial Sequence
  Synthetic oligonucleotide; TTC chr2 60485147 60485168 60485152 60485147 -
aaggaagaaggggcctgtttag

SEQ ID NO: 222144 - DNA, 22 bp, Artificial Sequence
  Synthetic oligonucleotide; CTG chr2 60485130 60485151 60485135 60485130 -
tttaggaaattaggcactggcc

SEQ ID NO: 222145 - DNA, 22 bp, Artificial Sequence
  Synthetic oligonucleotide; TTT chr2 60485127 60485148 60485132 60485127 -
aggaaattaggcactggcctgg

SEQ ID NO: 222146 - DNA, 22 bp, Artificial Sequence
  Synthetic oligonucleotide; TTA chr2 60485126 60485147 60485131 60485126 -
ggaaattaggcactggcctggt

SEQ ID NO: 222147 - DNA, 22 bp, Artificial Sequence
  Synthetic oligonucleotide; TTA chr2 60485118 60485139 60485123 60485118 -
ggcactggcctggtgaaaaggt

SEQ ID NO: 222148 - DNA, 22 bp, Artificial Sequence
  Synthetic oligonucleotide; CTG chr2 60485111 60485132 60485116 60485111 -
gcctggtgaaaaggtcaacttg

SEQ ID NO: 222149 - DNA, 22 bp, Artificial Sequence
  Synthetic oligonucleotide; CTG chr2 60485106 60485127 60485111 60485106 -
gtgaaaaggtcaacttgcgaaa

SEQ ID NO: 222150 - DNA, 22 bp, Artificial Sequence
  Synthetic oligonucleotide; CTT chr2 60485090 60485111 60485095 60485090 -
gcgaaattgtggctgcaaggga

SEQ ID NO: 222151 - DNA, 22 bp, Artificial Sequence
  Synthetic oligonucleotide; TTG chr2 60485089 60485110 60485094 60485089 -
cgaaattgtggctgcaagggat

SEQ ID NO: 222152 - DNA, 22 bp, Artificial Sequence
  Synthetic oligonucleotide; TTG chr2 60485081 60485102 60485086 60485081 -
tggctgcaagggatgccttttt

SEQ ID NO: 222153 - DNA, 22 bp, Artificial Sequence
  Synthetic oligonucleotide; CTG chr2 60485075 60485096 60485080 60485075 -
caagggatgcctttttcttcca

SEQ ID NO: 222154 - DNA, 22 bp, Artificial Sequence
  Synthetic oligonucleotide; CTT chr2 60485062 60485083 60485067 60485062 -
tttcttccaaggctatgccttg

SEQ ID NO: 222155 - DNA, 22 bp, Artificial Sequence
  Synthetic oligonucleotide; TTT chr2 60485061 60485082 60485066 60485061 -
ttcttccaaggctatgccttgg

SEQ ID NO: 222156 - DNA, 22 bp, Artificial Sequence
  Synthetic oligonucleotide; TTT chr2 60485060 60485081 60485065 60485060 -
tcttccaaggctatgccttggt

SEQ ID NO: 222157 - DNA, 22 bp, Artificial Sequence
  Synthetic oligonucleotide; TTT chr2 60485059 60485080 60485064 60485059 -
cttccaaggctatgccttggtg

SEQ ID NO: 222158 - DNA, 22 bp, Artificial Sequence
  Synthetic oligonucleotide; TTC chr2 60485058 60485079 60485063 60485058 -
ttccaaggctatgccttggtgg

SEQ ID NO: 222159 - DNA, 22 bp, Artificial Sequence
  Synthetic oligonucleotide; CTT chr2 60485056 60485077 60485061 60485056 -
ccaaggctatgccttggtggtg

SEQ ID NO: 222160 - DNA, 22 bp, Artificial Sequence
  Synthetic oligonucleotide; TTC chr2 60485055 60485076 60485060 60485055 -
caaggctatgccttggtggtgg

SEQ ID NO: 222161 - DNA, 22 bp, Artificial Sequence
  Synthetic oligonucleotide; CTA chr2 60485047 60485068 60485052 60485047 -
tgccttggtggtggtggtgagg

SEQ ID NO: 222162 - DNA, 22 bp, Artificial Sequence
  Synthetic oligonucleotide; CTT chr2 60485041 60485062 60485046 60485041 -
ggtggtggtggtgagggtgtac

SEQ ID NO: 222163 - DNA, 22 bp, Artificial Sequence
  Synthetic oligonucleotide; TTG chr2 60485040 60485061 60485045 60485040 -
gtggtggtggtgagggtgtaca

SEQ ID NO: 222164 - DNA, 22 bp, Artificial Sequence
  Synthetic oligonucleotide; TTG chr2 60485013 60485034 60485018 60485013 -
ttttttgtatttcctattttga

SEQ ID NO: 222165 - DNA, 22 bp, Artificial Sequence
  Synthetic oligonucleotide; TTT chr2 60485010 60485031 60485015 60485010 -
tttgtatttcctattttgattt

SEQ ID NO: 222166 - DNA, 22 bp, Artificial Sequence
  Synthetic oligonucleotide; TTT chr2 60485009 60485030 60485014 60485009 -
ttgtatttcctattttgattta

SEQ ID NO: 222167 - DNA, 22 bp, Artificial Sequence
  Synthetic oligonucleotide; TTT chr2 60485008 60485029 60485013 60485008 -
tgtatttcctattttgatttaa

SEQ ID NO: 222168 - DNA, 22 bp, Artificial Sequence
  Synthetic oligonucleotide; TTT chr2 60485007 60485028 60485012 60485007 -
gtatttcctattttgatttaaa

SEQ ID NO: 222169 - DNA, 22 bp, Artificial Sequence
  Synthetic oligonucleotide; TTG chr2 60485006 60485027 60485011 60485006 -
tatttcctattttgatttaaat

SEQ ID NO: 222170 - DNA, 22 bp, Artificial Sequence
  Synthetic oligonucleotide; TTT chr2 60485001 60485022 60485006 60485001 -
cctattttgatttaaatactgt

SEQ ID NO: 222171 - DNA, 22 bp, Artificial Sequence
  Synthetic oligonucleotide; TTC chr2 60485000 60485021 60485005 60485000 -
ctattttgatttaaatactgtt

SEQ ID NO: 222172 - DNA, 22 bp, Artificial Sequence
  Synthetic oligonucleotide; CTA chr2 60484997 60485018 60485002 60484997 -
ttttgatttaaatactgttttt

SEQ ID NO: 222173 - DNA, 22 bp, Artificial Sequence
  Synthetic oligonucleotide; TTT chr2 60484994 60485015 60484999 60484994 -
tgatttaaatactgttttttgt

SEQ ID NO: 222174 - DNA, 22 bp, Artificial Sequence
  Synthetic oligonucleotide; TTT chr2 60484993 60485014 60484998 60484993 -
gatttaaatactgttttttgtt

SEQ ID NO: 222175 - DNA, 22 bp, Artificial Sequence
  Synthetic oligonucleotide; TTG chr2 60484992 60485013 60484997 60484992 -
atttaaatactgttttttgttt

SEQ ID NO: 222176 - DNA, 22 bp, Artificial Sequence
  Synthetic oligonucleotide; TTT chr2 60484988 60485009 60484993 60484988 -
aaatactgttttttgtttggtt

SEQ ID NO: 222177 - DNA, 22 bp, Artificial Sequence
  Synthetic oligonucleotide; TTA chr2 60484987 60485008 60484992 60484987 -
aatactgttttttgtttggttg

SEQ ID NO: 222178 - DNA, 22 bp, Artificial Sequence
  Synthetic oligonucleotide; CTG chr2 60484980 60485001 60484985 60484980 -
ttttttgtttggttggttggtt

SEQ ID NO: 222179 - DNA, 22 bp, Artificial Sequence
  Synthetic oligonucleotide; TTT chr2 60484977 60484998 60484982 60484977 -
tttgtttggttggttggttttt

SEQ ID NO: 222180 - DNA, 22 bp, Artificial Sequence
  Synthetic oligonucleotide; TTT chr2 60484976 60484997 60484981 60484976 -
ttgtttggttggttggtttttt

SEQ ID NO: 222181 - DNA, 22 bp, Artificial Sequence
  Synthetic oligonucleotide; TTT chr2 60484975 60484996 60484980 60484975 -
tgtttggttggttggttttttt

SEQ ID NO: 222182 - DNA, 22 bp, Artificial Sequence
  Synthetic oligonucleotide; TTT chr2 60484974 60484995 60484979 60484974 -
gtttggttggttggtttttttt

SEQ ID NO: 222183 - DNA, 22 bp, Artificial Sequence
  Synthetic oligonucleotide; TTG chr2 60484973 60484994 60484978 60484973 -
tttggttggttggttttttttt

SEQ ID NO: 222184 - DNA, 22 bp, Artificial Sequence
  Synthetic oligonucleotide; TTT chr2 60484970 60484991 60484975 60484970 -
ggttggttggtttttttttttt

SEQ ID NO: 222185 - DNA, 22 bp, Artificial Sequence
  Synthetic oligonucleotide; TTG chr2 60484969 60484990 60484974 60484969 -
gttggttggttttttttttttt

SEQ ID NO: 222186 - DNA, 22 bp, Artificial Sequence
  Synthetic oligonucleotide; TTG chr2 60484965 60484986 60484970 60484965 -
gttggttttttttttttttttt

SEQ ID NO: 222187 - DNA, 22 bp, Artificial Sequence
  Synthetic oligonucleotide; TTG chr2 60484961 60484982 60484966 60484961 -
gttttttttttttttttttaag

SEQ ID NO: 222188 - DNA, 22 bp, Artificial Sequence
  Synthetic oligonucleotide; TTT chr2 60484957 60484978 60484962 60484957 -
tttttttttttttttaagtcct

SEQ ID NO: 222189 - DNA, 22 bp, Artificial Sequence
  Synthetic oligonucleotide; TTT chr2 60484956 60484977 60484961 60484956 -
ttttttttttttttaagtccta

SEQ ID NO: 222190 - DNA, 22 bp, Artificial Sequence
  Synthetic oligonucleotide; TTT chr2 60484955 60484976 60484960 60484955 -
tttttttttttttaagtcctaa

SEQ ID NO: 222191 - DNA, 22 bp, Artificial Sequence
  Synthetic oligonucleotide; TTT chr2 60484954 60484975 60484959 60484954 -
ttttttttttttaagtcctaaa

SEQ ID NO: 222192 - DNA, 22 bp, Artificial Sequence
  Synthetic oligonucleotide; TTT chr2 60484953 60484974 60484958 60484953 -
tttttttttttaagtcctaaac

SEQ ID NO: 222193 - DNA, 22 bp, Artificial Sequence
  Synthetic oligonucleotide; TTT chr2 60484952 60484973 60484957 60484952 -
ttttttttttaagtcctaaaca

SEQ ID NO: 222194 - DNA, 22 bp, Artificial Sequence
  Synthetic oligonucleotide; TTT chr2 60484951 60484972 60484956 60484951 -
tttttttttaagtcctaaacaa

SEQ ID NO: 222195 - DNA, 22 bp, Artificial Sequence
  Synthetic oligonucleotide; TTT chr2 60484950 60484971 60484955 60484950 -
ttttttttaagtcctaaacaag

SEQ ID NO: 222196 - DNA, 22 bp, Artificial Sequence
  Synthetic oligonucleotide; TTT chr2 60484949 60484970 60484954 60484949 -
tttttttaagtcctaaacaagt

SEQ ID NO: 222197 - DNA, 22 bp, Artificial Sequence
  Synthetic oligonucleotide; TTT chr2 60484948 60484969 60484953 60484948 -
ttttttaagtcctaaacaagtg

SEQ ID NO: 222198 - DNA, 22 bp, Artificial Sequence
  Synthetic oligonucleotide; TTT chr2 60484947 60484968 60484952 60484947 -
tttttaagtcctaaacaagtgc

SEQ ID NO: 222199 - DNA, 22 bp, Artificial Sequence
  Synthetic oligonucleotide; TTT chr2 60484946 60484967 60484951 60484946 -
ttttaagtcctaaacaagtgcc

SEQ ID NO: 222200 - DNA, 22 bp, Artificial Sequence
  Synthetic oligonucleotide; TTT chr2 60484945 60484966 60484950 60484945 -
tttaagtcctaaacaagtgcca

SEQ ID NO: 222201 - DNA, 22 bp, Artificial Sequence
  Synthetic oligonucleotide; TTT chr2 60484944 60484965 60484949 60484944 -
ttaagtcctaaacaagtgccac

SEQ ID NO: 222202 - DNA, 22 bp, Artificial Sequence
  Synthetic oligonucleotide; TTT chr2 60484943 60484964 60484948 60484943 -
taagtcctaaacaagtgccaca

SEQ ID NO: 222203 - DNA, 22 bp, Artificial Sequence
  Synthetic oligonucleotide; TTT chr2 60484942 60484963 60484947 60484942 -
aagtcctaaacaagtgccacag

SEQ ID NO: 222204 - DNA, 22 bp, Artificial Sequence
  Synthetic oligonucleotide; TTA chr2 60484941 60484962 60484946 60484941 -
agtcctaaacaagtgccacaga

SEQ ID NO: 222205 - DNA, 22 bp, Artificial Sequence
  Synthetic oligonucleotide; CTA chr2 60484934 60484955 60484939 60484934 -
aacaagtgccacagaggatttc

SEQ ID NO: 222206 - DNA, 22 bp, Artificial Sequence
  Synthetic oligonucleotide; TTT chr2 60484913 60484934 60484918 60484913 -
ctttttggcttgaacttgataa

SEQ ID NO: 222207 - DNA, 22 bp, Artificial Sequence
  Synthetic oligonucleotide; TTC chr2 60484912 60484933 60484917 60484912 -
tttttggcttgaacttgataaa

SEQ ID NO: 222208 - DNA, 22 bp, Artificial Sequence
  Synthetic oligonucleotide; CTT chr2 60484910 60484931 60484915 60484910 -
tttggcttgaacttgataaaat

SEQ ID NO: 222209 - DNA, 22 bp, Artificial Sequence
  Synthetic oligonucleotide; TTT chr2 60484909 60484930 60484914 60484909 -
ttggcttgaacttgataaaatt

SEQ ID NO: 222210 - DNA, 22 bp, Artificial Sequence
  Synthetic oligonucleotide; TTT chr2 60484908 60484929 60484913 60484908 -
tggcttgaacttgataaaattt

SEQ ID NO: 222211 - DNA, 22 bp, Artificial Sequence
  Synthetic oligonucleotide; TTT chr2 60484907 60484928 60484912 60484907 -
ggcttgaacttgataaaatttg

SEQ ID NO: 222212 - DNA, 22 bp, Artificial Sequence
  Synthetic oligonucleotide; TTG chr2 60484906 60484927 60484911 60484906 -
gcttgaacttgataaaatttgg

SEQ ID NO: 222213 - DNA, 22 bp, Artificial Sequence
  Synthetic oligonucleotide; CTT chr2 60484902 60484923 60484907 60484902 -
gaacttgataaaatttggagca

SEQ ID NO: 222214 - DNA, 22 bp, Artificial Sequence
  Synthetic oligonucleotide; TTG chr2 60484901 60484922 60484906 60484901 -
aacttgataaaatttggagcac

SEQ ID NO: 222215 - DNA, 22 bp, Artificial Sequence
  Synthetic oligonucleotide; CTT chr2 60484896 60484917 60484901 60484896 -
gataaaatttggagcacacaag

SEQ ID NO: 222216 - DNA, 22 bp, Artificial Sequence
  Synthetic oligonucleotide; TTG chr2 60484895 60484916 60484900 60484895 -
ataaaatttggagcacacaagt

SEQ ID NO: 222217 - DNA, 22 bp, Artificial Sequence
  Synthetic oligonucleotide; TTT chr2 60484886 60484907 60484891 60484886 -
ggagcacacaagtttacacaca

SEQ ID NO: 222218 - DNA, 22 bp, Artificial Sequence
  Synthetic oligonucleotide; TTG chr2 60484885 60484906 60484890 60484885 -
gagcacacaagtttacacacat

SEQ ID NO: 222219 - DNA, 22 bp, Artificial Sequence
  Synthetic oligonucleotide; TTT chr2 60484871 60484892 60484876 60484871 -
acacacatggtcatgaacacac

SEQ ID NO: 222220 - DNA, 22 bp, Artificial Sequence
  Synthetic oligonucleotide; TTA chr2 60484870 60484891 60484875 60484870 -
cacacatggtcatgaacacaca

SEQ ID NO: 222221 - DNA, 22 bp, Artificial Sequence
  Synthetic oligonucleotide; CTT chr2 60484842 60484863 60484847 60484842 -
ctcccatctccccagaccccca

SEQ ID NO: 222222 - DNA, 22 bp, Artificial Sequence
  Synthetic oligonucleotide; TTC chr2 60484841 60484862 60484846 60484841 -
tcccatctccccagacccccag

SEQ ID NO: 222223 - DNA, 22 bp, Artificial Sequence
  Synthetic oligonucleotide; CTC chr2 60484839 60484860 60484844 60484839 -
ccatctccccagacccccagca

SEQ ID NO: 222224 - DNA, 22 bp, Artificial Sequence
  Synthetic oligonucleotide; CTC chr2 60484832 60484853 60484837 60484832 -
cccagacccccagcacatatgt

SEQ ID NO: 222225 - DNA, 22 bp, Artificial Sequence
  Synthetic oligonucleotide; TTC chr2 60484808 60484829 60484813 60484808 -
cataatgaggtgttcctaagtg

SEQ ID NO: 222226 - DNA, 22 bp, Artificial Sequence
  Synthetic oligonucleotide; TTC chr2 60484793 60484814 60484798 60484793 -
ctaagtgagaattcccataatt

SEQ ID NO: 222227 - DNA, 22 bp, Artificial Sequence
  Synthetic oligonucleotide; CTA chr2 60484790 60484811 60484795 60484790 -
agtgagaattcccataatttga

SEQ ID NO: 222228 - DNA, 22 bp, Artificial Sequence
  Synthetic oligonucleotide; TTC chr2 60484779 60484800 60484784 60484779 -
ccataatttgaggttttatact

SEQ ID NO: 222229 - DNA, 22 bp, Artificial Sequence
  Synthetic oligonucleotide; TTT chr2 60484770 60484791 60484775 60484770 -
gaggttttatactggaatggtg

SEQ ID NO: 222230 - DNA, 22 bp, Artificial Sequence
  Synthetic oligonucleotide; TTG chr2 60484769 60484790 60484774 60484769 -
aggttttatactggaatggtga

SEQ ID NO: 222231 - DNA, 22 bp, Artificial Sequence
  Synthetic oligonucleotide; TTT chr2 60484763 60484784 60484768 60484763 -
tatactggaatggtgataaggg

SEQ ID NO: 222232 - DNA, 22 bp, Artificial Sequence
  Synthetic oligonucleotide; TTT chr2 60484762 60484783 60484767 60484762 -
atactggaatggtgataagggc

SEQ ID NO: 222233 - DNA, 22 bp, Artificial Sequence
  Synthetic oligonucleotide; TTA chr2 60484761 60484782 60484766 60484761 -
tactggaatggtgataagggca

SEQ ID NO: 222234 - DNA, 22 bp, Artificial Sequence
  Synthetic oligonucleotide; CTG chr2 60484756 60484777 60484761 60484756 -
gaatggtgataagggcaggaaa

SEQ ID NO: 222235 - DNA, 22 bp, Artificial Sequence
  Synthetic oligonucleotide; CTC chr2 60484730 60484751 60484735 60484730 -
agcccatgtgcattttttctcg

SEQ ID NO: 222236 - DNA, 22 bp, Artificial Sequence
  Synthetic oligonucleotide; TTT chr2 60484715 60484736 60484720 60484715 -
tttctcgagtggttaacctttc

SEQ ID NO: 222237 - DNA, 22 bp, Artificial Sequence
  Synthetic oligonucleotide; TTT chr2 60484714 60484735 60484719 60484714 -
ttctcgagtggttaacctttcc

SEQ ID NO: 222238 - DNA, 22 bp, Artificial Sequence
  Synthetic oligonucleotide; TTT chr2 60484713 60484734 60484718 60484713 -
tctcgagtggttaacctttcct

SEQ ID NO: 222239 - DNA, 22 bp, Artificial Sequence
  Synthetic oligonucleotide; TTT chr2 60484712 60484733 60484717 60484712 -
ctcgagtggttaacctttcctc

SEQ ID NO: 222240 - DNA, 22 bp, Artificial Sequence
  Synthetic oligonucleotide; TTC chr2 60484711 60484732 60484716 60484711 -
tcgagtggttaacctttcctct

SEQ ID NO: 222241 - DNA, 22 bp, Artificial Sequence
  Synthetic oligonucleotide; CTC chr2 60484709 60484730 60484714 60484709 -
gagtggttaacctttcctctct

SEQ ID NO: 222242 - DNA, 22 bp, Artificial Sequence
  Synthetic oligonucleotide; TTA chr2 60484700 60484721 60484705 60484700 -
acctttcctctctttctccttc

SEQ ID NO: 222243 - DNA, 22 bp, Artificial Sequence
  Synthetic oligonucleotide; CTT chr2 60484695 60484716 60484700 60484695 -
tcctctctttctccttcttttt

SEQ ID NO: 222244 - DNA, 22 bp, Artificial Sequence
  Synthetic oligonucleotide; TTT chr2 60484694 60484715 60484699 60484694 -
cctctctttctccttctttttt

SEQ ID NO: 222245 - DNA, 22 bp, Artificial Sequence
  Synthetic oligonucleotide; TTC chr2 60484693 60484714 60484698 60484693 -
ctctctttctccttcttttttt

SEQ ID NO: 222246 - DNA, 22 bp, Artificial Sequence
  Synthetic oligonucleotide; CTC chr2 60484690 60484711 60484695 60484690 -
tctttctccttctttttttgcc

SEQ ID NO: 222247 - DNA, 22 bp, Artificial Sequence
  Synthetic oligonucleotide; CTC chr2 60484688 60484709 60484693 60484688 -
tttctccttctttttttgcccc

SEQ ID NO: 222248 - DNA, 22 bp, Artificial Sequence
  Synthetic oligonucleotide; CTT chr2 60484686 60484707 60484691 60484686 -
tctccttctttttttgcccccc

SEQ ID NO: 222249 - DNA, 22 bp, Artificial Sequence
  Synthetic oligonucleotide; TTT chr2 60484685 60484706 60484690 60484685 -
ctccttctttttttgcccccct

SEQ ID NO: 222250 - DNA, 22 bp, Artificial Sequence
  Synthetic oligonucleotide; TTC chr2 60484684 60484705 60484689 60484684 -
tccttctttttttgcccccctc

SEQ ID NO: 222251 - DNA, 22 bp, Artificial Sequence
  Synthetic oligonucleotide; CTC chr2 60484682 60484703 60484687 60484682 -
cttctttttttgcccccctcca

SEQ ID NO: 222252 - DNA, 22 bp, Artificial Sequence
  Synthetic oligonucleotide; CTT chr2 60484679 60484700 60484684 60484679 -
ctttttttgcccccctccaaat

SEQ ID NO: 222253 - DNA, 22 bp, Artificial Sequence
  Synthetic oligonucleotide; TTC chr2 60484678 60484699 60484683 60484678 -
tttttttgcccccctccaaatt

SEQ ID NO: 222254 - DNA, 22 bp, Artificial Sequence
  Synthetic oligonucleotide; CTT chr2 60484676 60484697 60484681 60484676 -
tttttgcccccctccaaattcc

SEQ ID NO: 222255 - DNA, 22 bp, Artificial Sequence
  Synthetic oligonucleotide; TTT chr2 60484675 60484696 60484680 60484675 -
ttttgcccccctccaaattccc

SEQ ID NO: 222256 - DNA, 22 bp, Artificial Sequence
  Synthetic oligonucleotide; TTT chr2 60484674 60484695 60484679 60484674 -
tttgcccccctccaaattcccc

SEQ ID NO: 222257 - DNA, 22 bp, Artificial Sequence
  Synthetic oligonucleotide; TTT chr2 60484673 60484694 60484678 60484673 -
ttgcccccctccaaattccccc

SEQ ID NO: 222258 - DNA, 22 bp, Artificial Sequence
  Synthetic oligonucleotide; TTT chr2 60484672 60484693 60484677 60484672 -
tgcccccctccaaattccccct

SEQ ID NO: 222259 - DNA, 22 bp, Artificial Sequence
  Synthetic oligonucleotide; TTT chr2 60484671 60484692 60484676 60484671 -
gcccccctccaaattccccctt

SEQ ID NO: 222260 - DNA, 22 bp, Artificial Sequence
  Synthetic oligonucleotide; TTG chr2 60484670 60484691 60484675 60484670 -
cccccctccaaattcccccttc

SEQ ID NO: 222261 - DNA, 22 bp, Artificial Sequence
  Synthetic oligonucleotide; CTC chr2 60484662 60484683 60484667 60484662 -
caaattcccccttctcttaaga

SEQ ID NO: 222262 - DNA, 22 bp, Artificial Sequence
  Synthetic oligonucleotide; TTC chr2 60484655 60484676 60484660 60484655 -
ccccttctcttaagaaaaaaca

SEQ ID NO: 222263 - DNA, 22 bp, Artificial Sequence
  Synthetic oligonucleotide; CTT chr2 60484649 60484670 60484654 60484649 -
ctcttaagaaaaaacacgtgag

SEQ ID NO: 222264 - DNA, 22 bp, Artificial Sequence
  Synthetic oligonucleotide; TTC chr2 60484648 60484669 60484653 60484648 -
tcttaagaaaaaacacgtgagc

SEQ ID NO: 222265 - DNA, 22 bp, Artificial Sequence
  Synthetic oligonucleotide; CTC chr2 60484646 60484667 60484651 60484646 -
ttaagaaaaaacacgtgagcca

SEQ ID NO: 222266 - DNA, 22 bp, Artificial Sequence
  Synthetic oligonucleotide; CTT chr2 60484644 60484665 60484649 60484644 -
aagaaaaaacacgtgagccatg

SEQ ID NO: 222267 - DNA, 22 bp, Artificial Sequence
  Synthetic oligonucleotide; TTA chr2 60484643 60484664 60484648 60484643 -
agaaaaaacacgtgagccatgt

SEQ ID NO: 222268 - DNA, 22 bp, Artificial Sequence
  Synthetic oligonucleotide; TTG chr2 60484619 60484640 60484624 60484619 -
gaagtacagccttgacctcagc

SEQ ID NO: 222269 - DNA, 22 bp, Artificial Sequence
  Synthetic oligonucleotide; CTT chr2 60484606 60484627 60484611 60484606 -
gacctcagcctcaccaggtgcg

SEQ ID NO: 222270 - DNA, 22 bp, Artificial Sequence
  Synthetic oligonucleotide; TTG chr2 60484605 60484626 60484610 60484605 -
acctcagcctcaccaggtgcgg

SEQ ID NO: 222271 - DNA, 22 bp, Artificial Sequence
  Synthetic oligonucleotide; CTC chr2 60484600 60484621 60484605 60484600 -
agcctcaccaggtgcggctgct

SEQ ID NO: 222272 - DNA, 22 bp, Artificial Sequence
  Synthetic oligonucleotide; CTC chr2 60484594 60484615 60484599 60484594 -
accaggtgcggctgctgaccgg

SEQ ID NO: 222273 - DNA, 22 bp, Artificial Sequence
  Synthetic oligonucleotide; CTG chr2 60484580 60484601 60484585 60484580 -
ctgaccggtgcaaaaaaatagg

SEQ ID NO: 222274 - DNA, 22 bp, Artificial Sequence
  Synthetic oligonucleotide; CTG chr2 60484577 60484598 60484582 60484577 -
accggtgcaaaaaaataggaaa

SEQ ID NO: 222275 - DNA, 22 bp, Artificial Sequence
  Synthetic oligonucleotide; TTA chr2 60484550 60484571 60484555 60484550 -
tttaaaaggcagggaggggaga

SEQ ID NO: 222276 - DNA, 22 bp, Artificial Sequence
  Synthetic oligonucleotide; TTT chr2 60484547 60484568 60484552 60484547 -
aaaaggcagggaggggagagtt

SEQ ID NO: 222277 - DNA, 22 bp, Artificial Sequence
  Synthetic oligonucleotide; TTA chr2 60484546 60484567 60484551 60484546 -
aaaggcagggaggggagagttt

SEQ ID NO: 222278 - DNA, 22 bp, Artificial Sequence
  Synthetic oligonucleotide; TTT chr2 60484524 60484545 60484529 60484524 -
ctgttccacaatcactgctgtt

SEQ ID NO: 222279 - DNA, 22 bp, Artificial Sequence
  Synthetic oligonucleotide; TTC chr2 60484523 60484544 60484528 60484523 -
tgttccacaatcactgctgttt

SEQ ID NO: 222280 - DNA, 22 bp, Artificial Sequence
  Synthetic oligonucleotide; CTG chr2 60484521 60484542 60484526 60484521 -
ttccacaatcactgctgtttca

SEQ ID NO: 222281 - DNA, 22 bp, Artificial Sequence
  Synthetic oligonucleotide; TTC chr2 60484518 60484539 60484523 60484518 -
cacaatcactgctgtttcagtg

SEQ ID NO: 222282 - DNA, 22 bp, Artificial Sequence
  Synthetic oligonucleotide; CTG chr2 60484507 60484528 60484512 60484507 -
ctgtttcagtgaaaagcaaccc

SEQ ID NO: 222283 - DNA, 22 bp, Artificial Sequence
  Synthetic oligonucleotide; CTG chr2 60484504 60484525 60484509 60484504 -
tttcagtgaaaagcaacccggt

SEQ ID NO: 222284 - DNA, 22 bp, Artificial Sequence
  Synthetic oligonucleotide; TTT chr2 60484501 60484522 60484506 60484501 -
cagtgaaaagcaacccggttta

SEQ ID NO: 222285 - DNA, 22 bp, Artificial Sequence
  Synthetic oligonucleotide; TTC chr2 60484500 60484521 60484505 60484500 -
agtgaaaagcaacccggtttat

SEQ ID NO: 222286 - DNA, 22 bp, Artificial Sequence
  Synthetic oligonucleotide; TTT chr2 60484480 60484501 60484485 60484480 -
atctgtaaaacctacttccctt

SEQ ID NO: 222287 - DNA, 22 bp, Artificial Sequence
  Synthetic oligonucleotide; TTA chr2 60484479 60484500 60484484 60484479 -
tctgtaaaacctacttcccttt

SEQ ID NO: 222288 - DNA, 22 bp, Artificial Sequence
  Synthetic oligonucleotide; CTG chr2 60484475 60484496 60484480 60484475 -
taaaacctacttccctttctgg

SEQ ID NO: 222289 - DNA, 22 bp, Artificial Sequence
  Synthetic oligonucleotide; CTA chr2 60484466 60484487 60484471 60484466 -
cttccctttctggtgaatgtgg

SEQ ID NO: 222290 - DNA, 22 bp, Artificial Sequence
  Synthetic oligonucleotide; CTT chr2 60484463 60484484 60484468 60484463 -
ccctttctggtgaatgtggctg

SEQ ID NO: 222291 - DNA, 22 bp, Artificial Sequence
  Synthetic oligonucleotide; TTC chr2 60484462 60484483 60484467 60484462 -
cctttctggtgaatgtggctgt

SEQ ID NO: 222292 - DNA, 22 bp, Artificial Sequence
  Synthetic oligonucleotide; CTT chr2 60484458 60484479 60484463 60484458 -
tctggtgaatgtggctgttttt

SEQ ID NO: 222293 - DNA, 22 bp, Artificial Sequence
  Synthetic oligonucleotide; TTT chr2 60484457 60484478 60484462 60484457 -
ctggtgaatgtggctgtttttg

SEQ ID NO: 222294 - DNA, 22 bp, Artificial Sequence
  Synthetic oligonucleotide; TTC chr2 60484456 60484477 60484461 60484456 -
tggtgaatgtggctgtttttga

SEQ ID NO: 222295 - DNA, 22 bp, Artificial Sequence
  Synthetic oligonucleotide; CTG chr2 60484454 60484475 60484459 60484454 -
gtgaatgtggctgtttttgaca

SEQ ID NO: 222296 - DNA, 22 bp, Artificial Sequence
  Synthetic oligonucleotide; CTG chr2 60484441 60484462 60484446 60484441 -
tttttgacagcagaggacccca

SEQ ID NO: 222297 - DNA, 22 bp, Artificial Sequence
  Synthetic oligonucleotide; TTT chr2 60484438 60484459 60484443 60484438 -
ttgacagcagaggaccccagtt

SEQ ID NO: 222298 - DNA, 22 bp, Artificial Sequence
  Synthetic oligonucleotide; TTT chr2 60484437 60484458 60484442 60484437 -
tgacagcagaggaccccagttg

SEQ ID NO: 222299 - DNA, 22 bp, Artificial Sequence
  Synthetic oligonucleotide; TTT chr2 60484436 60484457 60484441 60484436 -
gacagcagaggaccccagttgt

SEQ ID NO: 222300 - DNA, 22 bp, Artificial Sequence
  Synthetic oligonucleotide; TTG chr2 60484435 60484456 60484440 60484435 -
acagcagaggaccccagttgtt

SEQ ID NO: 222301 - DNA, 22 bp, Artificial Sequence
  Synthetic oligonucleotide; TTG chr2 60484415 60484436 60484420 60484415 -
ttgaggactaaagagagagaag

SEQ ID NO: 222302 - DNA, 22 bp, Artificial Sequence
  Synthetic oligonucleotide; TTG chr2 60484412 60484433 60484417 60484412 -
aggactaaagagagagaagatg

SEQ ID NO: 222303 - DNA, 22 bp, Artificial Sequence
  Synthetic oligonucleotide; CTA chr2 60484405 60484426 60484410 60484405 -
aagagagagaagatgagaaaga

SEQ ID NO: 222304 - DNA, 22 bp, Artificial Sequence
  Synthetic oligonucleotide; CTG chr2 60484375 60484396 60484380 60484375 -
gaaacagaggttggagaaagag

SEQ ID NO: 222305 - DNA, 22 bp, Artificial Sequence
  Synthetic oligonucleotide; TTG chr2 60484362 60484383 60484367 60484362 -
gagaaagagaggcaaggaagta

SEQ ID NO: 222306 - DNA, 22 bp, Artificial Sequence
  Synthetic oligonucleotide; TTG chr2 60484294 60484315 60484299 60484294 -
gaattcgagctattttcagctg

SEQ ID NO: 222307 - DNA, 22 bp, Artificial Sequence
  Synthetic oligonucleotide; TTC chr2 60484288 60484309 60484293 60484288 -
gagctattttcagctgaatgtg

SEQ ID NO: 222308 - DNA, 22 bp, Artificial Sequence
  Synthetic oligonucleotide; CTA chr2 60484282 60484303 60484287 60484282 -
ttttcagctgaatgtgagtgca

SEQ ID NO: 222309 - DNA, 22 bp, Artificial Sequence
  Synthetic oligonucleotide; TTT chr2 60484279 60484300 60484284 60484279 -
tcagctgaatgtgagtgcagat

SEQ ID NO: 222310 - DNA, 22 bp, Artificial Sequence
  Synthetic oligonucleotide; TTT chr2 60484278 60484299 60484283 60484278 -
cagctgaatgtgagtgcagatt

SEQ ID NO: 222311 - DNA, 22 bp, Artificial Sequence
  Synthetic oligonucleotide; TTC chr2 60484277 60484298 60484282 60484277 -
agctgaatgtgagtgcagattt

SEQ ID NO: 222312 - DNA, 22 bp, Artificial Sequence
  Synthetic oligonucleotide; CTG chr2 60484272 60484293 60484277 60484272 -
aatgtgagtgcagatttcatca

SEQ ID NO: 222313 - DNA, 22 bp, Artificial Sequence
  Synthetic oligonucleotide; TTT chr2 60484255 60484276 60484260 60484255 -
catcaggcttctgggctacagg

SEQ ID NO: 222314 - DNA, 22 bp, Artificial Sequence
  Synthetic oligonucleotide; TTC chr2 60484254 60484275 60484259 60484254 -
atcaggcttctgggctacaggg

SEQ ID NO: 222315 - DNA, 22 bp, Artificial Sequence
  Synthetic oligonucleotide; CTT chr2 60484245 60484266 60484250 60484245 -
ctgggctacagggaaactgact

SEQ ID NO: 222316 - DNA, 22 bp, Artificial Sequence
  Synthetic oligonucleotide; TTC chr2 60484244 60484265 60484249 60484244 -
tgggctacagggaaactgactg

SEQ ID NO: 222317 - DNA, 22 bp, Artificial Sequence
  Synthetic oligonucleotide; CTG chr2 60484242 60484263 60484247 60484242 -
ggctacagggaaactgactgtg

SEQ ID NO: 222318 - DNA, 22 bp, Artificial Sequence
  Synthetic oligonucleotide; CTA chr2 60484237 60484258 60484242 60484237 -
cagggaaactgactgtgtgcgg

SEQ ID NO: 222319 - DNA, 22 bp, Artificial Sequence
  Synthetic oligonucleotide; CTG chr2 60484226 60484247 60484231 60484226 -
actgtgtgcggaccttgcgtgt

SEQ ID NO: 222320 - DNA, 22 bp, Artificial Sequence
  Synthetic oligonucleotide; CTG chr2 60484222 60484243 60484227 60484222 -
tgtgcggaccttgcgtgtaact

SEQ ID NO: 222321 - DNA, 22 bp, Artificial Sequence
  Synthetic oligonucleotide; CTT chr2 60484210 60484231 60484215 60484210 -
gcgtgtaacttcctgtgaagca

SEQ ID NO: 222322 - DNA, 22 bp, Artificial Sequence
  Synthetic oligonucleotide; TTG chr2 60484209 60484230 60484214 60484209 -
cgtgtaacttcctgtgaagcag

SEQ ID NO: 222323 - DNA, 22 bp, Artificial Sequence
  Synthetic oligonucleotide; CTT chr2 60484199 60484220 60484204 60484199 -
cctgtgaagcagccgtggtgac

SEQ ID NO: 222324 - DNA, 22 bp, Artificial Sequence
  Synthetic oligonucleotide; TTC chr2 60484198 60484219 60484203 60484198 -
ctgtgaagcagccgtggtgact

SEQ ID NO: 222325 - DNA, 22 bp, Artificial Sequence
  Synthetic oligonucleotide; CTG chr2 60484195 60484216 60484200 60484195 -
tgaagcagccgtggtgactgca

SEQ ID NO: 222326 - DNA, 22 bp, Artificial Sequence
  Synthetic oligonucleotide; CTG chr2 60484175 60484196 60484180 60484175 -
cattttctgacactgtcagagt

SEQ ID NO: 222327 - DNA, 22 bp, Artificial Sequence
  Synthetic oligonucleotide; TTT chr2 60484170 60484191 60484175 60484170 -
tctgacactgtcagagtctgga

SEQ ID NO: 222328 - DNA, 22 bp, Artificial Sequence
  Synthetic oligonucleotide; TTT chr2 60484169 60484190 60484174 60484169 -
ctgacactgtcagagtctggac

SEQ ID NO: 222329 - DNA, 22 bp, Artificial Sequence
  Synthetic oligonucleotide; TTC chr2 60484168 60484189 60484173 60484168 -
tgacactgtcagagtctggaca

SEQ ID NO: 222330 - DNA, 22 bp, Artificial Sequence
  Synthetic oligonucleotide; CTG chr2 60484166 60484187 60484171 60484166 -
acactgtcagagtctggacaac

SEQ ID NO: 222331 - DNA, 22 bp, Artificial Sequence
  Synthetic oligonucleotide; CTG chr2 60484160 60484181 60484165 60484160 -
tcagagtctggacaaccctgcc

SEQ ID NO: 222332 - DNA, 22 bp, Artificial Sequence
  Synthetic oligonucleotide; CTG chr2 60484150 60484171 60484155 60484150 -
gacaaccctgccagctcctaga

SEQ ID NO: 222333 - DNA, 22 bp, Artificial Sequence
  Synthetic oligonucleotide; CTG chr2 60484140 60484161 60484145 60484140 -
ccagctcctagaagggcaaccc

SEQ ID NO: 222334 - DNA, 22 bp, Artificial Sequence
  Synthetic oligonucleotide; CTC chr2 60484133 60484154 60484138 60484133 -
ctagaagggcaacccaacaact

SEQ ID NO: 222335 - DNA, 22 bp, Artificial Sequence
  Synthetic oligonucleotide; CTA chr2 60484130 60484151 60484135 60484130 -
gaagggcaacccaacaactgtc

SEQ ID NO: 222336 - DNA, 22 bp, Artificial Sequence
  Synthetic oligonucleotide; CTG chr2 60484110 60484131 60484115 60484110 -
tcacagacgaagcatcaaaagc

SEQ ID NO: 222337 - DNA, 22 bp, Artificial Sequence
  Synthetic oligonucleotide; CTG chr2 60484080 60484101 60484085 60484080 -
tcgatagtgacctgcatttgca

SEQ ID NO: 222338 - DNA, 22 bp, Artificial Sequence
  Synthetic oligonucleotide; CTG chr2 60484066 60484087 60484071 60484066 -
catttgcagaaaatctgagggc

SEQ ID NO: 222339 - DNA, 22 bp, Artificial Sequence
  Synthetic oligonucleotide; TTT chr2 60484061 60484082 60484066 60484061 -
gcagaaaatctgagggctttct

SEQ ID NO: 222340 - DNA, 22 bp, Artificial Sequence
  Synthetic oligonucleotide; TTG chr2 60484060 60484081 60484065 60484060 -
cagaaaatctgagggctttcta

SEQ ID NO: 222341 - DNA, 22 bp, Artificial Sequence
  Synthetic oligonucleotide; CTG chr2 60484049 60484070 60484054 60484049 -
agggctttctaattaacagagg

SEQ ID NO: 222342 - DNA, 22 bp, Artificial Sequence
  Synthetic oligonucleotide; CTT chr2 60484042 60484063 60484047 60484042 -
tctaattaacagaggagctcta

SEQ ID NO: 222343 - DNA, 22 bp, Artificial Sequence
  Synthetic oligonucleotide; TTT chr2 60484041 60484062 60484046 60484041 -
ctaattaacagaggagctctaa

SEQ ID NO: 222344 - DNA, 22 bp, Artificial Sequence
  Synthetic oligonucleotide; TTC chr2 60484040 60484061 60484045 60484040 -
taattaacagaggagctctaaa

SEQ ID NO: 222345 - DNA, 22 bp, Artificial Sequence
  Synthetic oligonucleotide; CTA chr2 60484038 60484059 60484043 60484038 -
attaacagaggagctctaaatt

SEQ ID NO: 222346 - DNA, 22 bp, Artificial Sequence
  Synthetic oligonucleotide; TTA chr2 60484034 60484055 60484039 60484034 -
acagaggagctctaaattagag

SEQ ID NO: 222347 - DNA, 22 bp, Artificial Sequence
  Synthetic oligonucleotide; CTC chr2 60484022 60484043 60484027 60484022 -
taaattagagtaaagctgttcg

SEQ ID NO: 222348 - DNA, 22 bp, Artificial Sequence
  Synthetic oligonucleotide; CTA chr2 60484020 60484041 60484025 60484020 -
aattagagtaaagctgttcgac

SEQ ID NO: 222349 - DNA, 22 bp, Artificial Sequence
  Synthetic oligonucleotide; TTA chr2 60484015 60484036 60484020 60484015 -
gagtaaagctgttcgacaagac

SEQ ID NO: 222350 - DNA, 22 bp, Artificial Sequence
  Synthetic oligonucleotide; CTG chr2 60484004 60484025 60484009 60484004 -
ttcgacaagacccctcatacgc

SEQ ID NO: 222351 - DNA, 22 bp, Artificial Sequence
  Synthetic oligonucleotide; TTC chr2 60484001 60484022 60484006 60484001 -
gacaagacccctcatacgcggt

SEQ ID NO: 222352 - DNA, 22 bp, Artificial Sequence
  Synthetic oligonucleotide; CTC chr2 60483988 60484009 60483993 60483988 -
atacgcggtaagtgtcacaatg

SEQ ID NO: 222353 - DNA, 22 bp, Artificial Sequence
  Synthetic oligonucleotide; TTA chr2 60483953 60483974 60483958 60483953 -
catctaacaagcttctgatttt

SEQ ID NO: 222354 - DNA, 22 bp, Artificial Sequence
  Synthetic oligonucleotide; CTA chr2 60483947 60483968 60483952 60483947 -
acaagcttctgatttttaacag

SEQ ID NO: 222355 - DNA, 22 bp, Artificial Sequence
  Synthetic oligonucleotide; CTT chr2 60483939 60483960 60483944 60483939 -
ctgatttttaacagaagctatg

SEQ ID NO: 222356 - DNA, 22 bp, Artificial Sequence
  Synthetic oligonucleotide; TTC chr2 60483938 60483959 60483943 60483938 -
tgatttttaacagaagctatga

SEQ ID NO: 222357 - DNA, 22 bp, Artificial Sequence
  Synthetic oligonucleotide; CTG chr2 60483936 60483957 60483941 60483936 -
atttttaacagaagctatgaga

SEQ ID NO: 222358 - DNA, 22 bp, Artificial Sequence
  Synthetic oligonucleotide; TTT chr2 60483932 60483953 60483937 60483932 -
ttaacagaagctatgagaccaa

SEQ ID NO: 222359 - DNA, 22 bp, Artificial Sequence
  Synthetic oligonucleotide; TTT chr2 60483931 60483952 60483936 60483931 -
taacagaagctatgagaccaac

SEQ ID NO: 222360 - DNA, 22 bp, Artificial Sequence
  Synthetic oligonucleotide; TTT chr2 60483930 60483951 60483935 60483930 -
aacagaagctatgagaccaact

SEQ ID NO: 222361 - DNA, 22 bp, Artificial Sequence
  Synthetic oligonucleotide; TTA chr2 60483929 60483950 60483934 60483929 -
acagaagctatgagaccaactc

SEQ ID NO: 222362 - DNA, 22 bp, Artificial Sequence
  Synthetic oligonucleotide; CTA chr2 60483919 60483940 60483924 60483919 -
tgagaccaactcatttataatg

SEQ ID NO: 222363 - DNA, 22 bp, Artificial Sequence
  Synthetic oligonucleotide; CTC chr2 60483907 60483928 60483912 60483907 -
atttataatggttcagtttcaa

SEQ ID NO: 222364 - DNA, 22 bp, Artificial Sequence
  Synthetic oligonucleotide; TTT chr2 60483903 60483924 60483908 60483903 -
ataatggttcagtttcaaaggg

SEQ ID NO: 222365 - DNA, 22 bp, Artificial Sequence
  Synthetic oligonucleotide; TTA chr2 60483902 60483923 60483907 60483902 -
taatggttcagtttcaaagggg

SEQ ID NO: 222366 - DNA, 22 bp, Artificial Sequence
  Synthetic oligonucleotide; TTC chr2 60483893 60483914 60483898 60483893 -
agtttcaaagggggaaaaaaaa

SEQ ID NO: 222367 - DNA, 22 bp, Artificial Sequence
  Synthetic oligonucleotide; TTT chr2 60483888 60483909 60483893 60483888 -
caaagggggaaaaaaaagcaac

SEQ ID NO: 222368 - DNA, 22 bp, Artificial Sequence
  Synthetic oligonucleotide; TTC chr2 60483887 60483908 60483892 60483887 -
aaagggggaaaaaaaagcaacc

SEQ ID NO: 222369 - DNA, 22 bp, Artificial Sequence
  Synthetic oligonucleotide; CTC chr2 60483767 60483788 60483772 60483767 -
cttctagtgctttgggcgagtg

SEQ ID NO: 222370 - DNA, 22 bp, Artificial Sequence
  Synthetic oligonucleotide; CTT chr2 60483764 60483785 60483769 60483764 -
ctagtgctttgggcgagtgctt

SEQ ID NO: 222371 - DNA, 22 bp, Artificial Sequence
  Synthetic oligonucleotide; TTC chr2 60483763 60483784 60483768 60483763 -
tagtgctttgggcgagtgctta

SEQ ID NO: 222372 - DNA, 22 bp, Artificial Sequence
  Synthetic oligonucleotide; CTA chr2 60483761 60483782 60483766 60483761 -
gtgctttgggcgagtgcttaga

SEQ ID NO: 222373 - DNA, 22 bp, Artificial Sequence
  Synthetic oligonucleotide; CTT chr2 60483755 60483776 60483760 60483755 -
tgggcgagtgcttagacccagt

SEQ ID NO: 222374 - DNA, 22 bp, Artificial Sequence
  Synthetic oligonucleotide; TTT chr2 60483754 60483775 60483759 60483754 -
gggcgagtgcttagacccagtc

SEQ ID NO: 222375 - DNA, 22 bp, Artificial Sequence
  Synthetic oligonucleotide; TTG chr2 60483753 60483774 60483758 60483753 -
ggcgagtgcttagacccagtcc

SEQ ID NO: 222376 - DNA, 22 bp, Artificial Sequence
  Synthetic oligonucleotide; CTT chr2 60483742 60483763 60483747 60483742 -
agacccagtccccaaattcttc

SEQ ID NO: 222377 - DNA, 22 bp, Artificial Sequence
  Synthetic oligonucleotide; TTA chr2 60483741 60483762 60483746 60483741 -
gacccagtccccaaattcttcc

SEQ ID NO: 222378 - DNA, 22 bp, Artificial Sequence
  Synthetic oligonucleotide; TTC chr2 60483723 60483744 60483728 60483723 -
ttcctttgttgtctgctgaagc

SEQ ID NO: 222379 - DNA, 22 bp, Artificial Sequence
  Synthetic oligonucleotide; CTT chr2 60483721 60483742 60483726 60483721 -
cctttgttgtctgctgaagcat

SEQ ID NO: 222380 - DNA, 22 bp, Artificial Sequence
  Synthetic oligonucleotide; TTC chr2 60483720 60483741 60483725 60483720 -
ctttgttgtctgctgaagcatc

SEQ ID NO: 222381 - DNA, 22 bp, Artificial Sequence
  Synthetic oligonucleotide; CTT chr2 60483717 60483738 60483722 60483717 -
tgttgtctgctgaagcatccag

SEQ ID NO: 222382 - DNA, 22 bp, Artificial Sequence
  Synthetic oligonucleotide; TTT chr2 60483716 60483737 60483721 60483716 -
gttgtctgctgaagcatccaga

SEQ ID NO: 222383 - DNA, 22 bp, Artificial Sequence
  Synthetic oligonucleotide; TTG chr2 60483715 60483736 60483720 60483715 -
ttgtctgctgaagcatccagat

SEQ ID NO: 222384 - DNA, 22 bp, Artificial Sequence
  Synthetic oligonucleotide; TTG chr2 60483712 60483733 60483717 60483712 -
tctgctgaagcatccagataca

SEQ ID NO: 222385 - DNA, 22 bp, Artificial Sequence
  Synthetic oligonucleotide; CTG chr2 60483708 60483729 60483713 60483708 -
ctgaagcatccagatacatctt

SEQ ID NO: 222386 - DNA, 22 bp, Artificial Sequence
  Synthetic oligonucleotide; CTG chr2 60483705 60483726 60483710 60483705 -
aagcatccagatacatcttctg

SEQ ID NO: 222387 - DNA, 22 bp, Artificial Sequence
  Synthetic oligonucleotide; CTT chr2 60483686 60483707 60483691 60483686 -
ctgttttagattttccttactg

SEQ ID NO: 222388 - DNA, 22 bp, Artificial Sequence
  Synthetic oligonucleotide; TTC chr2 60483685 60483706 60483690 60483685 -
tgttttagattttccttactgt

SEQ ID NO: 222389 - DNA, 22 bp, Artificial Sequence
  Synthetic oligonucleotide; CTG chr2 60483683 60483704 60483688 60483683 -
ttttagattttccttactgtaa

SEQ ID NO: 222390 - DNA, 22 bp, Artificial Sequence
  Synthetic oligonucleotide; TTT chr2 60483680 60483701 60483685 60483680 -
tagattttccttactgtaatcc

SEQ ID NO: 222391 - DNA, 22 bp, Artificial Sequence
  Synthetic oligonucleotide; TTT chr2 60483679 60483700 60483684 60483679 -
agattttccttactgtaatcca

SEQ ID NO: 222392 - DNA, 22 bp, Artificial Sequence
  Synthetic oligonucleotide; TTA chr2 60483678 60483699 60483683 60483678 -
gattttccttactgtaatccac

SEQ ID NO: 222393 - DNA, 22 bp, Artificial Sequence
  Synthetic oligonucleotide; TTT chr2 60483673 60483694 60483678 60483673 -
tccttactgtaatccacgtctg

SEQ ID NO: 222394 - DNA, 22 bp, Artificial Sequence
  Synthetic oligonucleotide; TTT chr2 60483672 60483693 60483677 60483672 -
ccttactgtaatccacgtctgc

SEQ ID NO: 222395 - DNA, 22 bp, Artificial Sequence
  Synthetic oligonucleotide; TTC chr2 60483671 60483692 60483676 60483671 -
cttactgtaatccacgtctgct

SEQ ID NO: 222396 - DNA, 22 bp, Artificial Sequence
  Synthetic oligonucleotide; CTT chr2 60483668 60483689 60483673 60483668 -
actgtaatccacgtctgctaat

SEQ ID NO: 222397 - DNA, 22 bp, Artificial Sequence
  Synthetic oligonucleotide; TTA chr2 60483667 60483688 60483672 60483667 -
ctgtaatccacgtctgctaata

SEQ ID NO: 222398 - DNA, 22 bp, Artificial Sequence
  Synthetic oligonucleotide; CTG chr2 60483664 60483685 60483669 60483664 -
taatccacgtctgctaatatgc

SEQ ID NO: 222399 - DNA, 22 bp, Artificial Sequence
  Synthetic oligonucleotide; CTG chr2 60483651 60483672 60483656 60483651 -
ctaatatgccagctcattcatt

SEQ ID NO: 222400 - DNA, 22 bp, Artificial Sequence
  Synthetic oligonucleotide; CTA chr2 60483648 60483669 60483653 60483648 -
atatgccagctcattcatttga

SEQ ID NO: 222401 - DNA, 22 bp, Artificial Sequence
  Synthetic oligonucleotide; CTC chr2 60483636 60483657 60483641 60483636 -
attcatttgatgtttcctgggg

SEQ ID NO: 222402 - DNA, 22 bp, Artificial Sequence
  Synthetic oligonucleotide; TTC chr2 60483632 60483653 60483637 60483632 -
atttgatgtttcctggggacga

SEQ ID NO: 222403 - DNA, 22 bp, Artificial Sequence
  Synthetic oligonucleotide; TTT chr2 60483628 60483649 60483633 60483628 -
gatgtttcctggggacgagcat

SEQ ID NO: 222404 - DNA, 22 bp, Artificial Sequence
  Synthetic oligonucleotide; TTG chr2 60483627 60483648 60483632 60483627 -
atgtttcctggggacgagcatc

SEQ ID NO: 222405 - DNA, 22 bp, Artificial Sequence
  Synthetic oligonucleotide; TTT chr2 60483621 60483642 60483626 60483621 -
cctggggacgagcatcctctct

SEQ ID NO: 222406 - DNA, 22 bp, Artificial Sequence
  Synthetic oligonucleotide; TTC chr2 60483620 60483641 60483625 60483620 -
ctggggacgagcatcctctctt

SEQ ID NO: 222407 - DNA, 22 bp, Artificial Sequence
  Synthetic oligonucleotide; CTG chr2 60483617 60483638 60483622 60483617 -
gggacgagcatcctctcttgag

SEQ ID NO: 222408 - DNA, 22 bp, Artificial Sequence
  Synthetic oligonucleotide; CTC chr2 60483602 60483623 60483607 60483602 -
tcttgagttatttctgacaact

SEQ ID NO: 222409 - DNA, 22 bp, Artificial Sequence
  Synthetic oligonucleotide; CTC chr2 60483600 60483621 60483605 60483600 -
ttgagttatttctgacaactgc

SEQ ID NO: 222410 - DNA, 22 bp, Artificial Sequence
  Synthetic oligonucleotide; CTT chr2 60483598 60483619 60483603 60483598 -
gagttatttctgacaactgcag

SEQ ID NO: 222411 - DNA, 22 bp, Artificial Sequence
  Synthetic oligonucleotide; TTG chr2 60483597 60483618 60483602 60483597 -
agttatttctgacaactgcagc

SEQ ID NO: 222412 - DNA, 22 bp, Artificial Sequence
  Synthetic oligonucleotide; TTA chr2 60483592 60483613 60483597 60483592 -
tttctgacaactgcagcattcc

SEQ ID NO: 222413 - DNA, 22 bp, Artificial Sequence
  Synthetic oligonucleotide; TTT chr2 60483589 60483610 60483594 60483589 -
ctgacaactgcagcattccaca

SEQ ID NO: 222414 - DNA, 22 bp, Artificial Sequence
  Synthetic oligonucleotide; TTC chr2 60483588 60483609 60483593 60483588 -
tgacaactgcagcattccacag

SEQ ID NO: 222415 - DNA, 22 bp, Artificial Sequence
  Synthetic oligonucleotide; CTG chr2 60483586 60483607 60483591 60483586 -
acaactgcagcattccacaggg

SEQ ID NO: 222416 - DNA, 22 bp, Artificial Sequence
  Synthetic oligonucleotide; CTG chr2 60483579 60483600 60483584 60483579 -
cagcattccacagggtctgagt

SEQ ID NO: 222417 - DNA, 22 bp, Artificial Sequence
  Synthetic oligonucleotide; TTC chr2 60483571 60483592 60483576 60483571 -
cacagggtctgagttgttgaac

SEQ ID NO: 222418 - DNA, 22 bp, Artificial Sequence
  Synthetic oligonucleotide; CTG chr2 60483560 60483581 60483565 60483560 -
agttgttgaacacagtgcccta

SEQ ID NO: 222419 - DNA, 22 bp, Artificial Sequence
  Synthetic oligonucleotide; TTG chr2 60483555 60483576 60483560 60483555 -
ttgaacacagtgccctaactta

SEQ ID NO: 222420 - DNA, 22 bp, Artificial Sequence
  Synthetic oligonucleotide; TTG chr2 60483552 60483573 60483557 60483552 -
aacacagtgccctaacttaaat

SEQ ID NO: 222421 - DNA, 22 bp, Artificial Sequence
  Synthetic oligonucleotide; CTA chr2 60483538 60483559 60483543 60483538 -
acttaaatattacaatcaaaac

SEQ ID NO: 222422 - DNA, 22 bp, Artificial Sequence
  Synthetic oligonucleotide; CTT chr2 60483534 60483555 60483539 60483534 -
aaatattacaatcaaaacacat

SEQ ID NO: 222423 - DNA, 22 bp, Artificial Sequence
  Synthetic oligonucleotide; TTA chr2 60483533 60483554 60483538 60483533 -
aatattacaatcaaaacacatg

SEQ ID NO: 222424 - DNA, 22 bp, Artificial Sequence
  Synthetic oligonucleotide; TTA chr2 60483526 60483547 60483531 60483526 -
caatcaaaacacatgacataga

SEQ ID NO: 222425 - DNA, 22 bp, Artificial Sequence
  Synthetic oligonucleotide; TTG chr2 60483495 60483516 60483500 60483495 -
atttgggttctgccttggacag

SEQ ID NO: 222426 - DNA, 22 bp, Artificial Sequence
  Synthetic oligonucleotide; TTT chr2 60483491 60483512 60483496 60483491 -
gggttctgccttggacagagaa

SEQ ID NO: 222427 - DNA, 22 bp, Artificial Sequence
  Synthetic oligonucleotide; TTG chr2 60483490 60483511 60483495 60483490 -
ggttctgccttggacagagaaa

SEQ ID NO: 222428 - DNA, 22 bp, Artificial Sequence
  Synthetic oligonucleotide; TTC chr2 60483485 60483506 60483490 60483485 -
tgccttggacagagaaacagac

SEQ ID NO: 222429 - DNA, 22 bp, Artificial Sequence
  Synthetic oligonucleotide; CTG chr2 60483483 60483504 60483488 60483483 -
ccttggacagagaaacagactg

SEQ ID NO: 222430 - DNA, 22 bp, Artificial Sequence
  Synthetic oligonucleotide; CTT chr2 60483479 60483500 60483484 60483479 -
ggacagagaaacagactggggc

SEQ ID NO: 222431 - DNA, 22 bp, Artificial Sequence
  Synthetic oligonucleotide; TTG chr2 60483478 60483499 60483483 60483478 -
gacagagaaacagactggggct

SEQ ID NO: 222432 - DNA, 22 bp, Artificial Sequence
  Synthetic oligonucleotide; CTG chr2 60483461 60483482 60483466 60483461 -
gggctaaagggactgcagctat

SEQ ID NO: 222433 - DNA, 22 bp, Artificial Sequence
  Synthetic oligonucleotide; CTA chr2 60483455 60483476 60483460 60483455 -
aagggactgcagctatacctgg

SEQ ID NO: 222434 - DNA, 22 bp, Artificial Sequence
  Synthetic oligonucleotide; CTG chr2 60483446 60483467 60483451 60483446 -
cagctatacctggggacttgcc

SEQ ID NO: 222435 - DNA, 22 bp, Artificial Sequence
  Synthetic oligonucleotide; CTA chr2 60483440 60483461 60483445 60483440 -
tacctggggacttgcctgagat

SEQ ID NO: 222436 - DNA, 22 bp, Artificial Sequence
  Synthetic oligonucleotide; CTG chr2 60483434 60483455 60483439 60483434 -
gggacttgcctgagatcatctg

SEQ ID NO: 222437 - DNA, 22 bp, Artificial Sequence
  Synthetic oligonucleotide; CTT chr2 60483427 60483448 60483432 60483427 -
gcctgagatcatctgggacttg

SEQ ID NO: 222438 - DNA, 22 bp, Artificial Sequence
  Synthetic oligonucleotide; TTG chr2 60483426 60483447 60483431 60483426 -
cctgagatcatctgggacttgc

SEQ ID NO: 222439 - DNA, 22 bp, Artificial Sequence
  Synthetic oligonucleotide; CTG chr2 60483422 60483443 60483427 60483422 -
agatcatctgggacttgcctgg

SEQ ID NO: 222440 - DNA, 22 bp, Artificial Sequence
  Synthetic oligonucleotide; CTG chr2 60483412 60483433 60483417 60483412 -
ggacttgcctggtctcaagtct

SEQ ID NO: 222441 - DNA, 22 bp, Artificial Sequence
  Synthetic oligonucleotide; CTT chr2 60483406 60483427 60483411 60483406 -
gcctggtctcaagtcttctgac

SEQ ID NO: 222442 - DNA, 22 bp, Artificial Sequence
  Synthetic oligonucleotide; TTG chr2 60483405 60483426 60483410 60483405 -
cctggtctcaagtcttctgacc

SEQ ID NO: 222443 - DNA, 22 bp, Artificial Sequence
  Synthetic oligonucleotide; CTG chr2 60483401 60483422 60483406 60483401 -
gtctcaagtcttctgaccttgg

SEQ ID NO: 222444 - DNA, 22 bp, Artificial Sequence
  Synthetic oligonucleotide; CTC chr2 60483396 60483417 60483401 60483396 -
aagtcttctgaccttggccagg

SEQ ID NO: 222445 - DNA, 22 bp, Artificial Sequence
  Synthetic oligonucleotide; CTT chr2 60483389 60483410 60483394 60483389 -
ctgaccttggccagggatcttt

SEQ ID NO: 222446 - DNA, 22 bp, Artificial Sequence
  Synthetic oligonucleotide; TTC chr2 60483388 60483409 60483393 60483388 -
tgaccttggccagggatctttg

SEQ ID NO: 222447 - DNA, 22 bp, Artificial Sequence
  Synthetic oligonucleotide; CTG chr2 60483386 60483407 60483391 60483386 -
accttggccagggatctttgca

SEQ ID NO: 222448 - DNA, 22 bp, Artificial Sequence
  Synthetic oligonucleotide; CTT chr2 60483381 60483402 60483386 60483381 -
ggccagggatctttgcactggg

SEQ ID NO: 222449 - DNA, 22 bp, Artificial Sequence
  Synthetic oligonucleotide; TTG chr2 60483380 60483401 60483385 60483380 -
gccagggatctttgcactgggc

SEQ ID NO: 222450 - DNA, 22 bp, Artificial Sequence
  Synthetic oligonucleotide; CTT chr2 60483368 60483389 60483373 60483368 -
tgcactgggcaggggaatttga

SEQ ID NO: 222451 - DNA, 22 bp, Artificial Sequence
  Synthetic oligonucleotide; TTT chr2 60483367 60483388 60483372 60483367 -
gcactgggcaggggaatttgag

SEQ ID NO: 222452 - DNA, 22 bp, Artificial Sequence
  Synthetic oligonucleotide; TTG chr2 60483366 60483387 60483371 60483366 -
cactgggcaggggaatttgagt

SEQ ID NO: 222453 - DNA, 22 bp, Artificial Sequence
  Synthetic oligonucleotide; CTG chr2 60483361 60483382 60483366 60483361 -
ggcaggggaatttgagtcccaa

SEQ ID NO: 222454 - DNA, 22 bp, Artificial Sequence
  Synthetic oligonucleotide; TTT chr2 60483348 60483369 60483353 60483348 -
gagtcccaatttgaggcatcga

SEQ ID NO: 222455 - DNA, 22 bp, Artificial Sequence
  Synthetic oligonucleotide; TTG chr2 60483347 60483368 60483352 60483347 -
agtcccaatttgaggcatcgat

SEQ ID NO: 222456 - DNA, 22 bp, Artificial Sequence
  Synthetic oligonucleotide; TTT chr2 60483336 60483357 60483341 60483336 -
gaggcatcgatttaaaccactt

SEQ ID NO: 222457 - DNA, 22 bp, Artificial Sequence
  Synthetic oligonucleotide; TTG chr2 60483335 60483356 60483340 60483335 -
aggcatcgatttaaaccacttt

SEQ ID NO: 222458 - DNA, 22 bp, Artificial Sequence
  Synthetic oligonucleotide; TTT chr2 60483323 60483344 60483328 60483323 -
aaaccacttttcaaaggcctga

SEQ ID NO: 222459 - DNA, 22 bp, Artificial Sequence
  Synthetic oligonucleotide; TTA chr2 60483322 60483343 60483327 60483322 -
aaccacttttcaaaggcctgaa

SEQ ID NO: 222460 - DNA, 22 bp, Artificial Sequence
  Synthetic oligonucleotide; CTT chr2 60483314 60483335 60483319 60483314 -
ttcaaaggcctgaatggagctg

SEQ ID NO: 222461 - DNA, 22 bp, Artificial Sequence
  Synthetic oligonucleotide; TTT chr2 60483313 60483334 60483318 60483313 -
tcaaaggcctgaatggagctga

SEQ ID NO: 222462 - DNA, 22 bp, Artificial Sequence
  Synthetic oligonucleotide; TTT chr2 60483312 60483333 60483317 60483312 -
caaaggcctgaatggagctgat

SEQ ID NO: 222463 - DNA, 22 bp, Artificial Sequence
  Synthetic oligonucleotide; TTC chr2 60483311 60483332 60483316 60483311 -
aaaggcctgaatggagctgatt

SEQ ID NO: 222464 - DNA, 22 bp, Artificial Sequence
  Synthetic oligonucleotide; CTG chr2 60483302 60483323 60483307 60483302 -
aatggagctgattatttgtgtg

SEQ ID NO: 222465 - DNA, 22 bp, Artificial Sequence
  Synthetic oligonucleotide; CTG chr2 60483292 60483313 60483297 60483292 -
attatttgtgtgtcttcttttc

SEQ ID NO: 222466 - DNA, 22 bp, Artificial Sequence
  Synthetic oligonucleotide; TTA chr2 60483288 60483309 60483293 60483288 -
tttgtgtgtcttcttttcctgg

SEQ ID NO: 222467 - DNA, 22 bp, Artificial Sequence
  Synthetic oligonucleotide; TTT chr2 60483285 60483306 60483290 60483285 -
gtgtgtcttcttttcctggtct

SEQ ID NO: 222468 - DNA, 22 bp, Artificial Sequence
  Synthetic oligonucleotide; TTG chr2 60483284 60483305 60483289 60483284 -
tgtgtcttcttttcctggtctt

SEQ ID NO: 222469 - DNA, 22 bp, Artificial Sequence
  Synthetic oligonucleotide; CTT chr2 60483276 60483297 60483281 60483276 -
cttttcctggtcttccccttgt

SEQ ID NO: 222470 - DNA, 22 bp, Artificial Sequence
  Synthetic oligonucleotide; TTC chr2 60483275 60483296 60483280 60483275 -
ttttcctggtcttccccttgtc

SEQ ID NO: 222471 - DNA, 22 bp, Artificial Sequence
  Synthetic oligonucleotide; CTT chr2 60483273 60483294 60483278 60483273 -
ttcctggtcttccccttgtcaa

SEQ ID NO: 222472 - DNA, 22 bp, Artificial Sequence
  Synthetic oligonucleotide; TTT chr2 60483272 60483293 60483277 60483272 -
tcctggtcttccccttgtcaag

SEQ ID NO: 222473 - DNA, 22 bp, Artificial Sequence
  Synthetic oligonucleotide; TTT chr2 60483271 60483292 60483276 60483271 -
cctggtcttccccttgtcaaga

SEQ ID NO: 222474 - DNA, 22 bp, Artificial Sequence
  Synthetic oligonucleotide; TTC chr2 60483270 60483291 60483275 60483270 -
ctggtcttccccttgtcaagac

SEQ ID NO: 222475 - DNA, 22 bp, Artificial Sequence
  Synthetic oligonucleotide; CTG chr2 60483267 60483288 60483272 60483267 -
gtcttccccttgtcaagaccat

SEQ ID NO: 222476 - DNA, 22 bp, Artificial Sequence
  Synthetic oligonucleotide; CTT chr2 60483262 60483283 60483267 60483262 -
ccccttgtcaagaccatttctc

SEQ ID NO: 222477 - DNA, 22 bp, Artificial Sequence
  Synthetic oligonucleotide; TTC chr2 60483261 60483282 60483266 60483261 -
cccttgtcaagaccatttctct

SEQ ID NO: 222478 - DNA, 22 bp, Artificial Sequence
  Synthetic oligonucleotide; CTT chr2 60483256 60483277 60483261 60483256 -
gtcaagaccatttctctaccac

SEQ ID NO: 222479 - DNA, 22 bp, Artificial Sequence
  Synthetic oligonucleotide; TTG chr2 60483255 60483276 60483260 60483255 -
tcaagaccatttctctaccacg

SEQ ID NO: 222480 - DNA, 22 bp, Artificial Sequence
  Synthetic oligonucleotide; TTT chr2 60483243 60483264 60483248 60483243 -
ctctaccacgggatatatatta

SEQ ID NO: 222481 - DNA, 22 bp, Artificial Sequence
  Synthetic oligonucleotide; TTC chr2 60483242 60483263 60483247 60483242 -
tctaccacgggatatatattag

SEQ ID NO: 222482 - DNA, 22 bp, Artificial Sequence
  Synthetic oligonucleotide; CTC chr2 60483240 60483261 60483245 60483240 -
taccacgggatatatattagag

SEQ ID NO: 222483 - DNA, 22 bp, Artificial Sequence
  Synthetic oligonucleotide; CTA chr2 60483238 60483259 60483243 60483238 -
ccacgggatatatattagaggg

SEQ ID NO: 222484 - DNA, 22 bp, Artificial Sequence
  Synthetic oligonucleotide; TTA chr2 60483221 60483242 60483226 60483221 -
gaggggaaaacggctgtaaacc

SEQ ID NO: 222485 - DNA, 22 bp, Artificial Sequence
  Synthetic oligonucleotide; CTG chr2 60483205 60483226 60483210 60483205 -
taaaccctgattgttggctagc

SEQ ID NO: 222486 - DNA, 22 bp, Artificial Sequence
  Synthetic oligonucleotide; CTG chr2 60483196 60483217 60483201 60483196 -
attgttggctagcattgttcag

SEQ ID NO: 222487 - DNA, 22 bp, Artificial Sequence
  Synthetic oligonucleotide; TTG chr2 60483192 60483213 60483197 60483192 -
ttggctagcattgttcaggaag

SEQ ID NO: 222488 - DNA, 22 bp, Artificial Sequence
  Synthetic oligonucleotide; TTG chr2 60483189 60483210 60483194 60483189 -
gctagcattgttcaggaagtgt

SEQ ID NO: 222489 - DNA, 22 bp, Artificial Sequence
  Synthetic oligonucleotide; CTA chr2 60483185 60483206 60483190 60483185 -
gcattgttcaggaagtgtagca

SEQ ID NO: 222490 - DNA, 22 bp, Artificial Sequence
  Synthetic oligonucleotide; TTG chr2 60483179 60483200 60483184 60483179 -
ttcaggaagtgtagcattaagg

SEQ ID NO: 222491 - DNA, 22 bp, Artificial Sequence
  Synthetic oligonucleotide; TTC chr2 60483176 60483197 60483181 60483176 -
aggaagtgtagcattaaggagc

SEQ ID NO: 222492 - DNA, 22 bp, Artificial Sequence
  Synthetic oligonucleotide; TTA chr2 60483160 60483181 60483165 60483160 -
aggagcaacacttctctcgcct

SEQ ID NO: 222493 - DNA, 22 bp, Artificial Sequence
  Synthetic oligonucleotide; CTT chr2 60483147 60483168 60483152 60483147 -
ctctcgcctgtgttgattctcc

SEQ ID NO: 222494 - DNA, 22 bp, Artificial Sequence
  Synthetic oligonucleotide; TTC chr2 60483146 60483167 60483151 60483146 -
tctcgcctgtgttgattctcct

SEQ ID NO: 222495 - DNA, 22 bp, Artificial Sequence
  Synthetic oligonucleotide; CTC chr2 60483144 60483165 60483149 60483144 -
tcgcctgtgttgattctcctcc

SEQ ID NO: 222496 - DNA, 22 bp, Artificial Sequence
  Synthetic oligonucleotide; CTC chr2 60483142 60483163 60483147 60483142 -
gcctgtgttgattctcctccaa

SEQ ID NO: 222497 - DNA, 22 bp, Artificial Sequence
  Synthetic oligonucleotide; CTG chr2 60483137 60483158 60483142 60483137 -
tgttgattctcctccaactacc

SEQ ID NO: 222498 - DNA, 22 bp, Artificial Sequence
  Synthetic oligonucleotide; TTG chr2 60483132 60483153 60483137 60483132 -
attctcctccaactacccacac

SEQ ID NO: 222499 - DNA, 22 bp, Artificial Sequence
  Synthetic oligonucleotide; TTC chr2 60483128 60483149 60483133 60483128 -
tcctccaactacccacactatc

SEQ ID NO: 222500 - DNA, 22 bp, Artificial Sequence
  Synthetic oligonucleotide; CTC chr2 60483126 60483147 60483131 60483126 -
ctccaactacccacactatcct

SEQ ID NO: 222501 - DNA, 22 bp, Artificial Sequence
  Synthetic oligonucleotide; CTC chr2 60483123 60483144 60483128 60483123 -
caactacccacactatccttgc

SEQ ID NO: 222502 - DNA, 22 bp, Artificial Sequence
  Synthetic oligonucleotide; CTA chr2 60483117 60483138 60483122 60483117 -
cccacactatccttgcagttat

SEQ ID NO: 222503 - DNA, 22 bp, Artificial Sequence
  Synthetic oligonucleotide; CTA chr2 60483108 60483129 60483113 60483108 -
tccttgcagttattcatgggaa

SEQ ID NO: 222504 - DNA, 22 bp, Artificial Sequence
  Synthetic oligonucleotide; CTT chr2 60483103 60483124 60483108 60483103 -
gcagttattcatgggaaataat

SEQ ID NO: 222505 - DNA, 22 bp, Artificial Sequence
  Synthetic oligonucleotide; TTG chr2 60483102 60483123 60483107 60483102 -
cagttattcatgggaaataata

SEQ ID NO: 222506 - DNA, 22 bp, Artificial Sequence
  Synthetic oligonucleotide; TTA chr2 60483096 60483117 60483101 60483096 -
ttcatgggaaataatataaatc

SEQ ID NO: 222507 - DNA, 22 bp, Artificial Sequence
  Synthetic oligonucleotide; TTC chr2 60483093 60483114 60483098 60483093 -
atgggaaataatataaatcaca

SEQ ID NO: 222508 - DNA, 22 bp, Artificial Sequence
  Synthetic oligonucleotide; CTG chr2 60483068 60483089 60483073 60483068 -
cctgattcttctcaaacatctc

SEQ ID NO: 222509 - DNA, 22 bp, Artificial Sequence
  Synthetic oligonucleotide; CTG chr2 60483064 60483085 60483069 60483064 -
attcttctcaaacatctcgcaa

SEQ ID NO: 222510 - DNA, 22 bp, Artificial Sequence
  Synthetic oligonucleotide; TTC chr2 60483060 60483081 60483065 60483060 -
ttctcaaacatctcgcaaagta

SEQ ID NO: 222511 - DNA, 22 bp, Artificial Sequence
  Synthetic oligonucleotide; CTT chr2 60483058 60483079 60483063 60483058 -
ctcaaacatctcgcaaagtaat

SEQ ID NO: 222512 - DNA, 22 bp, Artificial Sequence
  Synthetic oligonucleotide; TTC chr2 60483057 60483078 60483062 60483057 -
tcaaacatctcgcaaagtaatc

SEQ ID NO: 222513 - DNA, 22 bp, Artificial Sequence
  Synthetic oligonucleotide; CTC chr2 60483055 60483076 60483060 60483055 -
aaacatctcgcaaagtaatcat

SEQ ID NO: 222514 - DNA, 22 bp, Artificial Sequence
  Synthetic oligonucleotide; CTC chr2 60483046 60483067 60483051 60483046 -
gcaaagtaatcatgggctgaag

SEQ ID NO: 222515 - DNA, 22 bp, Artificial Sequence
  Synthetic oligonucleotide; CTG chr2 60483027 60483048 60483032 60483027 -
aagtgcaggttttcttgcagtg

SEQ ID NO: 222516 - DNA, 22 bp, Artificial Sequence
  Synthetic oligonucleotide; TTT chr2 60483015 60483036 60483020 60483015 -
tcttgcagtgcctttatcagta

SEQ ID NO: 222517 - DNA, 22 bp, Artificial Sequence
  Synthetic oligonucleotide; TTT chr2 60483014 60483035 60483019 60483014 -
cttgcagtgcctttatcagtaa

SEQ ID NO: 222518 - DNA, 22 bp, Artificial Sequence
  Synthetic oligonucleotide; TTC chr2 60483013 60483034 60483018 60483013 -
ttgcagtgcctttatcagtaaa

SEQ ID NO: 222519 - DNA, 22 bp, Artificial Sequence
  Synthetic oligonucleotide; CTT chr2 60483011 60483032 60483016 60483011 -
gcagtgcctttatcagtaaatc

SEQ ID NO: 222520 - DNA, 22 bp, Artificial Sequence
  Synthetic oligonucleotide; TTG chr2 60483010 60483031 60483015 60483010 -
cagtgcctttatcagtaaatca

SEQ ID NO: 222521 - DNA, 22 bp, Artificial Sequence
  Synthetic oligonucleotide; CTT chr2 60483001 60483022 60483006 60483001 -
tatcagtaaatcagattttgag

SEQ ID NO: 222522 - DNA, 22 bp, Artificial Sequence
  Synthetic oligonucleotide; TTT chr2 60483000 60483021 60483005 60483000 -
atcagtaaatcagattttgagc

SEQ ID NO: 222523 - DNA, 22 bp, Artificial Sequence
  Synthetic oligonucleotide; TTA chr2 60482999 60483020 60483004 60482999 -
tcagtaaatcagattttgagca

SEQ ID NO: 222524 - DNA, 22 bp, Artificial Sequence
  Synthetic oligonucleotide; TTT chr2 60482983 60483004 60482988 60482983 -
tgagcatttatcagcaaaagtt

SEQ ID NO: 222525 - DNA, 22 bp, Artificial Sequence
  Synthetic oligonucleotide; TTT chr2 60482982 60483003 60482987 60482982 -
gagcatttatcagcaaaagtta

SEQ ID NO: 222526 - DNA, 22 bp, Artificial Sequence
  Synthetic oligonucleotide; TTG chr2 60482981 60483002 60482986 60482981 -
agcatttatcagcaaaagttag

SEQ ID NO: 222527 - DNA, 22 bp, Artificial Sequence
  Synthetic oligonucleotide; TTT chr2 60482974 60482995 60482979 60482974 -
atcagcaaaagttagacttaaa

SEQ ID NO: 222528 - DNA, 22 bp, Artificial Sequence
  Synthetic oligonucleotide; TTA chr2 60482973 60482994 60482978 60482973 -
tcagcaaaagttagacttaaac

SEQ ID NO: 222529 - DNA, 22 bp, Artificial Sequence
  Synthetic oligonucleotide; TTA chr2 60482960 60482981 60482965 60482960 -
gacttaaacatcatcatttctg

SEQ ID NO: 222530 - DNA, 22 bp, Artificial Sequence
  Synthetic oligonucleotide; CTT chr2 60482955 60482976 60482960 60482955 -
aaacatcatcatttctgtaatg

SEQ ID NO: 222531 - DNA, 22 bp, Artificial Sequence
  Synthetic oligonucleotide; TTA chr2 60482954 60482975 60482959 60482954 -
aacatcatcatttctgtaatgt

SEQ ID NO: 222532 - DNA, 22 bp, Artificial Sequence
  Synthetic oligonucleotide; TTT chr2 60482941 60482962 60482946 60482941 -
ctgtaatgtttgaaagaaagat

SEQ ID NO: 222533 - DNA, 22 bp, Artificial Sequence
  Synthetic oligonucleotide; TTC chr2 60482940 60482961 60482945 60482940 -
tgtaatgtttgaaagaaagatt

SEQ ID NO: 222534 - DNA, 22 bp, Artificial Sequence
  Synthetic oligonucleotide; CTG chr2 60482938 60482959 60482943 60482938 -
taatgtttgaaagaaagatttg

SEQ ID NO: 222535 - DNA, 22 bp, Artificial Sequence
  Synthetic oligonucleotide; TTT chr2 60482930 60482951 60482935 60482930 -
gaaagaaagatttgtttcagtg

SEQ ID NO: 222536 - DNA, 22 bp, Artificial Sequence
  Synthetic oligonucleotide; TTG chr2 60482929 60482950 60482934 60482929 -
aaagaaagatttgtttcagtgg

SEQ ID NO: 222537 - DNA, 22 bp, Artificial Sequence
  Synthetic oligonucleotide; TTT chr2 60482917 60482938 60482922 60482917 -
gtttcagtggggactctgccaa

SEQ ID NO: 222538 - DNA, 22 bp, Artificial Sequence
  Synthetic oligonucleotide; TTG chr2 60482916 60482937 60482921 60482916 -
tttcagtggggactctgccaat

SEQ ID NO: 222539 - DNA, 22 bp, Artificial Sequence
  Synthetic oligonucleotide; TTT chr2 60482913 60482934 60482918 60482913 -
cagtggggactctgccaatcaa

SEQ ID NO: 222540 - DNA, 22 bp, Artificial Sequence
  Synthetic oligonucleotide; TTC chr2 60482912 60482933 60482917 60482912 -
agtggggactctgccaatcaat

SEQ ID NO: 222541 - DNA, 22 bp, Artificial Sequence
  Synthetic oligonucleotide; CTC chr2 60482901 60482922 60482906 60482901 -
tgccaatcaatgatcttccagc

SEQ ID NO: 222542 - DNA, 22 bp, Artificial Sequence
  Synthetic oligonucleotide; CTG chr2 60482899 60482920 60482904 60482899 -
ccaatcaatgatcttccagctt

SEQ ID NO: 222543 - DNA, 22 bp, Artificial Sequence
  Synthetic oligonucleotide; CTT chr2 60482884 60482905 60482889 60482884 -
ccagcttgactctgctatcaat

SEQ ID NO: 222544 - DNA, 22 bp, Artificial Sequence
  Synthetic oligonucleotide; TTC chr2 60482883 60482904 60482888 60482883 -
cagcttgactctgctatcaatt

SEQ ID NO: 222545 - DNA, 22 bp, Artificial Sequence
  Synthetic oligonucleotide; CTT chr2 60482877 60482898 60482882 60482877 -
gactctgctatcaattattgct

SEQ ID NO: 222546 - DNA, 22 bp, Artificial Sequence
  Synthetic oligonucleotide; TTG chr2 60482876 60482897 60482881 60482876 -
actctgctatcaattattgctg

SEQ ID NO: 222547 - DNA, 22 bp, Artificial Sequence
  Synthetic oligonucleotide; CTC chr2 60482872 60482893 60482877 60482872 -
tgctatcaattattgctgcaat

SEQ ID NO: 222548 - DNA, 22 bp, Artificial Sequence
  Synthetic oligonucleotide; CTG chr2 60482870 60482891 60482875 60482870 -
ctatcaattattgctgcaatta

SEQ ID NO: 222549 - DNA, 22 bp, Artificial Sequence
  Synthetic oligonucleotide; CTA chr2 60482867 60482888 60482872 60482867 -
tcaattattgctgcaattattt

SEQ ID NO: 222550 - DNA, 22 bp, Artificial Sequence
  Synthetic oligonucleotide; TTA chr2 60482860 60482881 60482865 60482860 -
ttgctgcaattatttgtctagt

SEQ ID NO: 222551 - DNA, 22 bp, Artificial Sequence
  Synthetic oligonucleotide; TTG chr2 60482857 60482878 60482862 60482857 -
ctgcaattatttgtctagttgg

SEQ ID NO: 222552 - DNA, 22 bp, Artificial Sequence
  Synthetic oligonucleotide; CTG chr2 60482854 60482875 60482859 60482854 -
caattatttgtctagttggata

SEQ ID NO: 222553 - DNA, 22 bp, Artificial Sequence
  Synthetic oligonucleotide; TTA chr2 60482848 60482869 60482853 60482848 -
tttgtctagttggatatttaaa

SEQ ID NO: 222554 - DNA, 22 bp, Artificial Sequence
  Synthetic oligonucleotide; TTT chr2 60482845 60482866 60482850 60482845 -
gtctagttggatatttaaaatg

SEQ ID NO: 222555 - DNA, 22 bp, Artificial Sequence
  Synthetic oligonucleotide; TTG chr2 60482844 60482865 60482849 60482844 -
tctagttggatatttaaaatgt

SEQ ID NO: 222556 - DNA, 22 bp, Artificial Sequence
  Synthetic oligonucleotide; CTA chr2 60482840 60482861 60482845 60482840 -
gttggatatttaaaatgtcatc

SEQ ID NO: 222557 - DNA, 22 bp, Artificial Sequence
  Synthetic oligonucleotide; TTG chr2 60482836 60482857 60482841 60482836 -
gatatttaaaatgtcatcagaa

SEQ ID NO: 222558 - DNA, 22 bp, Artificial Sequence
  Synthetic oligonucleotide; TTT chr2 60482829 60482850 60482834 60482829 -
aaaatgtcatcagaaagagatg

SEQ ID NO: 222559 - DNA, 22 bp, Artificial Sequence
  Synthetic oligonucleotide; TTA chr2 60482828 60482849 60482833 60482828 -
aaatgtcatcagaaagagatga

SEQ ID NO: 222560 - DNA, 22 bp, Artificial Sequence
  Synthetic oligonucleotide; TTA chr2 60482803 60482824 60482808 60482803 -
cacattctagaaagcaaggcac

SEQ ID NO: 222561 - DNA, 22 bp, Artificial Sequence
  Synthetic oligonucleotide; TTC chr2 60482796 60482817 60482801 60482796 -
tagaaagcaaggcactgtataa

SEQ ID NO: 222562 - DNA, 22 bp, Artificial Sequence
  Synthetic oligonucleotide; CTA chr2 60482794 60482815 60482799 60482794 -
gaaagcaaggcactgtataatc

SEQ ID NO: 222563 - DNA, 22 bp, Artificial Sequence
  Synthetic oligonucleotide; CTG chr2 60482779 60482800 60482784 60482779 -
tataatcacatgaactgaatcc

SEQ ID NO: 222564 - DNA, 22 bp, Artificial Sequence
  Synthetic oligonucleotide; CTG chr2 60482762 60482783 60482767 60482762 -
aatccagttaaatgtagtgtgg

SEQ ID NO: 222565 - DNA, 22 bp, Artificial Sequence
  Synthetic oligonucleotide; TTA chr2 60482752 60482773 60482757 60482752 -
aatgtagtgtggtactaacctg

SEQ ID NO: 222566 - DNA, 22 bp, Artificial Sequence
  Synthetic oligonucleotide; CTA chr2 60482735 60482756 60482740 60482735 -
acctgtccttcaaaatagaatt

SEQ ID NO: 222567 - DNA, 22 bp, Artificial Sequence
  Synthetic oligonucleotide; CTG chr2 60482730 60482751 60482735 60482730 -
tccttcaaaatagaatttttga

SEQ ID NO: 222568 - DNA, 22 bp, Artificial Sequence
  Synthetic oligonucleotide; CTT chr2 60482725 60482746 60482730 60482725 -
caaaatagaatttttgagctac

SEQ ID NO: 222569 - DNA, 22 bp, Artificial Sequence
  Synthetic oligonucleotide; TTC chr2 60482724 60482745 60482729 60482724 -
aaaatagaatttttgagctacc

SEQ ID NO: 222570 - DNA, 22 bp, Artificial Sequence
  Synthetic oligonucleotide; TTT chr2 60482712 60482733 60482717 60482712 -
ttgagctaccactgaagcagca

SEQ ID NO: 222571 - DNA, 22 bp, Artificial Sequence
  Synthetic oligonucleotide; TTT chr2 60482711 60482732 60482716 60482711 -
tgagctaccactgaagcagcag

SEQ ID NO: 222572 - DNA, 22 bp, Artificial Sequence
  Synthetic oligonucleotide; TTT chr2 60482710 60482731 60482715 60482710 -
gagctaccactgaagcagcagt

SEQ ID NO: 222573 - DNA, 22 bp, Artificial Sequence
  Synthetic oligonucleotide; TTG chr2 60482709 60482730 60482714 60482709 -
agctaccactgaagcagcagtc

SEQ ID NO: 222574 - DNA, 22 bp, Artificial Sequence
  Synthetic oligonucleotide; CTA chr2 60482704 60482725 60482709 60482704 -
ccactgaagcagcagtcttctg

SEQ ID NO: 222575 - DNA, 22 bp, Artificial Sequence
  Synthetic oligonucleotide; CTG chr2 60482698 60482719 60482703 60482698 -
aagcagcagtcttctgccctgt

SEQ ID NO: 222576 - DNA, 22 bp, Artificial Sequence
  Synthetic oligonucleotide; CTT chr2 60482685 60482706 60482690 60482685 -
ctgccctgttttcaggaagctg

SEQ ID NO: 222577 - DNA, 22 bp, Artificial Sequence
  Synthetic oligonucleotide; TTC chr2 60482684 60482705 60482689 60482684 -
tgccctgttttcaggaagctga

SEQ ID NO: 222578 - DNA, 22 bp, Artificial Sequence
  Synthetic oligonucleotide; CTG chr2 60482682 60482703 60482687 60482682 -
ccctgttttcaggaagctgatc

SEQ ID NO: 222579 - DNA, 22 bp, Artificial Sequence
  Synthetic oligonucleotide; CTG chr2 60482677 60482698 60482682 60482677 -
ttttcaggaagctgatcttaac

SEQ ID NO: 222580 - DNA, 22 bp, Artificial Sequence
  Synthetic oligonucleotide; TTT chr2 60482674 60482695 60482679 60482674 -
tcaggaagctgatcttaacctt

SEQ ID NO: 222581 - DNA, 22 bp, Artificial Sequence
  Synthetic oligonucleotide; TTT chr2 60482673 60482694 60482678 60482673 -
caggaagctgatcttaaccttg

SEQ ID NO: 222582 - DNA, 22 bp, Artificial Sequence
  Synthetic oligonucleotide; TTC chr2 60482672 60482693 60482677 60482672 -
aggaagctgatcttaaccttgg

SEQ ID NO: 222583 - DNA, 22 bp, Artificial Sequence
  Synthetic oligonucleotide; CTG chr2 60482663 60482684 60482668 60482663 -
atcttaaccttgggatgcagtg

SEQ ID NO: 222584 - DNA, 22 bp, Artificial Sequence
  Synthetic oligonucleotide; CTT chr2 60482658 60482679 60482663 60482658 -
aaccttgggatgcagtgtgctt

SEQ ID NO: 222585 - DNA, 22 bp, Artificial Sequence
  Synthetic oligonucleotide; TTA chr2 60482657 60482678 60482662 60482657 -
accttgggatgcagtgtgcttt

SEQ ID NO: 222586 - DNA, 22 bp, Artificial Sequence
  Synthetic oligonucleotide; CTT chr2 60482652 60482673 60482657 60482652 -
gggatgcagtgtgctttcaggg

SEQ ID NO: 222587 - DNA, 22 bp, Artificial Sequence
  Synthetic oligonucleotide; TTG chr2 60482651 60482672 60482656 60482651 -
ggatgcagtgtgctttcagggt

SEQ ID NO: 222588 - DNA, 22 bp, Artificial Sequence
  Synthetic oligonucleotide; CTT chr2 60482636 60482657 60482641 60482636 -
tcagggttgggtgatacttaat

SEQ ID NO: 222589 - DNA, 22 bp, Artificial Sequence
  Synthetic oligonucleotide; TTT chr2 60482635 60482656 60482640 60482635 -
cagggttgggtgatacttaatt

SEQ ID NO: 222590 - DNA, 22 bp, Artificial Sequence
  Synthetic oligonucleotide; TTC chr2 60482634 60482655 60482639 60482634 -
agggttgggtgatacttaatta

SEQ ID NO: 222591 - DNA, 22 bp, Artificial Sequence
  Synthetic oligonucleotide; TTG chr2 60482627 60482648 60482632 60482627 -
ggtgatacttaattatggagaa

SEQ ID NO: 222592 - DNA, 22 bp, Artificial Sequence
  Synthetic oligonucleotide; CTT chr2 60482617 60482638 60482622 60482617 -
aattatggagaactttccaagt

SEQ ID NO: 222593 - DNA, 22 bp, Artificial Sequence
  Synthetic oligonucleotide; TTA chr2 60482616 60482637 60482621 60482616 -
attatggagaactttccaagtc

SEQ ID NO: 222594 - DNA, 22 bp, Artificial Sequence
  Synthetic oligonucleotide; TTA chr2 60482612 60482633 60482617 60482612 -
tggagaactttccaagtctgaa

SEQ ID NO: 222595 - DNA, 22 bp, Artificial Sequence
  Synthetic oligonucleotide; CTT chr2 60482602 60482623 60482607 60482602 -
tccaagtctgaaaatggaattg

SEQ ID NO: 222596 - DNA, 22 bp, Artificial Sequence
  Synthetic oligonucleotide; TTT chr2 60482601 60482622 60482606 60482601 -
ccaagtctgaaaatggaattgc

SEQ ID NO: 222597 - DNA, 22 bp, Artificial Sequence
  Synthetic oligonucleotide; TTC chr2 60482600 60482621 60482605 60482600 -
caagtctgaaaatggaattgct

SEQ ID NO: 222598 - DNA, 22 bp, Artificial Sequence
  Synthetic oligonucleotide; CTG chr2 60482592 60482613 60482597 60482592 -
aaaatggaattgctccttcaca

SEQ ID NO: 222599 - DNA, 22 bp, Artificial Sequence
  Synthetic oligonucleotide; TTG chr2 60482580 60482601 60482585 60482580 -
ctccttcacatacgcgagaagt

SEQ ID NO: 222600 - DNA, 22 bp, Artificial Sequence
  Synthetic oligonucleotide; CTC chr2 60482577 60482598 60482582 60482577 -
cttcacatacgcgagaagtgca

SEQ ID NO: 222601 - DNA, 22 bp, Artificial Sequence
  Synthetic oligonucleotide; CTT chr2 60482574 60482595 60482579 60482574 -
cacatacgcgagaagtgcattt

SEQ ID NO: 222602 - DNA, 22 bp, Artificial Sequence
  Synthetic oligonucleotide; TTC chr2 60482573 60482594 60482578 60482573 -
acatacgcgagaagtgcatttt

SEQ ID NO: 222603 - DNA, 22 bp, Artificial Sequence
  Synthetic oligonucleotide; TTT chr2 60482552 60482573 60482557 60482552 -
tggttatctcattcatctgcaa

SEQ ID NO: 222604 - DNA, 22 bp, Artificial Sequence
  Synthetic oligonucleotide; TTT chr2 60482551 60482572 60482556 60482551 -
ggttatctcattcatctgcaaa

SEQ ID NO: 222605 - DNA, 22 bp, Artificial Sequence
  Synthetic oligonucleotide; TTG chr2 60482550 60482571 60482555 60482550 -
gttatctcattcatctgcaaat

SEQ ID NO: 222606 - DNA, 22 bp, Artificial Sequence
  Synthetic oligonucleotide; TTA chr2 60482546 60482567 60482551 60482546 -
tctcattcatctgcaaatctat

SEQ ID NO: 222607 - DNA, 22 bp, Artificial Sequence
  Synthetic oligonucleotide; CTC chr2 60482542 60482563 60482547 60482542 -
attcatctgcaaatctataaat

SEQ ID NO: 222608 - DNA, 22 bp, Artificial Sequence
  Synthetic oligonucleotide; TTC chr2 60482538 60482559 60482543 60482538 -
atctgcaaatctataaataagc

SEQ ID NO: 222609 - DNA, 22 bp, Artificial Sequence
  Synthetic oligonucleotide; CTG chr2 60482533 60482554 60482538 60482533 -
caaatctataaataagcagtcc

SEQ ID NO: 222610 - DNA, 22 bp, Artificial Sequence
  Synthetic oligonucleotide; CTA chr2 60482525 60482546 60482530 60482525 -
taaataagcagtccctctattc

SEQ ID NO: 222611 - DNA, 22 bp, Artificial Sequence
  Synthetic oligonucleotide; CTC chr2 60482508 60482529 60482513 60482508 -
tattcttcttgcttcctgtgga

SEQ ID NO: 222612 - DNA, 22 bp, Artificial Sequence
  Synthetic oligonucleotide; CTA chr2 60482506 60482527 60482511 60482506 -
ttcttcttgcttcctgtggatt

SEQ ID NO: 222613 - DNA, 22 bp, Artificial Sequence
  Synthetic oligonucleotide; TTC chr2 60482503 60482524 60482508 60482503 -
ttcttgcttcctgtggatttaa

SEQ ID NO: 222614 - DNA, 22 bp, Artificial Sequence
  Synthetic oligonucleotide; CTT chr2 60482501 60482522 60482506 60482501 -
cttgcttcctgtggatttaaat

SEQ ID NO: 222615 - DNA, 22 bp, Artificial Sequence
  Synthetic oligonucleotide; TTC chr2 60482500 60482521 60482505 60482500 -
ttgcttcctgtggatttaaatg

SEQ ID NO: 222616 - DNA, 22 bp, Artificial Sequence
  Synthetic oligonucleotide; CTT chr2 60482498 60482519 60482503 60482498 -
gcttcctgtggatttaaatgcc

SEQ ID NO: 222617 - DNA, 22 bp, Artificial Sequence
  Synthetic oligonucleotide; TTG chr2 60482497 60482518 60482502 60482497 -
cttcctgtggatttaaatgcca

SEQ ID NO: 222618 - DNA, 22 bp, Artificial Sequence
  Synthetic oligonucleotide; CTT chr2 60482494 60482515 60482499 60482494 -
cctgtggatttaaatgccaaat

SEQ ID NO: 222619 - DNA, 22 bp, Artificial Sequence
  Synthetic oligonucleotide; TTC chr2 60482493 60482514 60482498 60482493 -
ctgtggatttaaatgccaaatc

SEQ ID NO: 222620 - DNA, 22 bp, Artificial Sequence
  Synthetic oligonucleotide; CTG chr2 60482490 60482511 60482495 60482490 -
tggatttaaatgccaaatcctg

SEQ ID NO: 222621 - DNA, 22 bp, Artificial Sequence
  Synthetic oligonucleotide; TTT chr2 60482483 60482504 60482488 60482483 -
aaatgccaaatcctgatttgtg

SEQ ID NO: 222622 - DNA, 22 bp, Artificial Sequence
  Synthetic oligonucleotide; TTA chr2 60482482 60482503 60482487 60482482 -
aatgccaaatcctgatttgtgg

SEQ ID NO: 222623 - DNA, 22 bp, Artificial Sequence
  Synthetic oligonucleotide; CTG chr2 60482468 60482489 60482473 60482468 -
atttgtggcaaagttgtcacat

SEQ ID NO: 222624 - DNA, 22 bp, Artificial Sequence
  Synthetic oligonucleotide; TTT chr2 60482464 60482485 60482469 60482464 -
gtggcaaagttgtcacatgccc

SEQ ID NO: 222625 - DNA, 22 bp, Artificial Sequence
  Synthetic oligonucleotide; TTG chr2 60482463 60482484 60482468 60482463 -
tggcaaagttgtcacatgcccc

SEQ ID NO: 222626 - DNA, 22 bp, Artificial Sequence
  Synthetic oligonucleotide; TTG chr2 60482452 60482473 60482457 60482452 -
tcacatgcccctttcccactct

SEQ ID NO: 222627 - DNA, 22 bp, Artificial Sequence
  Synthetic oligonucleotide; CTT chr2 60482439 60482460 60482444 60482439 -
tcccactctgtatgcctggtgc

SEQ ID NO: 222628 - DNA, 22 bp, Artificial Sequence
  Synthetic oligonucleotide; TTT chr2 60482438 60482459 60482443 60482438 -
cccactctgtatgcctggtgcc

SEQ ID NO: 222629 - DNA, 22 bp, Artificial Sequence
  Synthetic oligonucleotide; TTC chr2 60482437 60482458 60482442 60482437 -
ccactctgtatgcctggtgccc

SEQ ID NO: 222630 - DNA, 22 bp, Artificial Sequence
  Synthetic oligonucleotide; CTC chr2 60482431 60482452 60482436 60482431 -
tgtatgcctggtgcccaggaac

SEQ ID NO: 222631 - DNA, 22 bp, Artificial Sequence
  Synthetic oligonucleotide; CTG chr2 60482429 60482450 60482434 60482429 -
tatgcctggtgcccaggaacta

SEQ ID NO: 222632 - DNA, 22 bp, Artificial Sequence
  Synthetic oligonucleotide; CTG chr2 60482421 60482442 60482426 60482421 -
gtgcccaggaactaagcagtgg

SEQ ID NO: 222633 - DNA, 22 bp, Artificial Sequence
  Synthetic oligonucleotide; CTA chr2 60482407 60482428 60482412 60482407 -
agcagtggcagtggaaattaca

SEQ ID NO: 222634 - DNA, 22 bp, Artificial Sequence
  Synthetic oligonucleotide; TTA chr2 60482387 60482408 60482392 60482387 -
caactgtttggaagccaagaaa

SEQ ID NO: 222635 - DNA, 22 bp, Artificial Sequence
  Synthetic oligonucleotide; CTG chr2 60482381 60482402 60482386 60482381 -
tttggaagccaagaaaaaagct

SEQ ID NO: 222636 - DNA, 22 bp, Artificial Sequence
  Synthetic oligonucleotide; TTT chr2 60482378 60482399 60482383 60482378 -
ggaagccaagaaaaaagctcca

SEQ ID NO: 222637 - DNA, 22 bp, Artificial Sequence
  Synthetic oligonucleotide; TTG chr2 60482377 60482398 60482382 60482377 -
gaagccaagaaaaaagctccat

SEQ ID NO: 222638 - DNA, 22 bp, Artificial Sequence
  Synthetic oligonucleotide; CTC chr2 60482358 60482379 60482363 60482358 -
catttctcacttttctccagtt

SEQ ID NO: 222639 - DNA, 22 bp, Artificial Sequence
  Synthetic oligonucleotide; TTT chr2 60482353 60482374 60482358 60482353 -
ctcacttttctccagttccgga

SEQ ID NO: 222640 - DNA, 22 bp, Artificial Sequence
  Synthetic oligonucleotide; TTC chr2 60482352 60482373 60482357 60482352 -
tcacttttctccagttccggat

SEQ ID NO: 222641 - DNA, 22 bp, Artificial Sequence
  Synthetic oligonucleotide; CTC chr2 60482350 60482371 60482355 60482350 -
acttttctccagttccggatat

SEQ ID NO: 222642 - DNA, 22 bp, Artificial Sequence
  Synthetic oligonucleotide; CTT chr2 60482346 60482367 60482351 60482346 -
ttctccagttccggatattctc

SEQ ID NO: 222643 - DNA, 22 bp, Artificial Sequence
  Synthetic oligonucleotide; TTT chr2 60482345 60482366 60482350 60482345 -
tctccagttccggatattctcg

SEQ ID NO: 222644 - DNA, 22 bp, Artificial Sequence
  Synthetic oligonucleotide; TTT chr2 60482344 60482365 60482349 60482344 -
ctccagttccggatattctcgg

SEQ ID NO: 222645 - DNA, 22 bp, Artificial Sequence
  Synthetic oligonucleotide; TTC chr2 60482343 60482364 60482348 60482343 -
tccagttccggatattctcggc

SEQ ID NO: 222646 - DNA, 22 bp, Artificial Sequence
  Synthetic oligonucleotide; CTC chr2 60482341 60482362 60482346 60482341 -
cagttccggatattctcggctc

SEQ ID NO: 222647 - DNA, 22 bp, Artificial Sequence
  Synthetic oligonucleotide; TTC chr2 60482335 60482356 60482340 60482335 -
cggatattctcggctctgctcc

SEQ ID NO: 222648 - DNA, 22 bp, Artificial Sequence
  Synthetic oligonucleotide; TTC chr2 60482326 60482347 60482331 60482326 -
tcggctctgctccatgtatcag

SEQ ID NO: 222649 - DNA, 22 bp, Artificial Sequence
  Synthetic oligonucleotide; CTC chr2 60482324 60482345 60482329 60482324 -
ggctctgctccatgtatcagcc

SEQ ID NO: 222650 - DNA, 22 bp, Artificial Sequence
  Synthetic oligonucleotide; CTC chr2 60482319 60482340 60482324 60482319 -
tgctccatgtatcagcctcctc

SEQ ID NO: 222651 - DNA, 22 bp, Artificial Sequence
  Synthetic oligonucleotide; CTG chr2 60482317 60482338 60482322 60482317 -
ctccatgtatcagcctcctccc

SEQ ID NO: 222652 - DNA, 22 bp, Artificial Sequence
  Synthetic oligonucleotide; CTC chr2 60482314 60482335 60482319 60482314 -
catgtatcagcctcctccccac

SEQ ID NO: 222653 - DNA, 22 bp, Artificial Sequence
  Synthetic oligonucleotide; CTC chr2 60482300 60482321 60482305 60482300 -
ctccccacacacctcctccact

SEQ ID NO: 222654 - DNA, 22 bp, Artificial Sequence
  Synthetic oligonucleotide; CTC chr2 60482297 60482318 60482302 60482297 -
cccacacacctcctccactgca

SEQ ID NO: 222655 - DNA, 22 bp, Artificial Sequence
  Synthetic oligonucleotide; CTC chr2 60482285 60482306 60482290 60482285 -
ctccactgcacaccctccttct

SEQ ID NO: 222656 - DNA, 22 bp, Artificial Sequence
  Synthetic oligonucleotide; CTC chr2 60482282 60482303 60482287 60482282 -
cactgcacaccctccttctgtc

SEQ ID NO: 222657 - DNA, 22 bp, Artificial Sequence
  Synthetic oligonucleotide; CTG chr2 60482277 60482298 60482282 60482277 -
cacaccctccttctgtccgctc

SEQ ID NO: 222658 - DNA, 22 bp, Artificial Sequence
  Synthetic oligonucleotide; CTC chr2 60482268 60482289 60482273 60482268 -
cttctgtccgctccgtgaacag

SEQ ID NO: 222659 - DNA, 22 bp, Artificial Sequence
  Synthetic oligonucleotide; CTT chr2 60482265 60482286 60482270 60482265 -
ctgtccgctccgtgaacaggaa

SEQ ID NO: 222660 - DNA, 22 bp, Artificial Sequence
  Synthetic oligonucleotide; TTC chr2 60482264 60482285 60482269 60482264 -
tgtccgctccgtgaacaggaaa

SEQ ID NO: 222661 - DNA, 22 bp, Artificial Sequence
  Synthetic oligonucleotide; CTG chr2 60482262 60482283 60482267 60482262 -
tccgctccgtgaacaggaaaca

SEQ ID NO: 222662 - DNA, 22 bp, Artificial Sequence
  Synthetic oligonucleotide; CTC chr2 60482255 60482276 60482260 60482255 -
cgtgaacaggaaacagaaatac

SEQ ID NO: 222663 - DNA, 22 bp, Artificial Sequence
  Synthetic oligonucleotide; CTC chr2 60482228 60482249 60482233 60482228 -
caatttttttttttaatggagg

SEQ ID NO: 222664 - DNA, 22 bp, Artificial Sequence
  Synthetic oligonucleotide; TTT chr2 60482222 60482243 60482227 60482222 -
ttttttttaatggaggaagaga

SEQ ID NO: 222665 - DNA, 22 bp, Artificial Sequence
  Synthetic oligonucleotide; TTT chr2 60482221 60482242 60482226 60482221 -
tttttttaatggaggaagagaa

SEQ ID NO: 222666 - DNA, 22 bp, Artificial Sequence
  Synthetic oligonucleotide; TTT chr2 60482220 60482241 60482225 60482220 -
ttttttaatggaggaagagaaa

SEQ ID NO: 222667 - DNA, 22 bp, Artificial Sequence
  Synthetic oligonucleotide; TTT chr2 60482219 60482240 60482224 60482219 -
tttttaatggaggaagagaaac

SEQ ID NO: 222668 - DNA, 22 bp, Artificial Sequence
  Synthetic oligonucleotide; TTT chr2 60482218 60482239 60482223 60482218 -
ttttaatggaggaagagaaacc

SEQ ID NO: 222669 - DNA, 22 bp, Artificial Sequence
  Synthetic oligonucleotide; TTT chr2 60482217 60482238 60482222 60482217 -
tttaatggaggaagagaaacca

SEQ ID NO: 222670 - DNA, 22 bp, Artificial Sequence
  Synthetic oligonucleotide; TTT chr2 60482216 60482237 60482221 60482216 -
ttaatggaggaagagaaaccac

SEQ ID NO: 222671 - DNA, 22 bp, Artificial Sequence
  Synthetic oligonucleotide; TTT chr2 60482215 60482236 60482220 60482215 -
taatggaggaagagaaaccaca

SEQ ID NO: 222672 - DNA, 22 bp, Artificial Sequence
  Synthetic oligonucleotide; TTT chr2 60482214 60482235 60482219 60482214 -
aatggaggaagagaaaccacaa

SEQ ID NO: 222673 - DNA, 22 bp, Artificial Sequence
  Synthetic oligonucleotide; TTA chr2 60482213 60482234 60482218 60482213 -
atggaggaagagaaaccacaac

SEQ ID NO: 222674 - DNA, 22 bp, Artificial Sequence
  Synthetic oligonucleotide; CTC chr2 60482176 60482197 60482181 60482176 -
aaaaactaaactccaaccaaac

SEQ ID NO: 222675 - DNA, 22 bp, Artificial Sequence
  Synthetic oligonucleotide; CTA chr2 60482168 60482189 60482173 60482168 -
aactccaaccaaactaaactct

SEQ ID NO: 222676 - DNA, 22 bp, Artificial Sequence
  Synthetic oligonucleotide; CTC chr2 60482163 60482184 60482168 60482163 -
caaccaaactaaactctcaaga

SEQ ID NO: 222677 - DNA, 22 bp, Artificial Sequence
  Synthetic oligonucleotide; CTA chr2 60482152 60482173 60482157 60482152 -
aactctcaagatagaatcatga

SEQ ID NO: 222678 - DNA, 22 bp, Artificial Sequence
  Synthetic oligonucleotide; CTC chr2 60482147 60482168 60482152 60482147 -
tcaagatagaatcatgagagat

SEQ ID NO: 222679 - DNA, 22 bp, Artificial Sequence
  Synthetic oligonucleotide; CTC chr2 60482145 60482166 60482150 60482145 -
aagatagaatcatgagagatgc

SEQ ID NO: 222680 - DNA, 22 bp, Artificial Sequence
  Synthetic oligonucleotide; CTA chr2 60482103 60482124 60482108 60482103 -
agtggctcaaaccacccgcccc

SEQ ID NO: 222681 - DNA, 22 bp, Artificial Sequence
  Synthetic oligonucleotide; CTC chr2 60482095 60482116 60482100 60482095 -
aaaccacccgccccttaacagg

SEQ ID NO: 222682 - DNA, 22 bp, Artificial Sequence
  Synthetic oligonucleotide; CTT chr2 60482079 60482100 60482084 60482079 -
aacaggtctgcctctcttcctg

SEQ ID NO: 222683 - DNA, 22 bp, Artificial Sequence
  Synthetic oligonucleotide; TTA chr2 60482078 60482099 60482083 60482078 -
acaggtctgcctctcttcctgg

SEQ ID NO: 222684 - DNA, 22 bp, Artificial Sequence
  Synthetic oligonucleotide; CTG chr2 60482069 60482090 60482074 60482069 -
cctctcttcctgggagtcagaa

SEQ ID NO: 222685 - DNA, 22 bp, Artificial Sequence
  Synthetic oligonucleotide; CTC chr2 60482065 60482086 60482070 60482065 -
tcttcctgggagtcagaagtga

SEQ ID NO: 222686 - DNA, 22 bp, Artificial Sequence
  Synthetic oligonucleotide; CTC chr2 60482063 60482084 60482068 60482063 -
ttcctgggagtcagaagtgacc

SEQ ID NO: 222687 - DNA, 22 bp, Artificial Sequence
  Synthetic oligonucleotide; CTT chr2 60482061 60482082 60482066 60482061 -
cctgggagtcagaagtgacctt

SEQ ID NO: 222688 - DNA, 22 bp, Artificial Sequence
  Synthetic oligonucleotide; TTC chr2 60482060 60482081 60482065 60482060 -
ctgggagtcagaagtgaccttg

SEQ ID NO: 222689 - DNA, 22 bp, Artificial Sequence
  Synthetic oligonucleotide; CTG chr2 60482057 60482078 60482062 60482057 -
ggagtcagaagtgaccttgatg

SEQ ID NO: 222690 - DNA, 22 bp, Artificial Sequence
  Synthetic oligonucleotide; CTT chr2 60482039 60482060 60482044 60482039 -
gatgaactggatgttaggtcca

SEQ ID NO: 222691 - DNA, 22 bp, Artificial Sequence
  Synthetic oligonucleotide; TTG chr2 60482038 60482059 60482043 60482038 -
atgaactggatgttaggtccaa

SEQ ID NO: 222692 - DNA, 22 bp, Artificial Sequence
  Synthetic oligonucleotide; CTG chr2 60482030 60482051 60482035 60482030 -
gatgttaggtccaaaaatgaca

SEQ ID NO: 222693 - DNA, 22 bp, Artificial Sequence
  Synthetic oligonucleotide; TTA chr2 60482023 60482044 60482028 60482023 -
ggtccaaaaatgacaaacaagc

SEQ ID NO: 222694 - DNA, 22 bp, Artificial Sequence
  Synthetic oligonucleotide; CTC chr2 60481997 60482018 60482002 60481997 -
cactgggaaacatcagtccaac

SEQ ID NO: 222695 - DNA, 22 bp, Artificial Sequence
  Synthetic oligonucleotide; CTG chr2 60481992 60482013 60481997 60481992 -
ggaaacatcagtccaacccctt

SEQ ID NO: 222696 - DNA, 22 bp, Artificial Sequence
  Synthetic oligonucleotide; CTT chr2 60481970 60481991 60481975 60481970 -
tcttttgacagcaggactagaa

SEQ ID NO: 222697 - DNA, 22 bp, Artificial Sequence
  Synthetic oligonucleotide; TTT chr2 60481969 60481990 60481974 60481969 -
cttttgacagcaggactagaac

SEQ ID NO: 222698 - DNA, 22 bp, Artificial Sequence
  Synthetic oligonucleotide; TTC chr2 60481968 60481989 60481973 60481968 -
ttttgacagcaggactagaaca

SEQ ID NO: 222699 - DNA, 22 bp, Artificial Sequence
  Synthetic oligonucleotide; CTT chr2 60481966 60481987 60481971 60481966 -
ttgacagcaggactagaacaga

SEQ ID NO: 222700 - DNA, 22 bp, Artificial Sequence
  Synthetic oligonucleotide; TTT chr2 60481965 60481986 60481970 60481965 -
tgacagcaggactagaacagac

SEQ ID NO: 222701 - DNA, 22 bp, Artificial Sequence
  Synthetic oligonucleotide; TTT chr2 60481964 60481985 60481969 60481964 -
gacagcaggactagaacagacc

SEQ ID NO: 222702 - DNA, 22 bp, Artificial Sequence
  Synthetic oligonucleotide; TTG chr2 60481963 60481984 60481968 60481963 -
acagcaggactagaacagacca

SEQ ID NO: 222703 - DNA, 22 bp, Artificial Sequence
  Synthetic oligonucleotide; CTA chr2 60481951 60481972 60481956 60481951 -
gaacagaccagaggttccggag

SEQ ID NO: 222704 - DNA, 22 bp, Artificial Sequence
  Synthetic oligonucleotide; TTC chr2 60481934 60481955 60481939 60481934 -
cggagaaggtctctatacctag

SEQ ID NO: 222705 - DNA, 22 bp, Artificial Sequence
  Synthetic oligonucleotide; CTC chr2 60481921 60481942 60481926 60481921 -
tatacctaggtgggtttcctga

SEQ ID NO: 222706 - DNA, 22 bp, Artificial Sequence
  Synthetic oligonucleotide; CTA chr2 60481919 60481940 60481924 60481919 -
tacctaggtgggtttcctgagc

SEQ ID NO: 222707 - DNA, 22 bp, Artificial Sequence
  Synthetic oligonucleotide; CTA chr2 60481913 60481934 60481918 60481913 -
ggtgggtttcctgagctggaga

SEQ ID NO: 222708 - DNA, 22 bp, Artificial Sequence
  Synthetic oligonucleotide; TTT chr2 60481904 60481925 60481909 60481904 -
cctgagctggagaattttccat

SEQ ID NO: 222709 - DNA, 22 bp, Artificial Sequence
  Synthetic oligonucleotide; TTC chr2 60481903 60481924 60481908 60481903 -
ctgagctggagaattttccatg

SEQ ID NO: 222710 - DNA, 22 bp, Artificial Sequence
  Synthetic oligonucleotide; CTG chr2 60481900 60481921 60481905 60481900 -
agctggagaattttccatgggg

SEQ ID NO: 222711 - DNA, 22 bp, Artificial Sequence
  Synthetic oligonucleotide; CTG chr2 60481895 60481916 60481900 60481895 -
gagaattttccatggggctgtc

SEQ ID NO: 222712 - DNA, 22 bp, Artificial Sequence
  Synthetic oligonucleotide; TTT chr2 60481887 60481908 60481892 60481887 -
tccatggggctgtctgtgtgtt

SEQ ID NO: 222713 - DNA, 22 bp, Artificial Sequence
  Synthetic oligonucleotide; TTT chr2 60481886 60481907 60481891 60481886 -
ccatggggctgtctgtgtgttg

SEQ ID NO: 222714 - DNA, 22 bp, Artificial Sequence
  Synthetic oligonucleotide; TTC chr2 60481885 60481906 60481890 60481885 -
catggggctgtctgtgtgttga

SEQ ID NO: 222715 - DNA, 22 bp, Artificial Sequence
  Synthetic oligonucleotide; CTG chr2 60481875 60481896 60481880 60481875 -
tctgtgtgttgaggcttttccc

SEQ ID NO: 222716 - DNA, 22 bp, Artificial Sequence
  Synthetic oligonucleotide; CTG chr2 60481871 60481892 60481876 60481871 -
tgtgttgaggcttttccccatt

SEQ ID NO: 222717 - DNA, 22 bp, Artificial Sequence
  Synthetic oligonucleotide; TTG chr2 60481864 60481885 60481869 60481864 -
aggcttttccccattcactttc

SEQ ID NO: 222718 - DNA, 22 bp, Artificial Sequence
  Synthetic oligonucleotide; CTT chr2 60481858 60481879 60481863 60481858 -
ttccccattcactttcccaatt

SEQ ID NO: 222719 - DNA, 22 bp, Artificial Sequence
  Synthetic oligonucleotide; TTT chr2 60481857 60481878 60481862 60481857 -
tccccattcactttcccaattc

SEQ ID NO: 222720 - DNA, 22 bp, Artificial Sequence
  Synthetic oligonucleotide; TTT chr2 60481856 60481877 60481861 60481856 -
ccccattcactttcccaattca

SEQ ID NO: 222721 - DNA, 22 bp, Artificial Sequence
  Synthetic oligonucleotide; TTC chr2 60481855 60481876 60481860 60481855 -
cccattcactttcccaattcac

SEQ ID NO: 222722 - DNA, 22 bp, Artificial Sequence
  Synthetic oligonucleotide; TTC chr2 60481848 60481869 60481853 60481848 -
actttcccaattcacttcccag

SEQ ID NO: 222723 - DNA, 22 bp, Artificial Sequence
  Synthetic oligonucleotide; CTT chr2 60481844 60481865 60481849 60481844 -
tcccaattcacttcccagagag

SEQ ID NO: 222724 - DNA, 22 bp, Artificial Sequence
  Synthetic oligonucleotide; TTT chr2 60481843 60481864 60481848 60481843 -
cccaattcacttcccagagagc

SEQ ID NO: 222725 - DNA, 22 bp, Artificial Sequence
  Synthetic oligonucleotide; TTC chr2 60481842 60481863 60481847 60481842 -
ccaattcacttcccagagagca

SEQ ID NO: 222726 - DNA, 22 bp, Artificial Sequence
  Synthetic oligonucleotide; TTC chr2 60481835 60481856 60481840 60481835 -
acttcccagagagcatgctgag

SEQ ID NO: 222727 - DNA, 22 bp, Artificial Sequence
  Synthetic oligonucleotide; CTT chr2 60481831 60481852 60481836 60481831 -
cccagagagcatgctgagctca

SEQ ID NO: 222728 - DNA, 22 bp, Artificial Sequence
  Synthetic oligonucleotide; TTC chr2 60481830 60481851 60481835 60481830 -
ccagagagcatgctgagctcat

SEQ ID NO: 222729 - DNA, 22 bp, Artificial Sequence
  Synthetic oligonucleotide; CTG chr2 60481815 60481836 60481820 60481815 -
agctcattccaggacactgtga

SEQ ID NO: 222730 - DNA, 22 bp, Artificial Sequence
  Synthetic oligonucleotide; CTC chr2 60481810 60481831 60481815 60481810 -
attccaggacactgtgatggtc

SEQ ID NO: 222731 - DNA, 22 bp, Artificial Sequence
  Synthetic oligonucleotide; TTC chr2 60481806 60481827 60481811 60481806 -
caggacactgtgatggtcaaaa

SEQ ID NO: 222732 - DNA, 22 bp, Artificial Sequence
  Synthetic oligonucleotide; CTG chr2 60481796 60481817 60481801 60481796 -
tgatggtcaaaaggctctccca

SEQ ID NO: 222733 - DNA, 22 bp, Artificial Sequence
  Synthetic oligonucleotide; CTC chr2 60481779 60481800 60481784 60481779 -
tcccaccatcacacagaatgta

SEQ ID NO: 222734 - DNA, 22 bp, Artificial Sequence
  Synthetic oligonucleotide; CTC chr2 60481777 60481798 60481782 60481777 -
ccaccatcacacagaatgtact

SEQ ID NO: 222735 - DNA, 22 bp, Artificial Sequence
  Synthetic oligonucleotide; CTA chr2 60481754 60481775 60481759 60481754 -
gggttctgttagaaaattaatc

SEQ ID NO: 222736 - DNA, 22 bp, Artificial Sequence
  Synthetic oligonucleotide; TTC chr2 60481748 60481769 60481753 60481748 -
tgttagaaaattaatctcactt

SEQ ID NO: 222737 - DNA, 22 bp, Artificial Sequence
  Synthetic oligonucleotide; CTG chr2 60481746 60481767 60481751 60481746 -
ttagaaaattaatctcacttgt

SEQ ID NO: 222738 - DNA, 22 bp, Artificial Sequence
  Synthetic oligonucleotide; TTA chr2 60481743 60481764 60481748 60481743 -
gaaaattaatctcacttgtgga

SEQ ID NO: 222739 - DNA, 22 bp, Artificial Sequence
  Synthetic oligonucleotide; TTA chr2 60481735 60481756 60481740 60481735 -
atctcacttgtggaaaaaaaat

SEQ ID NO: 222740 - DNA, 22 bp, Artificial Sequence
  Synthetic oligonucleotide; CTC chr2 60481730 60481751 60481735 60481730 -
acttgtggaaaaaaaatgccct

SEQ ID NO: 222741 - DNA, 22 bp, Artificial Sequence
  Synthetic oligonucleotide; CTT chr2 60481726 60481747 60481731 60481726 -
gtggaaaaaaaatgcccttaaa

SEQ ID NO: 222742 - DNA, 22 bp, Artificial Sequence
  Synthetic oligonucleotide; TTG chr2 60481725 60481746 60481730 60481725 -
tggaaaaaaaatgcccttaaaa

SEQ ID NO: 222743 - DNA, 22 bp, Artificial Sequence
  Synthetic oligonucleotide; CTT chr2 60481707 60481728 60481712 60481707 -
aaaacactggagccctgagttg

SEQ ID NO: 222744 - DNA, 22 bp, Artificial Sequence
  Synthetic oligonucleotide; TTA chr2 60481706 60481727 60481711 60481706 -
aaacactggagccctgagttgt

SEQ ID NO: 222745 - DNA, 22 bp, Artificial Sequence
  Synthetic oligonucleotide; CTG chr2 60481698 60481719 60481703 60481698 -
gagccctgagttgtatgtgctg

SEQ ID NO: 222746 - DNA, 22 bp, Artificial Sequence
  Synthetic oligonucleotide; CTG chr2 60481690 60481711 60481695 60481690 -
agttgtatgtgctggagcatgt

SEQ ID NO: 222747 - DNA, 22 bp, Artificial Sequence
  Synthetic oligonucleotide; TTG chr2 60481685 60481706 60481690 60481685 -
tatgtgctggagcatgtgggga

SEQ ID NO: 222748 - DNA, 22 bp, Artificial Sequence
  Synthetic oligonucleotide; CTG chr2 60481676 60481697 60481681 60481676 -
gagcatgtggggaaaagaaaga

SEQ ID NO: 222749 - DNA, 22 bp, Artificial Sequence
  Synthetic oligonucleotide; TTC chr2 60481612 60481633 60481617 60481612 -
acgagccatggaaatggagaag

SEQ ID NO: 222750 - DNA, 22 bp, Artificial Sequence
  Synthetic oligonucleotide; CTG chr2 60481582 60481603 60481587 60481582 -
tttctgctgcagttgctcttag

SEQ ID NO: 222751 - DNA, 22 bp, Artificial Sequence
  Synthetic oligonucleotide; TTT chr2 60481579 60481600 60481584 60481579 -
ctgctgcagttgctcttagcca

SEQ ID NO: 222752 - DNA, 22 bp, Artificial Sequence
  Synthetic oligonucleotide; TTC chr2 60481578 60481599 60481583 60481578 -
tgctgcagttgctcttagccag

SEQ ID NO: 222753 - DNA, 22 bp, Artificial Sequence
  Synthetic oligonucleotide; CTG chr2 60481576 60481597 60481581 60481576 -
ctgcagttgctcttagccaggg

SEQ ID NO: 222754 - DNA, 22 bp, Artificial Sequence
  Synthetic oligonucleotide; CTG chr2 60481573 60481594 60481578 60481573 -
cagttgctcttagccaggggcc

SEQ ID NO: 222755 - DNA, 22 bp, Artificial Sequence
  Synthetic oligonucleotide; TTG chr2 60481567 60481588 60481572 60481567 -
ctcttagccaggggccagcgtg

SEQ ID NO: 222756 - DNA, 22 bp, Artificial Sequence
  Synthetic oligonucleotide; CTC chr2 60481564 60481585 60481569 60481564 -
ttagccaggggccagcgtggac

SEQ ID NO: 222757 - DNA, 22 bp, Artificial Sequence
  Synthetic oligonucleotide; CTT chr2 60481562 60481583 60481567 60481562 -
agccaggggccagcgtggacag

SEQ ID NO: 222758 - DNA, 22 bp, Artificial Sequence
  Synthetic oligonucleotide; TTA chr2 60481561 60481582 60481566 60481561 -
gccaggggccagcgtggacagc

SEQ ID NO: 222759 - DNA, 22 bp, Artificial Sequence
  Synthetic oligonucleotide; CTG chr2 60481535 60481556 60481540 60481535 -
tcaccttgatccctgtcctcct

SEQ ID NO: 222760 - DNA, 22 bp, Artificial Sequence
  Synthetic oligonucleotide; CTT chr2 60481528 60481549 60481533 60481528 -
gatccctgtcctccttcacctg

SEQ ID NO: 222761 - DNA, 22 bp, Artificial Sequence
  Synthetic oligonucleotide; TTG chr2 60481527 60481548 60481532 60481527 -
atccctgtcctccttcacctgc

SEQ ID NO: 222762 - DNA, 22 bp, Artificial Sequence
  Synthetic oligonucleotide; CTG chr2 60481520 60481541 60481525 60481520 -
tcctccttcacctgccagcttg

SEQ ID NO: 222763 - DNA, 22 bp, Artificial Sequence
  Synthetic oligonucleotide; CTC chr2 60481515 60481536 60481520 60481515 -
cttcacctgccagcttgtgggc

SEQ ID NO: 222764 - DNA, 22 bp, Artificial Sequence
  Synthetic oligonucleotide; CTT chr2 60481512 60481533 60481517 60481512 -
cacctgccagcttgtgggctgg

SEQ ID NO: 222765 - DNA, 22 bp, Artificial Sequence
  Synthetic oligonucleotide; TTC chr2 60481511 60481532 60481516 60481511 -
acctgccagcttgtgggctggg

SEQ ID NO: 222766 - DNA, 22 bp, Artificial Sequence
  Synthetic oligonucleotide; CTG chr2 60481506 60481527 60481511 60481506 -
ccagcttgtgggctgggtggct

SEQ ID NO: 222767 - DNA, 22 bp, Artificial Sequence
  Synthetic oligonucleotide; CTT chr2 60481499 60481520 60481504 60481499 -
gtgggctgggtggcttaagttc

SEQ ID NO: 222768 - DNA, 22 bp, Artificial Sequence
  Synthetic oligonucleotide; TTG chr2 60481498 60481519 60481503 60481498 -
tgggctgggtggcttaagttct

SEQ ID NO: 222769 - DNA, 22 bp, Artificial Sequence
  Synthetic oligonucleotide; CTG chr2 60481491 60481512 60481496 60481491 -
ggtggcttaagttctagccctg

SEQ ID NO: 222770 - DNA, 22 bp, Artificial Sequence
  Synthetic oligonucleotide; CTT chr2 60481483 60481504 60481488 60481483 -
aagttctagccctgggtgaccc

SEQ ID NO: 222771 - DNA, 22 bp, Artificial Sequence
  Synthetic oligonucleotide; TTA chr2 60481482 60481503 60481487 60481482 -
agttctagccctgggtgaccct

SEQ ID NO: 222772 - DNA, 22 bp, Artificial Sequence
  Synthetic oligonucleotide; TTC chr2 60481477 60481498 60481482 60481477 -
tagccctgggtgaccctctgac

SEQ ID NO: 222773 - DNA, 22 bp, Artificial Sequence
  Synthetic oligonucleotide; CTA chr2 60481475 60481496 60481480 60481475 -
gccctgggtgaccctctgactc

SEQ ID NO: 222774 - DNA, 22 bp, Artificial Sequence
  Synthetic oligonucleotide; CTG chr2 60481469 60481490 60481474 60481469 -
ggtgaccctctgactcctgaga

SEQ ID NO: 222775 - DNA, 22 bp, Artificial Sequence
  Synthetic oligonucleotide; CTC chr2 60481459 60481480 60481464 60481459 -
tgactcctgagagcatgtgtat

SEQ ID NO: 222776 - DNA, 22 bp, Artificial Sequence
  Synthetic oligonucleotide; CTG chr2 60481457 60481478 60481462 60481457 -
actcctgagagcatgtgtatgt

SEQ ID NO: 222777 - DNA, 22 bp, Artificial Sequence
  Synthetic oligonucleotide; CTC chr2 60481453 60481474 60481458 60481453 -
ctgagagcatgtgtatgtgctt

SEQ ID NO: 222778 - DNA, 22 bp, Artificial Sequence
  Synthetic oligonucleotide; CTG chr2 60481450 60481471 60481455 60481450 -
agagcatgtgtatgtgcttgtg

SEQ ID NO: 222779 - DNA, 22 bp, Artificial Sequence
  Synthetic oligonucleotide; CTT chr2 60481431 60481452 60481436 60481431 -
gtggtgggtggggtgtagtgcg

SEQ ID NO: 222780 - DNA, 22 bp, Artificial Sequence
  Synthetic oligonucleotide; TTG chr2 60481430 60481451 60481435 60481430 -
tggtgggtggggtgtagtgcgt

SEQ ID NO: 222781 - DNA, 22 bp, Artificial Sequence
  Synthetic oligonucleotide; TTA chr2 60481406 60481427 60481411 60481406 -
aagccgcaaagcagaggtgcga

SEQ ID NO: 222782 - DNA, 22 bp, Artificial Sequence
  Synthetic oligonucleotide; CTG chr2 60481376 60481397 60481381 60481376 -
gtgtaggtcgtgggagacagag

SEQ ID NO: 222783 - DNA, 22 bp, Artificial Sequence
  Synthetic oligonucleotide; CTG chr2 60481343 60481364 60481348 60481343 -
ggttctgaatgtttttactttt

SEQ ID NO: 222784 - DNA, 22 bp, Artificial Sequence
  Synthetic oligonucleotide; TTC chr2 60481338 60481359 60481343 60481338 -
tgaatgtttttacttttcctag

SEQ ID NO: 222785 - DNA, 22 bp, Artificial Sequence
  Synthetic oligonucleotide; CTG chr2 60481336 60481357 60481341 60481336 -
aatgtttttacttttcctagga

SEQ ID NO: 222786 - DNA, 22 bp, Artificial Sequence
  Synthetic oligonucleotide; TTT chr2 60481329 60481350 60481334 60481329 -
ttacttttcctaggatccctgc

SEQ ID NO: 222787 - DNA, 22 bp, Artificial Sequence
  Synthetic oligonucleotide; TTT chr2 60481328 60481349 60481333 60481328 -
tacttttcctaggatccctgct

SEQ ID NO: 222788 - DNA, 22 bp, Artificial Sequence
  Synthetic oligonucleotide; TTT chr2 60481327 60481348 60481332 60481327 -
acttttcctaggatccctgctt

SEQ ID NO: 222789 - DNA, 22 bp, Artificial Sequence
  Synthetic oligonucleotide; TTA chr2 60481326 60481347 60481331 60481326 -
cttttcctaggatccctgcttc

SEQ ID NO: 222790 - DNA, 22 bp, Artificial Sequence
  Synthetic oligonucleotide; CTT chr2 60481323 60481344 60481328 60481323 -
ttcctaggatccctgcttcatt

SEQ ID NO: 222791 - DNA, 22 bp, Artificial Sequence
  Synthetic oligonucleotide; TTT chr2 60481322 60481343 60481327 60481322 -
tcctaggatccctgcttcattt

SEQ ID NO: 222792 - DNA, 22 bp, Artificial Sequence
  Synthetic oligonucleotide; TTT chr2 60481321 60481342 60481326 60481321 -
cctaggatccctgcttcatttt

SEQ ID NO: 222793 - DNA, 22 bp, Artificial Sequence
  Synthetic oligonucleotide; TTC chr2 60481320 60481341 60481325 60481320 -
ctaggatccctgcttcattttt

SEQ ID NO: 222794 - DNA, 22 bp, Artificial Sequence
  Synthetic oligonucleotide; CTA chr2 60481317 60481338 60481322 60481317 -
ggatccctgcttcatttttgtt

SEQ ID NO: 222795 - DNA, 22 bp, Artificial Sequence
  Synthetic oligonucleotide; CTG chr2 60481308 60481329 60481313 60481308 -
cttcatttttgttttcaaggag

SEQ ID NO: 222796 - DNA, 22 bp, Artificial Sequence
  Synthetic oligonucleotide; CTT chr2 60481305 60481326 60481310 60481305 -
catttttgttttcaaggagtta

SEQ ID NO: 222797 - DNA, 22 bp, Artificial Sequence
  Synthetic oligonucleotide; TTC chr2 60481304 60481325 60481309 60481304 -
atttttgttttcaaggagttac

SEQ ID NO: 222798 - DNA, 22 bp, Artificial Sequence
  Synthetic oligonucleotide; TTT chr2 60481300 60481321 60481305 60481300 -
ttgttttcaaggagttacttgt

SEQ ID NO: 222799 - DNA, 22 bp, Artificial Sequence
  Synthetic oligonucleotide; TTT chr2 60481299 60481320 60481304 60481299 -
tgttttcaaggagttacttgtt

SEQ ID NO: 222800 - DNA, 22 bp, Artificial Sequence
  Synthetic oligonucleotide; TTT chr2 60481298 60481319 60481303 60481298 -
gttttcaaggagttacttgttt

SEQ ID NO: 222801 - DNA, 22 bp, Artificial Sequence
  Synthetic oligonucleotide; TTG chr2 60481297 60481318 60481302 60481297 -
ttttcaaggagttacttgtttc

SEQ ID NO: 222802 - DNA, 22 bp, Artificial Sequence
  Synthetic oligonucleotide; TTT chr2 60481294 60481315 60481299 60481294 -
tcaaggagttacttgtttctct

SEQ ID NO: 222803 - DNA, 22 bp, Artificial Sequence
  Synthetic oligonucleotide; TTT chr2 60481293 60481314 60481298 60481293 -
caaggagttacttgtttctctc

SEQ ID NO: 222804 - DNA, 22 bp, Artificial Sequence
  Synthetic oligonucleotide; TTC chr2 60481292 60481313 60481297 60481292 -
aaggagttacttgtttctctct

SEQ ID NO: 222805 - DNA, 22 bp, Artificial Sequence
  Synthetic oligonucleotide; TTA chr2 60481283 60481304 60481288 60481283 -
cttgtttctctcttcttgcctt

SEQ ID NO: 222806 - DNA, 22 bp, Artificial Sequence
  Synthetic oligonucleotide; CTT chr2 60481280 60481301 60481285 60481280 -
gtttctctcttcttgccttcca

SEQ ID NO: 222807 - DNA, 22 bp, Artificial Sequence
  Synthetic oligonucleotide; TTG chr2 60481279 60481300 60481284 60481279 -
tttctctcttcttgccttccag

SEQ ID NO: 222808 - DNA, 22 bp, Artificial Sequence
  Synthetic oligonucleotide; TTT chr2 60481276 60481297 60481281 60481276 -
ctctcttcttgccttccagcat

SEQ ID NO: 222809 - DNA, 22 bp, Artificial Sequence
  Synthetic oligonucleotide; TTC chr2 60481275 60481296 60481280 60481275 -
tctcttcttgccttccagcatg

SEQ ID NO: 222810 - DNA, 22 bp, Artificial Sequence
  Synthetic oligonucleotide; CTC chr2 60481273 60481294 60481278 60481273 -
tcttcttgccttccagcatgtc

SEQ ID NO: 222811 - DNA, 22 bp, Artificial Sequence
  Synthetic oligonucleotide; CTC chr2 60481271 60481292 60481276 60481271 -
ttcttgccttccagcatgtccc

SEQ ID NO: 222812 - DNA, 22 bp, Artificial Sequence
  Synthetic oligonucleotide; CTT chr2 60481269 60481290 60481274 60481269 -
cttgccttccagcatgtcccaa

SEQ ID NO: 222813 - DNA, 22 bp, Artificial Sequence
  Synthetic oligonucleotide; TTC chr2 60481268 60481289 60481273 60481268 -
ttgccttccagcatgtcccaag

SEQ ID NO: 222814 - DNA, 22 bp, Artificial Sequence
  Synthetic oligonucleotide; CTT chr2 60481266 60481287 60481271 60481266 -
gccttccagcatgtcccaagca

SEQ ID NO: 222815 - DNA, 22 bp, Artificial Sequence
  Synthetic oligonucleotide; TTG chr2 60481265 60481286 60481270 60481265 -
ccttccagcatgtcccaagcag

SEQ ID NO: 222816 - DNA, 22 bp, Artificial Sequence
  Synthetic oligonucleotide; CTT chr2 60481261 60481282 60481266 60481261 -
ccagcatgtcccaagcagagat

SEQ ID NO: 222817 - DNA, 22 bp, Artificial Sequence
  Synthetic oligonucleotide; TTC chr2 60481260 60481281 60481265 60481260 -
cagcatgtcccaagcagagatg

SEQ ID NO: 222818 - DNA, 22 bp, Artificial Sequence
  Synthetic oligonucleotide; CTA chr2 60481230 60481251 60481235 60481230 -
ggtttgggaatggggtgctggg

SEQ ID NO: 222819 - DNA, 22 bp, Artificial Sequence
  Synthetic oligonucleotide; TTT chr2 60481225 60481246 60481230 60481225 -
gggaatggggtgctgggagggg

SEQ ID NO: 222820 - DNA, 22 bp, Artificial Sequence
  Synthetic oligonucleotide; TTG chr2 60481224 60481245 60481229 60481224 -
ggaatggggtgctgggagggga

SEQ ID NO: 222821 - DNA, 22 bp, Artificial Sequence
  Synthetic oligonucleotide; CTG chr2 60481210 60481231 60481215 60481210 -
ggaggggaggggatatcccatt

SEQ ID NO: 222822 - DNA, 22 bp, Artificial Sequence
  Synthetic oligonucleotide; TTC chr2 60481187 60481208 60481192 60481187 -
cagggcccttcccagttttggg

SEQ ID NO: 222823 - DNA, 22 bp, Artificial Sequence
  Synthetic oligonucleotide; CTT chr2 60481177 60481198 60481182 60481177 -
cccagttttggggctgggaagc

SEQ ID NO: 222824 - DNA, 22 bp, Artificial Sequence
  Synthetic oligonucleotide; TTC chr2 60481176 60481197 60481181 60481176 -
ccagttttggggctgggaagcc

SEQ ID NO: 222825 - DNA, 22 bp, Artificial Sequence
  Synthetic oligonucleotide; TTT chr2 60481169 60481190 60481174 60481169 -
tggggctgggaagcctcaatct

SEQ ID NO: 222826 - DNA, 22 bp, Artificial Sequence
  Synthetic oligonucleotide; TTT chr2 60481168 60481189 60481173 60481168 -
ggggctgggaagcctcaatctc

SEQ ID NO: 222827 - DNA, 22 bp, Artificial Sequence
  Synthetic oligonucleotide; TTG chr2 60481167 60481188 60481172 60481167 -
gggctgggaagcctcaatctcc

SEQ ID NO: 222828 - DNA, 22 bp, Artificial Sequence
  Synthetic oligonucleotide; CTG chr2 60481161 60481182 60481166 60481161 -
ggaagcctcaatctccttgagc

SEQ ID NO: 222829 - DNA, 22 bp, Artificial Sequence
  Synthetic oligonucleotide; CTC chr2 60481152 60481173 60481157 60481152 -
aatctccttgagcacagcaggg

SEQ ID NO: 222830 - DNA, 22 bp, Artificial Sequence
  Synthetic oligonucleotide; CTC chr2 60481146 60481167 60481151 60481146 -
cttgagcacagcagggctttgc

SEQ ID NO: 222831 - DNA, 22 bp, Artificial Sequence
  Synthetic oligonucleotide; CTT chr2 60481143 60481164 60481148 60481143 -
gagcacagcagggctttgcctt

SEQ ID NO: 222832 - DNA, 22 bp, Artificial Sequence
  Synthetic oligonucleotide; TTG chr2 60481142 60481163 60481147 60481142 -
agcacagcagggctttgccttc

SEQ ID NO: 222833 - DNA, 22 bp, Artificial Sequence
  Synthetic oligonucleotide; CTT chr2 60481127 60481148 60481132 60481127 -
tgccttctttcttccctgagct

SEQ ID NO: 222834 - DNA, 22 bp, Artificial Sequence
  Synthetic oligonucleotide; TTT chr2 60481126 60481147 60481131 60481126 -
gccttctttcttccctgagctg

SEQ ID NO: 222835 - DNA, 22 bp, Artificial Sequence
  Synthetic oligonucleotide; TTG chr2 60481125 60481146 60481130 60481125 -
ccttctttcttccctgagctgc

SEQ ID NO: 222836 - DNA, 22 bp, Artificial Sequence
  Synthetic oligonucleotide; CTT chr2 60481121 60481142 60481126 60481121 -
ctttcttccctgagctgcggcc

SEQ ID NO: 222837 - DNA, 22 bp, Artificial Sequence
  Synthetic oligonucleotide; TTC chr2 60481120 60481141 60481125 60481120 -
tttcttccctgagctgcggcca

SEQ ID NO: 222838 - DNA, 22 bp, Artificial Sequence
  Synthetic oligonucleotide; CTT chr2 60481118 60481139 60481123 60481118 -
tcttccctgagctgcggccacc

SEQ ID NO: 222839 - DNA, 22 bp, Artificial Sequence
  Synthetic oligonucleotide; TTT chr2 60481117 60481138 60481122 60481117 -
cttccctgagctgcggccacca

SEQ ID NO: 222840 - DNA, 22 bp, Artificial Sequence
  Synthetic oligonucleotide; TTC chr2 60481116 60481137 60481121 60481116 -
ttccctgagctgcggccaccac

SEQ ID NO: 222841 - DNA, 22 bp, Artificial Sequence
  Synthetic oligonucleotide; CTT chr2 60481114 60481135 60481119 60481114 -
ccctgagctgcggccaccactg

SEQ ID NO: 222842 - DNA, 22 bp, Artificial Sequence
  Synthetic oligonucleotide; TTC chr2 60481113 60481134 60481118 60481113 -
cctgagctgcggccaccactgg

SEQ ID NO: 222843 - DNA, 22 bp, Artificial Sequence
  Synthetic oligonucleotide; CTG chr2 60481109 60481130 60481114 60481109 -
agctgcggccaccactgggctg

SEQ ID NO: 222844 - DNA, 22 bp, Artificial Sequence
  Synthetic oligonucleotide; CTG chr2 60481104 60481125 60481109 60481104 -
cggccaccactgggctgtacca

SEQ ID NO: 222845 - DNA, 22 bp, Artificial Sequence
  Synthetic oligonucleotide; CTG chr2 60481092 60481113 60481097 60481092 -
ggctgtaccaggatctagtgca

SEQ ID NO: 222846 - DNA, 22 bp, Artificial Sequence
  Synthetic oligonucleotide; CTG chr2 60481087 60481108 60481092 60481087 -
taccaggatctagtgcaacttg

SEQ ID NO: 222847 - DNA, 22 bp, Artificial Sequence
  Synthetic oligonucleotide; CTA chr2 60481075 60481096 60481080 60481075 -
gtgcaacttgggtgacaaggtg

SEQ ID NO: 222848 - DNA, 22 bp, Artificial Sequence
  Synthetic oligonucleotide; CTT chr2 60481066 60481087 60481071 60481066 -
gggtgacaaggtgtgggtggct

SEQ ID NO: 222849 - DNA, 22 bp, Artificial Sequence
  Synthetic oligonucleotide; TTG chr2 60481065 60481086 60481070 60481065 -
ggtgacaaggtgtgggtggctg

SEQ ID NO: 222850 - DNA, 22 bp, Artificial Sequence
  Synthetic oligonucleotide; CTG chr2 60481043 60481064 60481048 60481043 -
caggtgttctccctgcatctga

SEQ ID NO: 222851 - DNA, 22 bp, Artificial Sequence
  Synthetic oligonucleotide; TTC chr2 60481034 60481055 60481039 60481034 -
tccctgcatctgaggcagggag

SEQ ID NO: 222852 - DNA, 22 bp, Artificial Sequence
  Synthetic oligonucleotide; CTC chr2 60481032 60481053 60481037 60481032 -
cctgcatctgaggcagggaggc

SEQ ID NO: 222853 - DNA, 22 bp, Artificial Sequence
  Synthetic oligonucleotide; CTG chr2 60481028 60481049 60481033 60481028 -
catctgaggcagggaggcagct

SEQ ID NO: 222854 - DNA, 22 bp, Artificial Sequence
  Synthetic oligonucleotide; CTG chr2 60481022 60481043 60481027 60481022 -
aggcagggaggcagctgggggc

SEQ ID NO: 222855 - DNA, 22 bp, Artificial Sequence
  Synthetic oligonucleotide; CTG chr2 60481005 60481026 60481010 60481005 -
ggggcttccagccagcctgtaa

SEQ ID NO: 222856 - DNA, 22 bp, Artificial Sequence
  Synthetic oligonucleotide; CTT chr2 60480998 60481019 60481003 60480998 -
ccagccagcctgtaatgcccct

SEQ ID NO: 222857 - DNA, 22 bp, Artificial Sequence
  Synthetic oligonucleotide; TTC chr2 60480997 60481018 60481002 60480997 -
cagccagcctgtaatgcccctc

SEQ ID NO: 222858 - DNA, 22 bp, Artificial Sequence
  Synthetic oligonucleotide; CTG chr2 60480986 60481007 60480991 60480986 -
taatgcccctcccaggtctagc

SEQ ID NO: 222859 - DNA, 22 bp, Artificial Sequence
  Synthetic oligonucleotide; CTC chr2 60480975 60480996 60480980 60480975 -
ccaggtctagcttcctagcctt

SEQ ID NO: 222860 - DNA, 22 bp, Artificial Sequence
  Synthetic oligonucleotide; CTA chr2 60480966 60480987 60480971 60480966 -
gcttcctagccttatttttaag

SEQ ID NO: 222861 - DNA, 22 bp, Artificial Sequence
  Synthetic oligonucleotide; CTT chr2 60480962 60480983 60480967 60480962 -
cctagccttatttttaagccct

SEQ ID NO: 222862 - DNA, 22 bp, Artificial Sequence
  Synthetic oligonucleotide; TTC chr2 60480961 60480982 60480966 60480961 -
ctagccttatttttaagccctt

SEQ ID NO: 222863 - DNA, 22 bp, Artificial Sequence
  Synthetic oligonucleotide; CTA chr2 60480958 60480979 60480963 60480958 -
gccttatttttaagccctttta

SEQ ID NO: 222864 - DNA, 22 bp, Artificial Sequence
  Synthetic oligonucleotide; CTT chr2 60480953 60480974 60480958 60480953 -
atttttaagcccttttagtgga

SEQ ID NO: 222865 - DNA, 22 bp, Artificial Sequence
  Synthetic oligonucleotide; TTA chr2 60480952 60480973 60480957 60480952 -
tttttaagcccttttagtggag

SEQ ID NO: 222866 - DNA, 22 bp, Artificial Sequence
  Synthetic oligonucleotide; TTT chr2 60480949 60480970 60480954 60480949 -
ttaagcccttttagtggagcaa

SEQ ID NO: 222867 - DNA, 22 bp, Artificial Sequence
  Synthetic oligonucleotide; TTT chr2 60480948 60480969 60480953 60480948 -
taagcccttttagtggagcaaa

SEQ ID NO: 222868 - DNA, 22 bp, Artificial Sequence
  Synthetic oligonucleotide; TTT chr2 60480947 60480968 60480952 60480947 -
aagcccttttagtggagcaaaa

SEQ ID NO: 222869 - DNA, 22 bp, Artificial Sequence
  Synthetic oligonucleotide; TTA chr2 60480946 60480967 60480951 60480946 -
agcccttttagtggagcaaaaa

SEQ ID NO: 222870 - DNA, 22 bp, Artificial Sequence
  Synthetic oligonucleotide; CTT chr2 60480939 60480960 60480944 60480939 -
ttagtggagcaaaaactattta

SEQ ID NO: 222871 - DNA, 22 bp, Artificial Sequence
  Synthetic oligonucleotide; TTT chr2 60480938 60480959 60480943 60480938 -
tagtggagcaaaaactatttag

SEQ ID NO: 222872 - DNA, 22 bp, Artificial Sequence
  Synthetic oligonucleotide; TTT chr2 60480937 60480958 60480942 60480937 -
agtggagcaaaaactatttaga

SEQ ID NO: 222873 - DNA, 22 bp, Artificial Sequence
  Synthetic oligonucleotide; TTA chr2 60480936 60480957 60480941 60480936 -
gtggagcaaaaactatttagaa

SEQ ID NO: 222874 - DNA, 22 bp, Artificial Sequence
  Synthetic oligonucleotide; CTA chr2 60480921 60480942 60480926 60480921 -
tttagaactatgagttcaaaaa

SEQ ID NO: 222875 - DNA, 22 bp, Artificial Sequence
  Synthetic oligonucleotide; TTT chr2 60480918 60480939 60480923 60480918 -
agaactatgagttcaaaaatag

SEQ ID NO: 222876 - DNA, 22 bp, Artificial Sequence
  Synthetic oligonucleotide; TTA chr2 60480917 60480938 60480922 60480917 -
gaactatgagttcaaaaatagg

SEQ ID NO: 222877 - DNA, 22 bp, Artificial Sequence
  Synthetic oligonucleotide; CTA chr2 60480911 60480932 60480916 60480911 -
tgagttcaaaaataggattatt

SEQ ID NO: 222878 - DNA, 22 bp, Artificial Sequence
  Synthetic oligonucleotide; TTC chr2 60480904 60480925 60480909 60480904 -
aaaaataggattattcaagcgg

SEQ ID NO: 222879 - DNA, 22 bp, Artificial Sequence
  Synthetic oligonucleotide; TTA chr2 60480891 60480912 60480896 60480891 -
ttcaagcggaggtacttcacac

SEQ ID NO: 222880 - DNA, 22 bp, Artificial Sequence
  Synthetic oligonucleotide; TTC chr2 60480888 60480909 60480893 60480888 -
aagcggaggtacttcacactgt

SEQ ID NO: 222881 - DNA, 22 bp, Artificial Sequence
  Synthetic oligonucleotide; CTT chr2 60480874 60480895 60480879 60480874 -
cacactgttctttctcttggga

SEQ ID NO: 222882 - DNA, 22 bp, Artificial Sequence
  Synthetic oligonucleotide; TTC chr2 60480873 60480894 60480878 60480873 -
acactgttctttctcttgggac

SEQ ID NO: 222883 - DNA, 22 bp, Artificial Sequence
  Synthetic oligonucleotide; CTG chr2 60480867 60480888 60480872 60480867 -
ttctttctcttgggacagagat

SEQ ID NO: 222884 - DNA, 22 bp, Artificial Sequence
  Synthetic oligonucleotide; TTC chr2 60480864 60480885 60480869 60480864 -
tttctcttgggacagagatggg

SEQ ID NO: 222885 - DNA, 22 bp, Artificial Sequence
  Synthetic oligonucleotide; CTT chr2 60480862 60480883 60480867 60480862 -
tctcttgggacagagatggggg

SEQ ID NO: 222886 - DNA, 22 bp, Artificial Sequence
  Synthetic oligonucleotide; TTT chr2 60480861 60480882 60480866 60480861 -
ctcttgggacagagatgggggt

SEQ ID NO: 222887 - DNA, 22 bp, Artificial Sequence
  Synthetic oligonucleotide; TTC chr2 60480860 60480881 60480865 60480860 -
tcttgggacagagatgggggtg

SEQ ID NO: 222888 - DNA, 22 bp, Artificial Sequence
  Synthetic oligonucleotide; CTC chr2 60480858 60480879 60480863 60480858 -
ttgggacagagatgggggtgca

SEQ ID NO: 222889 - DNA, 22 bp, Artificial Sequence
  Synthetic oligonucleotide; CTT chr2 60480856 60480877 60480861 60480856 -
gggacagagatgggggtgcagg

SEQ ID NO: 222890 - DNA, 22 bp, Artificial Sequence
  Synthetic oligonucleotide; TTG chr2 60480855 60480876 60480860 60480855 -
ggacagagatgggggtgcaggt

SEQ ID NO: 222891 - DNA, 22 bp, Artificial Sequence
  Synthetic oligonucleotide; TTG chr2 60480799 60480820 60480804 60480799 -
ctaaaacaaattgagagaggaa

SEQ ID NO: 222892 - DNA, 22 bp, Artificial Sequence
  Synthetic oligonucleotide; CTA chr2 60480796 60480817 60480801 60480796 -
aaacaaattgagagaggaagga

SEQ ID NO: 222893 - DNA, 22 bp, Artificial Sequence
  Synthetic oligonucleotide; TTG chr2 60480786 60480807 60480791 60480786 -
agagaggaaggaagaaagggac

SEQ ID NO: 222894 - DNA, 22 bp, Artificial Sequence
  Synthetic oligonucleotide; CTA chr2 60480756 60480777 60480761 60480756 -
gtaattgagaccaattcaccag

SEQ ID NO: 222895 - DNA, 22 bp, Artificial Sequence
  Synthetic oligonucleotide; TTG chr2 60480749 60480770 60480754 60480749 -
agaccaattcaccagaagactt

SEQ ID NO: 222896 - DNA, 22 bp, Artificial Sequence
  Synthetic oligonucleotide; TTC chr2 60480739 60480760 60480744 60480739 -
accagaagacttaaggaaattt

SEQ ID NO: 222897 - DNA, 22 bp, Artificial Sequence
  Synthetic oligonucleotide; CTT chr2 60480727 60480748 60480732 60480727 -
aaggaaatttgacatccgctgt

SEQ ID NO: 222898 - DNA, 22 bp, Artificial Sequence
  Synthetic oligonucleotide; TTA chr2 60480726 60480747 60480731 60480726 -
aggaaatttgacatccgctgta

SEQ ID NO: 222899 - DNA, 22 bp, Artificial Sequence
  Synthetic oligonucleotide; TTT chr2 60480717 60480738 60480722 60480717 -
gacatccgctgtagctctttta

SEQ ID NO: 222900 - DNA, 22 bp, Artificial Sequence
  Synthetic oligonucleotide; TTG chr2 60480716 60480737 60480721 60480716 -
acatccgctgtagctcttttaa

SEQ ID NO: 222901 - DNA, 22 bp, Artificial Sequence
  Synthetic oligonucleotide; CTG chr2 60480706 60480727 60480711 60480706 -
tagctcttttaactgtgtaatt

SEQ ID NO: 222902 - DNA, 22 bp, Artificial Sequence
  Synthetic oligonucleotide; CTC chr2 60480700 60480721 60480705 60480700 -
ttttaactgtgtaattacacag

SEQ ID NO: 222903 - DNA, 22 bp, Artificial Sequence
  Synthetic oligonucleotide; CTT chr2 60480698 60480719 60480703 60480698 -
ttaactgtgtaattacacagca

SEQ ID NO: 222904 - DNA, 22 bp, Artificial Sequence
  Synthetic oligonucleotide; TTT chr2 60480697 60480718 60480702 60480697 -
taactgtgtaattacacagcat

SEQ ID NO: 222905 - DNA, 22 bp, Artificial Sequence
  Synthetic oligonucleotide; TTT chr2 60480696 60480717 60480701 60480696 -
aactgtgtaattacacagcatt

SEQ ID NO: 222906 - DNA, 22 bp, Artificial Sequence
  Synthetic oligonucleotide; TTA chr2 60480695 60480716 60480700 60480695 -
actgtgtaattacacagcattt

SEQ ID NO: 222907 - DNA, 22 bp, Artificial Sequence
  Synthetic oligonucleotide; CTG chr2 60480691 60480712 60480696 60480691 -
tgtaattacacagcatttggaa

SEQ ID NO: 222908 - DNA, 22 bp, Artificial Sequence
  Synthetic oligonucleotide; TTA chr2 60480683 60480704 60480688 60480683 -
cacagcatttggaaagtgaatg

SEQ ID NO: 222909 - DNA, 22 bp, Artificial Sequence
  Synthetic oligonucleotide; TTT chr2 60480673 60480694 60480678 60480673 -
ggaaagtgaatgattaacctga

SEQ ID NO: 222910 - DNA, 22 bp, Artificial Sequence
  Synthetic oligonucleotide; TTG chr2 60480672 60480693 60480677 60480672 -
gaaagtgaatgattaacctgat

SEQ ID NO: 222911 - DNA, 22 bp, Artificial Sequence
  Synthetic oligonucleotide; TTA chr2 60480657 60480678 60480662 60480657 -
acctgattgtccataacaacca

SEQ ID NO: 222912 - DNA, 22 bp, Artificial Sequence
  Synthetic oligonucleotide; CTG chr2 60480652 60480673 60480657 60480652 -
attgtccataacaaccattgag

SEQ ID NO: 222913 - DNA, 22 bp, Artificial Sequence
  Synthetic oligonucleotide; TTG chr2 60480648 60480669 60480653 60480648 -
tccataacaaccattgagtaaa

SEQ ID NO: 222914 - DNA, 22 bp, Artificial Sequence
  Synthetic oligonucleotide; TTG chr2 60480632 60480653 60480637 60480632 -
agtaaatacactattacagatt

SEQ ID NO: 222915 - DNA, 22 bp, Artificial Sequence
  Synthetic oligonucleotide; CTA chr2 60480619 60480640 60480624 60480619 -
ttacagattgccaaaatagtac

SEQ ID NO: 222916 - DNA, 22 bp, Artificial Sequence
  Synthetic oligonucleotide; TTA chr2 60480616 60480637 60480621 60480616 -
cagattgccaaaatagtacagt

SEQ ID NO: 222917 - DNA, 22 bp, Artificial Sequence
  Synthetic oligonucleotide; TTG chr2 60480609 60480630 60480614 60480609 -
ccaaaatagtacagtgaagcga

SEQ ID NO: 222918 - DNA, 22 bp, Artificial Sequence
  Synthetic oligonucleotide; CTT chr2 60480570 60480591 60480575 60480570 -
tcaaggggctgtaatcctctcc

SEQ ID NO: 222919 - DNA, 22 bp, Artificial Sequence
  Synthetic oligonucleotide; TTT chr2 60480569 60480590 60480574 60480569 -
caaggggctgtaatcctctcct

SEQ ID NO: 222920 - DNA, 22 bp, Artificial Sequence
  Synthetic oligonucleotide; TTC chr2 60480568 60480589 60480573 60480568 -
aaggggctgtaatcctctcctg

SEQ ID NO: 222921 - DNA, 22 bp, Artificial Sequence
  Synthetic oligonucleotide; CTG chr2 60480559 60480580 60480564 60480559 -
taatcctctcctgggtcaaggc

SEQ ID NO: 222922 - DNA, 22 bp, Artificial Sequence
  Synthetic oligonucleotide; CTC chr2 60480551 60480572 60480556 60480551 -
tcctgggtcaaggctgacccag

SEQ ID NO: 222923 - DNA, 22 bp, Artificial Sequence
  Synthetic oligonucleotide; CTC chr2 60480549 60480570 60480554 60480549 -
ctgggtcaaggctgacccagag

SEQ ID NO: 222924 - DNA, 22 bp, Artificial Sequence
  Synthetic oligonucleotide; CTG chr2 60480546 60480567 60480551 60480546 -
ggtcaaggctgacccagaggct

SEQ ID NO: 222925 - DNA, 22 bp, Artificial Sequence
  Synthetic oligonucleotide; CTG chr2 60480535 60480556 60480540 60480535 -
acccagaggctccttggttagt

SEQ ID NO: 222926 - DNA, 22 bp, Artificial Sequence
  Synthetic oligonucleotide; CTC chr2 60480523 60480544 60480528 60480523 -
cttggttagtgaatcatttact

SEQ ID NO: 222927 - DNA, 22 bp, Artificial Sequence
  Synthetic oligonucleotide; CTT chr2 60480520 60480541 60480525 60480520 -
ggttagtgaatcatttactagg

SEQ ID NO: 222928 - DNA, 22 bp, Artificial Sequence
  Synthetic oligonucleotide; TTG chr2 60480519 60480540 60480524 60480519 -
gttagtgaatcatttactaggg

SEQ ID NO: 222929 - DNA, 22 bp, Artificial Sequence
  Synthetic oligonucleotide; TTA chr2 60480515 60480536 60480520 60480515 -
gtgaatcatttactagggaagg

SEQ ID NO: 222930 - DNA, 22 bp, Artificial Sequence
  Synthetic oligonucleotide; TTT chr2 60480504 60480525 60480509 60480504 -
actagggaaggtttcccctggt

SEQ ID NO: 222931 - DNA, 22 bp, Artificial Sequence
  Synthetic oligonucleotide; TTA chr2 60480503 60480524 60480508 60480503 -
ctagggaaggtttcccctggtc

SEQ ID NO: 222932 - DNA, 22 bp, Artificial Sequence
  Synthetic oligonucleotide; CTA chr2 60480500 60480521 60480505 60480500 -
gggaaggtttcccctggtcact

SEQ ID NO: 222933 - DNA, 22 bp, Artificial Sequence
  Synthetic oligonucleotide; TTT chr2 60480490 60480511 60480495 60480490 -
cccctggtcactgctggctcca

SEQ ID NO: 222934 - DNA, 22 bp, Artificial Sequence
  Synthetic oligonucleotide; TTC chr2 60480489 60480510 60480494 60480489 -
ccctggtcactgctggctccat

SEQ ID NO: 222935 - DNA, 22 bp, Artificial Sequence
  Synthetic oligonucleotide; CTG chr2 60480484 60480505 60480489 60480484 -
gtcactgctggctccatggcct

SEQ ID NO: 222936 - DNA, 22 bp, Artificial Sequence
  Synthetic oligonucleotide; CTG chr2 60480477 60480498 60480482 60480477 -
ctggctccatggcctggtcctt

SEQ ID NO: 222937 - DNA, 22 bp, Artificial Sequence
  Synthetic oligonucleotide; CTG chr2 60480474 60480495 60480479 60480474 -
gctccatggcctggtccttcca

SEQ ID NO: 222938 - DNA, 22 bp, Artificial Sequence
  Synthetic oligonucleotide; CTC chr2 60480470 60480491 60480475 60480470 -
catggcctggtccttccagcca

SEQ ID NO: 222939 - DNA, 22 bp, Artificial Sequence
  Synthetic oligonucleotide; CTG chr2 60480461 60480482 60480466 60480461 -
gtccttccagccaggtcattta

SEQ ID NO: 222940 - DNA, 22 bp, Artificial Sequence
  Synthetic oligonucleotide; CTT chr2 60480455 60480476 60480460 60480455 -
ccagccaggtcatttagaatgg

SEQ ID NO: 222941 - DNA, 22 bp, Artificial Sequence
  Synthetic oligonucleotide; TTC chr2 60480454 60480475 60480459 60480454 -
cagccaggtcatttagaatggc

SEQ ID NO: 222942 - DNA, 22 bp, Artificial Sequence
  Synthetic oligonucleotide; TTT chr2 60480440 60480461 60480445 60480440 -
agaatggctctccaacaggaag

SEQ ID NO: 222943 - DNA, 22 bp, Artificial Sequence
  Synthetic oligonucleotide; TTA chr2 60480439 60480460 60480444 60480439 -
gaatggctctccaacaggaaga

SEQ ID NO: 222944 - DNA, 22 bp, Artificial Sequence
  Synthetic oligonucleotide; CTC chr2 60480430 60480451 60480435 60480430 -
tccaacaggaagaaaagttcac

SEQ ID NO: 222945 - DNA, 22 bp, Artificial Sequence
  Synthetic oligonucleotide; CTC chr2 60480428 60480449 60480433 60480428 -
caacaggaagaaaagttcactg

SEQ ID NO: 222946 - DNA, 22 bp, Artificial Sequence
  Synthetic oligonucleotide; TTC chr2 60480410 60480431 60480415 60480410 -
actgcacagcgcttgaatccta

SEQ ID NO: 222947 - DNA, 22 bp, Artificial Sequence
  Synthetic oligonucleotide; CTG chr2 60480406 60480427 60480411 60480406 -
cacagcgcttgaatcctaatta

SEQ ID NO: 222948 - DNA, 22 bp, Artificial Sequence
  Synthetic oligonucleotide; CTT chr2 60480396 60480417 60480401 60480396 -
gaatcctaattatttattgagg

SEQ ID NO: 222949 - DNA, 22 bp, Artificial Sequence
  Synthetic oligonucleotide; TTG chr2 60480395 60480416 60480400 60480395 -
aatcctaattatttattgaggg

SEQ ID NO: 222950 - DNA, 22 bp, Artificial Sequence
  Synthetic oligonucleotide; CTA chr2 60480388 60480409 60480393 60480388 -
attatttattgaggggctcttc

SEQ ID NO: 222951 - DNA, 22 bp, Artificial Sequence
  Synthetic oligonucleotide; TTA chr2 60480384 60480405 60480389 60480384 -
tttattgaggggctcttctttg

SEQ ID NO: 222952 - DNA, 22 bp, Artificial Sequence
  Synthetic oligonucleotide; TTT chr2 60480381 60480402 60480386 60480381 -
attgaggggctcttctttgccc

SEQ ID NO: 222953 - DNA, 22 bp, Artificial Sequence
  Synthetic oligonucleotide; TTA chr2 60480380 60480401 60480385 60480380 -
ttgaggggctcttctttgccca

SEQ ID NO: 222954 - DNA, 22 bp, Artificial Sequence
  Synthetic oligonucleotide; TTG chr2 60480377 60480398 60480382 60480377 -
aggggctcttctttgcccagca

SEQ ID NO: 222955 - DNA, 22 bp, Artificial Sequence
  Synthetic oligonucleotide; CTC chr2 60480369 60480390 60480374 60480369 -
ttctttgcccagcatggtgctg

SEQ ID NO: 222956 - DNA, 22 bp, Artificial Sequence
  Synthetic oligonucleotide; CTT chr2 60480367 60480388 60480372 60480367 -
ctttgcccagcatggtgctgga

SEQ ID NO: 222957 - DNA, 22 bp, Artificial Sequence
  Synthetic oligonucleotide; TTC chr2 60480366 60480387 60480371 60480366 -
tttgcccagcatggtgctggac

SEQ ID NO: 222958 - DNA, 22 bp, Artificial Sequence
  Synthetic oligonucleotide; CTT chr2 60480364 60480385 60480369 60480364 -
tgcccagcatggtgctggacag

SEQ ID NO: 222959 - DNA, 22 bp, Artificial Sequence
  Synthetic oligonucleotide; TTT chr2 60480363 60480384 60480368 60480363 -
gcccagcatggtgctggacagt

SEQ ID NO: 222960 - DNA, 22 bp, Artificial Sequence
  Synthetic oligonucleotide; TTG chr2 60480362 60480383 60480367 60480362 -
cccagcatggtgctggacagtc

SEQ ID NO: 222961 - DNA, 22 bp, Artificial Sequence
  Synthetic oligonucleotide; CTG chr2 60480347 60480368 60480352 60480347 -
gacagtcagaggtagaccactg

SEQ ID NO: 222962 - DNA, 22 bp, Artificial Sequence
  Synthetic oligonucleotide; CTG chr2 60480325 60480346 60480330 60480325 -
agtcttggttcttagaagcctt

SEQ ID NO: 222963 - DNA, 22 bp, Artificial Sequence
  Synthetic oligonucleotide; CTT chr2 60480319 60480340 60480324 60480319 -
ggttcttagaagccttgaactt

SEQ ID NO: 222964 - DNA, 22 bp, Artificial Sequence
  Synthetic oligonucleotide; TTG chr2 60480318 60480339 60480323 60480318 -
gttcttagaagccttgaacttt

SEQ ID NO: 222965 - DNA, 22 bp, Artificial Sequence
  Synthetic oligonucleotide; TTC chr2 60480314 60480335 60480319 60480314 -
ttagaagccttgaacttttagt

SEQ ID NO: 222966 - DNA, 22 bp, Artificial Sequence
  Synthetic oligonucleotide; CTT chr2 60480312 60480333 60480317 60480312 -
agaagccttgaacttttagttg

SEQ ID NO: 222967 - DNA, 22 bp, Artificial Sequence
  Synthetic oligonucleotide; TTA chr2 60480311 60480332 60480316 60480311 -
gaagccttgaacttttagttgg

SEQ ID NO: 222968 - DNA, 22 bp, Artificial Sequence
  Synthetic oligonucleotide; CTT chr2 60480303 60480324 60480308 60480303 -
gaacttttagttggagaaccag

SEQ ID NO: 222969 - DNA, 22 bp, Artificial Sequence
  Synthetic oligonucleotide; TTG chr2 60480302 60480323 60480307 60480302 -
aacttttagttggagaaccagt

SEQ ID NO: 222970 - DNA, 22 bp, Artificial Sequence
  Synthetic oligonucleotide; CTT chr2 60480297 60480318 60480302 60480297 -
ttagttggagaaccagtggtag

SEQ ID NO: 222971 - DNA, 22 bp, Artificial Sequence
  Synthetic oligonucleotide; TTT chr2 60480296 60480317 60480301 60480296 -
tagttggagaaccagtggtaga

SEQ ID NO: 222972 - DNA, 22 bp, Artificial Sequence
  Synthetic oligonucleotide; TTT chr2 60480295 60480316 60480300 60480295 -
agttggagaaccagtggtagat

SEQ ID NO: 222973 - DNA, 22 bp, Artificial Sequence
  Synthetic oligonucleotide; TTA chr2 60480294 60480315 60480299 60480294 -
gttggagaaccagtggtagata

SEQ ID NO: 222974 - DNA, 22 bp, Artificial Sequence
  Synthetic oligonucleotide; TTG chr2 60480290 60480311 60480295 60480290 -
gagaaccagtggtagatacatg

SEQ ID NO: 222975 - DNA, 22 bp, Artificial Sequence
  Synthetic oligonucleotide; CTG chr2 60480265 60480286 60480270 60480265 -
attacagggagacttggatcca

SEQ ID NO: 222976 - DNA, 22 bp, Artificial Sequence
  Synthetic oligonucleotide; TTA chr2 60480261 60480282 60480266 60480261 -
cagggagacttggatccaggag

SEQ ID NO: 222977 - DNA, 22 bp, Artificial Sequence
  Synthetic oligonucleotide; CTT chr2 60480250 60480271 60480255 60480250 -
ggatccaggagaaatggagtgg

SEQ ID NO: 222978 - DNA, 22 bp, Artificial Sequence
  Synthetic oligonucleotide; TTG chr2 60480249 60480270 60480254 60480249 -
gatccaggagaaatggagtgga

SEQ ID NO: 222979 - DNA, 22 bp, Artificial Sequence
  Synthetic oligonucleotide; TTC chr2 60480216 60480237 60480221 60480216 -
agaagagagacatatcctttac

SEQ ID NO: 222980 - DNA, 22 bp, Artificial Sequence
  Synthetic oligonucleotide; CTT chr2 60480197 60480218 60480202 60480197 -
tacaggcctttgtgttacctag

SEQ ID NO: 222981 - DNA, 22 bp, Artificial Sequence
  Synthetic oligonucleotide; TTT chr2 60480196 60480217 60480201 60480196 -
acaggcctttgtgttacctagc

SEQ ID NO: 222982 - DNA, 22 bp, Artificial Sequence
  Synthetic oligonucleotide; TTA chr2 60480195 60480216 60480200 60480195 -
caggcctttgtgttacctagcc

SEQ ID NO: 222983 - DNA, 22 bp, Artificial Sequence
  Synthetic oligonucleotide; CTT chr2 60480187 60480208 60480192 60480187 -
tgtgttacctagccagtgcctt

SEQ ID NO: 222984 - DNA, 22 bp, Artificial Sequence
  Synthetic oligonucleotide; TTT chr2 60480186 60480207 60480191 60480186 -
gtgttacctagccagtgccttc

SEQ ID NO: 222985 - DNA, 22 bp, Artificial Sequence
  Synthetic oligonucleotide; TTG chr2 60480185 60480206 60480190 60480185 -
tgttacctagccagtgccttca

SEQ ID NO: 222986 - DNA, 22 bp, Artificial Sequence
  Synthetic oligonucleotide; TTA chr2 60480180 60480201 60480185 60480180 -
cctagccagtgccttcatgtcc

SEQ ID NO: 222987 - DNA, 22 bp, Artificial Sequence
  Synthetic oligonucleotide; CTA chr2 60480176 60480197 60480181 60480176 -
gccagtgccttcatgtccccag

SEQ ID NO: 222988 - DNA, 22 bp, Artificial Sequence
  Synthetic oligonucleotide; CTT chr2 60480165 60480186 60480170 60480165 -
catgtccccagccccctggcct

SEQ ID NO: 222989 - DNA, 22 bp, Artificial Sequence
  Synthetic oligonucleotide; TTC chr2 60480164 60480185 60480169 60480164 -
atgtccccagccccctggcctc

SEQ ID NO: 222990 - DNA, 22 bp, Artificial Sequence
  Synthetic oligonucleotide; CTG chr2 60480147 60480168 60480152 60480147 -
gcctccagctcctccaccccca

SEQ ID NO: 222991 - DNA, 22 bp, Artificial Sequence
  Synthetic oligonucleotide; CTC chr2 60480142 60480163 60480147 60480142 -
cagctcctccacccccaccttc

SEQ ID NO: 222992 - DNA, 22 bp, Artificial Sequence
  Synthetic oligonucleotide; CTC chr2 60480136 60480157 60480141 60480136 -
ctccacccccaccttcccccct

SEQ ID NO: 222993 - DNA, 22 bp, Artificial Sequence
  Synthetic oligonucleotide; CTC chr2 60480133 60480154 60480138 60480133 -
cacccccaccttcccccctcct

SEQ ID NO: 222994 - DNA, 22 bp, Artificial Sequence
  Synthetic oligonucleotide; CTT chr2 60480121 60480142 60480126 60480121 -
cccccctcctcgctgtccttgg

SEQ ID NO: 222995 - DNA, 22 bp, Artificial Sequence
  Synthetic oligonucleotide; TTC chr2 60480120 60480141 60480125 60480120 -
ccccctcctcgctgtccttggt

SEQ ID NO: 222996 - DNA, 22 bp, Artificial Sequence
  Synthetic oligonucleotide; CTC chr2 60480113 60480134 60480118 60480113 -
ctcgctgtccttggtgcagagt

SEQ ID NO: 222997 - DNA, 22 bp, Artificial Sequence
  Synthetic oligonucleotide; CTC chr2 60480110 60480131 60480115 60480110 -
gctgtccttggtgcagagtggg

SEQ ID NO: 222998 - DNA, 22 bp, Artificial Sequence
  Synthetic oligonucleotide; CTG chr2 60480106 60480127 60480111 60480106 -
tccttggtgcagagtggggcag

SEQ ID NO: 222999 - DNA, 22 bp, Artificial Sequence
  Synthetic oligonucleotide; CTT chr2 60480101 60480122 60480106 60480101 -
ggtgcagagtggggcagtcatc

SEQ ID NO: 223000 - DNA, 22 bp, Artificial Sequence
  Synthetic oligonucleotide; TTG chr2 60480100 60480121 60480105 60480100 -
gtgcagagtggggcagtcatct

SEQ ID NO: 223001 - DNA, 22 bp, Artificial Sequence
  Synthetic oligonucleotide; CTC chr2 60480077 60480098 60480082 60480077 -
agtggggcctcctcccggggaa

SEQ ID NO: 223002 - DNA, 22 bp, Artificial Sequence
  Synthetic oligonucleotide; CTC chr2 60480066 60480087 60480071 60480066 -
ctcccggggaagtccacagctt

SEQ ID NO: 223003 - DNA, 22 bp, Artificial Sequence
  Synthetic oligonucleotide; CTC chr2 60480063 60480084 60480068 60480063 -
ccggggaagtccacagcttgct

SEQ ID NO: 223004 - DNA, 22 bp, Artificial Sequence
  Synthetic oligonucleotide; CTT chr2 60480044 60480065 60480049 60480044 -
gctccacaccggaggagccgcc

SEQ ID NO: 223005 - DNA, 22 bp, Artificial Sequence
  Synthetic oligonucleotide; TTG chr2 60480043 60480064 60480048 60480043 -
ctccacaccggaggagccgcca

SEQ ID NO: 223006 - DNA, 22 bp, Artificial Sequence
  Synthetic oligonucleotide; CTC chr2 60480040 60480061 60480045 60480040 -
cacaccggaggagccgccaaag

SEQ ID NO: 223007 - DNA, 22 bp, Artificial Sequence
  Synthetic oligonucleotide; TTT chr2 60479978 60479999 60479983 60479978 -
aacaaaagcagcttttgagtga

SEQ ID NO: 223008 - DNA, 22 bp, Artificial Sequence
  Synthetic oligonucleotide; TTA chr2 60479977 60479998 60479982 60479977 -
acaaaagcagcttttgagtgag

SEQ ID NO: 223009 - DNA, 22 bp, Artificial Sequence
  Synthetic oligonucleotide; CTT chr2 60479964 60479985 60479969 60479964 -
ttgagtgagaaagctgagtgga

SEQ ID NO: 223010 - DNA, 22 bp, Artificial Sequence
  Synthetic oligonucleotide; TTT chr2 60479963 60479984 60479968 60479963 -
tgagtgagaaagctgagtggag

SEQ ID NO: 223011 - DNA, 22 bp, Artificial Sequence
  Synthetic oligonucleotide; TTT chr2 60479962 60479983 60479967 60479962 -
gagtgagaaagctgagtggagt

SEQ ID NO: 223012 - DNA, 22 bp, Artificial Sequence
  Synthetic oligonucleotide; TTG chr2 60479961 60479982 60479966 60479961 -
agtgagaaagctgagtggagtt

SEQ ID NO: 223013 - DNA, 22 bp, Artificial Sequence
  Synthetic oligonucleotide; CTG chr2 60479948 60479969 60479953 60479948 -
agtggagttgtcccaacctgtc

SEQ ID NO: 223014 - DNA, 22 bp, Artificial Sequence
  Synthetic oligonucleotide; TTG chr2 60479938 60479959 60479943 60479938 -
tcccaacctgtcaacttcagat

SEQ ID NO: 223015 - DNA, 22 bp, Artificial Sequence
  Synthetic oligonucleotide; CTG chr2 60479928 60479949 60479933 60479928 -
tcaacttcagatttctttcctc

SEQ ID NO: 223016 - DNA, 22 bp, Artificial Sequence
  Synthetic oligonucleotide; CTT chr2 60479921 60479942 60479926 60479921 -
cagatttctttcctcctcccca

SEQ ID NO: 223017 - DNA, 22 bp, Artificial Sequence
  Synthetic oligonucleotide; TTC chr2 60479920 60479941 60479925 60479920 -
agatttctttcctcctccccat

SEQ ID NO: 223018 - DNA, 22 bp, Artificial Sequence
  Synthetic oligonucleotide; TTT chr2 60479914 60479935 60479919 60479914 -
ctttcctcctccccataaatca

SEQ ID NO: 223019 - DNA, 22 bp, Artificial Sequence
  Synthetic oligonucleotide; TTC chr2 60479913 60479934 60479918 60479913 -
tttcctcctccccataaatcaa

SEQ ID NO: 223020 - DNA, 22 bp, Artificial Sequence
  Synthetic oligonucleotide; CTT chr2 60479911 60479932 60479916 60479911 -
tcctcctccccataaatcaaaa

SEQ ID NO: 223021 - DNA, 22 bp, Artificial Sequence
  Synthetic oligonucleotide; TTT chr2 60479910 60479931 60479915 60479910 -
cctcctccccataaatcaaaaa

SEQ ID NO: 223022 - DNA, 22 bp, Artificial Sequence
  Synthetic oligonucleotide; TTC chr2 60479909 60479930 60479914 60479909 -
ctcctccccataaatcaaaaaa

SEQ ID NO: 223023 - DNA, 22 bp, Artificial Sequence
  Synthetic oligonucleotide; CTC chr2 60479906 60479927 60479911 60479906 -
ctccccataaatcaaaaaacgg

SEQ ID NO: 223024 - DNA, 22 bp, Artificial Sequence
  Synthetic oligonucleotide; CTC chr2 60479903 60479924 60479908 60479903 -
cccataaatcaaaaaacggttg

SEQ ID NO: 223025 - DNA, 22 bp, Artificial Sequence
  Synthetic oligonucleotide; TTG chr2 60479881 60479902 60479886 60479881 -
gtggaagggagggacagaagcg

SEQ ID NO: 223026 - DNA, 22 bp, Artificial Sequence
  Synthetic oligonucleotide; TTT chr2 60479856 60479877 60479861 60479856 -
cattttcagattttgtaagaaa

SEQ ID NO: 223027 - DNA, 22 bp, Artificial Sequence
  Synthetic oligonucleotide; TTC chr2 60479855 60479876 60479860 60479855 -
attttcagattttgtaagaaaa

SEQ ID NO: 223028 - DNA, 22 bp, Artificial Sequence
  Synthetic oligonucleotide; TTT chr2 60479851 60479872 60479856 60479851 -
tcagattttgtaagaaaataaa

SEQ ID NO: 223029 - DNA, 22 bp, Artificial Sequence
  Synthetic oligonucleotide; TTT chr2 60479850 60479871 60479855 60479850 -
cagattttgtaagaaaataaaa

SEQ ID NO: 223030 - DNA, 22 bp, Artificial Sequence
  Synthetic oligonucleotide; TTC chr2 60479849 60479870 60479854 60479849 -
agattttgtaagaaaataaaat

SEQ ID NO: 223031 - DNA, 22 bp, Artificial Sequence
  Synthetic oligonucleotide; TTT chr2 60479843 60479864 60479848 60479843 -
tgtaagaaaataaaataaaatc

SEQ ID NO: 223032 - DNA, 22 bp, Artificial Sequence
  Synthetic oligonucleotide; TTT chr2 60479842 60479863 60479847 60479842 -
gtaagaaaataaaataaaatca

SEQ ID NO: 223033 - DNA, 22 bp, Artificial Sequence
  Synthetic oligonucleotide; TTG chr2 60479841 60479862 60479846 60479841 -
taagaaaataaaataaaatcaa

SEQ ID NO: 223034 - DNA, 22 bp, Artificial Sequence
  Synthetic oligonucleotide; CTG chr2 60479810 60479831 60479815 60479810 -
tcccacgctgataccttacatg

SEQ ID NO: 223035 - DNA, 22 bp, Artificial Sequence
  Synthetic oligonucleotide; CTG chr2 60479800 60479821 60479805 60479800 -
ataccttacatgccaggtttga

SEQ ID NO: 223036 - DNA, 22 bp, Artificial Sequence
  Synthetic oligonucleotide; CTT chr2 60479793 60479814 60479798 60479793 -
acatgccaggtttgagcctgag

SEQ ID NO: 223037 - DNA, 22 bp, Artificial Sequence
  Synthetic oligonucleotide; TTA chr2 60479792 60479813 60479797 60479792 -
catgccaggtttgagcctgagg

SEQ ID NO: 223038 - DNA, 22 bp, Artificial Sequence
  Synthetic oligonucleotide; TTT chr2 60479780 60479801 60479785 60479780 -
gagcctgaggcaaatttttgtg

SEQ ID NO: 223039 - DNA, 22 bp, Artificial Sequence
  Synthetic oligonucleotide; TTG chr2 60479779 60479800 60479784 60479779 -
agcctgaggcaaatttttgtgg

SEQ ID NO: 223040 - DNA, 22 bp, Artificial Sequence
  Synthetic oligonucleotide; CTG chr2 60479773 60479794 60479778 60479773 -
aggcaaatttttgtggccatgt

SEQ ID NO: 223041 - DNA, 22 bp, Artificial Sequence
  Synthetic oligonucleotide; TTT chr2 60479763 60479784 60479768 60479763 -
ttgtggccatgtaataagcctc

SEQ ID NO: 223042 - DNA, 22 bp, Artificial Sequence
  Synthetic oligonucleotide; TTT chr2 60479762 60479783 60479767 60479762 -
tgtggccatgtaataagcctct

SEQ ID NO: 223043 - DNA, 22 bp, Artificial Sequence
  Synthetic oligonucleotide; TTT chr2 60479761 60479782 60479766 60479761 -
gtggccatgtaataagcctctt

SEQ ID NO: 223044 - DNA, 22 bp, Artificial Sequence
  Synthetic oligonucleotide; TTG chr2 60479760 60479781 60479765 60479760 -
tggccatgtaataagcctcttt

SEQ ID NO: 223045 - DNA, 22 bp, Artificial Sequence
  Synthetic oligonucleotide; CTC chr2 60479741 60479762 60479746 60479741 -
tttaaaatggtgacagaccctt

SEQ ID NO: 223046 - DNA, 22 bp, Artificial Sequence
  Synthetic oligonucleotide; CTT chr2 60479739 60479760 60479744 60479739 -
taaaatggtgacagacccttga

SEQ ID NO: 223047 - DNA, 22 bp, Artificial Sequence
  Synthetic oligonucleotide; TTT chr2 60479738 60479759 60479743 60479738 -
aaaatggtgacagacccttgac

SEQ ID NO: 223048 - DNA, 22 bp, Artificial Sequence
  Synthetic oligonucleotide; TTA chr2 60479737 60479758 60479742 60479737 -
aaatggtgacagacccttgact

SEQ ID NO: 223049 - DNA, 22 bp, Artificial Sequence
  Synthetic oligonucleotide; CTT chr2 60479719 60479740 60479724 60479719 -
gactctttgccttgaattacat

SEQ ID NO: 223050 - DNA, 22 bp, Artificial Sequence
  Synthetic oligonucleotide; TTG chr2 60479718 60479739 60479723 60479718 -
actctttgccttgaattacatt

SEQ ID NO: 223051 - DNA, 22 bp, Artificial Sequence
  Synthetic oligonucleotide; CTC chr2 60479714 60479735 60479719 60479714 -
tttgccttgaattacattgata

SEQ ID NO: 223052 - DNA, 22 bp, Artificial Sequence
  Synthetic oligonucleotide; CTT chr2 60479712 60479733 60479717 60479712 -
tgccttgaattacattgataaa

SEQ ID NO: 223053 - DNA, 22 bp, Artificial Sequence
  Synthetic oligonucleotide; TTT chr2 60479711 60479732 60479716 60479711 -
gccttgaattacattgataaaa

SEQ ID NO: 223054 - DNA, 22 bp, Artificial Sequence
  Synthetic oligonucleotide; TTG chr2 60479710 60479731 60479715 60479710 -
ccttgaattacattgataaaag

SEQ ID NO: 223055 - DNA, 22 bp, Artificial Sequence
  Synthetic oligonucleotide; CTT chr2 60479706 60479727 60479711 60479706 -
gaattacattgataaaagacat

SEQ ID NO: 223056 - DNA, 22 bp, Artificial Sequence
  Synthetic oligonucleotide; TTG chr2 60479705 60479726 60479710 60479705 -
aattacattgataaaagacatt

SEQ ID NO: 223057 - DNA, 22 bp, Artificial Sequence
  Synthetic oligonucleotide; TTA chr2 60479700 60479721 60479705 60479700 -
cattgataaaagacattttatt

SEQ ID NO: 223058 - DNA, 22 bp, Artificial Sequence
  Synthetic oligonucleotide; TTG chr2 60479695 60479716 60479700 60479695 -
ataaaagacattttattgcatt

SEQ ID NO: 223059 - DNA, 22 bp, Artificial Sequence
  Synthetic oligonucleotide; TTT chr2 60479682 60479703 60479687 60479682 -
tattgcattagagctggggcag

SEQ ID NO: 223060 - DNA, 22 bp, Artificial Sequence
  Synthetic oligonucleotide; TTT chr2 60479681 60479702 60479686 60479681 -
attgcattagagctggggcagg

SEQ ID NO: 223061 - DNA, 22 bp, Artificial Sequence
  Synthetic oligonucleotide; TTA chr2 60479680 60479701 60479685 60479680 -
ttgcattagagctggggcagga

SEQ ID NO: 223062 - DNA, 22 bp, Artificial Sequence
  Synthetic oligonucleotide; TTG chr2 60479677 60479698 60479682 60479677 -
cattagagctggggcaggagta

SEQ ID NO: 223063 - DNA, 22 bp, Artificial Sequence
  Synthetic oligonucleotide; TTA chr2 60479672 60479693 60479677 60479672 -
gagctggggcaggagtacagga

SEQ ID NO: 223064 - DNA, 22 bp, Artificial Sequence
  Synthetic oligonucleotide; CTG chr2 60479666 60479687 60479671 60479666 -
gggcaggagtacaggacggttc

SEQ ID NO: 223065 - DNA, 22 bp, Artificial Sequence
  Synthetic oligonucleotide; TTC chr2 60479644 60479665 60479649 60479644 -
ttgcctggtcggcctctttgaa

SEQ ID NO: 223066 - DNA, 22 bp, Artificial Sequence
  Synthetic oligonucleotide; CTT chr2 60479642 60479663 60479647 60479642 -
gcctggtcggcctctttgaaac

SEQ ID NO: 223067 - DNA, 22 bp, Artificial Sequence
  Synthetic oligonucleotide; TTG chr2 60479641 60479662 60479646 60479641 -
cctggtcggcctctttgaaacc

SEQ ID NO: 223068 - DNA, 22 bp, Artificial Sequence
  Synthetic oligonucleotide; CTG chr2 60479637 60479658 60479642 60479637 -
gtcggcctctttgaaaccgcgt

SEQ ID NO: 223069 - DNA, 22 bp, Artificial Sequence
  Synthetic oligonucleotide; CTC chr2 60479628 60479649 60479633 60479628 -
tttgaaaccgcgtcagcctgcc

SEQ ID NO: 223070 - DNA, 22 bp, Artificial Sequence
  Synthetic oligonucleotide; CTT chr2 60479626 60479647 60479631 60479626 -
tgaaaccgcgtcagcctgccgt

SEQ ID NO: 223071 - DNA, 22 bp, Artificial Sequence
  Synthetic oligonucleotide; TTT chr2 60479625 60479646 60479630 60479625 -
gaaaccgcgtcagcctgccgtc

SEQ ID NO: 223072 - DNA, 22 bp, Artificial Sequence
  Synthetic oligonucleotide; TTG chr2 60479624 60479645 60479629 60479624 -
aaaccgcgtcagcctgccgtcc

SEQ ID NO: 223073 - DNA, 22 bp, Artificial Sequence
  Synthetic oligonucleotide; CTG chr2 60479608 60479629 60479613 60479608 -
ccgtccacactctccaccgcct

SEQ ID NO: 223074 - DNA, 22 bp, Artificial Sequence
  Synthetic oligonucleotide; CTC chr2 60479596 60479617 60479601 60479596 -
tccaccgcctgacagggtttga

SEQ ID NO: 223075 - DNA, 22 bp, Artificial Sequence
  Synthetic oligonucleotide; CTC chr2 60479594 60479615 60479599 60479594 -
caccgcctgacagggtttgagt

SEQ ID NO: 223076 - DNA, 22 bp, Artificial Sequence
  Synthetic oligonucleotide; CTG chr2 60479585 60479606 60479590 60479585 -
acagggtttgagtgcgatggca

SEQ ID NO: 223077 - DNA, 22 bp, Artificial Sequence
  Synthetic oligonucleotide; TTT chr2 60479576 60479597 60479581 60479576 -
gagtgcgatggcagctgagatc

SEQ ID NO: 223078 - DNA, 22 bp, Artificial Sequence
  Synthetic oligonucleotide; TTG chr2 60479575 60479596 60479580 60479575 -
agtgcgatggcagctgagatct

SEQ ID NO: 223079 - DNA, 22 bp, Artificial Sequence
  Synthetic oligonucleotide; CTG chr2 60479559 60479580 60479564 60479559 -
agatctgtgggccggtgacaga

SEQ ID NO: 223080 - DNA, 22 bp, Artificial Sequence
  Synthetic oligonucleotide; CTG chr2 60479552 60479573 60479557 60479552 -
tgggccggtgacagagggggct

SEQ ID NO: 223081 - DNA, 22 bp, Artificial Sequence
  Synthetic oligonucleotide; CTT chr2 60479529 60479550 60479534 60479529 -
tctacccagcagtagaaggttg

SEQ ID NO: 223082 - DNA, 22 bp, Artificial Sequence
  Synthetic oligonucleotide; TTT chr2 60479528 60479549 60479533 60479528 -
ctacccagcagtagaaggttga

SEQ ID NO: 223083 - DNA, 22 bp, Artificial Sequence
  Synthetic oligonucleotide; TTC chr2 60479527 60479548 60479532 60479527 -
tacccagcagtagaaggttgag

SEQ ID NO: 223084 - DNA, 22 bp, Artificial Sequence
  Synthetic oligonucleotide; CTA chr2 60479525 60479546 60479530 60479525 -
cccagcagtagaaggttgaggc

SEQ ID NO: 223085 - DNA, 22 bp, Artificial Sequence
  Synthetic oligonucleotide; TTG chr2 60479507 60479528 60479512 60479507 -
aggccctggaagcaaaaggatt

SEQ ID NO: 223086 - DNA, 22 bp, Artificial Sequence
  Synthetic oligonucleotide; CTG chr2 60479499 60479520 60479504 60479499 -
gaagcaaaaggatttcagcctg

SEQ ID NO: 223087 - DNA, 22 bp, Artificial Sequence
  Synthetic oligonucleotide; TTT chr2 60479484 60479505 60479489 60479484 -
cagcctgaggggcttgttaagg

SEQ ID NO: 223088 - DNA, 22 bp, Artificial Sequence
  Synthetic oligonucleotide; TTC chr2 60479483 60479504 60479488 60479483 -
agcctgaggggcttgttaaggg

SEQ ID NO: 223089 - DNA, 22 bp, Artificial Sequence
  Synthetic oligonucleotide; CTG chr2 60479477 60479498 60479482 60479477 -
aggggcttgttaagggagagtt

SEQ ID NO: 223090 - DNA, 22 bp, Artificial Sequence
  Synthetic oligonucleotide; CTT chr2 60479469 60479490 60479474 60479469 -
gttaagggagagttattctttc

SEQ ID NO: 223091 - DNA, 22 bp, Artificial Sequence
  Synthetic oligonucleotide; TTG chr2 60479468 60479489 60479473 60479468 -
ttaagggagagttattctttcc

SEQ ID NO: 223092 - DNA, 22 bp, Artificial Sequence
  Synthetic oligonucleotide; TTA chr2 60479465 60479486 60479470 60479465 -
agggagagttattctttcctgt

SEQ ID NO: 223093 - DNA, 22 bp, Artificial Sequence
  Synthetic oligonucleotide; TTA chr2 60479454 60479475 60479459 60479454 -
ttctttcctgttcctagtagac

SEQ ID NO: 223094 - DNA, 22 bp, Artificial Sequence
  Synthetic oligonucleotide; TTC chr2 60479451 60479472 60479456 60479451 -
tttcctgttcctagtagacctg

SEQ ID NO: 223095 - DNA, 22 bp, Artificial Sequence
  Synthetic oligonucleotide; CTT chr2 60479449 60479470 60479454 60479449 -
tcctgttcctagtagacctgag

SEQ ID NO: 223096 - DNA, 22 bp, Artificial Sequence
  Synthetic oligonucleotide; TTT chr2 60479448 60479469 60479453 60479448 -
cctgttcctagtagacctgaga

SEQ ID NO: 223097 - DNA, 22 bp, Artificial Sequence
  Synthetic oligonucleotide; TTC chr2 60479447 60479468 60479452 60479447 -
ctgttcctagtagacctgagag

SEQ ID NO: 223098 - DNA, 22 bp, Artificial Sequence
  Synthetic oligonucleotide; CTG chr2 60479444 60479465 60479449 60479444 -
ttcctagtagacctgagagagc

SEQ ID NO: 223099 - DNA, 22 bp, Artificial Sequence
  Synthetic oligonucleotide; TTC chr2 60479441 60479462 60479446 60479441 -
ctagtagacctgagagagcttg

SEQ ID NO: 223100 - DNA, 22 bp, Artificial Sequence
  Synthetic oligonucleotide; CTA chr2 60479438 60479459 60479443 60479438 -
gtagacctgagagagcttgacg

SEQ ID NO: 223101 - DNA, 22 bp, Artificial Sequence
  Synthetic oligonucleotide; CTG chr2 60479429 60479450 60479434 60479429 -
agagagcttgacgttggtggcc

SEQ ID NO: 223102 - DNA, 22 bp, Artificial Sequence
  Synthetic oligonucleotide; CTT chr2 60479420 60479441 60479425 60479420 -
gacgttggtggcctctggtcag

SEQ ID NO: 223103 - DNA, 22 bp, Artificial Sequence
  Synthetic oligonucleotide; TTG chr2 60479419 60479440 60479424 60479419 -
acgttggtggcctctggtcagc

SEQ ID NO: 223104 - DNA, 22 bp, Artificial Sequence
  Synthetic oligonucleotide; TTG chr2 60479413 60479434 60479418 60479413 -
gtggcctctggtcagcctcatg

SEQ ID NO: 223105 - DNA, 22 bp, Artificial Sequence
  Synthetic oligonucleotide; CTC chr2 60479405 60479426 60479410 60479405 -
tggtcagcctcatggttgggac

SEQ ID NO: 223106 - DNA, 22 bp, Artificial Sequence
  Synthetic oligonucleotide; CTG chr2 60479403 60479424 60479408 60479403 -
gtcagcctcatggttgggactg

SEQ ID NO: 223107 - DNA, 22 bp, Artificial Sequence
  Synthetic oligonucleotide; CTC chr2 60479394 60479415 60479399 60479394 -
atggttgggactgcgtggaaat

SEQ ID NO: 223108 - DNA, 22 bp, Artificial Sequence
  Synthetic oligonucleotide; TTG chr2 60479387 60479408 60479392 60479387 -
ggactgcgtggaaatgctagac

SEQ ID NO: 223109 - DNA, 22 bp, Artificial Sequence
  Synthetic oligonucleotide; CTG chr2 60479381 60479402 60479386 60479381 -
cgtggaaatgctagacctgaga

SEQ ID NO: 223110 - DNA, 22 bp, Artificial Sequence
  Synthetic oligonucleotide; CTA chr2 60479368 60479389 60479373 60479368 -
gacctgagagacctcatttccc

SEQ ID NO: 223111 - DNA, 22 bp, Artificial Sequence
  Synthetic oligonucleotide; CTG chr2 60479362 60479383 60479367 60479362 -
agagacctcatttcccaagcag

SEQ ID NO: 223112 - DNA, 22 bp, Artificial Sequence
  Synthetic oligonucleotide; CTC chr2 60479353 60479374 60479358 60479353 -
atttcccaagcagtcttagaga

SEQ ID NO: 223113 - DNA, 22 bp, Artificial Sequence
  Synthetic oligonucleotide; TTT chr2 60479349 60479370 60479354 60479349 -
cccaagcagtcttagagagact

SEQ ID NO: 223114 - DNA, 22 bp, Artificial Sequence
  Synthetic oligonucleotide; TTC chr2 60479348 60479369 60479353 60479348 -
ccaagcagtcttagagagactc

SEQ ID NO: 223115 - DNA, 22 bp, Artificial Sequence
  Synthetic oligonucleotide; CTT chr2 60479336 60479357 60479341 60479336 -
agagagactcaaaacaaaaaat

SEQ ID NO: 223116 - DNA, 22 bp, Artificial Sequence
  Synthetic oligonucleotide; TTA chr2 60479335 60479356 60479340 60479335 -
gagagactcaaaacaaaaaatg

SEQ ID NO: 223117 - DNA, 22 bp, Artificial Sequence
  Synthetic oligonucleotide; CTC chr2 60479326 60479347 60479331 60479326 -
aaaacaaaaaatggtctccggg

SEQ ID NO: 223118 - DNA, 22 bp, Artificial Sequence
  Synthetic oligonucleotide; CTC chr2 60479308 60479329 60479313 60479308 -
cgggtcccaccgtggtgtgtgg

SEQ ID NO: 223119 - DNA, 22 bp, Artificial Sequence
  Synthetic oligonucleotide; CTG chr2 60479280 60479301 60479285 60479280 -
tgcccgcagaggccaggtgtcc

SEQ ID NO: 223120 - DNA, 22 bp, Artificial Sequence
  Synthetic oligonucleotide; CTG chr2 60479250 60479271 60479255 60479250 -
agtccccacgtggacctgctag

SEQ ID NO: 223121 - DNA, 22 bp, Artificial Sequence
  Synthetic oligonucleotide; CTG chr2 60479232 60479253 60479237 60479232 -
ctaggtgggtagaaaggagttg

SEQ ID NO: 223122 - DNA, 22 bp, Artificial Sequence
  Synthetic oligonucleotide; CTA chr2 60479229 60479250 60479234 60479229 -
ggtgggtagaaaggagttgaag

SEQ ID NO: 223123 - DNA, 22 bp, Artificial Sequence
  Synthetic oligonucleotide; TTG chr2 60479210 60479231 60479215 60479210 -
aagatgttgtgctgttggttgg

SEQ ID NO: 223124 - DNA, 22 bp, Artificial Sequence
  Synthetic oligonucleotide; TTG chr2 60479201 60479222 60479206 60479201 -
tgctgttggttggaggagcttg

SEQ ID NO: 223125 - DNA, 22 bp, Artificial Sequence
  Synthetic oligonucleotide; CTG chr2 60479196 60479217 60479201 60479196 -
ttggttggaggagcttggaggt

SEQ ID NO: 223126 - DNA, 22 bp, Artificial Sequence
  Synthetic oligonucleotide; TTG chr2 60479193 60479214 60479198 60479193 -
gttggaggagcttggaggtgtc

SEQ ID NO: 223127 - DNA, 22 bp, Artificial Sequence
  Synthetic oligonucleotide; TTG chr2 60479189 60479210 60479194 60479189 -
gaggagcttggaggtgtctggg

SEQ ID NO: 223128 - DNA, 22 bp, Artificial Sequence
  Synthetic oligonucleotide; CTT chr2 60479180 60479201 60479185 60479180 -
ggaggtgtctgggaacattgga

SEQ ID NO: 223129 - DNA, 22 bp, Artificial Sequence
  Synthetic oligonucleotide; TTG chr2 60479179 60479200 60479184 60479179 -
gaggtgtctgggaacattggat

SEQ ID NO: 223130 - DNA, 22 bp, Artificial Sequence
  Synthetic oligonucleotide; CTG chr2 60479169 60479190 60479174 60479169 -
ggaacattggatgttactcata

SEQ ID NO: 223131 - DNA, 22 bp, Artificial Sequence
  Synthetic oligonucleotide; TTG chr2 60479160 60479181 60479165 60479160 -
gatgttactcatatggaatcag

SEQ ID NO: 223132 - DNA, 22 bp, Artificial Sequence
  Synthetic oligonucleotide; TTA chr2 60479153 60479174 60479158 60479153 -
ctcatatggaatcagcagaatt

SEQ ID NO: 223133 - DNA, 22 bp, Artificial Sequence
  Synthetic oligonucleotide; CTC chr2 60479150 60479171 60479155 60479150 -
atatggaatcagcagaattagt

SEQ ID NO: 223134 - DNA, 22 bp, Artificial Sequence
  Synthetic oligonucleotide; TTA chr2 60479130 60479151 60479135 60479130 -
gtagagccaagaacagacggca

SEQ ID NO: 223135 - DNA, 22 bp, Artificial Sequence
  Synthetic oligonucleotide; CTG chr2 60479089 60479110 60479094 60479089 -
gactgaggctgctccaatgatg

SEQ ID NO: 223136 - DNA, 22 bp, Artificial Sequence
  Synthetic oligonucleotide; CTG chr2 60479084 60479105 60479089 60479084 -
aggctgctccaatgatggcagg

SEQ ID NO: 223137 - DNA, 22 bp, Artificial Sequence
  Synthetic oligonucleotide; CTG chr2 60479078 60479099 60479083 60479078 -
ctccaatgatggcaggttgtat

SEQ ID NO: 223138 - DNA, 22 bp, Artificial Sequence
  Synthetic oligonucleotide; CTC chr2 60479075 60479096 60479080 60479075 -
caatgatggcaggttgtatctg

SEQ ID NO: 223139 - DNA, 22 bp, Artificial Sequence
  Synthetic oligonucleotide; TTG chr2 60479059 60479080 60479064 60479059 -
tatctgcgggcatctccaattt

SEQ ID NO: 223140 - DNA, 22 bp, Artificial Sequence
  Synthetic oligonucleotide; CTG chr2 60479053 60479074 60479058 60479053 -
cgggcatctccaatttgctcag

SEQ ID NO: 223141 - DNA, 22 bp, Artificial Sequence
  Synthetic oligonucleotide; CTC chr2 60479043 60479064 60479048 60479043 -
caatttgctcagggaactcttt

SEQ ID NO: 223142 - DNA, 22 bp, Artificial Sequence
  Synthetic oligonucleotide; TTT chr2 60479037 60479058 60479042 60479037 -
gctcagggaactctttccagat

SEQ ID NO: 223143 - DNA, 22 bp, Artificial Sequence
  Synthetic oligonucleotide; TTG chr2 60479036 60479057 60479041 60479036 -
ctcagggaactctttccagatt

SEQ ID NO: 223144 - DNA, 22 bp, Artificial Sequence
  Synthetic oligonucleotide; CTC chr2 60479033 60479054 60479038 60479033 -
agggaactctttccagattggt

SEQ ID NO: 223145 - DNA, 22 bp, Artificial Sequence
  Synthetic oligonucleotide; CTC chr2 60479024 60479045 60479029 60479024 -
tttccagattggtcagtggtat

SEQ ID NO: 223146 - DNA, 22 bp, Artificial Sequence
  Synthetic oligonucleotide; CTT chr2 60479022 60479043 60479027 60479022 -
tccagattggtcagtggtataa

SEQ ID NO: 223147 - DNA, 22 bp, Artificial Sequence
  Synthetic oligonucleotide; TTT chr2 60479021 60479042 60479026 60479021 -
ccagattggtcagtggtataaa

SEQ ID NO: 223148 - DNA, 22 bp, Artificial Sequence
  Synthetic oligonucleotide; TTC chr2 60479020 60479041 60479025 60479020 -
cagattggtcagtggtataaat

SEQ ID NO: 223149 - DNA, 22 bp, Artificial Sequence
  Synthetic oligonucleotide; TTG chr2 60479013 60479034 60479018 60479013 -
gtcagtggtataaatgaaggat

SEQ ID NO: 223150 - DNA, 22 bp, Artificial Sequence
  Synthetic oligonucleotide; TTA chr2 60478989 60479010 60478994 60478989 -
ggaaattgggtaaaaagccagg

SEQ ID NO: 223151 - DNA, 22 bp, Artificial Sequence
  Synthetic oligonucleotide; TTG chr2 60478981 60479002 60478986 60478981 -
ggtaaaaagccagggaggaggg

SEQ ID NO: 223152 - DNA, 22 bp, Artificial Sequence
  Synthetic oligonucleotide; CTG chr2 60478915 60478936 60478920 60478915 -
tgttttgttctgtgggactttg

SEQ ID NO: 223153 - DNA, 22 bp, Artificial Sequence
  Synthetic oligonucleotide; TTT chr2 60478910 60478931 60478915 60478910 -
tgttctgtgggactttgccaga

SEQ ID NO: 223154 - DNA, 22 bp, Artificial Sequence
  Synthetic oligonucleotide; TTT chr2 60478909 60478930 60478914 60478909 -
gttctgtgggactttgccagag

SEQ ID NO: 223155 - DNA, 22 bp, Artificial Sequence
  Synthetic oligonucleotide; TTG chr2 60478908 60478929 60478913 60478908 -
ttctgtgggactttgccagaga

SEQ ID NO: 223156 - DNA, 22 bp, Artificial Sequence
  Synthetic oligonucleotide; TTC chr2 60478905 60478926 60478910 60478905 -
tgtgggactttgccagagagat

SEQ ID NO: 223157 - DNA, 22 bp, Artificial Sequence
  Synthetic oligonucleotide; CTG chr2 60478903 60478924 60478908 60478903 -
tgggactttgccagagagatga

SEQ ID NO: 223158 - DNA, 22 bp, Artificial Sequence
  Synthetic oligonucleotide; CTT chr2 60478895 60478916 60478900 60478895 -
tgccagagagatgaggactgag

SEQ ID NO: 223159 - DNA, 22 bp, Artificial Sequence
  Synthetic oligonucleotide; TTT chr2 60478894 60478915 60478899 60478894 -
gccagagagatgaggactgagg

SEQ ID NO: 223160 - DNA, 22 bp, Artificial Sequence
  Synthetic oligonucleotide; TTG chr2 60478893 60478914 60478898 60478893 -
ccagagagatgaggactgaggc

SEQ ID NO: 223161 - DNA, 22 bp, Artificial Sequence
  Synthetic oligonucleotide; CTG chr2 60478875 60478896 60478880 60478875 -
aggctgggctgctgtgtgcctg

SEQ ID NO: 223162 - DNA, 22 bp, Artificial Sequence
  Synthetic oligonucleotide; CTG chr2 60478869 60478890 60478874 60478869 -
ggctgctgtgtgcctgggaggc

SEQ ID NO: 223163 - DNA, 22 bp, Artificial Sequence
  Synthetic oligonucleotide; CTG chr2 60478864 60478885 60478869 60478864 -
ctgtgtgcctgggaggcgggaa

SEQ ID NO: 223164 - DNA, 22 bp, Artificial Sequence
  Synthetic oligonucleotide; CTG chr2 60478861 60478882 60478866 60478861 -
tgtgcctgggaggcgggaaggt

SEQ ID NO: 223165 - DNA, 22 bp, Artificial Sequence
  Synthetic oligonucleotide; CTG chr2 60478853 60478874 60478858 60478853 -
ggaggcgggaaggtgctgaggc

SEQ ID NO: 223166 - DNA, 22 bp, Artificial Sequence
  Synthetic oligonucleotide; CTG chr2 60478835 60478856 60478840 60478835 -
aggcactgcagagaagcagctg

SEQ ID NO: 223167 - DNA, 22 bp, Artificial Sequence
  Synthetic oligonucleotide; CTG chr2 60478827 60478848 60478832 60478827 -
cagagaagcagctgcagcatgc

SEQ ID NO: 223168 - DNA, 22 bp, Artificial Sequence
  Synthetic oligonucleotide; CTG chr2 60478813 60478834 60478818 60478813 -
cagcatgccccgggcagaggcc

SEQ ID NO: 223169 - DNA, 22 bp, Artificial Sequence
  Synthetic oligonucleotide; CTG chr2 60478789 60478810 60478794 60478789 -
ttttctgaaagaaggacttgcc

SEQ ID NO: 223170 - DNA, 22 bp, Artificial Sequence
  Synthetic oligonucleotide; TTT chr2 60478786 60478807 60478791 60478786 -
tctgaaagaaggacttgccgtc

SEQ ID NO: 223171 - DNA, 22 bp, Artificial Sequence
  Synthetic oligonucleotide; TTT chr2 60478785 60478806 60478790 60478785 -
ctgaaagaaggacttgccgtca

SEQ ID NO: 223172 - DNA, 22 bp, Artificial Sequence
  Synthetic oligonucleotide; TTC chr2 60478784 60478805 60478789 60478784 -
tgaaagaaggacttgccgtcat

SEQ ID NO: 223173 - DNA, 22 bp, Artificial Sequence
  Synthetic oligonucleotide; CTG chr2 60478782 60478803 60478787 60478782 -
aaagaaggacttgccgtcatgg

SEQ ID NO: 223174 - DNA, 22 bp, Artificial Sequence
  Synthetic oligonucleotide; CTT chr2 60478770 60478791 60478775 60478770 -
gccgtcatgggaggaggcctgg

SEQ ID NO: 223175 - DNA, 22 bp, Artificial Sequence
  Synthetic oligonucleotide; TTG chr2 60478769 60478790 60478774 60478769 -
ccgtcatgggaggaggcctggc

SEQ ID NO: 223176 - DNA, 22 bp, Artificial Sequence
  Synthetic oligonucleotide; CTG chr2 60478749 60478770 60478754 60478749 -
gcctcgcagcaccagagcgctc

SEQ ID NO: 223177 - DNA, 22 bp, Artificial Sequence
  Synthetic oligonucleotide; CTC chr2 60478744 60478765 60478749 60478744 -
gcagcaccagagcgctccttca

SEQ ID NO: 223178 - DNA, 22 bp, Artificial Sequence
  Synthetic oligonucleotide; CTC chr2 60478727 60478748 60478732 60478727 -
cttcattcagcctcacctcagg

SEQ ID NO: 223179 - DNA, 22 bp, Artificial Sequence
  Synthetic oligonucleotide; CTT chr2 60478724 60478745 60478729 60478724 -
cattcagcctcacctcaggcga

SEQ ID NO: 223180 - DNA, 22 bp, Artificial Sequence
  Synthetic oligonucleotide; TTC chr2 60478723 60478744 60478728 60478723 -
attcagcctcacctcaggcgag

SEQ ID NO: 223181 - DNA, 22 bp, Artificial Sequence
  Synthetic oligonucleotide; TTC chr2 60478719 60478740 60478724 60478719 -
agcctcacctcaggcgagaggg

SEQ ID NO: 223182 - DNA, 22 bp, Artificial Sequence
  Synthetic oligonucleotide; CTC chr2 60478713 60478734 60478718 60478713 -
acctcaggcgagagggcagcct

SEQ ID NO: 223183 - DNA, 22 bp, Artificial Sequence
  Synthetic oligonucleotide; CTC chr2 60478708 60478729 60478713 60478708 -
aggcgagagggcagcctagttt

SEQ ID NO: 223184 - DNA, 22 bp, Artificial Sequence
  Synthetic oligonucleotide; CTA chr2 60478690 60478711 60478695 60478690 -
gttttattcctgaagaaatgtt

SEQ ID NO: 223185 - DNA, 22 bp, Artificial Sequence
  Synthetic oligonucleotide; TTT chr2 60478686 60478707 60478691 60478686 -
tattcctgaagaaatgttagag

SEQ ID NO: 223186 - DNA, 22 bp, Artificial Sequence
  Synthetic oligonucleotide; TTT chr2 60478685 60478706 60478690 60478685 -
attcctgaagaaatgttagagc

SEQ ID NO: 223187 - DNA, 22 bp, Artificial Sequence
  Synthetic oligonucleotide; TTA chr2 60478684 60478705 60478689 60478684 -
ttcctgaagaaatgttagagcc

SEQ ID NO: 223188 - DNA, 22 bp, Artificial Sequence
  Synthetic oligonucleotide; TTC chr2 60478681 60478702 60478686 60478681 -
ctgaagaaatgttagagcctga

SEQ ID NO: 223189 - DNA, 22 bp, Artificial Sequence
  Synthetic oligonucleotide; CTG chr2 60478678 60478699 60478683 60478678 -
aagaaatgttagagcctgacct

SEQ ID NO: 223190 - DNA, 22 bp, Artificial Sequence
  Synthetic oligonucleotide; TTA chr2 60478667 60478688 60478672 60478667 -
gagcctgacctgctagaccatt

SEQ ID NO: 223191 - DNA, 22 bp, Artificial Sequence
  Synthetic oligonucleotide; CTG chr2 60478660 60478681 60478665 60478660 -
acctgctagaccattttttttg

SEQ ID NO: 223192 - DNA, 22 bp, Artificial Sequence
  Synthetic oligonucleotide; CTG chr2 60478655 60478676 60478660 60478655 -
ctagaccattttttttggtaga

SEQ ID NO: 223193 - DNA, 22 bp, Artificial Sequence
  Synthetic oligonucleotide; CTA chr2 60478652 60478673 60478657 60478652 -
gaccattttttttggtagagct

SEQ ID NO: 223194 - DNA, 22 bp, Artificial Sequence
  Synthetic oligonucleotide; TTT chr2 60478644 60478665 60478649 60478644 -
tttttggtagagctttgaagcc

SEQ ID NO: 223195 - DNA, 22 bp, Artificial Sequence
  Synthetic oligonucleotide; TTT chr2 60478643 60478664 60478648 60478643 -
ttttggtagagctttgaagcct

SEQ ID NO: 223196 - DNA, 22 bp, Artificial Sequence
  Synthetic oligonucleotide; TTT chr2 60478642 60478663 60478647 60478642 -
tttggtagagctttgaagcctt

SEQ ID NO: 223197 - DNA, 22 bp, Artificial Sequence
  Synthetic oligonucleotide; TTT chr2 60478641 60478662 60478646 60478641 -
ttggtagagctttgaagcctta

SEQ ID NO: 223198 - DNA, 22 bp, Artificial Sequence
  Synthetic oligonucleotide; TTT chr2 60478640 60478661 60478645 60478640 -
tggtagagctttgaagccttaa

SEQ ID NO: 223199 - DNA, 22 bp, Artificial Sequence
  Synthetic oligonucleotide; TTT chr2 60478639 60478660 60478644 60478639 -
ggtagagctttgaagccttaaa

SEQ ID NO: 223200 - DNA, 22 bp, Artificial Sequence
  Synthetic oligonucleotide; TTG chr2 60478638 60478659 60478643 60478638 -
gtagagctttgaagccttaaat

SEQ ID NO: 223201 - DNA, 22 bp, Artificial Sequence
  Synthetic oligonucleotide; CTT chr2 60478629 60478650 60478634 60478629 -
tgaagccttaaattagttctca

SEQ ID NO: 223202 - DNA, 22 bp, Artificial Sequence
  Synthetic oligonucleotide; TTT chr2 60478628 60478649 60478633 60478628 -
gaagccttaaattagttctcat

SEQ ID NO: 223203 - DNA, 22 bp, Artificial Sequence
  Synthetic oligonucleotide; TTG chr2 60478627 60478648 60478632 60478627 -
aagccttaaattagttctcata

SEQ ID NO: 223204 - DNA, 22 bp, Artificial Sequence
  Synthetic oligonucleotide; CTT chr2 60478620 60478641 60478625 60478620 -
aaattagttctcataatttctg

SEQ ID NO: 223205 - DNA, 22 bp, Artificial Sequence
  Synthetic oligonucleotide; TTA chr2 60478619 60478640 60478624 60478619 -
aattagttctcataatttctga

SEQ ID NO: 223206 - DNA, 22 bp, Artificial Sequence
  Synthetic oligonucleotide; TTA chr2 60478614 60478635 60478619 60478614 -
gttctcataatttctgagcagc

SEQ ID NO: 223207 - DNA, 22 bp, Artificial Sequence
  Synthetic oligonucleotide; TTC chr2 60478610 60478631 60478615 60478610 -
tcataatttctgagcagctctg

SEQ ID NO: 223208 - DNA, 22 bp, Artificial Sequence
  Synthetic oligonucleotide; CTC chr2 60478608 60478629 60478613 60478608 -
ataatttctgagcagctctgtg

SEQ ID NO: 223209 - DNA, 22 bp, Artificial Sequence
  Synthetic oligonucleotide; TTT chr2 60478601 60478622 60478606 60478601 -
ctgagcagctctgtgttaacca

SEQ ID NO: 223210 - DNA, 22 bp, Artificial Sequence
  Synthetic oligonucleotide; TTC chr2 60478600 60478621 60478605 60478600 -
tgagcagctctgtgttaaccat

SEQ ID NO: 223211 - DNA, 22 bp, Artificial Sequence
  Synthetic oligonucleotide; CTG chr2 60478598 60478619 60478603 60478598 -
agcagctctgtgttaaccatag

SEQ ID NO: 223212 - DNA, 22 bp, Artificial Sequence
  Synthetic oligonucleotide; CTC chr2 60478590 60478611 60478595 60478590 -
tgtgttaaccataggacataat

SEQ ID NO: 223213 - DNA, 22 bp, Artificial Sequence
  Synthetic oligonucleotide; CTG chr2 60478588 60478609 60478593 60478588 -
tgttaaccataggacataatag

SEQ ID NO: 223214 - DNA, 22 bp, Artificial Sequence
  Synthetic oligonucleotide; TTA chr2 60478583 60478604 60478588 60478583 -
accataggacataataggtttt

SEQ ID NO: 223215 - DNA, 22 bp, Artificial Sequence
  Synthetic oligonucleotide; TTT chr2 60478562 60478583 60478567 60478562 -
taattctggagaatggccagtt

SEQ ID NO: 223216 - DNA, 22 bp, Artificial Sequence
  Synthetic oligonucleotide; TTT chr2 60478561 60478582 60478566 60478561 -
aattctggagaatggccagttc

SEQ ID NO: 223217 - DNA, 22 bp, Artificial Sequence
  Synthetic oligonucleotide; TTA chr2 60478560 60478581 60478565 60478560 -
attctggagaatggccagttct

SEQ ID NO: 223218 - DNA, 22 bp, Artificial Sequence
  Synthetic oligonucleotide; TTC chr2 60478556 60478577 60478561 60478556 -
tggagaatggccagttctggtt

SEQ ID NO: 223219 - DNA, 22 bp, Artificial Sequence
  Synthetic oligonucleotide; CTG chr2 60478554 60478575 60478559 60478554 -
gagaatggccagttctggttct

SEQ ID NO: 223220 - DNA, 22 bp, Artificial Sequence
  Synthetic oligonucleotide; TTC chr2 60478539 60478560 60478544 60478539 -
tggttctcagaatctcttggcc

SEQ ID NO: 223221 - DNA, 22 bp, Artificial Sequence
  Synthetic oligonucleotide; CTG chr2 60478537 60478558 60478542 60478537 -
gttctcagaatctcttggccaa

SEQ ID NO: 223222 - DNA, 22 bp, Artificial Sequence
  Synthetic oligonucleotide; TTC chr2 60478533 60478554 60478538 60478533 -
tcagaatctcttggccaagact

SEQ ID NO: 223223 - DNA, 22 bp, Artificial Sequence
  Synthetic oligonucleotide; CTC chr2 60478531 60478552 60478536 60478531 -
agaatctcttggccaagactgt

SEQ ID NO: 223224 - DNA, 22 bp, Artificial Sequence
  Synthetic oligonucleotide; CTC chr2 60478523 60478544 60478528 60478523 -
ttggccaagactgtcacagagt

SEQ ID NO: 223225 - DNA, 22 bp, Artificial Sequence
  Synthetic oligonucleotide; CTT chr2 60478521 60478542 60478526 60478521 -
ggccaagactgtcacagagtat

SEQ ID NO: 223226 - DNA, 22 bp, Artificial Sequence
  Synthetic oligonucleotide; TTG chr2 60478520 60478541 60478525 60478520 -
gccaagactgtcacagagtatt

SEQ ID NO: 223227 - DNA, 22 bp, Artificial Sequence
  Synthetic oligonucleotide; CTG chr2 60478510 60478531 60478515 60478510 -
tcacagagtattaggcctgtga

SEQ ID NO: 223228 - DNA, 22 bp, Artificial Sequence
  Synthetic oligonucleotide; TTA chr2 60478497 60478518 60478502 60478497 -
ggcctgtgaagtgccttccacg

SEQ ID NO: 223229 - DNA, 22 bp, Artificial Sequence
  Synthetic oligonucleotide; CTG chr2 60478491 60478512 60478496 60478491 -
tgaagtgccttccacgcttccc

SEQ ID NO: 223230 - DNA, 22 bp, Artificial Sequence
  Synthetic oligonucleotide; CTT chr2 60478480 60478501 60478485 60478480 -
ccacgcttcccctgaagtccac

SEQ ID NO: 223231 - DNA, 22 bp, Artificial Sequence
  Synthetic oligonucleotide; TTC chr2 60478479 60478500 60478484 60478479 -
cacgcttcccctgaagtccaca

SEQ ID NO: 223232 - DNA, 22 bp, Artificial Sequence
  Synthetic oligonucleotide; CTT chr2 60478472 60478493 60478477 60478472 -
cccctgaagtccacacaccagt

SEQ ID NO: 223233 - DNA, 22 bp, Artificial Sequence
  Synthetic oligonucleotide; TTC chr2 60478471 60478492 60478476 60478471 -
ccctgaagtccacacaccagtc

SEQ ID NO: 223234 - DNA, 22 bp, Artificial Sequence
  Synthetic oligonucleotide; CTG chr2 60478466 60478487 60478471 60478466 -
aagtccacacaccagtcactca

SEQ ID NO: 223235 - DNA, 22 bp, Artificial Sequence
  Synthetic oligonucleotide; CTC chr2 60478445 60478466 60478450 60478445 -
aatagtgccagaaaggcaagtg

SEQ ID NO: 223236 - DNA, 22 bp, Artificial Sequence
  Synthetic oligonucleotide; TTG chr2 60478414 60478435 60478419 60478414 -
cctgaaaggggctgtatgacca

SEQ ID NO: 223237 - DNA, 22 bp, Artificial Sequence
  Synthetic oligonucleotide; CTG chr2 60478410 60478431 60478415 60478410 -
aaaggggctgtatgaccagtgt

SEQ ID NO: 223238 - DNA, 22 bp, Artificial Sequence
  Synthetic oligonucleotide; CTG chr2 60478400 60478421 60478405 60478400 -
tatgaccagtgtccagacgaca

SEQ ID NO: 223239 - DNA, 22 bp, Artificial Sequence
  Synthetic oligonucleotide; TTT chr2 60478373 60478394 60478378 60478373 -
ctgccgcggccctgaggtggca

SEQ ID NO: 223240 - DNA, 22 bp, Artificial Sequence
  Synthetic oligonucleotide; TTC chr2 60478372 60478393 60478377 60478372 -
tgccgcggccctgaggtggcag

SEQ ID NO: 223241 - DNA, 22 bp, Artificial Sequence
  Synthetic oligonucleotide; CTG chr2 60478370 60478391 60478375 60478370 -
ccgcggccctgaggtggcagtg

SEQ ID NO: 223242 - DNA, 22 bp, Artificial Sequence
  Synthetic oligonucleotide; CTG chr2 60478359 60478380 60478364 60478359 -
aggtggcagtgggaggggtttg

SEQ ID NO: 223243 - DNA, 22 bp, Artificial Sequence
  Synthetic oligonucleotide; TTT chr2 60478338 60478359 60478343 60478338 -
gtcagaaggtgggcagggtcct

SEQ ID NO: 223244 - DNA, 22 bp, Artificial Sequence
  Synthetic oligonucleotide; TTG chr2 60478337 60478358 60478342 60478337 -
tcagaaggtgggcagggtcctg

SEQ ID NO: 223245 - DNA, 22 bp, Artificial Sequence
  Synthetic oligonucleotide; CTG chr2 60478315 60478336 60478320 60478315 -
aagcccagccctgtcctccctg

SEQ ID NO: 223246 - DNA, 22 bp, Artificial Sequence
  Synthetic oligonucleotide; CTG chr2 60478302 60478323 60478307 60478302 -
tcctccctgtccacagcaggac

SEQ ID NO: 223247 - DNA, 22 bp, Artificial Sequence
  Synthetic oligonucleotide; CTC chr2 60478297 60478318 60478302 60478297 -
cctgtccacagcaggacacttc

SEQ ID NO: 223248 - DNA, 22 bp, Artificial Sequence
  Synthetic oligonucleotide; CTG chr2 60478293 60478314 60478298 60478293 -
tccacagcaggacacttctgag

SEQ ID NO: 223249 - DNA, 22 bp, Artificial Sequence
  Synthetic oligonucleotide; CTT chr2 60478276 60478297 60478281 60478276 -
ctgagatcttcgagttcctcac

SEQ ID NO: 223250 - DNA, 22 bp, Artificial Sequence
  Synthetic oligonucleotide; TTC chr2 60478275 60478296 60478280 60478275 -
tgagatcttcgagttcctcact

SEQ ID NO: 223251 - DNA, 22 bp, Artificial Sequence
  Synthetic oligonucleotide; CTG chr2 60478273 60478294 60478278 60478273 -
agatcttcgagttcctcactgg

SEQ ID NO: 223252 - DNA, 22 bp, Artificial Sequence
  Synthetic oligonucleotide; CTT chr2 60478266 60478287 60478271 60478266 -
cgagttcctcactgggaggtga

SEQ ID NO: 223253 - DNA, 22 bp, Artificial Sequence
  Synthetic oligonucleotide; TTC chr2 60478265 60478286 60478270 60478265 -
gagttcctcactgggaggtgag

SEQ ID NO: 223254 - DNA, 22 bp, Artificial Sequence
  Synthetic oligonucleotide; TTC chr2 60478259 60478280 60478264 60478259 -
ctcactgggaggtgaggctaat

SEQ ID NO: 223255 - DNA, 22 bp, Artificial Sequence
  Synthetic oligonucleotide; CTC chr2 60478256 60478277 60478261 60478256 -
actgggaggtgaggctaatacc

SEQ ID NO: 223256 - DNA, 22 bp, Artificial Sequence
  Synthetic oligonucleotide; CTG chr2 60478252 60478273 60478257 60478252 -
ggaggtgaggctaataccttcc

SEQ ID NO: 223257 - DNA, 22 bp, Artificial Sequence
  Synthetic oligonucleotide; CTA chr2 60478239 60478260 60478244 60478239 -
ataccttccctcattccacagg

SEQ ID NO: 223258 - DNA, 22 bp, Artificial Sequence
  Synthetic oligonucleotide; CTT chr2 60478232 60478253 60478237 60478232 -
ccctcattccacagggcgactg

SEQ ID NO: 223259 - DNA, 22 bp, Artificial Sequence
  Synthetic oligonucleotide; TTC chr2 60478231 60478252 60478236 60478231 -
cctcattccacagggcgactgt

SEQ ID NO: 223260 - DNA, 22 bp, Artificial Sequence
  Synthetic oligonucleotide; CTC chr2 60478227 60478248 60478232 60478227 -
attccacagggcgactgttggg

SEQ ID NO: 223261 - DNA, 22 bp, Artificial Sequence
  Synthetic oligonucleotide; TTC chr2 60478223 60478244 60478228 60478223 -
cacagggcgactgttggggcag

SEQ ID NO: 223262 - DNA, 22 bp, Artificial Sequence
  Synthetic oligonucleotide; CTG chr2 60478210 60478231 60478215 60478210 -
ttggggcaggatgtgaggagag

SEQ ID NO: 223263 - DNA, 22 bp, Artificial Sequence
  Synthetic oligonucleotide; TTG chr2 60478207 60478228 60478212 60478207 -
gggcaggatgtgaggagagtac

SEQ ID NO: 223264 - DNA, 22 bp, Artificial Sequence
  Synthetic oligonucleotide; CTT chr2 60478183 60478204 60478188 60478183 -
tgggaagaacataacactttcc

SEQ ID NO: 223265 - DNA, 22 bp, Artificial Sequence
  Synthetic oligonucleotide; TTT chr2 60478182 60478203 60478187 60478182 -
gggaagaacataacactttcca

SEQ ID NO: 223266 - DNA, 22 bp, Artificial Sequence
  Synthetic oligonucleotide; TTG chr2 60478181 60478202 60478186 60478181 -
ggaagaacataacactttccac

SEQ ID NO: 223267 - DNA, 22 bp, Artificial Sequence
  Synthetic oligonucleotide; CTT chr2 60478164 60478185 60478169 60478164 -
tccacccagcctgggcaacatg

SEQ ID NO: 223268 - DNA, 22 bp, Artificial Sequence
  Synthetic oligonucleotide; TTT chr2 60478163 60478184 60478168 60478163 -
ccacccagcctgggcaacatgg

SEQ ID NO: 223269 - DNA, 22 bp, Artificial Sequence
  Synthetic oligonucleotide; TTC chr2 60478162 60478183 60478167 60478162 -
cacccagcctgggcaacatggt

SEQ ID NO: 223270 - DNA, 22 bp, Artificial Sequence
  Synthetic oligonucleotide; CTG chr2 60478151 60478172 60478156 60478151 -
ggcaacatggtgagatcccatc

SEQ ID NO: 223271 - DNA, 22 bp, Artificial Sequence
  Synthetic oligonucleotide; CTC chr2 60478127 60478148 60478132 60478127 -
tacaaaaaatacaaaaattagc

SEQ ID NO: 223272 - DNA, 22 bp, Artificial Sequence
  Synthetic oligonucleotide; CTA chr2 60478125 60478146 60478130 60478125 -
caaaaaatacaaaaattagcca

SEQ ID NO: 223273 - DNA, 22 bp, Artificial Sequence
  Synthetic oligonucleotide; TTA chr2 60478107 60478128 60478112 60478107 -
gccaggtgtggtggtggcgcat

SEQ ID NO: 223274 - DNA, 22 bp, Artificial Sequence
  Synthetic oligonucleotide; CTG chr2 60478080 60478101 60478085 60478080 -
tagtcctagctacttgagagct

SEQ ID NO: 223275 - DNA, 22 bp, Artificial Sequence
  Synthetic oligonucleotide; CTA chr2 60478072 60478093 60478077 60478072 -
gctacttgagagctgaggcagg

SEQ ID NO: 223276 - DNA, 22 bp, Artificial Sequence
  Synthetic oligonucleotide; CTA chr2 60478068 60478089 60478073 60478068 -
cttgagagctgaggcaggagga

SEQ ID NO: 223277 - DNA, 22 bp, Artificial Sequence
  Synthetic oligonucleotide; CTT chr2 60478065 60478086 60478070 60478065 -
gagagctgaggcaggaggactg

SEQ ID NO: 223278 - DNA, 22 bp, Artificial Sequence
  Synthetic oligonucleotide; TTG chr2 60478064 60478085 60478069 60478064 -
agagctgaggcaggaggactgc

SEQ ID NO: 223279 - DNA, 22 bp, Artificial Sequence
  Synthetic oligonucleotide; CTG chr2 60478057 60478078 60478062 60478057 -
aggcaggaggactgcttgaact

SEQ ID NO: 223280 - DNA, 22 bp, Artificial Sequence
  Synthetic oligonucleotide; CTG chr2 60478043 60478064 60478048 60478043 -
cttgaactcgggaggcggaggt

SEQ ID NO: 223281 - DNA, 22 bp, Artificial Sequence
  Synthetic oligonucleotide; CTT chr2 60478040 60478061 60478045 60478040 -
gaactcgggaggcggaggttgc

SEQ ID NO: 223282 - DNA, 22 bp, Artificial Sequence
  Synthetic oligonucleotide; TTG chr2 60478039 60478060 60478044 60478039 -
aactcgggaggcggaggttgca

SEQ ID NO: 223283 - DNA, 22 bp, Artificial Sequence
  Synthetic oligonucleotide; CTC chr2 60478034 60478055 60478039 60478034 -
gggaggcggaggttgcagtgag

SEQ ID NO: 223284 - DNA, 22 bp, Artificial Sequence
  Synthetic oligonucleotide; TTG chr2 60478019 60478040 60478024 60478019 -
cagtgagccaagattgcaccac

SEQ ID NO: 223285 - DNA, 22 bp, Artificial Sequence
  Synthetic oligonucleotide; TTG chr2 60478003 60478024 60478008 60478003 -
caccactgcactccagcctggg

SEQ ID NO: 223286 - DNA, 22 bp, Artificial Sequence
  Synthetic oligonucleotide; CTG chr2 60477995 60478016 60478000 60477995 -
cactccagcctgggcaacagag

SEQ ID NO: 223287 - DNA, 22 bp, Artificial Sequence
  Synthetic oligonucleotide; CTC chr2 60477990 60478011 60477995 60477990 -
cagcctgggcaacagagtgaga

SEQ ID NO: 223288 - DNA, 22 bp, Artificial Sequence
  Synthetic oligonucleotide; CTG chr2 60477983 60478004 60477988 60477983 -
ggcaacagagtgagaccatgtc

SEQ ID NO: 223289 - DNA, 22 bp, Artificial Sequence
  Synthetic oligonucleotide; CTC chr2 60477959 60477980 60477964 60477959 -
aattaaaaaaaaaaaaaaaaaa

SEQ ID NO: 223290 - DNA, 22 bp, Artificial Sequence
  Synthetic oligonucleotide; TTA chr2 60477954 60477975 60477959 60477954 -
aaaaaaaaaaaaaaaaagcttt

SEQ ID NO: 223291 - DNA, 22 bp, Artificial Sequence
  Synthetic oligonucleotide; CTT chr2 60477933 60477954 60477938 60477933 -
tccataaaggccaggacagatg

SEQ ID NO: 223292 - DNA, 22 bp, Artificial Sequence
  Synthetic oligonucleotide; TTT chr2 60477932 60477953 60477937 60477932 -
ccataaaggccaggacagatgt

SEQ ID NO: 223293 - DNA, 22 bp, Artificial Sequence
  Synthetic oligonucleotide; TTC chr2 60477931 60477952 60477936 60477931 -
cataaaggccaggacagatgtg

SEQ ID NO: 223294 - DNA, 22 bp, Artificial Sequence
  Synthetic oligonucleotide; CTT chr2 60477906 60477927 60477911 60477906 -
ccttaagaagggctagagttgg

SEQ ID NO: 223295 - DNA, 22 bp, Artificial Sequence
  Synthetic oligonucleotide; TTC chr2 60477905 60477926 60477910 60477905 -
cttaagaagggctagagttgga

SEQ ID NO: 223296 - DNA, 22 bp, Artificial Sequence
  Synthetic oligonucleotide; CTT chr2 60477902 60477923 60477907 60477902 -
aagaagggctagagttggaggc

SEQ ID NO: 223297 - DNA, 22 bp, Artificial Sequence
  Synthetic oligonucleotide; TTA chr2 60477901 60477922 60477906 60477901 -
agaagggctagagttggaggcc

SEQ ID NO: 223298 - DNA, 22 bp, Artificial Sequence
  Synthetic oligonucleotide; CTA chr2 60477891 60477912 60477896 60477891 -
gagttggaggccttgccctcct

SEQ ID NO: 223299 - DNA, 22 bp, Artificial Sequence
  Synthetic oligonucleotide; TTG chr2 60477885 60477906 60477890 60477885 -
gaggccttgccctcctctgggc

SEQ ID NO: 223300 - DNA, 22 bp, Artificial Sequence
  Synthetic oligonucleotide; CTT chr2 60477877 60477898 60477882 60477877 -
gccctcctctgggcttgttggc

SEQ ID NO: 223301 - DNA, 22 bp, Artificial Sequence
  Synthetic oligonucleotide; TTG chr2 60477876 60477897 60477881 60477876 -
ccctcctctgggcttgttggcc

SEQ ID NO: 223302 - DNA, 22 bp, Artificial Sequence
  Synthetic oligonucleotide; CTC chr2 60477871 60477892 60477876 60477871 -
ctctgggcttgttggccttggg

SEQ ID NO: 223303 - DNA, 22 bp, Artificial Sequence
  Synthetic oligonucleotide; CTC chr2 60477868 60477889 60477873 60477868 -
tgggcttgttggccttggggga

SEQ ID NO: 223304 - DNA, 22 bp, Artificial Sequence
  Synthetic oligonucleotide; CTG chr2 60477866 60477887 60477871 60477866 -
ggcttgttggccttgggggagg

SEQ ID NO: 223305 - DNA, 22 bp, Artificial Sequence
  Synthetic oligonucleotide; CTT chr2 60477861 60477882 60477866 60477861 -
gttggccttgggggaggcctga

SEQ ID NO: 223306 - DNA, 22 bp, Artificial Sequence
  Synthetic oligonucleotide; TTG chr2 60477860 60477881 60477865 60477860 -
ttggccttgggggaggcctgac

SEQ ID NO: 223307 - DNA, 22 bp, Artificial Sequence
  Synthetic oligonucleotide; TTG chr2 60477857 60477878 60477862 60477857 -
gccttgggggaggcctgacaga

SEQ ID NO: 223308 - DNA, 22 bp, Artificial Sequence
  Synthetic oligonucleotide; CTT chr2 60477852 60477873 60477857 60477852 -
gggggaggcctgacagagcctt

SEQ ID NO: 223309 - DNA, 22 bp, Artificial Sequence
  Synthetic oligonucleotide; TTG chr2 60477851 60477872 60477856 60477851 -
ggggaggcctgacagagccttc

SEQ ID NO: 223310 - DNA, 22 bp, Artificial Sequence
  Synthetic oligonucleotide; CTG chr2 60477840 60477861 60477845 60477840 -
acagagccttcctggggctgcc

SEQ ID NO: 223311 - DNA, 22 bp, Artificial Sequence
  Synthetic oligonucleotide; CTT chr2 60477830 60477851 60477835 60477830 -
cctggggctgcctgttcttctg

SEQ ID NO: 223312 - DNA, 22 bp, Artificial Sequence
  Synthetic oligonucleotide; TTC chr2 60477829 60477850 60477834 60477829 -
ctggggctgcctgttcttctgg

SEQ ID NO: 223313 - DNA, 22 bp, Artificial Sequence
  Synthetic oligonucleotide; CTG chr2 60477826 60477847 60477831 60477826 -
gggctgcctgttcttctggccc

SEQ ID NO: 223314 - DNA, 22 bp, Artificial Sequence
  Synthetic oligonucleotide; CTG chr2 60477820 60477841 60477825 60477820 -
cctgttcttctggccccttctc

SEQ ID NO: 223315 - DNA, 22 bp, Artificial Sequence
  Synthetic oligonucleotide; CTG chr2 60477816 60477837 60477821 60477816 -
ttcttctggccccttctccgtg

SEQ ID NO: 223316 - DNA, 22 bp, Artificial Sequence
  Synthetic oligonucleotide; TTC chr2 60477813 60477834 60477818 60477813 -
ttctggccccttctccgtgcac

SEQ ID NO: 223317 - DNA, 22 bp, Artificial Sequence
  Synthetic oligonucleotide; CTT chr2 60477811 60477832 60477816 60477811 -
ctggccccttctccgtgcacag

SEQ ID NO: 223318 - DNA, 22 bp, Artificial Sequence
  Synthetic oligonucleotide; TTC chr2 60477810 60477831 60477815 60477810 -
tggccccttctccgtgcacaga

SEQ ID NO: 223319 - DNA, 22 bp, Artificial Sequence
  Synthetic oligonucleotide; CTG chr2 60477808 60477829 60477813 60477808 -
gccccttctccgtgcacagacc

SEQ ID NO: 223320 - DNA, 22 bp, Artificial Sequence
  Synthetic oligonucleotide; CTT chr2 60477801 60477822 60477806 60477801 -
ctccgtgcacagaccagtcttg

SEQ ID NO: 223321 - DNA, 22 bp, Artificial Sequence
  Synthetic oligonucleotide; TTC chr2 60477800 60477821 60477805 60477800 -
tccgtgcacagaccagtcttgg

SEQ ID NO: 223322 - DNA, 22 bp, Artificial Sequence
  Synthetic oligonucleotide; CTC chr2 60477798 60477819 60477803 60477798 -
cgtgcacagaccagtcttggat

SEQ ID NO: 223323 - DNA, 22 bp, Artificial Sequence
  Synthetic oligonucleotide; CTT chr2 60477780 60477801 60477785 60477780 -
ggatgataagtcaggaaagccc

SEQ ID NO: 223324 - DNA, 22 bp, Artificial Sequence
  Synthetic oligonucleotide; TTG chr2 60477779 60477800 60477784 60477779 -
gatgataagtcaggaaagccct

SEQ ID NO: 223325 - DNA, 22 bp, Artificial Sequence
  Synthetic oligonucleotide; CTC chr2 60477756 60477777 60477761 60477756 -
cacctggccgggctgcagtgtc

SEQ ID NO: 223326 - DNA, 22 bp, Artificial Sequence
  Synthetic oligonucleotide; CTG chr2 60477750 60477771 60477755 60477750 -
gccgggctgcagtgtcgctggg

SEQ ID NO: 223327 - DNA, 22 bp, Artificial Sequence
  Synthetic oligonucleotide; CTG chr2 60477741 60477762 60477746 60477741 -
cagtgtcgctggggctgcccac

SEQ ID NO: 223328 - DNA, 22 bp, Artificial Sequence
  Synthetic oligonucleotide; CTG chr2 60477730 60477751 60477735 60477730 -
gggctgcccacacttgctgacc

SEQ ID NO: 223329 - DNA, 22 bp, Artificial Sequence
  Synthetic oligonucleotide; CTG chr2 60477724 60477745 60477729 60477724 -
cccacacttgctgaccatggct

SEQ ID NO: 223330 - DNA, 22 bp, Artificial Sequence
  Synthetic oligonucleotide; CTT chr2 60477715 60477736 60477720 60477715 -
gctgaccatggctccccactcc

SEQ ID NO: 223331 - DNA, 22 bp, Artificial Sequence
  Synthetic oligonucleotide; TTG chr2 60477714 60477735 60477719 60477714 -
ctgaccatggctccccactccc

SEQ ID NO: 223332 - DNA, 22 bp, Artificial Sequence
  Synthetic oligonucleotide; CTG chr2 60477711 60477732 60477716 60477711 -
accatggctccccactcccttg

SEQ ID NO: 223333 - DNA, 22 bp, Artificial Sequence
  Synthetic oligonucleotide; CTC chr2 60477701 60477722 60477706 60477701 -
cccactcccttgtctctcacag

SEQ ID NO: 223334 - DNA, 22 bp, Artificial Sequence
  Synthetic oligonucleotide; CTC chr2 60477694 60477715 60477699 60477694 -
ccttgtctctcacagcaccact

SEQ ID NO: 223335 - DNA, 22 bp, Artificial Sequence
  Synthetic oligonucleotide; CTT chr2 60477690 60477711 60477695 60477690 -
gtctctcacagcaccactgccc

SEQ ID NO: 223336 - DNA, 22 bp, Artificial Sequence
  Synthetic oligonucleotide; TTG chr2 60477689 60477710 60477694 60477689 -
tctctcacagcaccactgcccc

SEQ ID NO: 223337 - DNA, 22 bp, Artificial Sequence
  Synthetic oligonucleotide; CTC chr2 60477685 60477706 60477690 60477685 -
tcacagcaccactgcccctgtt

SEQ ID NO: 223338 - DNA, 22 bp, Artificial Sequence
  Synthetic oligonucleotide; CTC chr2 60477683 60477704 60477688 60477683 -
acagcaccactgcccctgtttc

SEQ ID NO: 223339 - DNA, 22 bp, Artificial Sequence
  Synthetic oligonucleotide; CTG chr2 60477671 60477692 60477676 60477671 -
cccctgtttccacagtgcccac

SEQ ID NO: 223340 - DNA, 22 bp, Artificial Sequence
  Synthetic oligonucleotide; CTG chr2 60477665 60477686 60477670 60477665 -
tttccacagtgcccacgaacaa

SEQ ID NO: 223341 - DNA, 22 bp, Artificial Sequence
  Synthetic oligonucleotide; TTT chr2 60477662 60477683 60477667 60477662 -
ccacagtgcccacgaacaaaac

SEQ ID NO: 223342 - DNA, 22 bp, Artificial Sequence
  Synthetic oligonucleotide; TTC chr2 60477661 60477682 60477666 60477661 -
cacagtgcccacgaacaaaaca

SEQ ID NO: 223343 - DNA, 22 bp, Artificial Sequence
  Synthetic oligonucleotide; CTC chr2 60477628 60477649 60477633 60477628 -
ttggaaacaccatgtttgatta

SEQ ID NO: 223344 - DNA, 22 bp, Artificial Sequence
  Synthetic oligonucleotide; CTT chr2 60477626 60477647 60477631 60477626 -
ggaaacaccatgtttgattatt

SEQ ID NO: 223345 - DNA, 22 bp, Artificial Sequence
  Synthetic oligonucleotide; TTG chr2 60477625 60477646 60477630 60477625 -
gaaacaccatgtttgattattt

SEQ ID NO: 223346 - DNA, 22 bp, Artificial Sequence
  Synthetic oligonucleotide; TTT chr2 60477611 60477632 60477616 60477611 -
gattatttctttctttctttct

SEQ ID NO: 223347 - DNA, 22 bp, Artificial Sequence
  Synthetic oligonucleotide; TTG chr2 60477610 60477631 60477615 60477610 -
attatttctttctttctttctt

SEQ ID NO: 223348 - DNA, 22 bp, Artificial Sequence
  Synthetic oligonucleotide; TTA chr2 60477606 60477627 60477611 60477606 -
tttctttctttctttctttctt

SEQ ID NO: 223349 - DNA, 22 bp, Artificial Sequence
  Synthetic oligonucleotide; TTT chr2 60477603 60477624 60477608 60477603 -
ctttctttctttctttctttat

SEQ ID NO: 223350 - DNA, 22 bp, Artificial Sequence
  Synthetic oligonucleotide; TTC chr2 60477602 60477623 60477607 60477602 -
tttctttctttctttctttatt

SEQ ID NO: 223351 - DNA, 22 bp, Artificial Sequence
  Synthetic oligonucleotide; CTT chr2 60477600 60477621 60477605 60477600 -
tctttctttctttctttattta

SEQ ID NO: 223352 - DNA, 22 bp, Artificial Sequence
  Synthetic oligonucleotide; TTT chr2 60477599 60477620 60477604 60477599 -
ctttctttctttctttatttat

SEQ ID NO: 223353 - DNA, 22 bp, Artificial Sequence
  Synthetic oligonucleotide; TTC chr2 60477598 60477619 60477603 60477598 -
tttctttctttctttatttatt

SEQ ID NO: 223354 - DNA, 22 bp, Artificial Sequence
  Synthetic oligonucleotide; CTT chr2 60477596 60477617 60477601 60477596 -
tctttctttctttatttatttt

SEQ ID NO: 223355 - DNA, 22 bp, Artificial Sequence
  Synthetic oligonucleotide; TTT chr2 60477595 60477616 60477600 60477595 -
ctttctttctttatttatttta

SEQ ID NO: 223356 - DNA, 22 bp, Artificial Sequence
  Synthetic oligonucleotide; TTC chr2 60477594 60477615 60477599 60477594 -
tttctttctttatttattttac

SEQ ID NO: 223357 - DNA, 22 bp, Artificial Sequence
  Synthetic oligonucleotide; CTT chr2 60477592 60477613 60477597 60477592 -
tctttctttatttattttactc

SEQ ID NO: 223358 - DNA, 22 bp, Artificial Sequence
  Synthetic oligonucleotide; TTT chr2 60477591 60477612 60477596 60477591 -
ctttctttatttattttactct

SEQ ID NO: 223359 - DNA, 22 bp, Artificial Sequence
  Synthetic oligonucleotide; TTC chr2 60477590 60477611 60477595 60477590 -
tttctttatttattttactcta

SEQ ID NO: 223360 - DNA, 22 bp, Artificial Sequence
  Synthetic oligonucleotide; CTT chr2 60477588 60477609 60477593 60477588 -
tctttatttattttactctaag

SEQ ID NO: 223361 - DNA, 22 bp, Artificial Sequence
  Synthetic oligonucleotide; TTT chr2 60477587 60477608 60477592 60477587 -
ctttatttattttactctaagt

SEQ ID NO: 223362 - DNA, 22 bp, Artificial Sequence
  Synthetic oligonucleotide; TTC chr2 60477586 60477607 60477591 60477586 -
tttatttattttactctaagtt

SEQ ID NO: 223363 - DNA, 22 bp, Artificial Sequence
  Synthetic oligonucleotide; CTT chr2 60477584 60477605 60477589 60477584 -
tatttattttactctaagttct

SEQ ID NO: 223364 - DNA, 22 bp, Artificial Sequence
  Synthetic oligonucleotide; TTT chr2 60477583 60477604 60477588 60477583 -
atttattttactctaagttctg

SEQ ID NO: 223365 - DNA, 22 bp, Artificial Sequence
  Synthetic oligonucleotide; TTA chr2 60477582 60477603 60477587 60477582 -
tttattttactctaagttctgg

SEQ ID NO: 223366 - DNA, 22 bp, Artificial Sequence
  Synthetic oligonucleotide; TTT chr2 60477579 60477600 60477584 60477579 -
attttactctaagttctgggat

SEQ ID NO: 223367 - DNA, 22 bp, Artificial Sequence
  Synthetic oligonucleotide; TTA chr2 60477578 60477599 60477583 60477578 -
ttttactctaagttctgggata

SEQ ID NO: 223368 - DNA, 22 bp, Artificial Sequence
  Synthetic oligonucleotide; TTT chr2 60477575 60477596 60477580 60477575 -
tactctaagttctgggatacat

SEQ ID NO: 223369 - DNA, 22 bp, Artificial Sequence
  Synthetic oligonucleotide; TTT chr2 60477574 60477595 60477579 60477574 -
actctaagttctgggatacatg

SEQ ID NO: 223370 - DNA, 22 bp, Artificial Sequence
  Synthetic oligonucleotide; TTA chr2 60477573 60477594 60477578 60477573 -
ctctaagttctgggatacatgt

SEQ ID NO: 223371 - DNA, 22 bp, Artificial Sequence
  Synthetic oligonucleotide; CTC chr2 60477570 60477591 60477575 60477570 -
taagttctgggatacatgtgca

SEQ ID NO: 223372 - DNA, 22 bp, Artificial Sequence
  Synthetic oligonucleotide; CTA chr2 60477568 60477589 60477573 60477568 -
agttctgggatacatgtgcaga

SEQ ID NO: 223373 - DNA, 22 bp, Artificial Sequence
  Synthetic oligonucleotide; TTC chr2 60477563 60477584 60477568 60477563 -
tgggatacatgtgcagaatgtg

SEQ ID NO: 223374 - DNA, 22 bp, Artificial Sequence
  Synthetic oligonucleotide; CTG chr2 60477561 60477582 60477566 60477561 -
ggatacatgtgcagaatgtgca

SEQ ID NO: 223375 - DNA, 22 bp, Artificial Sequence
  Synthetic oligonucleotide; TTT chr2 60477534 60477555 60477539 60477534 -
gttacataagtatacatgtacc

SEQ ID NO: 223376 - DNA, 22 bp, Artificial Sequence
  Synthetic oligonucleotide; TTG chr2 60477533 60477554 60477538 60477533 -
ttacataagtatacatgtacca

SEQ ID NO: 223377 - DNA, 22 bp, Artificial Sequence
  Synthetic oligonucleotide; TTA chr2 60477530 60477551 60477535 60477530 -
cataagtatacatgtaccatgg

SEQ ID NO: 223378 - DNA, 22 bp, Artificial Sequence
  Synthetic oligonucleotide; TTT chr2 60477502 60477523 60477507 60477502 -
gctgcacctatcaacccatcat

SEQ ID NO: 223379 - DNA, 22 bp, Artificial Sequence
  Synthetic oligonucleotide; TTG chr2 60477501 60477522 60477506 60477501 -
ctgcacctatcaacccatcatc

SEQ ID NO: 223380 - DNA, 22 bp, Artificial Sequence
  Synthetic oligonucleotide; CTG chr2 60477498 60477519 60477503 60477498 -
cacctatcaacccatcatctac

SEQ ID NO: 223381 - DNA, 22 bp, Artificial Sequence
  Synthetic oligonucleotide; CTA chr2 60477492 60477513 60477497 60477492 -
tcaacccatcatctacattagg

SEQ ID NO: 223382 - DNA, 22 bp, Artificial Sequence
  Synthetic oligonucleotide; CTA chr2 60477477 60477498 60477482 60477477 -
cattaggcatttctcctaatgc

SEQ ID NO: 223383 - DNA, 22 bp, Artificial Sequence
  Synthetic oligonucleotide; TTA chr2 60477472 60477493 60477477 60477472 -
ggcatttctcctaatgctatcc

SEQ ID NO: 223384 - DNA, 22 bp, Artificial Sequence
  Synthetic oligonucleotide; TTT chr2 60477465 60477486 60477470 60477465 -
ctcctaatgctatccctcccct

SEQ ID NO: 223385 - DNA, 22 bp, Artificial Sequence
  Synthetic oligonucleotide; TTC chr2 60477464 60477485 60477469 60477464 -
tcctaatgctatccctcccctt

SEQ ID NO: 223386 - DNA, 22 bp, Artificial Sequence
  Synthetic oligonucleotide; CTC chr2 60477462 60477483 60477467 60477462 -
ctaatgctatccctccccttgc

SEQ ID NO: 223387 - DNA, 22 bp, Artificial Sequence
  Synthetic oligonucleotide; CTA chr2 60477459 60477480 60477464 60477459 -
atgctatccctccccttgcccc

SEQ ID NO: 223388 - DNA, 22 bp, Artificial Sequence
  Synthetic oligonucleotide; CTA chr2 60477453 60477474 60477458 60477453 -
tccctccccttgcccctccacc

SEQ ID NO: 223389 - DNA, 22 bp, Artificial Sequence
  Synthetic oligonucleotide; CTC chr2 60477447 60477468 60477452 60477447 -
cccttgcccctccacccatgtt

SEQ ID NO: 223390 - DNA, 22 bp, Artificial Sequence
  Synthetic oligonucleotide; CTT chr2 60477442 60477463 60477447 60477442 -
gcccctccacccatgtttggtt

SEQ ID NO: 223391 - DNA, 22 bp, Artificial Sequence
  Synthetic oligonucleotide; TTG chr2 60477441 60477462 60477446 60477441 -
cccctccacccatgtttggttt

SEQ ID NO: 223392 - DNA, 22 bp, Artificial Sequence
  Synthetic oligonucleotide; CTC chr2 60477435 60477456 60477440 60477435 -
cacccatgtttggttttcttta

SEQ ID NO: 223393 - DNA, 22 bp, Artificial Sequence
  Synthetic oligonucleotide; TTT chr2 60477424 60477445 60477429 60477424 -
ggttttctttagcttattctag

SEQ ID NO: 223394 - DNA, 22 bp, Artificial Sequence
  Synthetic oligonucleotide; TTG chr2 60477423 60477444 60477428 60477423 -
gttttctttagcttattctagt

SEQ ID NO: 223395 - DNA, 22 bp, Artificial Sequence
  Synthetic oligonucleotide; TTT chr2 60477419 60477440 60477424 60477419 -
tctttagcttattctagtattt

SEQ ID NO: 223396 - DNA, 22 bp, Artificial Sequence
  Synthetic oligonucleotide; TTT chr2 60477418 60477439 60477423 60477418 -
ctttagcttattctagtatttt

SEQ ID NO: 223397 - DNA, 22 bp, Artificial Sequence
  Synthetic oligonucleotide; TTC chr2 60477417 60477438 60477422 60477417 -
tttagcttattctagtattttc

SEQ ID NO: 223398 - DNA, 22 bp, Artificial Sequence
  Synthetic oligonucleotide; CTT chr2 60477415 60477436 60477420 60477415 -
tagcttattctagtattttctc

SEQ ID NO: 223399 - DNA, 22 bp, Artificial Sequence
  Synthetic oligonucleotide; TTT chr2 60477414 60477435 60477419 60477414 -
agcttattctagtattttctca

SEQ ID NO: 223400 - DNA, 22 bp, Artificial Sequence
  Synthetic oligonucleotide; TTA chr2 60477413 60477434 60477418 60477413 -
gcttattctagtattttctcaa

SEQ ID NO: 223401 - DNA, 22 bp, Artificial Sequence
  Synthetic oligonucleotide; CTT chr2 60477409 60477430 60477414 60477409 -
attctagtattttctcaagacc

SEQ ID NO: 223402 - DNA, 22 bp, Artificial Sequence
  Synthetic oligonucleotide; TTA chr2 60477408 60477429 60477413 60477408 -
ttctagtattttctcaagaccg

SEQ ID NO: 223403 - DNA, 22 bp, Artificial Sequence
  Synthetic oligonucleotide; TTC chr2 60477405 60477426 60477410 60477405 -
tagtattttctcaagaccgatc

SEQ ID NO: 223404 - DNA, 22 bp, Artificial Sequence
  Synthetic oligonucleotide; CTA chr2 60477403 60477424 60477408 60477403 -
gtattttctcaagaccgatcga

SEQ ID NO: 223405 - DNA, 22 bp, Artificial Sequence
  Synthetic oligonucleotide; TTT chr2 60477397 60477418 60477402 60477397 -
tctcaagaccgatcgaaatgat

SEQ ID NO: 223406 - DNA, 22 bp, Artificial Sequence
  Synthetic oligonucleotide; TTT chr2 60477396 60477417 60477401 60477396 -
ctcaagaccgatcgaaatgata

SEQ ID NO: 223407 - DNA, 22 bp, Artificial Sequence
  Synthetic oligonucleotide; TTC chr2 60477395 60477416 60477400 60477395 -
tcaagaccgatcgaaatgataa

SEQ ID NO: 223408 - DNA, 22 bp, Artificial Sequence
  Synthetic oligonucleotide; CTC chr2 60477393 60477414 60477398 60477393 -
aagaccgatcgaaatgataata

SEQ ID NO: 223409 - DNA, 22 bp, Artificial Sequence
  Synthetic oligonucleotide; TTT chr2 60477351 60477372 60477356 60477351 -
gttgtgagttgatgcagataaa

SEQ ID NO: 223410 - DNA, 22 bp, Artificial Sequence
  Synthetic oligonucleotide; TTG chr2 60477350 60477371 60477355 60477350 -
ttgtgagttgatgcagataaaa

SEQ ID NO: 223411 - DNA, 22 bp, Artificial Sequence
  Synthetic oligonucleotide; TTG chr2 60477347 60477368 60477352 60477347 -
tgagttgatgcagataaaaagg

SEQ ID NO: 223412 - DNA, 22 bp, Artificial Sequence
  Synthetic oligonucleotide; TTG chr2 60477340 60477361 60477345 60477340 -
atgcagataaaaaggcttgggg

SEQ ID NO: 223413 - DNA, 22 bp, Artificial Sequence
  Synthetic oligonucleotide; CTT chr2 60477322 60477343 60477327 60477322 -
ggggtggtcttcagagtaattt

SEQ ID NO: 223414 - DNA, 22 bp, Artificial Sequence
  Synthetic oligonucleotide; TTG chr2 60477321 60477342 60477326 60477321 -
gggtggtcttcagagtaatttg

SEQ ID NO: 223415 - DNA, 22 bp, Artificial Sequence
  Synthetic oligonucleotide; CTT chr2 60477311 60477332 60477316 60477311 -
cagagtaatttgggagttgtgt

SEQ ID NO: 223416 - DNA, 22 bp, Artificial Sequence
  Synthetic oligonucleotide; TTC chr2 60477310 60477331 60477315 60477310 -
agagtaatttgggagttgtgtg

SEQ ID NO: 223417 - DNA, 22 bp, Artificial Sequence
  Synthetic oligonucleotide; TTT chr2 60477300 60477321 60477305 60477300 -
gggagttgtgtgttctgctggc

SEQ ID NO: 223418 - DNA, 22 bp, Artificial Sequence
  Synthetic oligonucleotide; TTG chr2 60477299 60477320 60477304 60477299 -
ggagttgtgtgttctgctggct

SEQ ID NO: 223419 - DNA, 22 bp, Artificial Sequence
  Synthetic oligonucleotide; TTG chr2 60477292 60477313 60477297 60477292 -
tgtgttctgctggctttgatag

SEQ ID NO: 223420 - DNA, 22 bp, Artificial Sequence
  Synthetic oligonucleotide; TTC chr2 60477285 60477306 60477290 60477285 -
tgctggctttgatagacaagcc

SEQ ID NO: 223421 - DNA, 22 bp, Artificial Sequence
  Synthetic oligonucleotide; CTG chr2 60477283 60477304 60477288 60477283 -
ctggctttgatagacaagccct

SEQ ID NO: 223422 - DNA, 22 bp, Artificial Sequence
  Synthetic oligonucleotide; CTG chr2 60477280 60477301 60477285 60477280 -
gctttgatagacaagcccttct

SEQ ID NO: 223423 - DNA, 22 bp, Artificial Sequence
  Synthetic oligonucleotide; CTT chr2 60477276 60477297 60477281 60477276 -
tgatagacaagcccttctctgc

SEQ ID NO: 223424 - DNA, 22 bp, Artificial Sequence
  Synthetic oligonucleotide; TTT chr2 60477275 60477296 60477280 60477275 -
gatagacaagcccttctctgct

SEQ ID NO: 223425 - DNA, 22 bp, Artificial Sequence
  Synthetic oligonucleotide; TTG chr2 60477274 60477295 60477279 60477274 -
atagacaagcccttctctgctc

SEQ ID NO: 223426 - DNA, 22 bp, Artificial Sequence
  Synthetic oligonucleotide; CTT chr2 60477260 60477281 60477265 60477260 -
ctctgctctggcaggtgttatc

SEQ ID NO: 223427 - DNA, 22 bp, Artificial Sequence
  Synthetic oligonucleotide; TTC chr2 60477259 60477280 60477264 60477259 -
tctgctctggcaggtgttatca

SEQ ID NO: 223428 - DNA, 22 bp, Artificial Sequence
  Synthetic oligonucleotide; CTC chr2 60477257 60477278 60477262 60477257 -
tgctctggcaggtgttatcaga

SEQ ID NO: 223429 - DNA, 22 bp, Artificial Sequence
  Synthetic oligonucleotide; CTG chr2 60477255 60477276 60477260 60477255 -
ctctggcaggtgttatcagaat

SEQ ID NO: 223430 - DNA, 22 bp, Artificial Sequence
  Synthetic oligonucleotide; CTC chr2 60477252 60477273 60477257 60477252 -
tggcaggtgttatcagaatcaa

SEQ ID NO: 223431 - DNA, 22 bp, Artificial Sequence
  Synthetic oligonucleotide; CTG chr2 60477250 60477271 60477255 60477250 -
gcaggtgttatcagaatcaaac

SEQ ID NO: 223432 - DNA, 22 bp, Artificial Sequence
  Synthetic oligonucleotide; TTA chr2 60477240 60477261 60477245 60477240 -
tcagaatcaaacgtttgcaaat

SEQ ID NO: 223433 - DNA, 22 bp, Artificial Sequence
  Synthetic oligonucleotide; TTT chr2 60477224 60477245 60477229 60477224 -
gcaaatgatcattctcatcgca

SEQ ID NO: 223434 - DNA, 22 bp, Artificial Sequence
  Synthetic oligonucleotide; TTG chr2 60477223 60477244 60477228 60477223 -
caaatgatcattctcatcgcat

SEQ ID NO: 223435 - DNA, 22 bp, Artificial Sequence
  Synthetic oligonucleotide; TTC chr2 60477210 60477231 60477215 60477210 -
tcatcgcatccatcttcacagc

SEQ ID NO: 223436 - DNA, 22 bp, Artificial Sequence
  Synthetic oligonucleotide; CTC chr2 60477208 60477229 60477213 60477208 -
atcgcatccatcttcacagccc

SEQ ID NO: 223437 - DNA, 22 bp, Artificial Sequence
  Synthetic oligonucleotide; CTT chr2 60477194 60477215 60477199 60477194 -
cacagccccatgcctcttcctg

SEQ ID NO: 223438 - DNA, 22 bp, Artificial Sequence
  Synthetic oligonucleotide; TTC chr2 60477193 60477214 60477198 60477193 -
acagccccatgcctcttcctga

SEQ ID NO: 223439 - DNA, 22 bp, Artificial Sequence
  Synthetic oligonucleotide; CTC chr2 60477178 60477199 60477183 60477178 -
ttcctgaatgctcagttgaaaa

SEQ ID NO: 223440 - DNA, 22 bp, Artificial Sequence
  Synthetic oligonucleotide; CTT chr2 60477176 60477197 60477181 60477176 -
cctgaatgctcagttgaaaatg

SEQ ID NO: 223441 - DNA, 22 bp, Artificial Sequence
  Synthetic oligonucleotide; TTC chr2 60477175 60477196 60477180 60477175 -
ctgaatgctcagttgaaaatgc

SEQ ID NO: 223442 - DNA, 22 bp, Artificial Sequence
  Synthetic oligonucleotide; CTG chr2 60477172 60477193 60477177 60477172 -
aatgctcagttgaaaatgcgta

SEQ ID NO: 223443 - DNA, 22 bp, Artificial Sequence
  Synthetic oligonucleotide; CTC chr2 60477165 60477186 60477170 60477165 -
agttgaaaatgcgtatttcacc

SEQ ID NO: 223444 - DNA, 22 bp, Artificial Sequence
  Synthetic oligonucleotide; TTG chr2 60477160 60477181 60477165 60477160 -
aaaatgcgtatttcaccttcct

SEQ ID NO: 223445 - DNA, 22 bp, Artificial Sequence
  Synthetic oligonucleotide; TTT chr2 60477147 60477168 60477152 60477147 -
caccttcctcaggtatctaata

SEQ ID NO: 223446 - DNA, 22 bp, Artificial Sequence
  Synthetic oligonucleotide; TTC chr2 60477146 60477167 60477151 60477146 -
accttcctcaggtatctaatac

SEQ ID NO: 223447 - DNA, 22 bp, Artificial Sequence
  Synthetic oligonucleotide; CTT chr2 60477141 60477162 60477146 60477141 -
cctcaggtatctaatacttaac

SEQ ID NO: 223448 - DNA, 22 bp, Artificial Sequence
  Synthetic oligonucleotide; TTC chr2 60477140 60477161 60477145 60477140 -
ctcaggtatctaatacttaacc

SEQ ID NO: 223449 - DNA, 22 bp, Artificial Sequence
  Synthetic oligonucleotide; CTC chr2 60477137 60477158 60477142 60477137 -
aggtatctaatacttaacctgg

SEQ ID NO: 223450 - DNA, 22 bp, Artificial Sequence
  Synthetic oligonucleotide; CTA chr2 60477128 60477149 60477133 60477128 -
atacttaacctgggagaaacgc

SEQ ID NO: 223451 - DNA, 22 bp, Artificial Sequence
  Synthetic oligonucleotide; CTT chr2 60477122 60477143 60477127 60477122 -
aacctgggagaaacgcaagtgt

SEQ ID NO: 223452 - DNA, 22 bp, Artificial Sequence
  Synthetic oligonucleotide; TTA chr2 60477121 60477142 60477126 60477121 -
acctgggagaaacgcaagtgtg

SEQ ID NO: 223453 - DNA, 22 bp, Artificial Sequence
  Synthetic oligonucleotide; CTG chr2 60477116 60477137 60477121 60477116 -
ggagaaacgcaagtgtggtttg

SEQ ID NO: 223454 - DNA, 22 bp, Artificial Sequence
  Synthetic oligonucleotide; TTT chr2 60477095 60477116 60477100 60477095 -
gcaaggctttccaggtgtccaa

SEQ ID NO: 223455 - DNA, 22 bp, Artificial Sequence
  Synthetic oligonucleotide; TTG chr2 60477094 60477115 60477099 60477094 -
caaggctttccaggtgtccaaa

SEQ ID NO: 223456 - DNA, 22 bp, Artificial Sequence
  Synthetic oligonucleotide; CTT chr2 60477086 60477107 60477091 60477086 -
tccaggtgtccaaatgatgatt

SEQ ID NO: 223457 - DNA, 22 bp, Artificial Sequence
  Synthetic oligonucleotide; TTT chr2 60477085 60477106 60477090 60477085 -
ccaggtgtccaaatgatgattt

SEQ ID NO: 223458 - DNA, 22 bp, Artificial Sequence
  Synthetic oligonucleotide; TTC chr2 60477084 60477105 60477089 60477084 -
caggtgtccaaatgatgatttc

SEQ ID NO: 223459 - DNA, 22 bp, Artificial Sequence
  Synthetic oligonucleotide; TTT chr2 60477063 60477084 60477068 60477063 -
cccatccttttcttcatttctc

SEQ ID NO: 223460 - DNA, 22 bp, Artificial Sequence
  Synthetic oligonucleotide; TTC chr2 60477062 60477083 60477067 60477062 -
ccatccttttcttcatttctcg

SEQ ID NO: 223461 - DNA, 22 bp, Artificial Sequence
  Synthetic oligonucleotide; CTT chr2 60477054 60477075 60477059 60477054 -
ttcttcatttctcgagtggggc

SEQ ID NO: 223462 - DNA, 22 bp, Artificial Sequence
  Synthetic oligonucleotide; TTT chr2 60477053 60477074 60477058 60477053 -
tcttcatttctcgagtggggca

SEQ ID NO: 223463 - DNA, 22 bp, Artificial Sequence
  Synthetic oligonucleotide; TTT chr2 60477052 60477073 60477057 60477052 -
cttcatttctcgagtggggcag

SEQ ID NO: 223464 - DNA, 22 bp, Artificial Sequence
  Synthetic oligonucleotide; TTC chr2 60477051 60477072 60477056 60477051 -
ttcatttctcgagtggggcagg

SEQ ID NO: 223465 - DNA, 22 bp, Artificial Sequence
  Synthetic oligonucleotide; CTT chr2 60477049 60477070 60477054 60477049 -
catttctcgagtggggcaggga

SEQ ID NO: 223466 - DNA, 22 bp, Artificial Sequence
  Synthetic oligonucleotide; TTC chr2 60477048 60477069 60477053 60477048 -
atttctcgagtggggcagggag

SEQ ID NO: 223467 - DNA, 22 bp, Artificial Sequence
  Synthetic oligonucleotide; TTT chr2 60477044 60477065 60477049 60477044 -
ctcgagtggggcagggaggcat

SEQ ID NO: 223468 - DNA, 22 bp, Artificial Sequence
  Synthetic oligonucleotide; TTC chr2 60477043 60477064 60477048 60477043 -
tcgagtggggcagggaggcatc

SEQ ID NO: 223469 - DNA, 22 bp, Artificial Sequence
  Synthetic oligonucleotide; CTC chr2 60477041 60477062 60477046 60477041 -
gagtggggcagggaggcatcgg

SEQ ID NO: 223470 - DNA, 22 bp, Artificial Sequence
  Synthetic oligonucleotide; TTT chr2 60477012 60477033 60477017 60477012 -
gtgatacgtttgtgtgaagctg

SEQ ID NO: 223471 - DNA, 22 bp, Artificial Sequence
  Synthetic oligonucleotide; TTG chr2 60477011 60477032 60477016 60477011 -
tgatacgtttgtgtgaagctgg

SEQ ID NO: 223472 - DNA, 22 bp, Artificial Sequence
  Synthetic oligonucleotide; TTT chr2 60477001 60477022 60477006 60477001 -
gtgtgaagctggacaattcggg

SEQ ID NO: 223473 - DNA, 22 bp, Artificial Sequence
  Synthetic oligonucleotide; TTG chr2 60477000 60477021 60477005 60477000 -
tgtgaagctggacaattcgggt

SEQ ID NO: 223474 - DNA, 22 bp, Artificial Sequence
  Synthetic oligonucleotide; CTG chr2 60476990 60477011 60476995 60476990 -
gacaattcgggtgacagaaata

SEQ ID NO: 223475 - DNA, 22 bp, Artificial Sequence
  Synthetic oligonucleotide; TTC chr2 60476982 60477003 60476987 60476982 -
gggtgacagaaatatgttcagg

SEQ ID NO: 223476 - DNA, 22 bp, Artificial Sequence
  Synthetic oligonucleotide; TTC chr2 60476963 60476984 60476968 60476963 -
agggcagtgtcttttatcgtcc

SEQ ID NO: 223477 - DNA, 22 bp, Artificial Sequence
  Synthetic oligonucleotide; CTT chr2 60476950 60476971 60476955 60476950 -
ttatcgtcccttctaactacaa

SEQ ID NO: 223478 - DNA, 22 bp, Artificial Sequence
  Synthetic oligonucleotide; TTT chr2 60476949 60476970 60476954 60476949 -
tatcgtcccttctaactacaaa

SEQ ID NO: 223479 - DNA, 22 bp, Artificial Sequence
  Synthetic oligonucleotide; TTT chr2 60476948 60476969 60476953 60476948 -
atcgtcccttctaactacaaag

SEQ ID NO: 223480 - DNA, 22 bp, Artificial Sequence
  Synthetic oligonucleotide; TTA chr2 60476947 60476968 60476952 60476947 -
tcgtcccttctaactacaaagg

SEQ ID NO: 223481 - DNA, 22 bp, Artificial Sequence
  Synthetic oligonucleotide; CTT chr2 60476938 60476959 60476943 60476938 -
ctaactacaaaggcatggattg

SEQ ID NO: 223482 - DNA, 22 bp, Artificial Sequence
  Synthetic oligonucleotide; TTC chr2 60476937 60476958 60476942 60476937 -
taactacaaaggcatggattgc

SEQ ID NO: 223483 - DNA, 22 bp, Artificial Sequence
  Synthetic oligonucleotide; CTA chr2 60476935 60476956 60476940 60476935 -
actacaaaggcatggattgcag

SEQ ID NO: 223484 - DNA, 22 bp, Artificial Sequence
  Synthetic oligonucleotide; CTA chr2 60476931 60476952 60476936 60476931 -
caaaggcatggattgcagttga

SEQ ID NO: 223485 - DNA, 22 bp, Artificial Sequence
  Synthetic oligonucleotide; TTG chr2 60476916 60476937 60476921 60476916 -
cagttgagccccactttcagaa

SEQ ID NO: 223486 - DNA, 22 bp, Artificial Sequence
  Synthetic oligonucleotide; TTG chr2 60476910 60476931 60476915 60476910 -
agccccactttcagaaggccca

SEQ ID NO: 223487 - DNA, 22 bp, Artificial Sequence
  Synthetic oligonucleotide; CTT chr2 60476900 60476921 60476905 60476900 -
tcagaaggcccaatacacacaa

SEQ ID NO: 223488 - DNA, 22 bp, Artificial Sequence
  Synthetic oligonucleotide; TTT chr2 60476899 60476920 60476904 60476899 -
cagaaggcccaatacacacaaa

SEQ ID NO: 223489 - DNA, 22 bp, Artificial Sequence
  Synthetic oligonucleotide; TTC chr2 60476898 60476919 60476903 60476898 -
agaaggcccaatacacacaaaa

SEQ ID NO: 223490 - DNA, 22 bp, Artificial Sequence
  Synthetic oligonucleotide; CTC chr2 60476871 60476892 60476876 60476871 -
attaatggaaactgataaatta

SEQ ID NO: 223491 - DNA, 22 bp, Artificial Sequence
  Synthetic oligonucleotide; TTA chr2 60476867 60476888 60476872 60476867 -
atggaaactgataaattagaga

SEQ ID NO: 223492 - DNA, 22 bp, Artificial Sequence
  Synthetic oligonucleotide; CTG chr2 60476857 60476878 60476862 60476857 -
ataaattagagagtgatttttc

SEQ ID NO: 223493 - DNA, 22 bp, Artificial Sequence
  Synthetic oligonucleotide; TTA chr2 60476849 60476870 60476854 60476849 -
gagagtgatttttcacattaca

SEQ ID NO: 223494 - DNA, 22 bp, Artificial Sequence
  Synthetic oligonucleotide; TTT chr2 60476838 60476859 60476843 60476838 -
ttcacattacagaaagattgtt

SEQ ID NO: 223495 - DNA, 22 bp, Artificial Sequence
  Synthetic oligonucleotide; TTT chr2 60476837 60476858 60476842 60476837 -
tcacattacagaaagattgtta

SEQ ID NO: 223496 - DNA, 22 bp, Artificial Sequence
  Synthetic oligonucleotide; TTT chr2 60476836 60476857 60476841 60476836 -
cacattacagaaagattgttaa

SEQ ID NO: 223497 - DNA, 22 bp, Artificial Sequence
  Synthetic oligonucleotide; TTC chr2 60476835 60476856 60476840 60476835 -
acattacagaaagattgttaac

SEQ ID NO: 223498 - DNA, 22 bp, Artificial Sequence
  Synthetic oligonucleotide; TTA chr2 60476829 60476850 60476834 60476829 -
cagaaagattgttaacttttca

SEQ ID NO: 223499 - DNA, 22 bp, Artificial Sequence
  Synthetic oligonucleotide; TTG chr2 60476818 60476839 60476823 60476818 -
ttaacttttcaaaaggtttcac

SEQ ID NO: 223500 - DNA, 22 bp, Artificial Sequence
  Synthetic oligonucleotide; TTA chr2 60476815 60476836 60476820 60476815 -
acttttcaaaaggtttcaccac

SEQ ID NO: 223501 - DNA, 22 bp, Artificial Sequence
  Synthetic oligonucleotide; CTT chr2 60476811 60476832 60476816 60476811 -
ttcaaaaggtttcaccacaggg

SEQ ID NO: 223502 - DNA, 22 bp, Artificial Sequence
  Synthetic oligonucleotide; TTT chr2 60476810 60476831 60476815 60476810 -
tcaaaaggtttcaccacagggt

SEQ ID NO: 223503 - DNA, 22 bp, Artificial Sequence
  Synthetic oligonucleotide; TTT chr2 60476809 60476830 60476814 60476809 -
caaaaggtttcaccacagggtt

SEQ ID NO: 223504 - DNA, 22 bp, Artificial Sequence
  Synthetic oligonucleotide; TTC chr2 60476808 60476829 60476813 60476808 -
aaaaggtttcaccacagggttt

SEQ ID NO: 223505 - DNA, 22 bp, Artificial Sequence
  Synthetic oligonucleotide; TTT chr2 60476799 60476820 60476804 60476799 -
caccacagggtttctttaaata

SEQ ID NO: 223506 - DNA, 22 bp, Artificial Sequence
  Synthetic oligonucleotide; TTC chr2 60476798 60476819 60476803 60476798 -
accacagggtttctttaaatag

SEQ ID NO: 223507 - DNA, 22 bp, Artificial Sequence
  Synthetic oligonucleotide; TTT chr2 60476786 60476807 60476791 60476786 -
ctttaaatagtgagctccccca

SEQ ID NO: 223508 - DNA, 22 bp, Artificial Sequence
  Synthetic oligonucleotide; TTC chr2 60476785 60476806 60476790 60476785 -
tttaaatagtgagctcccccac

SEQ ID NO: 223509 - DNA, 22 bp, Artificial Sequence
  Synthetic oligonucleotide; CTT chr2 60476783 60476804 60476788 60476783 -
taaatagtgagctcccccactg

SEQ ID NO: 223510 - DNA, 22 bp, Artificial Sequence
  Synthetic oligonucleotide; TTT chr2 60476782 60476803 60476787 60476782 -
aaatagtgagctcccccactga

SEQ ID NO: 223511 - DNA, 22 bp, Artificial Sequence
  Synthetic oligonucleotide; TTA chr2 60476781 60476802 60476786 60476781 -
aatagtgagctcccccactgaa

SEQ ID NO: 223512 - DNA, 22 bp, Artificial Sequence
  Synthetic oligonucleotide; CTC chr2 60476769 60476790 60476774 60476769 -
ccccactgaatttaaagtgttt

SEQ ID NO: 223513 - DNA, 22 bp, Artificial Sequence
  Synthetic oligonucleotide; CTG chr2 60476761 60476782 60476766 60476761 -
aatttaaagtgtttgtttacag

SEQ ID NO: 223514 - DNA, 22 bp, Artificial Sequence
  Synthetic oligonucleotide; TTT chr2 60476756 60476777 60476761 60476756 -
aaagtgtttgtttacagatcat

SEQ ID NO: 223515 - DNA, 22 bp, Artificial Sequence
  Synthetic oligonucleotide; TTA chr2 60476755 60476776 60476760 60476755 -
aagtgtttgtttacagatcatt

SEQ ID NO: 223516 - DNA, 22 bp, Artificial Sequence
  Synthetic oligonucleotide; TTT chr2 60476747 60476768 60476752 60476747 -
gtttacagatcattaactactt

SEQ ID NO: 223517 - DNA, 22 bp, Artificial Sequence
  Synthetic oligonucleotide; TTG chr2 60476746 60476767 60476751 60476746 -
tttacagatcattaactacttg

SEQ ID NO: 223518 - DNA, 22 bp, Artificial Sequence
  Synthetic oligonucleotide; TTT chr2 60476743 60476764 60476748 60476743 -
acagatcattaactacttgaca

SEQ ID NO: 223519 - DNA, 22 bp, Artificial Sequence
  Synthetic oligonucleotide; TTA chr2 60476742 60476763 60476747 60476742 -
cagatcattaactacttgacag

SEQ ID NO: 223520 - DNA, 22 bp, Artificial Sequence
  Synthetic oligonucleotide; TTA chr2 60476732 60476753 60476737 60476732 -
actacttgacagagaggatatt

SEQ ID NO: 223521 - DNA, 22 bp, Artificial Sequence
  Synthetic oligonucleotide; CTA chr2 60476728 60476749 60476733 60476728 -
cttgacagagaggatattgggg

SEQ ID NO: 223522 - DNA, 22 bp, Artificial Sequence
  Synthetic oligonucleotide; CTT chr2 60476725 60476746 60476730 60476725 -
gacagagaggatattgggggtt

SEQ ID NO: 223523 - DNA, 22 bp, Artificial Sequence
  Synthetic oligonucleotide; TTG chr2 60476724 60476745 60476729 60476724 -
acagagaggatattgggggttg

SEQ ID NO: 223524 - DNA, 22 bp, Artificial Sequence
  Synthetic oligonucleotide; TTG chr2 60476709 60476730 60476714 60476709 -
ggggttgggggaaggaagacac

SEQ ID NO: 223525 - DNA, 22 bp, Artificial Sequence
  Synthetic oligonucleotide; TTG chr2 60476702 60476723 60476707 60476702 -
ggggaaggaagacacacttaaa

SEQ ID NO: 223526 - DNA, 22 bp, Artificial Sequence
  Synthetic oligonucleotide; CTT chr2 60476683 60476704 60476688 60476683 -
aaaaggtaaaatgttagaagcc

SEQ ID NO: 223527 - DNA, 22 bp, Artificial Sequence
  Synthetic oligonucleotide; TTA chr2 60476682 60476703 60476687 60476682 -
aaaggtaaaatgttagaagccc

SEQ ID NO: 223528 - DNA, 22 bp, Artificial Sequence
  Synthetic oligonucleotide; TTA chr2 60476667 60476688 60476672 60476667 -
gaagccctgccaattttcaatg

SEQ ID NO: 223529 - DNA, 22 bp, Artificial Sequence
  Synthetic oligonucleotide; CTG chr2 60476658 60476679 60476663 60476658 -
ccaattttcaatgagcctggaa

SEQ ID NO: 223530 - DNA, 22 bp, Artificial Sequence
  Synthetic oligonucleotide; TTT chr2 60476651 60476672 60476656 60476651 -
tcaatgagcctggaagggtgac

SEQ ID NO: 223531 - DNA, 22 bp, Artificial Sequence
  Synthetic oligonucleotide; TTT chr2 60476650 60476671 60476655 60476650 -
caatgagcctggaagggtgacg

SEQ ID NO: 223532 - DNA, 22 bp, Artificial Sequence
  Synthetic oligonucleotide; TTC chr2 60476649 60476670 60476654 60476649 -
aatgagcctggaagggtgacga

SEQ ID NO: 223533 - DNA, 22 bp, Artificial Sequence
  Synthetic oligonucleotide; CTG chr2 60476639 60476660 60476644 60476639 -
gaagggtgacgaaacatctctg

SEQ ID NO: 223534 - DNA, 22 bp, Artificial Sequence
  Synthetic oligonucleotide; CTC chr2 60476619 60476640 60476624 60476619 -
tgaaattatgttggttagcaaa

SEQ ID NO: 223535 - DNA, 22 bp, Artificial Sequence
  Synthetic oligonucleotide; CTG chr2 60476617 60476638 60476622 60476617 -
aaattatgttggttagcaaata

SEQ ID NO: 223536 - DNA, 22 bp, Artificial Sequence
  Synthetic oligonucleotide; TTA chr2 60476611 60476632 60476616 60476611 -
tgttggttagcaaatatgattt

SEQ ID NO: 223537 - DNA, 22 bp, Artificial Sequence
  Synthetic oligonucleotide; TTG chr2 60476606 60476627 60476611 60476606 -
gttagcaaatatgatttatttt

SEQ ID NO: 223538 - DNA, 22 bp, Artificial Sequence
  Synthetic oligonucleotide; TTA chr2 60476602 60476623 60476607 60476602 -
gcaaatatgatttattttacag

SEQ ID NO: 223539 - DNA, 22 bp, Artificial Sequence
  Synthetic oligonucleotide; TTT chr2 60476589 60476610 60476594 60476589 -
attttacagaaattcattttac

SEQ ID NO: 223540 - DNA, 22 bp, Artificial Sequence
  Synthetic oligonucleotide; TTA chr2 60476588 60476609 60476593 60476588 -
ttttacagaaattcattttaca

SEQ ID NO: 223541 - DNA, 22 bp, Artificial Sequence
  Synthetic oligonucleotide; TTT chr2 60476585 60476606 60476590 60476585 -
tacagaaattcattttacacat

SEQ ID NO: 223542 - DNA, 22 bp, Artificial Sequence
  Synthetic oligonucleotide; TTT chr2 60476584 60476605 60476589 60476584 -
acagaaattcattttacacatg

SEQ ID NO: 223543 - DNA, 22 bp, Artificial Sequence
  Synthetic oligonucleotide; TTA chr2 60476583 60476604 60476588 60476583 -
cagaaattcattttacacatgg

SEQ ID NO: 223544 - DNA, 22 bp, Artificial Sequence
  Synthetic oligonucleotide; TTC chr2 60476574 60476595 60476579 60476574 -
attttacacatggctttccaag

SEQ ID NO: 223545 - DNA, 22 bp, Artificial Sequence
  Synthetic oligonucleotide; TTT chr2 60476570 60476591 60476575 60476570 -
tacacatggctttccaagaacc

SEQ ID NO: 223546 - DNA, 22 bp, Artificial Sequence
  Synthetic oligonucleotide; TTT chr2 60476569 60476590 60476574 60476569 -
acacatggctttccaagaaccc

SEQ ID NO: 223547 - DNA, 22 bp, Artificial Sequence
  Synthetic oligonucleotide; TTA chr2 60476568 60476589 60476573 60476568 -
cacatggctttccaagaaccct

SEQ ID NO: 223548 - DNA, 22 bp, Artificial Sequence
  Synthetic oligonucleotide; CTT chr2 60476558 60476579 60476563 60476558 -
tccaagaaccctccatgctgat

SEQ ID NO: 223549 - DNA, 22 bp, Artificial Sequence
  Synthetic oligonucleotide; TTT chr2 60476557 60476578 60476562 60476557 -
ccaagaaccctccatgctgatg

SEQ ID NO: 223550 - DNA, 22 bp, Artificial Sequence
  Synthetic oligonucleotide; TTC chr2 60476556 60476577 60476561 60476556 -
caagaaccctccatgctgatgg

SEQ ID NO: 223551 - DNA, 22 bp, Artificial Sequence
  Synthetic oligonucleotide; CTC chr2 60476545 60476566 60476550 60476545 -
catgctgatggggtgtggtggg

SEQ ID NO: 223552 - DNA, 22 bp, Artificial Sequence
  Synthetic oligonucleotide; CTG chr2 60476538 60476559 60476543 60476538 -
atggggtgtggtgggaggtcaa

SEQ ID NO: 223553 - DNA, 22 bp, Artificial Sequence
  Synthetic oligonucleotide; CTG chr2 60476500 60476521 60476505 60476500 -
ggctttgctgtcctggtttgtg

SEQ ID NO: 223554 - DNA, 22 bp, Artificial Sequence
  Synthetic oligonucleotide; CTT chr2 60476495 60476516 60476500 60476495 -
tgctgtcctggtttgtggtggc

SEQ ID NO: 223555 - DNA, 22 bp, Artificial Sequence
  Synthetic oligonucleotide; TTT chr2 60476494 60476515 60476499 60476494 -
gctgtcctggtttgtggtggct

SEQ ID NO: 223556 - DNA, 22 bp, Artificial Sequence
  Synthetic oligonucleotide; TTG chr2 60476493 60476514 60476498 60476493 -
ctgtcctggtttgtggtggctg

SEQ ID NO: 223557 - DNA, 22 bp, Artificial Sequence
  Synthetic oligonucleotide; CTG chr2 60476490 60476511 60476495 60476490 -
tcctggtttgtggtggctgggg

SEQ ID NO: 223558 - DNA, 22 bp, Artificial Sequence
  Synthetic oligonucleotide; CTG chr2 60476485 60476506 60476490 60476485 -
gtttgtggtggctggggagagg

SEQ ID NO: 223559 - DNA, 22 bp, Artificial Sequence
  Synthetic oligonucleotide; TTT chr2 60476481 60476502 60476486 60476481 -
gtggtggctggggagaggactc

SEQ ID NO: 223560 - DNA, 22 bp, Artificial Sequence
  Synthetic oligonucleotide; TTG chr2 60476480 60476501 60476485 60476480 -
tggtggctggggagaggactcc

SEQ ID NO: 223561 - DNA, 22 bp, Artificial Sequence
  Synthetic oligonucleotide; CTG chr2 60476471 60476492 60476476 60476471 -
gggagaggactcccttttctta

SEQ ID NO: 223562 - DNA, 22 bp, Artificial Sequence
  Synthetic oligonucleotide; CTC chr2 60476459 60476480 60476464 60476459 -
ccttttcttagagtcctgtgtg

SEQ ID NO: 223563 - DNA, 22 bp, Artificial Sequence
  Synthetic oligonucleotide; CTT chr2 60476455 60476476 60476460 60476455 -
ttcttagagtcctgtgtgtgcc

SEQ ID NO: 223564 - DNA, 22 bp, Artificial Sequence
  Synthetic oligonucleotide; TTT chr2 60476454 60476475 60476459 60476454 -
tcttagagtcctgtgtgtgcct

SEQ ID NO: 223565 - DNA, 22 bp, Artificial Sequence
  Synthetic oligonucleotide; TTT chr2 60476453 60476474 60476458 60476453 -
cttagagtcctgtgtgtgcctt

SEQ ID NO: 223566 - DNA, 22 bp, Artificial Sequence
  Synthetic oligonucleotide; TTC chr2 60476452 60476473 60476457 60476452 -
ttagagtcctgtgtgtgccttt

SEQ ID NO: 223567 - DNA, 22 bp, Artificial Sequence
  Synthetic oligonucleotide; CTT chr2 60476450 60476471 60476455 60476450 -
agagtcctgtgtgtgcctttgt

SEQ ID NO: 223568 - DNA, 22 bp, Artificial Sequence
  Synthetic oligonucleotide; TTA chr2 60476449 60476470 60476454 60476449 -
gagtcctgtgtgtgcctttgtg

SEQ ID NO: 223569 - DNA, 22 bp, Artificial Sequence
  Synthetic oligonucleotide; CTG chr2 60476441 60476462 60476446 60476441 -
tgtgtgcctttgtgagcaatgg

SEQ ID NO: 223570 - DNA, 22 bp, Artificial Sequence
  Synthetic oligonucleotide; CTT chr2 60476431 60476452 60476436 60476431 -
tgtgagcaatgggtgccaggct

SEQ ID NO: 223571 - DNA, 22 bp, Artificial Sequence
  Synthetic oligonucleotide; TTT chr2 60476430 60476451 60476435 60476430 -
gtgagcaatgggtgccaggctc

SEQ ID NO: 223572 - DNA, 22 bp, Artificial Sequence
  Synthetic oligonucleotide; TTG chr2 60476429 60476450 60476434 60476429 -
tgagcaatgggtgccaggctct

SEQ ID NO: 223573 - DNA, 22 bp, Artificial Sequence
  Synthetic oligonucleotide; CTC chr2 60476408 60476429 60476413 60476408 -
tggcatgaggccgagctttgct

SEQ ID NO: 223574 - DNA, 22 bp, Artificial Sequence
  Synthetic oligonucleotide; CTG chr2 60476406 60476427 60476411 60476406 -
gcatgaggccgagctttgctac

SEQ ID NO: 223575 - DNA, 22 bp, Artificial Sequence
  Synthetic oligonucleotide; CTT chr2 60476390 60476411 60476395 60476390 -
tgctactggacttctggcatga

SEQ ID NO: 223576 - DNA, 22 bp, Artificial Sequence
  Synthetic oligonucleotide; TTT chr2 60476389 60476410 60476394 60476389 -
gctactggacttctggcatgag

SEQ ID NO: 223577 - DNA, 22 bp, Artificial Sequence
  Synthetic oligonucleotide; TTG chr2 60476388 60476409 60476393 60476388 -
ctactggacttctggcatgagc

SEQ ID NO: 223578 - DNA, 22 bp, Artificial Sequence
  Synthetic oligonucleotide; CTA chr2 60476385 60476406 60476390 60476385 -
ctggacttctggcatgagccac

SEQ ID NO: 223579 - DNA, 22 bp, Artificial Sequence
  Synthetic oligonucleotide; CTG chr2 60476382 60476403 60476387 60476382 -
gacttctggcatgagccactga

SEQ ID NO: 223580 - DNA, 22 bp, Artificial Sequence
  Synthetic oligonucleotide; CTT chr2 60476377 60476398 60476382 60476377 -
ctggcatgagccactgagacct

SEQ ID NO: 223581 - DNA, 22 bp, Artificial Sequence
  Synthetic oligonucleotide; TTC chr2 60476376 60476397 60476381 60476376 -
tggcatgagccactgagacctt

SEQ ID NO: 223582 - DNA, 22 bp, Artificial Sequence
  Synthetic oligonucleotide; CTG chr2 60476374 60476395 60476379 60476374 -
gcatgagccactgagacctttt

SEQ ID NO: 223583 - DNA, 22 bp, Artificial Sequence
  Synthetic oligonucleotide; CTG chr2 60476361 60476382 60476366 60476361 -
agaccttttcccttgacattta

SEQ ID NO: 223584 - DNA, 22 bp, Artificial Sequence
  Synthetic oligonucleotide; CTT chr2 60476354 60476375 60476359 60476354 -
ttcccttgacatttagcctggg

SEQ ID NO: 223585 - DNA, 22 bp, Artificial Sequence
  Synthetic oligonucleotide; TTT chr2 60476353 60476374 60476358 60476353 -
tcccttgacatttagcctgggt

SEQ ID NO: 223586 - DNA, 22 bp, Artificial Sequence
  Synthetic oligonucleotide; TTT chr2 60476352 60476373 60476357 60476352 -
cccttgacatttagcctgggtt

SEQ ID NO: 223587 - DNA, 22 bp, Artificial Sequence
  Synthetic oligonucleotide; TTC chr2 60476351 60476372 60476356 60476351 -
ccttgacatttagcctgggttt

SEQ ID NO: 223588 - DNA, 22 bp, Artificial Sequence
  Synthetic oligonucleotide; CTT chr2 60476347 60476368 60476352 60476347 -
gacatttagcctgggtttgggg

SEQ ID NO: 223589 - DNA, 22 bp, Artificial Sequence
  Synthetic oligonucleotide; TTG chr2 60476346 60476367 60476351 60476346 -
acatttagcctgggtttgggga

SEQ ID NO: 223590 - DNA, 22 bp, Artificial Sequence
  Synthetic oligonucleotide; TTT chr2 60476340 60476361 60476345 60476340 -
agcctgggtttggggaagtttc

SEQ ID NO: 223591 - DNA, 22 bp, Artificial Sequence
  Synthetic oligonucleotide; TTA chr2 60476339 60476360 60476344 60476339 -
gcctgggtttggggaagtttct

SEQ ID NO: 223592 - DNA, 22 bp, Artificial Sequence
  Synthetic oligonucleotide; CTG chr2 60476334 60476355 60476339 60476334 -
ggtttggggaagtttcttcctg

SEQ ID NO: 223593 - DNA, 22 bp, Artificial Sequence
  Synthetic oligonucleotide; TTT chr2 60476329 60476350 60476334 60476329 -
ggggaagtttcttcctggttct

SEQ ID NO: 223594 - DNA, 22 bp, Artificial Sequence
  Synthetic oligonucleotide; TTG chr2 60476328 60476349 60476333 60476328 -
gggaagtttcttcctggttctc

SEQ ID NO: 223595 - DNA, 22 bp, Artificial Sequence
  Synthetic oligonucleotide; TTT chr2 60476319 60476340 60476324 60476319 -
cttcctggttctctgaccttca

SEQ ID NO: 223596 - DNA, 22 bp, Artificial Sequence
  Synthetic oligonucleotide; TTC chr2 60476318 60476339 60476323 60476318 -
ttcctggttctctgaccttcag

SEQ ID NO: 223597 - DNA, 22 bp, Artificial Sequence
  Synthetic oligonucleotide; CTT chr2 60476316 60476337 60476321 60476316 -
cctggttctctgaccttcagtc

SEQ ID NO: 223598 - DNA, 22 bp, Artificial Sequence
  Synthetic oligonucleotide; TTC chr2 60476315 60476336 60476320 60476315 -
ctggttctctgaccttcagtct

SEQ ID NO: 223599 - DNA, 22 bp, Artificial Sequence
  Synthetic oligonucleotide; CTG chr2 60476312 60476333 60476317 60476312 -
gttctctgaccttcagtctcat

SEQ ID NO: 223600 - DNA, 22 bp, Artificial Sequence
  Synthetic oligonucleotide; TTC chr2 60476308 60476329 60476313 60476308 -
tctgaccttcagtctcattggc

SEQ ID NO: 223601 - DNA, 22 bp, Artificial Sequence
  Synthetic oligonucleotide; CTC chr2 60476306 60476327 60476311 60476306 -
tgaccttcagtctcattggctc

SEQ ID NO: 223602 - DNA, 22 bp, Artificial Sequence
  Synthetic oligonucleotide; CTG chr2 60476304 60476325 60476309 60476304 -
accttcagtctcattggctcag

SEQ ID NO: 223603 - DNA, 22 bp, Artificial Sequence
  Synthetic oligonucleotide; CTT chr2 60476299 60476320 60476304 60476299 -
cagtctcattggctcaggacac

SEQ ID NO: 223604 - DNA, 22 bp, Artificial Sequence
  Synthetic oligonucleotide; TTC chr2 60476298 60476319 60476303 60476298 -
agtctcattggctcaggacaca

SEQ ID NO: 223605 - DNA, 22 bp, Artificial Sequence
  Synthetic oligonucleotide; CTC chr2 60476292 60476313 60476297 60476292 -
attggctcaggacacacctagg

SEQ ID NO: 223606 - DNA, 22 bp, Artificial Sequence
  Synthetic oligonucleotide; TTG chr2 60476288 60476309 60476293 60476288 -
gctcaggacacacctaggtttc

SEQ ID NO: 223607 - DNA, 22 bp, Artificial Sequence
  Synthetic oligonucleotide; CTC chr2 60476284 60476305 60476289 60476284 -
aggacacacctaggtttcctcc

SEQ ID NO: 223608 - DNA, 22 bp, Artificial Sequence
  Synthetic oligonucleotide; CTA chr2 60476272 60476293 60476277 60476272 -
ggtttcctccttgaagctcaga

SEQ ID NO: 223609 - DNA, 22 bp, Artificial Sequence
  Synthetic oligonucleotide; TTT chr2 60476267 60476288 60476272 60476267 -
cctccttgaagctcagacatgt

SEQ ID NO: 223610 - DNA, 22 bp, Artificial Sequence
  Synthetic oligonucleotide; TTC chr2 60476266 60476287 60476271 60476266 -
ctccttgaagctcagacatgta

SEQ ID NO: 223611 - DNA, 22 bp, Artificial Sequence
  Synthetic oligonucleotide; CTC chr2 60476263 60476284 60476268 60476263 -
cttgaagctcagacatgtaaac

SEQ ID NO: 223612 - DNA, 22 bp, Artificial Sequence
  Synthetic oligonucleotide; CTT chr2 60476260 60476281 60476265 60476260 -
gaagctcagacatgtaaacttt

SEQ ID NO: 223613 - DNA, 22 bp, Artificial Sequence
  Synthetic oligonucleotide; TTG chr2 60476259 60476280 60476264 60476259 -
aagctcagacatgtaaactttg

SEQ ID NO: 223614 - DNA, 22 bp, Artificial Sequence
  Synthetic oligonucleotide; CTC chr2 60476253 60476274 60476258 60476253 -
agacatgtaaactttgcaagac

SEQ ID NO: 223615 - DNA, 22 bp, Artificial Sequence
  Synthetic oligonucleotide; CTT chr2 60476239 60476260 60476244 60476239 -
tgcaagactgtgtcccaggagg

SEQ ID NO: 223616 - DNA, 22 bp, Artificial Sequence
  Synthetic oligonucleotide; TTT chr2 60476238 60476259 60476243 60476238 -
gcaagactgtgtcccaggaggt

SEQ ID NO: 223617 - DNA, 22 bp, Artificial Sequence
  Synthetic oligonucleotide; TTG chr2 60476237 60476258 60476242 60476237 -
caagactgtgtcccaggaggtt

SEQ ID NO: 223618 - DNA, 22 bp, Artificial Sequence
  Synthetic oligonucleotide; CTG chr2 60476229 60476250 60476234 60476229 -
tgtcccaggaggttgaaatcca

SEQ ID NO: 223619 - DNA, 22 bp, Artificial Sequence
  Synthetic oligonucleotide; TTG chr2 60476214 60476235 60476219 60476214 -
aaatccatcatcaggctcactc
